United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 174

SEQ ID NO: 7267384 - DNA, 22 bp, Homo sapiens
tatatgcatgcccatgtataca

SEQ ID NO: 7267385 - DNA, 22 bp, Homo sapiens
tatatgcagtgtgtcattcaag

SEQ ID NO: 7267386 - DNA, 22 bp, Homo sapiens
tagtgtcagggagtgataaatg

SEQ ID NO: 7267387 - DNA, 22 bp, Homo sapiens
tatactgatcactgaggtcatc

SEQ ID NO: 7267388 - DNA, 22 bp, Homo sapiens
tatactgagagcaaatacattc

SEQ ID NO: 7267389 - DNA, 22 bp, Homo sapiens
tatactgagtgtgttaatgatg

SEQ ID NO: 7267390 - DNA, 22 bp, Homo sapiens
tagcagtatattttaaggaagc

SEQ ID NO: 7267391 - DNA, 22 bp, Homo sapiens
tagcacataacttagaatagtt

SEQ ID NO: 7267392 - DNA, 22 bp, Homo sapiens
tagagcagtgttgtccatcaga

SEQ ID NO: 7267393 - DNA, 22 bp, Homo sapiens
tagagctagcttcaaaatgcga

SEQ ID NO: 7267394 - DNA, 22 bp, Homo sapiens
tagagctatacactgagtaaaa

SEQ ID NO: 7267395 - DNA, 22 bp, Homo sapiens
tagagatagcagtattgattcg

SEQ ID NO: 7267396 - DNA, 22 bp, Homo sapiens
tagagatgaattctgcagtctt

SEQ ID NO: 7267397 - DNA, 22 bp, Homo sapiens
tagtccaggacaatcttcatat

SEQ ID NO: 7267398 - DNA, 22 bp, Homo sapiens
taggaaatactgtaagtttggg

SEQ ID NO: 7267399 - DNA, 22 bp, Homo sapiens
gtcttcattctcatagccctgg

SEQ ID NO: 7267400 - DNA, 22 bp, Homo sapiens
gtgatacaaataaacatatgct

SEQ ID NO: 7267401 - DNA, 22 bp, Homo sapiens
gtgatacaggtgttctggatat

SEQ ID NO: 7267402 - DNA, 22 bp, Homo sapiens
gtcttgaaattctgttaaagga

SEQ ID NO: 7267403 - DNA, 22 bp, Homo sapiens
gtgcacaatcttcatatggcgt

SEQ ID NO: 7267404 - DNA, 22 bp, Homo sapiens
gtagctgatattagcaatgagt

SEQ ID NO: 7267405 - DNA, 23 bp, Homo sapiens
gggggccgtcctggggattatag

SEQ ID NO: 7267406 - DNA, 22 bp, Homo sapiens
ggctgtgcagggcagagtctca

SEQ ID NO: 7267407 - DNA, 23 bp, Homo sapiens
ggctgtgcagcctgcggcaaaag

SEQ ID NO: 7267408 - DNA, 22 bp, Homo sapiens
ggctgtgcaccatccacctccc

SEQ ID NO: 7267409 - DNA, 17 bp, Homo sapiens
ggctgtgccaggtgaga

SEQ ID NO: 7267410 - DNA, 22 bp, Homo sapiens
ggctgtgccctcacatggggca

SEQ ID NO: 7267411 - DNA, 20 bp, Homo sapiens
ggctgtgcccttccgtggcc

SEQ ID NO: 7267412 - DNA, 22 bp, Homo sapiens
ggctgtgcctctggcagcacat

SEQ ID NO: 7267413 - DNA, 22 bp, Homo sapiens
ggctgtgcctcaaggctactca

SEQ ID NO: 7267414 - DNA, 22 bp, Homo sapiens
ggctgtgcgggcagccgtggga

SEQ ID NO: 7267415 - DNA, 22 bp, Homo sapiens
ggaaatcaagaagcagatgagt

SEQ ID NO: 7267416 - DNA, 22 bp, Homo sapiens
gctgtgcagccaagtgcctctg

SEQ ID NO: 7267417 - DNA, 22 bp, Homo sapiens
gctgtgcaggggatttggttat

SEQ ID NO: 7267418 - DNA, 21 bp, Homo sapiens
gctgtgcaggattgaaagcag

SEQ ID NO: 7267419 - DNA, 21 bp, Homo sapiens
gctgtgcaggtgcccctgctc

SEQ ID NO: 7267420 - DNA, 22 bp, Homo sapiens
gctgtgcagtagtaggtacagt

SEQ ID NO: 7267421 - DNA, 22 bp, Homo sapiens
gctgtgcaggtccccactgcct

SEQ ID NO: 7267422 - DNA, 22 bp, Homo sapiens
gctgtgcattgagcctgagagt

SEQ ID NO: 7267423 - DNA, 22 bp, Homo sapiens
gctgtgcatggagggccgttca

SEQ ID NO: 7267424 - DNA, 22 bp, Homo sapiens
gctgtgcatcttcattctggac

SEQ ID NO: 7267425 - DNA, 22 bp, Homo sapiens
gctgtgcataagtataataaac

SEQ ID NO: 7267426 - DNA, 22 bp, Homo sapiens
gctgtgcagtctttggtgtgcc

SEQ ID NO: 7267427 - DNA, 22 bp, Homo sapiens
gctgtgcagtgggagttcggtg

SEQ ID NO: 7267428 - DNA, 22 bp, Homo sapiens
gctgtgcactacctatacatcc

SEQ ID NO: 7267429 - DNA, 21 bp, Homo sapiens
gctgtgcagaggatggagtgg

SEQ ID NO: 7267430 - DNA, 22 bp, Homo sapiens
gctgtgcagagcacagggtccc

SEQ ID NO: 7267431 - DNA, 22 bp, Homo sapiens
gctgtgcagaggtgagaatcca

SEQ ID NO: 7267432 - DNA, 22 bp, Homo sapiens
gctgtgcagatgtagggagtgg

SEQ ID NO: 7267433 - DNA, 22 bp, Homo sapiens
gctgtgcaaatcgatttgttgg

SEQ ID NO: 7267434 - DNA, 21 bp, Homo sapiens
gctgtgcacatagtagaagtg

SEQ ID NO: 7267435 - DNA, 23 bp, Homo sapiens
gctgtgcacgagccactgcctgt

SEQ ID NO: 7267436 - DNA, 22 bp, Homo sapiens
gctgatgcagggttgagaggag

SEQ ID NO: 7267437 - DNA, 17 bp, Homo sapiens
gcagtgaaaagagatca

SEQ ID NO: 7267438 - DNA, 22 bp, Homo sapiens
gcatttgaaatgcaagaaagtg

SEQ ID NO: 7267439 - DNA, 22 bp, Homo sapiens
gacattctaaaaaatatggaag

SEQ ID NO: 7267440 - DNA, 22 bp, Homo sapiens
ctgtcaatttatgttgacatgc

SEQ ID NO: 7267441 - DNA, 22 bp, Homo sapiens
cttaaattttcatctacaagaa

SEQ ID NO: 7267442 - DNA, 22 bp, Homo sapiens
cttaaattggatgagttaagtt

SEQ ID NO: 7267443 - DNA, 22 bp, Homo sapiens
cttaaattcttaatgccctcat

SEQ ID NO: 7267444 - DNA, 22 bp, Homo sapiens
ctgtttaatgaggtgtaacaac

SEQ ID NO: 7267445 - DNA, 22 bp, Homo sapiens
cttcatttggagaactgtgctt

SEQ ID NO: 7267446 - DNA, 22 bp, Homo sapiens
cttcattacttgctcgtagcac

SEQ ID NO: 7267447 - DNA, 17 bp, Homo sapiens
cttatactttacggaag

SEQ ID NO: 7267448 - DNA, 22 bp, Homo sapiens
cttgtgcaaatcctcgagcaca

SEQ ID NO: 7267449 - DNA, 22 bp, Homo sapiens
ctttgcaaaagttaattgttga

SEQ ID NO: 7267450 - DNA, 22 bp, Homo sapiens
ctgagctgggagcctggcacca

SEQ ID NO: 7267451 - DNA, 22 bp, Homo sapiens
ctgagctggttctcttgtgaaa

SEQ ID NO: 7267452 - DNA, 22 bp, Homo sapiens
ctgagctggtggaagcatgcag

SEQ ID NO: 7267453 - DNA, 22 bp, Homo sapiens
ctgaaaatgttacacaggaaga

SEQ ID NO: 7267454 - DNA, 23 bp, Homo sapiens
ctgcatatggaggttagcaactc

SEQ ID NO: 7267455 - DNA, 22 bp, Homo sapiens
tttctgcatatgtatgtatgga

SEQ ID NO: 7267456 - DNA, 22 bp, Homo sapiens
tttctgcaggtattgcataagt

SEQ ID NO: 7267457 - DNA, 20 bp, Homo sapiens
tttctgcagatgtttacatg

SEQ ID NO: 7267458 - DNA, 22 bp, Homo sapiens
tttcttatactatattgtcatc

SEQ ID NO: 7267459 - DNA, 22 bp, Homo sapiens
tttcaaatagaatctttccaaa

SEQ ID NO: 7267460 - DNA, 22 bp, Homo sapiens
tttatatgtttgtacaattaag

SEQ ID NO: 7267461 - DNA, 22 bp, Homo sapiens
tttatatgtattgactttgatg

SEQ ID NO: 7267462 - DNA, 22 bp, Homo sapiens
tttatatgtgaaggtttgcaga

SEQ ID NO: 7267463 - DNA, 22 bp, Homo sapiens
tttatatggttgactatgagtt

SEQ ID NO: 7267464 - DNA, 18 bp, Homo sapiens
tttatatggatagagacc

SEQ ID NO: 7267465 - DNA, 22 bp, Homo sapiens
tttatatcttatgtcatttcaa

SEQ ID NO: 7267466 - DNA, 22 bp, Homo sapiens
tttatatgaaagtgaccagtgg

SEQ ID NO: 7267467 - DNA, 22 bp, Homo sapiens
tttatatccatctttgaagtaa

SEQ ID NO: 7267468 - DNA, 22 bp, Homo sapiens
ttgtttaatccttgtacccatg

SEQ ID NO: 7267469 - DNA, 22 bp, Homo sapiens
ttacctgtaaaactgcgatata

SEQ ID NO: 7267470 - DNA, 22 bp, Homo sapiens
cgatgctggaatgacagctgct

SEQ ID NO: 7267471 - DNA, 22 bp, Homo sapiens
ttaatgatttggaaccctttaa

SEQ ID NO: 7267472 - DNA, 22 bp, Homo sapiens
ttaatgcagaaatcaaactgac

SEQ ID NO: 7267473 - DNA, 22 bp, Homo sapiens
ttaaaatgaatattgattagca

SEQ ID NO: 7267474 - DNA, 22 bp, Homo sapiens
tgtttatacctgcaacctgtca

SEQ ID NO: 7267475 - DNA, 22 bp, Homo sapiens
tgtttataccttggtataacca

SEQ ID NO: 7267476 - DNA, 22 bp, Homo sapiens
ttgcacatgatagatgatttct

SEQ ID NO: 7267477 - DNA, 22 bp, Homo sapiens
ttgcacatctaataatgctaga

SEQ ID NO: 7267478 - DNA, 21 bp, Homo sapiens
ttcttcatgatgattaatggc

SEQ ID NO: 7267479 - DNA, 22 bp, Homo sapiens
ttgaataattaattacactcag

SEQ ID NO: 7267480 - DNA, 22 bp, Homo sapiens
ctacagtgacagaattaaacag

SEQ ID NO: 7267481 - DNA, 22 bp, Homo sapiens
ctacagtgaagactagctatag

SEQ ID NO: 7267482 - DNA, 22 bp, Homo sapiens
ctacatgaactcttaagtcaca

SEQ ID NO: 7267483 - DNA, 22 bp, Homo sapiens
ctaacatttattgagcacttag

SEQ ID NO: 7267484 - DNA, 22 bp, Homo sapiens
ctaacctagttcaacaactgtc

SEQ ID NO: 7267485 - DNA, 22 bp, Homo sapiens
ctagttgaagaggctgtcatca

SEQ ID NO: 7267486 - DNA, 22 bp, Homo sapiens
tcttacatatagcatgagtaca

SEQ ID NO: 7267487 - DNA, 22 bp, Homo sapiens
tcttgcaggcggctcagcaacc

SEQ ID NO: 7267488 - DNA, 22 bp, Homo sapiens
tgcactccaggctgggtgacag

SEQ ID NO: 7267489 - DNA, 22 bp, Homo sapiens
tgcaataagttgtgttatcact

SEQ ID NO: 7267490 - DNA, 22 bp, Homo sapiens
tgcaatacatacttagacccag

SEQ ID NO: 7267491 - DNA, 22 bp, Homo sapiens
tggagatgaatatgtgtacctg

SEQ ID NO: 7267492 - DNA, 22 bp, Homo sapiens
tggagatgcacgagcaggtgga

SEQ ID NO: 7267493 - DNA, 22 bp, Homo sapiens
tggagatgtaaagcaaggctta

SEQ ID NO: 7267494 - DNA, 22 bp, Homo sapiens
tgctacactcaatcagtgctat

SEQ ID NO: 7267495 - DNA, 21 bp, Homo sapiens
tgctaagtgtcacatgtctgc

SEQ ID NO: 7267496 - DNA, 22 bp, Homo sapiens
tcaaatgggtatgctttataat

SEQ ID NO: 7267497 - DNA, 22 bp, Homo sapiens
cagtgcagtcaaggaagaacca

SEQ ID NO: 7267498 - DNA, 22 bp, Homo sapiens
tcacattctagaatgttatcgt

SEQ ID NO: 7267499 - DNA, 22 bp, Homo sapiens
tatgaacacttattggggaagg

SEQ ID NO: 7267500 - DNA, 22 bp, Homo sapiens
tatgaacattgaagaggagccc

SEQ ID NO: 7267501 - DNA, 22 bp, Homo sapiens
tatgatttgtagacatttgatt

SEQ ID NO: 7267502 - DNA, 22 bp, Homo sapiens
tatgcacacatcgcagcaggaa

SEQ ID NO: 7267503 - DNA, 22 bp, Homo sapiens
tatgcacacatgtatgcatgtg

SEQ ID NO: 7267504 - DNA, 22 bp, Homo sapiens
tacagagactttatggcacaaa

SEQ ID NO: 7267505 - DNA, 22 bp, Homo sapiens
tacagctagagggcacgtgaac

SEQ ID NO: 7267506 - DNA, 22 bp, Homo sapiens
tacagttctttgaaggatctag

SEQ ID NO: 7267507 - DNA, 22 bp, Homo sapiens
tacagttccaggatcatagggt

SEQ ID NO: 7267508 - DNA, 22 bp, Homo sapiens
tacagaccagtagttctcagcg

SEQ ID NO: 7267509 - DNA, 22 bp, Homo sapiens
tagcatatggagggtaagaggg

SEQ ID NO: 7267510 - DNA, 22 bp, Homo sapiens
tagacattttaagacatatacc

SEQ ID NO: 7267511 - DNA, 22 bp, Homo sapiens
cattttcagcacccatctgaaa

SEQ ID NO: 7267512 - DNA, 22 bp, Homo sapiens
catgtacagtttttctgtcctg

SEQ ID NO: 7267513 - DNA, 22 bp, Homo sapiens
catgtacaaggatgctcagagt

SEQ ID NO: 7267514 - DNA, 22 bp, Homo sapiens
catgtacacacaaagggacaat

SEQ ID NO: 7267515 - DNA, 22 bp, Homo sapiens
catgctgtgtggttagaactgt

SEQ ID NO: 7267516 - DNA, 22 bp, Homo sapiens
catgctgtggtaaatcactgaa

SEQ ID NO: 7267517 - DNA, 22 bp, Homo sapiens
catgctgtgcatcttgatgacc

SEQ ID NO: 7267518 - DNA, 22 bp, Homo sapiens
catgctgtcctgaaaagatatt

SEQ ID NO: 7267519 - DNA, 22 bp, Homo sapiens
catcaaattatgtgtcaaagca

SEQ ID NO: 7267520 - DNA, 20 bp, Homo sapiens
tcatacacatgagcatgcag

SEQ ID NO: 7267521 - DNA, 22 bp, Homo sapiens
tcatacaggctcaagctatacg

SEQ ID NO: 7267522 - DNA, 22 bp, Homo sapiens
tcataacagctaagtccctttc

SEQ ID NO: 7267523 - DNA, 18 bp, Homo sapiens
catcagtatccactaggt

SEQ ID NO: 7267524 - DNA, 22 bp, Homo sapiens
catcataataacccagacacag

SEQ ID NO: 7267525 - DNA, 22 bp, Homo sapiens
catcatactgtttacactcaaa

SEQ ID NO: 7267526 - DNA, 22 bp, Homo sapiens
tttgacatgaagtagcttataa

SEQ ID NO: 7267527 - DNA, 22 bp, Homo sapiens
tttgacatgcaaagcactttag

SEQ ID NO: 7267528 - DNA, 20 bp, Homo sapiens
tttgacatatacagttcagg

SEQ ID NO: 7267529 - DNA, 22 bp, Homo sapiens
tttgaaatatgaggcattatga

SEQ ID NO: 7267530 - DNA, 22 bp, Homo sapiens
tttgagcagcagatgcacttag

SEQ ID NO: 7267531 - DNA, 22 bp, Homo sapiens
ttttgtcagtgagaacagagtt

SEQ ID NO: 7267532 - DNA, 22 bp, Homo sapiens
tttgtgcaagacatgctaagag

SEQ ID NO: 7267533 - DNA, 22 bp, Homo sapiens
ttctcacagtacctaacatgta

SEQ ID NO: 7267534 - DNA, 22 bp, Homo sapiens
ttctcaaagaaagctgtcatta

SEQ ID NO: 7267535 - DNA, 22 bp, Homo sapiens
ttgaaacattctcctattgatt

SEQ ID NO: 7267536 - DNA, 22 bp, Homo sapiens
ttgaaacagtagctcatagacc

SEQ ID NO: 7267537 - DNA, 22 bp, Homo sapiens
ttcatatgcagattaacaaata

SEQ ID NO: 7267538 - DNA, 23 bp, Homo sapiens
ttcatatgttgctgaaaacagca

SEQ ID NO: 7267539 - DNA, 22 bp, Homo sapiens
ttcatacatttttactaacagc

SEQ ID NO: 7267540 - DNA, 22 bp, Homo sapiens
ttcatacatgagactagatgca

SEQ ID NO: 7267541 - DNA, 22 bp, Homo sapiens
ttcatacatgtgtactgttcca

SEQ ID NO: 7267542 - DNA, 22 bp, Homo sapiens
ttcagaaattcatggagttcag

SEQ ID NO: 7267543 - DNA, 22 bp, Homo sapiens
ttcagaaatcgagtttcatgtc

SEQ ID NO: 7267544 - DNA, 22 bp, Homo sapiens
ttcactgtcctgcaactctaga

SEQ ID NO: 7267545 - DNA, 22 bp, Homo sapiens
ttatttacaactcttctcttcc

SEQ ID NO: 7267546 - DNA, 22 bp, Homo sapiens
ttatttaaaagtggtaagattc

SEQ ID NO: 7267547 - DNA, 23 bp, Homo sapiens
ttatgcaagcttcctggtctcag

SEQ ID NO: 7267548 - DNA, 22 bp, Homo sapiens
ttatgcaaggacttattacagt

SEQ ID NO: 7267549 - DNA, 22 bp, Homo sapiens
ttgtgcagctataaagaaatgg

SEQ ID NO: 7267550 - DNA, 22 bp, Homo sapiens
ttgtatttcctataacctttct

SEQ ID NO: 7267551 - DNA, 22 bp, Homo sapiens
tttaaattatagttaatgtctg

SEQ ID NO: 7267552 - DNA, 22 bp, Homo sapiens
tttatctttaggactttgcaga

SEQ ID NO: 7267553 - DNA, 22 bp, Homo sapiens
tttatctgtggtaaataacatt

SEQ ID NO: 7267554 - DNA, 22 bp, Homo sapiens
tttcacattggcttctatttct

SEQ ID NO: 7267555 - DNA, 22 bp, Homo sapiens
tttcacatttaggcgtgaattg

SEQ ID NO: 7267556 - DNA, 20 bp, Homo sapiens
tttcacatctgtccctttaa

SEQ ID NO: 7267557 - DNA, 22 bp, Homo sapiens
tttcacatatggttgttgattg

SEQ ID NO: 7267558 - DNA, 22 bp, Homo sapiens
tttcacatcagaggtagattag

SEQ ID NO: 7267559 - DNA, 22 bp, Homo sapiens
caccataaaaataagagatgcc

SEQ ID NO: 7267560 - DNA, 22 bp, Homo sapiens
cacagtgctgtttgtaaagaga

SEQ ID NO: 7267561 - DNA, 22 bp, Homo sapiens
cacagtgctttatgagagatct

SEQ ID NO: 7267562 - DNA, 22 bp, Homo sapiens
ggcacaattgcagcaataaaca

SEQ ID NO: 7267563 - DNA, 22 bp, Homo sapiens
caacagtgattctgcatgagga

SEQ ID NO: 7267564 - DNA, 22 bp, Homo sapiens
caacagtgttgcaatctgaaaa

SEQ ID NO: 7267565 - DNA, 22 bp, Homo sapiens
caagataaaatcagcattccaa

SEQ ID NO: 7267566 - DNA, 22 bp, Homo sapiens
caaggattctcactagactaga

SEQ ID NO: 7267567 - DNA, 22 bp, Homo sapiens
cagcagcagagatactggtttc

SEQ ID NO: 7267568 - DNA, 22 bp, Homo sapiens
gtaaacaggaatgtggtcatgg

SEQ ID NO: 7267569 - DNA, 23 bp, Homo sapiens
caaacctgttctccccacatgca

SEQ ID NO: 7267570 - DNA, 22 bp, Homo sapiens
atttcgatagacctaacaattg

SEQ ID NO: 7267571 - DNA, 22 bp, Homo sapiens
gatgataactctttatgatgaa

SEQ ID NO: 7267572 - DNA, 22 bp, Homo sapiens
attaaattaagtggctaattta

SEQ ID NO: 7267573 - DNA, 22 bp, Homo sapiens
attaaattagcaaactgtgaaa

SEQ ID NO: 7267574 - DNA, 22 bp, Homo sapiens
attaaacaatgtaaagttcttg

SEQ ID NO: 7267575 - DNA, 22 bp, Homo sapiens
atgttttatattttgcagcagt

SEQ ID NO: 7267576 - DNA, 22 bp, Homo sapiens
atgttttatgttccactcaagg

SEQ ID NO: 7267577 - DNA, 23 bp, Homo sapiens
atgttttatgtctctagctgcca

SEQ ID NO: 7267578 - DNA, 22 bp, Homo sapiens
gcaagaaaaaggcttcatgaac

SEQ ID NO: 7267579 - DNA, 22 bp, Homo sapiens
attgcagaacatgaggtcttct

SEQ ID NO: 7267580 - DNA, 22 bp, Homo sapiens
attctgttacttggtgatcttc

SEQ ID NO: 7267581 - DNA, 22 bp, Homo sapiens
attctcaattttgccaaagggt

SEQ ID NO: 7267582 - DNA, 22 bp, Homo sapiens
attctcaaagccagagtcaacg

SEQ ID NO: 7267583 - DNA, 22 bp, Homo sapiens
attctgtctttttatacatcta

SEQ ID NO: 7267584 - DNA, 22 bp, Homo sapiens
attctcaaaacataacttcact

SEQ ID NO: 7267585 - DNA, 22 bp, Homo sapiens
attattgtactttcaataaggt

SEQ ID NO: 7267586 - DNA, 22 bp, Homo sapiens
cttgatattttaaacatacagt

SEQ ID NO: 7267587 - DNA, 22 bp, Homo sapiens
cttgctactatgcctggctaat

SEQ ID NO: 7267588 - DNA, 22 bp, Homo sapiens
atgaaaacggaccagagctatt

SEQ ID NO: 7267589 - DNA, 22 bp, Homo sapiens
atgaaaacagcctcctgtgata

SEQ ID NO: 7267590 - DNA, 22 bp, Homo sapiens
atgcagctgtgggcaagaaatg

SEQ ID NO: 7267591 - DNA, 22 bp, Homo sapiens
atgcagcttcaggattatgatg

SEQ ID NO: 7267592 - DNA, 22 bp, Homo sapiens
atgcatttgacgggatatattt

SEQ ID NO: 7267593 - DNA, 22 bp, Homo sapiens
atgcagaagcagaacttacaca

SEQ ID NO: 7267594 - DNA, 22 bp, Homo sapiens
atgcagaaagagaatgtaatgt

SEQ ID NO: 7267595 - DNA, 19 bp, Homo sapiens
atgcaaatagatttggaat

SEQ ID NO: 7267596 - DNA, 20 bp, Homo sapiens
atgcaaatcccaaaatcagg

SEQ ID NO: 7267597 - DNA, 22 bp, Homo sapiens
atgcaaataaagcaactataca

SEQ ID NO: 7267598 - DNA, 22 bp, Homo sapiens
atgcaaacattcgcttgtctct

SEQ ID NO: 7267599 - DNA, 22 bp, Homo sapiens
atgataacaacagcagtgctgg

SEQ ID NO: 7267600 - DNA, 22 bp, Homo sapiens
atgagtaaaaccactatttaca

SEQ ID NO: 7267601 - DNA, 22 bp, Homo sapiens
atggaaatgatggaacattaaa

SEQ ID NO: 7267602 - DNA, 22 bp, Homo sapiens
atggaaatgttccatatattga

SEQ ID NO: 7267603 - DNA, 21 bp, Homo sapiens
atggaaattggcaaatgctac

SEQ ID NO: 7267604 - DNA, 22 bp, Homo sapiens
atggagatttttagaattacag

SEQ ID NO: 7267605 - DNA, 22 bp, Homo sapiens
atgtacatctttataacaagct

SEQ ID NO: 7267606 - DNA, 22 bp, Homo sapiens
atgtacatttgtagtaatatca

SEQ ID NO: 7267607 - DNA, 18 bp, Homo sapiens
atgtacatttgctaaagc

SEQ ID NO: 7267608 - DNA, 22 bp, Homo sapiens
agtttgataaacaccagctagt

SEQ ID NO: 7267609 - DNA, 22 bp, Homo sapiens
agtttgatggcttaatagtaga

SEQ ID NO: 7267610 - DNA, 22 bp, Homo sapiens
agttgggtttgtgtcagttgca

SEQ ID NO: 7267611 - DNA, 18 bp, Homo sapiens
ataataggagataaaaat

SEQ ID NO: 7267612 - DNA, 22 bp, Homo sapiens
atcacatcgaggagcaatcaga

SEQ ID NO: 7267613 - DNA, 22 bp, Homo sapiens
atcacatctcaccactgcaacc

SEQ ID NO: 7267614 - DNA, 22 bp, Homo sapiens
atatgaatttggctggaaaggt

SEQ ID NO: 7267615 - DNA, 22 bp, Homo sapiens
atatgcaagcacatagaatact

SEQ ID NO: 7267616 - DNA, 22 bp, Homo sapiens
catgaaatgttagaattagaca

SEQ ID NO: 7267617 - DNA, 23 bp, Homo sapiens
atggaaatagcatgtgtcattta

SEQ ID NO: 7267618 - DNA, 22 bp, Homo sapiens
atggaaatatctttagagctta

SEQ ID NO: 7267619 - DNA, 22 bp, Homo sapiens
atgtacataaaatgtataatga

SEQ ID NO: 7267620 - DNA, 22 bp, Homo sapiens
atgtaaacaaggttattgtcca

SEQ ID NO: 7267621 - DNA, 22 bp, Homo sapiens
atgtaaacttagataagcagta

SEQ ID NO: 7267622 - DNA, 22 bp, Homo sapiens
atgtaaactttaccagctctga

SEQ ID NO: 7267623 - DNA, 22 bp, Homo sapiens
agacagtgacttagtgaccaga

SEQ ID NO: 7267624 - DNA, 22 bp, Homo sapiens
agacagtgagaatgagttgaaa

SEQ ID NO: 7267625 - DNA, 22 bp, Homo sapiens
attaaagacagcagatggatgg

SEQ ID NO: 7267626 - DNA, 22 bp, Homo sapiens
agaggtatggtatattggaaga

SEQ ID NO: 7267627 - DNA, 22 bp, Homo sapiens
atttagcaaaaaatgatgaagc

SEQ ID NO: 7267628 - DNA, 22 bp, Homo sapiens
cacatcattcaatggtgatatt

SEQ ID NO: 7267629 - DNA, 22 bp, Homo sapiens
cacatcatagagactcaatcca

SEQ ID NO: 7267630 - DNA, 22 bp, Homo sapiens
cacatcatgttaattcattaca

SEQ ID NO: 7267631 - DNA, 20 bp, Homo sapiens
cagcacagagcttggctcta

SEQ ID NO: 7267632 - DNA, 22 bp, Homo sapiens
cagcacagagtattttattgat

SEQ ID NO: 7267633 - DNA, 22 bp, Homo sapiens
cagcacaggcctgtctttgtct

SEQ ID NO: 7267634 - DNA, 22 bp, Homo sapiens
cagcacagggacaatagcagat

SEQ ID NO: 7267635 - DNA, 22 bp, Homo sapiens
cagcacaggaatatggtggaca

SEQ ID NO: 7267636 - DNA, 22 bp, Homo sapiens
cagcacagctggctctggaagc

SEQ ID NO: 7267637 - DNA, 22 bp, Homo sapiens
cagcacagtacaaggcacggat

SEQ ID NO: 7267638 - DNA, 22 bp, Homo sapiens
cagacagagctcacaagtcttt

SEQ ID NO: 7267639 - DNA, 22 bp, Homo sapiens
actaaacacatgagattcctgc

SEQ ID NO: 7267640 - DNA, 22 bp, Homo sapiens
acctgttttcagaaaatgcaga

SEQ ID NO: 7267641 - DNA, 22 bp, Homo sapiens
accttcaaactagatagaagtt

SEQ ID NO: 7267642 - DNA, 22 bp, Homo sapiens
actatttactcaaatgaggttg

SEQ ID NO: 7267643 - DNA, 22 bp, Homo sapiens
actattagcatatcatgaatgg

SEQ ID NO: 7267644 - DNA, 22 bp, Homo sapiens
actatgaatagccagatagtga

SEQ ID NO: 7267645 - DNA, 22 bp, Homo sapiens
actatgaaagtataatattgaa

SEQ ID NO: 7267646 - DNA, 22 bp, Homo sapiens
actggacagaggaaatatggag

SEQ ID NO: 7267647 - DNA, 22 bp, Homo sapiens
actgattaaaaacagacattta

SEQ ID NO: 7267648 - DNA, 23 bp, Homo sapiens
actgattaacatgtgtgatattc

SEQ ID NO: 7267649 - DNA, 22 bp, Homo sapiens
agtttatagcccagattcatgg

SEQ ID NO: 7267650 - DNA, 22 bp, Homo sapiens
acttcatatggacagcaaacta

SEQ ID NO: 7267651 - DNA, 22 bp, Homo sapiens
acttggcaagtatctataaagt

SEQ ID NO: 7267652 - DNA, 22 bp, Homo sapiens
atataattctcaggtttgacta

SEQ ID NO: 7267653 - DNA, 22 bp, Homo sapiens
atataatttttggttagctcaa

SEQ ID NO: 7267654 - DNA, 22 bp, Homo sapiens
acagtttggttgctacagtaaa

SEQ ID NO: 7267655 - DNA, 17 bp, Homo sapiens
acagtttgtcattctaa

SEQ ID NO: 7267656 - DNA, 22 bp, Homo sapiens
acagttacatcacttactgaca

SEQ ID NO: 7267657 - DNA, 22 bp, Homo sapiens
acagtgattttaggatagatgg

SEQ ID NO: 7267658 - DNA, 22 bp, Homo sapiens
acagtgattggggtatctgcag

SEQ ID NO: 7267659 - DNA, 22 bp, Homo sapiens
acagtgattggcactgattcag

SEQ ID NO: 7267660 - DNA, 22 bp, Homo sapiens
acagtgatcagttactgtctgt

SEQ ID NO: 7267661 - DNA, 22 bp, Homo sapiens
acagtgatgagccggctgaggc

SEQ ID NO: 7267662 - DNA, 22 bp, Homo sapiens
acagtgatgagggaattttgtg

SEQ ID NO: 7267663 - DNA, 22 bp, Homo sapiens
acagtgcacatcctgagtgatt

SEQ ID NO: 7267664 - DNA, 22 bp, Homo sapiens
agctgcccaaggtcacagagct

SEQ ID NO: 7267665 - DNA, 22 bp, Homo sapiens
agctgcccccagggctgtgctt

SEQ ID NO: 7267666 - DNA, 21 bp, Homo sapiens
acagctaagcaacaactactg

SEQ ID NO: 7267667 - DNA, 22 bp, Homo sapiens
acatttgtgcaacgtatccaca

SEQ ID NO: 7267668 - DNA, 22 bp, Homo sapiens
acatttgtcttcctcctcagtg

SEQ ID NO: 7267669 - DNA, 22 bp, Homo sapiens
accattctggtccatactgttc

SEQ ID NO: 7267670 - DNA, 22 bp, Homo sapiens
acatttatataactcactagga

SEQ ID NO: 7267671 - DNA, 19 bp, Homo sapiens
acatttagaatgtacttgc

SEQ ID NO: 7267672 - DNA, 22 bp, Homo sapiens
acatttagctgtacaatctatg

SEQ ID NO: 7267673 - DNA, 18 bp, Homo sapiens
acatttaggagagtcaat

SEQ ID NO: 7267674 - DNA, 22 bp, Homo sapiens
acatttaatgatcctactgtga

SEQ ID NO: 7267675 - DNA, 21 bp, Homo sapiens
acatgagacacacatatatgt

SEQ ID NO: 7267676 - DNA, 23 bp, Homo sapiens
acatgatacacaattagcaaacc

SEQ ID NO: 7267677 - DNA, 22 bp, Homo sapiens
acatgattaaaagattttaaag

SEQ ID NO: 7267678 - DNA, 22 bp, Homo sapiens
acatgatttgcatgatttgtaa

SEQ ID NO: 7267679 - DNA, 22 bp, Homo sapiens
acatggataaattttactttcc

SEQ ID NO: 7267680 - DNA, 22 bp, Homo sapiens
acatggatcaacctattttctt

SEQ ID NO: 7267681 - DNA, 22 bp, Homo sapiens
aacatacagtgagcagtggact

SEQ ID NO: 7267682 - DNA, 22 bp, Homo sapiens
aacagtgagttgatgactgaat

SEQ ID NO: 7267683 - DNA, 22 bp, Homo sapiens
aagaacagttgggaggtgagcc

SEQ ID NO: 7267684 - DNA, 22 bp, Homo sapiens
aacatttgtttggcttcaatta

SEQ ID NO: 7267685 - DNA, 22 bp, Homo sapiens
aaatactggcaagtgctaattc

SEQ ID NO: 7267686 - DNA, 22 bp, Homo sapiens
aaatctgaaatagtgtgaagta

SEQ ID NO: 7267687 - DNA, 22 bp, Homo sapiens
aagcagcatatgacagcatcca

SEQ ID NO: 7267688 - DNA, 22 bp, Homo sapiens
aaagacttggcttatgatttgc

SEQ ID NO: 7267689 - DNA, 22 bp, Homo sapiens
aaacagcagctgtttaatttgc

SEQ ID NO: 7267690 - DNA, 22 bp, Homo sapiens
aaacatgatgtcatatatgcca

SEQ ID NO: 7267691 - DNA, 22 bp, Homo sapiens
aaacagataagggacaatttca

SEQ ID NO: 7267692 - DNA, 20 bp, Homo sapiens
aaacattcatgtacaagtga

SEQ ID NO: 7267693 - DNA, 22 bp, Homo sapiens
aaacatgtaagttcagatcacc

SEQ ID NO: 7267694 - DNA, 22 bp, Homo sapiens
aaaacttagctaggcaagtttt

SEQ ID NO: 7267695 - DNA, 22 bp, Homo sapiens
aaaattgagagtcttgtgcaag

SEQ ID NO: 7267696 - DNA, 22 bp, Homo sapiens
aaacacgtataatgtgacagag

SEQ ID NO: 7267697 - DNA, 22 bp, Homo sapiens
aaacagtaagttctagtattat

SEQ ID NO: 7267698 - DNA, 22 bp, Homo sapiens
aaacaggtctgaaaatagctac

SEQ ID NO: 7267699 - DNA, 22 bp, Homo sapiens
aaacaggtagccctagccttct

SEQ ID NO: 7267700 - DNA, 22 bp, Homo sapiens
aacacagtcctgctcacttatt

SEQ ID NO: 7267701 - DNA, 23 bp, Homo sapiens
aaattattgctcttcaattgcct

SEQ ID NO: 7267702 - DNA, 22 bp, Homo sapiens
aacagctgtctgcctatctctg

SEQ ID NO: 7267703 - DNA, 19 bp, Homo sapiens
aacatcatggctctttcca

SEQ ID NO: 7267704 - DNA, 22 bp, Homo sapiens
aacatcattatgtccattaatg

SEQ ID NO: 7267705 - DNA, 22 bp, Homo sapiens
aacatcatcatgaacaactaat

SEQ ID NO: 7267706 - DNA, 22 bp, Homo sapiens
aacatgaaaactacctgtgatt

SEQ ID NO: 7267707 - DNA, 22 bp, Homo sapiens
aacatgttgctttaataatatt

SEQ ID NO: 7267708 - DNA, 22 bp, Homo sapiens
aactagaacgagaaagctgaac

SEQ ID NO: 7267709 - DNA, 22 bp, Homo sapiens
aagacttgaccaggttgaaggc

SEQ ID NO: 7267710 - DNA, 22 bp, Homo sapiens
acaatgtttctctttagtcatt

SEQ ID NO: 7267711 - DNA, 22 bp, Homo sapiens
aagatgcttgagaactgtttga

SEQ ID NO: 7267712 - DNA, 22 bp, Homo sapiens
aatggcactttataaatgttaa

SEQ ID NO: 7267713 - DNA, 20 bp, Homo sapiens
agacaaaatgacttcatgca

SEQ ID NO: 7267714 - DNA, 22 bp, Homo sapiens
aatggtatcacctcacagaatt

SEQ ID NO: 7267715 - DNA, 22 bp, Homo sapiens
aatggtttcaaacacactaagt

SEQ ID NO: 7267716 - DNA, 22 bp, Homo sapiens
aatgtgaggccttggtagttat

SEQ ID NO: 7267717 - DNA, 22 bp, Homo sapiens
aatgtggatgatactagtactt

SEQ ID NO: 7267718 - DNA, 22 bp, Homo sapiens
aatgtggatccttacagatacc

SEQ ID NO: 7267719 - DNA, 17 bp, Homo sapiens
aatgtggaagtacatgc

SEQ ID NO: 7267720 - DNA, 17 bp, Homo sapiens
aatgtggaagtacatgc

SEQ ID NO: 7267721 - DNA, 22 bp, Homo sapiens
acaagagccctttcagattgac

SEQ ID NO: 7267722 - DNA, 22 bp, Homo sapiens
acactagctattaacttcacat

SEQ ID NO: 7267723 - DNA, 22 bp, Homo sapiens
acagcacaggagttgaatgggc

SEQ ID NO: 7267724 - DNA, 19 bp, Homo sapiens
acagcacagaaatatttca

SEQ ID NO: 7267725 - DNA, 22 bp, Homo sapiens
acattttgaaagggaaattgtt

SEQ ID NO: 7267726 - DNA, 22 bp, Homo sapiens
acattttgagaaatgacaagct

SEQ ID NO: 7267727 - DNA, 22 bp, Homo sapiens
acatttgtttctctagagtagg

SEQ ID NO: 7267728 - DNA, 22 bp, Homo sapiens
acattcttcttgtgaatttact

SEQ ID NO: 7267729 - DNA, 22 bp, Homo sapiens
acatatgagtactatacagtgc

SEQ ID NO: 7267730 - DNA, 22 bp, Homo sapiens
aagcatttttcacagcaacagc

SEQ ID NO: 7267731 - DNA, 22 bp, Homo sapiens
aagcattttagtaatgaacttg

SEQ ID NO: 7267732 - DNA, 22 bp, Homo sapiens
acgtgatatatttacttcccca

SEQ ID NO: 7267733 - DNA, 22 bp, Homo sapiens
aatactgcctgtgaggtaactc

SEQ ID NO: 7267734 - DNA, 22 bp, Homo sapiens
taaaacagcagggcagagaagt

SEQ ID NO: 7267735 - DNA, 22 bp, Homo sapiens
gtggaaatgcccccaaatagtg

SEQ ID NO: 7267736 - DNA, 22 bp, Homo sapiens
gtatatgagaaccatggaggtg

SEQ ID NO: 7267737 - DNA, 22 bp, Homo sapiens
gtacagtagagccaggttcagt

SEQ ID NO: 7267738 - DNA, 22 bp, Homo sapiens
gtacagtagtaaaagtgaatga

SEQ ID NO: 7267739 - DNA, 22 bp, Homo sapiens
gtacatgagcataaacacacat

SEQ ID NO: 7267740 - DNA, 22 bp, Homo sapiens
gtacattcagcttagcacttct

SEQ ID NO: 7267741 - DNA, 22 bp, Homo sapiens
gtaaacattttcatctgtgccc

SEQ ID NO: 7267742 - DNA, 22 bp, Homo sapiens
gtaaacattactgtgctgtata

SEQ ID NO: 7267743 - DNA, 22 bp, Homo sapiens
gtctgcatacaggacatgcaca

SEQ ID NO: 7267744 - DNA, 20 bp, Homo sapiens
ggagatgcctctcagtccat

SEQ ID NO: 7267745 - DNA, 22 bp, Homo sapiens
ggagatgccttgtttcaggaac

SEQ ID NO: 7267746 - DNA, 22 bp, Homo sapiens
ggagatgcgactcgcggggctg

SEQ ID NO: 7267747 - DNA, 22 bp, Homo sapiens
ggagatgctacagttcagctct

SEQ ID NO: 7267748 - DNA, 22 bp, Homo sapiens
ggagatgctatgtagtttggtt

SEQ ID NO: 7267749 - DNA, 23 bp, Homo sapiens
ggagatgcttaagagtggttgag

SEQ ID NO: 7267750 - DNA, 20 bp, Homo sapiens
ggagatgcagcccaggtgcc

SEQ ID NO: 7267751 - DNA, 22 bp, Homo sapiens
ggagatgccagaattgcaaatt

SEQ ID NO: 7267752 - DNA, 22 bp, Homo sapiens
ggagatgcaatgtagaatctgg

SEQ ID NO: 7267753 - DNA, 22 bp, Homo sapiens
ggagatgcttcttgtgtttatt

SEQ ID NO: 7267754 - DNA, 22 bp, Homo sapiens
ggagatgctttccagtggggat

SEQ ID NO: 7267755 - DNA, 22 bp, Homo sapiens
gggaaatagagctggaaccttg

SEQ ID NO: 7267756 - DNA, 22 bp, Homo sapiens
gctgagatgtcgttagatatct

SEQ ID NO: 7267757 - DNA, 22 bp, Homo sapiens
gctgagattacgggcatgagcc

SEQ ID NO: 7267758 - DNA, 22 bp, Homo sapiens
gctggagatgctatgcagaggg

SEQ ID NO: 7267759 - DNA, 18 bp, Homo sapiens
gatggaaagtgtatgagt

SEQ ID NO: 7267760 - DNA, 22 bp, Homo sapiens
gatgctgagctgtatggctggt

SEQ ID NO: 7267761 - DNA, 22 bp, Homo sapiens
gatgctgattttactgttttct

SEQ ID NO: 7267762 - DNA, 22 bp, Homo sapiens
gatgtaaatggtctttggcaga

SEQ ID NO: 7267763 - DNA, 22 bp, Homo sapiens
gatgtaaaaactcctttcgaaa

SEQ ID NO: 7267764 - DNA, 18 bp, Homo sapiens
gatgtaaaatagtagctt

SEQ ID NO: 7267765 - DNA, 22 bp, Homo sapiens
gatttaaagtagacctttgttt

SEQ ID NO: 7267766 - DNA, 22 bp, Homo sapiens
gattactgtctacttgggatag

SEQ ID NO: 7267767 - DNA, 22 bp, Homo sapiens
gattacaattcaggttgataag

SEQ ID NO: 7267768 - DNA, 20 bp, Homo sapiens
gcaatatatgagtgcaataa

SEQ ID NO: 7267769 - DNA, 22 bp, Homo sapiens
gataacattttgaagtgctagt

SEQ ID NO: 7267770 - DNA, 22 bp, Homo sapiens
gataacattataagttcactgt

SEQ ID NO: 7267771 - DNA, 22 bp, Homo sapiens
gataaacacaaggtgatttcat

SEQ ID NO: 7267772 - DNA, 22 bp, Homo sapiens
gataaacatgaagttctgtgta

SEQ ID NO: 7267773 - DNA, 22 bp, Homo sapiens
gataaactggaaccattgcctc

SEQ ID NO: 7267774 - DNA, 22 bp, Homo sapiens
gataaaagaggaaatttgttca

SEQ ID NO: 7267775 - DNA, 22 bp, Homo sapiens
gagtgatgtctgtagtgaagaa

SEQ ID NO: 7267776 - DNA, 22 bp, Homo sapiens
gataactacacttaagacaacc

SEQ ID NO: 7267777 - DNA, 22 bp, Homo sapiens
gatacagtatttaaagagcaac

SEQ ID NO: 7267778 - DNA, 22 bp, Homo sapiens
gatacataaaaatgtgctctat

SEQ ID NO: 7267779 - DNA, 22 bp, Homo sapiens
gatacagtgtgttaacgagaaa

SEQ ID NO: 7267780 - DNA, 22 bp, Homo sapiens
gatgcaaactgtgacatagagt

SEQ ID NO: 7267781 - DNA, 22 bp, Homo sapiens
gatgcaaagataaaacagacgc

SEQ ID NO: 7267782 - DNA, 22 bp, Homo sapiens
gatgcatagtgaagctgacaga

SEQ ID NO: 7267783 - DNA, 22 bp, Homo sapiens
gatgagctgtctagctgttgga

SEQ ID NO: 7267784 - DNA, 22 bp, Homo sapiens
gatgaagaggcactgacatatt

SEQ ID NO: 7267785 - DNA, 22 bp, Homo sapiens
gaggtcatgcaaaattgaatca

SEQ ID NO: 7267786 - DNA, 22 bp, Homo sapiens
gaggtcatcaccaatatatgcc

SEQ ID NO: 7267787 - DNA, 19 bp, Homo sapiens
ctttgtcagaacatgcttc

SEQ ID NO: 7267788 - DNA, 22 bp, Homo sapiens
gaactgtagttaatactacaca

SEQ ID NO: 7267789 - DNA, 22 bp, Homo sapiens
tgtgagcagagcctgacatgag

SEQ ID NO: 7267790 - DNA, 22 bp, Homo sapiens
tgtcattagtttcagccattct

SEQ ID NO: 7267791 - DNA, 22 bp, Homo sapiens
tgtataaaccatggacagcttt

SEQ ID NO: 7267792 - DNA, 22 bp, Homo sapiens
tgctgagacaacaggaaacaag

SEQ ID NO: 7267793 - DNA, 22 bp, Homo sapiens
tggatgaaaaatgagaattttc

SEQ ID NO: 7267794 - DNA, 22 bp, Homo sapiens
tttaaatttgtgtttagagggt

SEQ ID NO: 7267795 - DNA, 22 bp, Homo sapiens
tttaaattctgtctgccgctta

SEQ ID NO: 7267796 - DNA, 22 bp, Homo sapiens
tttaaatttagaagaaacactg

SEQ ID NO: 7267797 - DNA, 22 bp, Homo sapiens
ctcataaaagctttgtttacac

SEQ ID NO: 7267798 - DNA, 22 bp, Homo sapiens
ctcataaagtgagaatatgacc

SEQ ID NO: 7267799 - DNA, 22 bp, Homo sapiens
ttgatacatgctctagagttga

SEQ ID NO: 7267800 - DNA, 22 bp, Homo sapiens
ttgatacatagcacagtttagg

SEQ ID NO: 7267801 - DNA, 22 bp, Homo sapiens
ctaattgtaagctccttgaggg

SEQ ID NO: 7267802 - DNA, 19 bp, Homo sapiens
ttcattctcttattgttgt

SEQ ID NO: 7267803 - DNA, 22 bp, Homo sapiens
ttcattcttatttgtgatctgg

SEQ ID NO: 7267804 - DNA, 22 bp, Homo sapiens
ttcacttatagggatgttattg

SEQ ID NO: 7267805 - DNA, 22 bp, Homo sapiens
cgctgtgcctggcacccagtgt

SEQ ID NO: 7267806 - DNA, 22 bp, Homo sapiens
ttgatacagcagcctgtgatcc

SEQ ID NO: 7267807 - DNA, 22 bp, Homo sapiens
ttgatacaggctctatttcatc

SEQ ID NO: 7267808 - DNA, 22 bp, Homo sapiens
ctaggctagatagtatattggt

SEQ ID NO: 7267809 - DNA, 22 bp, Homo sapiens
ttctgtcaaatttgccatatgg

SEQ ID NO: 7267810 - DNA, 22 bp, Homo sapiens
gtttacattaagtattagcatc

SEQ ID NO: 7267811 - DNA, 22 bp, Homo sapiens
gtttacatgcagaaaatcaatg

SEQ ID NO: 7267812 - DNA, 22 bp, Homo sapiens
gtgttttattggtgcagtcaga

SEQ ID NO: 7267813 - DNA, 22 bp, Homo sapiens
gtgttttatcagacaaagtata

SEQ ID NO: 7267814 - DNA, 22 bp, Homo sapiens
tacatcatgaaagcatacatca

SEQ ID NO: 7267815 - DNA, 22 bp, Homo sapiens
tacatcatggcttcatgctgca

SEQ ID NO: 7267816 - DNA, 22 bp, Homo sapiens
tacaggtagagtctctagttta

SEQ ID NO: 7267817 - DNA, 22 bp, Homo sapiens
tacaggtaaaattatcagaaac

SEQ ID NO: 7267818 - DNA, 22 bp, Homo sapiens
taacattgtcagttcaactgct

SEQ ID NO: 7267819 - DNA, 22 bp, Homo sapiens
taacatttcggtgacagtggga

SEQ ID NO: 7267820 - DNA, 22 bp, Homo sapiens
taacatttaaatttttcacata

SEQ ID NO: 7267821 - DNA, 22 bp, Homo sapiens
caggacacagaataaggcagtt

SEQ ID NO: 7267822 - DNA, 22 bp, Homo sapiens
caggacatcgtcatcatgggga

SEQ ID NO: 7267823 - DNA, 22 bp, Homo sapiens
catttgaagaagaaacgtacta

SEQ ID NO: 7267824 - DNA, 22 bp, Homo sapiens
catttgatcctcacaacaatct

SEQ ID NO: 7267825 - DNA, 22 bp, Homo sapiens
catttgatctcctgaataaaca

SEQ ID NO: 7267826 - DNA, 22 bp, Homo sapiens
catttgattactaaagataatt

SEQ ID NO: 7267827 - DNA, 22 bp, Homo sapiens
catttgcagagggtgacactct

SEQ ID NO: 7267828 - DNA, 22 bp, Homo sapiens
catttgcaagagataaatgttt

SEQ ID NO: 7267829 - DNA, 22 bp, Homo sapiens
catttgattcctttactcttat

SEQ ID NO: 7267830 - DNA, 22 bp, Homo sapiens
catttgcaaaccaacaagatga

SEQ ID NO: 7267831 - DNA, 22 bp, Homo sapiens
catttagagaagattacaagga

SEQ ID NO: 7267832 - DNA, 19 bp, Homo sapiens
catttagaagtacatatta

SEQ ID NO: 7267833 - DNA, 22 bp, Homo sapiens
tctgtcataagtgctgaagtat

SEQ ID NO: 7267834 - DNA, 22 bp, Homo sapiens
catcatgaagatgagaaagcat

SEQ ID NO: 7267835 - DNA, 22 bp, Homo sapiens
catccatagattgagagatggt

SEQ ID NO: 7267836 - DNA, 22 bp, Homo sapiens
catgataattgttaacaaagta

SEQ ID NO: 7267837 - DNA, 22 bp, Homo sapiens
catgattatattaatggcttca

SEQ ID NO: 7267838 - DNA, 22 bp, Homo sapiens
catgattatgtgttagagtttg

SEQ ID NO: 7267839 - DNA, 18 bp, Homo sapiens
tcatttgttttgcatgaa

SEQ ID NO: 7267840 - DNA, 22 bp, Homo sapiens
tcatttgttgctgttacctgag

SEQ ID NO: 7267841 - DNA, 22 bp, Homo sapiens
tcatttgttgaactttagtgcg

SEQ ID NO: 7267842 - DNA, 22 bp, Homo sapiens
catccatatgaggcacattggt

SEQ ID NO: 7267843 - DNA, 22 bp, Homo sapiens
catgtacatgcctactatcaat

SEQ ID NO: 7267844 - DNA, 18 bp, Homo sapiens
tcattttgtctgcctttg

SEQ ID NO: 7267845 - DNA, 22 bp, Homo sapiens
tatttacttttaaattgagaac

SEQ ID NO: 7267846 - DNA, 22 bp, Homo sapiens
cagtgatgatcattgtaacatc

SEQ ID NO: 7267847 - DNA, 22 bp, Homo sapiens
tatgcacacattagcacagggt

SEQ ID NO: 7267848 - DNA, 22 bp, Homo sapiens
tatgcacagttacaagaatatc

SEQ ID NO: 7267849 - DNA, 22 bp, Homo sapiens
ttacattcattgaagtgattca

SEQ ID NO: 7267850 - DNA, 22 bp, Homo sapiens
ttacatgatgatttcataaaca

SEQ ID NO: 7267851 - DNA, 22 bp, Homo sapiens
ttacaagataacctgatgctgt

SEQ ID NO: 7267852 - DNA, 22 bp, Homo sapiens
ttaaagcagtttgtatacatgg

SEQ ID NO: 7267853 - DNA, 17 bp, Homo sapiens
ttacaacaattcatgag

SEQ ID NO: 7267854 - DNA, 22 bp, Homo sapiens
ttacaacagacacatattctaa

SEQ ID NO: 7267855 - DNA, 22 bp, Homo sapiens
ttacaacatatgataggagtct

SEQ ID NO: 7267856 - DNA, 22 bp, Homo sapiens
ttattcttcttctcttgccagg

SEQ ID NO: 7267857 - DNA, 22 bp, Homo sapiens
ttatattagttagacttgctgt

SEQ ID NO: 7267858 - DNA, 18 bp, Homo sapiens
ttatgcaaaactgttttc

SEQ ID NO: 7267859 - DNA, 22 bp, Homo sapiens
ttatgcaaaggggcctcttcct

SEQ ID NO: 7267860 - DNA, 22 bp, Homo sapiens
ttatgcaacaggtgagcagaca

SEQ ID NO: 7267861 - DNA, 22 bp, Homo sapiens
ttagatcattttgaactaattt

SEQ ID NO: 7267862 - DNA, 22 bp, Homo sapiens
ttagatcattttagctaaatgg

SEQ ID NO: 7267863 - DNA, 22 bp, Homo sapiens
ttatttgcccatgtttagcaga

SEQ ID NO: 7267864 - DNA, 22 bp, Homo sapiens
tgtgtacacagatagtaatggc

SEQ ID NO: 7267865 - DNA, 22 bp, Homo sapiens
tgttaaactgtattgcataagg

SEQ ID NO: 7267866 - DNA, 22 bp, Homo sapiens
tgttaaacctagtacaggtcct

SEQ ID NO: 7267867 - DNA, 22 bp, Homo sapiens
tgttgattagtgtttagactta

SEQ ID NO: 7267868 - DNA, 22 bp, Homo sapiens
tgttagagctaagataacatct

SEQ ID NO: 7267869 - DNA, 22 bp, Homo sapiens
tgttagcagagcagctgacaga

SEQ ID NO: 7267870 - DNA, 22 bp, Homo sapiens
tgttttagttctgtcttgcatg

SEQ ID NO: 7267871 - DNA, 22 bp, Homo sapiens
ttaaacacactgagatttatgt

SEQ ID NO: 7267872 - DNA, 22 bp, Homo sapiens
ttaaaatgcagattctgattca

SEQ ID NO: 7267873 - DNA, 17 bp, Homo sapiens
tgtgcatagaataatga

SEQ ID NO: 7267874 - DNA, 22 bp, Homo sapiens
tgtcatacaacaataagtaccg

SEQ ID NO: 7267875 - DNA, 18 bp, Homo sapiens
tgtcataatatatcacct

SEQ ID NO: 7267876 - DNA, 22 bp, Homo sapiens
tgtcagaactctattgatgtcc

SEQ ID NO: 7267877 - DNA, 22 bp, Homo sapiens
tgtcactacatcataaatatat

SEQ ID NO: 7267878 - DNA, 22 bp, Homo sapiens
tgtcatatagatattagacagg

SEQ ID NO: 7267879 - DNA, 22 bp, Homo sapiens
tgtcatatgctgtcatagccat

SEQ ID NO: 7267880 - DNA, 21 bp, Homo sapiens
tgtcatatttcaatacagttt

SEQ ID NO: 7267881 - DNA, 22 bp, Homo sapiens
tggttgtataatgtcactaagc

SEQ ID NO: 7267882 - DNA, 22 bp, Homo sapiens
tgtaaagcatctctgtcatata

SEQ ID NO: 7267883 - DNA, 18 bp, Homo sapiens
tgtaaacactttcattct

SEQ ID NO: 7267884 - DNA, 20 bp, Homo sapiens
tggctgtgggcatctgtttc

SEQ ID NO: 7267885 - DNA, 23 bp, Homo sapiens
tgggaaatgtagccttggcatga

SEQ ID NO: 7267886 - DNA, 22 bp, Homo sapiens
tggataaatagatacacttgca

SEQ ID NO: 7267887 - DNA, 22 bp, Homo sapiens
tggaatctgtatgtatgtataa

SEQ ID NO: 7267888 - DNA, 22 bp, Homo sapiens
tggaatcttgcgggcacatggc

SEQ ID NO: 7267889 - DNA, 22 bp, Homo sapiens
tggaatttagttaattccattt

SEQ ID NO: 7267890 - DNA, 22 bp, Homo sapiens
tgctttgcaaataatagaatgt

SEQ ID NO: 7267891 - DNA, 22 bp, Homo sapiens
tggaaatacaagaagtatgtca

SEQ ID NO: 7267892 - DNA, 22 bp, Homo sapiens
tggaaatatgctccattctttt

SEQ ID NO: 7267893 - DNA, 22 bp, Homo sapiens
tggaaatacttgccataaaact

SEQ ID NO: 7267894 - DNA, 22 bp, Homo sapiens
tggaaatagctccagttaagca

SEQ ID NO: 7267895 - DNA, 22 bp, Homo sapiens
tggaaatatttgctcattatct

SEQ ID NO: 7267896 - DNA, 22 bp, Homo sapiens
tgctgtgcaaaggtgatgtgag

SEQ ID NO: 7267897 - DNA, 23 bp, Homo sapiens
tgctgtgcctttgtctgcctcca

SEQ ID NO: 7267898 - DNA, 18 bp, Homo sapiens
tgctgtgcacagccctat

SEQ ID NO: 7267899 - DNA, 22 bp, Homo sapiens
tgctgtgcatcatagtgtttgg

SEQ ID NO: 7267900 - DNA, 19 bp, Homo sapiens
tgctgctgtccttgcaggg

SEQ ID NO: 7267901 - DNA, 20 bp, Homo sapiens
tgctatattgaagtgcagtt

SEQ ID NO: 7267902 - DNA, 22 bp, Homo sapiens
tgctcattgctgatttacatgt

SEQ ID NO: 7267903 - DNA, 22 bp, Homo sapiens
tgctgagatctgccagtagatg

SEQ ID NO: 7267904 - DNA, 22 bp, Homo sapiens
tgagaacttgtgctattgcaca

SEQ ID NO: 7267905 - DNA, 22 bp, Homo sapiens
tgagagctgggaaatgttagct

SEQ ID NO: 7267906 - DNA, 22 bp, Homo sapiens
tgagatgcaggagatgggactg

SEQ ID NO: 7267907 - DNA, 22 bp, Homo sapiens
tgagatgctgctgtaacaaata

SEQ ID NO: 7267908 - DNA, 19 bp, Homo sapiens
tgagatgccttccagccct

SEQ ID NO: 7267909 - DNA, 22 bp, Homo sapiens
tgagatgctaaagggctgctca

SEQ ID NO: 7267910 - DNA, 21 bp, Homo sapiens
tgagatgctagaaggcaggga

SEQ ID NO: 7267911 - DNA, 22 bp, Homo sapiens
tgagatgctgggaacaaggaag

SEQ ID NO: 7267912 - DNA, 22 bp, Homo sapiens
tgagatctgtgcatgttagtta

SEQ ID NO: 7267913 - DNA, 22 bp, Homo sapiens
tgagatctctgcctatatggat

SEQ ID NO: 7267914 - DNA, 22 bp, Homo sapiens
tgagctttgttgttagtatatt

SEQ ID NO: 7267915 - DNA, 22 bp, Homo sapiens
tgaggaaactgaggcacagatg

SEQ ID NO: 7267916 - DNA, 22 bp, Homo sapiens
tgagctgagaacacttgggcta

SEQ ID NO: 7267917 - DNA, 22 bp, Homo sapiens
tgagctgataggctgtgagcct

SEQ ID NO: 7267918 - DNA, 22 bp, Homo sapiens
tgagcacagctttcactagaaa

SEQ ID NO: 7267919 - DNA, 22 bp, Homo sapiens
tgagcacatttcacatgacagg

SEQ ID NO: 7267920 - DNA, 22 bp, Homo sapiens
tgagcagaggaggctgccaact

SEQ ID NO: 7267921 - DNA, 22 bp, Homo sapiens
tgagcagagttgtttctcctga

SEQ ID NO: 7267922 - DNA, 22 bp, Homo sapiens
tgaggatggaatgctgtgcaag

SEQ ID NO: 7267923 - DNA, 22 bp, Homo sapiens
tgagtaaagggccagatagtaa

SEQ ID NO: 7267924 - DNA, 22 bp, Homo sapiens
tgagtaaatatttatgactaga

SEQ ID NO: 7267925 - DNA, 22 bp, Homo sapiens
tgacaaaggtgttgccagaggg

SEQ ID NO: 7267926 - DNA, 19 bp, Homo sapiens
tgaatacagagatacagaa

SEQ ID NO: 7267927 - DNA, 22 bp, Homo sapiens
tgaattaaaggaattcgaattc

SEQ ID NO: 7267928 - DNA, 22 bp, Homo sapiens
tgaataaactatgaggaggaat

SEQ ID NO: 7267929 - DNA, 22 bp, Homo sapiens
tgacatttgagagagatataca

SEQ ID NO: 7267930 - DNA, 21 bp, Homo sapiens
tgacatttggattcatagtaa

SEQ ID NO: 7267931 - DNA, 22 bp, Homo sapiens
tgacatttcttgttgatataaa

SEQ ID NO: 7267932 - DNA, 22 bp, Homo sapiens
tgacatttaatccctaaatatt

SEQ ID NO: 7267933 - DNA, 22 bp, Homo sapiens
tgaaaaactgaatagttgagta

SEQ ID NO: 7267934 - DNA, 23 bp, Homo sapiens
tgaaacatttagggtagaatttc

SEQ ID NO: 7267935 - DNA, 22 bp, Homo sapiens
tgaaacattaggaaatcattat

SEQ ID NO: 7267936 - DNA, 22 bp, Homo sapiens
tgaaacattatagaatatttat

SEQ ID NO: 7267937 - DNA, 22 bp, Homo sapiens
tgaagactcagaagctaagata

SEQ ID NO: 7267938 - DNA, 22 bp, Homo sapiens
tgaagaaaggtgtgggatactc

SEQ ID NO: 7267939 - DNA, 22 bp, Homo sapiens
tgaacattgtcacattcctagc

SEQ ID NO: 7267940 - DNA, 22 bp, Homo sapiens
tgaaataatatctggatcaatc

SEQ ID NO: 7267941 - DNA, 22 bp, Homo sapiens
tgcatgaaatattttctgtagg

SEQ ID NO: 7267942 - DNA, 22 bp, Homo sapiens
tgcatacataaagtgctatcat

SEQ ID NO: 7267943 - DNA, 22 bp, Homo sapiens
tgcatacacaagcatacatgta

SEQ ID NO: 7267944 - DNA, 22 bp, Homo sapiens
tgcataactagagtaattacag

SEQ ID NO: 7267945 - DNA, 22 bp, Homo sapiens
tgcataaaatatgagaaatgta

SEQ ID NO: 7267946 - DNA, 22 bp, Homo sapiens
tgcataaacagatacttcatgt

SEQ ID NO: 7267947 - DNA, 22 bp, Homo sapiens
tgcataaagtgccatagtatta

SEQ ID NO: 7267948 - DNA, 22 bp, Homo sapiens
tgcacagtgaccactgagcaag

SEQ ID NO: 7267949 - DNA, 22 bp, Homo sapiens
tgcacagttggctacatcgtgg

SEQ ID NO: 7267950 - DNA, 22 bp, Homo sapiens
tgcacagttcgccttctccaag

SEQ ID NO: 7267951 - DNA, 22 bp, Homo sapiens
tgcacagttaatatgtgacaga

SEQ ID NO: 7267952 - DNA, 22 bp, Homo sapiens
tgcacaggccttgaagggagag

SEQ ID NO: 7267953 - DNA, 22 bp, Homo sapiens
tgcagatacagtatgtggaagc

SEQ ID NO: 7267954 - DNA, 22 bp, Homo sapiens
tgcagataatactagaacttac

SEQ ID NO: 7267955 - DNA, 21 bp, Homo sapiens
tgcagataattgaaagctgac

SEQ ID NO: 7267956 - DNA, 22 bp, Homo sapiens
tgcagatgagggatgaaaatga

SEQ ID NO: 7267957 - DNA, 22 bp, Homo sapiens
tgcagcaaacaggccttcaggg

SEQ ID NO: 7267958 - DNA, 22 bp, Homo sapiens
tgcagcaagaccggatatgtcg

SEQ ID NO: 7267959 - DNA, 22 bp, Homo sapiens
tgcagctgaacctagagtctgt

SEQ ID NO: 7267960 - DNA, 17 bp, Homo sapiens
tgcaaacaatcacatat

SEQ ID NO: 7267961 - DNA, 22 bp, Homo sapiens
tgcaaacaatttcctataaagt

SEQ ID NO: 7267962 - DNA, 22 bp, Homo sapiens
tgcaaatgtgtaggtttacata

SEQ ID NO: 7267963 - DNA, 22 bp, Homo sapiens
tgcaaatgggtgagggttagga

SEQ ID NO: 7267964 - DNA, 22 bp, Homo sapiens
tgcaaatcctgtttggagtaag

SEQ ID NO: 7267965 - DNA, 22 bp, Homo sapiens
tgcaaatatttccttatagcca

SEQ ID NO: 7267966 - DNA, 22 bp, Homo sapiens
tgatttatgaccaagttagaat

SEQ ID NO: 7267967 - DNA, 22 bp, Homo sapiens
tgcaacaggctgtgacatggaa

SEQ ID NO: 7267968 - DNA, 22 bp, Homo sapiens
tgatcagtgttggttctatcta

SEQ ID NO: 7267969 - DNA, 22 bp, Homo sapiens
tgatggaaaataaatcttattc

SEQ ID NO: 7267970 - DNA, 18 bp, Homo sapiens
tgatgcaagagtgagcta

SEQ ID NO: 7267971 - DNA, 17 bp, Homo sapiens
tgatgcaaagtcagctg

SEQ ID NO: 7267972 - DNA, 22 bp, Homo sapiens
tgatgattgggagacatttggg

SEQ ID NO: 7267973 - DNA, 22 bp, Homo sapiens
tgatgatatgaaagaatcttta

SEQ ID NO: 7267974 - DNA, 22 bp, Homo sapiens
tgatgaaaatatgattctgagg

SEQ ID NO: 7267975 - DNA, 22 bp, Homo sapiens
tgattgaattcaaatgcaatct

SEQ ID NO: 7267976 - DNA, 19 bp, Homo sapiens
tgattcatctaactgcctc

SEQ ID NO: 7267977 - DNA, 22 bp, Homo sapiens
tgattacacaccacagtgctcc

SEQ ID NO: 7267978 - DNA, 22 bp, Homo sapiens
tgattaaaatttaacttagtta

SEQ ID NO: 7267979 - DNA, 22 bp, Homo sapiens
tgattaaaggtggaaggcaggt

SEQ ID NO: 7267980 - DNA, 22 bp, Homo sapiens
tgattaaattaattaagatgag

SEQ ID NO: 7267981 - DNA, 22 bp, Homo sapiens
tgattacaattgtcttagattt

SEQ ID NO: 7267982 - DNA, 22 bp, Homo sapiens
tctgtttatgtgtctaaataaa

SEQ ID NO: 7267983 - DNA, 22 bp, Homo sapiens
tctgtttatgcatatttaaaac

SEQ ID NO: 7267984 - DNA, 22 bp, Homo sapiens
tctgtttagactcagttgaaac

SEQ ID NO: 7267985 - DNA, 22 bp, Homo sapiens
tctgtttaatgggaatgatact

SEQ ID NO: 7267986 - DNA, 22 bp, Homo sapiens
tctgtgcaccttctaatgagta

SEQ ID NO: 7267987 - DNA, 22 bp, Homo sapiens
tctgtgcactaacattcctggt

SEQ ID NO: 7267988 - DNA, 22 bp, Homo sapiens
tctgtgcaatagtttgttttac

SEQ ID NO: 7267989 - DNA, 22 bp, Homo sapiens
tctgtgcacaataggcattttt

SEQ ID NO: 7267990 - DNA, 22 bp, Homo sapiens
tctgtgcaccagaatgatattt

SEQ ID NO: 7267991 - DNA, 20 bp, Homo sapiens
tctgtgcacctgctacaagg

SEQ ID NO: 7267992 - DNA, 22 bp, Homo sapiens
tctgtgcaagaccaactttcaa

SEQ ID NO: 7267993 - DNA, 22 bp, Homo sapiens
tctgtgcaagtatttgacattt

SEQ ID NO: 7267994 - DNA, 22 bp, Homo sapiens
tctgtgcaggatttgaggaacc

SEQ ID NO: 7267995 - DNA, 22 bp, Homo sapiens
tctgtgcaggaagtcattatga

SEQ ID NO: 7267996 - DNA, 22 bp, Homo sapiens
tctgtgcagatgtagaccagtt

SEQ ID NO: 7267997 - DNA, 15 bp, Homo sapiens
tctgtgcagcaaggg

SEQ ID NO: 7267998 - DNA, 22 bp, Homo sapiens
tctgtgcagacatggggaagcc

SEQ ID NO: 7267999 - DNA, 22 bp, Homo sapiens
tctgtgcagaatcaaggagctt

SEQ ID NO: 7268000 - DNA, 22 bp, Homo sapiens
tctgtgcactgtgtcattaggt

SEQ ID NO: 7268001 - DNA, 22 bp, Homo sapiens
tctgtgcagaactcacagaagg

SEQ ID NO: 7268002 - DNA, 22 bp, Homo sapiens
tctgtgcagtcagggctcagtc

SEQ ID NO: 7268003 - DNA, 22 bp, Homo sapiens
tctgtgcagggaccccaagagt

SEQ ID NO: 7268004 - DNA, 20 bp, Homo sapiens
tctgtgcagtggaggggcag

SEQ ID NO: 7268005 - DNA, 22 bp, Homo sapiens
tctgtgcattgtaacaactaaa

SEQ ID NO: 7268006 - DNA, 22 bp, Homo sapiens
tctgtgcatttcaggacctgaa

SEQ ID NO: 7268007 - DNA, 22 bp, Homo sapiens
tctgtgcagttcttgtcttgac

SEQ ID NO: 7268008 - DNA, 20 bp, Homo sapiens
tctgtgcagtttaggaaggc

SEQ ID NO: 7268009 - DNA, 22 bp, Homo sapiens
tctgtgcatccttaacgcctgc

SEQ ID NO: 7268010 - DNA, 20 bp, Homo sapiens
tctgtgcattgcctgctggt

SEQ ID NO: 7268011 - DNA, 22 bp, Homo sapiens
tctgtcatgccacaggacttgg

SEQ ID NO: 7268012 - DNA, 22 bp, Homo sapiens
tctgtcatttcaatatggttaa

SEQ ID NO: 7268013 - DNA, 22 bp, Homo sapiens
tctgtcatttcattcatatgaa

SEQ ID NO: 7268014 - DNA, 19 bp, Homo sapiens
tctgtcatttcttctgtac

SEQ ID NO: 7268015 - DNA, 22 bp, Homo sapiens
tctgtcattttgtatctacatg

SEQ ID NO: 7268016 - DNA, 22 bp, Homo sapiens
tctttataaaagtcattatgtc

SEQ ID NO: 7268017 - DNA, 22 bp, Homo sapiens
tcttcattctcgcctttgtcgt

SEQ ID NO: 7268018 - DNA, 22 bp, Homo sapiens
tctatgtaaagccatattgata

SEQ ID NO: 7268019 - DNA, 22 bp, Homo sapiens
tctatgaacctctgcaatgaca

SEQ ID NO: 7268020 - DNA, 22 bp, Homo sapiens
tctaaatgtatcacatctggat

SEQ ID NO: 7268021 - DNA, 22 bp, Homo sapiens
tctaaatgtcagtacagaatga

SEQ ID NO: 7268022 - DNA, 22 bp, Homo sapiens
tctaattttaggcatttgttca

SEQ ID NO: 7268023 - DNA, 22 bp, Homo sapiens
tctaattttggcattttaacct

SEQ ID NO: 7268024 - DNA, 23 bp, Homo sapiens
aatgatttcatgatgatagcagc

SEQ ID NO: 7268025 - DNA, 22 bp, Homo sapiens
acggggctagagaaggtttctt

SEQ ID NO: 7268026 - DNA, 22 bp, Homo sapiens
aagctcagaggtagataatgtt

SEQ ID NO: 7268027 - DNA, 22 bp, Homo sapiens
aagctcaggaaagagtctggtt

SEQ ID NO: 7268028 - DNA, 22 bp, Homo sapiens
acagattcactgcactggccat

SEQ ID NO: 7268029 - DNA, 23 bp, Homo sapiens
aatgggtgcaactatccatgaca

SEQ ID NO: 7268030 - DNA, 22 bp, Homo sapiens
accatcagagcacagtccgtgc

SEQ ID NO: 7268031 - DNA, 22 bp, Homo sapiens
accatcagtactggatgctgac

SEQ ID NO: 7268032 - DNA, 22 bp, Homo sapiens
accatcagtcacatgtagagaa

SEQ ID NO: 7268033 - DNA, 22 bp, Homo sapiens
accatcagtcattgtcagtggg

SEQ ID NO: 7268034 - DNA, 22 bp, Homo sapiens
accctcaacaaattcactctat

SEQ ID NO: 7268035 - DNA, 22 bp, Homo sapiens
acccggagtcggaggttgcagt

SEQ ID NO: 7268036 - DNA, 20 bp, Homo sapiens
agctgggcaattatgactat

SEQ ID NO: 7268037 - DNA, 22 bp, Homo sapiens
acaggtggtctttgctcctttt

SEQ ID NO: 7268038 - DNA, 22 bp, Homo sapiens
actgatttggttagagggccag

SEQ ID NO: 7268039 - DNA, 22 bp, Homo sapiens
actgatttttcaggagggcctt

SEQ ID NO: 7268040 - DNA, 22 bp, Homo sapiens
cagacagagtcttcccatcagt

SEQ ID NO: 7268041 - DNA, 22 bp, Homo sapiens
agctcagaactgcagacatgtg

SEQ ID NO: 7268042 - DNA, 22 bp, Homo sapiens
agcagacaacccagatgaccca

SEQ ID NO: 7268043 - DNA, 22 bp, Homo sapiens
atgggtggccccgtgtgcagtc

SEQ ID NO: 7268044 - DNA, 22 bp, Homo sapiens
aggctccattccaggagctaga

SEQ ID NO: 7268045 - DNA, 22 bp, Homo sapiens
aggctccattttcctgcagctg

SEQ ID NO: 7268046 - DNA, 22 bp, Homo sapiens
aggctccagtctgaaccttggg

SEQ ID NO: 7268047 - DNA, 22 bp, Homo sapiens
aggctccacggtcactggctct

SEQ ID NO: 7268048 - DNA, 22 bp, Homo sapiens
aggctccatgctaagcgatatg

SEQ ID NO: 7268049 - DNA, 22 bp, Homo sapiens
aggctccatggttctccctcag

SEQ ID NO: 7268050 - DNA, 22 bp, Homo sapiens
aggctccattcatgtgaaggca

SEQ ID NO: 7268051 - DNA, 22 bp, Homo sapiens
aggctccataccatctccggag

SEQ ID NO: 7268052 - DNA, 22 bp, Homo sapiens
aggctccatgcaaaggctgttt

SEQ ID NO: 7268053 - DNA, 22 bp, Homo sapiens
aggtggggtgttggatgtttat

SEQ ID NO: 7268054 - DNA, 22 bp, Homo sapiens
aggtggggtgagctgcagacta

SEQ ID NO: 7268055 - DNA, 22 bp, Homo sapiens
aggtgggggctgtgtccttgac

SEQ ID NO: 7268056 - DNA, 22 bp, Homo sapiens
aggtggcatgagactgtaccag

SEQ ID NO: 7268057 - DNA, 22 bp, Homo sapiens
aggtggggctgggaaagattcc

SEQ ID NO: 7268058 - DNA, 22 bp, Homo sapiens
ctcgggcttgaggctgtttacc

SEQ ID NO: 7268059 - DNA, 22 bp, Homo sapiens
atgtgtatgcatgcactaagat

SEQ ID NO: 7268060 - DNA, 22 bp, Homo sapiens
atgtgtatgtcttattcaaaga

SEQ ID NO: 7268061 - DNA, 22 bp, Homo sapiens
cttgtgtagtgctccacagtga

SEQ ID NO: 7268062 - DNA, 22 bp, Homo sapiens
ggtggggtcacgacagagggaa

SEQ ID NO: 7268063 - DNA, 22 bp, Homo sapiens
ggtggggctcagcaatctgtgt

SEQ ID NO: 7268064 - DNA, 22 bp, Homo sapiens
ggtggggctgcaagcagttcgg

SEQ ID NO: 7268065 - DNA, 22 bp, Homo sapiens
gggagcagttaaaatgattcct

SEQ ID NO: 7268066 - DNA, 22 bp, Homo sapiens
cagacagggacctcgctccaga

SEQ ID NO: 7268067 - DNA, 22 bp, Homo sapiens
gggagcaggacataatagcaat

SEQ ID NO: 7268068 - DNA, 22 bp, Homo sapiens
cagagctgcacattctatgatg

SEQ ID NO: 7268069 - DNA, 19 bp, Homo sapiens
tcaggaagttgatgaggtg

SEQ ID NO: 7268070 - DNA, 22 bp, Homo sapiens
tcaggaagtctcaattagctac

SEQ ID NO: 7268071 - DNA, 22 bp, Homo sapiens
caggaggcatcatggagcggac

SEQ ID NO: 7268072 - DNA, 22 bp, Homo sapiens
caggagctggatctccttgcgg

SEQ ID NO: 7268073 - DNA, 22 bp, Homo sapiens
caggcagccaggggacctgtcc

SEQ ID NO: 7268074 - DNA, 22 bp, Homo sapiens
gtggggcagtggcctgggagca

SEQ ID NO: 7268075 - DNA, 22 bp, Homo sapiens
gtggggagtgttctgtgattgg

SEQ ID NO: 7268076 - DNA, 22 bp, Homo sapiens
gtggggcatgcacgctgctcct

SEQ ID NO: 7268077 - DNA, 22 bp, Homo sapiens
gtgtatactgagaaatgtcagc

SEQ ID NO: 7268078 - DNA, 22 bp, Homo sapiens
gtgtatactaggttctattcca

SEQ ID NO: 7268079 - DNA, 22 bp, Homo sapiens
ttgcttttaatctttgtacatc

SEQ ID NO: 7268080 - DNA, 17 bp, Homo sapiens
ttgcttttgaaattgtc

SEQ ID NO: 7268081 - DNA, 22 bp, Homo sapiens
ttgcttttaattaatcattgct

SEQ ID NO: 7268082 - DNA, 22 bp, Homo sapiens
ctggattttatcattgtagttt

SEQ ID NO: 7268083 - DNA, 22 bp, Homo sapiens
ctggatttgcctatggtgcttt

SEQ ID NO: 7268084 - DNA, 22 bp, Homo sapiens
ctggatttactgagttttatca

SEQ ID NO: 7268085 - DNA, 22 bp, Homo sapiens
tgctccatgcgctcggccggcg

SEQ ID NO: 7268086 - DNA, 22 bp, Homo sapiens
tgtggggcttacaaaggcagat

SEQ ID NO: 7268087 - DNA, 22 bp, Homo sapiens
tgtggggctgtggtgttcttct

SEQ ID NO: 7268088 - DNA, 22 bp, Homo sapiens
tgtggggctgtcaggcaactgg

SEQ ID NO: 7268089 - DNA, 22 bp, Homo sapiens
tgtggggctccctggcagcctg

SEQ ID NO: 7268090 - DNA, 22 bp, Homo sapiens
tgtggggcagctagccggcctg

SEQ ID NO: 7268091 - DNA, 22 bp, Homo sapiens
tgtggggcctcgtgctagctgg

SEQ ID NO: 7268092 - DNA, 22 bp, Homo sapiens
tgtggggccaaagcccagccac

SEQ ID NO: 7268093 - DNA, 20 bp, Homo sapiens
gacaggagagttaggtaggt

SEQ ID NO: 7268094 - DNA, 22 bp, Homo sapiens
gagagtctaggaacctcatata

SEQ ID NO: 7268095 - DNA, 22 bp, Homo sapiens
gagagctgggctttgggtgaag

SEQ ID NO: 7268096 - DNA, 22 bp, Homo sapiens
gagtcaggagtcctgtgtgaga

SEQ ID NO: 7268097 - DNA, 22 bp, Homo sapiens
gaggcagctgggctggtggttt

SEQ ID NO: 7268098 - DNA, 22 bp, Homo sapiens
gagctggccgcagagagggcag

SEQ ID NO: 7268099 - DNA, 22 bp, Homo sapiens
gagctggcctcaggcacaggag

SEQ ID NO: 7268100 - DNA, 22 bp, Homo sapiens
gagtggcagaactgggggtcct

SEQ ID NO: 7268101 - DNA, 22 bp, Homo sapiens
gagtggggtctgggcatcagtc

SEQ ID NO: 7268102 - DNA, 22 bp, Homo sapiens
gattgtgtctcactgtgatgct

SEQ ID NO: 7268103 - DNA, 22 bp, Homo sapiens
gattgtgttcataggcatgtta

SEQ ID NO: 7268104 - DNA, 22 bp, Homo sapiens
gatttatttttaatcagcaggg

SEQ ID NO: 7268105 - DNA, 22 bp, Homo sapiens
gatggtgtcccaggctcaggct

SEQ ID NO: 7268106 - DNA, 19 bp, Homo sapiens
gccgaccgttggggtgccc

SEQ ID NO: 7268107 - DNA, 22 bp, Homo sapiens
ggctggctcttaccgacagcgt

SEQ ID NO: 7268108 - DNA, 22 bp, Homo sapiens
gggctagaaattctgcagtgga

SEQ ID NO: 7268109 - DNA, 22 bp, Homo sapiens
gggctagaagttagctagagaa

SEQ ID NO: 7268110 - DNA, 22 bp, Homo sapiens
ggggacgcagaaagagtggcag

SEQ ID NO: 7268111 - DNA, 22 bp, Homo sapiens
ggagctgaggaatagctttgat

SEQ ID NO: 7268112 - DNA, 22 bp, Homo sapiens
ggcagacactcaaaagctggga

SEQ ID NO: 7268113 - DNA, 22 bp, Homo sapiens
ggcagacacctttatgtctaat

SEQ ID NO: 7268114 - DNA, 19 bp, Homo sapiens
ggcagacacagttgacatg

SEQ ID NO: 7268115 - DNA, 22 bp, Homo sapiens
ggcagacaatctgtctgttagg

SEQ ID NO: 7268116 - DNA, 22 bp, Homo sapiens
ggcagacacaaaaacataaggt

SEQ ID NO: 7268117 - DNA, 22 bp, Homo sapiens
ggagtggccacgactgggagat

SEQ ID NO: 7268118 - DNA, 22 bp, Homo sapiens
ggagtggcctctcctgtgcagg

SEQ ID NO: 7268119 - DNA, 22 bp, Homo sapiens
ggagtggcagctaggctgtcag

SEQ ID NO: 7268120 - DNA, 22 bp, Homo sapiens
ggagtggcagcgaggatcagat

SEQ ID NO: 7268121 - DNA, 22 bp, Homo sapiens
ggagtggcactctgaggcgggg

SEQ ID NO: 7268122 - DNA, 22 bp, Homo sapiens
ggtgattctgtgaggggctgac

SEQ ID NO: 7268123 - DNA, 21 bp, Homo sapiens
gggtggggttccagccttttc

SEQ ID NO: 7268124 - DNA, 22 bp, Homo sapiens
gggtggggcccaggaaatctat

SEQ ID NO: 7268125 - DNA, 22 bp, Homo sapiens
gggtggggccaggcaatttgca

SEQ ID NO: 7268126 - DNA, 22 bp, Homo sapiens
gggtggggttcaggaatcttca

SEQ ID NO: 7268127 - DNA, 22 bp, Homo sapiens
gggtggggtgtatcggatccta

SEQ ID NO: 7268128 - DNA, 22 bp, Homo sapiens
ggtgtatacctacacatttttg

SEQ ID NO: 7268129 - DNA, 22 bp, Homo sapiens
ggtggcattcagaagagctggc

SEQ ID NO: 7268130 - DNA, 22 bp, Homo sapiens
gtggcagcagaggggtggtatg

SEQ ID NO: 7268131 - DNA, 22 bp, Homo sapiens
gtgggagctttggcatcaggct

SEQ ID NO: 7268132 - DNA, 22 bp, Homo sapiens
gtggctggtttcctgcatgcaa

SEQ ID NO: 7268133 - DNA, 22 bp, Homo sapiens
gtggctgggctccgagcggctt

SEQ ID NO: 7268134 - DNA, 22 bp, Homo sapiens
gtggctcttgcatggggtctct

SEQ ID NO: 7268135 - DNA, 22 bp, Homo sapiens
gtggcatggagaaggaggcagt

SEQ ID NO: 7268136 - DNA, 22 bp, Homo sapiens
gtggtgtttgccagttaataac

SEQ ID NO: 7268137 - DNA, 22 bp, Homo sapiens
gtggtgttcccacgcctgctag

SEQ ID NO: 7268138 - DNA, 22 bp, Homo sapiens
gtggtgtttgagctgccaggga

SEQ ID NO: 7268139 - DNA, 22 bp, Homo sapiens
gtggtgtttttggggcagagga

SEQ ID NO: 7268140 - DNA, 22 bp, Homo sapiens
gtgggtggagactgggtgcaag

SEQ ID NO: 7268141 - DNA, 22 bp, Homo sapiens
gtggggaggcctaagcaagttg

SEQ ID NO: 7268142 - DNA, 22 bp, Homo sapiens
gtggggaggcattcttctccct

SEQ ID NO: 7268143 - DNA, 22 bp, Homo sapiens
tgatctggtcctactgtgggca

SEQ ID NO: 7268144 - DNA, 22 bp, Homo sapiens
tgatctggaattccctgtggta

SEQ ID NO: 7268145 - DNA, 22 bp, Homo sapiens
tgatatgggaaaagggctcgga

SEQ ID NO: 7268146 - DNA, 20 bp, Homo sapiens
tgatatggtttggctgtgtt

SEQ ID NO: 7268147 - DNA, 22 bp, Homo sapiens
tgcagacaagtcgtgggatctt

SEQ ID NO: 7268148 - DNA, 22 bp, Homo sapiens
tgcatttgaagtcagacaggct

SEQ ID NO: 7268149 - DNA, 22 bp, Homo sapiens
tgcctaggctggagtgtagtgg

SEQ ID NO: 7268150 - DNA, 22 bp, Homo sapiens
tgagggactcagaattcagcct

SEQ ID NO: 7268151 - DNA, 22 bp, Homo sapiens
tgcggcaggagaaggtgttatg

SEQ ID NO: 7268152 - DNA, 22 bp, Homo sapiens
tgcggcagccaccgcgtggccc

SEQ ID NO: 7268153 - DNA, 22 bp, Homo sapiens
tgctggtggagaaagtggaggt

SEQ ID NO: 7268154 - DNA, 21 bp, Homo sapiens
tgctggtgagctcatgtggct

SEQ ID NO: 7268155 - DNA, 23 bp, Homo sapiens
tgctggtgtttttgggaccaggg

SEQ ID NO: 7268156 - DNA, 22 bp, Homo sapiens
tggagcagccatgatgacagag

SEQ ID NO: 7268157 - DNA, 22 bp, Homo sapiens
tggagcagagttcagcggggag

SEQ ID NO: 7268158 - DNA, 22 bp, Homo sapiens
tggagcagaggctgaggttggg

SEQ ID NO: 7268159 - DNA, 22 bp, Homo sapiens
tggagcaggacggggagtggta

SEQ ID NO: 7268160 - DNA, 22 bp, Homo sapiens
tggagcaggtgctcagggtaat

SEQ ID NO: 7268161 - DNA, 22 bp, Homo sapiens
tggagcaggtgccaggtgtgtg

SEQ ID NO: 7268162 - DNA, 22 bp, Homo sapiens
tggagcagctgaacagagttga

SEQ ID NO: 7268163 - DNA, 22 bp, Homo sapiens
tggctttttctcagctctggct

SEQ ID NO: 7268164 - DNA, 21 bp, Homo sapiens
tggcttttatggagctctggg

SEQ ID NO: 7268165 - DNA, 22 bp, Homo sapiens
tggctgttactcttttcatttc

SEQ ID NO: 7268166 - DNA, 22 bp, Homo sapiens
tggctggtcacatggtaggtct

SEQ ID NO: 7268167 - DNA, 21 bp, Homo sapiens
tggctggtggcagggcttctc

SEQ ID NO: 7268168 - DNA, 22 bp, Homo sapiens
tggctggtgggcctcagcctgc

SEQ ID NO: 7268169 - DNA, 22 bp, Homo sapiens
tggctggttttggtgagctccg

SEQ ID NO: 7268170 - DNA, 22 bp, Homo sapiens
tgggagcaggaagcaggaagta

SEQ ID NO: 7268171 - DNA, 20 bp, Homo sapiens
tggcctttaaatagtattcc

SEQ ID NO: 7268172 - DNA, 22 bp, Homo sapiens
tggcctttgttgatagctatgc

SEQ ID NO: 7268173 - DNA, 22 bp, Homo sapiens
tggctccagatctgtctcctgt

SEQ ID NO: 7268174 - DNA, 22 bp, Homo sapiens
tggcatttcctcagtgctcaga

SEQ ID NO: 7268175 - DNA, 22 bp, Homo sapiens
tggcatggcaaccctgcaggga

SEQ ID NO: 7268176 - DNA, 21 bp, Homo sapiens
tggcatggaggtagcagtgtg

SEQ ID NO: 7268177 - DNA, 22 bp, Homo sapiens
tggcatgggccagggagagctg

SEQ ID NO: 7268178 - DNA, 22 bp, Homo sapiens
tggcatgggtggagagagcaca

SEQ ID NO: 7268179 - DNA, 22 bp, Homo sapiens
tggatttgagatgtgttcagat

SEQ ID NO: 7268180 - DNA, 22 bp, Homo sapiens
tggtgtgggcagcagcaggtac

SEQ ID NO: 7268181 - DNA, 22 bp, Homo sapiens
tggtgtgggcgtggcaggcaag

SEQ ID NO: 7268182 - DNA, 23 bp, Homo sapiens
tggtggggtcttggagacagcac

SEQ ID NO: 7268183 - DNA, 22 bp, Homo sapiens
tggtcgggagcgagcagctatt

SEQ ID NO: 7268184 - DNA, 22 bp, Homo sapiens
tggtggcaaagtacaaagtgac

SEQ ID NO: 7268185 - DNA, 16 bp, Homo sapiens
tggtggggaggacagc

SEQ ID NO: 7268186 - DNA, 22 bp, Homo sapiens
tggtggggattccctccctggc

SEQ ID NO: 7268187 - DNA, 22 bp, Homo sapiens
tggtggggtcatcgtcagatgc

SEQ ID NO: 7268188 - DNA, 22 bp, Homo sapiens
tggtgggggaggctgtctagca

SEQ ID NO: 7268189 - DNA, 22 bp, Homo sapiens
tggtggggctttccttctgctt

SEQ ID NO: 7268190 - DNA, 22 bp, Homo sapiens
tggtggggccagacttcagctc

SEQ ID NO: 7268191 - DNA, 22 bp, Homo sapiens
tggtggcagtctcctggctgtg

SEQ ID NO: 7268192 - DNA, 22 bp, Homo sapiens
tggtggcagctgggacagaggt

SEQ ID NO: 7268193 - DNA, 22 bp, Homo sapiens
tggtggcatgatagtgtgaatg

SEQ ID NO: 7268194 - DNA, 23 bp, Homo sapiens
tggtggcagaagtagcagatgac

SEQ ID NO: 7268195 - DNA, 22 bp, Homo sapiens
tggtggcagagcaagagctgga

SEQ ID NO: 7268196 - DNA, 18 bp, Homo sapiens
tgtagctggaggccaggc

SEQ ID NO: 7268197 - DNA, 22 bp, Homo sapiens
tgtatacatttggtgcatattt

SEQ ID NO: 7268198 - DNA, 22 bp, Homo sapiens
tgtatacatgtgtgttcacgca

SEQ ID NO: 7268199 - DNA, 22 bp, Homo sapiens
tgtatacatgtgttcatgcatg

SEQ ID NO: 7268200 - DNA, 22 bp, Homo sapiens
tgtatacaggcataagagatac

SEQ ID NO: 7268201 - DNA, 23 bp, Homo sapiens
tgtatacaccctgtgcatctggg

SEQ ID NO: 7268202 - DNA, 22 bp, Homo sapiens
tgtatacaggattactcatagc

SEQ ID NO: 7268203 - DNA, 22 bp, Homo sapiens
tgggattcaccatgggcttcag

SEQ ID NO: 7268204 - DNA, 22 bp, Homo sapiens
tgggatgggatctcgctgtgtc

SEQ ID NO: 7268205 - DNA, 22 bp, Homo sapiens
tgggatatctgtcagcagcttc

SEQ ID NO: 7268206 - DNA, 23 bp, Homo sapiens
tgggatggattcaccagtgtgct

SEQ ID NO: 7268207 - DNA, 22 bp, Homo sapiens
tgggcagcaaagactgtgtgct

SEQ ID NO: 7268208 - DNA, 20 bp, Homo sapiens
tgggcagcactgctggctgg

SEQ ID NO: 7268209 - DNA, 23 bp, Homo sapiens
tgggtctctagtacaggcaggca

SEQ ID NO: 7268210 - DNA, 22 bp, Homo sapiens
tgggtctcctgtgcctgggagg

SEQ ID NO: 7268211 - DNA, 22 bp, Homo sapiens
tgggtctccagttcagggcagg

SEQ ID NO: 7268212 - DNA, 22 bp, Homo sapiens
tgggggagattagagcttctta

SEQ ID NO: 7268213 - DNA, 22 bp, Homo sapiens
tgtgctatttttgcatatgtgt

SEQ ID NO: 7268214 - DNA, 22 bp, Homo sapiens
tgtctatacctgatacagagtt

SEQ ID NO: 7268215 - DNA, 22 bp, Homo sapiens
tgtcttttagtttgtgagatct

SEQ ID NO: 7268216 - DNA, 22 bp, Homo sapiens
tgtcttttataactgacatata

SEQ ID NO: 7268217 - DNA, 22 bp, Homo sapiens
tgtctttttacctgtgatgagt

SEQ ID NO: 7268218 - DNA, 18 bp, Homo sapiens
tgtttatttttctcttac

SEQ ID NO: 7268219 - DNA, 22 bp, Homo sapiens
tgttgggaagctctgccagggg

SEQ ID NO: 7268220 - DNA, 22 bp, Homo sapiens
tgtttattgctgcaattgtgcc

SEQ ID NO: 7268221 - DNA, 22 bp, Homo sapiens
tgtttattttcaggatggattg

SEQ ID NO: 7268222 - DNA, 22 bp, Homo sapiens
tgtttattgcagtgctgggctg

SEQ ID NO: 7268223 - DNA, 22 bp, Homo sapiens
tgtttattgagtgcctactata

SEQ ID NO: 7268224 - DNA, 18 bp, Homo sapiens
tgtttattctcctgacag

SEQ ID NO: 7268225 - DNA, 22 bp, Homo sapiens
tgtttattcatggctaatgaaa

SEQ ID NO: 7268226 - DNA, 22 bp, Homo sapiens
tgtttattacagttcttggaat

SEQ ID NO: 7268227 - DNA, 22 bp, Homo sapiens
tgtgtacaggacagaaaggagg

SEQ ID NO: 7268228 - DNA, 23 bp, Homo sapiens
tgtgtacacaatagatgaggttt

SEQ ID NO: 7268229 - DNA, 22 bp, Homo sapiens
agattagggtctgtgtctggcg

SEQ ID NO: 7268230 - DNA, 22 bp, Homo sapiens
agatctgagtggctgcatgtaa

SEQ ID NO: 7268231 - DNA, 22 bp, Homo sapiens
agatttggtgtctggttgatat

SEQ ID NO: 7268232 - DNA, 23 bp, Homo sapiens
aggctccactccctgggatgtgg

SEQ ID NO: 7268233 - DNA, 22 bp, Homo sapiens
aggctccagcccaaggctgcag

SEQ ID NO: 7268234 - DNA, 22 bp, Homo sapiens
aggctccagccaatgggtctgt

SEQ ID NO: 7268235 - DNA, 22 bp, Homo sapiens
aggctccagcagccagaggaag

SEQ ID NO: 7268236 - DNA, 22 bp, Homo sapiens
aggctccagtctcctctggcag

SEQ ID NO: 7268237 - DNA, 22 bp, Homo sapiens
aggctccaggcctccctgcatg

SEQ ID NO: 7268238 - DNA, 22 bp, Homo sapiens
aggctccagggctgtgtgggag

SEQ ID NO: 7268239 - DNA, 22 bp, Homo sapiens
aggctccaggcaatgtttctga

SEQ ID NO: 7268240 - DNA, 22 bp, Homo sapiens
aggctccaggcccttcaccagc

SEQ ID NO: 7268241 - DNA, 22 bp, Homo sapiens
aggctccaggcaaaatttcgga

SEQ ID NO: 7268242 - DNA, 22 bp, Homo sapiens
aggtggggaaaccagcgatccc

SEQ ID NO: 7268243 - DNA, 22 bp, Homo sapiens
agacaaggcaaggcggccagat

SEQ ID NO: 7268244 - DNA, 20 bp, Homo sapiens
agcggcagcttcctgcttcg

SEQ ID NO: 7268245 - DNA, 22 bp, Homo sapiens
agcggcagcagatgtgatcagg

SEQ ID NO: 7268246 - DNA, 21 bp, Homo sapiens
agcggcagaccctgcatttga

SEQ ID NO: 7268247 - DNA, 22 bp, Homo sapiens
aggagctgggctgctgctggga

SEQ ID NO: 7268248 - DNA, 22 bp, Homo sapiens
aggataataatagtgctcactc

SEQ ID NO: 7268249 - DNA, 22 bp, Homo sapiens
aggataattggcatttgtaggc

SEQ ID NO: 7268250 - DNA, 22 bp, Homo sapiens
agctggtgctcaggggcatgga

SEQ ID NO: 7268251 - DNA, 22 bp, Homo sapiens
aggtggcaggaggtcagagaaa

SEQ ID NO: 7268252 - DNA, 22 bp, Homo sapiens
aggtggcagcagcctggtgaaa

SEQ ID NO: 7268253 - DNA, 22 bp, Homo sapiens
aggtggcagcagaatcagggag

SEQ ID NO: 7268254 - DNA, 22 bp, Homo sapiens
aggtggcagagtgacaggctga

SEQ ID NO: 7268255 - DNA, 22 bp, Homo sapiens
aggtggcagagctggcccagcg

SEQ ID NO: 7268256 - DNA, 22 bp, Homo sapiens
aggtggcagactaacagaagga

SEQ ID NO: 7268257 - DNA, 22 bp, Homo sapiens
agtcaggagatattttgatatg

SEQ ID NO: 7268258 - DNA, 22 bp, Homo sapiens
agtcaggagctgctgcattgta

SEQ ID NO: 7268259 - DNA, 22 bp, Homo sapiens
agtcaggaaaagctttcctgga

SEQ ID NO: 7268260 - DNA, 22 bp, Homo sapiens
agtcaggaagctggagctgggg

SEQ ID NO: 7268261 - DNA, 22 bp, Homo sapiens
agtcaggatatgccttgtgggc

SEQ ID NO: 7268262 - DNA, 22 bp, Homo sapiens
agtggcctggagccccgcctgg

SEQ ID NO: 7268263 - DNA, 22 bp, Homo sapiens
agtggggccgcggtcctgccct

SEQ ID NO: 7268264 - DNA, 22 bp, Homo sapiens
atcagcaggtgctggtggagac

SEQ ID NO: 7268265 - DNA, 22 bp, Homo sapiens
ctgggtggctgtccagccagcc

SEQ ID NO: 7268266 - DNA, 22 bp, Homo sapiens
gcagatgcagagatggctgggg

SEQ ID NO: 7268267 - DNA, 22 bp, Homo sapiens
attgtgcagcacagatcatgac

SEQ ID NO: 7268268 - DNA, 22 bp, Homo sapiens
ggagcagccgcgtctcagggca

SEQ ID NO: 7268269 - DNA, 22 bp, Homo sapiens
ggagcagcctgtgtagacgggg

SEQ ID NO: 7268270 - DNA, 22 bp, Homo sapiens
ggagcagccacgtctcagggca

SEQ ID NO: 7268271 - DNA, 22 bp, Homo sapiens
ggagcagcttgcatgctcaggg

SEQ ID NO: 7268272 - DNA, 22 bp, Homo sapiens
ggcaggtgccttctgtgctagc

SEQ ID NO: 7268273 - DNA, 21 bp, Homo sapiens
ggagtttttctggaagggact

SEQ ID NO: 7268274 - DNA, 22 bp, Homo sapiens
cagatggcaacagctctgtgac

SEQ ID NO: 7268275 - DNA, 22 bp, Homo sapiens
ggtggcagtgcttgcgggtcta

SEQ ID NO: 7268276 - DNA, 22 bp, Homo sapiens
ggtgggacaggtaggagtggct

SEQ ID NO: 7268277 - DNA, 22 bp, Homo sapiens
ggtggctggaggagctgatgga

SEQ ID NO: 7268278 - DNA, 23 bp, Homo sapiens
gggggagctggactcctagatcc

SEQ ID NO: 7268279 - DNA, 22 bp, Homo sapiens
gggggagctgttattggcaggg

SEQ ID NO: 7268280 - DNA, 22 bp, Homo sapiens
gtgcctgggacacagcagatac

SEQ ID NO: 7268281 - DNA, 22 bp, Homo sapiens
tcaggagggagtgtggatagag

SEQ ID NO: 7268282 - DNA, 22 bp, Homo sapiens
tcaggaggcgtctcgctggggc

SEQ ID NO: 7268283 - DNA, 20 bp, Homo sapiens
catggtggaggagcagggcc

SEQ ID NO: 7268284 - DNA, 22 bp, Homo sapiens
caggtgggctgcctctccagct

SEQ ID NO: 7268285 - DNA, 22 bp, Homo sapiens
caggtgggcgtggcgagaaggc

SEQ ID NO: 7268286 - DNA, 22 bp, Homo sapiens
caggtgggcttgggagaacact

SEQ ID NO: 7268287 - DNA, 22 bp, Homo sapiens
caggtggggagagtgtggagca

SEQ ID NO: 7268288 - DNA, 22 bp, Homo sapiens
caggtggggcgccctcaggcag

SEQ ID NO: 7268289 - DNA, 22 bp, Homo sapiens
caggtggggcagctgtgggagc

SEQ ID NO: 7268290 - DNA, 22 bp, Homo sapiens
caggtggggggcttccgagcct

SEQ ID NO: 7268291 - DNA, 22 bp, Homo sapiens
tgctgggggtgtctcaccaggc

SEQ ID NO: 7268292 - DNA, 21 bp, Homo sapiens
tggcagacaggaggagctcac

SEQ ID NO: 7268293 - DNA, 22 bp, Homo sapiens
tgggtggcagcttcagcatgtt

SEQ ID NO: 7268294 - DNA, 22 bp, Homo sapiens
tggcattttagacatgatggtg

SEQ ID NO: 7268295 - DNA, 22 bp, Homo sapiens
tggcattttccaatgatatgtt

SEQ ID NO: 7268296 - DNA, 22 bp, Homo sapiens
tggcatttggcttacttatgtt

SEQ ID NO: 7268297 - DNA, 22 bp, Homo sapiens
tggcttgtcatgtatctgaggc

SEQ ID NO: 7268298 - DNA, 22 bp, Homo sapiens
ccagtcagggcaggagcctggt

SEQ ID NO: 7268299 - DNA, 22 bp, Homo sapiens
ccaggagcagagtaggtgttca

SEQ ID NO: 7268300 - DNA, 22 bp, Homo sapiens
cggctggtgtcgggcacagcaa

SEQ ID NO: 7268301 - DNA, 20 bp, Homo sapiens
ttgtttattatgttctgatc

SEQ ID NO: 7268302 - DNA, 22 bp, Homo sapiens
ttgtttatggattgtagaaact

SEQ ID NO: 7268303 - DNA, 22 bp, Homo sapiens
gacagacacaattgatccatga

SEQ ID NO: 7268304 - DNA, 22 bp, Homo sapiens
gaggctgagtagctttgtgctc

SEQ ID NO: 7268305 - DNA, 22 bp, Homo sapiens
gaggcagcttggggctgtgggt

SEQ ID NO: 7268306 - DNA, 22 bp, Homo sapiens
gccaggaggctgctgtgtaggc

SEQ ID NO: 7268307 - DNA, 22 bp, Homo sapiens
gccaggagaaaaggcgaatgat

SEQ ID NO: 7268308 - DNA, 22 bp, Homo sapiens
gcctggtggtatcctggcaaga

SEQ ID NO: 7268309 - DNA, 22 bp, Homo sapiens
ggctggtgttacagtcggcagc

SEQ ID NO: 7268310 - DNA, 22 bp, Homo sapiens
ggctggtggggaaagaggacca

SEQ ID NO: 7268311 - DNA, 23 bp, Homo sapiens
ggctggtgcccttggccagtcgg

SEQ ID NO: 7268312 - DNA, 22 bp, Homo sapiens
ggctggtgagttcagagaaccc

SEQ ID NO: 7268313 - DNA, 22 bp, Homo sapiens
ggcagcaggagccatctggtag

SEQ ID NO: 7268314 - DNA, 22 bp, Homo sapiens
ggcactgtttttgtattcagtt

SEQ ID NO: 7268315 - DNA, 22 bp, Homo sapiens
gggggagctagtccagctgagg

SEQ ID NO: 7268316 - DNA, 22 bp, Homo sapiens
gggggagctacaggtcccttgg

SEQ ID NO: 7268317 - DNA, 22 bp, Homo sapiens
gggctccatcggacttgggttt

SEQ ID NO: 7268318 - DNA, 22 bp, Homo sapiens
gggctccagccagctccttgtg

SEQ ID NO: 7268319 - DNA, 22 bp, Homo sapiens
ggtggctctgttgtcaactgat

SEQ ID NO: 7268320 - DNA, 22 bp, Homo sapiens
ggtgggcagctcttggcaggca

SEQ ID NO: 7268321 - DNA, 22 bp, Homo sapiens
tagccaggcctttgatcccggc

SEQ ID NO: 7268322 - DNA, 22 bp, Homo sapiens
tattgggtaaagatccagtttt

SEQ ID NO: 7268323 - DNA, 22 bp, Homo sapiens
tcaggaggacagataaggatag

SEQ ID NO: 7268324 - DNA, 22 bp, Homo sapiens
tcaggaggcaagtaggtattga

SEQ ID NO: 7268325 - DNA, 22 bp, Homo sapiens
tcaggggcttgaggtgcatgtc

SEQ ID NO: 7268326 - DNA, 19 bp, Homo sapiens
tttaggataaagtctggac

SEQ ID NO: 7268327 - DNA, 22 bp, Homo sapiens
ttgtgcattagggaaaggaact

SEQ ID NO: 7268328 - DNA, 22 bp, Homo sapiens
ttgtgctagaaccagtacagaa

SEQ ID NO: 7268329 - DNA, 22 bp, Homo sapiens
ttgtgctaagtgctatgaaggc

SEQ ID NO: 7268330 - DNA, 22 bp, Homo sapiens
ttgtggattgtgttaaattcct

SEQ ID NO: 7268331 - DNA, 22 bp, Homo sapiens
ttggggagttaatgccaaagat

SEQ ID NO: 7268332 - DNA, 22 bp, Homo sapiens
ttggggagaaatgaaatgaagt

SEQ ID NO: 7268333 - DNA, 22 bp, Homo sapiens
tttgtgtagtctgttcccactg

SEQ ID NO: 7268334 - DNA, 22 bp, Homo sapiens
tttgtgtatgcttcacctagcc

SEQ ID NO: 7268335 - DNA, 22 bp, Homo sapiens
tttgtgtatgtatgcttgtaca

SEQ ID NO: 7268336 - DNA, 19 bp, Homo sapiens
tttgtgtatgtgcgtacca

SEQ ID NO: 7268337 - DNA, 22 bp, Homo sapiens
tttgtgtaccttgtacatttgt

SEQ ID NO: 7268338 - DNA, 22 bp, Homo sapiens
ttttggtagaatgatattggat

SEQ ID NO: 7268339 - DNA, 22 bp, Homo sapiens
ttttggtaattaagtagatatt

SEQ ID NO: 7268340 - DNA, 18 bp, Homo sapiens
ttttggtgaggaagtgag

SEQ ID NO: 7268341 - DNA, 22 bp, Homo sapiens
agagctgggtggacttgtagtt

SEQ ID NO: 7268342 - DNA, 22 bp, Homo sapiens
aaaggtggagttgtgcccattt

SEQ ID NO: 7268343 - DNA, 22 bp, Homo sapiens
acacaggttccatctccacctt

SEQ ID NO: 7268344 - DNA, 22 bp, Homo sapiens
actcaggaatggggctgggact

SEQ ID NO: 7268345 - DNA, 22 bp, Homo sapiens
aggtggcatgcctgagacataa

SEQ ID NO: 7268346 - DNA, 22 bp, Homo sapiens
aggtggcatttacaccatggga

SEQ ID NO: 7268347 - DNA, 22 bp, Homo sapiens
atatttataagcaagcaggact

SEQ ID NO: 7268348 - DNA, 22 bp, Homo sapiens
agctggattaaatatagctttc

SEQ ID NO: 7268349 - DNA, 22 bp, Homo sapiens
atgggtggagggtgacacggat

SEQ ID NO: 7268350 - DNA, 22 bp, Homo sapiens
atgggtggaggagaaaggcatc

SEQ ID NO: 7268351 - DNA, 22 bp, Homo sapiens
attgctaggaacaggttgcacc

SEQ ID NO: 7268352 - DNA, 22 bp, Homo sapiens
agcagccacacgcctccttctc

SEQ ID NO: 7268353 - DNA, 22 bp, Homo sapiens
caggtgggagcggagactgatt

SEQ ID NO: 7268354 - DNA, 22 bp, Homo sapiens
caggtgggattttgctgcttga

SEQ ID NO: 7268355 - DNA, 22 bp, Homo sapiens
caggtgggagcgaggagctact

SEQ ID NO: 7268356 - DNA, 22 bp, Homo sapiens
caggtgggaccatgatagggca

SEQ ID NO: 7268357 - DNA, 22 bp, Homo sapiens
caggtgggagccacagcgtaca

SEQ ID NO: 7268358 - DNA, 16 bp, Homo sapiens
aggctccaagagctgt

SEQ ID NO: 7268359 - DNA, 22 bp, Homo sapiens
aggctccaagaggttaagtcac

SEQ ID NO: 7268360 - DNA, 23 bp, Homo sapiens
aggctccacatgggcactttgca

SEQ ID NO: 7268361 - DNA, 22 bp, Homo sapiens
aggctccaaattaccaagctct

SEQ ID NO: 7268362 - DNA, 22 bp, Homo sapiens
aggctccaccagtcaggtgcat

SEQ ID NO: 7268363 - DNA, 22 bp, Homo sapiens
aggctccaccctacagagctcc

SEQ ID NO: 7268364 - DNA, 22 bp, Homo sapiens
aggctccaccccgccagacctt

SEQ ID NO: 7268365 - DNA, 22 bp, Homo sapiens
aggctccacggcaggatgctgt

SEQ ID NO: 7268366 - DNA, 22 bp, Homo sapiens
ctggggaggcagggctgcccct

SEQ ID NO: 7268367 - DNA, 22 bp, Homo sapiens
ctggggcagagcctttagcaaa

SEQ ID NO: 7268368 - DNA, 22 bp, Homo sapiens
ctggtggggagtcctggtctcc

SEQ ID NO: 7268369 - DNA, 22 bp, Homo sapiens
ctggtggcaatgaggcgtcact

SEQ ID NO: 7268370 - DNA, 22 bp, Homo sapiens
agtcaggattttggattattcg

SEQ ID NO: 7268371 - DNA, 22 bp, Homo sapiens
aggtggggttcagtctcagccg

SEQ ID NO: 7268372 - DNA, 22 bp, Homo sapiens
gagctgcagacatagataagcg

SEQ ID NO: 7268373 - DNA, 22 bp, Homo sapiens
gagctgcagacttgatacagga

SEQ ID NO: 7268374 - DNA, 22 bp, Homo sapiens
ggggcgccccgagggtgcgcac

SEQ ID NO: 7268375 - DNA, 22 bp, Homo sapiens
gggctgtaggagctggaatggg

SEQ ID NO: 7268376 - DNA, 22 bp, Homo sapiens
cacatgtgtatatgtgaggggg

SEQ ID NO: 7268377 - DNA, 22 bp, Homo sapiens
ccggagtgtctggcctgctggg

SEQ ID NO: 7268378 - DNA, 22 bp, Homo sapiens
gtgagggcagaacccccaggcc

SEQ ID NO: 7268379 - DNA, 17 bp, Homo sapiens
gtgagggcagaggatgg

SEQ ID NO: 7268380 - DNA, 22 bp, Homo sapiens
tcagcagagctcaggctccagc

SEQ ID NO: 7268381 - DNA, 22 bp, Homo sapiens
tcgggctcgctctcctagcgga

SEQ ID NO: 7268382 - DNA, 23 bp, Homo sapiens
tcggtgggcgtggaggccgaggc

SEQ ID NO: 7268383 - DNA, 22 bp, Homo sapiens
cgtggggcgggtggacacttgc

SEQ ID NO: 7268384 - DNA, 22 bp, Homo sapiens
gaggtggcttagtctctggaca

SEQ ID NO: 7268385 - DNA, 22 bp, Homo sapiens
gacctggactgagttagatggc

SEQ ID NO: 7268386 - DNA, 22 bp, Homo sapiens
gagagctgtcagcgtagcaccg

SEQ ID NO: 7268387 - DNA, 22 bp, Homo sapiens
ctggtgttgtccgggtgagagt

SEQ ID NO: 7268388 - DNA, 22 bp, Homo sapiens
ctggtgtttattacaggtgctc

SEQ ID NO: 7268389 - DNA, 22 bp, Homo sapiens
gccagctggtaggcacctagcc

SEQ ID NO: 7268390 - DNA, 22 bp, Homo sapiens
gcagacaggcccagtggaggga

SEQ ID NO: 7268391 - DNA, 19 bp, Homo sapiens
gctaggtgaccagctggat

SEQ ID NO: 7268392 - DNA, 20 bp, Homo sapiens
gctcccagcctgcagtcccc

SEQ ID NO: 7268393 - DNA, 22 bp, Homo sapiens
gcttttgttccacagttttgaa

SEQ ID NO: 7268394 - DNA, 22 bp, Homo sapiens
ggcagcagaactggccctgtat

SEQ ID NO: 7268395 - DNA, 23 bp, Homo sapiens
gggagccatgggtggtcatggag

SEQ ID NO: 7268396 - DNA, 22 bp, Homo sapiens
gtgctgacaggagcctggcggt

SEQ ID NO: 7268397 - DNA, 21 bp, Homo sapiens
ggttggtgtgtccagtggcca

SEQ ID NO: 7268398 - DNA, 23 bp, Homo sapiens
ggtggtgctcatatctcaggcct

SEQ ID NO: 7268399 - DNA, 22 bp, Homo sapiens
ggtggggattcctgatcactgt

SEQ ID NO: 7268400 - DNA, 22 bp, Homo sapiens
ggtggggccagggctccaacct

SEQ ID NO: 7268401 - DNA, 22 bp, Homo sapiens
ggtggggccctggcactggtat

SEQ ID NO: 7268402 - DNA, 22 bp, Homo sapiens
ggtggggcccaggcatctgatg

SEQ ID NO: 7268403 - DNA, 22 bp, Homo sapiens
ggtggggctaggacctcaggat

SEQ ID NO: 7268404 - DNA, 22 bp, Homo sapiens
ggtggggcctgctccagcggcc

SEQ ID NO: 7268405 - DNA, 22 bp, Homo sapiens
taccagggaacagggatattaa

SEQ ID NO: 7268406 - DNA, 22 bp, Homo sapiens
gtgtttattttcatagttggcc

SEQ ID NO: 7268407 - DNA, 22 bp, Homo sapiens
gtgtttatgagtgaccttgtct

SEQ ID NO: 7268408 - DNA, 22 bp, Homo sapiens
gtgtttataggagtgaatgctg

SEQ ID NO: 7268409 - DNA, 22 bp, Homo sapiens
gtgtttatgtttgtgtagggga

SEQ ID NO: 7268410 - DNA, 22 bp, Homo sapiens
gtgtttatttagagtaggccat

SEQ ID NO: 7268411 - DNA, 22 bp, Homo sapiens
gtgtttatacagcaaagagcat

SEQ ID NO: 7268412 - DNA, 17 bp, Homo sapiens
gtgctggcctggggctc

SEQ ID NO: 7268413 - DNA, 22 bp, Homo sapiens
tatcagcgtgcaaatctttgga

SEQ ID NO: 7268414 - DNA, 22 bp, Homo sapiens
tcaggaagtataatcagattca

SEQ ID NO: 7268415 - DNA, 23 bp, Homo sapiens
ttgtgtctacttcctatctaggg

SEQ ID NO: 7268416 - DNA, 22 bp, Homo sapiens
ttgtgtattttttgatactaac

SEQ ID NO: 7268417 - DNA, 22 bp, Homo sapiens
ttgtgtagctaaaaccaagaaa

SEQ ID NO: 7268418 - DNA, 22 bp, Homo sapiens
tttggtattgcacactgtcttc

SEQ ID NO: 7268419 - DNA, 22 bp, Homo sapiens
aatgtgtagtcattgatcaaga

SEQ ID NO: 7268420 - DNA, 22 bp, Homo sapiens
aatgtgtacatgacagatagaa

SEQ ID NO: 7268421 - DNA, 22 bp, Homo sapiens
aaagctcatcattaggaggcta

SEQ ID NO: 7268422 - DNA, 22 bp, Homo sapiens
aaaagcatctcaaaggagcttc

SEQ ID NO: 7268423 - DNA, 22 bp, Homo sapiens
attggtggtgaggacatgccag

SEQ ID NO: 7268424 - DNA, 22 bp, Homo sapiens
attgtgtaggggcagtctggga

SEQ ID NO: 7268425 - DNA, 22 bp, Homo sapiens
atgatttgttaacagacttaat

SEQ ID NO: 7268426 - DNA, 22 bp, Homo sapiens
agcagacaggctgccacagtgc

SEQ ID NO: 7268427 - DNA, 21 bp, Homo sapiens
agcagacagatgcacgcacac

SEQ ID NO: 7268428 - DNA, 22 bp, Homo sapiens
agtggggcggacaggaccagga

SEQ ID NO: 7268429 - DNA, 22 bp, Homo sapiens
agtggggccggtgaggccgagg

SEQ ID NO: 7268430 - DNA, 22 bp, Homo sapiens
aggggagcaaggccgtggtgta

SEQ ID NO: 7268431 - DNA, 22 bp, Homo sapiens
caggtgggccatgaaaaatgac

SEQ ID NO: 7268432 - DNA, 22 bp, Homo sapiens
caggtgggccggggtttgttct

SEQ ID NO: 7268433 - DNA, 22 bp, Homo sapiens
agctggtggagaagcagacctc

SEQ ID NO: 7268434 - DNA, 22 bp, Homo sapiens
aggggctcctttgtgctgcgtc

SEQ ID NO: 7268435 - DNA, 22 bp, Homo sapiens
aggggctcagttactttggcag

SEQ ID NO: 7268436 - DNA, 22 bp, Homo sapiens
aggtggggaggagtgtctcttt

SEQ ID NO: 7268437 - DNA, 22 bp, Homo sapiens
aggtggggcccaccaatttgca

SEQ ID NO: 7268438 - DNA, 21 bp, Homo sapiens
aggtggggctgcacctctgct

SEQ ID NO: 7268439 - DNA, 22 bp, Homo sapiens
aggtggggagtatatgtaattg

SEQ ID NO: 7268440 - DNA, 22 bp, Homo sapiens
aggtggggccaaatgctacagt

SEQ ID NO: 7268441 - DNA, 22 bp, Homo sapiens
gactggagtgcctccaggaaag

SEQ ID NO: 7268442 - DNA, 22 bp, Homo sapiens
gaggtggcctcaagcagtcttc

SEQ ID NO: 7268443 - DNA, 22 bp, Homo sapiens
gaggtggccaagcgaggaaggg

SEQ ID NO: 7268444 - DNA, 22 bp, Homo sapiens
gaggtggcactgtgaggagcac

SEQ ID NO: 7268445 - DNA, 22 bp, Homo sapiens
gaggcagcatctatggtgggaa

SEQ ID NO: 7268446 - DNA, 22 bp, Homo sapiens
gaggcagcctcagtggacctcg

SEQ ID NO: 7268447 - DNA, 22 bp, Homo sapiens
atggggagagaagggctgagct

SEQ ID NO: 7268448 - DNA, 22 bp, Homo sapiens
atggggagagcctctgtcccca

SEQ ID NO: 7268449 - DNA, 22 bp, Homo sapiens
atggggagctcaccacctgttt

SEQ ID NO: 7268450 - DNA, 22 bp, Homo sapiens
attgtcgtcaatggacacatag

SEQ ID NO: 7268451 - DNA, 22 bp, Homo sapiens
gatattgtgatgatgtctttgg

SEQ ID NO: 7268452 - DNA, 22 bp, Homo sapiens
gctgacccctacaggttgtgtt

SEQ ID NO: 7268453 - DNA, 22 bp, Homo sapiens
ggccactgtttcctgggcagtt

SEQ ID NO: 7268454 - DNA, 21 bp, Homo sapiens
ggctggtgtttagctgtgata

SEQ ID NO: 7268455 - DNA, 22 bp, Homo sapiens
ggctggtgttgagtgcctgtag

SEQ ID NO: 7268456 - DNA, 22 bp, Homo sapiens
ggggagcaggctgggctgtctg

SEQ ID NO: 7268457 - DNA, 22 bp, Homo sapiens
caggtgggtacatcacagagac

SEQ ID NO: 7268458 - DNA, 18 bp, Homo sapiens
caggtgggtctcctgccc

SEQ ID NO: 7268459 - DNA, 22 bp, Homo sapiens
caggtgggtgtatgaatgcaaa

SEQ ID NO: 7268460 - DNA, 22 bp, Homo sapiens
tagattcagatatttaggacaa

SEQ ID NO: 7268461 - DNA, 22 bp, Homo sapiens
tggagcagggcatcactgtgcg

SEQ ID NO: 7268462 - DNA, 22 bp, Homo sapiens
tggagcaggccggaagtggctt

SEQ ID NO: 7268463 - DNA, 22 bp, Homo sapiens
tgatttgaaacctttggcaaga

SEQ ID NO: 7268464 - DNA, 22 bp, Homo sapiens
tgatttgttacacaggtgtgtg

SEQ ID NO: 7268465 - DNA, 22 bp, Homo sapiens
tgagggcacctgggattaatgg

SEQ ID NO: 7268466 - DNA, 22 bp, Homo sapiens
ccaggagttggaggttgcagtg

SEQ ID NO: 7268467 - DNA, 22 bp, Homo sapiens
ccaggagtcaataaaggaagct

SEQ ID NO: 7268468 - DNA, 22 bp, Homo sapiens
tgtgtataaaagcagtgcagga

SEQ ID NO: 7268469 - DNA, 22 bp, Homo sapiens
tgtgtatagcagtttccagtct

SEQ ID NO: 7268470 - DNA, 22 bp, Homo sapiens
tgtgtatatatgtgcacatgta

SEQ ID NO: 7268471 - DNA, 22 bp, Homo sapiens
tgtgtatacatacatacacacg

SEQ ID NO: 7268472 - DNA, 22 bp, Homo sapiens
tgtgtataattagaccatttac

SEQ ID NO: 7268473 - DNA, 22 bp, Homo sapiens
tgtgtatgttttgaggttgcta

SEQ ID NO: 7268474 - DNA, 22 bp, Homo sapiens
tgtgtatgtaagcatgtgcata

SEQ ID NO: 7268475 - DNA, 22 bp, Homo sapiens
tgtgtatctgtatacaagtttg

SEQ ID NO: 7268476 - DNA, 22 bp, Homo sapiens
tgtgtatattaggacacattct

SEQ ID NO: 7268477 - DNA, 22 bp, Homo sapiens
cctggtggacagcagccagcag

SEQ ID NO: 7268478 - DNA, 22 bp, Homo sapiens
cggtctcccgtgtgtgtgcgct

SEQ ID NO: 7268479 - DNA, 22 bp, Homo sapiens
ctggctttgatcagagtgacct

SEQ ID NO: 7268480 - DNA, 22 bp, Homo sapiens
gagcggcaggagccacctgcct

SEQ ID NO: 7268481 - DNA, 22 bp, Homo sapiens
ggtggctctcttaagggcagcg

SEQ ID NO: 7268482 - DNA, 17 bp, Homo sapiens
ggtggctcgggcgcggc

SEQ ID NO: 7268483 - DNA, 22 bp, Homo sapiens
ggtggctcggccagtgcaggcc

SEQ ID NO: 7268484 - DNA, 22 bp, Homo sapiens
ggtggctctccctggactcagc

SEQ ID NO: 7268485 - DNA, 22 bp, Homo sapiens
ggtggccttttatgagcagggt

SEQ ID NO: 7268486 - DNA, 22 bp, Homo sapiens
ggggccgaccgcggttcaggcc

SEQ ID NO: 7268487 - DNA, 22 bp, Homo sapiens
gggagagcgggaggtgccacag

SEQ ID NO: 7268488 - DNA, 22 bp, Homo sapiens
gggacagctgtagtgcttggct

SEQ ID NO: 7268489 - DNA, 22 bp, Homo sapiens
gggcagctgcagggatggtgac

SEQ ID NO: 7268490 - DNA, 22 bp, Homo sapiens
gggcagctgccaagtgcatcgc

SEQ ID NO: 7268491 - DNA, 22 bp, Homo sapiens
gggcagctgcccctctctgggc

SEQ ID NO: 7268492 - DNA, 22 bp, Homo sapiens
ggagcagcactgccacacagag

SEQ ID NO: 7268493 - DNA, 22 bp, Homo sapiens
gctggggcctgaacagtcagct

SEQ ID NO: 7268494 - DNA, 22 bp, Homo sapiens
tcagtgatttctggggtgaggg

SEQ ID NO: 7268495 - DNA, 22 bp, Homo sapiens
tcaggagtaaagaagacttgac

SEQ ID NO: 7268496 - DNA, 18 bp, Homo sapiens
tcaggagtttgtggatgg

SEQ ID NO: 7268497 - DNA, 21 bp, Homo sapiens
tcaggagtggagagaattggt

SEQ ID NO: 7268498 - DNA, 22 bp, Homo sapiens
tcaggagtgcagcagtttggag

SEQ ID NO: 7268499 - DNA, 22 bp, Homo sapiens
tcaggatgagtcatcaagctgc

SEQ ID NO: 7268500 - DNA, 22 bp, Homo sapiens
tcaggatgttaatatagcatta

SEQ ID NO: 7268501 - DNA, 22 bp, Homo sapiens
gttgggatgtcaggcctaggtg

SEQ ID NO: 7268502 - DNA, 22 bp, Homo sapiens
gttcagatttgactggtttctc

SEQ ID NO: 7268503 - DNA, 22 bp, Homo sapiens
gtgctccctccttcctcaagga

SEQ ID NO: 7268504 - DNA, 21 bp, Homo sapiens
taggtgggagccccagtatgc

SEQ ID NO: 7268505 - DNA, 22 bp, Homo sapiens
taggtgggtgacttccatgggg

SEQ ID NO: 7268506 - DNA, 22 bp, Homo sapiens
tgttttggtttaagtatatgaa

SEQ ID NO: 7268507 - DNA, 22 bp, Homo sapiens
tgtttcttgataaagcagaaaa

SEQ ID NO: 7268508 - DNA, 22 bp, Homo sapiens
tgtgtaattatagggagatcta

SEQ ID NO: 7268509 - DNA, 22 bp, Homo sapiens
tgtggcagtctcactggagggc

SEQ ID NO: 7268510 - DNA, 22 bp, Homo sapiens
ttcaggagtgtcaggagtgcct

SEQ ID NO: 7268511 - DNA, 22 bp, Homo sapiens
ttcaggagctagggatgtgaaa

SEQ ID NO: 7268512 - DNA, 22 bp, Homo sapiens
ttcaggtgggccttttgagcat

SEQ ID NO: 7268513 - DNA, 22 bp, Homo sapiens
ttgtgaatagtgctgcagtaaa

SEQ ID NO: 7268514 - DNA, 22 bp, Homo sapiens
ttgtgttaaggtgcatctagtg

SEQ ID NO: 7268515 - DNA, 22 bp, Homo sapiens
ttgtgtttctggccaagatgga

SEQ ID NO: 7268516 - DNA, 22 bp, Homo sapiens
tttgtataagaacattctagca

SEQ ID NO: 7268517 - DNA, 22 bp, Homo sapiens
cagaggcacaagaaagcaaggc

SEQ ID NO: 7268518 - DNA, 22 bp, Homo sapiens
cagagggcttcaggttcaggat

SEQ ID NO: 7268519 - DNA, 22 bp, Homo sapiens
cagagggaaaaggggagtaata

SEQ ID NO: 7268520 - DNA, 22 bp, Homo sapiens
ggtccagaagctggtagggtag

SEQ ID NO: 7268521 - DNA, 22 bp, Homo sapiens
ggtccacctccaagctggggac

SEQ ID NO: 7268522 - DNA, 23 bp, Homo sapiens
ggtccacccgagcctgcagcttc

SEQ ID NO: 7268523 - DNA, 22 bp, Homo sapiens
ggtcatctgtaattctgttcct

SEQ ID NO: 7268524 - DNA, 22 bp, Homo sapiens
cagagtcccagatgcccctcct

SEQ ID NO: 7268525 - DNA, 23 bp, Homo sapiens
cagagggttccatggagcatggt

SEQ ID NO: 7268526 - DNA, 21 bp, Homo sapiens
cagagggtttctcaggtgttt

SEQ ID NO: 7268527 - DNA, 22 bp, Homo sapiens
ggtgagaaagggattcctgttc

SEQ ID NO: 7268528 - DNA, 22 bp, Homo sapiens
ggtctgagtggtgctgactcag

SEQ ID NO: 7268529 - DNA, 22 bp, Homo sapiens
ggtctgagtggggcctgagatt

SEQ ID NO: 7268530 - DNA, 22 bp, Homo sapiens
ggtgacagtggttaaaatttgt

SEQ ID NO: 7268531 - DNA, 22 bp, Homo sapiens
cagcacagtagagtagttgtaa

SEQ ID NO: 7268532 - DNA, 22 bp, Homo sapiens
cagcaccatttgcagcctcttt

SEQ ID NO: 7268533 - DNA, 22 bp, Homo sapiens
cagaggcaaaagaggtggaggt

SEQ ID NO: 7268534 - DNA, 22 bp, Homo sapiens
cagaggatgatctggcctctct

SEQ ID NO: 7268535 - DNA, 22 bp, Homo sapiens
cagaggattccctagtgacctg

SEQ ID NO: 7268536 - DNA, 20 bp, Homo sapiens
cagaggcaaggagacttgga

SEQ ID NO: 7268537 - DNA, 22 bp, Homo sapiens
cagaggcacaagaaagcaaggc

SEQ ID NO: 7268538 - DNA, 20 bp, Homo sapiens
cagaggcaaggagacttgga

SEQ ID NO: 7268539 - DNA, 22 bp, Homo sapiens
gggctgaggggtatctcatggg

SEQ ID NO: 7268540 - DNA, 22 bp, Homo sapiens
gggctgagtcatctggggcctc

SEQ ID NO: 7268541 - DNA, 22 bp, Homo sapiens
gggctgagtctgctgcctgtca

SEQ ID NO: 7268542 - DNA, 22 bp, Homo sapiens
gggctgagtgacctcaggccaa

SEQ ID NO: 7268543 - DNA, 19 bp, Homo sapiens
cagagctgctggcctcgtc

SEQ ID NO: 7268544 - DNA, 22 bp, Homo sapiens
cagagctgggatcccatgggcg

SEQ ID NO: 7268545 - DNA, 22 bp, Homo sapiens
gggctcttttctgagcttcact

SEQ ID NO: 7268546 - DNA, 22 bp, Homo sapiens
gggctcttctcaggagctatct

SEQ ID NO: 7268547 - DNA, 22 bp, Homo sapiens
gggcagtgtcgaggtctggtcc

SEQ ID NO: 7268548 - DNA, 22 bp, Homo sapiens
gggcagtgtcggggcccaggga

SEQ ID NO: 7268549 - DNA, 22 bp, Homo sapiens
gggcagtgtctgcaaatgaaca

SEQ ID NO: 7268550 - DNA, 22 bp, Homo sapiens
gggcagtgtctgcaaatgaaca

SEQ ID NO: 7268551 - DNA, 22 bp, Homo sapiens
gggcagtgtctggcccccaggc

SEQ ID NO: 7268552 - DNA, 22 bp, Homo sapiens
gggcagtgtggtcgtgcctttg

SEQ ID NO: 7268553 - DNA, 22 bp, Homo sapiens
cagacccttttctgagaggacc

SEQ ID NO: 7268554 - DNA, 22 bp, Homo sapiens
cagaccctcgggtgagttggcc

SEQ ID NO: 7268555 - DNA, 22 bp, Homo sapiens
cagacagggtcctgtccgtcac

SEQ ID NO: 7268556 - DNA, 22 bp, Homo sapiens
gggcagagaaatggacagttgg

SEQ ID NO: 7268557 - DNA, 22 bp, Homo sapiens
gggcagcatcaggaggggcttt

SEQ ID NO: 7268558 - DNA, 21 bp, Homo sapiens
gggcagcagcagcaacaaggg

SEQ ID NO: 7268559 - DNA, 22 bp, Homo sapiens
gggcagcagagccctgccgagt

SEQ ID NO: 7268560 - DNA, 22 bp, Homo sapiens
gggcagcagcaggaggtctctg

SEQ ID NO: 7268561 - DNA, 22 bp, Homo sapiens
gggcagcatgaggaccctcatc

SEQ ID NO: 7268562 - DNA, 22 bp, Homo sapiens
gggcagcatgtcactagcatgg

SEQ ID NO: 7268563 - DNA, 22 bp, Homo sapiens
gggcagtggtccaggctacagc

SEQ ID NO: 7268564 - DNA, 22 bp, Homo sapiens
gggcagtggttacacagctgag

SEQ ID NO: 7268565 - DNA, 22 bp, Homo sapiens
gggcagtggttacacagctgag

SEQ ID NO: 7268566 - DNA, 22 bp, Homo sapiens
gggcagtgggtggctgcagcct

SEQ ID NO: 7268567 - DNA, 22 bp, Homo sapiens
gggcagtggtccaggctacagc

SEQ ID NO: 7268568 - DNA, 22 bp, Homo sapiens
gggcagtgggaccaggcaccag

SEQ ID NO: 7268569 - DNA, 20 bp, Homo sapiens
gggcagtggcgctatctcag

SEQ ID NO: 7268570 - DNA, 22 bp, Homo sapiens
gggcagtggctcacgcctgtaa

SEQ ID NO: 7268571 - DNA, 22 bp, Homo sapiens
gtgctgagtagaatgaatgcct

SEQ ID NO: 7268572 - DNA, 20 bp, Homo sapiens
cagcctccactcactcagct

SEQ ID NO: 7268573 - DNA, 23 bp, Homo sapiens
cagccctggagatgtgggaggca

SEQ ID NO: 7268574 - DNA, 22 bp, Homo sapiens
cagcctgcagggctgcctgttg

SEQ ID NO: 7268575 - DNA, 22 bp, Homo sapiens
cagcctgagccttctgtagcaa

SEQ ID NO: 7268576 - DNA, 22 bp, Homo sapiens
cagccctgctggttttgggcaa

SEQ ID NO: 7268577 - DNA, 22 bp, Homo sapiens
cagccctgctcttagtgtctcc

SEQ ID NO: 7268578 - DNA, 22 bp, Homo sapiens
cagccctgctgacactgtctga

SEQ ID NO: 7268579 - DNA, 22 bp, Homo sapiens
cagccctgcagccatggcctgt

SEQ ID NO: 7268580 - DNA, 22 bp, Homo sapiens
cagctactcctcccatgacttc

SEQ ID NO: 7268581 - DNA, 22 bp, Homo sapiens
cagctagctaagaaggccagag

SEQ ID NO: 7268582 - DNA, 22 bp, Homo sapiens
cagcctggacagcgaccagagt

SEQ ID NO: 7268583 - DNA, 22 bp, Homo sapiens
cagcctggagccacagcccagg

SEQ ID NO: 7268584 - DNA, 22 bp, Homo sapiens
cagcctggagccacagcccagg

SEQ ID NO: 7268585 - DNA, 22 bp, Homo sapiens
gtcatcttcgcagagtgatttt

SEQ ID NO: 7268586 - DNA, 22 bp, Homo sapiens
gtcatatacactgcatgtaatc

SEQ ID NO: 7268587 - DNA, 22 bp, Homo sapiens
cagcaccctcggaggctgccgt

SEQ ID NO: 7268588 - DNA, 22 bp, Homo sapiens
gtctgcttttctgccctttcat

SEQ ID NO: 7268589 - DNA, 22 bp, Homo sapiens
cagcccctcacagagctgtcct

SEQ ID NO: 7268590 - DNA, 22 bp, Homo sapiens
gtctgtgcagttactagctggt

SEQ ID NO: 7268591 - DNA, 22 bp, Homo sapiens
gtctgtctgttgttgagaagca

SEQ ID NO: 7268592 - DNA, 22 bp, Homo sapiens
gtctgtctctctccagagtgca

SEQ ID NO: 7268593 - DNA, 22 bp, Homo sapiens
cagccctcaggtcctcagcagc

SEQ ID NO: 7268594 - DNA, 22 bp, Homo sapiens
gtctgtattcctgtcggcagcc

SEQ ID NO: 7268595 - DNA, 22 bp, Homo sapiens
gtctgtatttatgcaatgaggg

SEQ ID NO: 7268596 - DNA, 22 bp, Homo sapiens
gtctgtctccctgtgactgaga

SEQ ID NO: 7268597 - DNA, 22 bp, Homo sapiens
ggctgtagttacctgatgaaat

SEQ ID NO: 7268598 - DNA, 22 bp, Homo sapiens
ggctgtaggttggtgctggaca

SEQ ID NO: 7268599 - DNA, 22 bp, Homo sapiens
ggctgtgaaccctggcagtgtg

SEQ ID NO: 7268600 - DNA, 21 bp, Homo sapiens
cactttaatggatatttgttt

SEQ ID NO: 7268601 - DNA, 22 bp, Homo sapiens
cagaaagccctatgtacagtgg

SEQ ID NO: 7268602 - DNA, 22 bp, Homo sapiens
ggctcaatgcaacttctgcctc

SEQ ID NO: 7268603 - DNA, 22 bp, Homo sapiens
ggctcaggctggagtgcagtgg

SEQ ID NO: 7268604 - DNA, 19 bp, Homo sapiens
ggctcagggcgctgccgcc

SEQ ID NO: 7268605 - DNA, 22 bp, Homo sapiens
ggcctgagcagacagcatgatg

SEQ ID NO: 7268606 - DNA, 22 bp, Homo sapiens
ggcctgagcttgggcagcgtat

SEQ ID NO: 7268607 - DNA, 19 bp, Homo sapiens
ggctgagcgccttggctgc

SEQ ID NO: 7268608 - DNA, 22 bp, Homo sapiens
ggctgaggcggcgatgcccttg

SEQ ID NO: 7268609 - DNA, 22 bp, Homo sapiens
ggctgagcttatatatgtgctg

SEQ ID NO: 7268610 - DNA, 22 bp, Homo sapiens
ggctgagccccctctgcgtagg

SEQ ID NO: 7268611 - DNA, 22 bp, Homo sapiens
ggctccaggtttaagggtatgt

SEQ ID NO: 7268612 - DNA, 22 bp, Homo sapiens
ggccgctctccggtgtggatct

SEQ ID NO: 7268613 - DNA, 22 bp, Homo sapiens
cacgcatgtggatcagatgaag

SEQ ID NO: 7268614 - DNA, 22 bp, Homo sapiens
ggcaggtgccagttggcttggg

SEQ ID NO: 7268615 - DNA, 22 bp, Homo sapiens
ggcaggcagtgtggtgtgaaac

SEQ ID NO: 7268616 - DNA, 22 bp, Homo sapiens
ggcaggcaggagcgtgcttggg

SEQ ID NO: 7268617 - DNA, 22 bp, Homo sapiens
ggcaggcatcatgtggtcatta

SEQ ID NO: 7268618 - DNA, 22 bp, Homo sapiens
cacagtgttccagagcagtggt

SEQ ID NO: 7268619 - DNA, 22 bp, Homo sapiens
gctttgcctgtagcattggcct

SEQ ID NO: 7268620 - DNA, 22 bp, Homo sapiens
caagtttacaatgtgtatgtgt

SEQ ID NO: 7268621 - DNA, 22 bp, Homo sapiens
caagtaaagaatcacatttctt

SEQ ID NO: 7268622 - DNA, 22 bp, Homo sapiens
caagtaaacaatatgtgattca

SEQ ID NO: 7268623 - DNA, 22 bp, Homo sapiens
caagtttaaggcactgataagt

SEQ ID NO: 7268624 - DNA, 21 bp, Homo sapiens
gctgttgcccgccgcctcttc

SEQ ID NO: 7268625 - DNA, 22 bp, Homo sapiens
gctgttctttgcatctctggtg

SEQ ID NO: 7268626 - DNA, 22 bp, Homo sapiens
gctggaggatggactggaagaa

SEQ ID NO: 7268627 - DNA, 22 bp, Homo sapiens
caaatgtaaattcttttgaagc

SEQ ID NO: 7268628 - DNA, 22 bp, Homo sapiens
caaatgtataaatgtactttct

SEQ ID NO: 7268629 - DNA, 22 bp, Homo sapiens
caaatgtgtaaggaagtgttag

SEQ ID NO: 7268630 - DNA, 22 bp, Homo sapiens
caaatgtattctcacttcaggg

SEQ ID NO: 7268631 - DNA, 22 bp, Homo sapiens
gctggctgtatcacctggccag

SEQ ID NO: 7268632 - DNA, 20 bp, Homo sapiens
caaggcttctttgatggggt

SEQ ID NO: 7268633 - DNA, 22 bp, Homo sapiens
caaggcttgaattctgatgggt

SEQ ID NO: 7268634 - DNA, 22 bp, Homo sapiens
gctggctggtccagcaggggct

SEQ ID NO: 7268635 - DNA, 22 bp, Homo sapiens
cacaggaagtggtcagtgccag

SEQ ID NO: 7268636 - DNA, 22 bp, Homo sapiens
cacaggaatataagtttgagtt

SEQ ID NO: 7268637 - DNA, 22 bp, Homo sapiens
ggaggcaggaaagacaggttca

SEQ ID NO: 7268638 - DNA, 20 bp, Homo sapiens
cacaggcttacagtttagat

SEQ ID NO: 7268639 - DNA, 22 bp, Homo sapiens
cacaggctgggaagcctaggcc

SEQ ID NO: 7268640 - DNA, 20 bp, Homo sapiens
cacaggcttacagtttagat

SEQ ID NO: 7268641 - DNA, 22 bp, Homo sapiens
cacaggcttccagtccccagct

SEQ ID NO: 7268642 - DNA, 22 bp, Homo sapiens
cacaggcttgtcagcatgaggc

SEQ ID NO: 7268643 - DNA, 22 bp, Homo sapiens
cacaggcttgtcagcatgaggc

SEQ ID NO: 7268644 - DNA, 22 bp, Homo sapiens
cacaggcttttctgacataggc

SEQ ID NO: 7268645 - DNA, 22 bp, Homo sapiens
cacagatgaagtaaacaactct

SEQ ID NO: 7268646 - DNA, 22 bp, Homo sapiens
ggagccctgccctaggcagctc

SEQ ID NO: 7268647 - DNA, 22 bp, Homo sapiens
cacagagctgaacctgggtcat

SEQ ID NO: 7268648 - DNA, 22 bp, Homo sapiens
cacaattttaatacacagtcaa

SEQ ID NO: 7268649 - DNA, 22 bp, Homo sapiens
gctgacagttactgctgtaaca

SEQ ID NO: 7268650 - DNA, 22 bp, Homo sapiens
gctgacagagtgcctggcctca

SEQ ID NO: 7268651 - DNA, 20 bp, Homo sapiens
gctgactgtttgggtggcgg

SEQ ID NO: 7268652 - DNA, 22 bp, Homo sapiens
caaatgatacctattactaggc

SEQ ID NO: 7268653 - DNA, 17 bp, Homo sapiens
gctgaccctggagaagt

SEQ ID NO: 7268654 - DNA, 22 bp, Homo sapiens
gctgactggttgcacagagggt

SEQ ID NO: 7268655 - DNA, 22 bp, Homo sapiens
gctgactgatggacacagcacc

SEQ ID NO: 7268656 - DNA, 22 bp, Homo sapiens
gctgactgctcagggccagctg

SEQ ID NO: 7268657 - DNA, 22 bp, Homo sapiens
caaatggatacaggcaaacatt

SEQ ID NO: 7268658 - DNA, 22 bp, Homo sapiens
caaatggagaattagcagtttg

SEQ ID NO: 7268659 - DNA, 22 bp, Homo sapiens
caaatgcatgagaaataagagg

SEQ ID NO: 7268660 - DNA, 22 bp, Homo sapiens
caaatactgggtaagttaattt

SEQ ID NO: 7268661 - DNA, 22 bp, Homo sapiens
caaagcttggagaagcagctgg

SEQ ID NO: 7268662 - DNA, 22 bp, Homo sapiens
atttttaggctctaccctcaga

SEQ ID NO: 7268663 - DNA, 23 bp, Homo sapiens
atttttagcctctctgagctgag

SEQ ID NO: 7268664 - DNA, 22 bp, Homo sapiens
attttagagctccaagtacagc

SEQ ID NO: 7268665 - DNA, 22 bp, Homo sapiens
attttacttcatttgaaatgcc

SEQ ID NO: 7268666 - DNA, 22 bp, Homo sapiens
attttactttgtgaatattgac

SEQ ID NO: 7268667 - DNA, 22 bp, Homo sapiens
attttactttgtgaatattgac

SEQ ID NO: 7268668 - DNA, 23 bp, Homo sapiens
caaaatggtttaaaagtggcata

SEQ ID NO: 7268669 - DNA, 20 bp, Homo sapiens
caaagcagtaggataaaaat

SEQ ID NO: 7268670 - DNA, 22 bp, Homo sapiens
attttacttagtgtaatgtcca

SEQ ID NO: 7268671 - DNA, 22 bp, Homo sapiens
attttactactccaattaatga

SEQ ID NO: 7268672 - DNA, 22 bp, Homo sapiens
attttactactccaattaatga

SEQ ID NO: 7268673 - DNA, 22 bp, Homo sapiens
gcctgacctcttctgccctggg

SEQ ID NO: 7268674 - DNA, 22 bp, Homo sapiens
gcccccagaagggccacagatt

SEQ ID NO: 7268675 - DNA, 22 bp, Homo sapiens
gcccccagacctcagtgggctg

SEQ ID NO: 7268676 - DNA, 22 bp, Homo sapiens
gcccccagagaatgaggtacga

SEQ ID NO: 7268677 - DNA, 18 bp, Homo sapiens
gcccccagatgctactga

SEQ ID NO: 7268678 - DNA, 22 bp, Homo sapiens
gcccccaggcactacatgtgaa

SEQ ID NO: 7268679 - DNA, 19 bp, Homo sapiens
gcctcacaggtctcaggcc

SEQ ID NO: 7268680 - DNA, 22 bp, Homo sapiens
gcccacctaacctgctcacctt

SEQ ID NO: 7268681 - DNA, 22 bp, Homo sapiens
atttccattttcagccattact

SEQ ID NO: 7268682 - DNA, 22 bp, Homo sapiens
atttccattatcatgacaaatt

SEQ ID NO: 7268683 - DNA, 22 bp, Homo sapiens
atttccatgtcggtattttata

SEQ ID NO: 7268684 - DNA, 22 bp, Homo sapiens
atttccatgtccaaaaattagt

SEQ ID NO: 7268685 - DNA, 22 bp, Homo sapiens
atttccatgaaggcagatttta

SEQ ID NO: 7268686 - DNA, 22 bp, Homo sapiens
atttccatgaagtttagttata

SEQ ID NO: 7268687 - DNA, 22 bp, Homo sapiens
atttccatgaattcccactcat

SEQ ID NO: 7268688 - DNA, 22 bp, Homo sapiens
atttccatgccttagcttaagg

SEQ ID NO: 7268689 - DNA, 22 bp, Homo sapiens
atttccatagagcgtctcacag

SEQ ID NO: 7268690 - DNA, 22 bp, Homo sapiens
atttccatcatcattaggccta

SEQ ID NO: 7268691 - DNA, 22 bp, Homo sapiens
atttccatagagcgtctcacag

SEQ ID NO: 7268692 - DNA, 22 bp, Homo sapiens
atttccatacacccatttctga

SEQ ID NO: 7268693 - DNA, 22 bp, Homo sapiens
gcccacagtgtagcaggtactc

SEQ ID NO: 7268694 - DNA, 22 bp, Homo sapiens
gccacaggtaggaacctacctc

SEQ ID NO: 7268695 - DNA, 22 bp, Homo sapiens
gccacaggtcggctagagggtc

SEQ ID NO: 7268696 - DNA, 22 bp, Homo sapiens
gccaggtgcatggctgagtctc

SEQ ID NO: 7268697 - DNA, 22 bp, Homo sapiens
atttccaggagaaaggatttta

SEQ ID NO: 7268698 - DNA, 22 bp, Homo sapiens
atttccagtcctaatgatctgg

SEQ ID NO: 7268699 - DNA, 22 bp, Homo sapiens
attcaaattaagttaattcagc

SEQ ID NO: 7268700 - DNA, 22 bp, Homo sapiens
attcaaattaagttaattcagc

SEQ ID NO: 7268701 - DNA, 22 bp, Homo sapiens
attagtgtacatctcacacgca

SEQ ID NO: 7268702 - DNA, 22 bp, Homo sapiens
attagtgtctgtgaataattct

SEQ ID NO: 7268703 - DNA, 22 bp, Homo sapiens
attagtgttcttatcttctagg

SEQ ID NO: 7268704 - DNA, 22 bp, Homo sapiens
attagtaaaacattgtatatgt

SEQ ID NO: 7268705 - DNA, 22 bp, Homo sapiens
gcagatgcttggcactgacagt

SEQ ID NO: 7268706 - DNA, 22 bp, Homo sapiens
gcagatgcttggcactgacagt

SEQ ID NO: 7268707 - DNA, 22 bp, Homo sapiens
gcagatgctgtggtgatagaag

SEQ ID NO: 7268708 - DNA, 22 bp, Homo sapiens
gcagatgctgtgtgaatgttgg

SEQ ID NO: 7268709 - DNA, 22 bp, Homo sapiens
attcatctatgactctaatgtg

SEQ ID NO: 7268710 - DNA, 22 bp, Homo sapiens
attcataacggcaaatgtcacc

SEQ ID NO: 7268711 - DNA, 22 bp, Homo sapiens
gcagcagatgctttcatggaca

SEQ ID NO: 7268712 - DNA, 22 bp, Homo sapiens
attcagttgtctactactgcct

SEQ ID NO: 7268713 - DNA, 22 bp, Homo sapiens
gcagtgtgtagagtttaggaaa

SEQ ID NO: 7268714 - DNA, 22 bp, Homo sapiens
gcagtgtgcatggcttttggcc

SEQ ID NO: 7268715 - DNA, 22 bp, Homo sapiens
gcagtgtgtctcttggcttcct

SEQ ID NO: 7268716 - DNA, 22 bp, Homo sapiens
gcagtgtgaccgagcttgcttc

SEQ ID NO: 7268717 - DNA, 22 bp, Homo sapiens
gcagtgtgatgcttccagccac

SEQ ID NO: 7268718 - DNA, 23 bp, Homo sapiens
gcagtgtgaatccagtgtttcag

SEQ ID NO: 7268719 - DNA, 22 bp, Homo sapiens
gcagtgttacttggtttgcaga

SEQ ID NO: 7268720 - DNA, 22 bp, Homo sapiens
gcatacagagaggatgtggcat

SEQ ID NO: 7268721 - DNA, 22 bp, Homo sapiens
gcagtgttaaacaactgctgct

SEQ ID NO: 7268722 - DNA, 22 bp, Homo sapiens
gcagtgttacctcttcagtggg

SEQ ID NO: 7268723 - DNA, 22 bp, Homo sapiens
gcagtgttaatgcgagtgttca

SEQ ID NO: 7268724 - DNA, 22 bp, Homo sapiens
gcagtgttaccttgggctggtt

SEQ ID NO: 7268725 - DNA, 22 bp, Homo sapiens
gcagtgttacttggagtactaa

SEQ ID NO: 7268726 - DNA, 22 bp, Homo sapiens
gcagtgtgtttctgagatatgg

SEQ ID NO: 7268727 - DNA, 22 bp, Homo sapiens
gcagtgtgtggtgagggctgcc

SEQ ID NO: 7268728 - DNA, 22 bp, Homo sapiens
attgtgattagagaatatagag

SEQ ID NO: 7268729 - DNA, 22 bp, Homo sapiens
attgtgcaaatattatctgtag

SEQ ID NO: 7268730 - DNA, 22 bp, Homo sapiens
gccaaataagtggaatcacaca

SEQ ID NO: 7268731 - DNA, 22 bp, Homo sapiens
gcaggcggaggttgcagtgagc

SEQ ID NO: 7268732 - DNA, 22 bp, Homo sapiens
attcttcagtatgtgtggattg

SEQ ID NO: 7268733 - DNA, 22 bp, Homo sapiens
attccttgtttcactgaaaagg

SEQ ID NO: 7268734 - DNA, 22 bp, Homo sapiens
attccttgtatatctacatgca

SEQ ID NO: 7268735 - DNA, 22 bp, Homo sapiens
attccttggcattctggacttg

SEQ ID NO: 7268736 - DNA, 22 bp, Homo sapiens
attccttgggctgccttattat

SEQ ID NO: 7268737 - DNA, 22 bp, Homo sapiens
attccttgggaattattgaatg

SEQ ID NO: 7268738 - DNA, 22 bp, Homo sapiens
attccttgctctcatcaacctt

SEQ ID NO: 7268739 - DNA, 22 bp, Homo sapiens
attccttggaacagatgcgaag

SEQ ID NO: 7268740 - DNA, 22 bp, Homo sapiens
attccttgcacatcagatagtt

SEQ ID NO: 7268741 - DNA, 22 bp, Homo sapiens
gcagctggacccacacggctta

SEQ ID NO: 7268742 - DNA, 19 bp, Homo sapiens
gcagctgcttgaaaagaaa

SEQ ID NO: 7268743 - DNA, 22 bp, Homo sapiens
gcagctgccttcagctggatgg

SEQ ID NO: 7268744 - DNA, 22 bp, Homo sapiens
gcagctgccttcagctggatgg

SEQ ID NO: 7268745 - DNA, 22 bp, Homo sapiens
gcagctgctggagggaggcagg

SEQ ID NO: 7268746 - DNA, 22 bp, Homo sapiens
atgggcagggcagtgtataaga

SEQ ID NO: 7268747 - DNA, 22 bp, Homo sapiens
gaggcagcctcagtggacctcg

SEQ ID NO: 7268748 - DNA, 22 bp, Homo sapiens
gaggcagccagaggttctcatt

SEQ ID NO: 7268749 - DNA, 22 bp, Homo sapiens
gaggcagccagaggttctcatt

SEQ ID NO: 7268750 - DNA, 22 bp, Homo sapiens
gaggcagcggctcacagagaaa

SEQ ID NO: 7268751 - DNA, 22 bp, Homo sapiens
gaggcagcatggtaccttggag

SEQ ID NO: 7268752 - DNA, 22 bp, Homo sapiens
gaggcagcatggtaccttggag

SEQ ID NO: 7268753 - DNA, 22 bp, Homo sapiens
gaggcagcattcgcatagacag

SEQ ID NO: 7268754 - DNA, 22 bp, Homo sapiens
gaggcagcatctatggtgggaa

SEQ ID NO: 7268755 - DNA, 22 bp, Homo sapiens
atggttaaattggttatttatg

SEQ ID NO: 7268756 - DNA, 18 bp, Homo sapiens
atggtctcatactgggag

SEQ ID NO: 7268757 - DNA, 22 bp, Homo sapiens
gaggaaggctaaggggcttaga

SEQ ID NO: 7268758 - DNA, 22 bp, Homo sapiens
atggctttcagatttctatgtt

SEQ ID NO: 7268759 - DNA, 22 bp, Homo sapiens
gagagaggcctccatgtactga

SEQ ID NO: 7268760 - DNA, 22 bp, Homo sapiens
gagagattaccacgcttcctga

SEQ ID NO: 7268761 - DNA, 22 bp, Homo sapiens
gagagcaatggggacgggcagg

SEQ ID NO: 7268762 - DNA, 22 bp, Homo sapiens
gagagcacggtcttgggcatgg

SEQ ID NO: 7268763 - DNA, 22 bp, Homo sapiens
atggagggtggtaagacagaga

SEQ ID NO: 7268764 - DNA, 22 bp, Homo sapiens
atggagggtggtaagacagaga

SEQ ID NO: 7268765 - DNA, 21 bp, Homo sapiens
atggagggaccagggaagcag

SEQ ID NO: 7268766 - DNA, 22 bp, Homo sapiens
atggagggtgtcagagagcgaa

SEQ ID NO: 7268767 - DNA, 17 bp, Homo sapiens
gagatggcattggcagc

SEQ ID NO: 7268768 - DNA, 20 bp, Homo sapiens
atgtgtctgcctctgtgttc

SEQ ID NO: 7268769 - DNA, 17 bp, Homo sapiens
atgtgtctgagtgtcct

SEQ ID NO: 7268770 - DNA, 17 bp, Homo sapiens
atgtgtctgagtgtcct

SEQ ID NO: 7268771 - DNA, 22 bp, Homo sapiens
atgtgtctgaccactgtattgg

SEQ ID NO: 7268772 - DNA, 20 bp, Homo sapiens
atgtgtctgtaaacaactct

SEQ ID NO: 7268773 - DNA, 22 bp, Homo sapiens
atgttctttcagccagtgcatc

SEQ ID NO: 7268774 - DNA, 22 bp, Homo sapiens
atgttcttgttcaaatgtcagt

SEQ ID NO: 7268775 - DNA, 22 bp, Homo sapiens
atgttcttccaaatctgtaaca

SEQ ID NO: 7268776 - DNA, 20 bp, Homo sapiens
atgttgtttactcatagcat

SEQ ID NO: 7268777 - DNA, 22 bp, Homo sapiens
atgttgtgtttgactgttaccc

SEQ ID NO: 7268778 - DNA, 22 bp, Homo sapiens
gataatttgatacctcaatcag

SEQ ID NO: 7268779 - DNA, 22 bp, Homo sapiens
gataattttagtctgaaaattg

SEQ ID NO: 7268780 - DNA, 22 bp, Homo sapiens
atgtctatgttctttactgtgt

SEQ ID NO: 7268781 - DNA, 22 bp, Homo sapiens
atgtctaaaagataaagtttaa

SEQ ID NO: 7268782 - DNA, 22 bp, Homo sapiens
atgtccttggagtccactttcc

SEQ ID NO: 7268783 - DNA, 22 bp, Homo sapiens
atgtcattgccaagatgctaat

SEQ ID NO: 7268784 - DNA, 22 bp, Homo sapiens
gaggcagcgggtcaggaccgtg

SEQ ID NO: 7268785 - DNA, 22 bp, Homo sapiens
gaggcagcggctcacagagaaa

SEQ ID NO: 7268786 - DNA, 22 bp, Homo sapiens
gacggcagaaactcatgaggtc

SEQ ID NO: 7268787 - DNA, 22 bp, Homo sapiens
atgctattttacataggaatgg

SEQ ID NO: 7268788 - DNA, 20 bp, Homo sapiens
atgctcgttgggtttcttcc

SEQ ID NO: 7268789 - DNA, 22 bp, Homo sapiens
atgctcctcgagtgtctcacag

SEQ ID NO: 7268790 - DNA, 18 bp, Homo sapiens
atgctcctatctctgagc

SEQ ID NO: 7268791 - DNA, 18 bp, Homo sapiens
atgctcctatctctgagc

SEQ ID NO: 7268792 - DNA, 22 bp, Homo sapiens
gaccttgtgatctgcccacctt

SEQ ID NO: 7268793 - DNA, 22 bp, Homo sapiens
atgctctggccctttgaacgct

SEQ ID NO: 7268794 - DNA, 22 bp, Homo sapiens
atgctctgatgctgttaaatgt

SEQ ID NO: 7268795 - DNA, 22 bp, Homo sapiens
gaccaaggccctcagtgggagg

SEQ ID NO: 7268796 - DNA, 22 bp, Homo sapiens
gacaatttctcaatatagaaac

SEQ ID NO: 7268797 - DNA, 22 bp, Homo sapiens
gaaggctgtttctggtagtgat

SEQ ID NO: 7268798 - DNA, 16 bp, Homo sapiens
gaaggctgggtgatcc

SEQ ID NO: 7268799 - DNA, 22 bp, Homo sapiens
gaaggctggggcatcagtgaaa

SEQ ID NO: 7268800 - DNA, 22 bp, Homo sapiens
gaaggctgtcagagaggagggc

SEQ ID NO: 7268801 - DNA, 22 bp, Homo sapiens
gaaggctgtggctggtctcagt

SEQ ID NO: 7268802 - DNA, 22 bp, Homo sapiens
gaatattttcagtacagatggt

SEQ ID NO: 7268803 - DNA, 22 bp, Homo sapiens
gaatcaattgtgaagactatga

SEQ ID NO: 7268804 - DNA, 22 bp, Homo sapiens
atgatgctgttattatctatac

SEQ ID NO: 7268805 - DNA, 22 bp, Homo sapiens
atgatgctgttattatctatac

SEQ ID NO: 7268806 - DNA, 22 bp, Homo sapiens
atgatgctgtttatcatatact

SEQ ID NO: 7268807 - DNA, 22 bp, Homo sapiens
atgatgctgtttatcatatact

SEQ ID NO: 7268808 - DNA, 22 bp, Homo sapiens
atgatatttgcaatgtgcttgc

SEQ ID NO: 7268809 - DNA, 22 bp, Homo sapiens
atgacaggtgattttatgcttt

SEQ ID NO: 7268810 - DNA, 22 bp, Homo sapiens
atgacaggtatgccttataatc

SEQ ID NO: 7268811 - DNA, 22 bp, Homo sapiens
atgacagccttgggtacgagag

SEQ ID NO: 7268812 - DNA, 22 bp, Homo sapiens
atgacatcactacattattcct

SEQ ID NO: 7268813 - DNA, 22 bp, Homo sapiens
atgacatcaacagtggtgctgt

SEQ ID NO: 7268814 - DNA, 22 bp, Homo sapiens
atgacatgacctggtagagaca

SEQ ID NO: 7268815 - DNA, 22 bp, Homo sapiens
atgacatgaataaaaatcgtgt

SEQ ID NO: 7268816 - DNA, 22 bp, Homo sapiens
atgacatgattctttctttcat

SEQ ID NO: 7268817 - DNA, 22 bp, Homo sapiens
atgacatgaggcatctttggag

SEQ ID NO: 7268818 - DNA, 22 bp, Homo sapiens
atgaaacacacacgcgcatact

SEQ ID NO: 7268819 - DNA, 22 bp, Homo sapiens
atgaaacagtgtgtatagcaaa

SEQ ID NO: 7268820 - DNA, 22 bp, Homo sapiens
ctttctgattttaagctctaat

SEQ ID NO: 7268821 - DNA, 22 bp, Homo sapiens
ctttctgatgtaaggaactagg

SEQ ID NO: 7268822 - DNA, 22 bp, Homo sapiens
cttcttgtcaatttgccattgt

SEQ ID NO: 7268823 - DNA, 22 bp, Homo sapiens
ctttcccttagccccattctat

SEQ ID NO: 7268824 - DNA, 22 bp, Homo sapiens
ctttccccagtatatcattgcc

SEQ ID NO: 7268825 - DNA, 22 bp, Homo sapiens
ctttccctgcttagaaggattt

SEQ ID NO: 7268826 - DNA, 22 bp, Homo sapiens
ctttccccaagcaccacagtgc

SEQ ID NO: 7268827 - DNA, 22 bp, Homo sapiens
ctttccccagtatatcattgcc

SEQ ID NO: 7268828 - DNA, 22 bp, Homo sapiens
cctgtcctccaagagcacatct

SEQ ID NO: 7268829 - DNA, 22 bp, Homo sapiens
cctgggcataaatcactccaag

SEQ ID NO: 7268830 - DNA, 22 bp, Homo sapiens
cctgggctttcaaaaccagcct

SEQ ID NO: 7268831 - DNA, 22 bp, Homo sapiens
cctgccagccagatcactcgcc

SEQ ID NO: 7268832 - DNA, 22 bp, Homo sapiens
cctgccagcgcttatctctcgg

SEQ ID NO: 7268833 - DNA, 22 bp, Homo sapiens
aggtagggggtttgggaactgc

SEQ ID NO: 7268834 - DNA, 22 bp, Homo sapiens
aggtaggccctgagtgctgttg

SEQ ID NO: 7268835 - DNA, 22 bp, Homo sapiens
agtattgtgactcaagtattct

SEQ ID NO: 7268836 - DNA, 22 bp, Homo sapiens
agtattgtgactcaagtattct

SEQ ID NO: 7268837 - DNA, 22 bp, Homo sapiens
ctacccagatccaggatggcta

SEQ ID NO: 7268838 - DNA, 22 bp, Homo sapiens
ctacccagcacctaggctgcct

SEQ ID NO: 7268839 - DNA, 22 bp, Homo sapiens
ctacccaggctggagtgcagta

SEQ ID NO: 7268840 - DNA, 22 bp, Homo sapiens
ctacccagagtgaatctcttaa

SEQ ID NO: 7268841 - DNA, 22 bp, Homo sapiens
ctagtattaagtgtgagtaaaa

SEQ ID NO: 7268842 - DNA, 22 bp, Homo sapiens
agtcccatttgtgaccttggga

SEQ ID NO: 7268843 - DNA, 22 bp, Homo sapiens
agtcccattgcaagttatgcga

SEQ ID NO: 7268844 - DNA, 16 bp, Homo sapiens
agtcccatgtttgagt

SEQ ID NO: 7268845 - DNA, 22 bp, Homo sapiens
agtcccatgtcattatttctgc

SEQ ID NO: 7268846 - DNA, 22 bp, Homo sapiens
agtccatgctgtctacagaatc

SEQ ID NO: 7268847 - DNA, 22 bp, Homo sapiens
agtccatggttctgactcatct

SEQ ID NO: 7268848 - DNA, 19 bp, Homo sapiens
agtccatgaatggaggatg

SEQ ID NO: 7268849 - DNA, 22 bp, Homo sapiens
ctagggtcaggggcctgcgtcg

SEQ ID NO: 7268850 - DNA, 22 bp, Homo sapiens
ctaggtgatccactgctctctt

SEQ ID NO: 7268851 - DNA, 22 bp, Homo sapiens
ctaggtgatccactgctctctt

SEQ ID NO: 7268852 - DNA, 22 bp, Homo sapiens
agtccaaggttcatggcacaga

SEQ ID NO: 7268853 - DNA, 22 bp, Homo sapiens
ctaaactttgtttatactctga

SEQ ID NO: 7268854 - DNA, 22 bp, Homo sapiens
ctaaacttcttggcaattttat

SEQ ID NO: 7268855 - DNA, 22 bp, Homo sapiens
cgggcactgcctttgttgattt

SEQ ID NO: 7268856 - DNA, 22 bp, Homo sapiens
cgggcgcactccgggcagctgt

SEQ ID NO: 7268857 - DNA, 22 bp, Homo sapiens
cgcagggatttcaaggggcctt

SEQ ID NO: 7268858 - DNA, 22 bp, Homo sapiens
agttataatctgctactgatat

SEQ ID NO: 7268859 - DNA, 22 bp, Homo sapiens
ctgagctgggactcagtagcaa

SEQ ID NO: 7268860 - DNA, 22 bp, Homo sapiens
ctgaggagaggtggcctgtgtt

SEQ ID NO: 7268861 - DNA, 22 bp, Homo sapiens
ctctgcctgtgtcgccaccaca

SEQ ID NO: 7268862 - DNA, 22 bp, Homo sapiens
ctctgcgccaccctcgcctgct

SEQ ID NO: 7268863 - DNA, 22 bp, Homo sapiens
ctctgctgagccagagtcccca

SEQ ID NO: 7268864 - DNA, 21 bp, Homo sapiens
ctctgctgagtcctaggattc

SEQ ID NO: 7268865 - DNA, 22 bp, Homo sapiens
ctctgcaggccttgagtgtggt

SEQ ID NO: 7268866 - DNA, 22 bp, Homo sapiens
ctccagctgagtaagaacacta

SEQ ID NO: 7268867 - DNA, 22 bp, Homo sapiens
ctccagcttctgcccagagact

SEQ ID NO: 7268868 - DNA, 22 bp, Homo sapiens
ctccaggaaaatagggaatgag

SEQ ID NO: 7268869 - DNA, 22 bp, Homo sapiens
ctccaggaaagcctgaggcccg

SEQ ID NO: 7268870 - DNA, 22 bp, Homo sapiens
ctccaggctggggtgcaggttg

SEQ ID NO: 7268871 - DNA, 22 bp, Homo sapiens
ctccaggctggatccaagtcaa

SEQ ID NO: 7268872 - DNA, 22 bp, Homo sapiens
agtcctggacttggagtcaggg

SEQ ID NO: 7268873 - DNA, 22 bp, Homo sapiens
agtcctggccccaaggaaggat

SEQ ID NO: 7268874 - DNA, 22 bp, Homo sapiens
agtcctggcatggaattgtccc

SEQ ID NO: 7268875 - DNA, 22 bp, Homo sapiens
agtcctggcatataggtcctca

SEQ ID NO: 7268876 - DNA, 18 bp, Homo sapiens
agtcctggagatcaccaa

SEQ ID NO: 7268877 - DNA, 22 bp, Homo sapiens
ctcatggagggagtgctcttcc

SEQ ID NO: 7268878 - DNA, 19 bp, Homo sapiens
agtcctggcctgggggacc

SEQ ID NO: 7268879 - DNA, 22 bp, Homo sapiens
agtcctggctctacgggcttca

SEQ ID NO: 7268880 - DNA, 18 bp, Homo sapiens
agtcctggctctaccacc

SEQ ID NO: 7268881 - DNA, 22 bp, Homo sapiens
agtcctgggtccagcaggtcct

SEQ ID NO: 7268882 - DNA, 19 bp, Homo sapiens
agtggcagatctggaagta

SEQ ID NO: 7268883 - DNA, 22 bp, Homo sapiens
agtggcagagtgcactcaggca

SEQ ID NO: 7268884 - DNA, 22 bp, Homo sapiens
agtggcagaggttgactgcagt

SEQ ID NO: 7268885 - DNA, 22 bp, Homo sapiens
agtggcagaagccaagtctgca

SEQ ID NO: 7268886 - DNA, 22 bp, Homo sapiens
ctccctctcaccggagccctgg

SEQ ID NO: 7268887 - DNA, 22 bp, Homo sapiens
ctccctcaggccttagccctgc

SEQ ID NO: 7268888 - DNA, 18 bp, Homo sapiens
ctccagggaactcagtca

SEQ ID NO: 7268889 - DNA, 22 bp, Homo sapiens
ctccagggaaaggggcgtccgc

SEQ ID NO: 7268890 - DNA, 19 bp, Homo sapiens
atacagatgtatccatgat

SEQ ID NO: 7268891 - DNA, 22 bp, Homo sapiens
ctggagaagccaaactagtcac

SEQ ID NO: 7268892 - DNA, 17 bp, Homo sapiens
ctggagaagcctgtgga

SEQ ID NO: 7268893 - DNA, 22 bp, Homo sapiens
ctgctgccattagggcacagac

SEQ ID NO: 7268894 - DNA, 22 bp, Homo sapiens
ctgctgccaagggtgccacagg

SEQ ID NO: 7268895 - DNA, 22 bp, Homo sapiens
ctggaatgcctccctgtcagag

SEQ ID NO: 7268896 - DNA, 22 bp, Homo sapiens
ctggaatgaagctatgtacatt

SEQ ID NO: 7268897 - DNA, 22 bp, Homo sapiens
ctggaatgggagtcagacagag

SEQ ID NO: 7268898 - DNA, 21 bp, Homo sapiens
atacattctattaagcattta

SEQ ID NO: 7268899 - DNA, 22 bp, Homo sapiens
atacctgtgtatccacaagcgt

SEQ ID NO: 7268900 - DNA, 22 bp, Homo sapiens
atacagtgaatacttacagtgt

SEQ ID NO: 7268901 - DNA, 22 bp, Homo sapiens
atacagtgccccttttcacatg

SEQ ID NO: 7268902 - DNA, 22 bp, Homo sapiens
atacagtgtactatttagcagt

SEQ ID NO: 7268903 - DNA, 22 bp, Homo sapiens
atacatacatgtatgcacatac

SEQ ID NO: 7268904 - DNA, 17 bp, Homo sapiens
atacagtttattttaca

SEQ ID NO: 7268905 - DNA, 22 bp, Homo sapiens
atactaaagtatagaacttagt

SEQ ID NO: 7268906 - DNA, 22 bp, Homo sapiens
ctggctggccatgcagcgccag

SEQ ID NO: 7268907 - DNA, 22 bp, Homo sapiens
ctggctggccggagcgaggcgg

SEQ ID NO: 7268908 - DNA, 22 bp, Homo sapiens
ctggctggcaagtagaacacaa

SEQ ID NO: 7268909 - DNA, 22 bp, Homo sapiens
ctgcatcctaacctccatgcag

SEQ ID NO: 7268910 - DNA, 22 bp, Homo sapiens
ctgcatctcaggagacgggtct

SEQ ID NO: 7268911 - DNA, 22 bp, Homo sapiens
ctgcatcctggaaatagctaag

SEQ ID NO: 7268912 - DNA, 22 bp, Homo sapiens
ctgcattagtcatgctttgcag

SEQ ID NO: 7268913 - DNA, 22 bp, Homo sapiens
ctgcatgtcactctgctgtccc

SEQ ID NO: 7268914 - DNA, 22 bp, Homo sapiens
ctgcatctctgctagtcagtca

SEQ ID NO: 7268915 - DNA, 22 bp, Homo sapiens
ctgcatggttcaaatgagctaa

SEQ ID NO: 7268916 - DNA, 22 bp, Homo sapiens
ctgcaaatcaagttcttataat

SEQ ID NO: 7268917 - DNA, 22 bp, Homo sapiens
agttattactctttaacatatt

SEQ ID NO: 7268918 - DNA, 22 bp, Homo sapiens
ctgaggagcagctggcccgcta

SEQ ID NO: 7268919 - DNA, 22 bp, Homo sapiens
ctgaggagcaaccccgtgccct

SEQ ID NO: 7268920 - DNA, 22 bp, Homo sapiens
ctgaggagctgaaggccctcca

SEQ ID NO: 7268921 - DNA, 22 bp, Homo sapiens
agttatatgtgaaaacacgtat

SEQ ID NO: 7268922 - DNA, 22 bp, Homo sapiens
ctgcctctcagcctgaccgcca

SEQ ID NO: 7268923 - DNA, 22 bp, Homo sapiens
ctgcctctcaggtccctgagat

SEQ ID NO: 7268924 - DNA, 22 bp, Homo sapiens
ctgcctctccccagagtggccc

SEQ ID NO: 7268925 - DNA, 22 bp, Homo sapiens
ataaatgaacattcacagagct

SEQ ID NO: 7268926 - DNA, 21 bp, Homo sapiens
ataagcatgctgattacattt

SEQ ID NO: 7268927 - DNA, 22 bp, Homo sapiens
ataagcatgttagaatatttga

SEQ ID NO: 7268928 - DNA, 22 bp, Homo sapiens
atacaacagaaaatgattattc

SEQ ID NO: 7268929 - DNA, 22 bp, Homo sapiens
atacaactttacatgcaattcc

SEQ ID NO: 7268930 - DNA, 22 bp, Homo sapiens
atattactctgatttagtaaat

SEQ ID NO: 7268931 - DNA, 22 bp, Homo sapiens
atattcatcgtgtagaaatact

SEQ ID NO: 7268932 - DNA, 22 bp, Homo sapiens
ctgggctcacctgtggctggca

SEQ ID NO: 7268933 - DNA, 22 bp, Homo sapiens
ctggctgggagcgagctgctca

SEQ ID NO: 7268934 - DNA, 22 bp, Homo sapiens
atattgagatgaggatattaac

SEQ ID NO: 7268935 - DNA, 22 bp, Homo sapiens
atattgagataagaactgacat

SEQ ID NO: 7268936 - DNA, 22 bp, Homo sapiens
atatttaaacagggtaccaata

SEQ ID NO: 7268937 - DNA, 22 bp, Homo sapiens
atattgtactagggttacatgt

SEQ ID NO: 7268938 - DNA, 22 bp, Homo sapiens
atattgtactagggttacatgt

SEQ ID NO: 7268939 - DNA, 22 bp, Homo sapiens
atatttaactggtcccaatata

SEQ ID NO: 7268940 - DNA, 21 bp, Homo sapiens
atcagaaaatgtaatggagca

SEQ ID NO: 7268941 - DNA, 22 bp, Homo sapiens
cttcattaatgtctataagttt

SEQ ID NO: 7268942 - DNA, 22 bp, Homo sapiens
cttcccacagaattcaatcagt

SEQ ID NO: 7268943 - DNA, 22 bp, Homo sapiens
cttccaggtgctggcctggcct

SEQ ID NO: 7268944 - DNA, 22 bp, Homo sapiens
atctgacaaggccacatattct

SEQ ID NO: 7268945 - DNA, 22 bp, Homo sapiens
atctgcagaggacaggcgagga

SEQ ID NO: 7268946 - DNA, 22 bp, Homo sapiens
atctgcaggaatgtgtgcagag

SEQ ID NO: 7268947 - DNA, 22 bp, Homo sapiens
cttcttaatgcataaactgtgt

SEQ ID NO: 7268948 - DNA, 22 bp, Homo sapiens
ctgtgtgcatagttgtgctcaa

SEQ ID NO: 7268949 - DNA, 22 bp, Homo sapiens
atcctgaaaacttacgaagtgg

SEQ ID NO: 7268950 - DNA, 22 bp, Homo sapiens
ctgtgtgctcggatggactcgt

SEQ ID NO: 7268951 - DNA, 22 bp, Homo sapiens
ctgtggctaggaagctgtggga

SEQ ID NO: 7268952 - DNA, 22 bp, Homo sapiens
ctgtggctaataattagtattt

SEQ ID NO: 7268953 - DNA, 15 bp, Homo sapiens
ctgtggctaacctaa

SEQ ID NO: 7268954 - DNA, 22 bp, Homo sapiens
atcagagaccggtcaagtcatg

SEQ ID NO: 7268955 - DNA, 22 bp, Homo sapiens
ctgtggcttttccggggagcct

SEQ ID NO: 7268956 - DNA, 22 bp, Homo sapiens
ctgtggctttgtgtctattgta

SEQ ID NO: 7268957 - DNA, 22 bp, Homo sapiens
ctgtggctttggggcggaggac

SEQ ID NO: 7268958 - DNA, 22 bp, Homo sapiens
ctgtggctcaggcctgtaagcc

SEQ ID NO: 7268959 - DNA, 22 bp, Homo sapiens
ctgtggctcagcacggggtcag

SEQ ID NO: 7268960 - DNA, 22 bp, Homo sapiens
ctgtggctaggattattcctga

SEQ ID NO: 7268961 - DNA, 22 bp, Homo sapiens
ctgtggctatggtgtacatact

SEQ ID NO: 7268962 - DNA, 22 bp, Homo sapiens
ctgtggctcaattgcctactga

SEQ ID NO: 7268963 - DNA, 22 bp, Homo sapiens
ctgtggctcaaaatcccatgat

SEQ ID NO: 7268964 - DNA, 22 bp, Homo sapiens
ctgtggctcaaaatcccatgat

SEQ ID NO: 7268965 - DNA, 22 bp, Homo sapiens
agggggtcgtccggaagacctg

SEQ ID NO: 7268966 - DNA, 22 bp, Homo sapiens
cctcttcacctcgggcacactg

SEQ ID NO: 7268967 - DNA, 22 bp, Homo sapiens
cctcttcaggcactcgaaggcc

SEQ ID NO: 7268968 - DNA, 22 bp, Homo sapiens
agggggtgcatttgtgaatgaa

SEQ ID NO: 7268969 - DNA, 22 bp, Homo sapiens
agggggtgcccagatgaaggat

SEQ ID NO: 7268970 - DNA, 22 bp, Homo sapiens
agggggtgtctctgattgggtt

SEQ ID NO: 7268971 - DNA, 20 bp, Homo sapiens
agggctgagaagggactagc

SEQ ID NO: 7268972 - DNA, 22 bp, Homo sapiens
agggctgagactaaggccagat

SEQ ID NO: 7268973 - DNA, 22 bp, Homo sapiens
cctcaggtgtgggccagctgtc

SEQ ID NO: 7268974 - DNA, 22 bp, Homo sapiens
cctcagggtctctcacagcacc

SEQ ID NO: 7268975 - DNA, 22 bp, Homo sapiens
cctacagttatattcttgattg

SEQ ID NO: 7268976 - DNA, 22 bp, Homo sapiens
ccctggcagagggggcaggtgc

SEQ ID NO: 7268977 - DNA, 22 bp, Homo sapiens
cccaggaatgagcaggcagggg

SEQ ID NO: 7268978 - DNA, 22 bp, Homo sapiens
cccaggaagtggaggttgcagt

SEQ ID NO: 7268979 - DNA, 22 bp, Homo sapiens
cccaggaagagtgagtggcatt

SEQ ID NO: 7268980 - DNA, 22 bp, Homo sapiens
cccaggaagaggggtcaggtgt

SEQ ID NO: 7268981 - DNA, 22 bp, Homo sapiens
cccaggaaatcaggctttctag

SEQ ID NO: 7268982 - DNA, 22 bp, Homo sapiens
cccaggaagaaattctgatttg

SEQ ID NO: 7268983 - DNA, 22 bp, Homo sapiens
cccaggaactccagagctcctc

SEQ ID NO: 7268984 - DNA, 22 bp, Homo sapiens
cccaggaacctaccagctcgag

SEQ ID NO: 7268985 - DNA, 22 bp, Homo sapiens
cccaggaacagggctcagaccc

SEQ ID NO: 7268986 - DNA, 22 bp, Homo sapiens
cccaggaacagcacagaacagc

SEQ ID NO: 7268987 - DNA, 22 bp, Homo sapiens
cccaggaaatgaacttctgatt

SEQ ID NO: 7268988 - DNA, 22 bp, Homo sapiens
cccaggaaatgggctcttgcct

SEQ ID NO: 7268989 - DNA, 21 bp, Homo sapiens
agggaaaaggctgagtgaggg

SEQ ID NO: 7268990 - DNA, 22 bp, Homo sapiens
agggacccatagagagaccagt

SEQ ID NO: 7268991 - DNA, 22 bp, Homo sapiens
agggactatttacccatctcac

SEQ ID NO: 7268992 - DNA, 22 bp, Homo sapiens
agggactatttacccatctcac

SEQ ID NO: 7268993 - DNA, 22 bp, Homo sapiens
cccaggccccagggcttgtcag

SEQ ID NO: 7268994 - DNA, 22 bp, Homo sapiens
cccaggccagaacttggttgct

SEQ ID NO: 7268995 - DNA, 22 bp, Homo sapiens
agggagctgagctgtgagcagc

SEQ ID NO: 7268996 - DNA, 21 bp, Homo sapiens
agggagctggccacacagcct

SEQ ID NO: 7268997 - DNA, 22 bp, Homo sapiens
agggagcttccgaactacagct

SEQ ID NO: 7268998 - DNA, 22 bp, Homo sapiens
agggagcttctggcctcagcct

SEQ ID NO: 7268999 - DNA, 22 bp, Homo sapiens
cccctgccagctatccctgaac

SEQ ID NO: 7269000 - DNA, 22 bp, Homo sapiens
agggcagactaggatggaagtg

SEQ ID NO: 7269001 - DNA, 21 bp, Homo sapiens
agggagctttaggtagaagtt

SEQ ID NO: 7269002 - DNA, 22 bp, Homo sapiens
cccaggtgctgcgtgaagcctc

SEQ ID NO: 7269003 - DNA, 22 bp, Homo sapiens
aggctgtggccctggtctagca

SEQ ID NO: 7269004 - DNA, 21 bp, Homo sapiens
cccacggaatgatgaggcact

SEQ ID NO: 7269005 - DNA, 17 bp, Homo sapiens
cccacggaggtgtgaaa

SEQ ID NO: 7269006 - DNA, 22 bp, Homo sapiens
ccagtgtgaccatctgttagct

SEQ ID NO: 7269007 - DNA, 22 bp, Homo sapiens
ccagtgtgattgttgcaagaat

SEQ ID NO: 7269008 - DNA, 21 bp, Homo sapiens
aggctgcatgcatgagtgtgg

SEQ ID NO: 7269009 - DNA, 22 bp, Homo sapiens
aggctgagtcgggaggatcact

SEQ ID NO: 7269010 - DNA, 22 bp, Homo sapiens
aggctctgtcaggcggagcagc

SEQ ID NO: 7269011 - DNA, 22 bp, Homo sapiens
aggctgagtcgggaggatcact

SEQ ID NO: 7269012 - DNA, 21 bp, Homo sapiens
ccagtattatttctctatgta

SEQ ID NO: 7269013 - DNA, 20 bp, Homo sapiens
ccaggcctgggcctgctcta

SEQ ID NO: 7269014 - DNA, 22 bp, Homo sapiens
aggctctgcttttctggatata

SEQ ID NO: 7269015 - DNA, 19 bp, Homo sapiens
aggctctgtaggagagggc

SEQ ID NO: 7269016 - DNA, 22 bp, Homo sapiens
ccaggaggggtctctgtctccc

SEQ ID NO: 7269017 - DNA, 21 bp, Homo sapiens
aggccctggaggtcagagaaa

SEQ ID NO: 7269018 - DNA, 22 bp, Homo sapiens
ccagctccaggtagatgggcag

SEQ ID NO: 7269019 - DNA, 22 bp, Homo sapiens
aggccctgctttccagagctca

SEQ ID NO: 7269020 - DNA, 22 bp, Homo sapiens
ccagctcccgcaggctgcacag

SEQ ID NO: 7269021 - DNA, 22 bp, Homo sapiens
ccagctccctgaagcctggtct

SEQ ID NO: 7269022 - DNA, 22 bp, Homo sapiens
aggctagatagagggtcatctt

SEQ ID NO: 7269023 - DNA, 22 bp, Homo sapiens
aggctcagaggtgagcatctgc

SEQ ID NO: 7269024 - DNA, 22 bp, Homo sapiens
ccagccctgattagagaatgtc

SEQ ID NO: 7269025 - DNA, 22 bp, Homo sapiens
ccagccctgaaccctgctgcat

SEQ ID NO: 7269026 - DNA, 23 bp, Homo sapiens
ccagccctccaccagctctaggc

SEQ ID NO: 7269027 - DNA, 22 bp, Homo sapiens
ccagccctcctccatcagagga

SEQ ID NO: 7269028 - DNA, 17 bp, Homo sapiens
ccagccctcgcgctttt

SEQ ID NO: 7269029 - DNA, 22 bp, Homo sapiens
ccagccagatgataagctctat

SEQ ID NO: 7269030 - DNA, 22 bp, Homo sapiens
ccagccaggcattgcaaactga

SEQ ID NO: 7269031 - DNA, 22 bp, Homo sapiens
ccagccagtatattccaaagcc

SEQ ID NO: 7269032 - DNA, 19 bp, Homo sapiens
aggcaggtgcagaggtccc

SEQ ID NO: 7269033 - DNA, 20 bp, Homo sapiens
ccactccaggtgattctgat

SEQ ID NO: 7269034 - DNA, 22 bp, Homo sapiens
aggcaggtcccctggaaggcac

SEQ ID NO: 7269035 - DNA, 22 bp, Homo sapiens
caggcagctcaaccttgggagc

SEQ ID NO: 7269036 - DNA, 22 bp, Homo sapiens
caggcagctcgatgccttgttg

SEQ ID NO: 7269037 - DNA, 22 bp, Homo sapiens
caggcaggtcagtgaagaagga

SEQ ID NO: 7269038 - DNA, 22 bp, Homo sapiens
caggcagcgctcgtggcctggc

SEQ ID NO: 7269039 - DNA, 22 bp, Homo sapiens
caggcagcgctcgtggcctggc

SEQ ID NO: 7269040 - DNA, 22 bp, Homo sapiens
caggcagctagatttataacaa

SEQ ID NO: 7269041 - DNA, 22 bp, Homo sapiens
caggcagcgtcctgcttcctgt

SEQ ID NO: 7269042 - DNA, 22 bp, Homo sapiens
caggcagccttctcgtctcaca

SEQ ID NO: 7269043 - DNA, 22 bp, Homo sapiens
caggcagcctgcggtctgcaca

SEQ ID NO: 7269044 - DNA, 22 bp, Homo sapiens
caggcagcctgcggtctgcaca

SEQ ID NO: 7269045 - DNA, 22 bp, Homo sapiens
agcttcccaaggttggaaggtt

SEQ ID NO: 7269046 - DNA, 18 bp, Homo sapiens
agcttccctctgagaggg

SEQ ID NO: 7269047 - DNA, 22 bp, Homo sapiens
agcttcctgttgagagagggag

SEQ ID NO: 7269048 - DNA, 22 bp, Homo sapiens
agcttcctgatgcaagagggct

SEQ ID NO: 7269049 - DNA, 22 bp, Homo sapiens
caggatggagggagggctgtta

SEQ ID NO: 7269050 - DNA, 22 bp, Homo sapiens
caggatggcagagaaaagggtg

SEQ ID NO: 7269051 - DNA, 22 bp, Homo sapiens
caggatggccccggggctgtgc

SEQ ID NO: 7269052 - DNA, 22 bp, Homo sapiens
caggatgggatgtagtgggccc

SEQ ID NO: 7269053 - DNA, 22 bp, Homo sapiens
caggatggtcagatgcattgtc

SEQ ID NO: 7269054 - DNA, 22 bp, Homo sapiens
caggagaaatgtggctgctacc

SEQ ID NO: 7269055 - DNA, 22 bp, Homo sapiens
caggactgaagggcacagggaa

SEQ ID NO: 7269056 - DNA, 22 bp, Homo sapiens
cagctgttcttgggacagacag

SEQ ID NO: 7269057 - DNA, 22 bp, Homo sapiens
cagctgttactctgagtaaatg

SEQ ID NO: 7269058 - DNA, 22 bp, Homo sapiens
cagctgttcacatttccaaaac

SEQ ID NO: 7269059 - DNA, 22 bp, Homo sapiens
cagctgttcggggctggcatgt

SEQ ID NO: 7269060 - DNA, 22 bp, Homo sapiens
aggacagacctaggactggagc

SEQ ID NO: 7269061 - DNA, 22 bp, Homo sapiens
aggaagtggggttctctcactg

SEQ ID NO: 7269062 - DNA, 22 bp, Homo sapiens
cagtaaagcatgtatgtcttca

SEQ ID NO: 7269063 - DNA, 22 bp, Homo sapiens
aggacagagggaccagagccca

SEQ ID NO: 7269064 - DNA, 20 bp, Homo sapiens
cagtattgatccattgtctg

SEQ ID NO: 7269065 - DNA, 22 bp, Homo sapiens
aggaagagcccgggtgacataa

SEQ ID NO: 7269066 - DNA, 22 bp, Homo sapiens
cagggctggcttccaagttgtt

SEQ ID NO: 7269067 - DNA, 22 bp, Homo sapiens
aggaaaggcctttgcatttggt

SEQ ID NO: 7269068 - DNA, 22 bp, Homo sapiens
cagggcagtaacgggaacatct

SEQ ID NO: 7269069 - DNA, 22 bp, Homo sapiens
caggctgacaactgagcatttt

SEQ ID NO: 7269070 - DNA, 22 bp, Homo sapiens
caggctgaagtgcagtggtgtg

SEQ ID NO: 7269071 - DNA, 20 bp, Homo sapiens
catcttgaaggtcttccaca

SEQ ID NO: 7269072 - DNA, 22 bp, Homo sapiens
catcttgaaggtttctttagct

SEQ ID NO: 7269073 - DNA, 22 bp, Homo sapiens
catcttgatgctttgacaggtt

SEQ ID NO: 7269074 - DNA, 22 bp, Homo sapiens
catcttgagacatgaaaggtgt

SEQ ID NO: 7269075 - DNA, 22 bp, Homo sapiens
catcttgactgggataagggat

SEQ ID NO: 7269076 - DNA, 22 bp, Homo sapiens
aggatgagagatacatggagca

SEQ ID NO: 7269077 - DNA, 22 bp, Homo sapiens
aggatggcttgcaggaggctgt

SEQ ID NO: 7269078 - DNA, 22 bp, Homo sapiens
catgagcataaatcagtcacga

SEQ ID NO: 7269079 - DNA, 22 bp, Homo sapiens
catacaatcaagttctttatta

SEQ ID NO: 7269080 - DNA, 22 bp, Homo sapiens
cataatatactacattgatgaa

SEQ ID NO: 7269081 - DNA, 23 bp, Homo sapiens
ccactagcacctgttcaacttct

SEQ ID NO: 7269082 - DNA, 22 bp, Homo sapiens
ccacgctcatcctctctgagag

SEQ ID NO: 7269083 - DNA, 22 bp, Homo sapiens
ccacccagaccagggatctggg

SEQ ID NO: 7269084 - DNA, 22 bp, Homo sapiens
ccacagtgggcacagcaggact

SEQ ID NO: 7269085 - DNA, 22 bp, Homo sapiens
ccacagtggttgtggcatgtgg

SEQ ID NO: 7269086 - DNA, 22 bp, Homo sapiens
ccaccaggcactcacagggaag

SEQ ID NO: 7269087 - DNA, 22 bp, Homo sapiens
ccacagagacagggtccttgct

SEQ ID NO: 7269088 - DNA, 23 bp, Homo sapiens
ccacagagctgccaattcctgtg

SEQ ID NO: 7269089 - DNA, 22 bp, Homo sapiens
ccacagagcattagatttcaga

SEQ ID NO: 7269090 - DNA, 22 bp, Homo sapiens
aggcaggaaccctgtgtgcgcc

SEQ ID NO: 7269091 - DNA, 22 bp, Homo sapiens
aggcaggaaccctgtgtgcgcc

SEQ ID NO: 7269092 - DNA, 17 bp, Homo sapiens
aggcaggagattggaga

SEQ ID NO: 7269093 - DNA, 17 bp, Homo sapiens
aggcaggagattggaga

SEQ ID NO: 7269094 - DNA, 22 bp, Homo sapiens
aggcaggaggatcatggatgca

SEQ ID NO: 7269095 - DNA, 22 bp, Homo sapiens
aggcaatcccctgaggatactt

SEQ ID NO: 7269096 - DNA, 22 bp, Homo sapiens
aggcaatcccctgaggatactt

SEQ ID NO: 7269097 - DNA, 22 bp, Homo sapiens
aggcaagcatttaaccactcat

SEQ ID NO: 7269098 - DNA, 22 bp, Homo sapiens
aggcaagcccccagtgaggctc

SEQ ID NO: 7269099 - DNA, 22 bp, Homo sapiens
aggcaagctgcagagagtcctt

SEQ ID NO: 7269100 - DNA, 22 bp, Homo sapiens
aggcaagcgcagaagcggagga

SEQ ID NO: 7269101 - DNA, 22 bp, Homo sapiens
aggcaagcattgggaacagggc

SEQ ID NO: 7269102 - DNA, 22 bp, Homo sapiens
aggcaacttttggggatgatgg

SEQ ID NO: 7269103 - DNA, 22 bp, Homo sapiens
catttattggttaggccagcag

SEQ ID NO: 7269104 - DNA, 22 bp, Homo sapiens
aggggcaggtgctgcacttaga

SEQ ID NO: 7269105 - DNA, 22 bp, Homo sapiens
agggctcagagcaaaagggcac

SEQ ID NO: 7269106 - DNA, 22 bp, Homo sapiens
acctcacaagtctctgtcagct

SEQ ID NO: 7269107 - DNA, 22 bp, Homo sapiens
acctcagaggaggctcctggct

SEQ ID NO: 7269108 - DNA, 22 bp, Homo sapiens
agggcacaagactctgagcccc

SEQ ID NO: 7269109 - DNA, 22 bp, Homo sapiens
agggaggtctttgaggggctta

SEQ ID NO: 7269110 - DNA, 22 bp, Homo sapiens
accagagaaaacacagcaggct

SEQ ID NO: 7269111 - DNA, 20 bp, Homo sapiens
accagagacctgaatcagtt

SEQ ID NO: 7269112 - DNA, 22 bp, Homo sapiens
accagagcagactactggaggt

SEQ ID NO: 7269113 - DNA, 22 bp, Homo sapiens
accagaagctggagcacaagga

SEQ ID NO: 7269114 - DNA, 22 bp, Homo sapiens
accactggcctggtggggacca

SEQ ID NO: 7269115 - DNA, 22 bp, Homo sapiens
accacaggacccatgagtcagt

SEQ ID NO: 7269116 - DNA, 22 bp, Homo sapiens
aggctgtgattccaccactctc

SEQ ID NO: 7269117 - DNA, 22 bp, Homo sapiens
aggctctggcaacagctggtgt

SEQ ID NO: 7269118 - DNA, 22 bp, Homo sapiens
aggctgctgaggccaccacgct

SEQ ID NO: 7269119 - DNA, 22 bp, Homo sapiens
aggctgcagaacagtcaggtgc

SEQ ID NO: 7269120 - DNA, 22 bp, Homo sapiens
aggctgcttcaatggataagat

SEQ ID NO: 7269121 - DNA, 22 bp, Homo sapiens
aggctgctgccttggagagtgt

SEQ ID NO: 7269122 - DNA, 22 bp, Homo sapiens
acatgttttgtgccttgactag

SEQ ID NO: 7269123 - DNA, 22 bp, Homo sapiens
acattaacaccataagtgtgtt

SEQ ID NO: 7269124 - DNA, 22 bp, Homo sapiens
acattaacaccgtgagtttggt

SEQ ID NO: 7269125 - DNA, 22 bp, Homo sapiens
acattaacactggtgctggtgt

SEQ ID NO: 7269126 - DNA, 22 bp, Homo sapiens
aggctctggagttagccaggca

SEQ ID NO: 7269127 - DNA, 22 bp, Homo sapiens
aggctctggagtgtggtgctgg

SEQ ID NO: 7269128 - DNA, 22 bp, Homo sapiens
aggctctgacgtcacacgtggc

SEQ ID NO: 7269129 - DNA, 19 bp, Homo sapiens
aggctctgagctcctggag

SEQ ID NO: 7269130 - DNA, 22 bp, Homo sapiens
aggctctgacccatgggaccca

SEQ ID NO: 7269131 - DNA, 22 bp, Homo sapiens
aggctctgaaggagaacctgtt

SEQ ID NO: 7269132 - DNA, 20 bp, Homo sapiens
aggctcagctgagctcttgg

SEQ ID NO: 7269133 - DNA, 22 bp, Homo sapiens
acatgtaaaaggaacatgcatg

SEQ ID NO: 7269134 - DNA, 22 bp, Homo sapiens
acaggaactgttatctcagatg

SEQ ID NO: 7269135 - DNA, 22 bp, Homo sapiens
acagcatgtctagttaaatact

SEQ ID NO: 7269136 - DNA, 22 bp, Homo sapiens
acagcatggataacaaggcact

SEQ ID NO: 7269137 - DNA, 22 bp, Homo sapiens
acagcatgagagatgaacattc

SEQ ID NO: 7269138 - DNA, 22 bp, Homo sapiens
acagcatgagagtagcaaaagg

SEQ ID NO: 7269139 - DNA, 21 bp, Homo sapiens
acagcatgtttgtgtgtttgc

SEQ ID NO: 7269140 - DNA, 21 bp, Homo sapiens
acagcatgtttgtgtgtttgc

SEQ ID NO: 7269141 - DNA, 22 bp, Homo sapiens
acaggagaaatctggtcaaaag

SEQ ID NO: 7269142 - DNA, 22 bp, Homo sapiens
agcttcttggctcagcacttgg

SEQ ID NO: 7269143 - DNA, 20 bp, Homo sapiens
agcttcttctgtctaatttt

SEQ ID NO: 7269144 - DNA, 22 bp, Homo sapiens
aggacagggattcaaactccca

SEQ ID NO: 7269145 - DNA, 22 bp, Homo sapiens
aggaaaggtagcgtgccagcag

SEQ ID NO: 7269146 - DNA, 21 bp, Homo sapiens
acaggctcacgatccatttct

SEQ ID NO: 7269147 - DNA, 21 bp, Homo sapiens
acagggcatgcagctggctgt

SEQ ID NO: 7269148 - DNA, 21 bp, Homo sapiens
aggcaccacatctccctcccc

SEQ ID NO: 7269149 - DNA, 22 bp, Homo sapiens
aggcaccagtaagagtagaact

SEQ ID NO: 7269150 - DNA, 22 bp, Homo sapiens
aggcaccttgagagcaggagct

SEQ ID NO: 7269151 - DNA, 22 bp, Homo sapiens
aggcaccttgcggtccagtgaa

SEQ ID NO: 7269152 - DNA, 20 bp, Homo sapiens
aggcacctgtcacaggtgag

SEQ ID NO: 7269153 - DNA, 20 bp, Homo sapiens
acagtgttaggtttttcctt

SEQ ID NO: 7269154 - DNA, 22 bp, Homo sapiens
acagtgttctgaaagttgaggg

SEQ ID NO: 7269155 - DNA, 22 bp, Homo sapiens
acagtgttctcttcctgtatag

SEQ ID NO: 7269156 - DNA, 22 bp, Homo sapiens
acagtgttcactaaggttagct

SEQ ID NO: 7269157 - DNA, 22 bp, Homo sapiens
acagtgttcaaaccactaggct

SEQ ID NO: 7269158 - DNA, 22 bp, Homo sapiens
acagtgttatttctgagtaatg

SEQ ID NO: 7269159 - DNA, 20 bp, Homo sapiens
acagtgttagttatcatctc

SEQ ID NO: 7269160 - DNA, 22 bp, Homo sapiens
acagtgttcctttgttgtgact

SEQ ID NO: 7269161 - DNA, 22 bp, Homo sapiens
acagtgttcacttaacaatgga

SEQ ID NO: 7269162 - DNA, 20 bp, Homo sapiens
aggaggcatagtctggaaag

SEQ ID NO: 7269163 - DNA, 22 bp, Homo sapiens
acagtgagatccaagggcaggc

SEQ ID NO: 7269164 - DNA, 22 bp, Homo sapiens
acagtgaggaagcagctgtgct

SEQ ID NO: 7269165 - DNA, 22 bp, Homo sapiens
acagtgagatccaagggcaggc

SEQ ID NO: 7269166 - DNA, 22 bp, Homo sapiens
acagtgagcccactccaggaga

SEQ ID NO: 7269167 - DNA, 22 bp, Homo sapiens
aggcaggtgttgggagacacca

SEQ ID NO: 7269168 - DNA, 22 bp, Homo sapiens
aggcagatttaggagaaaagaa

SEQ ID NO: 7269169 - DNA, 22 bp, Homo sapiens
aggcagcaaagaaatgatgctg

SEQ ID NO: 7269170 - DNA, 22 bp, Homo sapiens
aggcagcaagattatttaatcc

SEQ ID NO: 7269171 - DNA, 22 bp, Homo sapiens
aggcagcaaatgtctggaacag

SEQ ID NO: 7269172 - DNA, 18 bp, Homo sapiens
aggcaggtgctggaagtc

SEQ ID NO: 7269173 - DNA, 22 bp, Homo sapiens
aggcagcaatgaatgaaatgga

SEQ ID NO: 7269174 - DNA, 18 bp, Homo sapiens
aggcagacactagaggtc

SEQ ID NO: 7269175 - DNA, 22 bp, Homo sapiens
aggcagacaaggtccctggtct

SEQ ID NO: 7269176 - DNA, 22 bp, Homo sapiens
aggcagactgtgcgggaagagt

SEQ ID NO: 7269177 - DNA, 22 bp, Homo sapiens
aggcagactcaatggctagata

SEQ ID NO: 7269178 - DNA, 22 bp, Homo sapiens
aggcagacaaggacacagtggg

SEQ ID NO: 7269179 - DNA, 22 bp, Homo sapiens
aggcagattacttgaggccagg

SEQ ID NO: 7269180 - DNA, 22 bp, Homo sapiens
aggcagatgggagctggaagtt

SEQ ID NO: 7269181 - DNA, 22 bp, Homo sapiens
aggcagatgggagctggaagtt

SEQ ID NO: 7269182 - DNA, 22 bp, Homo sapiens
aggcagatgggagctggaagtt

SEQ ID NO: 7269183 - DNA, 22 bp, Homo sapiens
aggcagatcacttgaggccagg

SEQ ID NO: 7269184 - DNA, 22 bp, Homo sapiens
aggcagagaaaaaccagatatg

SEQ ID NO: 7269185 - DNA, 22 bp, Homo sapiens
aggcagatattggggtgatgtg

SEQ ID NO: 7269186 - DNA, 22 bp, Homo sapiens
acatatattactagtaaagaca

SEQ ID NO: 7269187 - DNA, 22 bp, Homo sapiens
aggcagtgtgtagctggaagag

SEQ ID NO: 7269188 - DNA, 22 bp, Homo sapiens
aggcagtgtgggccaagcttcc

SEQ ID NO: 7269189 - DNA, 22 bp, Homo sapiens
aggcagtgtggagggctgttgc

SEQ ID NO: 7269190 - DNA, 22 bp, Homo sapiens
aggcagtgtgtagctggaagag

SEQ ID NO: 7269191 - DNA, 23 bp, Homo sapiens
aggcagtgtctcttatcctgtcc

SEQ ID NO: 7269192 - DNA, 22 bp, Homo sapiens
aggcagtgtattgctagcggct

SEQ ID NO: 7269193 - DNA, 20 bp, Homo sapiens
aggcagtgtagagatgagta

SEQ ID NO: 7269194 - DNA, 22 bp, Homo sapiens
aggcagtggtgtttgctggtgg

SEQ ID NO: 7269195 - DNA, 22 bp, Homo sapiens
agtgtctttcatatcctccatc

SEQ ID NO: 7269196 - DNA, 22 bp, Homo sapiens
agtgtcttacatgaattgattt

SEQ ID NO: 7269197 - DNA, 22 bp, Homo sapiens
agtgtgtccagaaatctgtatt

SEQ ID NO: 7269198 - DNA, 22 bp, Homo sapiens
agtgtgtactcatatacttcca

SEQ ID NO: 7269199 - DNA, 22 bp, Homo sapiens
agtgtgtctgatcacttgtgag

SEQ ID NO: 7269200 - DNA, 22 bp, Homo sapiens
agtgagcaacagaagcgtgggt

SEQ ID NO: 7269201 - DNA, 22 bp, Homo sapiens
agtgagagtattaatgtgaact

SEQ ID NO: 7269202 - DNA, 18 bp, Homo sapiens
agtccttcttggttttac

SEQ ID NO: 7269203 - DNA, 22 bp, Homo sapiens
agtccttcttttagttgcttgg

SEQ ID NO: 7269204 - DNA, 22 bp, Homo sapiens
agtgattttatcaatttactca

SEQ ID NO: 7269205 - DNA, 22 bp, Homo sapiens
agtgatttggttcatacttcca

SEQ ID NO: 7269206 - DNA, 20 bp, Homo sapiens
agtgatttgttagtacattg

SEQ ID NO: 7269207 - DNA, 22 bp, Homo sapiens
agtggcagacagagacagtacc

SEQ ID NO: 7269208 - DNA, 22 bp, Homo sapiens
actcagcttcctacagctagaa

SEQ ID NO: 7269209 - DNA, 22 bp, Homo sapiens
actcagctcaggagctggctgg

SEQ ID NO: 7269210 - DNA, 22 bp, Homo sapiens
actcagctgatgaagcacaagt

SEQ ID NO: 7269211 - DNA, 22 bp, Homo sapiens
agtcacttggattagcaattct

SEQ ID NO: 7269212 - DNA, 22 bp, Homo sapiens
agtcagtgaatggtgtatgcta

SEQ ID NO: 7269213 - DNA, 22 bp, Homo sapiens
agtcctggttctgattctgaca

SEQ ID NO: 7269214 - DNA, 22 bp, Homo sapiens
agtcctggtgacactcctcttc

SEQ ID NO: 7269215 - DNA, 22 bp, Homo sapiens
agtcctgggttctggtgttttg

SEQ ID NO: 7269216 - DNA, 22 bp, Homo sapiens
agtcctgggtgtgcaaggcaga

SEQ ID NO: 7269217 - DNA, 22 bp, Homo sapiens
actctggggtgatgtctctgag

SEQ ID NO: 7269218 - DNA, 22 bp, Homo sapiens
actctgctcaaagtcctgaggc

SEQ ID NO: 7269219 - DNA, 22 bp, Homo sapiens
actctgggcccaccctcagagt

SEQ ID NO: 7269220 - DNA, 22 bp, Homo sapiens
agaagccattgaagcagacctc

SEQ ID NO: 7269221 - DNA, 22 bp, Homo sapiens
atcctgcttgttacttatagag

SEQ ID NO: 7269222 - DNA, 22 bp, Homo sapiens
atcctgaagcatgaatgtcaaa

SEQ ID NO: 7269223 - DNA, 22 bp, Homo sapiens
agaagccaaaggggccagatat

SEQ ID NO: 7269224 - DNA, 22 bp, Homo sapiens
agaaagagctcgggattaacag

SEQ ID NO: 7269225 - DNA, 17 bp, Homo sapiens
agaaactgaggctcagt

SEQ ID NO: 7269226 - DNA, 22 bp, Homo sapiens
atcaatgacagttgaattctac

SEQ ID NO: 7269227 - DNA, 22 bp, Homo sapiens
atagtgtcagaaaatcataaga

SEQ ID NO: 7269228 - DNA, 22 bp, Homo sapiens
atagttgtgtggggattctggt

SEQ ID NO: 7269229 - DNA, 22 bp, Homo sapiens
agaaaaggattgatggatcaga

SEQ ID NO: 7269230 - DNA, 22 bp, Homo sapiens
actttagaaaagcatccataga

SEQ ID NO: 7269231 - DNA, 22 bp, Homo sapiens
actttagagaaatgtagaagta

SEQ ID NO: 7269232 - DNA, 22 bp, Homo sapiens
actttagaccatcttccacagt

SEQ ID NO: 7269233 - DNA, 22 bp, Homo sapiens
actttagaagtaaggatgagtt

SEQ ID NO: 7269234 - DNA, 22 bp, Homo sapiens
actttagaaaaggaacagagga

SEQ ID NO: 7269235 - DNA, 22 bp, Homo sapiens
actttagaaaaggaacagagga

SEQ ID NO: 7269236 - DNA, 22 bp, Homo sapiens
actttagatattcctctgtaca

SEQ ID NO: 7269237 - DNA, 23 bp, Homo sapiens
actttagataaattatgtgcaca

SEQ ID NO: 7269238 - DNA, 22 bp, Homo sapiens
actttacaggcacttcaagtat

SEQ ID NO: 7269239 - DNA, 22 bp, Homo sapiens
actttacagatggtttcctgac

SEQ ID NO: 7269240 - DNA, 22 bp, Homo sapiens
atacacgtgccatgttggtgtg

SEQ ID NO: 7269241 - DNA, 22 bp, Homo sapiens
atacaattattctgcagatatt

SEQ ID NO: 7269242 - DNA, 22 bp, Homo sapiens
agttgcagacgcagagatgttg

SEQ ID NO: 7269243 - DNA, 22 bp, Homo sapiens
agttcagtagtccttcattgta

SEQ ID NO: 7269244 - DNA, 22 bp, Homo sapiens
agcagacaggtaggaggataaa

SEQ ID NO: 7269245 - DNA, 22 bp, Homo sapiens
caaggcattaccatggctagag

SEQ ID NO: 7269246 - DNA, 22 bp, Homo sapiens
caaggcattcttgcaggtaggg

SEQ ID NO: 7269247 - DNA, 22 bp, Homo sapiens
caaggaaaagaagtatttcaga

SEQ ID NO: 7269248 - DNA, 22 bp, Homo sapiens
caaggaaaacagatgatcaaca

SEQ ID NO: 7269249 - DNA, 22 bp, Homo sapiens
agcaattttcccttagtctttg

SEQ ID NO: 7269250 - DNA, 22 bp, Homo sapiens
caagcagagaggttagaacaca

SEQ ID NO: 7269251 - DNA, 22 bp, Homo sapiens
caattatatttagaatgataca

SEQ ID NO: 7269252 - DNA, 22 bp, Homo sapiens
caattattcagtgacttaagag

SEQ ID NO: 7269253 - DNA, 22 bp, Homo sapiens
caatgtttttccttccttaata

SEQ ID NO: 7269254 - DNA, 22 bp, Homo sapiens
caagtctgacctctgggtgaag

SEQ ID NO: 7269255 - DNA, 22 bp, Homo sapiens
caagtctgacctctgggtgaag

SEQ ID NO: 7269256 - DNA, 22 bp, Homo sapiens
caagggctcttttgaggaatgt

SEQ ID NO: 7269257 - DNA, 22 bp, Homo sapiens
agcaggcaggcccagcggctgg

SEQ ID NO: 7269258 - DNA, 20 bp, Homo sapiens
cacaggaaagctactcagtt

SEQ ID NO: 7269259 - DNA, 22 bp, Homo sapiens
cacagctgccatgcagtcagtg

SEQ ID NO: 7269260 - DNA, 22 bp, Homo sapiens
cacagaacaccaaagaaccttc

SEQ ID NO: 7269261 - DNA, 22 bp, Homo sapiens
caatttctggaactaattctga

SEQ ID NO: 7269262 - DNA, 22 bp, Homo sapiens
cacacatgtctctccatgctct

SEQ ID NO: 7269263 - DNA, 22 bp, Homo sapiens
agccaaagagaccccatatcca

SEQ ID NO: 7269264 - DNA, 22 bp, Homo sapiens
cacatttaaaggttgaagctga

SEQ ID NO: 7269265 - DNA, 22 bp, Homo sapiens
cacattgggcttgcatgcacgg

SEQ ID NO: 7269266 - DNA, 22 bp, Homo sapiens
cacaggctctccagggcctgga

SEQ ID NO: 7269267 - DNA, 22 bp, Homo sapiens
cacaggctcttctcacttgatt

SEQ ID NO: 7269268 - DNA, 20 bp, Homo sapiens
cacaggctatatgagagcca

SEQ ID NO: 7269269 - DNA, 22 bp, Homo sapiens
cagatcaagctgtatggtcaga

SEQ ID NO: 7269270 - DNA, 22 bp, Homo sapiens
agcccttagtacatttctcaag

SEQ ID NO: 7269271 - DNA, 22 bp, Homo sapiens
cagatgaactaggctgcacttg

SEQ ID NO: 7269272 - DNA, 22 bp, Homo sapiens
cagatgaactctatcctgtggc

SEQ ID NO: 7269273 - DNA, 22 bp, Homo sapiens
cagaggaggcggtatacactgc

SEQ ID NO: 7269274 - DNA, 21 bp, Homo sapiens
cagagctgtccaaaccctgac

SEQ ID NO: 7269275 - DNA, 23 bp, Homo sapiens
cagagctggctcagagctgcctg

SEQ ID NO: 7269276 - DNA, 23 bp, Homo sapiens
cagagctggctcagagctgcctg

SEQ ID NO: 7269277 - DNA, 22 bp, Homo sapiens
cagagctgtccaaaccctgaca

SEQ ID NO: 7269278 - DNA, 22 bp, Homo sapiens
cagagctgttgcggggcttggc

SEQ ID NO: 7269279 - DNA, 22 bp, Homo sapiens
agccaggctcaaggcctgctcc

SEQ ID NO: 7269280 - DNA, 22 bp, Homo sapiens
agcgaggttttgcagatacagc

SEQ ID NO: 7269281 - DNA, 22 bp, Homo sapiens
agcgccactgcactccagcctg

SEQ ID NO: 7269282 - DNA, 22 bp, Homo sapiens
agcgagggaggtctgaggacag

SEQ ID NO: 7269283 - DNA, 22 bp, Homo sapiens
cagccctggtgaggttggctat

SEQ ID NO: 7269284 - DNA, 22 bp, Homo sapiens
cagccagctggcactgtgagta

SEQ ID NO: 7269285 - DNA, 22 bp, Homo sapiens
cagcccacgtcagggccactca

SEQ ID NO: 7269286 - DNA, 22 bp, Homo sapiens
cagcccagacaccatcattcta

SEQ ID NO: 7269287 - DNA, 22 bp, Homo sapiens
cagctggcaagtggagcagggt

SEQ ID NO: 7269288 - DNA, 19 bp, Homo sapiens
cagctggaatcatctgagg

SEQ ID NO: 7269289 - DNA, 20 bp, Homo sapiens
agctgaggcacctgaggtta

SEQ ID NO: 7269290 - DNA, 22 bp, Homo sapiens
cagctgctttcagcaggaggga

SEQ ID NO: 7269291 - DNA, 22 bp, Homo sapiens
agctgaggaggaatgatgggta

SEQ ID NO: 7269292 - DNA, 22 bp, Homo sapiens
agctgaggaataataacaaggt

SEQ ID NO: 7269293 - DNA, 22 bp, Homo sapiens
agctgaggacgtgaagggcggc

SEQ ID NO: 7269294 - DNA, 17 bp, Homo sapiens
agctgagctggccaggg

SEQ ID NO: 7269295 - DNA, 22 bp, Homo sapiens
cagcgctggggtaggagcacct

SEQ ID NO: 7269296 - DNA, 22 bp, Homo sapiens
cagcgcaggcgtgtgaaggcgc

SEQ ID NO: 7269297 - DNA, 22 bp, Homo sapiens
cagcgtctcgttgtgggcctcg

SEQ ID NO: 7269298 - DNA, 22 bp, Homo sapiens
cagctgagagtagaaatggagg

SEQ ID NO: 7269299 - DNA, 22 bp, Homo sapiens
cagccttgatggatgaggaagt

SEQ ID NO: 7269300 - DNA, 22 bp, Homo sapiens
cagcctctgagccttggcagat

SEQ ID NO: 7269301 - DNA, 18 bp, Homo sapiens
cagctgccagctcatgga

SEQ ID NO: 7269302 - DNA, 22 bp, Homo sapiens
cagctgccagcttctctccatc

SEQ ID NO: 7269303 - DNA, 22 bp, Homo sapiens
cagctgccatgacatgtcctgc

SEQ ID NO: 7269304 - DNA, 22 bp, Homo sapiens
cagctgcccctccagggctggg

SEQ ID NO: 7269305 - DNA, 22 bp, Homo sapiens
cagctgccccgctggctgacca

SEQ ID NO: 7269306 - DNA, 22 bp, Homo sapiens
cagctgcccaggccacctggag

SEQ ID NO: 7269307 - DNA, 22 bp, Homo sapiens
cagctgcccctccagggctggg

SEQ ID NO: 7269308 - DNA, 22 bp, Homo sapiens
atgattctaggcattgaagata

SEQ ID NO: 7269309 - DNA, 22 bp, Homo sapiens
atgattctctgctactctaaat

SEQ ID NO: 7269310 - DNA, 21 bp, Homo sapiens
atgattctgcaaatgagtagt

SEQ ID NO: 7269311 - DNA, 22 bp, Homo sapiens
atgattctggcaaatttattat

SEQ ID NO: 7269312 - DNA, 22 bp, Homo sapiens
atgattctcattttataaactt

SEQ ID NO: 7269313 - DNA, 22 bp, Homo sapiens
atgattcttttggatagatgat

SEQ ID NO: 7269314 - DNA, 22 bp, Homo sapiens
atgattctggtgagaatgagga

SEQ ID NO: 7269315 - DNA, 22 bp, Homo sapiens
atgattctggggcaaaagctgg

SEQ ID NO: 7269316 - DNA, 22 bp, Homo sapiens
atgattgaccatctgctgggct

SEQ ID NO: 7269317 - DNA, 22 bp, Homo sapiens
atgagaaagagttgtatctaga

SEQ ID NO: 7269318 - DNA, 22 bp, Homo sapiens
atgacaatatagctttgatttt

SEQ ID NO: 7269319 - DNA, 22 bp, Homo sapiens
atgctgagactggagcagctgg

SEQ ID NO: 7269320 - DNA, 22 bp, Homo sapiens
atgctgagataaggctttagtc

SEQ ID NO: 7269321 - DNA, 22 bp, Homo sapiens
atgctgagatcctcaggccaga

SEQ ID NO: 7269322 - DNA, 22 bp, Homo sapiens
atgctgcagctgcaggatcaga

SEQ ID NO: 7269323 - DNA, 22 bp, Homo sapiens
atgctgcacaagccacatgtag

SEQ ID NO: 7269324 - DNA, 22 bp, Homo sapiens
atgctgatctgtaataagattt

SEQ ID NO: 7269325 - DNA, 22 bp, Homo sapiens
atgcttgaaagttatttcattt

SEQ ID NO: 7269326 - DNA, 22 bp, Homo sapiens
atgccatcttcattctcacact

SEQ ID NO: 7269327 - DNA, 22 bp, Homo sapiens
agagctccgtgcctggctgcca

SEQ ID NO: 7269328 - DNA, 22 bp, Homo sapiens
attaagtgactaaagtaatgct

SEQ ID NO: 7269329 - DNA, 22 bp, Homo sapiens
attaagtgactaaagtaatgct

SEQ ID NO: 7269330 - DNA, 22 bp, Homo sapiens
agagcgcactgtctgcaggcaa

SEQ ID NO: 7269331 - DNA, 22 bp, Homo sapiens
atgtcttctctgtaggtaaatt

SEQ ID NO: 7269332 - DNA, 22 bp, Homo sapiens
atgtcttctgtggagacaggta

SEQ ID NO: 7269333 - DNA, 21 bp, Homo sapiens
atgtgcagcaagcagcatgct

SEQ ID NO: 7269334 - DNA, 22 bp, Homo sapiens
atgtgcagttggtggccaggag

SEQ ID NO: 7269335 - DNA, 22 bp, Homo sapiens
atggaatgtttcctcttttatt

SEQ ID NO: 7269336 - DNA, 22 bp, Homo sapiens
agagaagacttacagccacagt

SEQ ID NO: 7269337 - DNA, 22 bp, Homo sapiens
atggacaggtactgcagtgggt

SEQ ID NO: 7269338 - DNA, 22 bp, Homo sapiens
atggacagggcacaggcgcaga

SEQ ID NO: 7269339 - DNA, 18 bp, Homo sapiens
atgggaggggccaagaga

SEQ ID NO: 7269340 - DNA, 22 bp, Homo sapiens
atgggcagtgtattggaaggaa

SEQ ID NO: 7269341 - DNA, 22 bp, Homo sapiens
atgggcatgatattagtaccta

SEQ ID NO: 7269342 - DNA, 22 bp, Homo sapiens
attgtggtgtcagttataggca

SEQ ID NO: 7269343 - DNA, 19 bp, Homo sapiens
attgtgtcaatggtgttca

SEQ ID NO: 7269344 - DNA, 22 bp, Homo sapiens
attgttaaaaaggtggaaatgc

SEQ ID NO: 7269345 - DNA, 22 bp, Homo sapiens
attgtatttgtacaagacatgt

SEQ ID NO: 7269346 - DNA, 22 bp, Homo sapiens
attgttaataactattacattg

SEQ ID NO: 7269347 - DNA, 22 bp, Homo sapiens
agataaattcctaagatttcag

SEQ ID NO: 7269348 - DNA, 22 bp, Homo sapiens
attgtataacagcatgtatttt

SEQ ID NO: 7269349 - DNA, 21 bp, Homo sapiens
attcaaagaagaggaaggccc

SEQ ID NO: 7269350 - DNA, 22 bp, Homo sapiens
attctaaatgtaatttagaatt

SEQ ID NO: 7269351 - DNA, 22 bp, Homo sapiens
attctacaaaagaactggatct

SEQ ID NO: 7269352 - DNA, 22 bp, Homo sapiens
attctaagtcttgttcacattc

SEQ ID NO: 7269353 - DNA, 22 bp, Homo sapiens
attattttatgtgcggcctgat

SEQ ID NO: 7269354 - DNA, 22 bp, Homo sapiens
agaggcctctttgcaagtaggt

SEQ ID NO: 7269355 - DNA, 22 bp, Homo sapiens
atttgaatggcttaacacaacg

SEQ ID NO: 7269356 - DNA, 22 bp, Homo sapiens
agatgacaatgaaggaaaatgt

SEQ ID NO: 7269357 - DNA, 22 bp, Homo sapiens
agatgacaagagcttgctgcag

SEQ ID NO: 7269358 - DNA, 22 bp, Homo sapiens
atttgaatgcaggtagctgagt

SEQ ID NO: 7269359 - DNA, 23 bp, Homo sapiens
agatgaggcttctccatgttggt

SEQ ID NO: 7269360 - DNA, 22 bp, Homo sapiens
agatgacaatgaggttgttatt

SEQ ID NO: 7269361 - DNA, 22 bp, Homo sapiens
agatgacacaccatttttactt

SEQ ID NO: 7269362 - DNA, 22 bp, Homo sapiens
agatgacacacacgcacccgga

SEQ ID NO: 7269363 - DNA, 22 bp, Homo sapiens
agatgacagccaaggagatgaa

SEQ ID NO: 7269364 - DNA, 22 bp, Homo sapiens
agatgactaacatagtattgct

SEQ ID NO: 7269365 - DNA, 22 bp, Homo sapiens
agatgacatggttcaagtttcc

SEQ ID NO: 7269366 - DNA, 22 bp, Homo sapiens
agatgacatgggagcaagcact

SEQ ID NO: 7269367 - DNA, 22 bp, Homo sapiens
agatgacagtagctcccccatt

SEQ ID NO: 7269368 - DNA, 22 bp, Homo sapiens
agatgacaggtttttttggctt

SEQ ID NO: 7269369 - DNA, 22 bp, Homo sapiens
agatgacagctacgggatgaaa

SEQ ID NO: 7269370 - DNA, 22 bp, Homo sapiens
agatgtttgtgttatctccatt

SEQ ID NO: 7269371 - DNA, 17 bp, Homo sapiens
agcaaggcttaagtaaa

SEQ ID NO: 7269372 - DNA, 22 bp, Homo sapiens
agcaaggcttcagagctgtctg

SEQ ID NO: 7269373 - DNA, 22 bp, Homo sapiens
agcaaggcctacagagaggggc

SEQ ID NO: 7269374 - DNA, 22 bp, Homo sapiens
aaaacagtttaggcatcacagt

SEQ ID NO: 7269375 - DNA, 22 bp, Homo sapiens
aaaacactgcaaagctgattgg

SEQ ID NO: 7269376 - DNA, 22 bp, Homo sapiens
aaaacattgaattgcacactat

SEQ ID NO: 7269377 - DNA, 22 bp, Homo sapiens
aaaacattttactgccatctca

SEQ ID NO: 7269378 - DNA, 22 bp, Homo sapiens
aaaataacttctactatttgca

SEQ ID NO: 7269379 - DNA, 22 bp, Homo sapiens
aaaatactgtggagtgttgaaa

SEQ ID NO: 7269380 - DNA, 22 bp, Homo sapiens
aaaatactgtggagtgttgaaa

SEQ ID NO: 7269381 - DNA, 22 bp, Homo sapiens
aaagcaggcagcaggctggatt

SEQ ID NO: 7269382 - DNA, 22 bp, Homo sapiens
aaaatgagccatgaaccaacca

SEQ ID NO: 7269383 - DNA, 22 bp, Homo sapiens
aaaatgatatcctgacttttat

SEQ ID NO: 7269384 - DNA, 22 bp, Homo sapiens
aaaatggatagtgcgtcttctc

SEQ ID NO: 7269385 - DNA, 22 bp, Homo sapiens
aaagttcattgatgactgaggt

SEQ ID NO: 7269386 - DNA, 23 bp, Homo sapiens
aaatgtgagggaaaatctttctg

SEQ ID NO: 7269387 - DNA, 22 bp, Homo sapiens
aaagacagatggcaaggatgat

SEQ ID NO: 7269388 - DNA, 22 bp, Homo sapiens
aaagacagacggaaacctgagg

SEQ ID NO: 7269389 - DNA, 22 bp, Homo sapiens
aaagacagacggaaacctgagg

SEQ ID NO: 7269390 - DNA, 17 bp, Homo sapiens
aaacttcattctcagga

SEQ ID NO: 7269391 - DNA, 23 bp, Homo sapiens
aaacttcagtagtgtcatcagcc

SEQ ID NO: 7269392 - DNA, 22 bp, Homo sapiens
aaatgacactaggctttttgca

SEQ ID NO: 7269393 - DNA, 22 bp, Homo sapiens
aaatacacgtacatgtgtaaaa

SEQ ID NO: 7269394 - DNA, 21 bp, Homo sapiens
aaatacagaaacttgttttca

SEQ ID NO: 7269395 - DNA, 22 bp, Homo sapiens
aaatacagagttgcttaaaagc

SEQ ID NO: 7269396 - DNA, 20 bp, Homo sapiens
aaatccagtgtgtattttac

SEQ ID NO: 7269397 - DNA, 22 bp, Homo sapiens
aaatggaactgggctactaggt

SEQ ID NO: 7269398 - DNA, 22 bp, Homo sapiens
aaatggaactgttgtgcatttg

SEQ ID NO: 7269399 - DNA, 22 bp, Homo sapiens
aaatattggtaggatgcttgtt

SEQ ID NO: 7269400 - DNA, 22 bp, Homo sapiens
aaatcagacttgaattttcatc

SEQ ID NO: 7269401 - DNA, 22 bp, Homo sapiens
aagagagaagtctctctggttc

SEQ ID NO: 7269402 - DNA, 22 bp, Homo sapiens
aagagagacaataggtagcatt

SEQ ID NO: 7269403 - DNA, 22 bp, Homo sapiens
aaatatagtaaatgcatagttc

SEQ ID NO: 7269404 - DNA, 22 bp, Homo sapiens
aaatatagtgacacttatagtc

SEQ ID NO: 7269405 - DNA, 22 bp, Homo sapiens
aagaaggaagtgtggacatcac

SEQ ID NO: 7269406 - DNA, 22 bp, Homo sapiens
aagaaggttgaatgactacttt

SEQ ID NO: 7269407 - DNA, 22 bp, Homo sapiens
aaattggattttaaactgttgg

SEQ ID NO: 7269408 - DNA, 22 bp, Homo sapiens
aaattgctctttaaaagtactg

SEQ ID NO: 7269409 - DNA, 19 bp, Homo sapiens
aacatgacagccactctgg

SEQ ID NO: 7269410 - DNA, 22 bp, Homo sapiens
aacatgatggggaagaacaaga

SEQ ID NO: 7269411 - DNA, 22 bp, Homo sapiens
aaagggaagttgcacatgttcc

SEQ ID NO: 7269412 - DNA, 20 bp, Homo sapiens
aaagtctcaacagctgagaa

SEQ ID NO: 7269413 - DNA, 22 bp, Homo sapiens
aaagtcctagcgatccacagaa

SEQ ID NO: 7269414 - DNA, 22 bp, Homo sapiens
aaagtccagagggcacactgaa

SEQ ID NO: 7269415 - DNA, 22 bp, Homo sapiens
aacttgaagttgcagaaagtac

SEQ ID NO: 7269416 - DNA, 22 bp, Homo sapiens
aagaactgtatcaagatgtagt

SEQ ID NO: 7269417 - DNA, 22 bp, Homo sapiens
aagaagagaaatgtgctgctgg

SEQ ID NO: 7269418 - DNA, 22 bp, Homo sapiens
aagaagagaactggcatcctaa

SEQ ID NO: 7269419 - DNA, 22 bp, Homo sapiens
aattttatctctaagcaggctt

SEQ ID NO: 7269420 - DNA, 22 bp, Homo sapiens
aagaagagaactggcatcctaa

SEQ ID NO: 7269421 - DNA, 22 bp, Homo sapiens
aattttatctctaagcaggctt

SEQ ID NO: 7269422 - DNA, 22 bp, Homo sapiens
aagaacaggttctagaaccatt

SEQ ID NO: 7269423 - DNA, 22 bp, Homo sapiens
aagaacagtgtcctgggactcg

SEQ ID NO: 7269424 - DNA, 22 bp, Homo sapiens
acaaatatttactgaatccact

SEQ ID NO: 7269425 - DNA, 22 bp, Homo sapiens
acaaatgaatcatacataatgt

SEQ ID NO: 7269426 - DNA, 22 bp, Homo sapiens
acaaatgaatcatacataatgt

SEQ ID NO: 7269427 - DNA, 22 bp, Homo sapiens
aagaatatctgttttatttagg

SEQ ID NO: 7269428 - DNA, 22 bp, Homo sapiens
aagaatatagattttttgaagt

SEQ ID NO: 7269429 - DNA, 22 bp, Homo sapiens
aagaatcatctgaactttgagg

SEQ ID NO: 7269430 - DNA, 22 bp, Homo sapiens
acaatgtgtttttatacatttg

SEQ ID NO: 7269431 - DNA, 22 bp, Homo sapiens
acaatattgtacccagaagttt

SEQ ID NO: 7269432 - DNA, 20 bp, Homo sapiens
acaatatgtagatgaatagc

SEQ ID NO: 7269433 - DNA, 22 bp, Homo sapiens
acaaggcttcatattcttttta

SEQ ID NO: 7269434 - DNA, 22 bp, Homo sapiens
acaaggcttcacacagtatgaa

SEQ ID NO: 7269435 - DNA, 22 bp, Homo sapiens
acaaggcttatagttgcttttt

SEQ ID NO: 7269436 - DNA, 22 bp, Homo sapiens
acaaggctgttggtcacaaacc

SEQ ID NO: 7269437 - DNA, 22 bp, Homo sapiens
acacagcaacttgcagtatgga

SEQ ID NO: 7269438 - DNA, 22 bp, Homo sapiens
acacagcaacttgcagtatgga

SEQ ID NO: 7269439 - DNA, 22 bp, Homo sapiens
aagataatattcattaactaga

SEQ ID NO: 7269440 - DNA, 22 bp, Homo sapiens
aagatacaaatgtcaatattgg

SEQ ID NO: 7269441 - DNA, 22 bp, Homo sapiens
aagatacacggtcaactctcaa

SEQ ID NO: 7269442 - DNA, 22 bp, Homo sapiens
aagataatgtgtctgtctttgc

SEQ ID NO: 7269443 - DNA, 22 bp, Homo sapiens
acacagctttcagtcattatct

SEQ ID NO: 7269444 - DNA, 22 bp, Homo sapiens
acagctgctctatatctcagcc

SEQ ID NO: 7269445 - DNA, 19 bp, Homo sapiens
aagcccagtgtatgctctt

SEQ ID NO: 7269446 - DNA, 22 bp, Homo sapiens
aagcccagtaccttcagtgagg

SEQ ID NO: 7269447 - DNA, 22 bp, Homo sapiens
aagcccagatgtgagaactgag

SEQ ID NO: 7269448 - DNA, 22 bp, Homo sapiens
aagccagtaagtttttgtcatt

SEQ ID NO: 7269449 - DNA, 22 bp, Homo sapiens
acacttctcccatctcctgttg

SEQ ID NO: 7269450 - DNA, 22 bp, Homo sapiens
acacttctattccctgcacaaa

SEQ ID NO: 7269451 - DNA, 22 bp, Homo sapiens
acacataagcctaatcatctcc

SEQ ID NO: 7269452 - DNA, 22 bp, Homo sapiens
aagatacatatttgttctagtg

SEQ ID NO: 7269453 - DNA, 22 bp, Homo sapiens
aagatacacgttgtattgaata

SEQ ID NO: 7269454 - DNA, 23 bp, Homo sapiens
acagaaatcatttgtaaggtacc

SEQ ID NO: 7269455 - DNA, 22 bp, Homo sapiens
acagactggcctgtctcgcacc

SEQ ID NO: 7269456 - DNA, 22 bp, Homo sapiens
aactttacttgaaagaacatgt

SEQ ID NO: 7269457 - DNA, 22 bp, Homo sapiens
aactttaaaaaatatgtctgtt

SEQ ID NO: 7269458 - DNA, 22 bp, Homo sapiens
aactttaaagaggaggcttggg

SEQ ID NO: 7269459 - DNA, 22 bp, Homo sapiens
aactttaaggctataaattatg

SEQ ID NO: 7269460 - DNA, 22 bp, Homo sapiens
aacttcattcctttttatgact

SEQ ID NO: 7269461 - DNA, 22 bp, Homo sapiens
aatgcacctaccttgattctgc

SEQ ID NO: 7269462 - DNA, 22 bp, Homo sapiens
aatgaaatgtagcttatccata

SEQ ID NO: 7269463 - DNA, 22 bp, Homo sapiens
aatctctctggggttcagtcct

SEQ ID NO: 7269464 - DNA, 22 bp, Homo sapiens
aatacagtaattttgatgagtt

SEQ ID NO: 7269465 - DNA, 22 bp, Homo sapiens
aatacagtaggtaatagttcat

SEQ ID NO: 7269466 - DNA, 19 bp, Homo sapiens
aatacagtgttatagaatt

SEQ ID NO: 7269467 - DNA, 22 bp, Homo sapiens
aatacatatggaattccatgtt

SEQ ID NO: 7269468 - DNA, 22 bp, Homo sapiens
aatatccacactgtgtccctgc

SEQ ID NO: 7269469 - DNA, 22 bp, Homo sapiens
aatatccacactgtgtccctgc

SEQ ID NO: 7269470 - DNA, 22 bp, Homo sapiens
aatataattttattcctagagt

SEQ ID NO: 7269471 - DNA, 22 bp, Homo sapiens
aatattgagaaccagcatgttt

SEQ ID NO: 7269472 - DNA, 22 bp, Homo sapiens
aataatctcactttatgtggaa

SEQ ID NO: 7269473 - DNA, 22 bp, Homo sapiens
aataatctccctttttgtatgt

SEQ ID NO: 7269474 - DNA, 22 bp, Homo sapiens
aataatgagcttgtctaattgt

SEQ ID NO: 7269475 - DNA, 22 bp, Homo sapiens
aaatggatgcctgataacgtca

SEQ ID NO: 7269476 - DNA, 22 bp, Homo sapiens
aaatggaatgtgtttataattc

SEQ ID NO: 7269477 - DNA, 22 bp, Homo sapiens
aaatggaagctatttatgattc

SEQ ID NO: 7269478 - DNA, 16 bp, Homo sapiens
aaggagggaagagaat

SEQ ID NO: 7269479 - DNA, 22 bp, Homo sapiens
aaggagtggggcatatcacaga

SEQ ID NO: 7269480 - DNA, 22 bp, Homo sapiens
aaggataaaaaccacttctaat

SEQ ID NO: 7269481 - DNA, 22 bp, Homo sapiens
aaggctgaaagaccttgaacct

SEQ ID NO: 7269482 - DNA, 22 bp, Homo sapiens
aagggaggggatgtaagcctgg

SEQ ID NO: 7269483 - DNA, 21 bp, Homo sapiens
aaggctgagacaactcaggag

SEQ ID NO: 7269484 - DNA, 22 bp, Homo sapiens
aaggctgagacagcacaggtcc

SEQ ID NO: 7269485 - DNA, 22 bp, Homo sapiens
aaggctgaattcaagggtaggc

SEQ ID NO: 7269486 - DNA, 22 bp, Homo sapiens
aaggctgaccagtttacacttt

SEQ ID NO: 7269487 - DNA, 22 bp, Homo sapiens
aaggctgactcaacagggggcc

SEQ ID NO: 7269488 - DNA, 22 bp, Homo sapiens
aaggctgacgtttgtgtttatt

SEQ ID NO: 7269489 - DNA, 22 bp, Homo sapiens
aagggcaggagaagacggatat

SEQ ID NO: 7269490 - DNA, 22 bp, Homo sapiens
aagtgctgggattataggcatg

SEQ ID NO: 7269491 - DNA, 22 bp, Homo sapiens
aagtgctgggattacaggtgtg

SEQ ID NO: 7269492 - DNA, 22 bp, Homo sapiens
aagtgctgggattacaggtgtc

SEQ ID NO: 7269493 - DNA, 22 bp, Homo sapiens
aagtgctgggattacaggcatg

SEQ ID NO: 7269494 - DNA, 22 bp, Homo sapiens
aagtgctgagactacaggcatg

SEQ ID NO: 7269495 - DNA, 22 bp, Homo sapiens
aacagtgtcaggattacagata

SEQ ID NO: 7269496 - DNA, 22 bp, Homo sapiens
aacagtgtttttcttcagcact

SEQ ID NO: 7269497 - DNA, 22 bp, Homo sapiens
aagtctgatcatttcttctata

SEQ ID NO: 7269498 - DNA, 22 bp, Homo sapiens
aagtctgagagaaactctctca

SEQ ID NO: 7269499 - DNA, 22 bp, Homo sapiens
aatgtattcctcatgcaagagt

SEQ ID NO: 7269500 - DNA, 22 bp, Homo sapiens
agagaaggcatagaacttgagt

SEQ ID NO: 7269501 - DNA, 23 bp, Homo sapiens
agagcaaggaaatgaggtgtgat

SEQ ID NO: 7269502 - DNA, 21 bp, Homo sapiens
aatgtgtgctatttatctttt

SEQ ID NO: 7269503 - DNA, 22 bp, Homo sapiens
aatgtattatacataatttgtg

SEQ ID NO: 7269504 - DNA, 22 bp, Homo sapiens
aatgccttgcctgctacaactt

SEQ ID NO: 7269505 - DNA, 22 bp, Homo sapiens
agaggaatgtatttccctgcaa

SEQ ID NO: 7269506 - DNA, 22 bp, Homo sapiens
agaggaatttctggaaggaggc

SEQ ID NO: 7269507 - DNA, 21 bp, Homo sapiens
agaggaagtgattggtctggc

SEQ ID NO: 7269508 - DNA, 22 bp, Homo sapiens
agaggatgttctaggcactcat

SEQ ID NO: 7269509 - DNA, 18 bp, Homo sapiens
aatttccatatgaattgc

SEQ ID NO: 7269510 - DNA, 18 bp, Homo sapiens
aatttccatatgaattgc

SEQ ID NO: 7269511 - DNA, 18 bp, Homo sapiens
aatttccatatgaattgc

SEQ ID NO: 7269512 - DNA, 22 bp, Homo sapiens
agaggaggtccttttctgatgt

SEQ ID NO: 7269513 - DNA, 22 bp, Homo sapiens
agaggacaaaatgagaagtgct

SEQ ID NO: 7269514 - DNA, 22 bp, Homo sapiens
agaggatgattttaaggacact

SEQ ID NO: 7269515 - DNA, 22 bp, Homo sapiens
agaggatggttgaggaagacct

SEQ ID NO: 7269516 - DNA, 22 bp, Homo sapiens
agagctgagcaccaagcatggt

SEQ ID NO: 7269517 - DNA, 22 bp, Homo sapiens
agagctgaggatccagctgagc

SEQ ID NO: 7269518 - DNA, 22 bp, Homo sapiens
agagctgaattcaagtgctggc

SEQ ID NO: 7269519 - DNA, 22 bp, Homo sapiens
agcaaggcagtcagctggctgg

SEQ ID NO: 7269520 - DNA, 22 bp, Homo sapiens
agcaaggccgagaggatgctat

SEQ ID NO: 7269521 - DNA, 22 bp, Homo sapiens
agcacaggaacatggagatggg

SEQ ID NO: 7269522 - DNA, 22 bp, Homo sapiens
agcacagggcccagcctaggcc

SEQ ID NO: 7269523 - DNA, 22 bp, Homo sapiens
acacaaattgtaggataattgc

SEQ ID NO: 7269524 - DNA, 22 bp, Homo sapiens
acaatttttcaaagaagcttat

SEQ ID NO: 7269525 - DNA, 22 bp, Homo sapiens
agcacaggaccaaggaagctgt

SEQ ID NO: 7269526 - DNA, 22 bp, Homo sapiens
agcacaggacgtagagcttgga

SEQ ID NO: 7269527 - DNA, 22 bp, Homo sapiens
agcacagggcccagcctaggcc

SEQ ID NO: 7269528 - DNA, 22 bp, Homo sapiens
acaacatttaaggaggcactga

SEQ ID NO: 7269529 - DNA, 22 bp, Homo sapiens
acaacattcttaaatacactga

SEQ ID NO: 7269530 - DNA, 22 bp, Homo sapiens
acaacattatacatagaaagct

SEQ ID NO: 7269531 - DNA, 22 bp, Homo sapiens
agcaaagtccagtctgtgtaca

SEQ ID NO: 7269532 - DNA, 22 bp, Homo sapiens
acaagtttcattgtttagaacc

SEQ ID NO: 7269533 - DNA, 22 bp, Homo sapiens
agcaaatacttgaataaaaaga

SEQ ID NO: 7269534 - DNA, 22 bp, Homo sapiens
acaatagaaggaaactgacata

SEQ ID NO: 7269535 - DNA, 22 bp, Homo sapiens
acaatacaggcttctggactta

SEQ ID NO: 7269536 - DNA, 22 bp, Homo sapiens
agatgctatacattgtaagaca

SEQ ID NO: 7269537 - DNA, 22 bp, Homo sapiens
agatgctctctattatgcagaa

SEQ ID NO: 7269538 - DNA, 22 bp, Homo sapiens
agatgctctcttgctggttcat

SEQ ID NO: 7269539 - DNA, 22 bp, Homo sapiens
agatgccttttatttattgtca

SEQ ID NO: 7269540 - DNA, 22 bp, Homo sapiens
agatgcgtgtgctgtcgagtat

SEQ ID NO: 7269541 - DNA, 22 bp, Homo sapiens
agatgcgtgtgtactgtaagtc

SEQ ID NO: 7269542 - DNA, 22 bp, Homo sapiens
agatgcctgccagttatttagc

SEQ ID NO: 7269543 - DNA, 22 bp, Homo sapiens
agatgcatggaaatctcattac

SEQ ID NO: 7269544 - DNA, 22 bp, Homo sapiens
agatgcatgcttaattagcaca

SEQ ID NO: 7269545 - DNA, 21 bp, Homo sapiens
agatgctgatgctgcaggtcc

SEQ ID NO: 7269546 - DNA, 22 bp, Homo sapiens
agatgctcttgccaaagaagtc

SEQ ID NO: 7269547 - DNA, 22 bp, Homo sapiens
agatgctgccaggcccctcagt

SEQ ID NO: 7269548 - DNA, 22 bp, Homo sapiens
aatttgatgagtttgtaagtct

SEQ ID NO: 7269549 - DNA, 22 bp, Homo sapiens
aatttgattcagcaaatgttca

SEQ ID NO: 7269550 - DNA, 22 bp, Homo sapiens
aatttctaattgaatctctctt

SEQ ID NO: 7269551 - DNA, 22 bp, Homo sapiens
agctgatacatttcttgtagcc

SEQ ID NO: 7269552 - DNA, 22 bp, Homo sapiens
agctgaggttgaagagtgaacg

SEQ ID NO: 7269553 - DNA, 21 bp, Homo sapiens
agctgaggtaaggcaagagag

SEQ ID NO: 7269554 - DNA, 23 bp, Homo sapiens
agctgaggtgcagatccaaagaa

SEQ ID NO: 7269555 - DNA, 22 bp, Homo sapiens
agctgaggttagtataaatgtg

SEQ ID NO: 7269556 - DNA, 22 bp, Homo sapiens
acagcagcgtgaagtgtgttat

SEQ ID NO: 7269557 - DNA, 22 bp, Homo sapiens
acagcagcgtcaacttaaaatt

SEQ ID NO: 7269558 - DNA, 22 bp, Homo sapiens
acagcagccttgttggtttcga

SEQ ID NO: 7269559 - DNA, 22 bp, Homo sapiens
agctgagggcaggatggggtga

SEQ ID NO: 7269560 - DNA, 18 bp, Homo sapiens
agctgaggggactgaaga

SEQ ID NO: 7269561 - DNA, 22 bp, Homo sapiens
agctgagggttcggtgtccaca

SEQ ID NO: 7269562 - DNA, 22 bp, Homo sapiens
acagcagccagccactgtgagc

SEQ ID NO: 7269563 - DNA, 22 bp, Homo sapiens
acagcagcataaactgactaag

SEQ ID NO: 7269564 - DNA, 21 bp, Homo sapiens
acagcagcaatctgtctttcc

SEQ ID NO: 7269565 - DNA, 21 bp, Homo sapiens
acagaggcatacagcttaagg

SEQ ID NO: 7269566 - DNA, 22 bp, Homo sapiens
acagaggccatgagctgccacc

SEQ ID NO: 7269567 - DNA, 17 bp, Homo sapiens
acagaggcaggagtgga

SEQ ID NO: 7269568 - DNA, 22 bp, Homo sapiens
acagaggcagtgtgagatactg

SEQ ID NO: 7269569 - DNA, 22 bp, Homo sapiens
agcgggcagaagtggggtctgc

SEQ ID NO: 7269570 - DNA, 23 bp, Homo sapiens
acagaggcttaaatgagtggcag

SEQ ID NO: 7269571 - DNA, 22 bp, Homo sapiens
acagaggcctcgtaggtacaac

SEQ ID NO: 7269572 - DNA, 22 bp, Homo sapiens
acagaggctgatcttcaagccc

SEQ ID NO: 7269573 - DNA, 22 bp, Homo sapiens
acacaagttctaaagattgcgc

SEQ ID NO: 7269574 - DNA, 22 bp, Homo sapiens
acacaatgcatatttttccaga

SEQ ID NO: 7269575 - DNA, 22 bp, Homo sapiens
acacagttgattgtcactcagg

SEQ ID NO: 7269576 - DNA, 22 bp, Homo sapiens
agcaggctttcaagagtcttct

SEQ ID NO: 7269577 - DNA, 22 bp, Homo sapiens
acacatattcatatgtacttac

SEQ ID NO: 7269578 - DNA, 22 bp, Homo sapiens
acacatatgtggcaactgtaga

SEQ ID NO: 7269579 - DNA, 22 bp, Homo sapiens
agccaaggacacggagcctcct

SEQ ID NO: 7269580 - DNA, 22 bp, Homo sapiens
acacccagcttttgaatgccct

SEQ ID NO: 7269581 - DNA, 22 bp, Homo sapiens
agccaaggagtgcaggtggctt

SEQ ID NO: 7269582 - DNA, 18 bp, Homo sapiens
agccaaggaggaggagga

SEQ ID NO: 7269583 - DNA, 22 bp, Homo sapiens
agccaaggactcagtggtaggc

SEQ ID NO: 7269584 - DNA, 22 bp, Homo sapiens
agccaaggtcgccccagggcaa

SEQ ID NO: 7269585 - DNA, 22 bp, Homo sapiens
agccaaggagtgcaggtggctt

SEQ ID NO: 7269586 - DNA, 22 bp, Homo sapiens
agccagctggagaccactgttt

SEQ ID NO: 7269587 - DNA, 22 bp, Homo sapiens
agccagctgtgggctcaggcgg

SEQ ID NO: 7269588 - DNA, 22 bp, Homo sapiens
agccagctgttctggggcagca

SEQ ID NO: 7269589 - DNA, 22 bp, Homo sapiens
agccacagtctgatgcctgaga

SEQ ID NO: 7269590 - DNA, 22 bp, Homo sapiens
actgggcaaggatatgatgggt

SEQ ID NO: 7269591 - DNA, 22 bp, Homo sapiens
actgggattacaggtgggagtc

SEQ ID NO: 7269592 - DNA, 22 bp, Homo sapiens
actgggcaccatcatgagatgg

SEQ ID NO: 7269593 - DNA, 22 bp, Homo sapiens
actgggcaccatcatgagatag

SEQ ID NO: 7269594 - DNA, 22 bp, Homo sapiens
actgtacatgcatcttgtctat

SEQ ID NO: 7269595 - DNA, 22 bp, Homo sapiens
actgtacacgtgtcatttacag

SEQ ID NO: 7269596 - DNA, 22 bp, Homo sapiens
actgtaatgttttaaagcagag

SEQ ID NO: 7269597 - DNA, 22 bp, Homo sapiens
actgtacacacttctctgtctt

SEQ ID NO: 7269598 - DNA, 22 bp, Homo sapiens
aagtgtttggggatcattttaa

SEQ ID NO: 7269599 - DNA, 22 bp, Homo sapiens
actctttacttaaactctaagt

SEQ ID NO: 7269600 - DNA, 22 bp, Homo sapiens
aagtgtgggactagggctccag

SEQ ID NO: 7269601 - DNA, 22 bp, Homo sapiens
aagttcatcaaagagtaaatat

SEQ ID NO: 7269602 - DNA, 18 bp, Homo sapiens
aagttccacaagagatct

SEQ ID NO: 7269603 - DNA, 22 bp, Homo sapiens
acttttcaaatgggaaactcag

SEQ ID NO: 7269604 - DNA, 22 bp, Homo sapiens
actttgatagtttaatctagga

SEQ ID NO: 7269605 - DNA, 22 bp, Homo sapiens
aataggaaaatatttaacaaga

SEQ ID NO: 7269606 - DNA, 22 bp, Homo sapiens
agaaaggagaccagctctgccc

SEQ ID NO: 7269607 - DNA, 22 bp, Homo sapiens
agaaaggacatctccctttaag

SEQ ID NO: 7269608 - DNA, 22 bp, Homo sapiens
aatgaactggagaacaatgacc

SEQ ID NO: 7269609 - DNA, 22 bp, Homo sapiens
agaacttttggagacttttagt

SEQ ID NO: 7269610 - DNA, 22 bp, Homo sapiens
agaagccactgctcccagtgag

SEQ ID NO: 7269611 - DNA, 22 bp, Homo sapiens
agaagccaccagctgaggaaga

SEQ ID NO: 7269612 - DNA, 22 bp, Homo sapiens
aatgaagtgttatttagtttca

SEQ ID NO: 7269613 - DNA, 21 bp, Homo sapiens
aatgaagtggctattttgagg

SEQ ID NO: 7269614 - DNA, 22 bp, Homo sapiens
agaaggaaggataactgcatta

SEQ ID NO: 7269615 - DNA, 22 bp, Homo sapiens
agaaggaaggaagcattctgtt

SEQ ID NO: 7269616 - DNA, 19 bp, Homo sapiens
aatgcctcagagacttaag

SEQ ID NO: 7269617 - DNA, 19 bp, Homo sapiens
aatgcctcaaattgggaga

SEQ ID NO: 7269618 - DNA, 22 bp, Homo sapiens
aatgcctcttttctccagtcca

SEQ ID NO: 7269619 - DNA, 22 bp, Homo sapiens
aatgcctctttggagttatttc

SEQ ID NO: 7269620 - DNA, 22 bp, Homo sapiens
aatgcctcttggaagaagactt

SEQ ID NO: 7269621 - DNA, 22 bp, Homo sapiens
aatgcctcgccttatttatttt

SEQ ID NO: 7269622 - DNA, 22 bp, Homo sapiens
aatgcctcagcagttattattc

SEQ ID NO: 7269623 - DNA, 22 bp, Homo sapiens
aatgcatatgtaggcaagcagt

SEQ ID NO: 7269624 - DNA, 21 bp, Homo sapiens
aatgcattaacataaagctga

SEQ ID NO: 7269625 - DNA, 22 bp, Homo sapiens
aagggcagagggaatcccacat

SEQ ID NO: 7269626 - DNA, 20 bp, Homo sapiens
aagggcagagggaacagact

SEQ ID NO: 7269627 - DNA, 22 bp, Homo sapiens
aagggaggtaaagctatttaaa

SEQ ID NO: 7269628 - DNA, 22 bp, Homo sapiens
aagggcagaatagagaagatgg

SEQ ID NO: 7269629 - DNA, 22 bp, Homo sapiens
accagagctggctctgagcacc

SEQ ID NO: 7269630 - DNA, 22 bp, Homo sapiens
aagtccatgatcaagatgtggc

SEQ ID NO: 7269631 - DNA, 23 bp, Homo sapiens
aagtagataacactgttctgaga

SEQ ID NO: 7269632 - DNA, 22 bp, Homo sapiens
aagtataagctattcttcatga

SEQ ID NO: 7269633 - DNA, 20 bp, Homo sapiens
aagtcctgacctagtctaaa

SEQ ID NO: 7269634 - DNA, 22 bp, Homo sapiens
aagtcctgaataggggccctgg

SEQ ID NO: 7269635 - DNA, 22 bp, Homo sapiens
aagtcctgaagacacagaaaag

SEQ ID NO: 7269636 - DNA, 22 bp, Homo sapiens
aagtcctgaaacttctttctga

SEQ ID NO: 7269637 - DNA, 22 bp, Homo sapiens
aagtcctgtgtgcttacacttg

SEQ ID NO: 7269638 - DNA, 22 bp, Homo sapiens
aagtcctgtgctagagacacct

SEQ ID NO: 7269639 - DNA, 22 bp, Homo sapiens
aagtcctgggtgagaactgtcc

SEQ ID NO: 7269640 - DNA, 22 bp, Homo sapiens
aagtcctgggcatttgaacagg

SEQ ID NO: 7269641 - DNA, 22 bp, Homo sapiens
aagtcctggatattaaattgat

SEQ ID NO: 7269642 - DNA, 22 bp, Homo sapiens
aagtcctgccagcaaatgtata

SEQ ID NO: 7269643 - DNA, 22 bp, Homo sapiens
aagtcctgccacctataagcct

SEQ ID NO: 7269644 - DNA, 22 bp, Homo sapiens
aagtcctgagaccagaaaatgg

SEQ ID NO: 7269645 - DNA, 22 bp, Homo sapiens
aagtcctgttcctcatacttcc

SEQ ID NO: 7269646 - DNA, 22 bp, Homo sapiens
acctctgaagggccaagcaatg

SEQ ID NO: 7269647 - DNA, 19 bp, Homo sapiens
acctctgagaatgccagtc

SEQ ID NO: 7269648 - DNA, 22 bp, Homo sapiens
acctctgctcaagacccctccg

SEQ ID NO: 7269649 - DNA, 22 bp, Homo sapiens
aagcttcttagaatgcatgtgc

SEQ ID NO: 7269650 - DNA, 22 bp, Homo sapiens
aagcttaatcagtctggttgca

SEQ ID NO: 7269651 - DNA, 22 bp, Homo sapiens
aagctgtgcaggaactgcttgc

SEQ ID NO: 7269652 - DNA, 22 bp, Homo sapiens
aagctgtgaagagcaagtgagg

SEQ ID NO: 7269653 - DNA, 22 bp, Homo sapiens
acatgaagtggtcagatcaaac

SEQ ID NO: 7269654 - DNA, 22 bp, Homo sapiens
acatgacaaaatgcacaggatt

SEQ ID NO: 7269655 - DNA, 22 bp, Homo sapiens
acatgcatacacgtacatacct

SEQ ID NO: 7269656 - DNA, 22 bp, Homo sapiens
acatgacatagtagaaaagccc

SEQ ID NO: 7269657 - DNA, 22 bp, Homo sapiens
acatgacagtgcttagcaaact

SEQ ID NO: 7269658 - DNA, 22 bp, Homo sapiens
acatgacagtgactttataaga

SEQ ID NO: 7269659 - DNA, 22 bp, Homo sapiens
acatgacagggaatgaggtgaa

SEQ ID NO: 7269660 - DNA, 22 bp, Homo sapiens
acatgacacctctggctgggtg

SEQ ID NO: 7269661 - DNA, 22 bp, Homo sapiens
acatgacacaggcctggccaat

SEQ ID NO: 7269662 - DNA, 22 bp, Homo sapiens
acatgacaaggtttataaggct

SEQ ID NO: 7269663 - DNA, 19 bp, Homo sapiens
acatgacaacaggggaggc

SEQ ID NO: 7269664 - DNA, 22 bp, Homo sapiens
acatgcataggagaagtcttta

SEQ ID NO: 7269665 - DNA, 22 bp, Homo sapiens
aaggccagagcagactggagtt

SEQ ID NO: 7269666 - DNA, 22 bp, Homo sapiens
aaggcacatattttagagtcac

SEQ ID NO: 7269667 - DNA, 22 bp, Homo sapiens
aaggcacatattgcagatcttg

SEQ ID NO: 7269668 - DNA, 22 bp, Homo sapiens
tatatcatggagattaacattc

SEQ ID NO: 7269669 - DNA, 20 bp, Homo sapiens
tatctaaatgcttacattac

SEQ ID NO: 7269670 - DNA, 22 bp, Homo sapiens
tatctaaatggaatattccaga

SEQ ID NO: 7269671 - DNA, 22 bp, Homo sapiens
tatctaaaggatttaatttagt

SEQ ID NO: 7269672 - DNA, 22 bp, Homo sapiens
tatctaaaggatttaatttagt

SEQ ID NO: 7269673 - DNA, 22 bp, Homo sapiens
tatgacattataaaggattatt

SEQ ID NO: 7269674 - DNA, 22 bp, Homo sapiens
tatgacatgtgatctcaagagg

SEQ ID NO: 7269675 - DNA, 22 bp, Homo sapiens
tatgacatcagaagactttaaa

SEQ ID NO: 7269676 - DNA, 22 bp, Homo sapiens
tatgacattgctttttagaact

SEQ ID NO: 7269677 - DNA, 22 bp, Homo sapiens
tatgacattatgtattacatgt

SEQ ID NO: 7269678 - DNA, 22 bp, Homo sapiens
tatgacattttgccagcattgc

SEQ ID NO: 7269679 - DNA, 22 bp, Homo sapiens
tatgacattttttgtggccttc

SEQ ID NO: 7269680 - DNA, 22 bp, Homo sapiens
tatgacattttcccagatttat

SEQ ID NO: 7269681 - DNA, 22 bp, Homo sapiens
tatgacatttctctgatttgtg

SEQ ID NO: 7269682 - DNA, 22 bp, Homo sapiens
tatgacattggccaagttctgt

SEQ ID NO: 7269683 - DNA, 22 bp, Homo sapiens
tatgtcctgctactctctcatg

SEQ ID NO: 7269684 - DNA, 22 bp, Homo sapiens
tatgtacataacatgaaatgca

SEQ ID NO: 7269685 - DNA, 22 bp, Homo sapiens
tatgtgtgctttttccatgcat

SEQ ID NO: 7269686 - DNA, 22 bp, Homo sapiens
tatgtgataggcattttactga

SEQ ID NO: 7269687 - DNA, 22 bp, Homo sapiens
tatgtgatcaaaaaagtttgga

SEQ ID NO: 7269688 - DNA, 22 bp, Homo sapiens
tatgtgatagagttactttata

SEQ ID NO: 7269689 - DNA, 22 bp, Homo sapiens
tattcaaagtaccttcattgcc

SEQ ID NO: 7269690 - DNA, 22 bp, Homo sapiens
tattgaattagaccctaaaatg

SEQ ID NO: 7269691 - DNA, 22 bp, Homo sapiens
tattgacagacttgaaagtgtt

SEQ ID NO: 7269692 - DNA, 22 bp, Homo sapiens
tatttattggacagtgttgctg

SEQ ID NO: 7269693 - DNA, 22 bp, Homo sapiens
tatttctaagctgtaagtctga

SEQ ID NO: 7269694 - DNA, 22 bp, Homo sapiens
tatttctaagctgtaagtctga

SEQ ID NO: 7269695 - DNA, 22 bp, Homo sapiens
taggagggttagagggaaatat

SEQ ID NO: 7269696 - DNA, 22 bp, Homo sapiens
tagggaggctacttcttgtagg

SEQ ID NO: 7269697 - DNA, 22 bp, Homo sapiens
tagggaggagggttttcaaatc

SEQ ID NO: 7269698 - DNA, 22 bp, Homo sapiens
tagggatgacgaaaggacagag

SEQ ID NO: 7269699 - DNA, 22 bp, Homo sapiens
tagggatgagccagtgggtagt

SEQ ID NO: 7269700 - DNA, 22 bp, Homo sapiens
tagggcagagcttgtacacgat

SEQ ID NO: 7269701 - DNA, 22 bp, Homo sapiens
tagggatgtggtgagaactgag

SEQ ID NO: 7269702 - DNA, 22 bp, Homo sapiens
tagggatgtcctgagacttggc

SEQ ID NO: 7269703 - DNA, 22 bp, Homo sapiens
tagggatgtaaacatagtaatt

SEQ ID NO: 7269704 - DNA, 22 bp, Homo sapiens
taggctgggagcctgaggctag

SEQ ID NO: 7269705 - DNA, 22 bp, Homo sapiens
tagctcctggtgagcctactct

SEQ ID NO: 7269706 - DNA, 22 bp, Homo sapiens
tagcccctgcctttgaacctgg

SEQ ID NO: 7269707 - DNA, 22 bp, Homo sapiens
tagcccctgcctttgaacctgg

SEQ ID NO: 7269708 - DNA, 21 bp, Homo sapiens
tagcccttctccacctcgccc

SEQ ID NO: 7269709 - DNA, 22 bp, Homo sapiens
tagcccagcatgagcagagctg

SEQ ID NO: 7269710 - DNA, 22 bp, Homo sapiens
tagacaactggagatagtctga

SEQ ID NO: 7269711 - DNA, 22 bp, Homo sapiens
tagaattgggcctaacttccat

SEQ ID NO: 7269712 - DNA, 22 bp, Homo sapiens
tagaaagctggaggaattcttt

SEQ ID NO: 7269713 - DNA, 22 bp, Homo sapiens
tagaaagctgagtaatacattt

SEQ ID NO: 7269714 - DNA, 19 bp, Homo sapiens
tagaaagccagaaaacaga

SEQ ID NO: 7269715 - DNA, 22 bp, Homo sapiens
tagaaagcgttaaatctacaga

SEQ ID NO: 7269716 - DNA, 22 bp, Homo sapiens
tagaaataaatctgcagctggg

SEQ ID NO: 7269717 - DNA, 22 bp, Homo sapiens
tagaaacatcagctaaccaaaa

SEQ ID NO: 7269718 - DNA, 22 bp, Homo sapiens
tagaaacattcagttgcagtcc

SEQ ID NO: 7269719 - DNA, 22 bp, Homo sapiens
tagaaactagattgatagcgga

SEQ ID NO: 7269720 - DNA, 22 bp, Homo sapiens
tagaaacccatgtttattcagt

SEQ ID NO: 7269721 - DNA, 22 bp, Homo sapiens
gtgtgcatgtggaagcatgtat

SEQ ID NO: 7269722 - DNA, 22 bp, Homo sapiens
gtgtggctagaagtgtcttgtt

SEQ ID NO: 7269723 - DNA, 22 bp, Homo sapiens
gtgtgcctcgccaagctgtcgg

SEQ ID NO: 7269724 - DNA, 21 bp, Homo sapiens
gttcaatagctctttgaatgc

SEQ ID NO: 7269725 - DNA, 22 bp, Homo sapiens
gttgctctatgtgtgttctatg

SEQ ID NO: 7269726 - DNA, 22 bp, Homo sapiens
gttgagtgggttaggatgctga

SEQ ID NO: 7269727 - DNA, 19 bp, Homo sapiens
gtttcattaagataggaaa

SEQ ID NO: 7269728 - DNA, 22 bp, Homo sapiens
taaattatgtcacatgactctg

SEQ ID NO: 7269729 - DNA, 22 bp, Homo sapiens
taaattatgttccatgtccttt

SEQ ID NO: 7269730 - DNA, 22 bp, Homo sapiens
taaattatggctggcagagcag

SEQ ID NO: 7269731 - DNA, 22 bp, Homo sapiens
taaagtataagcattggagtat

SEQ ID NO: 7269732 - DNA, 22 bp, Homo sapiens
taaagtatattttttctcaata

SEQ ID NO: 7269733 - DNA, 22 bp, Homo sapiens
taaagtatccagttattcttct

SEQ ID NO: 7269734 - DNA, 22 bp, Homo sapiens
taaaatttgtccctgagtgttg

SEQ ID NO: 7269735 - DNA, 22 bp, Homo sapiens
taatgtttccagtctatgatgg

SEQ ID NO: 7269736 - DNA, 22 bp, Homo sapiens
taatactttgaatgagagctaa

SEQ ID NO: 7269737 - DNA, 22 bp, Homo sapiens
taattatagcattggagtggcc

SEQ ID NO: 7269738 - DNA, 22 bp, Homo sapiens
tacaaagtagaaattcagtaaa

SEQ ID NO: 7269739 - DNA, 22 bp, Homo sapiens
tacaaagtaatgtataatatcg

SEQ ID NO: 7269740 - DNA, 22 bp, Homo sapiens
taatacagggcactttgagtga

SEQ ID NO: 7269741 - DNA, 22 bp, Homo sapiens
taagtaaatttataatgtgatt

SEQ ID NO: 7269742 - DNA, 22 bp, Homo sapiens
taagtaaaacattcaagaagtc

SEQ ID NO: 7269743 - DNA, 22 bp, Homo sapiens
taaggcaggtagatgactacgg

SEQ ID NO: 7269744 - DNA, 22 bp, Homo sapiens
taaggcagtgagaagaaacagg

SEQ ID NO: 7269745 - DNA, 22 bp, Homo sapiens
tacagtaagatgaaatagcaat

SEQ ID NO: 7269746 - DNA, 22 bp, Homo sapiens
tacatttgctttgattttcagc

SEQ ID NO: 7269747 - DNA, 22 bp, Homo sapiens
tacacttttctggttactcttg

SEQ ID NO: 7269748 - DNA, 22 bp, Homo sapiens
tcaggcagtctgactccggagg

SEQ ID NO: 7269749 - DNA, 19 bp, Homo sapiens
tcaggcagttattcacaaa

SEQ ID NO: 7269750 - DNA, 20 bp, Homo sapiens
tcaggcagtggggaaaggca

SEQ ID NO: 7269751 - DNA, 22 bp, Homo sapiens
tcaggctggggtgctaaggtgt

SEQ ID NO: 7269752 - DNA, 22 bp, Homo sapiens
tcaggctgggctcctctcccca

SEQ ID NO: 7269753 - DNA, 22 bp, Homo sapiens
tcaggctggagtgcagtggcgc

SEQ ID NO: 7269754 - DNA, 22 bp, Homo sapiens
tcaggctgggagacaatcactg

SEQ ID NO: 7269755 - DNA, 18 bp, Homo sapiens
tcaggctgggcctccttc

SEQ ID NO: 7269756 - DNA, 22 bp, Homo sapiens
tcaggctgaggtcatctgcatc

SEQ ID NO: 7269757 - DNA, 22 bp, Homo sapiens
tcaggctgataggaggaactga

SEQ ID NO: 7269758 - DNA, 21 bp, Homo sapiens
tcaggctgatgtcgatgttag

SEQ ID NO: 7269759 - DNA, 22 bp, Homo sapiens
tcaggctgctggccagcaggct

SEQ ID NO: 7269760 - DNA, 22 bp, Homo sapiens
tcaggctgctgtactgtgaatg

SEQ ID NO: 7269761 - DNA, 22 bp, Homo sapiens
tcaggctgctttcatgcttaga

SEQ ID NO: 7269762 - DNA, 18 bp, Homo sapiens
tcaggctggaagtttgcc

SEQ ID NO: 7269763 - DNA, 22 bp, Homo sapiens
tcaggctggaatgcagtggggc

SEQ ID NO: 7269764 - DNA, 21 bp, Homo sapiens
tcagcagcttttgcagtccct

SEQ ID NO: 7269765 - DNA, 21 bp, Homo sapiens
tcagcagcttttgcagtccct

SEQ ID NO: 7269766 - DNA, 22 bp, Homo sapiens
tcagcctggtgattcctctgtc

SEQ ID NO: 7269767 - DNA, 22 bp, Homo sapiens
tcagccttgtggccctgctcca

SEQ ID NO: 7269768 - DNA, 22 bp, Homo sapiens
tcagctctcacagatctcaacc

SEQ ID NO: 7269769 - DNA, 22 bp, Homo sapiens
tcagctctctgggctcgaacct

SEQ ID NO: 7269770 - DNA, 22 bp, Homo sapiens
tcagctctacctgggagctgtc

SEQ ID NO: 7269771 - DNA, 22 bp, Homo sapiens
tcagtgatttctggggtgaggg

SEQ ID NO: 7269772 - DNA, 22 bp, Homo sapiens
tcagtgatttctggggtgaggg

SEQ ID NO: 7269773 - DNA, 22 bp, Homo sapiens
tcagtctttgcttatgacaata

SEQ ID NO: 7269774 - DNA, 22 bp, Homo sapiens
tcagtgtgttactttctcctat

SEQ ID NO: 7269775 - DNA, 22 bp, Homo sapiens
tcagtgttagacaagtttggaa

SEQ ID NO: 7269776 - DNA, 22 bp, Homo sapiens
tcagtgttacattatatagaac

SEQ ID NO: 7269777 - DNA, 22 bp, Homo sapiens
tcagtgttaatcagtggtacct

SEQ ID NO: 7269778 - DNA, 22 bp, Homo sapiens
tcagtgttaatcagtggtacct

SEQ ID NO: 7269779 - DNA, 22 bp, Homo sapiens
tcagtgtgttattctactttca

SEQ ID NO: 7269780 - DNA, 22 bp, Homo sapiens
tcagtgtgttcaattggatagg

SEQ ID NO: 7269781 - DNA, 22 bp, Homo sapiens
tcagggaccaccactcacccag

SEQ ID NO: 7269782 - DNA, 22 bp, Homo sapiens
tcagtcttccctccagtgcaac

SEQ ID NO: 7269783 - DNA, 22 bp, Homo sapiens
tcaggttcagactagtcccagt

SEQ ID NO: 7269784 - DNA, 22 bp, Homo sapiens
tcattatcctagtatcttgaat

SEQ ID NO: 7269785 - DNA, 22 bp, Homo sapiens
tcattattttggactggagtgt

SEQ ID NO: 7269786 - DNA, 22 bp, Homo sapiens
tcattattttggactggagtgt

SEQ ID NO: 7269787 - DNA, 23 bp, Homo sapiens
tcatggaactgggcaatcttgaa

SEQ ID NO: 7269788 - DNA, 22 bp, Homo sapiens
tcatattagggtaatgataaga

SEQ ID NO: 7269789 - DNA, 21 bp, Homo sapiens
tcatatttctcttgctattgt

SEQ ID NO: 7269790 - DNA, 22 bp, Homo sapiens
tcatgctagttaagaacacaat

SEQ ID NO: 7269791 - DNA, 22 bp, Homo sapiens
tcagtgttcgctcagggactcc

SEQ ID NO: 7269792 - DNA, 16 bp, Homo sapiens
tcagtgttccagaata

SEQ ID NO: 7269793 - DNA, 22 bp, Homo sapiens
tcagtgttcagggaccaggtcc

SEQ ID NO: 7269794 - DNA, 22 bp, Homo sapiens
tcagtgttcagcggtgtgtgca

SEQ ID NO: 7269795 - DNA, 22 bp, Homo sapiens
tcagtgttattagatgaggttt

SEQ ID NO: 7269796 - DNA, 22 bp, Homo sapiens
tcagtgttattagatgaggttt

SEQ ID NO: 7269797 - DNA, 22 bp, Homo sapiens
tcagtgttagacaagtttggaa

SEQ ID NO: 7269798 - DNA, 22 bp, Homo sapiens
tcagagcaccacacagttccct

SEQ ID NO: 7269799 - DNA, 22 bp, Homo sapiens
tcagacagtgtgatcagtctct

SEQ ID NO: 7269800 - DNA, 22 bp, Homo sapiens
tcaccactgaacagacctttgg

SEQ ID NO: 7269801 - DNA, 22 bp, Homo sapiens
tcacattttatctgagattgac

SEQ ID NO: 7269802 - DNA, 22 bp, Homo sapiens
tcactttagaggaaacattgag

SEQ ID NO: 7269803 - DNA, 19 bp, Homo sapiens
tcacttgtgccaggcactg

SEQ ID NO: 7269804 - DNA, 22 bp, Homo sapiens
tcactttaatgatttgtagaat

SEQ ID NO: 7269805 - DNA, 22 bp, Homo sapiens
tcacaaatagctatattaagga

SEQ ID NO: 7269806 - DNA, 22 bp, Homo sapiens
tcacaggctctccaccatgagg

SEQ ID NO: 7269807 - DNA, 22 bp, Homo sapiens
tcacaggcttgtgaacattgca

SEQ ID NO: 7269808 - DNA, 19 bp, Homo sapiens
tcacaggcatctccccaga

SEQ ID NO: 7269809 - DNA, 22 bp, Homo sapiens
tcacaggcccaaaccacgctta

SEQ ID NO: 7269810 - DNA, 22 bp, Homo sapiens
tcaagatgaaagatgtagccat

SEQ ID NO: 7269811 - DNA, 22 bp, Homo sapiens
tcaaggaaggtctgttgctcca

SEQ ID NO: 7269812 - DNA, 22 bp, Homo sapiens
tcaatacagaaaggatattttg

SEQ ID NO: 7269813 - DNA, 22 bp, Homo sapiens
tcaaggctaaactttcagagta

SEQ ID NO: 7269814 - DNA, 22 bp, Homo sapiens
tcaaggctattaattctgtgag

SEQ ID NO: 7269815 - DNA, 22 bp, Homo sapiens
tcaaggcttttggttttccata

SEQ ID NO: 7269816 - DNA, 19 bp, Homo sapiens
tcaaggctccctgagggat

SEQ ID NO: 7269817 - DNA, 19 bp, Homo sapiens
tcaaggctgcctctccttt

SEQ ID NO: 7269818 - DNA, 21 bp, Homo sapiens
tcaaggctgttgcattaatgc

SEQ ID NO: 7269819 - DNA, 22 bp, Homo sapiens
tcaagtcctgctgtggaccaca

SEQ ID NO: 7269820 - DNA, 22 bp, Homo sapiens
tcaagtcccagctcttcactta

SEQ ID NO: 7269821 - DNA, 22 bp, Homo sapiens
tccagaatactctgaaatcatt

SEQ ID NO: 7269822 - DNA, 23 bp, Homo sapiens
tccagctcccttcaatggcactg

SEQ ID NO: 7269823 - DNA, 22 bp, Homo sapiens
tccagctcagggttggctcaag

SEQ ID NO: 7269824 - DNA, 22 bp, Homo sapiens
tccagctcagggttggctcaag

SEQ ID NO: 7269825 - DNA, 22 bp, Homo sapiens
tccagctcaaagtgctcctgtc

SEQ ID NO: 7269826 - DNA, 22 bp, Homo sapiens
tccagcctttctactcactgag

SEQ ID NO: 7269827 - DNA, 22 bp, Homo sapiens
tccagctcaaattcagcttcca

SEQ ID NO: 7269828 - DNA, 22 bp, Homo sapiens
tccagcatttttcaatagaatt

SEQ ID NO: 7269829 - DNA, 22 bp, Homo sapiens
tccagcatatatagagaatgag

SEQ ID NO: 7269830 - DNA, 22 bp, Homo sapiens
tccagcatgaaggggcttttat

SEQ ID NO: 7269831 - DNA, 22 bp, Homo sapiens
tccaggaggcctcatttcctgt

SEQ ID NO: 7269832 - DNA, 22 bp, Homo sapiens
tccaggaggctctggttgacgt

SEQ ID NO: 7269833 - DNA, 19 bp, Homo sapiens
tccaggaggctgccattga

SEQ ID NO: 7269834 - DNA, 22 bp, Homo sapiens
tccaggagggattgggctgtgg

SEQ ID NO: 7269835 - DNA, 22 bp, Homo sapiens
tccagctttgagattttatgga

SEQ ID NO: 7269836 - DNA, 22 bp, Homo sapiens
tccagcttgacaaatgatttta

SEQ ID NO: 7269837 - DNA, 22 bp, Homo sapiens
tccagcttgcctggtcttttgg

SEQ ID NO: 7269838 - DNA, 22 bp, Homo sapiens
tccagcttataggtagatttaa

SEQ ID NO: 7269839 - DNA, 22 bp, Homo sapiens
tccagctctggcttggctagct

SEQ ID NO: 7269840 - DNA, 22 bp, Homo sapiens
tccagctctaaggctgatagcc

SEQ ID NO: 7269841 - DNA, 22 bp, Homo sapiens
tccagctcctgagttcactgct

SEQ ID NO: 7269842 - DNA, 22 bp, Homo sapiens
tccaggctgcagtcttgccctc

SEQ ID NO: 7269843 - DNA, 22 bp, Homo sapiens
tccatgcagaggagctggtggc

SEQ ID NO: 7269844 - DNA, 22 bp, Homo sapiens
tccatgcagagtccaggcctca

SEQ ID NO: 7269845 - DNA, 22 bp, Homo sapiens
tccatgaggcagggaggctggc

SEQ ID NO: 7269846 - DNA, 22 bp, Homo sapiens
tccatgaggaccaaattcgtag

SEQ ID NO: 7269847 - DNA, 22 bp, Homo sapiens
tccatgagctagggattcatca

SEQ ID NO: 7269848 - DNA, 22 bp, Homo sapiens
tccatgagctagctttccaaag

SEQ ID NO: 7269849 - DNA, 23 bp, Homo sapiens
tccatgagatgtgggcttctagt

SEQ ID NO: 7269850 - DNA, 22 bp, Homo sapiens
tccatgagacagatactgtaag

SEQ ID NO: 7269851 - DNA, 22 bp, Homo sapiens
tccatgagaacccttggagata

SEQ ID NO: 7269852 - DNA, 17 bp, Homo sapiens
tccatgagacatgaaga

SEQ ID NO: 7269853 - DNA, 22 bp, Homo sapiens
tccatgagaggtaactttacaa

SEQ ID NO: 7269854 - DNA, 22 bp, Homo sapiens
tccatgcagagaactgaagtac

SEQ ID NO: 7269855 - DNA, 22 bp, Homo sapiens
tccatgcagagaactgaagtac

SEQ ID NO: 7269856 - DNA, 22 bp, Homo sapiens
tccatgcaaacagtggctagct

SEQ ID NO: 7269857 - DNA, 20 bp, Homo sapiens
tccatgagttagagactata

SEQ ID NO: 7269858 - DNA, 22 bp, Homo sapiens
tccatgagtttgaggaaaagag

SEQ ID NO: 7269859 - DNA, 22 bp, Homo sapiens
tccatgagggacactggatgct

SEQ ID NO: 7269860 - DNA, 22 bp, Homo sapiens
tccaggctaggtttacaggaca

SEQ ID NO: 7269861 - DNA, 22 bp, Homo sapiens
tccaggagtctagcctcaggcc

SEQ ID NO: 7269862 - DNA, 22 bp, Homo sapiens
tccaggagtcctgggtggcccc

SEQ ID NO: 7269863 - DNA, 22 bp, Homo sapiens
tccaggaggtttggaggaagca

SEQ ID NO: 7269864 - DNA, 22 bp, Homo sapiens
tccaggaggttgagtgagttcc

SEQ ID NO: 7269865 - DNA, 22 bp, Homo sapiens
tccaggagtcctgggagtgatt

SEQ ID NO: 7269866 - DNA, 22 bp, Homo sapiens
tccaggagtcagacagatggtg

SEQ ID NO: 7269867 - DNA, 22 bp, Homo sapiens
tccaggaggtatgagtggcccc

SEQ ID NO: 7269868 - DNA, 22 bp, Homo sapiens
tccaggaggtgaggggaccaaa

SEQ ID NO: 7269869 - DNA, 20 bp, Homo sapiens
tccaggaggttagtgtggct

SEQ ID NO: 7269870 - DNA, 22 bp, Homo sapiens
tccaggaggttgagactgcagt

SEQ ID NO: 7269871 - DNA, 22 bp, Homo sapiens
tccaggagggttttctgccttc

SEQ ID NO: 7269872 - DNA, 22 bp, Homo sapiens
tccaggaggtagtgcttaattt

SEQ ID NO: 7269873 - DNA, 22 bp, Homo sapiens
tccaggaggggtaggcagtatg

SEQ ID NO: 7269874 - DNA, 22 bp, Homo sapiens
tccaggagggggagccgtgccg

SEQ ID NO: 7269875 - DNA, 22 bp, Homo sapiens
tccaggagtttgacctgtgggc

SEQ ID NO: 7269876 - DNA, 22 bp, Homo sapiens
tccaggagtttgagactgcagt

SEQ ID NO: 7269877 - DNA, 22 bp, Homo sapiens
tccaggagtgtgtgctaatggg

SEQ ID NO: 7269878 - DNA, 21 bp, Homo sapiens
tccaggagttctaataggtgt

SEQ ID NO: 7269879 - DNA, 22 bp, Homo sapiens
tccaggagtggggcagaggtct

SEQ ID NO: 7269880 - DNA, 21 bp, Homo sapiens
tccaggagtggctgggcaggg

SEQ ID NO: 7269881 - DNA, 22 bp, Homo sapiens
tccaggagtgataaggccactg

SEQ ID NO: 7269882 - DNA, 22 bp, Homo sapiens
tccaggagtgctggttagagta

SEQ ID NO: 7269883 - DNA, 22 bp, Homo sapiens
tccccacacagatacagagtag

SEQ ID NO: 7269884 - DNA, 22 bp, Homo sapiens
tcccattttggatgcggattgg

SEQ ID NO: 7269885 - DNA, 22 bp, Homo sapiens
tcccatttcttgcatccttgct

SEQ ID NO: 7269886 - DNA, 22 bp, Homo sapiens
tcccatttcatgctggctgtgg

SEQ ID NO: 7269887 - DNA, 22 bp, Homo sapiens
tccccacctacacactgctcct

SEQ ID NO: 7269888 - DNA, 22 bp, Homo sapiens
tccccagggctgcagagggtgt

SEQ ID NO: 7269889 - DNA, 22 bp, Homo sapiens
tcccatttcacaacaaaactgg

SEQ ID NO: 7269890 - DNA, 22 bp, Homo sapiens
tcccatttattaattagtttgc

SEQ ID NO: 7269891 - DNA, 22 bp, Homo sapiens
tcccatttatctagatgtcaga

SEQ ID NO: 7269892 - DNA, 22 bp, Homo sapiens
tcccagtgagatgaaacaggta

SEQ ID NO: 7269893 - DNA, 19 bp, Homo sapiens
tcccagtggggagaggtgt

SEQ ID NO: 7269894 - DNA, 22 bp, Homo sapiens
tcccagtggtgggtgcacattt

SEQ ID NO: 7269895 - DNA, 22 bp, Homo sapiens
tcccacaggtggagcttgcagt

SEQ ID NO: 7269896 - DNA, 22 bp, Homo sapiens
tcccagggatcctccgggtcgc

SEQ ID NO: 7269897 - DNA, 22 bp, Homo sapiens
tcccagggtgaaatgcagtagg

SEQ ID NO: 7269898 - DNA, 22 bp, Homo sapiens
gctgtgctgattcattccctgc

SEQ ID NO: 7269899 - DNA, 22 bp, Homo sapiens
gctgtggctttctgtttctgtt

SEQ ID NO: 7269900 - DNA, 22 bp, Homo sapiens
gctggcttgatagtttctgctt

SEQ ID NO: 7269901 - DNA, 21 bp, Homo sapiens
gctggctggctgaccggcctt

SEQ ID NO: 7269902 - DNA, 21 bp, Homo sapiens
gctggctggctgaccggcctt

SEQ ID NO: 7269903 - DNA, 22 bp, Homo sapiens
gctggctgcgtcatcacagggc

SEQ ID NO: 7269904 - DNA, 22 bp, Homo sapiens
gctggagagataggcatggggt

SEQ ID NO: 7269905 - DNA, 22 bp, Homo sapiens
gctggctgctaggacagctaca

SEQ ID NO: 7269906 - DNA, 22 bp, Homo sapiens
gctggagaaactgcagctgagg

SEQ ID NO: 7269907 - DNA, 23 bp, Homo sapiens
gctggctggcagtaaaggttgtt

SEQ ID NO: 7269908 - DNA, 22 bp, Homo sapiens
gctggctggaatgggagaagaa

SEQ ID NO: 7269909 - DNA, 19 bp, Homo sapiens
gctggctggaggagggaca

SEQ ID NO: 7269910 - DNA, 22 bp, Homo sapiens
ggagcagatgtcttcatggcct

SEQ ID NO: 7269911 - DNA, 22 bp, Homo sapiens
ggagcagggcagtgaattctgg

SEQ ID NO: 7269912 - DNA, 22 bp, Homo sapiens
ggagcagttgttgagcaagcca

SEQ ID NO: 7269913 - DNA, 22 bp, Homo sapiens
ggagcagtctaaatgataagag

SEQ ID NO: 7269914 - DNA, 22 bp, Homo sapiens
ggagcagtgagggatcatgggc

SEQ ID NO: 7269915 - DNA, 22 bp, Homo sapiens
ggagcagtggtcattcagctgg

SEQ ID NO: 7269916 - DNA, 22 bp, Homo sapiens
ggagacagtggtagggcctaag

SEQ ID NO: 7269917 - DNA, 22 bp, Homo sapiens
ggagaccagaaggaagcttcga

SEQ ID NO: 7269918 - DNA, 18 bp, Homo sapiens
ggagactaaactgttgac

SEQ ID NO: 7269919 - DNA, 22 bp, Homo sapiens
ggagacagtatggcttgtagct

SEQ ID NO: 7269920 - DNA, 18 bp, Homo sapiens
ggaatgtggacaggctgg

SEQ ID NO: 7269921 - DNA, 17 bp, Homo sapiens
ggacacagctcatggct

SEQ ID NO: 7269922 - DNA, 22 bp, Homo sapiens
ggaatcctggtgttttctgcct

SEQ ID NO: 7269923 - DNA, 22 bp, Homo sapiens
ggaatcctgccagctctgcccc

SEQ ID NO: 7269924 - DNA, 22 bp, Homo sapiens
ggaatcagatgaggggcagagc

SEQ ID NO: 7269925 - DNA, 22 bp, Homo sapiens
ggaagagggaaccacgactgta

SEQ ID NO: 7269926 - DNA, 22 bp, Homo sapiens
ggaagaggctgaggccatgctg

SEQ ID NO: 7269927 - DNA, 22 bp, Homo sapiens
ggaagaggctgagccaggtccc

SEQ ID NO: 7269928 - DNA, 22 bp, Homo sapiens
ggaagaggctgaggccatgctg

SEQ ID NO: 7269929 - DNA, 22 bp, Homo sapiens
gctttcctggccctgtccctgc

SEQ ID NO: 7269930 - DNA, 20 bp, Homo sapiens
gctttctatgagatggactg

SEQ ID NO: 7269931 - DNA, 23 bp, Homo sapiens
gcgtccggcctctctcgctcccg

SEQ ID NO: 7269932 - DNA, 22 bp, Homo sapiens
gcgtctcaaggcccccaggcca

SEQ ID NO: 7269933 - DNA, 22 bp, Homo sapiens
gcgtctgagttgcgggggctca

SEQ ID NO: 7269934 - DNA, 22 bp, Homo sapiens
gcgggttgaagggcgcatcgaa

SEQ ID NO: 7269935 - DNA, 22 bp, Homo sapiens
gccttgccgctcagcagtgggg

SEQ ID NO: 7269936 - DNA, 22 bp, Homo sapiens
gctactgattgaccttggagag

SEQ ID NO: 7269937 - DNA, 22 bp, Homo sapiens
gctcagcactttctccaaccac

SEQ ID NO: 7269938 - DNA, 22 bp, Homo sapiens
gctccaggaggctcccgcgtct

SEQ ID NO: 7269939 - DNA, 22 bp, Homo sapiens
gctccaggataataaagttgtt

SEQ ID NO: 7269940 - DNA, 22 bp, Homo sapiens
gctccaggcagagcctctttcg

SEQ ID NO: 7269941 - DNA, 22 bp, Homo sapiens
gctccagggagtacatttatca

SEQ ID NO: 7269942 - DNA, 22 bp, Homo sapiens
gctccagggacccaagagaaaa

SEQ ID NO: 7269943 - DNA, 22 bp, Homo sapiens
gctccagggtggatgacaattc

SEQ ID NO: 7269944 - DNA, 22 bp, Homo sapiens
gctccagggtcagctcagaact

SEQ ID NO: 7269945 - DNA, 20 bp, Homo sapiens
gctccaggtcagagaggacg

SEQ ID NO: 7269946 - DNA, 22 bp, Homo sapiens
gctccaggtgaatcctctcacc

SEQ ID NO: 7269947 - DNA, 22 bp, Homo sapiens
gctccaggtatttgccctttta

SEQ ID NO: 7269948 - DNA, 22 bp, Homo sapiens
gctccaggtggcttatttgtat

SEQ ID NO: 7269949 - DNA, 22 bp, Homo sapiens
gctccaggtgtcccaggtaaaa

SEQ ID NO: 7269950 - DNA, 22 bp, Homo sapiens
gctccagtggactgggggaggc

SEQ ID NO: 7269951 - DNA, 22 bp, Homo sapiens
gctgaggccccagggtgatggg

SEQ ID NO: 7269952 - DNA, 22 bp, Homo sapiens
gctgaggcggaaggattgctag

SEQ ID NO: 7269953 - DNA, 22 bp, Homo sapiens
gctgaggcctcagaaggctgag

SEQ ID NO: 7269954 - DNA, 22 bp, Homo sapiens
gctgagggaggctgaactgagt

SEQ ID NO: 7269955 - DNA, 22 bp, Homo sapiens
gctgaggctgggagcagcctgt

SEQ ID NO: 7269956 - DNA, 22 bp, Homo sapiens
gctgagaggcagccagaccctc

SEQ ID NO: 7269957 - DNA, 17 bp, Homo sapiens
gctgagaggcagcacag

SEQ ID NO: 7269958 - DNA, 22 bp, Homo sapiens
gctgagagcggccagctgggaa

SEQ ID NO: 7269959 - DNA, 22 bp, Homo sapiens
gctgagagcaaggacaaagcat

SEQ ID NO: 7269960 - DNA, 22 bp, Homo sapiens
gctgagagaaaagtgaggttct

SEQ ID NO: 7269961 - DNA, 22 bp, Homo sapiens
gctgagagatcaaggcaggatt

SEQ ID NO: 7269962 - DNA, 22 bp, Homo sapiens
gctgagactggcagcaggaagt

SEQ ID NO: 7269963 - DNA, 22 bp, Homo sapiens
gctgcccaggagaggtggggct

SEQ ID NO: 7269964 - DNA, 22 bp, Homo sapiens
gctgcccagacattgaatcagg

SEQ ID NO: 7269965 - DNA, 22 bp, Homo sapiens
gctgcccacaatgattacatgg

SEQ ID NO: 7269966 - DNA, 22 bp, Homo sapiens
gctgcccattccactggatggt

SEQ ID NO: 7269967 - DNA, 22 bp, Homo sapiens
gctgcccagggtggagccggct

SEQ ID NO: 7269968 - DNA, 22 bp, Homo sapiens
gctgcctcactccagcccaata

SEQ ID NO: 7269969 - DNA, 22 bp, Homo sapiens
gctgcctcactccagcccaata

SEQ ID NO: 7269970 - DNA, 22 bp, Homo sapiens
gctgcctcaggcacctcctggc

SEQ ID NO: 7269971 - DNA, 22 bp, Homo sapiens
gctgcctccaatctgtgccccg

SEQ ID NO: 7269972 - DNA, 22 bp, Homo sapiens
gctgcctcaggcacctcctggc

SEQ ID NO: 7269973 - DNA, 22 bp, Homo sapiens
gctgcctccaatctgtgccccg

SEQ ID NO: 7269974 - DNA, 21 bp, Homo sapiens
gctgctgtgggccagggaggc

SEQ ID NO: 7269975 - DNA, 22 bp, Homo sapiens
gctgcttgattaggttgacact

SEQ ID NO: 7269976 - DNA, 22 bp, Homo sapiens
gctgctgtgtgggagacaggcg

SEQ ID NO: 7269977 - DNA, 22 bp, Homo sapiens
gctgctgtgttggagagggact

SEQ ID NO: 7269978 - DNA, 22 bp, Homo sapiens
gctgctgttcctccagtggatc

SEQ ID NO: 7269979 - DNA, 22 bp, Homo sapiens
gctgcctgttgaagggtctgtg

SEQ ID NO: 7269980 - DNA, 22 bp, Homo sapiens
gctgcctgtggcccttctgggt

SEQ ID NO: 7269981 - DNA, 22 bp, Homo sapiens
gctgcctgtcctgaggagtccg

SEQ ID NO: 7269982 - DNA, 22 bp, Homo sapiens
gctgccttccaaagagttttat

SEQ ID NO: 7269983 - DNA, 20 bp, Homo sapiens
gctgcctgtttctgtaagta

SEQ ID NO: 7269984 - DNA, 22 bp, Homo sapiens
gcaaagcacactggagatgtcg

SEQ ID NO: 7269985 - DNA, 22 bp, Homo sapiens
gcaaagcattctgtggagtcta

SEQ ID NO: 7269986 - DNA, 22 bp, Homo sapiens
gcaaagcaaatgcctgaaggcg

SEQ ID NO: 7269987 - DNA, 22 bp, Homo sapiens
gcaaagaaatgtcagtgagagg

SEQ ID NO: 7269988 - DNA, 22 bp, Homo sapiens
gaggcccacagggagtaccaag

SEQ ID NO: 7269989 - DNA, 20 bp, Homo sapiens
gaggcccagagaggtgaagc

SEQ ID NO: 7269990 - DNA, 22 bp, Homo sapiens
gcacaggctccggaggagagct

SEQ ID NO: 7269991 - DNA, 22 bp, Homo sapiens
gcaaatattcaagacttttcca

SEQ ID NO: 7269992 - DNA, 22 bp, Homo sapiens
gcacagttctctcagtctccag

SEQ ID NO: 7269993 - DNA, 18 bp, Homo sapiens
gcagagcagaagctcaag

SEQ ID NO: 7269994 - DNA, 22 bp, Homo sapiens
gcagagaacccagcagattggc

SEQ ID NO: 7269995 - DNA, 22 bp, Homo sapiens
gcagagaagatgcccaggcttc

SEQ ID NO: 7269996 - DNA, 22 bp, Homo sapiens
gcagaggatagcatatgaacct

SEQ ID NO: 7269997 - DNA, 22 bp, Homo sapiens
gcagagcaggaaggaagtcagg

SEQ ID NO: 7269998 - DNA, 22 bp, Homo sapiens
gcagagggtcctgtgccagcag

SEQ ID NO: 7269999 - DNA, 22 bp, Homo sapiens
gcagaggggaagctgaggaatt

SEQ ID NO: 7270000 - DNA, 22 bp, Homo sapiens
gcagaggccaggccaccagcaa

SEQ ID NO: 7270001 - DNA, 22 bp, Homo sapiens
gcagaggtgaccagcagcaggg

SEQ ID NO: 7270002 - DNA, 22 bp, Homo sapiens
gcagggaagatcttggagctgc

SEQ ID NO: 7270003 - DNA, 19 bp, Homo sapiens
gcaggcagtggcattcgga

SEQ ID NO: 7270004 - DNA, 22 bp, Homo sapiens
gcaggcagttatttagtagaat

SEQ ID NO: 7270005 - DNA, 22 bp, Homo sapiens
gcagggaagacccggagcagcg

SEQ ID NO: 7270006 - DNA, 22 bp, Homo sapiens
gcaggcagatcacctgtcagga

SEQ ID NO: 7270007 - DNA, 22 bp, Homo sapiens
gcaggcagatcacctgtcagga

SEQ ID NO: 7270008 - DNA, 22 bp, Homo sapiens
gcaggcagccacgattcccttg

SEQ ID NO: 7270009 - DNA, 22 bp, Homo sapiens
gcaggcagaggtggaggagaca

SEQ ID NO: 7270010 - DNA, 22 bp, Homo sapiens
gcaggaagcatagaagaatgcc

SEQ ID NO: 7270011 - DNA, 22 bp, Homo sapiens
gcagctgtcgctaggagctgtg

SEQ ID NO: 7270012 - DNA, 22 bp, Homo sapiens
gcagctttctttttgcatgtct

SEQ ID NO: 7270013 - DNA, 22 bp, Homo sapiens
gcagctttctgcaatgtcatcc

SEQ ID NO: 7270014 - DNA, 21 bp, Homo sapiens
gcagatgggaagagacgaggc

SEQ ID NO: 7270015 - DNA, 21 bp, Homo sapiens
gcagatgggagtcatcaggct

SEQ ID NO: 7270016 - DNA, 22 bp, Homo sapiens
gcagatggcagcccaggctggg

SEQ ID NO: 7270017 - DNA, 18 bp, Homo sapiens
gcagatggagattcaggg

SEQ ID NO: 7270018 - DNA, 22 bp, Homo sapiens
gcagatggagacgaggttccgc

SEQ ID NO: 7270019 - DNA, 22 bp, Homo sapiens
gcatgcagtcaaccagtaaggg

SEQ ID NO: 7270020 - DNA, 22 bp, Homo sapiens
gcatgcagtaaaattcagcaac

SEQ ID NO: 7270021 - DNA, 22 bp, Homo sapiens
gccaccagtgggggcctgggca

SEQ ID NO: 7270022 - DNA, 22 bp, Homo sapiens
gccaccagggggtgcaaggtcc

SEQ ID NO: 7270023 - DNA, 22 bp, Homo sapiens
gccaccaggttctgggttaagc

SEQ ID NO: 7270024 - DNA, 22 bp, Homo sapiens
gccacaggcttaggagggaggt

SEQ ID NO: 7270025 - DNA, 22 bp, Homo sapiens
gcagtggaagcctctttaagca

SEQ ID NO: 7270026 - DNA, 22 bp, Homo sapiens
gcagtggatggccagcaggggc

SEQ ID NO: 7270027 - DNA, 22 bp, Homo sapiens
gcagtggcccagcttgcaggct

SEQ ID NO: 7270028 - DNA, 22 bp, Homo sapiens
gcatgcagacagtctgagacca

SEQ ID NO: 7270029 - DNA, 22 bp, Homo sapiens
gcatgcagaaaatgaacaacga

SEQ ID NO: 7270030 - DNA, 22 bp, Homo sapiens
gcatgcaattatggtattagat

SEQ ID NO: 7270031 - DNA, 23 bp, Homo sapiens
gcatgcaacttgcagtagtattc

SEQ ID NO: 7270032 - DNA, 22 bp, Homo sapiens
gcatgcaggagagaaagacggc

SEQ ID NO: 7270033 - DNA, 22 bp, Homo sapiens
gcatgcaggataggttgagctc

SEQ ID NO: 7270034 - DNA, 22 bp, Homo sapiens
gcatgcagggagggtctggctg

SEQ ID NO: 7270035 - DNA, 19 bp, Homo sapiens
gcatgcagagtaagaaggt

SEQ ID NO: 7270036 - DNA, 22 bp, Homo sapiens
gcatgcagacagtctgagacca

SEQ ID NO: 7270037 - DNA, 22 bp, Homo sapiens
gcatgcagagaatacctgtgat

SEQ ID NO: 7270038 - DNA, 22 bp, Homo sapiens
gccagctcccaagtgagcccct

SEQ ID NO: 7270039 - DNA, 22 bp, Homo sapiens
gccagctcagatgcaggaagga

SEQ ID NO: 7270040 - DNA, 22 bp, Homo sapiens
gccaggcagacaggtcatcagg

SEQ ID NO: 7270041 - DNA, 20 bp, Homo sapiens
gccaggcactgttctcaata

SEQ ID NO: 7270042 - DNA, 22 bp, Homo sapiens
gccaggcactgctctaagccct

SEQ ID NO: 7270043 - DNA, 22 bp, Homo sapiens
gccagcctgtgcttggccaggc

SEQ ID NO: 7270044 - DNA, 21 bp, Homo sapiens
gccagcctgtttacctgtggt

SEQ ID NO: 7270045 - DNA, 22 bp, Homo sapiens
gccagccttctgtggcctgcaa

SEQ ID NO: 7270046 - DNA, 23 bp, Homo sapiens
gccagccttgctctcctgcagcc

SEQ ID NO: 7270047 - DNA, 22 bp, Homo sapiens
gccaggcagcaggaagccagtg

SEQ ID NO: 7270048 - DNA, 22 bp, Homo sapiens
gccaggcagccaccctctgcga

SEQ ID NO: 7270049 - DNA, 22 bp, Homo sapiens
gccaggcagagccccgtgcagc

SEQ ID NO: 7270050 - DNA, 22 bp, Homo sapiens
gccaggcagatatgtgagctta

SEQ ID NO: 7270051 - DNA, 22 bp, Homo sapiens
gccaggcaggtgtcggagccct

SEQ ID NO: 7270052 - DNA, 22 bp, Homo sapiens
gccaggcagctagcaacccctg

SEQ ID NO: 7270053 - DNA, 22 bp, Homo sapiens
gccaggcaggccacgctgtgtt

SEQ ID NO: 7270054 - DNA, 22 bp, Homo sapiens
gccctggcacctcgttgcccag

SEQ ID NO: 7270055 - DNA, 22 bp, Homo sapiens
gccctggccttcatctcagaca

SEQ ID NO: 7270056 - DNA, 22 bp, Homo sapiens
gccccagctctgccacaactag

SEQ ID NO: 7270057 - DNA, 22 bp, Homo sapiens
gccaggggacgcggagcgacga

SEQ ID NO: 7270058 - DNA, 22 bp, Homo sapiens
gcccagccctgaggtcacagct

SEQ ID NO: 7270059 - DNA, 22 bp, Homo sapiens
gcccagcctccaagctccaagg

SEQ ID NO: 7270060 - DNA, 22 bp, Homo sapiens
gcccaggaggagaggctgcagt

SEQ ID NO: 7270061 - DNA, 18 bp, Homo sapiens
gcccatggtaaatgctgt

SEQ ID NO: 7270062 - DNA, 22 bp, Homo sapiens
gcccaggagcctggagatgtgt

SEQ ID NO: 7270063 - DNA, 22 bp, Homo sapiens
gcccaggactcagggtgtcgcg

SEQ ID NO: 7270064 - DNA, 22 bp, Homo sapiens
gcccaggagaggccagggctga

SEQ ID NO: 7270065 - DNA, 16 bp, Homo sapiens
gcccaggacgggaggc

SEQ ID NO: 7270066 - DNA, 20 bp, Homo sapiens
gcccaggaatttgcatttct

SEQ ID NO: 7270067 - DNA, 22 bp, Homo sapiens
gcccaggaagttgaggctgccg

SEQ ID NO: 7270068 - DNA, 22 bp, Homo sapiens
gcccaggaagtgactcagatgt

SEQ ID NO: 7270069 - DNA, 22 bp, Homo sapiens
gcccaggaagccaccgggaagt

SEQ ID NO: 7270070 - DNA, 17 bp, Homo sapiens
gcccaggaaggacggcc

SEQ ID NO: 7270071 - DNA, 22 bp, Homo sapiens
gcccaggaaagatagggcctca

SEQ ID NO: 7270072 - DNA, 22 bp, Homo sapiens
gcccaggaaataaaagtgggct

SEQ ID NO: 7270073 - DNA, 22 bp, Homo sapiens
gcccaggaaatgccccgtggtg

SEQ ID NO: 7270074 - DNA, 22 bp, Homo sapiens
gcccagctggcttccagcacat

SEQ ID NO: 7270075 - DNA, 22 bp, Homo sapiens
gggcagctgcccctctctgggc

SEQ ID NO: 7270076 - DNA, 22 bp, Homo sapiens
gggcagctgccagaggccatgg

SEQ ID NO: 7270077 - DNA, 22 bp, Homo sapiens
gggcagctgccaagtgcatcgc

SEQ ID NO: 7270078 - DNA, 22 bp, Homo sapiens
gggcagctgccagaggccatgg

SEQ ID NO: 7270079 - DNA, 22 bp, Homo sapiens
gggcagctgccactccgcttgc

SEQ ID NO: 7270080 - DNA, 23 bp, Homo sapiens
gggcagcttaagcttgtttttct

SEQ ID NO: 7270081 - DNA, 22 bp, Homo sapiens
gggcagctgtcttggttctcaa

SEQ ID NO: 7270082 - DNA, 22 bp, Homo sapiens
gggcagctgtatctgagcttat

SEQ ID NO: 7270083 - DNA, 22 bp, Homo sapiens
gggcagctggcttataggtttg

SEQ ID NO: 7270084 - DNA, 22 bp, Homo sapiens
gggcagctggccaggtattctg

SEQ ID NO: 7270085 - DNA, 22 bp, Homo sapiens
gggcagctggatagttttaaat

SEQ ID NO: 7270086 - DNA, 22 bp, Homo sapiens
gggcagctgcagggatggtgac

SEQ ID NO: 7270087 - DNA, 22 bp, Homo sapiens
gggcagctctttggtatccttc

SEQ ID NO: 7270088 - DNA, 21 bp, Homo sapiens
gggcagctctgttttattttc

SEQ ID NO: 7270089 - DNA, 22 bp, Homo sapiens
gggcagctctggctgtgggaag

SEQ ID NO: 7270090 - DNA, 22 bp, Homo sapiens
gggcagctctgcccatcagagg

SEQ ID NO: 7270091 - DNA, 22 bp, Homo sapiens
gggcaaagtggtggaggcagtt

SEQ ID NO: 7270092 - DNA, 19 bp, Homo sapiens
gggcaaagtgatcgtcctg

SEQ ID NO: 7270093 - DNA, 22 bp, Homo sapiens
gggaatgtaatcatggaatgct

SEQ ID NO: 7270094 - DNA, 22 bp, Homo sapiens
gggaatgtgaaacagtaaggga

SEQ ID NO: 7270095 - DNA, 22 bp, Homo sapiens
gggagacacgctgcaggcataa

SEQ ID NO: 7270096 - DNA, 22 bp, Homo sapiens
gggagaggttacccgagcaact

SEQ ID NO: 7270097 - DNA, 22 bp, Homo sapiens
ggctgaaggatgaaagctgcag

SEQ ID NO: 7270098 - DNA, 22 bp, Homo sapiens
ggctgagaacaggcccagcctc

SEQ ID NO: 7270099 - DNA, 22 bp, Homo sapiens
ggctgagactagagtgaggcat

SEQ ID NO: 7270100 - DNA, 23 bp, Homo sapiens
ggctgagactacaggcgcttgcc

SEQ ID NO: 7270101 - DNA, 22 bp, Homo sapiens
ggctgagacaacctgggaccca

SEQ ID NO: 7270102 - DNA, 23 bp, Homo sapiens
ggctgagaagtcccatgataggt

SEQ ID NO: 7270103 - DNA, 22 bp, Homo sapiens
ggctgagaaggagtgggtgagg

SEQ ID NO: 7270104 - DNA, 22 bp, Homo sapiens
ggctcttctgtttcacaggcca

SEQ ID NO: 7270105 - DNA, 22 bp, Homo sapiens
ggctcttctggttgtcacattt

SEQ ID NO: 7270106 - DNA, 22 bp, Homo sapiens
ggcgggaggctgaggagttggt

SEQ ID NO: 7270107 - DNA, 22 bp, Homo sapiens
ggctccaccctgcttccagaag

SEQ ID NO: 7270108 - DNA, 22 bp, Homo sapiens
ggctctgctgcacccttggctc

SEQ ID NO: 7270109 - DNA, 22 bp, Homo sapiens
ggctgggaggccgtgctgacct

SEQ ID NO: 7270110 - DNA, 22 bp, Homo sapiens
ggctgctgggaatatgccagct

SEQ ID NO: 7270111 - DNA, 22 bp, Homo sapiens
ggctgctggccagcctaggagt

SEQ ID NO: 7270112 - DNA, 22 bp, Homo sapiens
ggctgctggcattgaggtaggt

SEQ ID NO: 7270113 - DNA, 22 bp, Homo sapiens
ggctgctgcccacccctgcatg

SEQ ID NO: 7270114 - DNA, 22 bp, Homo sapiens
ggctgctggaagactgaacaag

SEQ ID NO: 7270115 - DNA, 22 bp, Homo sapiens
ggctgctgagttggccaggaga

SEQ ID NO: 7270116 - DNA, 22 bp, Homo sapiens
ggctgctgagttggccaggaga

SEQ ID NO: 7270117 - DNA, 22 bp, Homo sapiens
ggctgctgagtcacgacagtga

SEQ ID NO: 7270118 - DNA, 22 bp, Homo sapiens
ggctgctgacaaacatgatcat

SEQ ID NO: 7270119 - DNA, 22 bp, Homo sapiens
ggctgctgaagtgtggcaatct

SEQ ID NO: 7270120 - DNA, 22 bp, Homo sapiens
ggctgagcaattttgatgacat

SEQ ID NO: 7270121 - DNA, 22 bp, Homo sapiens
ggctgagagtggatcccaggga

SEQ ID NO: 7270122 - DNA, 22 bp, Homo sapiens
ggctgagaggacgtcgggctca

SEQ ID NO: 7270123 - DNA, 21 bp, Homo sapiens
ggctgagatggcagaatcacc

SEQ ID NO: 7270124 - DNA, 22 bp, Homo sapiens
ggctgagagtttcctctggggc

SEQ ID NO: 7270125 - DNA, 22 bp, Homo sapiens
ggcaaagagacatgcatcgggg

SEQ ID NO: 7270126 - DNA, 23 bp, Homo sapiens
ggagtgcaatggcgccatctcgg

SEQ ID NO: 7270127 - DNA, 23 bp, Homo sapiens
ggagtgcaatggcgccatctcgg

SEQ ID NO: 7270128 - DNA, 21 bp, Homo sapiens
ggcaagaaacacaatcaagta

SEQ ID NO: 7270129 - DNA, 22 bp, Homo sapiens
ggcaagaaccacaattactttt

SEQ ID NO: 7270130 - DNA, 22 bp, Homo sapiens
ggcaagaacctcaattaccttt

SEQ ID NO: 7270131 - DNA, 22 bp, Homo sapiens
ggcaagaaggcttcaggtagct

SEQ ID NO: 7270132 - DNA, 22 bp, Homo sapiens
ggcaagaaggcttcaggtagct

SEQ ID NO: 7270133 - DNA, 22 bp, Homo sapiens
ggcaaagttttcatctcataac

SEQ ID NO: 7270134 - DNA, 22 bp, Homo sapiens
ggcaagctcaggcctcaggtgt

SEQ ID NO: 7270135 - DNA, 19 bp, Homo sapiens
ggagtctgagcccaggtat

SEQ ID NO: 7270136 - DNA, 21 bp, Homo sapiens
ggagtcagggtctggctgggg

SEQ ID NO: 7270137 - DNA, 22 bp, Homo sapiens
ggagccagagcactggggagcc

SEQ ID NO: 7270138 - DNA, 22 bp, Homo sapiens
ggcagaggaggggtgaatttgc

SEQ ID NO: 7270139 - DNA, 22 bp, Homo sapiens
ggcagaggaggggtgaatttgc

SEQ ID NO: 7270140 - DNA, 22 bp, Homo sapiens
ggcagaggagctggaaacatgg

SEQ ID NO: 7270141 - DNA, 22 bp, Homo sapiens
ggcagaggagctggaaacatgg

SEQ ID NO: 7270142 - DNA, 23 bp, Homo sapiens
ggcaccaggccatggagcgggag

SEQ ID NO: 7270143 - DNA, 22 bp, Homo sapiens
ggcaccaggacatgactcccag

SEQ ID NO: 7270144 - DNA, 20 bp, Homo sapiens
ggcaccaggctaggattgga

SEQ ID NO: 7270145 - DNA, 22 bp, Homo sapiens
ggcagaggaaggatgaattcac

SEQ ID NO: 7270146 - DNA, 22 bp, Homo sapiens
ggcagaggaagctggaagtggg

SEQ ID NO: 7270147 - DNA, 22 bp, Homo sapiens
ggcagaggaaggatgaattcac

SEQ ID NO: 7270148 - DNA, 17 bp, Homo sapiens
ggcaccagacggagagt

SEQ ID NO: 7270149 - DNA, 22 bp, Homo sapiens
ggcaccagcacttgggatggct

SEQ ID NO: 7270150 - DNA, 22 bp, Homo sapiens
ggcaccagcaggcaccgatgcc

SEQ ID NO: 7270151 - DNA, 22 bp, Homo sapiens
ggcaggcaccagctcagcaata

SEQ ID NO: 7270152 - DNA, 22 bp, Homo sapiens
ggcaggaggtgagtggcgggtg

SEQ ID NO: 7270153 - DNA, 22 bp, Homo sapiens
ggcaggcaacggaccactagtc

SEQ ID NO: 7270154 - DNA, 22 bp, Homo sapiens
ggcaggcaatgaggatgggaag

SEQ ID NO: 7270155 - DNA, 20 bp, Homo sapiens
ggcagagggcctgggagaag

SEQ ID NO: 7270156 - DNA, 22 bp, Homo sapiens
ggcagaggtagctggaaccagg

SEQ ID NO: 7270157 - DNA, 21 bp, Homo sapiens
ggcctgagtataggacaggcc

SEQ ID NO: 7270158 - DNA, 22 bp, Homo sapiens
ggcctgagtcccacctggctgt

SEQ ID NO: 7270159 - DNA, 22 bp, Homo sapiens
ggcctgagaaccatggggccaa

SEQ ID NO: 7270160 - DNA, 22 bp, Homo sapiens
ggcctgaggcgtcccagctgtg

SEQ ID NO: 7270161 - DNA, 22 bp, Homo sapiens
ggcctcagtttcttcaactgta

SEQ ID NO: 7270162 - DNA, 22 bp, Homo sapiens
ggccagggcctggggactgtcc

SEQ ID NO: 7270163 - DNA, 22 bp, Homo sapiens
ggcagtcttatcagcattggac

SEQ ID NO: 7270164 - DNA, 19 bp, Homo sapiens
ggcagtctcaagcagcaca

SEQ ID NO: 7270165 - DNA, 22 bp, Homo sapiens
ggcaggtggacgtgctaaagct

SEQ ID NO: 7270166 - DNA, 22 bp, Homo sapiens
ggcaggcagaggctgagacagg

SEQ ID NO: 7270167 - DNA, 22 bp, Homo sapiens
ggcaggcagaggctgagacagg

SEQ ID NO: 7270168 - DNA, 22 bp, Homo sapiens
ggcaggcagaggctgagacagg

SEQ ID NO: 7270169 - DNA, 22 bp, Homo sapiens
ggcaggtggcactgctgctccc

SEQ ID NO: 7270170 - DNA, 22 bp, Homo sapiens
ggcagtcacttttgcttgtgcc

SEQ ID NO: 7270171 - DNA, 22 bp, Homo sapiens
ggcaggtggtaaggatttcata

SEQ ID NO: 7270172 - DNA, 22 bp, Homo sapiens
gggcttggtggagagaatgctg

SEQ ID NO: 7270173 - DNA, 22 bp, Homo sapiens
gggtggagcttggacaccagta

SEQ ID NO: 7270174 - DNA, 22 bp, Homo sapiens
gggtggagtagaaagatgaatt

SEQ ID NO: 7270175 - DNA, 22 bp, Homo sapiens
ggggtgggcgtgcagggacacc

SEQ ID NO: 7270176 - DNA, 22 bp, Homo sapiens
gggctgagagctggaatctgag

SEQ ID NO: 7270177 - DNA, 22 bp, Homo sapiens
gggctgagattggtgccctgtc

SEQ ID NO: 7270178 - DNA, 22 bp, Homo sapiens
gggctgagagtgactgttctgt

SEQ ID NO: 7270179 - DNA, 22 bp, Homo sapiens
gggctgagcacatactgacagc

SEQ ID NO: 7270180 - DNA, 22 bp, Homo sapiens
gggctgagccatttgaaccttg

SEQ ID NO: 7270181 - DNA, 22 bp, Homo sapiens
gggctgagccacagcttttgtt

SEQ ID NO: 7270182 - DNA, 22 bp, Homo sapiens
gggctgagctaagctgggttga

SEQ ID NO: 7270183 - DNA, 22 bp, Homo sapiens
gggctgagctgttctgagttta

SEQ ID NO: 7270184 - DNA, 22 bp, Homo sapiens
gggctgaggaacatattttgtt

SEQ ID NO: 7270185 - DNA, 20 bp, Homo sapiens
gggcttggaggactcgaggg

SEQ ID NO: 7270186 - DNA, 22 bp, Homo sapiens
gggcttggagtaggctgatgaa

SEQ ID NO: 7270187 - DNA, 19 bp, Homo sapiens
gggcttggggctgaagcct

SEQ ID NO: 7270188 - DNA, 22 bp, Homo sapiens
gggcttggccccagaagagcta

SEQ ID NO: 7270189 - DNA, 22 bp, Homo sapiens
gggctgaggctaccactggtct

SEQ ID NO: 7270190 - DNA, 22 bp, Homo sapiens
gggctgagggccaattcctact

SEQ ID NO: 7270191 - DNA, 22 bp, Homo sapiens
gggctgagtgtcccaggccgaa

SEQ ID NO: 7270192 - DNA, 22 bp, Homo sapiens
gggctgagttcctgcctcactc

SEQ ID NO: 7270193 - DNA, 22 bp, Homo sapiens
gggctgcatcagcaggacccgg

SEQ ID NO: 7270194 - DNA, 22 bp, Homo sapiens
ggtctgagagccactgaatccc

SEQ ID NO: 7270195 - DNA, 22 bp, Homo sapiens
ggtttattaatgtgaactgtat

SEQ ID NO: 7270196 - DNA, 22 bp, Homo sapiens
ggtttattgttaataagtttga

SEQ ID NO: 7270197 - DNA, 22 bp, Homo sapiens
ggtttattgaaggccaccccac

SEQ ID NO: 7270198 - DNA, 22 bp, Homo sapiens
ggtgttgtacattctgtggatt

SEQ ID NO: 7270199 - DNA, 22 bp, Homo sapiens
ggtgtgtgtggattagcatgcc

SEQ ID NO: 7270200 - DNA, 22 bp, Homo sapiens
ggtgtgtggttttgatacagtc

SEQ ID NO: 7270201 - DNA, 22 bp, Homo sapiens
ggtgtgtggtcctctcacttag

SEQ ID NO: 7270202 - DNA, 19 bp, Homo sapiens
ggtgtgtgctggggcctgt

SEQ ID NO: 7270203 - DNA, 22 bp, Homo sapiens
ggtcagagccatggagcaactg

SEQ ID NO: 7270204 - DNA, 22 bp, Homo sapiens
ggtcagagctggagagataggg

SEQ ID NO: 7270205 - DNA, 22 bp, Homo sapiens
ggtcagagaaagtggtagtaga

SEQ ID NO: 7270206 - DNA, 22 bp, Homo sapiens
ggtcagaattaggtctagagta

SEQ ID NO: 7270207 - DNA, 22 bp, Homo sapiens
gggtggcactgataatgagacg

SEQ ID NO: 7270208 - DNA, 22 bp, Homo sapiens
ggtcgctgtgtaggttcagcta

SEQ ID NO: 7270209 - DNA, 22 bp, Homo sapiens
gtgaaggaggggccacagatat

SEQ ID NO: 7270210 - DNA, 22 bp, Homo sapiens
gtctgctggtgcctggcctgcg

SEQ ID NO: 7270211 - DNA, 22 bp, Homo sapiens
gtctgctgcagtcgtggctcta

SEQ ID NO: 7270212 - DNA, 22 bp, Homo sapiens
gtctgctgcagagcatggcttt

SEQ ID NO: 7270213 - DNA, 22 bp, Homo sapiens
gtgcatatgtgtgtatacaaac

SEQ ID NO: 7270214 - DNA, 21 bp, Homo sapiens
gtgcagaggaatgtagggggc

SEQ ID NO: 7270215 - DNA, 22 bp, Homo sapiens
gtgcagtgaaaaaagaatgtcc

SEQ ID NO: 7270216 - DNA, 22 bp, Homo sapiens
gtgcaggtggttggcccagccg

SEQ ID NO: 7270217 - DNA, 22 bp, Homo sapiens
gtgagaagataagtattgcaaa

SEQ ID NO: 7270218 - DNA, 22 bp, Homo sapiens
gtgactctgcattttatggatc

SEQ ID NO: 7270219 - DNA, 22 bp, Homo sapiens
gtgactgtgatcttatttgcaa

SEQ ID NO: 7270220 - DNA, 22 bp, Homo sapiens
gtgactcttacctacccagcct

SEQ ID NO: 7270221 - DNA, 22 bp, Homo sapiens
gtgagactcgcctttgtgtagc

SEQ ID NO: 7270222 - DNA, 22 bp, Homo sapiens
gtgcagagaggaccttggggag

SEQ ID NO: 7270223 - DNA, 22 bp, Homo sapiens
gtgcagagaaggagcagtagtt

SEQ ID NO: 7270224 - DNA, 22 bp, Homo sapiens
gtattgtatatttgcaaataca

SEQ ID NO: 7270225 - DNA, 22 bp, Homo sapiens
gtattgtatttatttatgtgac

SEQ ID NO: 7270226 - DNA, 22 bp, Homo sapiens
gtattgcattttaatatgtgca

SEQ ID NO: 7270227 - DNA, 21 bp, Homo sapiens
gtattgcagagttatgtgctc

SEQ ID NO: 7270228 - DNA, 22 bp, Homo sapiens
ggtttggttctgagagttggca

SEQ ID NO: 7270229 - DNA, 22 bp, Homo sapiens
ggtttgttggggtccaggccca

SEQ ID NO: 7270230 - DNA, 22 bp, Homo sapiens
gtacatttatttttgcagcata

SEQ ID NO: 7270231 - DNA, 23 bp, Homo sapiens
gtaaaatacgcagtgcagtgtga

SEQ ID NO: 7270232 - DNA, 23 bp, Homo sapiens
gtaaaatacgcagtgcagtgtga

SEQ ID NO: 7270233 - DNA, 22 bp, Homo sapiens
gtacattttactttgtttgaat

SEQ ID NO: 7270234 - DNA, 22 bp, Homo sapiens
gtcattttctagaattatttga

SEQ ID NO: 7270235 - DNA, 22 bp, Homo sapiens
gtcattttgctgcatatttaga

SEQ ID NO: 7270236 - DNA, 22 bp, Homo sapiens
gtccactgctgtgtgcttcacc

SEQ ID NO: 7270237 - DNA, 22 bp, Homo sapiens
gtcccattcatctccctaggga

SEQ ID NO: 7270238 - DNA, 22 bp, Homo sapiens
gtcccatttcaagaaattcatg

SEQ ID NO: 7270239 - DNA, 22 bp, Homo sapiens
gtcccattgttctgggcttggc

SEQ ID NO: 7270240 - DNA, 22 bp, Homo sapiens
gtcccattgctcattagctttc

SEQ ID NO: 7270241 - DNA, 22 bp, Homo sapiens
gtcccattccctgtatcttaga

SEQ ID NO: 7270242 - DNA, 22 bp, Homo sapiens
gtcccattttgcagatagagca

SEQ ID NO: 7270243 - DNA, 22 bp, Homo sapiens
gtcccattttctactatggaat

SEQ ID NO: 7270244 - DNA, 18 bp, Homo sapiens
gtccacagattcttcact

SEQ ID NO: 7270245 - DNA, 22 bp, Homo sapiens
gtccacagctggccagggcctc

SEQ ID NO: 7270246 - DNA, 22 bp, Homo sapiens
gtccccagctaatctctttgcc

SEQ ID NO: 7270247 - DNA, 18 bp, Homo sapiens
gagctgagaagaggatgc

SEQ ID NO: 7270248 - DNA, 22 bp, Homo sapiens
gagctgagacacactttggcaa

SEQ ID NO: 7270249 - DNA, 22 bp, Homo sapiens
gagctgagaagcagcgcttgat

SEQ ID NO: 7270250 - DNA, 22 bp, Homo sapiens
gagcttcctcagcctttctcac

SEQ ID NO: 7270251 - DNA, 22 bp, Homo sapiens
gaggcactgcagtacagtgact

SEQ ID NO: 7270252 - DNA, 23 bp, Homo sapiens
gaggcactcaggaaatgtgagtg

SEQ ID NO: 7270253 - DNA, 22 bp, Homo sapiens
gaggcacctcgcgggaggaggc

SEQ ID NO: 7270254 - DNA, 22 bp, Homo sapiens
gaggcagaagttgcagtgagca

SEQ ID NO: 7270255 - DNA, 22 bp, Homo sapiens
gaggcactggaggaaaggagaa

SEQ ID NO: 7270256 - DNA, 22 bp, Homo sapiens
gaggcagaagttgcagtgagca

SEQ ID NO: 7270257 - DNA, 22 bp, Homo sapiens
gaggcagagaccttcaggacct

SEQ ID NO: 7270258 - DNA, 22 bp, Homo sapiens
gaggcagaagttgcagtgagca

SEQ ID NO: 7270259 - DNA, 22 bp, Homo sapiens
gaggcagaggttgcagtgagct

SEQ ID NO: 7270260 - DNA, 22 bp, Homo sapiens
gaggccaggacatgaaagctga

SEQ ID NO: 7270261 - DNA, 22 bp, Homo sapiens
gaggccaggaagcccaagatca

SEQ ID NO: 7270262 - DNA, 22 bp, Homo sapiens
gaggccagctagtccaggaagt

SEQ ID NO: 7270263 - DNA, 22 bp, Homo sapiens
gaggagcttgaggctaggagcc

SEQ ID NO: 7270264 - DNA, 22 bp, Homo sapiens
gaggagcttgtgagaagatgtc

SEQ ID NO: 7270265 - DNA, 19 bp, Homo sapiens
gaggagctatcggagacag

SEQ ID NO: 7270266 - DNA, 22 bp, Homo sapiens
gaggcaagcccagtgggtctaa

SEQ ID NO: 7270267 - DNA, 22 bp, Homo sapiens
gaggaggccagtggaaggaagc

SEQ ID NO: 7270268 - DNA, 22 bp, Homo sapiens
gaggaggcacttgagcagatgt

SEQ ID NO: 7270269 - DNA, 15 bp, Homo sapiens
gagatgctctcaggg

SEQ ID NO: 7270270 - DNA, 22 bp, Homo sapiens
gagatgctatggctattcccct

SEQ ID NO: 7270271 - DNA, 22 bp, Homo sapiens
gagatgctgaaatctgagtgta

SEQ ID NO: 7270272 - DNA, 22 bp, Homo sapiens
gagatgctgcctgatttattca

SEQ ID NO: 7270273 - DNA, 22 bp, Homo sapiens
gagatgctgctcttactgtata

SEQ ID NO: 7270274 - DNA, 22 bp, Homo sapiens
gagatgctgtcaggctatctgt

SEQ ID NO: 7270275 - DNA, 22 bp, Homo sapiens
gagatgcttgtctgtcttatca

SEQ ID NO: 7270276 - DNA, 22 bp, Homo sapiens
gagatgctttatctcctttgtc

SEQ ID NO: 7270277 - DNA, 22 bp, Homo sapiens
gagatgctttctgcccttggta

SEQ ID NO: 7270278 - DNA, 22 bp, Homo sapiens
gagatgatgagatttggaactt

SEQ ID NO: 7270279 - DNA, 22 bp, Homo sapiens
gagatgatcgtacttgcaagaa

SEQ ID NO: 7270280 - DNA, 22 bp, Homo sapiens
gagatgatctttcctgtagtcc

SEQ ID NO: 7270281 - DNA, 20 bp, Homo sapiens
gagatgcaagtgtatctgac

SEQ ID NO: 7270282 - DNA, 17 bp, Homo sapiens
gagatgctaatctgatc

SEQ ID NO: 7270283 - DNA, 22 bp, Homo sapiens
gagatgcaagcaagtctatttt

SEQ ID NO: 7270284 - DNA, 22 bp, Homo sapiens
gagatgacatgcctgttgtagg

SEQ ID NO: 7270285 - DNA, 22 bp, Homo sapiens
gagagggagccagccaggaacc

SEQ ID NO: 7270286 - DNA, 22 bp, Homo sapiens
gagagggatactgagttttggt

SEQ ID NO: 7270287 - DNA, 22 bp, Homo sapiens
gagaggctcagggacttgctga

SEQ ID NO: 7270288 - DNA, 22 bp, Homo sapiens
gagaggctggtaaagtctgaac

SEQ ID NO: 7270289 - DNA, 22 bp, Homo sapiens
gagaggctatgaggttctgtgt

SEQ ID NO: 7270290 - DNA, 22 bp, Homo sapiens
gagaatgctggagatttatttt

SEQ ID NO: 7270291 - DNA, 22 bp, Homo sapiens
gagaaggctgatccttggagtt

SEQ ID NO: 7270292 - DNA, 22 bp, Homo sapiens
gacctcaggtttgtaatggaca

SEQ ID NO: 7270293 - DNA, 17 bp, Homo sapiens
gacctcaggtgatctgc

SEQ ID NO: 7270294 - DNA, 22 bp, Homo sapiens
gacctcagctgtggggatgctg

SEQ ID NO: 7270295 - DNA, 22 bp, Homo sapiens
gacctcaggcttctgtaattaa

SEQ ID NO: 7270296 - DNA, 22 bp, Homo sapiens
gacctcagtgaatggtcatgta

SEQ ID NO: 7270297 - DNA, 22 bp, Homo sapiens
gacctcgtgatccgccctcctt

SEQ ID NO: 7270298 - DNA, 22 bp, Homo sapiens
gacctctgaaggcagagcaggg

SEQ ID NO: 7270299 - DNA, 22 bp, Homo sapiens
gagatgttgtgggtagttttgg

SEQ ID NO: 7270300 - DNA, 22 bp, Homo sapiens
gagatgttctgattaggtttcc

SEQ ID NO: 7270301 - DNA, 22 bp, Homo sapiens
gagatgtttagatgtttgtcca

SEQ ID NO: 7270302 - DNA, 22 bp, Homo sapiens
gagattctaagtcgttggttag

SEQ ID NO: 7270303 - DNA, 22 bp, Homo sapiens
gagattggcctggcttgccaac

SEQ ID NO: 7270304 - DNA, 22 bp, Homo sapiens
gagattctggttaggtgtattt

SEQ ID NO: 7270305 - DNA, 22 bp, Homo sapiens
gagattctgagaagttaagtcc

SEQ ID NO: 7270306 - DNA, 22 bp, Homo sapiens
gagattctatgttgttgattat

SEQ ID NO: 7270307 - DNA, 21 bp, Homo sapiens
gagatgctttttattcaaccc

SEQ ID NO: 7270308 - DNA, 22 bp, Homo sapiens
gagatgctttgtgtatagacaa

SEQ ID NO: 7270309 - DNA, 22 bp, Homo sapiens
gagatgcttttggtccaagagt

SEQ ID NO: 7270310 - DNA, 22 bp, Homo sapiens
gagatggttgcaatagtttaaa

SEQ ID NO: 7270311 - DNA, 22 bp, Homo sapiens
gagatggagtctttttctgtca

SEQ ID NO: 7270312 - DNA, 22 bp, Homo sapiens
gagcagagtctatttccacact

SEQ ID NO: 7270313 - DNA, 22 bp, Homo sapiens
gagcagcaggtggctgtgatgg

SEQ ID NO: 7270314 - DNA, 22 bp, Homo sapiens
gagccaggttggaggctgcagt

SEQ ID NO: 7270315 - DNA, 22 bp, Homo sapiens
gagcagcttatgtcaagccaga

SEQ ID NO: 7270316 - DNA, 22 bp, Homo sapiens
gagcagctggacaggcctccct

SEQ ID NO: 7270317 - DNA, 22 bp, Homo sapiens
gagcagctgcagtgcagaccct

SEQ ID NO: 7270318 - DNA, 22 bp, Homo sapiens
gaacatttggcatgagaatttg

SEQ ID NO: 7270319 - DNA, 22 bp, Homo sapiens
gaacagtactaagagctttaca

SEQ ID NO: 7270320 - DNA, 22 bp, Homo sapiens
gaaatgctacacttgttaatga

SEQ ID NO: 7270321 - DNA, 20 bp, Homo sapiens
gaaatcagttaatgatggtt

SEQ ID NO: 7270322 - DNA, 22 bp, Homo sapiens
ctttccaactctagtgaaattt

SEQ ID NO: 7270323 - DNA, 22 bp, Homo sapiens
ctttcagaggttactcaggaaa

SEQ ID NO: 7270324 - DNA, 22 bp, Homo sapiens
ctttatgtgctgggcattaagg

SEQ ID NO: 7270325 - DNA, 22 bp, Homo sapiens
gaagaggatgacaggagccggt

SEQ ID NO: 7270326 - DNA, 22 bp, Homo sapiens
gaagaggactgtggcatcctag

SEQ ID NO: 7270327 - DNA, 22 bp, Homo sapiens
gaagataattcctacttataac

SEQ ID NO: 7270328 - DNA, 22 bp, Homo sapiens
gaagcccatttgtacagcacat

SEQ ID NO: 7270329 - DNA, 22 bp, Homo sapiens
gaatacattggaaatcagaata

SEQ ID NO: 7270330 - DNA, 22 bp, Homo sapiens
gaagctttattgcaagtgaggc

SEQ ID NO: 7270331 - DNA, 22 bp, Homo sapiens
gaaggaaaacagatctgcctga

SEQ ID NO: 7270332 - DNA, 22 bp, Homo sapiens
gaaggaaaacagatctgcctga

SEQ ID NO: 7270333 - DNA, 22 bp, Homo sapiens
gaataacattggaaccctgaag

SEQ ID NO: 7270334 - DNA, 22 bp, Homo sapiens
gaatacatgatacatgaactgc

SEQ ID NO: 7270335 - DNA, 22 bp, Homo sapiens
gacaggtgggtacctttatgga

SEQ ID NO: 7270336 - DNA, 18 bp, Homo sapiens
gacaggtgggtgagacca

SEQ ID NO: 7270337 - DNA, 22 bp, Homo sapiens
gacaggtggggaaactaaggta

SEQ ID NO: 7270338 - DNA, 22 bp, Homo sapiens
gacaggtgctaagggacctggc

SEQ ID NO: 7270339 - DNA, 20 bp, Homo sapiens
gacaggtgctaaagaggggc

SEQ ID NO: 7270340 - DNA, 22 bp, Homo sapiens
gacaggtgtgatgatttaggct

SEQ ID NO: 7270341 - DNA, 22 bp, Homo sapiens
gacaggtgggttctcgtatctg

SEQ ID NO: 7270342 - DNA, 22 bp, Homo sapiens
gacaggtgtgtgtatattaggg

SEQ ID NO: 7270343 - DNA, 22 bp, Homo sapiens
gacaggtgaaacagcaaggtaa

SEQ ID NO: 7270344 - DNA, 22 bp, Homo sapiens
gacaggtgagatgaggaacacc

SEQ ID NO: 7270345 - DNA, 21 bp, Homo sapiens
gacaggtgattcagagcaggg

SEQ ID NO: 7270346 - DNA, 22 bp, Homo sapiens
gacaaggcaaccagggaggctt

SEQ ID NO: 7270347 - DNA, 22 bp, Homo sapiens
gacaggcttcatcctcagagtt

SEQ ID NO: 7270348 - DNA, 22 bp, Homo sapiens
ctggctttgctggactgggagt

SEQ ID NO: 7270349 - DNA, 22 bp, Homo sapiens
ctggctttctctgtggtgttca

SEQ ID NO: 7270350 - DNA, 22 bp, Homo sapiens
ctggctttccttgtctgcatcc

SEQ ID NO: 7270351 - DNA, 22 bp, Homo sapiens
ctggctttctatttggtgctat

SEQ ID NO: 7270352 - DNA, 22 bp, Homo sapiens
ctggcttgcagctcatcataaa

SEQ ID NO: 7270353 - DNA, 22 bp, Homo sapiens
ctggctttacctcactggggct

SEQ ID NO: 7270354 - DNA, 22 bp, Homo sapiens
ctggctttcattcattcaggcc

SEQ ID NO: 7270355 - DNA, 22 bp, Homo sapiens
ctggcttttttcccattatgca

SEQ ID NO: 7270356 - DNA, 22 bp, Homo sapiens
ctgggaaatggcttcgagctca

SEQ ID NO: 7270357 - DNA, 22 bp, Homo sapiens
ctggcttttcctaaactgggaa

SEQ ID NO: 7270358 - DNA, 22 bp, Homo sapiens
ctgggcaggagggctctatgga

SEQ ID NO: 7270359 - DNA, 22 bp, Homo sapiens
ctgggcagttttacatcattgc

SEQ ID NO: 7270360 - DNA, 22 bp, Homo sapiens
ctgggctgcagcgggagcgacg

SEQ ID NO: 7270361 - DNA, 22 bp, Homo sapiens
ctggggcccgagccttgggcca

SEQ ID NO: 7270362 - DNA, 22 bp, Homo sapiens
ctggggcccatcgagggctgag

SEQ ID NO: 7270363 - DNA, 20 bp, Homo sapiens
ctggggaggaggatgtgttc

SEQ ID NO: 7270364 - DNA, 22 bp, Homo sapiens
ctggggtgtgctcagagcaggg

SEQ ID NO: 7270365 - DNA, 19 bp, Homo sapiens
ctggccaggccaggggccc

SEQ ID NO: 7270366 - DNA, 22 bp, Homo sapiens
ctggctcaggaaagttgctgct

SEQ ID NO: 7270367 - DNA, 22 bp, Homo sapiens
ctggcctgtcctgacccagcct

SEQ ID NO: 7270368 - DNA, 22 bp, Homo sapiens
ctggctcttgcgactcagcttg

SEQ ID NO: 7270369 - DNA, 22 bp, Homo sapiens
ctggctcttcagtgcttggttc

SEQ ID NO: 7270370 - DNA, 22 bp, Homo sapiens
ctggctcatccaggtgttgctc

SEQ ID NO: 7270371 - DNA, 23 bp, Homo sapiens
ctggctcatcctggttgcagtgg

SEQ ID NO: 7270372 - DNA, 22 bp, Homo sapiens
ctggctggaagttagagaactt

SEQ ID NO: 7270373 - DNA, 22 bp, Homo sapiens
ctggctggaacgccgaggcggc

SEQ ID NO: 7270374 - DNA, 22 bp, Homo sapiens
ctgccagaaggttcctgctgca

SEQ ID NO: 7270375 - DNA, 22 bp, Homo sapiens
ctgcatccatgttgctgcaaag

SEQ ID NO: 7270376 - DNA, 22 bp, Homo sapiens
ctgccaagtaatgcctgggctc

SEQ ID NO: 7270377 - DNA, 22 bp, Homo sapiens
ctgcatcagtggatatgatggt

SEQ ID NO: 7270378 - DNA, 22 bp, Homo sapiens
ctggccactgattcctcccctg

SEQ ID NO: 7270379 - DNA, 22 bp, Homo sapiens
ctggccagctgacagcagggct

SEQ ID NO: 7270380 - DNA, 21 bp, Homo sapiens
ctggccactgcacctcttcct

SEQ ID NO: 7270381 - DNA, 22 bp, Homo sapiens
ctggccactgcacctcttcctt

SEQ ID NO: 7270382 - DNA, 22 bp, Homo sapiens
ctggccagagttggagggtgtg

SEQ ID NO: 7270383 - DNA, 22 bp, Homo sapiens
ctgttaattctagatggtgagt

SEQ ID NO: 7270384 - DNA, 22 bp, Homo sapiens
ctgtgtcttcaatgtactggga

SEQ ID NO: 7270385 - DNA, 22 bp, Homo sapiens
ctgtgtctgaataactctgtgt

SEQ ID NO: 7270386 - DNA, 22 bp, Homo sapiens
ctgtgtctctacctccccatcc

SEQ ID NO: 7270387 - DNA, 22 bp, Homo sapiens
ctgtgtctcgttaaagcattgg

SEQ ID NO: 7270388 - DNA, 21 bp, Homo sapiens
ctgttcactgtgctgtgcaaa

SEQ ID NO: 7270389 - DNA, 22 bp, Homo sapiens
ctgttcttctagtccactgaca

SEQ ID NO: 7270390 - DNA, 22 bp, Homo sapiens
ctgttctttagttccactgcaa

SEQ ID NO: 7270391 - DNA, 22 bp, Homo sapiens
ctgttgcatgactgtgcatgct

SEQ ID NO: 7270392 - DNA, 22 bp, Homo sapiens
ctgtggctctcagaggctgctg

SEQ ID NO: 7270393 - DNA, 22 bp, Homo sapiens
ctgtggctctccaatggaggga

SEQ ID NO: 7270394 - DNA, 22 bp, Homo sapiens
ctgtggctctctgcagggtccc

SEQ ID NO: 7270395 - DNA, 20 bp, Homo sapiens
ctgtggctcatgcatctgcc

SEQ ID NO: 7270396 - DNA, 20 bp, Homo sapiens
ctgtggctcatgcatctgcc

SEQ ID NO: 7270397 - DNA, 22 bp, Homo sapiens
ctgtggctccatagaagttgca

SEQ ID NO: 7270398 - DNA, 16 bp, Homo sapiens
ctgtggctcccaggtt

SEQ ID NO: 7270399 - DNA, 22 bp, Homo sapiens
ctgtggctccagtgaaccaatg

SEQ ID NO: 7270400 - DNA, 22 bp, Homo sapiens
ctgtggctcattcttggtggca

SEQ ID NO: 7270401 - DNA, 22 bp, Homo sapiens
ctgtggctgcgccctgggggag

SEQ ID NO: 7270402 - DNA, 22 bp, Homo sapiens
ctgtggctgcgccatcgaaaac

SEQ ID NO: 7270403 - DNA, 22 bp, Homo sapiens
ctgtggctgcgtaggtctggca

SEQ ID NO: 7270404 - DNA, 22 bp, Homo sapiens
ctgtggctgcagccttggtcct

SEQ ID NO: 7270405 - DNA, 22 bp, Homo sapiens
ctgtggctgcagccttggtcct

SEQ ID NO: 7270406 - DNA, 22 bp, Homo sapiens
ctgtggctgcagaccttaaaca

SEQ ID NO: 7270407 - DNA, 22 bp, Homo sapiens
ctgtggctgcctcacctacagg

SEQ ID NO: 7270408 - DNA, 22 bp, Homo sapiens
ctgtggctctgcagtcccaaca

SEQ ID NO: 7270409 - DNA, 22 bp, Homo sapiens
ctgtggctctttagttgagcac

SEQ ID NO: 7270410 - DNA, 22 bp, Homo sapiens
ctgtggctgaactctgaagagg

SEQ ID NO: 7270411 - DNA, 19 bp, Homo sapiens
ctgtggctgacctctggcc

SEQ ID NO: 7270412 - DNA, 22 bp, Homo sapiens
ctgtggctgagttccttatgtt

SEQ ID NO: 7270413 - DNA, 23 bp, Homo sapiens
ctgtggctgagtcctgttggagt

SEQ ID NO: 7270414 - DNA, 22 bp, Homo sapiens
ctgtggctggccttattgctgc

SEQ ID NO: 7270415 - DNA, 22 bp, Homo sapiens
ctgtggctggaataataaatgt

SEQ ID NO: 7270416 - DNA, 22 bp, Homo sapiens
ctgtggctggcctgtctgacat

SEQ ID NO: 7270417 - DNA, 22 bp, Homo sapiens
ctgtggctggctcatcataggt

SEQ ID NO: 7270418 - DNA, 22 bp, Homo sapiens
ctgtggctgtatttggccagag

SEQ ID NO: 7270419 - DNA, 22 bp, Homo sapiens
ctgtggctgtgaaacttctcag

SEQ ID NO: 7270420 - DNA, 22 bp, Homo sapiens
ctgtggctgtctctttcccatg

SEQ ID NO: 7270421 - DNA, 22 bp, Homo sapiens
ctgtggcttcagcattcagagc

SEQ ID NO: 7270422 - DNA, 22 bp, Homo sapiens
ctgtggtgggccctgggcttca

SEQ ID NO: 7270423 - DNA, 23 bp, Homo sapiens
ctgtgtctatgcagccatatcca

SEQ ID NO: 7270424 - DNA, 22 bp, Homo sapiens
ctgtggccccaccctcttggcc

SEQ ID NO: 7270425 - DNA, 22 bp, Homo sapiens
ctgtggctcatatctgtaatct

SEQ ID NO: 7270426 - DNA, 22 bp, Homo sapiens
ctgtcctggccgcccttgtgag

SEQ ID NO: 7270427 - DNA, 22 bp, Homo sapiens
ctgtcctgcccaccctgcaggg

SEQ ID NO: 7270428 - DNA, 22 bp, Homo sapiens
ctgtcctgatggtgccactggt

SEQ ID NO: 7270429 - DNA, 22 bp, Homo sapiens
ctgtcctgaaagggagattggg

SEQ ID NO: 7270430 - DNA, 22 bp, Homo sapiens
ctgtcccttcattattcactac

SEQ ID NO: 7270431 - DNA, 22 bp, Homo sapiens
ctgggtgacagagtgagatggt

SEQ ID NO: 7270432 - DNA, 22 bp, Homo sapiens
ctgggtgagctggccagagggt

SEQ ID NO: 7270433 - DNA, 22 bp, Homo sapiens
cttgtccccagcaggttggttt

SEQ ID NO: 7270434 - DNA, 22 bp, Homo sapiens
cttgtccagatgtttgttaggt

SEQ ID NO: 7270435 - DNA, 22 bp, Homo sapiens
cttgtcttgcacacggttgcca

SEQ ID NO: 7270436 - DNA, 22 bp, Homo sapiens
cttgtagacccctggactcacg

SEQ ID NO: 7270437 - DNA, 22 bp, Homo sapiens
cttgcatgcatttgaagatcat

SEQ ID NO: 7270438 - DNA, 22 bp, Homo sapiens
cttcctggatgagcaggctgat

SEQ ID NO: 7270439 - DNA, 22 bp, Homo sapiens
cttgatggaggggccaggcttt

SEQ ID NO: 7270440 - DNA, 22 bp, Homo sapiens
cttgcacacatgtacatgtgta

SEQ ID NO: 7270441 - DNA, 22 bp, Homo sapiens
cttgcaggattttgctgctgta

SEQ ID NO: 7270442 - DNA, 23 bp, Homo sapiens
cttgcaggaagcagatggcacac

SEQ ID NO: 7270443 - DNA, 22 bp, Homo sapiens
cttgcaggcctttctagctcta

SEQ ID NO: 7270444 - DNA, 23 bp, Homo sapiens
cttgcagggctggaggcttagaa

SEQ ID NO: 7270445 - DNA, 22 bp, Homo sapiens
cttcagtgaatgttgagtaagg

SEQ ID NO: 7270446 - DNA, 22 bp, Homo sapiens
cttcagtgatataggcttctcc

SEQ ID NO: 7270447 - DNA, 22 bp, Homo sapiens
cttattttaagtcagtttgggt

SEQ ID NO: 7270448 - DNA, 22 bp, Homo sapiens
cttatttctccatccagagtca

SEQ ID NO: 7270449 - DNA, 22 bp, Homo sapiens
cttatttcagccctgggcaccc

SEQ ID NO: 7270450 - DNA, 22 bp, Homo sapiens
cttattttgctgatgacccagg

SEQ ID NO: 7270451 - DNA, 22 bp, Homo sapiens
cggtttattttcaggaactgaa

SEQ ID NO: 7270452 - DNA, 22 bp, Homo sapiens
ttcatgaatgttccatgtgagt

SEQ ID NO: 7270453 - DNA, 22 bp, Homo sapiens
ctaaagaagctagcaatctata

SEQ ID NO: 7270454 - DNA, 22 bp, Homo sapiens
ctaaacttttataacattgaga

SEQ ID NO: 7270455 - DNA, 22 bp, Homo sapiens
ttcagcaaatggactgttcagg

SEQ ID NO: 7270456 - DNA, 22 bp, Homo sapiens
ttcagcaaacacgatgcttgtt

SEQ ID NO: 7270457 - DNA, 22 bp, Homo sapiens
ttcagatgtggctttgtcaggc

SEQ ID NO: 7270458 - DNA, 22 bp, Homo sapiens
ttcagggagagcgggacgggtg

SEQ ID NO: 7270459 - DNA, 22 bp, Homo sapiens
ttcagataaactacaaataatt

SEQ ID NO: 7270460 - DNA, 19 bp, Homo sapiens
ttcacaattatgaaattag

SEQ ID NO: 7270461 - DNA, 22 bp, Homo sapiens
ttcaatatcattgtttagtctc

SEQ ID NO: 7270462 - DNA, 22 bp, Homo sapiens
cgccgcctgctgcagcagctgt

SEQ ID NO: 7270463 - DNA, 22 bp, Homo sapiens
cgccggcttgaggcaggcggca

SEQ ID NO: 7270464 - DNA, 22 bp, Homo sapiens
cctttcccgctttgagggcaag

SEQ ID NO: 7270465 - DNA, 22 bp, Homo sapiens
ctatggtgatagaaatcagaat

SEQ ID NO: 7270466 - DNA, 22 bp, Homo sapiens
ctatggctccttctctactggg

SEQ ID NO: 7270467 - DNA, 22 bp, Homo sapiens
ctatggctcaattctagtggtt

SEQ ID NO: 7270468 - DNA, 22 bp, Homo sapiens
ctagcagcattcttctagttag

SEQ ID NO: 7270469 - DNA, 22 bp, Homo sapiens
ctcacagatgtcctggcacttc

SEQ ID NO: 7270470 - DNA, 22 bp, Homo sapiens
ctcacaggtaccagcaccctcc

SEQ ID NO: 7270471 - DNA, 22 bp, Homo sapiens
ctcaagatgtcagggcacctgc

SEQ ID NO: 7270472 - DNA, 22 bp, Homo sapiens
ctcaagatcatcaatataccaa

SEQ ID NO: 7270473 - DNA, 22 bp, Homo sapiens
ctcaagatcacacagctgagaa

SEQ ID NO: 7270474 - DNA, 22 bp, Homo sapiens
ctcaagatattccagctctcaa

SEQ ID NO: 7270475 - DNA, 22 bp, Homo sapiens
ctcaagatattccagctctcaa

SEQ ID NO: 7270476 - DNA, 22 bp, Homo sapiens
ctcaagataatgacaaaaagag

SEQ ID NO: 7270477 - DNA, 22 bp, Homo sapiens
ctcaagtccatagaatcaggaa

SEQ ID NO: 7270478 - DNA, 22 bp, Homo sapiens
ctcaagtcagaaataaaagcat

SEQ ID NO: 7270479 - DNA, 22 bp, Homo sapiens
ctcaagtctgagtactggctct

SEQ ID NO: 7270480 - DNA, 22 bp, Homo sapiens
ctcaagtctattgataagtgca

SEQ ID NO: 7270481 - DNA, 22 bp, Homo sapiens
ctcaagtctgatgggttaggtt

SEQ ID NO: 7270482 - DNA, 22 bp, Homo sapiens
ctcaaaatccataaaatcaggt

SEQ ID NO: 7270483 - DNA, 22 bp, Homo sapiens
ttccaggaccaggaagagggga

SEQ ID NO: 7270484 - DNA, 22 bp, Homo sapiens
ttccaggagccacacaggggcg

SEQ ID NO: 7270485 - DNA, 21 bp, Homo sapiens
ctacttaagtaggggattagg

SEQ ID NO: 7270486 - DNA, 22 bp, Homo sapiens
ctacccaggcttagagggctgg

SEQ ID NO: 7270487 - DNA, 22 bp, Homo sapiens
cctggtgtcatggatgtcacat

SEQ ID NO: 7270488 - DNA, 20 bp, Homo sapiens
cctggtgtatttcctggggt

SEQ ID NO: 7270489 - DNA, 22 bp, Homo sapiens
cctggtgttgtgaagtagccgt

SEQ ID NO: 7270490 - DNA, 22 bp, Homo sapiens
cctggtgttatcataggtcatg

SEQ ID NO: 7270491 - DNA, 22 bp, Homo sapiens
cctggtgttgccaatctgtgcc

SEQ ID NO: 7270492 - DNA, 22 bp, Homo sapiens
cctggtgtggctgtcacagagg

SEQ ID NO: 7270493 - DNA, 22 bp, Homo sapiens
cctggtgtggccctgtgacatg

SEQ ID NO: 7270494 - DNA, 22 bp, Homo sapiens
cctggtgtctgtttacagcagc

SEQ ID NO: 7270495 - DNA, 23 bp, Homo sapiens
tgttccagatacgccttttcctc

SEQ ID NO: 7270496 - DNA, 22 bp, Homo sapiens
tgtgttctgaaggagaagagtg

SEQ ID NO: 7270497 - DNA, 22 bp, Homo sapiens
cctgggctggagtacagcagtg

SEQ ID NO: 7270498 - DNA, 22 bp, Homo sapiens
cctgggctgaagtcaagtgtgg

SEQ ID NO: 7270499 - DNA, 22 bp, Homo sapiens
tgtgtatgtaagcatgtgcata

SEQ ID NO: 7270500 - DNA, 22 bp, Homo sapiens
tgtgtattaatgtttgtatatg

SEQ ID NO: 7270501 - DNA, 23 bp, Homo sapiens
tgtgtctgaggatatatgtgcat

SEQ ID NO: 7270502 - DNA, 22 bp, Homo sapiens
cctgggcaaatgccagagacaa

SEQ ID NO: 7270503 - DNA, 22 bp, Homo sapiens
cctgggatttgcgccagacctt

SEQ ID NO: 7270504 - DNA, 22 bp, Homo sapiens
cctgggatttcctgagcactct

SEQ ID NO: 7270505 - DNA, 22 bp, Homo sapiens
cctgggcaacatagggagaccc

SEQ ID NO: 7270506 - DNA, 23 bp, Homo sapiens
tggggccaagtgaggaagggtct

SEQ ID NO: 7270507 - DNA, 22 bp, Homo sapiens
tggggccacactgatctcccag

SEQ ID NO: 7270508 - DNA, 23 bp, Homo sapiens
ttacttttgcaccaacctaatat

SEQ ID NO: 7270509 - DNA, 22 bp, Homo sapiens
ccttctagcaaatcaacataaa

SEQ ID NO: 7270510 - DNA, 22 bp, Homo sapiens
ccttcctttcagggctatgcct

SEQ ID NO: 7270511 - DNA, 22 bp, Homo sapiens
ccttccttgagaagcaattcct

SEQ ID NO: 7270512 - DNA, 22 bp, Homo sapiens
ttagaaaaatgttcagtagttt

SEQ ID NO: 7270513 - DNA, 22 bp, Homo sapiens
ttagacaagggctccttaaaag

SEQ ID NO: 7270514 - DNA, 20 bp, Homo sapiens
cctttagaaactcatatgta

SEQ ID NO: 7270515 - DNA, 23 bp, Homo sapiens
ttagacaatcctcaaaaggtaat

SEQ ID NO: 7270516 - DNA, 22 bp, Homo sapiens
ttagacaatctgttggtaaggt

SEQ ID NO: 7270517 - DNA, 22 bp, Homo sapiens
cctgtgtgaaggttaggcaggt

SEQ ID NO: 7270518 - DNA, 22 bp, Homo sapiens
cctgtgtgattggaagctgaga

SEQ ID NO: 7270519 - DNA, 20 bp, Homo sapiens
cctgtgtggccagctgaggc

SEQ ID NO: 7270520 - DNA, 22 bp, Homo sapiens
cctgtgtggtagccagcggtgc

SEQ ID NO: 7270521 - DNA, 22 bp, Homo sapiens
cctgtgcttcactcaacaagcc

SEQ ID NO: 7270522 - DNA, 22 bp, Homo sapiens
cctgtgctgggaaaacacggag

SEQ ID NO: 7270523 - DNA, 21 bp, Homo sapiens
cctgtgctccacacagggtcc

SEQ ID NO: 7270524 - DNA, 22 bp, Homo sapiens
ttaaagtatagaggacaaaaac

SEQ ID NO: 7270525 - DNA, 20 bp, Homo sapiens
tttcacagtccctgtttcct

SEQ ID NO: 7270526 - DNA, 22 bp, Homo sapiens
tttcacagttagcatgaggact

SEQ ID NO: 7270527 - DNA, 22 bp, Homo sapiens
tttcctaggagattgatcacat

SEQ ID NO: 7270528 - DNA, 22 bp, Homo sapiens
tttccagagcatgtctgctcag

SEQ ID NO: 7270529 - DNA, 22 bp, Homo sapiens
tttccagagcatgtctgctcag

SEQ ID NO: 7270530 - DNA, 23 bp, Homo sapiens
tttcaaattactctgcagatgac

SEQ ID NO: 7270531 - DNA, 21 bp, Homo sapiens
tttcacaaaagtatgtgacaa

SEQ ID NO: 7270532 - DNA, 22 bp, Homo sapiens
tttcacaggtaagcaatacagg

SEQ ID NO: 7270533 - DNA, 22 bp, Homo sapiens
tttcacaaatgtctttaacttg

SEQ ID NO: 7270534 - DNA, 22 bp, Homo sapiens
ctctccagtcaggaactctgac

SEQ ID NO: 7270535 - DNA, 22 bp, Homo sapiens
ctctccaggttagagcacttat

SEQ ID NO: 7270536 - DNA, 22 bp, Homo sapiens
ctctccagtcatattctcagtc

SEQ ID NO: 7270537 - DNA, 21 bp, Homo sapiens
ctctccaggtaggataaatgt

SEQ ID NO: 7270538 - DNA, 22 bp, Homo sapiens
ctctccaggggtagatgccttc

SEQ ID NO: 7270539 - DNA, 22 bp, Homo sapiens
ctctccaggctgggacaggacc

SEQ ID NO: 7270540 - DNA, 22 bp, Homo sapiens
ctctccaggagctcagagtcta

SEQ ID NO: 7270541 - DNA, 22 bp, Homo sapiens
tttcctagttctaagaaatgta

SEQ ID NO: 7270542 - DNA, 22 bp, Homo sapiens
tttccttgttattatttgtcct

SEQ ID NO: 7270543 - DNA, 18 bp, Homo sapiens
tttccttgtatgaacata

SEQ ID NO: 7270544 - DNA, 22 bp, Homo sapiens
tttccttgggtctcttagtggc

SEQ ID NO: 7270545 - DNA, 23 bp, Homo sapiens
ctccccagtgtcctcatgcatct

SEQ ID NO: 7270546 - DNA, 22 bp, Homo sapiens
tttagacatggcttgctcactt

SEQ ID NO: 7270547 - DNA, 19 bp, Homo sapiens
tttagacattgtctggtat

SEQ ID NO: 7270548 - DNA, 22 bp, Homo sapiens
tttagacatttgtggtttgcaa

SEQ ID NO: 7270549 - DNA, 22 bp, Homo sapiens
tttagtatgtatttaatggact

SEQ ID NO: 7270550 - DNA, 22 bp, Homo sapiens
tttagtctgactattacctcca

SEQ ID NO: 7270551 - DNA, 22 bp, Homo sapiens
tttagtatataaaaagagaagt

SEQ ID NO: 7270552 - DNA, 22 bp, Homo sapiens
tttattgttgggtcttaagctg

SEQ ID NO: 7270553 - DNA, 22 bp, Homo sapiens
tttattgttatcatgggtgagt

SEQ ID NO: 7270554 - DNA, 22 bp, Homo sapiens
tttattgttgttagtcataagt

SEQ ID NO: 7270555 - DNA, 22 bp, Homo sapiens
tttattgttgttagtcataagt

SEQ ID NO: 7270556 - DNA, 22 bp, Homo sapiens
tttattgtttagaagggggctg

SEQ ID NO: 7270557 - DNA, 22 bp, Homo sapiens
tttattgtttagaagggggctg

SEQ ID NO: 7270558 - DNA, 22 bp, Homo sapiens
tttatttaccttatgtcctcca

SEQ ID NO: 7270559 - DNA, 22 bp, Homo sapiens
tttatttaaagtcgtgtgttaa

SEQ ID NO: 7270560 - DNA, 22 bp, Homo sapiens
ttcttttcctacacagcgattt

SEQ ID NO: 7270561 - DNA, 22 bp, Homo sapiens
ctccaaattcagtcacagtctg

SEQ ID NO: 7270562 - DNA, 22 bp, Homo sapiens
ctccaaatataatcacattgga

SEQ ID NO: 7270563 - DNA, 19 bp, Homo sapiens
ctccaaatacttttccctt

SEQ ID NO: 7270564 - DNA, 23 bp, Homo sapiens
ctccaaatactcccaattgtttt

SEQ ID NO: 7270565 - DNA, 22 bp, Homo sapiens
ctccaaatacagtcatcttggg

SEQ ID NO: 7270566 - DNA, 22 bp, Homo sapiens
ctccaaatacaatattgttgtt

SEQ ID NO: 7270567 - DNA, 22 bp, Homo sapiens
ttgaaatactgcattgttcagt

SEQ ID NO: 7270568 - DNA, 22 bp, Homo sapiens
ctccagcagaaagggcgagtgg

SEQ ID NO: 7270569 - DNA, 22 bp, Homo sapiens
ctccagattccgtttattcagg

SEQ ID NO: 7270570 - DNA, 22 bp, Homo sapiens
ctccagatgtatactttccaag

SEQ ID NO: 7270571 - DNA, 20 bp, Homo sapiens
ctccaaattcctgaggataa

SEQ ID NO: 7270572 - DNA, 19 bp, Homo sapiens
ctccaagttaagagggagg

SEQ ID NO: 7270573 - DNA, 22 bp, Homo sapiens
ctccagcctcagatgacggtac

SEQ ID NO: 7270574 - DNA, 22 bp, Homo sapiens
ttgtggttaaccgcacattttt

SEQ ID NO: 7270575 - DNA, 22 bp, Homo sapiens
ctcccaggcacagggaggagcc

SEQ ID NO: 7270576 - DNA, 22 bp, Homo sapiens
tttaatatttctttcctgaagc

SEQ ID NO: 7270577 - DNA, 22 bp, Homo sapiens
tttaatatccagtggatacaaa

SEQ ID NO: 7270578 - DNA, 22 bp, Homo sapiens
ctcccaggactcagaggagaag

SEQ ID NO: 7270579 - DNA, 22 bp, Homo sapiens
ctcccagccttcgccagtctga

SEQ ID NO: 7270580 - DNA, 22 bp, Homo sapiens
tttgtacatataaatcttgtat

SEQ ID NO: 7270581 - DNA, 22 bp, Homo sapiens
tttgtacactgtctactatgaa

SEQ ID NO: 7270582 - DNA, 22 bp, Homo sapiens
tttgggcaggcttttccctaga

SEQ ID NO: 7270583 - DNA, 22 bp, Homo sapiens
ttttagattgggaaatgtaaag

SEQ ID NO: 7270584 - DNA, 22 bp, Homo sapiens
ttttagacttgtatgtaaagcc

SEQ ID NO: 7270585 - DNA, 22 bp, Homo sapiens
ttttagactccatctgattcag

SEQ ID NO: 7270586 - DNA, 22 bp, Homo sapiens
ttttaatactgctattgtagga

SEQ ID NO: 7270587 - DNA, 22 bp, Homo sapiens
ttttagtgtagtcaccgtgggt

SEQ ID NO: 7270588 - DNA, 22 bp, Homo sapiens
ttttcagaggcctaagaggttt

SEQ ID NO: 7270589 - DNA, 22 bp, Homo sapiens
ttttcaggtgcagtaatcatat

SEQ ID NO: 7270590 - DNA, 22 bp, Homo sapiens
ttttcagtgggcaatgatgtga

SEQ ID NO: 7270591 - DNA, 22 bp, Homo sapiens
ttttcagtaatgtctacataat

SEQ ID NO: 7270592 - DNA, 22 bp, Homo sapiens
ctcttcttgctagactgagtgc

SEQ ID NO: 7270593 - DNA, 22 bp, Homo sapiens
ttttcagttccatctctgctct

SEQ ID NO: 7270594 - DNA, 22 bp, Homo sapiens
ctcttcttgcctgatgaggcag

SEQ ID NO: 7270595 - DNA, 22 bp, Homo sapiens
ttttcagttactgtttatgtga

SEQ ID NO: 7270596 - DNA, 19 bp, Homo sapiens
ctctgcctccctcctgggt

SEQ ID NO: 7270597 - DNA, 19 bp, Homo sapiens
ctctgcctccctcctgggt

SEQ ID NO: 7270598 - DNA, 22 bp, Homo sapiens
tttccttgttcatttgccctat

SEQ ID NO: 7270599 - DNA, 22 bp, Homo sapiens
ctctgctttcctcttacacact

SEQ ID NO: 7270600 - DNA, 19 bp, Homo sapiens
tttgccttgcagctgtgtg

SEQ ID NO: 7270601 - DNA, 22 bp, Homo sapiens
ctgaggccagctgcagagctct

SEQ ID NO: 7270602 - DNA, 22 bp, Homo sapiens
ctgaggcccctctcttgagctt

SEQ ID NO: 7270603 - DNA, 22 bp, Homo sapiens
ctgaggcccctcttgtgagcat

SEQ ID NO: 7270604 - DNA, 22 bp, Homo sapiens
ctgaggccggagcactgaagag

SEQ ID NO: 7270605 - DNA, 19 bp, Homo sapiens
ctgcagggatgtgcagagt

SEQ ID NO: 7270606 - DNA, 22 bp, Homo sapiens
ctgcaggggaccaaagtctgac

SEQ ID NO: 7270607 - DNA, 22 bp, Homo sapiens
ctgacccatataagagtggagg

SEQ ID NO: 7270608 - DNA, 22 bp, Homo sapiens
ctctttcctcagccacagtcta

SEQ ID NO: 7270609 - DNA, 22 bp, Homo sapiens
ctgagccccatctgaggtgccc

SEQ ID NO: 7270610 - DNA, 22 bp, Homo sapiens
ctgagccccatctgaggtgccc

SEQ ID NO: 7270611 - DNA, 22 bp, Homo sapiens
ctgagcccattgggtgctgtta

SEQ ID NO: 7270612 - DNA, 22 bp, Homo sapiens
ctgagcccctctgacctcagag

SEQ ID NO: 7270613 - DNA, 20 bp, Homo sapiens
ctgagcccccagcctgcagg

SEQ ID NO: 7270614 - DNA, 22 bp, Homo sapiens
ctgagcctccatttcatcaggt

SEQ ID NO: 7270615 - DNA, 22 bp, Homo sapiens
ccaggagtggctggtgaccttc

SEQ ID NO: 7270616 - DNA, 22 bp, Homo sapiens
ccaggagactgtactgatattt

SEQ ID NO: 7270617 - DNA, 22 bp, Homo sapiens
ccaggagacaaagatgactgct

SEQ ID NO: 7270618 - DNA, 22 bp, Homo sapiens
ccaggagacccagggaaggagc

SEQ ID NO: 7270619 - DNA, 17 bp, Homo sapiens
ccaggagagatgcttgt

SEQ ID NO: 7270620 - DNA, 22 bp, Homo sapiens
tcttcacattttagtggtttgt

SEQ ID NO: 7270621 - DNA, 22 bp, Homo sapiens
tcttcacatggaacatgaagct

SEQ ID NO: 7270622 - DNA, 22 bp, Homo sapiens
tcttccctaatcaccatcttca

SEQ ID NO: 7270623 - DNA, 22 bp, Homo sapiens
ccaggcagggagctgtttggcc

SEQ ID NO: 7270624 - DNA, 22 bp, Homo sapiens
tcttcagataaagggagagtat

SEQ ID NO: 7270625 - DNA, 22 bp, Homo sapiens
tcttcagacccttagctgtgat

SEQ ID NO: 7270626 - DNA, 22 bp, Homo sapiens
tcttcagactccaaatgtttta

SEQ ID NO: 7270627 - DNA, 22 bp, Homo sapiens
tcttcagagtgaaagtctgtga

SEQ ID NO: 7270628 - DNA, 22 bp, Homo sapiens
tcttcagaggaagtcagtcttt

SEQ ID NO: 7270629 - DNA, 22 bp, Homo sapiens
ccaggctggagtgcaatggcgt

SEQ ID NO: 7270630 - DNA, 22 bp, Homo sapiens
ccaggctgctgttggtgtccgc

SEQ ID NO: 7270631 - DNA, 22 bp, Homo sapiens
ccaggctggagtgcaatggcat

SEQ ID NO: 7270632 - DNA, 22 bp, Homo sapiens
ccaggctgagcatgattggagc

SEQ ID NO: 7270633 - DNA, 22 bp, Homo sapiens
ccaggctgaatatgttccaggg

SEQ ID NO: 7270634 - DNA, 19 bp, Homo sapiens
ccaggccatcccagttccc

SEQ ID NO: 7270635 - DNA, 22 bp, Homo sapiens
tctttcaatgagcattctttcc

SEQ ID NO: 7270636 - DNA, 22 bp, Homo sapiens
ccagctctgattttgacctcca

SEQ ID NO: 7270637 - DNA, 22 bp, Homo sapiens
ccagctctgcatgtttcccttg

SEQ ID NO: 7270638 - DNA, 22 bp, Homo sapiens
ccagctctgcatgtttcccttg

SEQ ID NO: 7270639 - DNA, 22 bp, Homo sapiens
ccagctctctttgaagcataaa

SEQ ID NO: 7270640 - DNA, 22 bp, Homo sapiens
ccagctctgccaagcgtcagct

SEQ ID NO: 7270641 - DNA, 22 bp, Homo sapiens
ccagctctcagcgggagactca

SEQ ID NO: 7270642 - DNA, 22 bp, Homo sapiens
ccagctctctgcagaaaggact

SEQ ID NO: 7270643 - DNA, 22 bp, Homo sapiens
tctgctttgctgcctcctgatc

SEQ ID NO: 7270644 - DNA, 22 bp, Homo sapiens
tctgctttgaccttcttgatgc

SEQ ID NO: 7270645 - DNA, 22 bp, Homo sapiens
tctgctttagtgcaaagtctta

SEQ ID NO: 7270646 - DNA, 22 bp, Homo sapiens
tctgctttcaaattcacttagt

SEQ ID NO: 7270647 - DNA, 22 bp, Homo sapiens
tctcagaagtgatcaggatgtt

SEQ ID NO: 7270648 - DNA, 22 bp, Homo sapiens
ccagagagaaatggatttgagt

SEQ ID NO: 7270649 - DNA, 22 bp, Homo sapiens
ccagagactggctgagagatct

SEQ ID NO: 7270650 - DNA, 22 bp, Homo sapiens
ccagagaccagaacatggggat

SEQ ID NO: 7270651 - DNA, 22 bp, Homo sapiens
ccagagacgtcggtcagggcgc

SEQ ID NO: 7270652 - DNA, 22 bp, Homo sapiens
tctcagaatccttgcccaggtg

SEQ ID NO: 7270653 - DNA, 22 bp, Homo sapiens
tctcagagaagtgatgagcaat

SEQ ID NO: 7270654 - DNA, 22 bp, Homo sapiens
ccaggagaagcatctgagtgta

SEQ ID NO: 7270655 - DNA, 22 bp, Homo sapiens
ccaggagaatgggattacccta

SEQ ID NO: 7270656 - DNA, 22 bp, Homo sapiens
ccaggagaataatggcagatta

SEQ ID NO: 7270657 - DNA, 22 bp, Homo sapiens
tctggtgtcagtattctttgaa

SEQ ID NO: 7270658 - DNA, 22 bp, Homo sapiens
ccaggacagtgaacatgtaaga

SEQ ID NO: 7270659 - DNA, 22 bp, Homo sapiens
ccagtgttccctcgggttcatg

SEQ ID NO: 7270660 - DNA, 22 bp, Homo sapiens
ccagtgttccatggagtgatta

SEQ ID NO: 7270661 - DNA, 22 bp, Homo sapiens
tgaggggaactgatgcccattg

SEQ ID NO: 7270662 - DNA, 22 bp, Homo sapiens
ccagtgttctggtgttcatttc

SEQ ID NO: 7270663 - DNA, 22 bp, Homo sapiens
ccagtgttgaacagtatttgga

SEQ ID NO: 7270664 - DNA, 22 bp, Homo sapiens
ccagtgtttaggaataaaatgt

SEQ ID NO: 7270665 - DNA, 22 bp, Homo sapiens
ccagtgtttacagttgaacaaa

SEQ ID NO: 7270666 - DNA, 22 bp, Homo sapiens
ccagtgttggaggatggcttgc

SEQ ID NO: 7270667 - DNA, 22 bp, Homo sapiens
ccagtgttgcataggatgggga

SEQ ID NO: 7270668 - DNA, 22 bp, Homo sapiens
tgaggcagcattcttcaagaca

SEQ ID NO: 7270669 - DNA, 22 bp, Homo sapiens
tgaggcagcctgcattaaagag

SEQ ID NO: 7270670 - DNA, 22 bp, Homo sapiens
tgaggcagcccactttccttag

SEQ ID NO: 7270671 - DNA, 22 bp, Homo sapiens
ccagtcctcagatggtctgtgc

SEQ ID NO: 7270672 - DNA, 22 bp, Homo sapiens
ccagtctcctaagagcccctga

SEQ ID NO: 7270673 - DNA, 22 bp, Homo sapiens
ccatgcatataatagtgcctgg

SEQ ID NO: 7270674 - DNA, 22 bp, Homo sapiens
ccatgcagtgctggagctgatt

SEQ ID NO: 7270675 - DNA, 22 bp, Homo sapiens
ccagtgtttccccagaagagag

SEQ ID NO: 7270676 - DNA, 22 bp, Homo sapiens
ccagtgtttccgtcagtacacg

SEQ ID NO: 7270677 - DNA, 22 bp, Homo sapiens
ccagtgttttcatcctcccttg

SEQ ID NO: 7270678 - DNA, 22 bp, Homo sapiens
ccagtgtttgatgggattttca

SEQ ID NO: 7270679 - DNA, 22 bp, Homo sapiens
ccatgctgtgacacagtagtta

SEQ ID NO: 7270680 - DNA, 22 bp, Homo sapiens
tgaggtaggtggtgaaaaatga

SEQ ID NO: 7270681 - DNA, 23 bp, Homo sapiens
tgattttaaaaagtaagttatca

SEQ ID NO: 7270682 - DNA, 22 bp, Homo sapiens
tgatttgaggtacataaatcca

SEQ ID NO: 7270683 - DNA, 22 bp, Homo sapiens
tgattttacttagcatgatgtt

SEQ ID NO: 7270684 - DNA, 22 bp, Homo sapiens
tgatttctcatattgttcaaaa

SEQ ID NO: 7270685 - DNA, 22 bp, Homo sapiens
ccattgtaaattctgtggaagt

SEQ ID NO: 7270686 - DNA, 23 bp, Homo sapiens
tgcaaataacaaggagtttaagg

SEQ ID NO: 7270687 - DNA, 22 bp, Homo sapiens
tgcaaatacaaaatggtacagc

SEQ ID NO: 7270688 - DNA, 22 bp, Homo sapiens
tgcaaataaatttctgttcatt

SEQ ID NO: 7270689 - DNA, 21 bp, Homo sapiens
tgcaaagctgctgaagtggta

SEQ ID NO: 7270690 - DNA, 22 bp, Homo sapiens
tgcaaagccaccctggcggtgg

SEQ ID NO: 7270691 - DNA, 22 bp, Homo sapiens
tgcaaagcaatgtaggtcagct

SEQ ID NO: 7270692 - DNA, 22 bp, Homo sapiens
tgcaaataggggacaactcttt

SEQ ID NO: 7270693 - DNA, 22 bp, Homo sapiens
cccagaaggtcgaggctgcagt

SEQ ID NO: 7270694 - DNA, 22 bp, Homo sapiens
tgacatcagggcaggggttgag

SEQ ID NO: 7270695 - DNA, 22 bp, Homo sapiens
tgacatcagaatggcatagaaa

SEQ ID NO: 7270696 - DNA, 22 bp, Homo sapiens
tgacatcacgtcctttcagaga

SEQ ID NO: 7270697 - DNA, 22 bp, Homo sapiens
tgacatcacaagccatctgcag

SEQ ID NO: 7270698 - DNA, 22 bp, Homo sapiens
tgacatcattggccattgggga

SEQ ID NO: 7270699 - DNA, 22 bp, Homo sapiens
tgacatcattagtaacatagct

SEQ ID NO: 7270700 - DNA, 22 bp, Homo sapiens
ccaggggcctgtgaaggtgccc

SEQ ID NO: 7270701 - DNA, 22 bp, Homo sapiens
tgacagtgtcagtttcctaata

SEQ ID NO: 7270702 - DNA, 22 bp, Homo sapiens
tgacagttaaggtatacattca

SEQ ID NO: 7270703 - DNA, 20 bp, Homo sapiens
ccaggctggcaaatgggggc

SEQ ID NO: 7270704 - DNA, 22 bp, Homo sapiens
ccaggctggattttgcagttca

SEQ ID NO: 7270705 - DNA, 20 bp, Homo sapiens
ccaggctggcaaatgggggc

SEQ ID NO: 7270706 - DNA, 22 bp, Homo sapiens
ccaggctggagtgtagtcgcat

SEQ ID NO: 7270707 - DNA, 22 bp, Homo sapiens
ccaggctggagtgtagtcgcat

SEQ ID NO: 7270708 - DNA, 22 bp, Homo sapiens
ccaggctggagtgcagtggcac

SEQ ID NO: 7270709 - DNA, 22 bp, Homo sapiens
ccaggctggagtgcagtagtgt

SEQ ID NO: 7270710 - DNA, 22 bp, Homo sapiens
ccaggctggagtgcagtagtgt

SEQ ID NO: 7270711 - DNA, 22 bp, Homo sapiens
ccaggctggagtgcaatggtgc

SEQ ID NO: 7270712 - DNA, 21 bp, Homo sapiens
tgaatgcttcgtcatcctggc

SEQ ID NO: 7270713 - DNA, 22 bp, Homo sapiens
tgaggcagatatttattgggtt

SEQ ID NO: 7270714 - DNA, 22 bp, Homo sapiens
tgaggcagcaattgtattgtat

SEQ ID NO: 7270715 - DNA, 22 bp, Homo sapiens
tgaggcagcaattgattattca

SEQ ID NO: 7270716 - DNA, 22 bp, Homo sapiens
tgaggcagagtaagatacatga

SEQ ID NO: 7270717 - DNA, 22 bp, Homo sapiens
tgaggcagaaattcctgttttc

SEQ ID NO: 7270718 - DNA, 20 bp, Homo sapiens
tgagacccgctgacaagttc

SEQ ID NO: 7270719 - DNA, 23 bp, Homo sapiens
tgagaccctaatttagcaagtgt

SEQ ID NO: 7270720 - DNA, 22 bp, Homo sapiens
tgagacgaagtcttgctctgtt

SEQ ID NO: 7270721 - DNA, 22 bp, Homo sapiens
ccaggtgtagcactgctcacag

SEQ ID NO: 7270722 - DNA, 22 bp, Homo sapiens
tgagaaggcctgtgtgacaggg

SEQ ID NO: 7270723 - DNA, 20 bp, Homo sapiens
tgagaaggggtcagctgtac

SEQ ID NO: 7270724 - DNA, 22 bp, Homo sapiens
tgagaatgaatcttttgctttc

SEQ ID NO: 7270725 - DNA, 21 bp, Homo sapiens
ccagggtccagctgccatggt

SEQ ID NO: 7270726 - DNA, 22 bp, Homo sapiens
ccagggtcacaaataactgcag

SEQ ID NO: 7270727 - DNA, 21 bp, Homo sapiens
ccagggtccagctgccatggt

SEQ ID NO: 7270728 - DNA, 21 bp, Homo sapiens
ccctgcaggccagggctgagc

SEQ ID NO: 7270729 - DNA, 22 bp, Homo sapiens
ccctgcagggaggattctgaag

SEQ ID NO: 7270730 - DNA, 22 bp, Homo sapiens
ccctgcaggggacctgcagcct

SEQ ID NO: 7270731 - DNA, 23 bp, Homo sapiens
ccctgcagtcagggtgagatggt

SEQ ID NO: 7270732 - DNA, 21 bp, Homo sapiens
cccttcttgggtcaaagtata

SEQ ID NO: 7270733 - DNA, 19 bp, Homo sapiens
tggcagaggacaaggactt

SEQ ID NO: 7270734 - DNA, 22 bp, Homo sapiens
tggcagaggaaaaagtcactgg

SEQ ID NO: 7270735 - DNA, 22 bp, Homo sapiens
cccttcctgggtgtcccggagt

SEQ ID NO: 7270736 - DNA, 22 bp, Homo sapiens
cccttcctcctcgcctgtcaga

SEQ ID NO: 7270737 - DNA, 22 bp, Homo sapiens
cccttcctggagtaccctctgt

SEQ ID NO: 7270738 - DNA, 22 bp, Homo sapiens
cccttcctggagtaccctctgt

SEQ ID NO: 7270739 - DNA, 22 bp, Homo sapiens
ccctgtggggtccgcctgtccg

SEQ ID NO: 7270740 - DNA, 22 bp, Homo sapiens
cctaggagagggaaaatctagg

SEQ ID NO: 7270741 - DNA, 22 bp, Homo sapiens
cctagaggctgcaaggagaggc

SEQ ID NO: 7270742 - DNA, 22 bp, Homo sapiens
tggcagaggctctgtgatgttg

SEQ ID NO: 7270743 - DNA, 18 bp, Homo sapiens
cctaagctccagccccag

SEQ ID NO: 7270744 - DNA, 22 bp, Homo sapiens
tggcagaggaggctcagattga

SEQ ID NO: 7270745 - DNA, 19 bp, Homo sapiens
tggcagaggcagtttgtac

SEQ ID NO: 7270746 - DNA, 22 bp, Homo sapiens
tggcagaggagaattaagatta

SEQ ID NO: 7270747 - DNA, 22 bp, Homo sapiens
tggctctgtcaaactgcacaca

SEQ ID NO: 7270748 - DNA, 22 bp, Homo sapiens
tggctctgagacacaggctctc

SEQ ID NO: 7270749 - DNA, 21 bp, Homo sapiens
tggctctgggtaggagagtgc

SEQ ID NO: 7270750 - DNA, 22 bp, Homo sapiens
cctcagcatcctcctgctcagt

SEQ ID NO: 7270751 - DNA, 22 bp, Homo sapiens
cctcagcagacacgcttctcac

SEQ ID NO: 7270752 - DNA, 17 bp, Homo sapiens
cctcagcttctttcctc

SEQ ID NO: 7270753 - DNA, 22 bp, Homo sapiens
tggctgagaatgggatgatgcc

SEQ ID NO: 7270754 - DNA, 17 bp, Homo sapiens
tggctctgtcctcagct

SEQ ID NO: 7270755 - DNA, 22 bp, Homo sapiens
tggctgagaccatcagggtgta

SEQ ID NO: 7270756 - DNA, 22 bp, Homo sapiens
tggctgagaccttcccaaattc

SEQ ID NO: 7270757 - DNA, 22 bp, Homo sapiens
tggctgagagaagacggggaag

SEQ ID NO: 7270758 - DNA, 16 bp, Homo sapiens
tggctgagagagggtt

SEQ ID NO: 7270759 - DNA, 22 bp, Homo sapiens
tggcttcatgtagtttgagttg

SEQ ID NO: 7270760 - DNA, 22 bp, Homo sapiens
tggctgggagctggaactgggc

SEQ ID NO: 7270761 - DNA, 22 bp, Homo sapiens
cctcttcctcaccatctacaac

SEQ ID NO: 7270762 - DNA, 22 bp, Homo sapiens
cctctgtggccctgactctctt

SEQ ID NO: 7270763 - DNA, 22 bp, Homo sapiens
cctctggagtcagaccagcttg

SEQ ID NO: 7270764 - DNA, 22 bp, Homo sapiens
cctctggacttgggacagtgag

SEQ ID NO: 7270765 - DNA, 20 bp, Homo sapiens
cctctgcctttctagtctga

SEQ ID NO: 7270766 - DNA, 19 bp, Homo sapiens
cctcttcctctgacactat

SEQ ID NO: 7270767 - DNA, 22 bp, Homo sapiens
cctcttcctgcactgacatttt

SEQ ID NO: 7270768 - DNA, 22 bp, Homo sapiens
cctcttctaggacgtccttgtg

SEQ ID NO: 7270769 - DNA, 22 bp, Homo sapiens
cctgagcaaaggcccagaggga

SEQ ID NO: 7270770 - DNA, 22 bp, Homo sapiens
cctgagcattagacatccatca

SEQ ID NO: 7270771 - DNA, 22 bp, Homo sapiens
cctgagctgcggggcagtgctc

SEQ ID NO: 7270772 - DNA, 22 bp, Homo sapiens
cctgagctggagacattacata

SEQ ID NO: 7270773 - DNA, 22 bp, Homo sapiens
tgggctctagactttagtgtgg

SEQ ID NO: 7270774 - DNA, 18 bp, Homo sapiens
cccggctaatttttggta

SEQ ID NO: 7270775 - DNA, 22 bp, Homo sapiens
tgctgtggattcagagatgaaa

SEQ ID NO: 7270776 - DNA, 22 bp, Homo sapiens
ccctcctctccctaagagtcac

SEQ ID NO: 7270777 - DNA, 22 bp, Homo sapiens
ccctcgccgcagctgcttcccg

SEQ ID NO: 7270778 - DNA, 22 bp, Homo sapiens
tggaatgtaaactctgtgaggg

SEQ ID NO: 7270779 - DNA, 22 bp, Homo sapiens
tggaatgtcataccataaaaga

SEQ ID NO: 7270780 - DNA, 22 bp, Homo sapiens
ccctgaggaccaggaaggaggg

SEQ ID NO: 7270781 - DNA, 22 bp, Homo sapiens
ccctgagcaacaaactgaatac

SEQ ID NO: 7270782 - DNA, 22 bp, Homo sapiens
ccctgagccacacagagcaggt

SEQ ID NO: 7270783 - DNA, 22 bp, Homo sapiens
ccctgagccgctgctccaacct

SEQ ID NO: 7270784 - DNA, 22 bp, Homo sapiens
ccctctctcaggctgacagcct

SEQ ID NO: 7270785 - DNA, 22 bp, Homo sapiens
cccattccctttactgttgcat

SEQ ID NO: 7270786 - DNA, 22 bp, Homo sapiens
cccagttgttgccggctctgga

SEQ ID NO: 7270787 - DNA, 22 bp, Homo sapiens
cccagtttcaactttccagtgg

SEQ ID NO: 7270788 - DNA, 22 bp, Homo sapiens
cccaggtcccggggccagctgc

SEQ ID NO: 7270789 - DNA, 22 bp, Homo sapiens
cccaggtcccgccccagctcta

SEQ ID NO: 7270790 - DNA, 22 bp, Homo sapiens
cccattgtggttgttgaggata

SEQ ID NO: 7270791 - DNA, 22 bp, Homo sapiens
cccatttgtatagagccttata

SEQ ID NO: 7270792 - DNA, 23 bp, Homo sapiens
cccatttgctcacaggacagcag

SEQ ID NO: 7270793 - DNA, 22 bp, Homo sapiens
cccatttgtccaaagtataaaa

SEQ ID NO: 7270794 - DNA, 22 bp, Homo sapiens
ccccaccatgtagaaactgaga

SEQ ID NO: 7270795 - DNA, 22 bp, Homo sapiens
ccccttccttcctcagacagcc

SEQ ID NO: 7270796 - DNA, 22 bp, Homo sapiens
tgctggctttgcgagatgcatt

SEQ ID NO: 7270797 - DNA, 22 bp, Homo sapiens
cccaggctggggctcctccagc

SEQ ID NO: 7270798 - DNA, 21 bp, Homo sapiens
cccagggaagccgcagtcacc

SEQ ID NO: 7270799 - DNA, 22 bp, Homo sapiens
cccaggctggtcctgaactcct

SEQ ID NO: 7270800 - DNA, 22 bp, Homo sapiens
cccagggaaggcagatggagga

SEQ ID NO: 7270801 - DNA, 22 bp, Homo sapiens
cccagggaagggctacctgagg

SEQ ID NO: 7270802 - DNA, 23 bp, Homo sapiens
cccagggacacgatgacacctcc

SEQ ID NO: 7270803 - DNA, 22 bp, Homo sapiens
cccaggctggagggcagtgtca

SEQ ID NO: 7270804 - DNA, 22 bp, Homo sapiens
cccaggctggagtgcaatggca

SEQ ID NO: 7270805 - DNA, 22 bp, Homo sapiens
cccaggctggagtgcaatggtg

SEQ ID NO: 7270806 - DNA, 22 bp, Homo sapiens
tgccctggttacactggagtcc

SEQ ID NO: 7270807 - DNA, 22 bp, Homo sapiens
tgccctggtgaagtgctctcct

SEQ ID NO: 7270808 - DNA, 17 bp, Homo sapiens
cccagggaccactgctt

SEQ ID NO: 7270809 - DNA, 22 bp, Homo sapiens
cccagggacagatgggcagcta

SEQ ID NO: 7270810 - DNA, 22 bp, Homo sapiens
cccagggacagctaggtggggc

SEQ ID NO: 7270811 - DNA, 22 bp, Homo sapiens
cccagggattataaaggtgaaa

SEQ ID NO: 7270812 - DNA, 20 bp, Homo sapiens
cccaggtaggtgccatgagt

SEQ ID NO: 7270813 - DNA, 19 bp, Homo sapiens
cccagggtttcctctctcc

SEQ ID NO: 7270814 - DNA, 22 bp, Homo sapiens
cccagggttgcctgcctctgct

SEQ ID NO: 7270815 - DNA, 22 bp, Homo sapiens
cccagggtccggataaccctgg

SEQ ID NO: 7270816 - DNA, 22 bp, Homo sapiens
cccagggtccctgctctctgtg

SEQ ID NO: 7270817 - DNA, 22 bp, Homo sapiens
cccagggtccctgctctctgtg

SEQ ID NO: 7270818 - DNA, 22 bp, Homo sapiens
cccaggggttcaaggctgcagt

SEQ ID NO: 7270819 - DNA, 22 bp, Homo sapiens
cccagggtagctgagctggcag

SEQ ID NO: 7270820 - DNA, 22 bp, Homo sapiens
tgccagcttttgactatcttag

SEQ ID NO: 7270821 - DNA, 22 bp, Homo sapiens
cccaggagagaggccagttggc

SEQ ID NO: 7270822 - DNA, 22 bp, Homo sapiens
cccaggagagaggggataaagc

SEQ ID NO: 7270823 - DNA, 22 bp, Homo sapiens
cccaggagagggaaccaaatgt

SEQ ID NO: 7270824 - DNA, 22 bp, Homo sapiens
cccaggagataacgttcccaag

SEQ ID NO: 7270825 - DNA, 22 bp, Homo sapiens
cccaggagactgagctgtaacc

SEQ ID NO: 7270826 - DNA, 22 bp, Homo sapiens
cccaggagagagacttgaatct

SEQ ID NO: 7270827 - DNA, 22 bp, Homo sapiens
cccaggagacctgtgaaaggac

SEQ ID NO: 7270828 - DNA, 22 bp, Homo sapiens
tgccaggagtcaggccaggcag

SEQ ID NO: 7270829 - DNA, 22 bp, Homo sapiens
tgccaggatataagagtgcgat

SEQ ID NO: 7270830 - DNA, 22 bp, Homo sapiens
cccaggagacctagatctgttt

SEQ ID NO: 7270831 - DNA, 22 bp, Homo sapiens
cccaggagacctagatctgttt

SEQ ID NO: 7270832 - DNA, 22 bp, Homo sapiens
tgccaggatggccagggggcca

SEQ ID NO: 7270833 - DNA, 22 bp, Homo sapiens
tgccatattgcaaagtgtctgc

SEQ ID NO: 7270834 - DNA, 22 bp, Homo sapiens
cccaggcagtgtgtgcatgcgt

SEQ ID NO: 7270835 - DNA, 23 bp, Homo sapiens
cccaggctacaaattatgctctg

SEQ ID NO: 7270836 - DNA, 22 bp, Homo sapiens
tgccctggggagcccagccagg

SEQ ID NO: 7270837 - DNA, 21 bp, Homo sapiens
tgccctggggctcttccctca

SEQ ID NO: 7270838 - DNA, 22 bp, Homo sapiens
tgccctggggtctggagcagca

SEQ ID NO: 7270839 - DNA, 22 bp, Homo sapiens
tgccctgggagttggagctgct

SEQ ID NO: 7270840 - DNA, 22 bp, Homo sapiens
cccaggctcagactggcttgtt

SEQ ID NO: 7270841 - DNA, 22 bp, Homo sapiens
tagattcagatatttaggacaa

SEQ ID NO: 7270842 - DNA, 22 bp, Homo sapiens
cagggaaactaggaaataagct

SEQ ID NO: 7270843 - DNA, 22 bp, Homo sapiens
tagaaaatggccaagcaggact

SEQ ID NO: 7270844 - DNA, 22 bp, Homo sapiens
caggctgccaaggctggggagg

SEQ ID NO: 7270845 - DNA, 22 bp, Homo sapiens
caggctgccgtggggtccaggc

SEQ ID NO: 7270846 - DNA, 22 bp, Homo sapiens
tacatgtttggtaaatgatggc

SEQ ID NO: 7270847 - DNA, 22 bp, Homo sapiens
tacatgttcaaatttgtctttc

SEQ ID NO: 7270848 - DNA, 22 bp, Homo sapiens
caggcctgagacatctgagata

SEQ ID NO: 7270849 - DNA, 22 bp, Homo sapiens
tactttaaagaggtgtaatgag

SEQ ID NO: 7270850 - DNA, 22 bp, Homo sapiens
tactttaatatatgtgaagttc

SEQ ID NO: 7270851 - DNA, 22 bp, Homo sapiens
tactttattgtaaatgctgatg

SEQ ID NO: 7270852 - DNA, 22 bp, Homo sapiens
tactttaaaaactgataattca

SEQ ID NO: 7270853 - DNA, 22 bp, Homo sapiens
tactgtgtcttaggatgtggaa

SEQ ID NO: 7270854 - DNA, 22 bp, Homo sapiens
caggcgagtgaacagactctca

SEQ ID NO: 7270855 - DNA, 22 bp, Homo sapiens
caggcgagggccctgaggagcc

SEQ ID NO: 7270856 - DNA, 22 bp, Homo sapiens
taatacagaagtgtattaaaat

SEQ ID NO: 7270857 - DNA, 21 bp, Homo sapiens
taataattccactacagagta

SEQ ID NO: 7270858 - DNA, 21 bp, Homo sapiens
taataattccactacagagta

SEQ ID NO: 7270859 - DNA, 22 bp, Homo sapiens
caggcagcagaggagtgtggga

SEQ ID NO: 7270860 - DNA, 22 bp, Homo sapiens
caggcagatttgctgccctcca

SEQ ID NO: 7270861 - DNA, 22 bp, Homo sapiens
caggcaccccaggtgagcactg

SEQ ID NO: 7270862 - DNA, 22 bp, Homo sapiens
caggcagagttagagcaactgg

SEQ ID NO: 7270863 - DNA, 22 bp, Homo sapiens
caggcagagttagagcaactgg

SEQ ID NO: 7270864 - DNA, 22 bp, Homo sapiens
caggcagagttagagcaactgg

SEQ ID NO: 7270865 - DNA, 22 bp, Homo sapiens
cagctcagacgcaggtcgagca

SEQ ID NO: 7270866 - DNA, 22 bp, Homo sapiens
gtgcttcctctgccaacactct

SEQ ID NO: 7270867 - DNA, 22 bp, Homo sapiens
taagtattggcctatagctaga

SEQ ID NO: 7270868 - DNA, 22 bp, Homo sapiens
taagtcctaacagactgggggc

SEQ ID NO: 7270869 - DNA, 22 bp, Homo sapiens
taagtcctagatgattcacaga

SEQ ID NO: 7270870 - DNA, 22 bp, Homo sapiens
taagtcctaatggcagaagtct

SEQ ID NO: 7270871 - DNA, 22 bp, Homo sapiens
taagtccttcacctaatcctca

SEQ ID NO: 7270872 - DNA, 22 bp, Homo sapiens
taagtcctggctggtttgaagc

SEQ ID NO: 7270873 - DNA, 22 bp, Homo sapiens
taagtcctattccaggtctctc

SEQ ID NO: 7270874 - DNA, 17 bp, Homo sapiens
taagtcctagttatttt

SEQ ID NO: 7270875 - DNA, 22 bp, Homo sapiens
taagtcctagctttggtaggaa

SEQ ID NO: 7270876 - DNA, 22 bp, Homo sapiens
taatatgtgttactgacttttt

SEQ ID NO: 7270877 - DNA, 22 bp, Homo sapiens
taatgtataacaaatactcatc

SEQ ID NO: 7270878 - DNA, 22 bp, Homo sapiens
taatgtcagcatagtttatttt

SEQ ID NO: 7270879 - DNA, 22 bp, Homo sapiens
taatgtcaaggtgatagatttg

SEQ ID NO: 7270880 - DNA, 22 bp, Homo sapiens
caggcatgcttctgtctgggca

SEQ ID NO: 7270881 - DNA, 20 bp, Homo sapiens
tacaaacctccacactggtg

SEQ ID NO: 7270882 - DNA, 19 bp, Homo sapiens
caggtggtaatctgagcct

SEQ ID NO: 7270883 - DNA, 22 bp, Homo sapiens
tatttgaagattcttctgatgt

SEQ ID NO: 7270884 - DNA, 22 bp, Homo sapiens
tattttacagactactttagat

SEQ ID NO: 7270885 - DNA, 22 bp, Homo sapiens
cagtcagggacaccagctagga

SEQ ID NO: 7270886 - DNA, 22 bp, Homo sapiens
tcaagctcattcctctaacctc

SEQ ID NO: 7270887 - DNA, 19 bp, Homo sapiens
tcaagatggatggctccca

SEQ ID NO: 7270888 - DNA, 22 bp, Homo sapiens
tcaagatgcatgggtggcataa

SEQ ID NO: 7270889 - DNA, 22 bp, Homo sapiens
tcaagatgattgcttcaggccc

SEQ ID NO: 7270890 - DNA, 20 bp, Homo sapiens
tcaagatgaggtcatactgg

SEQ ID NO: 7270891 - DNA, 22 bp, Homo sapiens
tcaagatgaaccaggacattca

SEQ ID NO: 7270892 - DNA, 22 bp, Homo sapiens
tcaagatgtgatgtaacttttg

SEQ ID NO: 7270893 - DNA, 22 bp, Homo sapiens
tcaagatgtccagtgcctataa

SEQ ID NO: 7270894 - DNA, 22 bp, Homo sapiens
tattttatctgccagagtggag

SEQ ID NO: 7270895 - DNA, 22 bp, Homo sapiens
tattttatctgccagagtggag

SEQ ID NO: 7270896 - DNA, 22 bp, Homo sapiens
tattattaaatggcagaatttt

SEQ ID NO: 7270897 - DNA, 22 bp, Homo sapiens
caggtaaaaataaatttgtgag

SEQ ID NO: 7270898 - DNA, 22 bp, Homo sapiens
taggagggccctgaaaatggca

SEQ ID NO: 7270899 - DNA, 22 bp, Homo sapiens
cagggctgaactgagcttgtga

SEQ ID NO: 7270900 - DNA, 22 bp, Homo sapiens
taggctgggctgagctggacgg

SEQ ID NO: 7270901 - DNA, 22 bp, Homo sapiens
cagggctgaaatcaaggtgtag

SEQ ID NO: 7270902 - DNA, 22 bp, Homo sapiens
cattgttaattggtatcttaca

SEQ ID NO: 7270903 - DNA, 22 bp, Homo sapiens
catttaatgcctttgccatcca

SEQ ID NO: 7270904 - DNA, 22 bp, Homo sapiens
catttaatccatagaggaatgt

SEQ ID NO: 7270905 - DNA, 22 bp, Homo sapiens
catttaatctggctcatgagca

SEQ ID NO: 7270906 - DNA, 22 bp, Homo sapiens
catttattcatttgctagggct

SEQ ID NO: 7270907 - DNA, 22 bp, Homo sapiens
tccctctccctattgcctggag

SEQ ID NO: 7270908 - DNA, 22 bp, Homo sapiens
cattcttacacaatattttaat

SEQ ID NO: 7270909 - DNA, 22 bp, Homo sapiens
cattcttatatttactcattca

SEQ ID NO: 7270910 - DNA, 22 bp, Homo sapiens
cattcttatatttactcattca

SEQ ID NO: 7270911 - DNA, 22 bp, Homo sapiens
cattacatctttgatgcagtat

SEQ ID NO: 7270912 - DNA, 22 bp, Homo sapiens
cattagaactaagatgtccagg

SEQ ID NO: 7270913 - DNA, 22 bp, Homo sapiens
cattcatttatgaaatatctat

SEQ ID NO: 7270914 - DNA, 22 bp, Homo sapiens
tccaggagaggcctgaccaggt

SEQ ID NO: 7270915 - DNA, 22 bp, Homo sapiens
tccaggagaccagatgtaggcc

SEQ ID NO: 7270916 - DNA, 17 bp, Homo sapiens
tccaggagaggcaatgg

SEQ ID NO: 7270917 - DNA, 22 bp, Homo sapiens
tccaggagacacaaggtacata

SEQ ID NO: 7270918 - DNA, 22 bp, Homo sapiens
tccaggagacacccttgtgtgt

SEQ ID NO: 7270919 - DNA, 22 bp, Homo sapiens
tccaggagaggtagagggttcc

SEQ ID NO: 7270920 - DNA, 22 bp, Homo sapiens
tccaggagaggtgtggggactg

SEQ ID NO: 7270921 - DNA, 22 bp, Homo sapiens
tccaggagatacactgcaccag

SEQ ID NO: 7270922 - DNA, 22 bp, Homo sapiens
tccaggagattcattaggtcat

SEQ ID NO: 7270923 - DNA, 22 bp, Homo sapiens
catgggaggttggcttggcatg

SEQ ID NO: 7270924 - DNA, 21 bp, Homo sapiens
tccaggagcacgggactagga

SEQ ID NO: 7270925 - DNA, 19 bp, Homo sapiens
tccaggagcaaagccagtt

SEQ ID NO: 7270926 - DNA, 22 bp, Homo sapiens
tccaggagcatccaggtgaagc

SEQ ID NO: 7270927 - DNA, 22 bp, Homo sapiens
catgggcagaagtggcatcatt

SEQ ID NO: 7270928 - DNA, 22 bp, Homo sapiens
catgggcagttggcagggctca

SEQ ID NO: 7270929 - DNA, 22 bp, Homo sapiens
tcctggctccagcagctcttcc

SEQ ID NO: 7270930 - DNA, 17 bp, Homo sapiens
ccaaggctatttgtagt

SEQ ID NO: 7270931 - DNA, 22 bp, Homo sapiens
ccaaggctcctcagctggtctt

SEQ ID NO: 7270932 - DNA, 22 bp, Homo sapiens
ccaaggctgaggtttccagttg

SEQ ID NO: 7270933 - DNA, 22 bp, Homo sapiens
ccaaggctggagggcttatgta

SEQ ID NO: 7270934 - DNA, 22 bp, Homo sapiens
ccaaggctggagtgcagtggcg

SEQ ID NO: 7270935 - DNA, 22 bp, Homo sapiens
ccaaggctgtcattcagtagct

SEQ ID NO: 7270936 - DNA, 22 bp, Homo sapiens
ccaaggctggagtgcagtggcg

SEQ ID NO: 7270937 - DNA, 22 bp, Homo sapiens
ccaaggctgtggggctgtgcag

SEQ ID NO: 7270938 - DNA, 22 bp, Homo sapiens
ccaaggcttcccagagatgctc

SEQ ID NO: 7270939 - DNA, 22 bp, Homo sapiens
ccaaggcttcctgacctacatg

SEQ ID NO: 7270940 - DNA, 22 bp, Homo sapiens
ccaaggcaacgttggtgtcagg

SEQ ID NO: 7270941 - DNA, 22 bp, Homo sapiens
ccaaggagcaaggctcaacaag

SEQ ID NO: 7270942 - DNA, 22 bp, Homo sapiens
tctaagtttggtgattaccaat

SEQ ID NO: 7270943 - DNA, 22 bp, Homo sapiens
tctaatcctatggtggggaggg

SEQ ID NO: 7270944 - DNA, 22 bp, Homo sapiens
ccagagacaaggagctggagtc

SEQ ID NO: 7270945 - DNA, 22 bp, Homo sapiens
tccttgtgctgagggtgttgct

SEQ ID NO: 7270946 - DNA, 22 bp, Homo sapiens
tccttgtaaaggagctctaaca

SEQ ID NO: 7270947 - DNA, 22 bp, Homo sapiens
ccactgctaacttgctgcagct

SEQ ID NO: 7270948 - DNA, 22 bp, Homo sapiens
catggcagagcctgcaggtggg

SEQ ID NO: 7270949 - DNA, 22 bp, Homo sapiens
catgcatgtttactacagtgac

SEQ ID NO: 7270950 - DNA, 22 bp, Homo sapiens
catggcagcaattttcctgact

SEQ ID NO: 7270951 - DNA, 22 bp, Homo sapiens
catggcaggaaaatgaacaggc

SEQ ID NO: 7270952 - DNA, 22 bp, Homo sapiens
tccaggagaaggccatccagcg

SEQ ID NO: 7270953 - DNA, 23 bp, Homo sapiens
tccaggagaattccagggcccgg

SEQ ID NO: 7270954 - DNA, 22 bp, Homo sapiens
catggcaggatctgggcccaca

SEQ ID NO: 7270955 - DNA, 22 bp, Homo sapiens
catggcagtgattcagcctttg

SEQ ID NO: 7270956 - DNA, 22 bp, Homo sapiens
catggcaggtgtggggttttat

SEQ ID NO: 7270957 - DNA, 22 bp, Homo sapiens
catggcaggtgcagattctgtg

SEQ ID NO: 7270958 - DNA, 22 bp, Homo sapiens
catggcaggcttcttcagcctt

SEQ ID NO: 7270959 - DNA, 22 bp, Homo sapiens
catgcatattactagcacagca

SEQ ID NO: 7270960 - DNA, 22 bp, Homo sapiens
catgcatgccgggctgacagag

SEQ ID NO: 7270961 - DNA, 22 bp, Homo sapiens
catgaaggaccatttcacggtc

SEQ ID NO: 7270962 - DNA, 22 bp, Homo sapiens
catgaaggaataattgtttaga

SEQ ID NO: 7270963 - DNA, 22 bp, Homo sapiens
catgacatcctgaagctgcaca

SEQ ID NO: 7270964 - DNA, 22 bp, Homo sapiens
catgactctccctctgtttatt

SEQ ID NO: 7270965 - DNA, 22 bp, Homo sapiens
catgacattttaaaaagaacat

SEQ ID NO: 7270966 - DNA, 22 bp, Homo sapiens
catgacatctgcttagtatgaa

SEQ ID NO: 7270967 - DNA, 22 bp, Homo sapiens
catctgctgctgaagccagcat

SEQ ID NO: 7270968 - DNA, 22 bp, Homo sapiens
tcagtcccaaggtcctgaggtg

SEQ ID NO: 7270969 - DNA, 23 bp, Homo sapiens
tcagtcccaacagcttctcctgg

SEQ ID NO: 7270970 - DNA, 22 bp, Homo sapiens
tcagtccctaaggatatgggct

SEQ ID NO: 7270971 - DNA, 22 bp, Homo sapiens
tcagtccccagatgtgtgctgt

SEQ ID NO: 7270972 - DNA, 21 bp, Homo sapiens
tcagtccctgggtgtgtccca

SEQ ID NO: 7270973 - DNA, 22 bp, Homo sapiens
tcagtccctcgcaccctgccat

SEQ ID NO: 7270974 - DNA, 22 bp, Homo sapiens
tcagtcccttctccaggtcagc

SEQ ID NO: 7270975 - DNA, 22 bp, Homo sapiens
tcagtcccttaaaggtggcagc

SEQ ID NO: 7270976 - DNA, 22 bp, Homo sapiens
tcaatatattccatgttttctc

SEQ ID NO: 7270977 - DNA, 22 bp, Homo sapiens
cagttctttgtggggagttctc

SEQ ID NO: 7270978 - DNA, 22 bp, Homo sapiens
cagttcttatttggccagtgtc

SEQ ID NO: 7270979 - DNA, 22 bp, Homo sapiens
cagttcttaataccatgtggtt

SEQ ID NO: 7270980 - DNA, 22 bp, Homo sapiens
cagttgcctactacatggcagg

SEQ ID NO: 7270981 - DNA, 23 bp, Homo sapiens
cagttggaggtacagagacactg

SEQ ID NO: 7270982 - DNA, 22 bp, Homo sapiens
tcagagattcacgtcagtccca

SEQ ID NO: 7270983 - DNA, 22 bp, Homo sapiens
tcagatccgagtgtgccaagga

SEQ ID NO: 7270984 - DNA, 22 bp, Homo sapiens
tcagatgagtgctttcagctgc

SEQ ID NO: 7270985 - DNA, 22 bp, Homo sapiens
tcaggcagagtggaagctgcaa

SEQ ID NO: 7270986 - DNA, 22 bp, Homo sapiens
cataatatctccgattacttgc

SEQ ID NO: 7270987 - DNA, 22 bp, Homo sapiens
tcaggctgcctatcagactgtg

SEQ ID NO: 7270988 - DNA, 22 bp, Homo sapiens
tcaggctgtatatcttgcactc

SEQ ID NO: 7270989 - DNA, 21 bp, Homo sapiens
tcaggctgtctgctggttcca

SEQ ID NO: 7270990 - DNA, 17 bp, Homo sapiens
tcaggctgtgcctggta

SEQ ID NO: 7270991 - DNA, 22 bp, Homo sapiens
tcaggctgtgtctttaaacaat

SEQ ID NO: 7270992 - DNA, 22 bp, Homo sapiens
tcaggctgtggcttcagttctt

SEQ ID NO: 7270993 - DNA, 22 bp, Homo sapiens
tcaggctgtggctttgaccgca

SEQ ID NO: 7270994 - DNA, 22 bp, Homo sapiens
tcaggctgtgggcactggccat

SEQ ID NO: 7270995 - DNA, 22 bp, Homo sapiens
ttttatcaatcattaagacatt

SEQ ID NO: 7270996 - DNA, 22 bp, Homo sapiens
ttttatcaatcattaagacatt

SEQ ID NO: 7270997 - DNA, 22 bp, Homo sapiens
ttttatagctgaatagtattcc

SEQ ID NO: 7270998 - DNA, 22 bp, Homo sapiens
tttgttttcaatgtgtcattca

SEQ ID NO: 7270999 - DNA, 22 bp, Homo sapiens
tttgcaagatgaaaaagttcta

SEQ ID NO: 7271000 - DNA, 22 bp, Homo sapiens
tttgcagtagacatcttatttt

SEQ ID NO: 7271001 - DNA, 22 bp, Homo sapiens
tttgcactagcatttgtccatg

SEQ ID NO: 7271002 - DNA, 22 bp, Homo sapiens
tttgcaaataccatgaaacttg

SEQ ID NO: 7271003 - DNA, 22 bp, Homo sapiens
tttgatttactggatattctca

SEQ ID NO: 7271004 - DNA, 22 bp, Homo sapiens
tttgtacatgtaagattgcatc

SEQ ID NO: 7271005 - DNA, 22 bp, Homo sapiens
tttggcaaagatcaacatgtta

SEQ ID NO: 7271006 - DNA, 23 bp, Homo sapiens
tttggacttgtgactcttctcct

SEQ ID NO: 7271007 - DNA, 22 bp, Homo sapiens
tttggagagagttaaatatgtt

SEQ ID NO: 7271008 - DNA, 22 bp, Homo sapiens
tttggacttagcctgcagaatt

SEQ ID NO: 7271009 - DNA, 22 bp, Homo sapiens
tttgcagtgattcttgcagtga

SEQ ID NO: 7271010 - DNA, 22 bp, Homo sapiens
ttttgcatctggtgaagaccag

SEQ ID NO: 7271011 - DNA, 23 bp, Homo sapiens
ttttgacaggaggaaggtgttga

SEQ ID NO: 7271012 - DNA, 23 bp, Homo sapiens
ttttgacaggaggaaggtgttga

SEQ ID NO: 7271013 - DNA, 22 bp, Homo sapiens
ttttggccacatccttttgagt

SEQ ID NO: 7271014 - DNA, 22 bp, Homo sapiens
ttttggccacatccttttgagt

SEQ ID NO: 7271015 - DNA, 22 bp, Homo sapiens
ttttatctgcttcattagttga

SEQ ID NO: 7271016 - DNA, 22 bp, Homo sapiens
ttttatgaagataattttctga

SEQ ID NO: 7271017 - DNA, 23 bp, Homo sapiens
ttttcctttggacaggctgtatt

SEQ ID NO: 7271018 - DNA, 22 bp, Homo sapiens
tttttgaaggctgatgtgatta

SEQ ID NO: 7271019 - DNA, 22 bp, Homo sapiens
ttgtgtttcccttgcatattcc

SEQ ID NO: 7271020 - DNA, 22 bp, Homo sapiens
ttgtgaatggtgccgcaataaa

SEQ ID NO: 7271021 - DNA, 19 bp, Homo sapiens
ttgtgtgtcagtcagagtt

SEQ ID NO: 7271022 - DNA, 22 bp, Homo sapiens
ttgttataaagactaaatatgt

SEQ ID NO: 7271023 - DNA, 22 bp, Homo sapiens
ttgttttatctttctacagact

SEQ ID NO: 7271024 - DNA, 22 bp, Homo sapiens
ttgtttctctggtcttgagtga

SEQ ID NO: 7271025 - DNA, 22 bp, Homo sapiens
ttgtttctcctggtgcctgata

SEQ ID NO: 7271026 - DNA, 17 bp, Homo sapiens
ttgtttcttctctgtgg

SEQ ID NO: 7271027 - DNA, 23 bp, Homo sapiens
ttgtttctttgtattgtctctat

SEQ ID NO: 7271028 - DNA, 22 bp, Homo sapiens
ttgtgaatagtgccgcaataaa

SEQ ID NO: 7271029 - DNA, 22 bp, Homo sapiens
ttggtttaccagagggaacgtg

SEQ ID NO: 7271030 - DNA, 23 bp, Homo sapiens
ttggtttacaggaataagcaggg

SEQ ID NO: 7271031 - DNA, 22 bp, Homo sapiens
ttggtttactctggggatatct

SEQ ID NO: 7271032 - DNA, 22 bp, Homo sapiens
ttggtttatctgtggatctctt

SEQ ID NO: 7271033 - DNA, 22 bp, Homo sapiens
ttggtttgttcaccatcaagca

SEQ ID NO: 7271034 - DNA, 22 bp, Homo sapiens
ttgcaagacacttggaagcaca

SEQ ID NO: 7271035 - DNA, 22 bp, Homo sapiens
ttgcaagaggtgattttattga

SEQ ID NO: 7271036 - DNA, 22 bp, Homo sapiens
ttgcaagaaattaggaagtgaa

SEQ ID NO: 7271037 - DNA, 22 bp, Homo sapiens
ttgcaagatgttaccattgtta

SEQ ID NO: 7271038 - DNA, 22 bp, Homo sapiens
ttggtgggcacaggggagaagt

SEQ ID NO: 7271039 - DNA, 22 bp, Homo sapiens
ttggtgggttaatgagtgactg

SEQ ID NO: 7271040 - DNA, 22 bp, Homo sapiens
tttattagattatcaaagaggt

SEQ ID NO: 7271041 - DNA, 22 bp, Homo sapiens
tttattacaccaggttaactca

SEQ ID NO: 7271042 - DNA, 22 bp, Homo sapiens
tttattattctgttctctctac

SEQ ID NO: 7271043 - DNA, 22 bp, Homo sapiens
tttattattctctggagaatgt

SEQ ID NO: 7271044 - DNA, 22 bp, Homo sapiens
tttattatgtacaggcactata

SEQ ID NO: 7271045 - DNA, 22 bp, Homo sapiens
tttattatgatggacaccttcg

SEQ ID NO: 7271046 - DNA, 22 bp, Homo sapiens
tttatttggcatccagggagaa

SEQ ID NO: 7271047 - DNA, 22 bp, Homo sapiens
tttatttggcatccagggagaa

SEQ ID NO: 7271048 - DNA, 22 bp, Homo sapiens
tttatttgaatcaggggagaat

SEQ ID NO: 7271049 - DNA, 22 bp, Homo sapiens
tttcaaaattttgcagtggtaa

SEQ ID NO: 7271050 - DNA, 22 bp, Homo sapiens
tttcaaacatatcttcattact

SEQ ID NO: 7271051 - DNA, 22 bp, Homo sapiens
tttcaaacctacttgtatgttt

SEQ ID NO: 7271052 - DNA, 22 bp, Homo sapiens
tttacttgatatggagctgagg

SEQ ID NO: 7271053 - DNA, 22 bp, Homo sapiens
tttactcttgctacacaactgt

SEQ ID NO: 7271054 - DNA, 22 bp, Homo sapiens
tttaattatgttaagccactga

SEQ ID NO: 7271055 - DNA, 22 bp, Homo sapiens
tttaattagcaagccagagagc

SEQ ID NO: 7271056 - DNA, 22 bp, Homo sapiens
tttaattagcaagccagagagc

SEQ ID NO: 7271057 - DNA, 22 bp, Homo sapiens
tttaattgcatttaaagatgga

SEQ ID NO: 7271058 - DNA, 22 bp, Homo sapiens
tttaattgcatttaaagatgga

SEQ ID NO: 7271059 - DNA, 22 bp, Homo sapiens
tttaattgttgtgggtacatag

SEQ ID NO: 7271060 - DNA, 22 bp, Homo sapiens
tttaaaatttagacctctccac

SEQ ID NO: 7271061 - DNA, 22 bp, Homo sapiens
tttaaaatcagatgggagttgg

SEQ ID NO: 7271062 - DNA, 22 bp, Homo sapiens
tttaaaaaactagtctgagtct

SEQ ID NO: 7271063 - DNA, 22 bp, Homo sapiens
tttcttcagccttcacaacctg

SEQ ID NO: 7271064 - DNA, 22 bp, Homo sapiens
tttcttcattcaccttcacccc

SEQ ID NO: 7271065 - DNA, 22 bp, Homo sapiens
tttcttcatagaccttgtcttg

SEQ ID NO: 7271066 - DNA, 22 bp, Homo sapiens
tttcttcaattgctaacaagga

SEQ ID NO: 7271067 - DNA, 23 bp, Homo sapiens
tttcttcagaagccttgcgaggc

SEQ ID NO: 7271068 - DNA, 21 bp, Homo sapiens
tttcttcactttgccccatgt

SEQ ID NO: 7271069 - DNA, 22 bp, Homo sapiens
tttcttcacagggtattgggtg

SEQ ID NO: 7271070 - DNA, 22 bp, Homo sapiens
tttcttcagccactccaaactg

SEQ ID NO: 7271071 - DNA, 22 bp, Homo sapiens
tttcttcagagagagctttccc

SEQ ID NO: 7271072 - DNA, 20 bp, Homo sapiens
tttctgtgagaaacactgtt

SEQ ID NO: 7271073 - DNA, 20 bp, Homo sapiens
tttctgtgcccaggtctgtt

SEQ ID NO: 7271074 - DNA, 22 bp, Homo sapiens
tttctgctcgctctcaatcagg

SEQ ID NO: 7271075 - DNA, 22 bp, Homo sapiens
tttctggcagcgggacaggggt

SEQ ID NO: 7271076 - DNA, 22 bp, Homo sapiens
tttctcatttagagtggcaggg

SEQ ID NO: 7271077 - DNA, 22 bp, Homo sapiens
tttcctctttgtaccttgacta

SEQ ID NO: 7271078 - DNA, 22 bp, Homo sapiens
tttctacatgttttctattgaa

SEQ ID NO: 7271079 - DNA, 22 bp, Homo sapiens
tttcaaagaccattaactatca

SEQ ID NO: 7271080 - DNA, 22 bp, Homo sapiens
tttcaaagagttgtaaattact

SEQ ID NO: 7271081 - DNA, 19 bp, Homo sapiens
tttcaggagctatgcaggg

SEQ ID NO: 7271082 - DNA, 22 bp, Homo sapiens
tttcaggattagtttaagcagg

SEQ ID NO: 7271083 - DNA, 22 bp, Homo sapiens
tttcagggagcctagaagagct

SEQ ID NO: 7271084 - DNA, 22 bp, Homo sapiens
tttcagggtacatggagcaaat

SEQ ID NO: 7271085 - DNA, 22 bp, Homo sapiens
tttcagtgcacgtagtttattt

SEQ ID NO: 7271086 - DNA, 22 bp, Homo sapiens
tttcattgtccccaggcaagac

SEQ ID NO: 7271087 - DNA, 22 bp, Homo sapiens
tttcattgtgatgcttttatca

SEQ ID NO: 7271088 - DNA, 22 bp, Homo sapiens
tttcattgcctttggaaggtct

SEQ ID NO: 7271089 - DNA, 22 bp, Homo sapiens
tttcctctgggccctgccaccc

SEQ ID NO: 7271090 - DNA, 22 bp, Homo sapiens
tttcctcttctggcaggcaggg

SEQ ID NO: 7271091 - DNA, 22 bp, Homo sapiens
ttcagtaaggataataaacaga

SEQ ID NO: 7271092 - DNA, 22 bp, Homo sapiens
ttcagtaagcacttctagagct

SEQ ID NO: 7271093 - DNA, 22 bp, Homo sapiens
ttcagtaaaacactgcaatgtc

SEQ ID NO: 7271094 - DNA, 22 bp, Homo sapiens
ttcagtatgctgaatgattttt

SEQ ID NO: 7271095 - DNA, 22 bp, Homo sapiens
ttcacattcagaaaaagcccgt

SEQ ID NO: 7271096 - DNA, 22 bp, Homo sapiens
ttcatgtgaatatatttgtctt

SEQ ID NO: 7271097 - DNA, 22 bp, Homo sapiens
ttcatgtgataaatgtgtgact

SEQ ID NO: 7271098 - DNA, 22 bp, Homo sapiens
ttcatgtgtatggaacattttt

SEQ ID NO: 7271099 - DNA, 22 bp, Homo sapiens
ttcatggatcatgccttttgtg

SEQ ID NO: 7271100 - DNA, 22 bp, Homo sapiens
ttcatgctcctgccctttttgg

SEQ ID NO: 7271101 - DNA, 22 bp, Homo sapiens
ttagaggtgtcaggagcacagg

SEQ ID NO: 7271102 - DNA, 23 bp, Homo sapiens
ttcaaagcttaagctctttccac

SEQ ID NO: 7271103 - DNA, 22 bp, Homo sapiens
ttcaacatgctttatttctaaa

SEQ ID NO: 7271104 - DNA, 22 bp, Homo sapiens
ttcaacatcttggagctggaac

SEQ ID NO: 7271105 - DNA, 22 bp, Homo sapiens
ttcaactattatgaataaaatt

SEQ ID NO: 7271106 - DNA, 22 bp, Homo sapiens
ttcaactagatttatacaattc

SEQ ID NO: 7271107 - DNA, 22 bp, Homo sapiens
ttcaactaatgtttattttatg

SEQ ID NO: 7271108 - DNA, 22 bp, Homo sapiens
ttcacaataatgtccatcctct

SEQ ID NO: 7271109 - DNA, 22 bp, Homo sapiens
ttcacaataggagcatgcaaat

SEQ ID NO: 7271110 - DNA, 22 bp, Homo sapiens
ttctacaatatgaataatgaag

SEQ ID NO: 7271111 - DNA, 22 bp, Homo sapiens
ttctaatacacggtatgacttt

SEQ ID NO: 7271112 - DNA, 22 bp, Homo sapiens
ttctaagttactgttatggtct

SEQ ID NO: 7271113 - DNA, 19 bp, Homo sapiens
ttctagaactgttctctca

SEQ ID NO: 7271114 - DNA, 22 bp, Homo sapiens
ttctagaatccttgtctacttt

SEQ ID NO: 7271115 - DNA, 22 bp, Homo sapiens
ttccttagatccttcaatcacg

SEQ ID NO: 7271116 - DNA, 22 bp, Homo sapiens
ttcctcttccatcttcccaggg

SEQ ID NO: 7271117 - DNA, 22 bp, Homo sapiens
ttcctctttagggctggccagg

SEQ ID NO: 7271118 - DNA, 22 bp, Homo sapiens
ttccagaattgggagccttgag

SEQ ID NO: 7271119 - DNA, 21 bp, Homo sapiens
ttccagagattgtttcacctg

SEQ ID NO: 7271120 - DNA, 22 bp, Homo sapiens
ttcctccagcctggagcacttc

SEQ ID NO: 7271121 - DNA, 22 bp, Homo sapiens
ttcctccacgtgacaggagcca

SEQ ID NO: 7271122 - DNA, 22 bp, Homo sapiens
ttcctccacgtgacaggagcca

SEQ ID NO: 7271123 - DNA, 22 bp, Homo sapiens
ttcctagggcagagccgctggg

SEQ ID NO: 7271124 - DNA, 22 bp, Homo sapiens
ttcctagggcagagccgctggg

SEQ ID NO: 7271125 - DNA, 22 bp, Homo sapiens
ttcctagggcagagccgctggg

SEQ ID NO: 7271126 - DNA, 22 bp, Homo sapiens
ttctgaatttctgtgtatctta

SEQ ID NO: 7271127 - DNA, 22 bp, Homo sapiens
ttctgacaattcagtaacagca

SEQ ID NO: 7271128 - DNA, 22 bp, Homo sapiens
ttctgacacattactacatgga

SEQ ID NO: 7271129 - DNA, 22 bp, Homo sapiens
ttctgacatatccagtctcagt

SEQ ID NO: 7271130 - DNA, 22 bp, Homo sapiens
ttctgagaaatgggttcacata

SEQ ID NO: 7271131 - DNA, 20 bp, Homo sapiens
ttctgagattaggttacaaa

SEQ ID NO: 7271132 - DNA, 22 bp, Homo sapiens
ttctgagatgtgaatctgtcaa

SEQ ID NO: 7271133 - DNA, 22 bp, Homo sapiens
ttctgagagtgccagaagttct

SEQ ID NO: 7271134 - DNA, 22 bp, Homo sapiens
ttctgagagtaaacatagcctg

SEQ ID NO: 7271135 - DNA, 22 bp, Homo sapiens
ttctcttttcaccagttgctaa

SEQ ID NO: 7271136 - DNA, 22 bp, Homo sapiens
ttctagttaaagtatgtattag

SEQ ID NO: 7271137 - DNA, 20 bp, Homo sapiens
ttctagtttggagttattaa

SEQ ID NO: 7271138 - DNA, 20 bp, Homo sapiens
ttctgcttgcaaatatcaag

SEQ ID NO: 7271139 - DNA, 22 bp, Homo sapiens
ttctgccttcagtcctctgact

SEQ ID NO: 7271140 - DNA, 22 bp, Homo sapiens
ttcttaaaacttatggacaggt

SEQ ID NO: 7271141 - DNA, 22 bp, Homo sapiens
ttctggggccaattgccactgc

SEQ ID NO: 7271142 - DNA, 19 bp, Homo sapiens
ttctggtctggaatcaagg

SEQ ID NO: 7271143 - DNA, 22 bp, Homo sapiens
ttcttgattagtctcatgccaa

SEQ ID NO: 7271144 - DNA, 22 bp, Homo sapiens
ttcttgctcaatgtctgtttaa

SEQ ID NO: 7271145 - DNA, 22 bp, Homo sapiens
ttcttctttccccctgtggtac

SEQ ID NO: 7271146 - DNA, 22 bp, Homo sapiens
ttcttctttcctataattaatt

SEQ ID NO: 7271147 - DNA, 22 bp, Homo sapiens
ttcttcttgtctgccctcacat

SEQ ID NO: 7271148 - DNA, 22 bp, Homo sapiens
ttcttctttatctcagtatcct

SEQ ID NO: 7271149 - DNA, 21 bp, Homo sapiens
ttcttcttggactgttttggc

SEQ ID NO: 7271150 - DNA, 22 bp, Homo sapiens
ttcttacagagtttacagagcc

SEQ ID NO: 7271151 - DNA, 22 bp, Homo sapiens
ttcttacatattttcatatggt

SEQ ID NO: 7271152 - DNA, 22 bp, Homo sapiens
ttgattatagactcactaatct

SEQ ID NO: 7271153 - DNA, 20 bp, Homo sapiens
ttgattcaagggctgatgga

SEQ ID NO: 7271154 - DNA, 22 bp, Homo sapiens
ttgattctggtgactgatggaa

SEQ ID NO: 7271155 - DNA, 22 bp, Homo sapiens
ttgattcttctgaatttgcaga

SEQ ID NO: 7271156 - DNA, 22 bp, Homo sapiens
ttgattctgatcctgtctggag

SEQ ID NO: 7271157 - DNA, 22 bp, Homo sapiens
ttgattctatgaggtaagctat

SEQ ID NO: 7271158 - DNA, 23 bp, Homo sapiens
ttgattctccagtatgggctgag

SEQ ID NO: 7271159 - DNA, 22 bp, Homo sapiens
ttgagtctctgccaaaacacaa

SEQ ID NO: 7271160 - DNA, 23 bp, Homo sapiens
ttgatttcaaatgcagagaacac

SEQ ID NO: 7271161 - DNA, 22 bp, Homo sapiens
ttgatttatagaatgttcaagc

SEQ ID NO: 7271162 - DNA, 22 bp, Homo sapiens
ttgagcaggatggctatgcaca

SEQ ID NO: 7271163 - DNA, 23 bp, Homo sapiens
ttctttcaagaagttcacagtgc

SEQ ID NO: 7271164 - DNA, 22 bp, Homo sapiens
tgtggccagccacaggcatggt

SEQ ID NO: 7271165 - DNA, 22 bp, Homo sapiens
tcccctccaactccaactatgg

SEQ ID NO: 7271166 - DNA, 22 bp, Homo sapiens
tcccctcctctcctgatatggg

SEQ ID NO: 7271167 - DNA, 22 bp, Homo sapiens
tcccctcccttccaacagagct

SEQ ID NO: 7271168 - DNA, 22 bp, Homo sapiens
tcccctctggaggctgcagggg

SEQ ID NO: 7271169 - DNA, 22 bp, Homo sapiens
tcccctctggttgacccaggag

SEQ ID NO: 7271170 - DNA, 22 bp, Homo sapiens
tgtgtaacaatctacacttagg

SEQ ID NO: 7271171 - DNA, 22 bp, Homo sapiens
tgtggtgtatcaggaagccaat

SEQ ID NO: 7271172 - DNA, 22 bp, Homo sapiens
tgtggggaggctgcagtgctgc

SEQ ID NO: 7271173 - DNA, 22 bp, Homo sapiens
tgtgtgattgcaggagatgtgg

SEQ ID NO: 7271174 - DNA, 22 bp, Homo sapiens
tgtgtgaatggattattctatt

SEQ ID NO: 7271175 - DNA, 22 bp, Homo sapiens
tgtgtgaatctattgaatatat

SEQ ID NO: 7271176 - DNA, 22 bp, Homo sapiens
tgtgtgaagtgattttaagtct

SEQ ID NO: 7271177 - DNA, 22 bp, Homo sapiens
tgtgtgaacatgttttcatttc

SEQ ID NO: 7271178 - DNA, 22 bp, Homo sapiens
tgtgtgaactctctgatgtaca

SEQ ID NO: 7271179 - DNA, 22 bp, Homo sapiens
tgtgtgaagcacatgttcaagg

SEQ ID NO: 7271180 - DNA, 22 bp, Homo sapiens
tgtgtctttggcgatgtctgga

SEQ ID NO: 7271181 - DNA, 22 bp, Homo sapiens
tgtgtcttaagttccaagacat

SEQ ID NO: 7271182 - DNA, 22 bp, Homo sapiens
tgtttgaactgaataacatagt

SEQ ID NO: 7271183 - DNA, 22 bp, Homo sapiens
tgtttgagttctagcgcattta

SEQ ID NO: 7271184 - DNA, 22 bp, Homo sapiens
tgtttcatgattgctgtcattt

SEQ ID NO: 7271185 - DNA, 22 bp, Homo sapiens
tgtttcatgaaacatgtttagg

SEQ ID NO: 7271186 - DNA, 22 bp, Homo sapiens
tgttctctctggctgccagtac

SEQ ID NO: 7271187 - DNA, 21 bp, Homo sapiens
tgttctatcagctcaggtgtc

SEQ ID NO: 7271188 - DNA, 22 bp, Homo sapiens
tgttctatgctctttaaggtga

SEQ ID NO: 7271189 - DNA, 22 bp, Homo sapiens
tgttcccattttctgcataatc

SEQ ID NO: 7271190 - DNA, 22 bp, Homo sapiens
tgttcagaacaaaggtaaatga

SEQ ID NO: 7271191 - DNA, 22 bp, Homo sapiens
tgttatcctcagctcacctcta

SEQ ID NO: 7271192 - DNA, 19 bp, Homo sapiens
tgttatgactttgcctttt

SEQ ID NO: 7271193 - DNA, 22 bp, Homo sapiens
tgtgttcttaaaagcagtgata

SEQ ID NO: 7271194 - DNA, 21 bp, Homo sapiens
tgtgttcttctaggtcagcta

SEQ ID NO: 7271195 - DNA, 22 bp, Homo sapiens
tgtgttctggctgtgacagctg

SEQ ID NO: 7271196 - DNA, 22 bp, Homo sapiens
tgtgttattgccactgaagacc

SEQ ID NO: 7271197 - DNA, 22 bp, Homo sapiens
tgtgttctggaaagctcactga

SEQ ID NO: 7271198 - DNA, 22 bp, Homo sapiens
tgtgtttacttctatgcagttt

SEQ ID NO: 7271199 - DNA, 22 bp, Homo sapiens
tgtgttgttttaagctgctgca

SEQ ID NO: 7271200 - DNA, 22 bp, Homo sapiens
tgtgtttatagtgtatcttcca

SEQ ID NO: 7271201 - DNA, 22 bp, Homo sapiens
ttaaatattttcagcagggtca

SEQ ID NO: 7271202 - DNA, 22 bp, Homo sapiens
ttaaatattatgttgtctgcaa

SEQ ID NO: 7271203 - DNA, 22 bp, Homo sapiens
ttaaatgaacgagatatgcaac

SEQ ID NO: 7271204 - DNA, 22 bp, Homo sapiens
ttaaatgctcacataaaggtag

SEQ ID NO: 7271205 - DNA, 22 bp, Homo sapiens
ttaaatgagatgttcagatatt

SEQ ID NO: 7271206 - DNA, 22 bp, Homo sapiens
ttaaatgaggctgatgtagatt

SEQ ID NO: 7271207 - DNA, 22 bp, Homo sapiens
ttaacattgtccttagcagatt

SEQ ID NO: 7271208 - DNA, 22 bp, Homo sapiens
ttaactgctaccattattttcc

SEQ ID NO: 7271209 - DNA, 22 bp, Homo sapiens
ttaacatttgtgaagcatttag

SEQ ID NO: 7271210 - DNA, 22 bp, Homo sapiens
ttaacatacatcatgaacaatg

SEQ ID NO: 7271211 - DNA, 20 bp, Homo sapiens
ttaagaaaagcacatcctgc

SEQ ID NO: 7271212 - DNA, 22 bp, Homo sapiens
ttaagaatgtgccttttggttg

SEQ ID NO: 7271213 - DNA, 22 bp, Homo sapiens
ttaataaacaggtgcagctgaa

SEQ ID NO: 7271214 - DNA, 22 bp, Homo sapiens
ttaattgatataaagaacttca

SEQ ID NO: 7271215 - DNA, 22 bp, Homo sapiens
ttagagaattccaaatgactac

SEQ ID NO: 7271216 - DNA, 21 bp, Homo sapiens
ttagaagctaatgcagctggt

SEQ ID NO: 7271217 - DNA, 20 bp, Homo sapiens
ttactcagttcctgccatgc

SEQ ID NO: 7271218 - DNA, 22 bp, Homo sapiens
ttactcagtctcccatacattg

SEQ ID NO: 7271219 - DNA, 22 bp, Homo sapiens
ttactgtgtttggctttagatg

SEQ ID NO: 7271220 - DNA, 22 bp, Homo sapiens
ttactgcacgtgggacatatat

SEQ ID NO: 7271221 - DNA, 22 bp, Homo sapiens
ttaatttttatgtatagtgtgt

SEQ ID NO: 7271222 - DNA, 22 bp, Homo sapiens
ttaattttgatgaggttcagtt

SEQ ID NO: 7271223 - DNA, 22 bp, Homo sapiens
ttaatttgaccataaatatctt

SEQ ID NO: 7271224 - DNA, 22 bp, Homo sapiens
ttaattttaacctgtttgtgtc

SEQ ID NO: 7271225 - DNA, 22 bp, Homo sapiens
ttacacaacatctgtattatta

SEQ ID NO: 7271226 - DNA, 22 bp, Homo sapiens
ttacatattatccaaaactgct

SEQ ID NO: 7271227 - DNA, 22 bp, Homo sapiens
ttacacttctaaaaaaagcagg

SEQ ID NO: 7271228 - DNA, 22 bp, Homo sapiens
cacattattctaaagaggtact

SEQ ID NO: 7271229 - DNA, 22 bp, Homo sapiens
caccagctccaccagggcaggt

SEQ ID NO: 7271230 - DNA, 22 bp, Homo sapiens
ggcagagttggtggagtcagtt

SEQ ID NO: 7271231 - DNA, 22 bp, Homo sapiens
ggcagagtgctctgggcagggg

SEQ ID NO: 7271232 - DNA, 18 bp, Homo sapiens
ggcagatgacaggagaga

SEQ ID NO: 7271233 - DNA, 20 bp, Homo sapiens
ggcagatgcagagctatgca

SEQ ID NO: 7271234 - DNA, 22 bp, Homo sapiens
ggcagaggtgacagtgtctttt

SEQ ID NO: 7271235 - DNA, 22 bp, Homo sapiens
cacatgagtcctgccaggtatg

SEQ ID NO: 7271236 - DNA, 22 bp, Homo sapiens
cacatgaccactctttacttct

SEQ ID NO: 7271237 - DNA, 22 bp, Homo sapiens
cacatgacactattttgttcta

SEQ ID NO: 7271238 - DNA, 22 bp, Homo sapiens
cacagtctctgttgctgggacc

SEQ ID NO: 7271239 - DNA, 22 bp, Homo sapiens
ggcaagggttgaagataaggta

SEQ ID NO: 7271240 - DNA, 22 bp, Homo sapiens
cactccctctagttgcattctg

SEQ ID NO: 7271241 - DNA, 21 bp, Homo sapiens
cactatttatatatgccagct

SEQ ID NO: 7271242 - DNA, 22 bp, Homo sapiens
cactccaagacctactttctct

SEQ ID NO: 7271243 - DNA, 22 bp, Homo sapiens
caccaggctggagtgcagaggt

SEQ ID NO: 7271244 - DNA, 22 bp, Homo sapiens
cacctgcctgcaggggctccac

SEQ ID NO: 7271245 - DNA, 22 bp, Homo sapiens
cacctgcctgcaggggctccac

SEQ ID NO: 7271246 - DNA, 22 bp, Homo sapiens
cacctgggctaaactatgcagg

SEQ ID NO: 7271247 - DNA, 23 bp, Homo sapiens
cacctggcttgagttggtgggtc

SEQ ID NO: 7271248 - DNA, 22 bp, Homo sapiens
cacctggctgtgaagcctgggt

SEQ ID NO: 7271249 - DNA, 22 bp, Homo sapiens
cacctggctgtgaagcctgggt

SEQ ID NO: 7271250 - DNA, 22 bp, Homo sapiens
cacctggctggaagtgctccgg

SEQ ID NO: 7271251 - DNA, 20 bp, Homo sapiens
cacctggctgactgtctcca

SEQ ID NO: 7271252 - DNA, 22 bp, Homo sapiens
cacctggcagctgttggccacg

SEQ ID NO: 7271253 - DNA, 20 bp, Homo sapiens
cacctggatatgacccagct

SEQ ID NO: 7271254 - DNA, 22 bp, Homo sapiens
cactttaaaactgacagccctt

SEQ ID NO: 7271255 - DNA, 22 bp, Homo sapiens
cactttaactcacatttcagct

SEQ ID NO: 7271256 - DNA, 21 bp, Homo sapiens
cactttaaaaatatctttata

SEQ ID NO: 7271257 - DNA, 22 bp, Homo sapiens
cacttgttggtggtgaaatcac

SEQ ID NO: 7271258 - DNA, 22 bp, Homo sapiens
caactttagcaatgttagtata

SEQ ID NO: 7271259 - DNA, 22 bp, Homo sapiens
caactttagcaatgttagtata

SEQ ID NO: 7271260 - DNA, 22 bp, Homo sapiens
caactttatgattggtttgtca

SEQ ID NO: 7271261 - DNA, 22 bp, Homo sapiens
caacaatatgccagactcaatt

SEQ ID NO: 7271262 - DNA, 22 bp, Homo sapiens
caaagtcctagaacagtgcttg

SEQ ID NO: 7271263 - DNA, 22 bp, Homo sapiens
caaagtcatggggatgcaggtc

SEQ ID NO: 7271264 - DNA, 22 bp, Homo sapiens
caagctctgcgggctccaagat

SEQ ID NO: 7271265 - DNA, 22 bp, Homo sapiens
gctggctgagttctgtcgtctg

SEQ ID NO: 7271266 - DNA, 22 bp, Homo sapiens
gctgcctgcacagagctgcttt

SEQ ID NO: 7271267 - DNA, 20 bp, Homo sapiens
gctggaagggctagagggct

SEQ ID NO: 7271268 - DNA, 22 bp, Homo sapiens
caagaagtgtcagctttttaaa

SEQ ID NO: 7271269 - DNA, 22 bp, Homo sapiens
caagaagtcatttagcctctca

SEQ ID NO: 7271270 - DNA, 22 bp, Homo sapiens
caatatataggaacaacttagg

SEQ ID NO: 7271271 - DNA, 22 bp, Homo sapiens
caatatataatgagtactttcc

SEQ ID NO: 7271272 - DNA, 22 bp, Homo sapiens
caatacttccttgttagaggca

SEQ ID NO: 7271273 - DNA, 22 bp, Homo sapiens
caatagatgtttttgcttacca

SEQ ID NO: 7271274 - DNA, 22 bp, Homo sapiens
caaggctgtgcagggtccatat

SEQ ID NO: 7271275 - DNA, 22 bp, Homo sapiens
caaggctgtctccagcttccaa

SEQ ID NO: 7271276 - DNA, 22 bp, Homo sapiens
caaggctggctcacaataatga

SEQ ID NO: 7271277 - DNA, 22 bp, Homo sapiens
caaggctgctggcttctgagct

SEQ ID NO: 7271278 - DNA, 22 bp, Homo sapiens
caaggctgcttcagactagtga

SEQ ID NO: 7271279 - DNA, 22 bp, Homo sapiens
caataagatgtattgagcagag

SEQ ID NO: 7271280 - DNA, 22 bp, Homo sapiens
caaggcttagtcagagggtgct

SEQ ID NO: 7271281 - DNA, 22 bp, Homo sapiens
caaggctgctgcgggtcgcacc

SEQ ID NO: 7271282 - DNA, 22 bp, Homo sapiens
caaggctgcaaaactacatggg

SEQ ID NO: 7271283 - DNA, 22 bp, Homo sapiens
caatttcactaataatatttac

SEQ ID NO: 7271284 - DNA, 22 bp, Homo sapiens
caatttcatgccatgtattgct

SEQ ID NO: 7271285 - DNA, 22 bp, Homo sapiens
caatcccatcaccatctgctct

SEQ ID NO: 7271286 - DNA, 22 bp, Homo sapiens
cacaaatgtgcagaaatgtgag

SEQ ID NO: 7271287 - DNA, 22 bp, Homo sapiens
cacaaatggttgtagacattaa

SEQ ID NO: 7271288 - DNA, 22 bp, Homo sapiens
cacaaatggccgtgttcaaaga

SEQ ID NO: 7271289 - DNA, 22 bp, Homo sapiens
ggaagaggaggagccaggcttt

SEQ ID NO: 7271290 - DNA, 22 bp, Homo sapiens
ggaagcggccctgagcgcaggg

SEQ ID NO: 7271291 - DNA, 22 bp, Homo sapiens
ggagaagggacagactcagctt

SEQ ID NO: 7271292 - DNA, 20 bp, Homo sapiens
ggagagcagggaagacagta

SEQ ID NO: 7271293 - DNA, 22 bp, Homo sapiens
gggctgagtgggcctcttactt

SEQ ID NO: 7271294 - DNA, 22 bp, Homo sapiens
ggggccttggatctgtgccccg

SEQ ID NO: 7271295 - DNA, 22 bp, Homo sapiens
ggggcagcctccaggaaagctg

SEQ ID NO: 7271296 - DNA, 22 bp, Homo sapiens
ggggcagctaccggaagtaggg

SEQ ID NO: 7271297 - DNA, 21 bp, Homo sapiens
ggggcagagctaggccctgca

SEQ ID NO: 7271298 - DNA, 22 bp, Homo sapiens
ggtcaaagggtgagatggcagg

SEQ ID NO: 7271299 - DNA, 22 bp, Homo sapiens
ggtcaaagtgaggagtcaggtt

SEQ ID NO: 7271300 - DNA, 22 bp, Homo sapiens
ggtcaaagttgaagaagggcat

SEQ ID NO: 7271301 - DNA, 22 bp, Homo sapiens
cagatgagcatgggcacaagca

SEQ ID NO: 7271302 - DNA, 23 bp, Homo sapiens
cagatgaggttggcagcatggtc

SEQ ID NO: 7271303 - DNA, 22 bp, Homo sapiens
cagatgctaaacaaaggacttt

SEQ ID NO: 7271304 - DNA, 22 bp, Homo sapiens
cagatgctaagttatcagcagg

SEQ ID NO: 7271305 - DNA, 22 bp, Homo sapiens
cagatgctaggccaattcctga

SEQ ID NO: 7271306 - DNA, 22 bp, Homo sapiens
gggtccctggaattacttgaca

SEQ ID NO: 7271307 - DNA, 22 bp, Homo sapiens
gggtgtgttacaatgatgccga

SEQ ID NO: 7271308 - DNA, 22 bp, Homo sapiens
gggtgtgtgcagggtggcactc

SEQ ID NO: 7271309 - DNA, 22 bp, Homo sapiens
cagaattatagttgctttttaa

SEQ ID NO: 7271310 - DNA, 22 bp, Homo sapiens
cagagccaaacctcagggcccg

SEQ ID NO: 7271311 - DNA, 22 bp, Homo sapiens
cagagcatgaataaaagttaca

SEQ ID NO: 7271312 - DNA, 22 bp, Homo sapiens
cagagcagtggagagtaggtct

SEQ ID NO: 7271313 - DNA, 22 bp, Homo sapiens
cagagcacccaaggagcatttg

SEQ ID NO: 7271314 - DNA, 22 bp, Homo sapiens
cagagcacctgctcattgccag

SEQ ID NO: 7271315 - DNA, 22 bp, Homo sapiens
gtactttagagtaaaatagacc

SEQ ID NO: 7271316 - DNA, 22 bp, Homo sapiens
gtactttaaatcaatgtagatt

SEQ ID NO: 7271317 - DNA, 22 bp, Homo sapiens
gtactttaaatcaatgtagatt

SEQ ID NO: 7271318 - DNA, 22 bp, Homo sapiens
gtaggcagtctctcaggtgatc

SEQ ID NO: 7271319 - DNA, 22 bp, Homo sapiens
gtaggcagtggttggaagagaa

SEQ ID NO: 7271320 - DNA, 22 bp, Homo sapiens
gtaggcagggctgtggggagaa

SEQ ID NO: 7271321 - DNA, 22 bp, Homo sapiens
gtaggcaggtggaggagtgaag

SEQ ID NO: 7271322 - DNA, 22 bp, Homo sapiens
cagcaaaggtagaagcacagga

SEQ ID NO: 7271323 - DNA, 22 bp, Homo sapiens
cagcagccactagagggctcac

SEQ ID NO: 7271324 - DNA, 22 bp, Homo sapiens
cagcagccagacaagatacatc

SEQ ID NO: 7271325 - DNA, 22 bp, Homo sapiens
cagcagccatgtaccacactca

SEQ ID NO: 7271326 - DNA, 22 bp, Homo sapiens
cagcagcctacaatgcacagaa

SEQ ID NO: 7271327 - DNA, 22 bp, Homo sapiens
gtcacaggcctggatgaggggc

SEQ ID NO: 7271328 - DNA, 22 bp, Homo sapiens
gtagggagcccagagcccagtg

SEQ ID NO: 7271329 - DNA, 22 bp, Homo sapiens
gtcagcagaaacgccacatgca

SEQ ID NO: 7271330 - DNA, 22 bp, Homo sapiens
cagccagctgtcccaagtgcct

SEQ ID NO: 7271331 - DNA, 22 bp, Homo sapiens
cagccagcttcagatccaagcc

SEQ ID NO: 7271332 - DNA, 22 bp, Homo sapiens
gtccagcaggatgcaagtgcca

SEQ ID NO: 7271333 - DNA, 22 bp, Homo sapiens
gtccagcatttaggcttgctga

SEQ ID NO: 7271334 - DNA, 22 bp, Homo sapiens
gtccagagagtaaagggggtaa

SEQ ID NO: 7271335 - DNA, 22 bp, Homo sapiens
cagcatctctgggagaagcatc

SEQ ID NO: 7271336 - DNA, 22 bp, Homo sapiens
cagcatctcctgtgcagaggga

SEQ ID NO: 7271337 - DNA, 22 bp, Homo sapiens
gtgagcaattcaaaggcaggaa

SEQ ID NO: 7271338 - DNA, 22 bp, Homo sapiens
gtcctggtgaggtagtgggagg

SEQ ID NO: 7271339 - DNA, 22 bp, Homo sapiens
gtcctggtcctgcctccccatg

SEQ ID NO: 7271340 - DNA, 22 bp, Homo sapiens
gtcctggtataattgtttaaaa

SEQ ID NO: 7271341 - DNA, 22 bp, Homo sapiens
gtcctggtgctggtcattgtcg

SEQ ID NO: 7271342 - DNA, 22 bp, Homo sapiens
gtcctggtgccacctgcgggat

SEQ ID NO: 7271343 - DNA, 17 bp, Homo sapiens
gtcctggtgtgtgagga

SEQ ID NO: 7271344 - DNA, 22 bp, Homo sapiens
gtcctggtggagtctctgggga

SEQ ID NO: 7271345 - DNA, 22 bp, Homo sapiens
gtcctggtgggacaatggacat

SEQ ID NO: 7271346 - DNA, 22 bp, Homo sapiens
gtcctggttttcacagaccttt

SEQ ID NO: 7271347 - DNA, 22 bp, Homo sapiens
cagccctgaaacaacctcctct

SEQ ID NO: 7271348 - DNA, 22 bp, Homo sapiens
cagccctgtccaatgtctgctc

SEQ ID NO: 7271349 - DNA, 22 bp, Homo sapiens
cagccctgtccctgagggacct

SEQ ID NO: 7271350 - DNA, 20 bp, Homo sapiens
gagctgagtgtggtcatggg

SEQ ID NO: 7271351 - DNA, 22 bp, Homo sapiens
gagctgagtgtcctaggcatgg

SEQ ID NO: 7271352 - DNA, 22 bp, Homo sapiens
gagctgccagacatgggaatga

SEQ ID NO: 7271353 - DNA, 21 bp, Homo sapiens
atgggcagaggcagagaggct

SEQ ID NO: 7271354 - DNA, 22 bp, Homo sapiens
gagcacaggctttggtggacac

SEQ ID NO: 7271355 - DNA, 22 bp, Homo sapiens
atggctctatctagaattctgg

SEQ ID NO: 7271356 - DNA, 22 bp, Homo sapiens
atggcagacgaggcagcagggg

SEQ ID NO: 7271357 - DNA, 22 bp, Homo sapiens
atggctcttgaattgatactct

SEQ ID NO: 7271358 - DNA, 22 bp, Homo sapiens
atggctcttgaattgatactct

SEQ ID NO: 7271359 - DNA, 22 bp, Homo sapiens
atggctgagatgggctccaggc

SEQ ID NO: 7271360 - DNA, 19 bp, Homo sapiens
atggctctgggatcactgc

SEQ ID NO: 7271361 - DNA, 22 bp, Homo sapiens
atggctctctccttactgctgc

SEQ ID NO: 7271362 - DNA, 22 bp, Homo sapiens
atggctctgagaacctgagcta

SEQ ID NO: 7271363 - DNA, 20 bp, Homo sapiens
atggctctgattctgagccc

SEQ ID NO: 7271364 - DNA, 23 bp, Homo sapiens
gagaacagccacagagagctgtg

SEQ ID NO: 7271365 - DNA, 22 bp, Homo sapiens
gagaaggtggacctgaaggagc

SEQ ID NO: 7271366 - DNA, 22 bp, Homo sapiens
atggatgagtccttgagacaca

SEQ ID NO: 7271367 - DNA, 22 bp, Homo sapiens
atggattataaatattttaagg

SEQ ID NO: 7271368 - DNA, 22 bp, Homo sapiens
atggcagacacaggcaggcaga

SEQ ID NO: 7271369 - DNA, 22 bp, Homo sapiens
atggcagaagtcaagatgagtt

SEQ ID NO: 7271370 - DNA, 22 bp, Homo sapiens
gagacaggccaggtggtactta

SEQ ID NO: 7271371 - DNA, 21 bp, Homo sapiens
gagacagcccagtgccagggc

SEQ ID NO: 7271372 - DNA, 21 bp, Homo sapiens
gagacagcccagtgccagggc

SEQ ID NO: 7271373 - DNA, 17 bp, Homo sapiens
gagacagcaggagcccc

SEQ ID NO: 7271374 - DNA, 22 bp, Homo sapiens
gagacagcacaggccactggga

SEQ ID NO: 7271375 - DNA, 22 bp, Homo sapiens
atgttacctgttaggtacctgt

SEQ ID NO: 7271376 - DNA, 22 bp, Homo sapiens
atgtggctgccacctgcctgaa

SEQ ID NO: 7271377 - DNA, 22 bp, Homo sapiens
atgtggctcagcaggctcccgt

SEQ ID NO: 7271378 - DNA, 22 bp, Homo sapiens
atgtggctagtcctctgcggca

SEQ ID NO: 7271379 - DNA, 22 bp, Homo sapiens
gaggttgggatgagggatacag

SEQ ID NO: 7271380 - DNA, 22 bp, Homo sapiens
gagtgcagtatcttctgtgtcc

SEQ ID NO: 7271381 - DNA, 22 bp, Homo sapiens
atgttatagttataaaatgagg

SEQ ID NO: 7271382 - DNA, 22 bp, Homo sapiens
atgggcagagtggggacaggaa

SEQ ID NO: 7271383 - DNA, 22 bp, Homo sapiens
gaggctccagcgacacctaggc

SEQ ID NO: 7271384 - DNA, 22 bp, Homo sapiens
atgtatttctatgtagtgaaga

SEQ ID NO: 7271385 - DNA, 22 bp, Homo sapiens
atgtatttctatgtagtgaaga

SEQ ID NO: 7271386 - DNA, 23 bp, Homo sapiens
atgtatttaaatttcagtgatga

SEQ ID NO: 7271387 - DNA, 23 bp, Homo sapiens
atgtatttaaatttcagtgatga

SEQ ID NO: 7271388 - DNA, 22 bp, Homo sapiens
gaggctccgtgctgctgccctg

SEQ ID NO: 7271389 - DNA, 22 bp, Homo sapiens
gaggctcctcattcagtatgct

SEQ ID NO: 7271390 - DNA, 22 bp, Homo sapiens
atgtatgtagtgtacatataca

SEQ ID NO: 7271391 - DNA, 22 bp, Homo sapiens
atgtatgtaggatgggccagtg

SEQ ID NO: 7271392 - DNA, 22 bp, Homo sapiens
atgtatgtaaatttcagtcctt

SEQ ID NO: 7271393 - DNA, 18 bp, Homo sapiens
atgtatgtacatatttat

SEQ ID NO: 7271394 - DNA, 22 bp, Homo sapiens
atgtatgtataacacccagcta

SEQ ID NO: 7271395 - DNA, 22 bp, Homo sapiens
atgtatgtatacaccccacata

SEQ ID NO: 7271396 - DNA, 22 bp, Homo sapiens
atgtatgtatgctgtgcttgca

SEQ ID NO: 7271397 - DNA, 22 bp, Homo sapiens
atgtatgtatgtacttttgtat

SEQ ID NO: 7271398 - DNA, 22 bp, Homo sapiens
atgtatgtctaaaacggggagg

SEQ ID NO: 7271399 - DNA, 22 bp, Homo sapiens
atgtatgtgagctttgagatca

SEQ ID NO: 7271400 - DNA, 22 bp, Homo sapiens
atgtatgtgcacgcatgtacat

SEQ ID NO: 7271401 - DNA, 22 bp, Homo sapiens
atgtatgtctgatgcacatgca

SEQ ID NO: 7271402 - DNA, 22 bp, Homo sapiens
atgtatgtctgcatacacatac

SEQ ID NO: 7271403 - DNA, 22 bp, Homo sapiens
atgtatgttcaagcaatgatta

SEQ ID NO: 7271404 - DNA, 22 bp, Homo sapiens
atgtatgtgtgcaggcatgcgt

SEQ ID NO: 7271405 - DNA, 22 bp, Homo sapiens
atgtatgtgttgcaattatgtt

SEQ ID NO: 7271406 - DNA, 22 bp, Homo sapiens
atgtatgttagacaagcctaca

SEQ ID NO: 7271407 - DNA, 22 bp, Homo sapiens
atgtatgttagtgtattatcta

SEQ ID NO: 7271408 - DNA, 23 bp, Homo sapiens
atgtatgtttctgcatcttcaac

SEQ ID NO: 7271409 - DNA, 22 bp, Homo sapiens
atgtatgtttctatatatgaca

SEQ ID NO: 7271410 - DNA, 22 bp, Homo sapiens
atgtatgtttcatatcttcatt

SEQ ID NO: 7271411 - DNA, 22 bp, Homo sapiens
atgtattcaagccacatacatt

SEQ ID NO: 7271412 - DNA, 22 bp, Homo sapiens
atgtatgtttttgcagatacat

SEQ ID NO: 7271413 - DNA, 22 bp, Homo sapiens
atgtatgttttcagttgtatta

SEQ ID NO: 7271414 - DNA, 22 bp, Homo sapiens
atgatgttgataaattacttta

SEQ ID NO: 7271415 - DNA, 22 bp, Homo sapiens
atgatgtccctaggcaggtagt

SEQ ID NO: 7271416 - DNA, 22 bp, Homo sapiens
atgatgtctggaggcatgctgt

SEQ ID NO: 7271417 - DNA, 22 bp, Homo sapiens
atgagctcatccgagtcacact

SEQ ID NO: 7271418 - DNA, 23 bp, Homo sapiens
atgagcatttttaatttctgtgg

SEQ ID NO: 7271419 - DNA, 22 bp, Homo sapiens
gaagagagagccctggggtccg

SEQ ID NO: 7271420 - DNA, 22 bp, Homo sapiens
gaagagagagtggggttctgcg

SEQ ID NO: 7271421 - DNA, 23 bp, Homo sapiens
gaagcagatgtctgagtaggcag

SEQ ID NO: 7271422 - DNA, 22 bp, Homo sapiens
gaagcagcaagtataggacagg

SEQ ID NO: 7271423 - DNA, 22 bp, Homo sapiens
gaagcagcagctggggacagtt

SEQ ID NO: 7271424 - DNA, 22 bp, Homo sapiens
gaaggaggcgttagccctagga

SEQ ID NO: 7271425 - DNA, 22 bp, Homo sapiens
gaaggaggtgtcagttggactg

SEQ ID NO: 7271426 - DNA, 16 bp, Homo sapiens
atgctgctattagagg

SEQ ID NO: 7271427 - DNA, 16 bp, Homo sapiens
atgctgctattagagg

SEQ ID NO: 7271428 - DNA, 22 bp, Homo sapiens
gaatttcctctaaacccctgag

SEQ ID NO: 7271429 - DNA, 19 bp, Homo sapiens
gaattttaggacttcagca

SEQ ID NO: 7271430 - DNA, 22 bp, Homo sapiens
atgcctggactgtatcccagat

SEQ ID NO: 7271431 - DNA, 22 bp, Homo sapiens
atgctaatgagctaaggagtcc

SEQ ID NO: 7271432 - DNA, 22 bp, Homo sapiens
gaagtacagttttatctagcca

SEQ ID NO: 7271433 - DNA, 22 bp, Homo sapiens
gaagtagattcgttgcatcttg

SEQ ID NO: 7271434 - DNA, 22 bp, Homo sapiens
atgcatttgacgggatatattt

SEQ ID NO: 7271435 - DNA, 22 bp, Homo sapiens
atgagaggtttcgtcagaggaa

SEQ ID NO: 7271436 - DNA, 22 bp, Homo sapiens
atgacagaggagtgcaggtgat

SEQ ID NO: 7271437 - DNA, 22 bp, Homo sapiens
ctttttcattggctttaggaca

SEQ ID NO: 7271438 - DNA, 22 bp, Homo sapiens
atgacatgattgccatttgata

SEQ ID NO: 7271439 - DNA, 22 bp, Homo sapiens
atgacatgttgggaaccctgct

SEQ ID NO: 7271440 - DNA, 22 bp, Homo sapiens
atgacatgttccctttttctca

SEQ ID NO: 7271441 - DNA, 22 bp, Homo sapiens
atgacatgtcctagttggtcta

SEQ ID NO: 7271442 - DNA, 22 bp, Homo sapiens
atgacatgtactgctctctcat

SEQ ID NO: 7271443 - DNA, 22 bp, Homo sapiens
atgacatggtgcagacagtgtc

SEQ ID NO: 7271444 - DNA, 22 bp, Homo sapiens
atgacatgcgaatgtactggag

SEQ ID NO: 7271445 - DNA, 22 bp, Homo sapiens
ctttgggcaaagggccaattcg

SEQ ID NO: 7271446 - DNA, 22 bp, Homo sapiens
ctttgcctcctagagcacgttc

SEQ ID NO: 7271447 - DNA, 20 bp, Homo sapiens
ctttgcctattctctgcctg

SEQ ID NO: 7271448 - DNA, 22 bp, Homo sapiens
atctttgactgccattcttgac

SEQ ID NO: 7271449 - DNA, 22 bp, Homo sapiens
ctttattagatgtagactttct

SEQ ID NO: 7271450 - DNA, 22 bp, Homo sapiens
ctttattgtccttcttaggtgg

SEQ ID NO: 7271451 - DNA, 22 bp, Homo sapiens
ctttattgtccttcttaggtgg

SEQ ID NO: 7271452 - DNA, 22 bp, Homo sapiens
ctttatgttggggtgtcttagt

SEQ ID NO: 7271453 - DNA, 22 bp, Homo sapiens
atctttcaatcaggaaaaatct

SEQ ID NO: 7271454 - DNA, 22 bp, Homo sapiens
atctttcagggccatttgtatt

SEQ ID NO: 7271455 - DNA, 22 bp, Homo sapiens
atctttcagtttcataccaatt

SEQ ID NO: 7271456 - DNA, 22 bp, Homo sapiens
atctttctccatatacatcttt

SEQ ID NO: 7271457 - DNA, 22 bp, Homo sapiens
atctttctatttctaaaaacta

SEQ ID NO: 7271458 - DNA, 22 bp, Homo sapiens
atctttcctgttttcagacagc

SEQ ID NO: 7271459 - DNA, 23 bp, Homo sapiens
atgttattattagcagtcttgcc

SEQ ID NO: 7271460 - DNA, 22 bp, Homo sapiens
gatggcagtcaaccaggtgagg

SEQ ID NO: 7271461 - DNA, 22 bp, Homo sapiens
gatggcagtcaaccaggtgagg

SEQ ID NO: 7271462 - DNA, 22 bp, Homo sapiens
gatggcaggtagtggtctcatc

SEQ ID NO: 7271463 - DNA, 22 bp, Homo sapiens
gatggcaggtgatagccgagtc

SEQ ID NO: 7271464 - DNA, 22 bp, Homo sapiens
gatggcagcagcagccagggat

SEQ ID NO: 7271465 - DNA, 22 bp, Homo sapiens
gatggcagcatattgacagcat

SEQ ID NO: 7271466 - DNA, 22 bp, Homo sapiens
gatggcagcagcagccagggat

SEQ ID NO: 7271467 - DNA, 22 bp, Homo sapiens
gatggcaggcaggtgagtagag

SEQ ID NO: 7271468 - DNA, 22 bp, Homo sapiens
gatggcagcatattgacagcat

SEQ ID NO: 7271469 - DNA, 22 bp, Homo sapiens
gatggcaggcaggtgagtagag

SEQ ID NO: 7271470 - DNA, 22 bp, Homo sapiens
gattctgaaattaacagactgg

SEQ ID NO: 7271471 - DNA, 18 bp, Homo sapiens
gattctgattctggaggc

SEQ ID NO: 7271472 - DNA, 22 bp, Homo sapiens
gatgtcttctcaactgtagacc

SEQ ID NO: 7271473 - DNA, 20 bp, Homo sapiens
gatgtcttggtcacagtggc

SEQ ID NO: 7271474 - DNA, 22 bp, Homo sapiens
attatgcatatacatttgacta

SEQ ID NO: 7271475 - DNA, 22 bp, Homo sapiens
attatctatgtagaatgatttt

SEQ ID NO: 7271476 - DNA, 22 bp, Homo sapiens
attatataggacttgcccttcc

SEQ ID NO: 7271477 - DNA, 22 bp, Homo sapiens
gcaccaggaggcccttctcatc

SEQ ID NO: 7271478 - DNA, 22 bp, Homo sapiens
gcaccaggcagctgagcaggcc

SEQ ID NO: 7271479 - DNA, 22 bp, Homo sapiens
attctgatatcttattctagct

SEQ ID NO: 7271480 - DNA, 22 bp, Homo sapiens
attctgagtagaaattattctt

SEQ ID NO: 7271481 - DNA, 22 bp, Homo sapiens
attctgagtggaaactatcaat

SEQ ID NO: 7271482 - DNA, 22 bp, Homo sapiens
attctctttgtataacatcttg

SEQ ID NO: 7271483 - DNA, 22 bp, Homo sapiens
gcagcttcagtaggtgaagaca

SEQ ID NO: 7271484 - DNA, 22 bp, Homo sapiens
gcaggcaggagcccaactgcct

SEQ ID NO: 7271485 - DNA, 22 bp, Homo sapiens
attcacaaaatgatatagatac

SEQ ID NO: 7271486 - DNA, 22 bp, Homo sapiens
attcacaactgatccttgctca

SEQ ID NO: 7271487 - DNA, 22 bp, Homo sapiens
gcagggcatagaggcacggagg

SEQ ID NO: 7271488 - DNA, 22 bp, Homo sapiens
gcagggcatccctgagcgggtg

SEQ ID NO: 7271489 - DNA, 22 bp, Homo sapiens
gcagggcagtaagagctagagt

SEQ ID NO: 7271490 - DNA, 22 bp, Homo sapiens
gcagtaagatgtaagtgctata

SEQ ID NO: 7271491 - DNA, 22 bp, Homo sapiens
attgcaagtcagagtgcaggtg

SEQ ID NO: 7271492 - DNA, 22 bp, Homo sapiens
atttattaagcatctgctatgt

SEQ ID NO: 7271493 - DNA, 22 bp, Homo sapiens
atttatgcatcccagcatgtga

SEQ ID NO: 7271494 - DNA, 22 bp, Homo sapiens
atttattacctcggagtttctg

SEQ ID NO: 7271495 - DNA, 22 bp, Homo sapiens
gccatcatatcccctgtgacct

SEQ ID NO: 7271496 - DNA, 22 bp, Homo sapiens
gccagccagggaagggagagac

SEQ ID NO: 7271497 - DNA, 22 bp, Homo sapiens
atttcccatgtgaatcaattgg

SEQ ID NO: 7271498 - DNA, 22 bp, Homo sapiens
atttcccagctttgatcagttt

SEQ ID NO: 7271499 - DNA, 22 bp, Homo sapiens
gcccagtgctgagggtgctgct

SEQ ID NO: 7271500 - DNA, 22 bp, Homo sapiens
gccctgggctccctgctccaca

SEQ ID NO: 7271501 - DNA, 21 bp, Homo sapiens
gcccagtgatttcttcacagt

SEQ ID NO: 7271502 - DNA, 22 bp, Homo sapiens
gcccagtagttcaaggttgcag

SEQ ID NO: 7271503 - DNA, 22 bp, Homo sapiens
gcccaggagttgaatgcagcag

SEQ ID NO: 7271504 - DNA, 22 bp, Homo sapiens
atttcaaggctattaatataaa

SEQ ID NO: 7271505 - DNA, 22 bp, Homo sapiens
gccatgactctccataccaaag

SEQ ID NO: 7271506 - DNA, 22 bp, Homo sapiens
gccatgcctgtgtctccaggcc

SEQ ID NO: 7271507 - DNA, 19 bp, Homo sapiens
atttattgtatgattccat

SEQ ID NO: 7271508 - DNA, 22 bp, Homo sapiens
atttattggtttgcatggtgaa

SEQ ID NO: 7271509 - DNA, 19 bp, Homo sapiens
atttattgtatgattccat

SEQ ID NO: 7271510 - DNA, 22 bp, Homo sapiens
attttgcacactatgcagcttt

SEQ ID NO: 7271511 - DNA, 22 bp, Homo sapiens
gctcaaatgtcatggggagcct

SEQ ID NO: 7271512 - DNA, 22 bp, Homo sapiens
gctcaaatcccagcgggctcct

SEQ ID NO: 7271513 - DNA, 22 bp, Homo sapiens
attttgatgctatctaatgaat

SEQ ID NO: 7271514 - DNA, 22 bp, Homo sapiens
attttgataatcatgttagaga

SEQ ID NO: 7271515 - DNA, 19 bp, Homo sapiens
gctcagagacacctgttgc

SEQ ID NO: 7271516 - DNA, 22 bp, Homo sapiens
caaagaatgagtgagtacataa

SEQ ID NO: 7271517 - DNA, 22 bp, Homo sapiens
gctcccagtctgatggaggaga

SEQ ID NO: 7271518 - DNA, 22 bp, Homo sapiens
gctccagggaacagaatgtact

SEQ ID NO: 7271519 - DNA, 22 bp, Homo sapiens
gctcccaggcatggaggtaatt

SEQ ID NO: 7271520 - DNA, 22 bp, Homo sapiens
atttgtatcaatctcaatatat

SEQ ID NO: 7271521 - DNA, 22 bp, Homo sapiens
atttgtatcttctaatattatc

SEQ ID NO: 7271522 - DNA, 22 bp, Homo sapiens
atttggttactcagttgtctga

SEQ ID NO: 7271523 - DNA, 22 bp, Homo sapiens
atttgtaaagtgcttaaaagta

SEQ ID NO: 7271524 - DNA, 22 bp, Homo sapiens
attttccaaaataattgttact

SEQ ID NO: 7271525 - DNA, 22 bp, Homo sapiens
attttccagcctttctagaact

SEQ ID NO: 7271526 - DNA, 22 bp, Homo sapiens
attttcagttgaaaaagttggt

SEQ ID NO: 7271527 - DNA, 22 bp, Homo sapiens
attttcatcatgggtttaacat

SEQ ID NO: 7271528 - DNA, 20 bp, Homo sapiens
aggtttatatttagaggtgt

SEQ ID NO: 7271529 - DNA, 22 bp, Homo sapiens
aggtttataactttggagaatt

SEQ ID NO: 7271530 - DNA, 22 bp, Homo sapiens
aggtttatgagtttggaagggg

SEQ ID NO: 7271531 - DNA, 22 bp, Homo sapiens
aggtttatctcatagaaagaat

SEQ ID NO: 7271532 - DNA, 22 bp, Homo sapiens
aggtttatgtttggtgcaggag

SEQ ID NO: 7271533 - DNA, 19 bp, Homo sapiens
aggtttatggggagggtga

SEQ ID NO: 7271534 - DNA, 22 bp, Homo sapiens
aggtttattatagaggatgacg

SEQ ID NO: 7271535 - DNA, 22 bp, Homo sapiens
aggtttattaagtaaatagagc

SEQ ID NO: 7271536 - DNA, 22 bp, Homo sapiens
cctttagaaagtcagtagttgc

SEQ ID NO: 7271537 - DNA, 22 bp, Homo sapiens
cctttagaatacagactttcta

SEQ ID NO: 7271538 - DNA, 22 bp, Homo sapiens
cctttagatgatctcttggaca

SEQ ID NO: 7271539 - DNA, 22 bp, Homo sapiens
cctttagagcaaacgccaccta

SEQ ID NO: 7271540 - DNA, 22 bp, Homo sapiens
cctttagaattctgcccctcct

SEQ ID NO: 7271541 - DNA, 21 bp, Homo sapiens
cctttagatttctatgcagtt

SEQ ID NO: 7271542 - DNA, 22 bp, Homo sapiens
agtaacaggtgtacagactatc

SEQ ID NO: 7271543 - DNA, 22 bp, Homo sapiens
agtcagtgttctgggttgtaat

SEQ ID NO: 7271544 - DNA, 22 bp, Homo sapiens
agtcagaagggcccttccttcc

SEQ ID NO: 7271545 - DNA, 22 bp, Homo sapiens
agtcagatttagatgtagcaag

SEQ ID NO: 7271546 - DNA, 22 bp, Homo sapiens
ctaaacaagggattataattga

SEQ ID NO: 7271547 - DNA, 22 bp, Homo sapiens
cgtggaatattataatggcaca

SEQ ID NO: 7271548 - DNA, 19 bp, Homo sapiens
cgtggagctggcaggcagg

SEQ ID NO: 7271549 - DNA, 22 bp, Homo sapiens
cgcgctctccttctggcaccca

SEQ ID NO: 7271550 - DNA, 22 bp, Homo sapiens
aggtctgagtatggcctgagaa

SEQ ID NO: 7271551 - DNA, 22 bp, Homo sapiens
aggtgagggtgccagtgcatgg

SEQ ID NO: 7271552 - DNA, 22 bp, Homo sapiens
aggtgagggtgccagtgcatgg

SEQ ID NO: 7271553 - DNA, 22 bp, Homo sapiens
aggtctgggcaccactggctgc

SEQ ID NO: 7271554 - DNA, 22 bp, Homo sapiens
cctgggcagggagaccaggctc

SEQ ID NO: 7271555 - DNA, 22 bp, Homo sapiens
cctgggcaggccggacgctggg

SEQ ID NO: 7271556 - DNA, 22 bp, Homo sapiens
cctgggcaggatgggcccggtg

SEQ ID NO: 7271557 - DNA, 22 bp, Homo sapiens
cctgggcaggtgtggcttcccc

SEQ ID NO: 7271558 - DNA, 22 bp, Homo sapiens
cctgggtgtcatgggcagctgg

SEQ ID NO: 7271559 - DNA, 22 bp, Homo sapiens
cctggctcagaccccagttctg

SEQ ID NO: 7271560 - DNA, 22 bp, Homo sapiens
cctggctcaaggcgaggactcc

SEQ ID NO: 7271561 - DNA, 22 bp, Homo sapiens
agggtggctggaggaatcagaa

SEQ ID NO: 7271562 - DNA, 22 bp, Homo sapiens
agggtggctgagtagatggaag

SEQ ID NO: 7271563 - DNA, 22 bp, Homo sapiens
agggtggccaccaagtatgtca

SEQ ID NO: 7271564 - DNA, 22 bp, Homo sapiens
cctggagctcactgggagccgg

SEQ ID NO: 7271565 - DNA, 22 bp, Homo sapiens
agggtggccatgagggagagat

SEQ ID NO: 7271566 - DNA, 20 bp, Homo sapiens
cctggagcctggaaggagtc

SEQ ID NO: 7271567 - DNA, 22 bp, Homo sapiens
cctggagcccaaggcagtgaga

SEQ ID NO: 7271568 - DNA, 22 bp, Homo sapiens
cctggagcatcaggaggaaggg

SEQ ID NO: 7271569 - DNA, 22 bp, Homo sapiens
cctggagcaggagctgcagagg

SEQ ID NO: 7271570 - DNA, 22 bp, Homo sapiens
cctgcctggagctgagtgtgga

SEQ ID NO: 7271571 - DNA, 22 bp, Homo sapiens
agggtggcacctggaagggatg

SEQ ID NO: 7271572 - DNA, 22 bp, Homo sapiens
agggtggcaccacatatcatag

SEQ ID NO: 7271573 - DNA, 20 bp, Homo sapiens
agggtggcaagttagtgaca

SEQ ID NO: 7271574 - DNA, 22 bp, Homo sapiens
agggtggcacctggaagggatg

SEQ ID NO: 7271575 - DNA, 19 bp, Homo sapiens
agggtggcaaaggagggtg

SEQ ID NO: 7271576 - DNA, 23 bp, Homo sapiens
agggtgagcaagctatggagacc

SEQ ID NO: 7271577 - DNA, 22 bp, Homo sapiens
ctcttaattaagctgagatctg

SEQ ID NO: 7271578 - DNA, 22 bp, Homo sapiens
agtggggaagattttgcagtca

SEQ ID NO: 7271579 - DNA, 23 bp, Homo sapiens
agtggggaatcaacagattcttt

SEQ ID NO: 7271580 - DNA, 22 bp, Homo sapiens
ctgagagcctcctgttggctag

SEQ ID NO: 7271581 - DNA, 21 bp, Homo sapiens
agtgtgttcttggcattacct

SEQ ID NO: 7271582 - DNA, 22 bp, Homo sapiens
agtgatttgcagtatttactaa

SEQ ID NO: 7271583 - DNA, 22 bp, Homo sapiens
ctccagttggccccagttggtt

SEQ ID NO: 7271584 - DNA, 22 bp, Homo sapiens
ctccagttggccccagttggtt

SEQ ID NO: 7271585 - DNA, 22 bp, Homo sapiens
ctccatgaatttgagctttgtg

SEQ ID NO: 7271586 - DNA, 15 bp, Homo sapiens
ctccatgattttgca

SEQ ID NO: 7271587 - DNA, 22 bp, Homo sapiens
agtgacattaaggattcttcaa

SEQ ID NO: 7271588 - DNA, 22 bp, Homo sapiens
agtgcaggagcctggccagagc

SEQ ID NO: 7271589 - DNA, 22 bp, Homo sapiens
agtgcagccgagatcaggtgct

SEQ ID NO: 7271590 - DNA, 22 bp, Homo sapiens
agtgcagcatgctggggaggct

SEQ ID NO: 7271591 - DNA, 22 bp, Homo sapiens
ctcccagggtagggagagacta

SEQ ID NO: 7271592 - DNA, 22 bp, Homo sapiens
ctcccagggtctaggctgctgg

SEQ ID NO: 7271593 - DNA, 22 bp, Homo sapiens
ctcccaggttacatctgagcct

SEQ ID NO: 7271594 - DNA, 22 bp, Homo sapiens
agtcatatgacccttcacaaac

SEQ ID NO: 7271595 - DNA, 22 bp, Homo sapiens
agtccaaggagagacagcattt

SEQ ID NO: 7271596 - DNA, 22 bp, Homo sapiens
agtccaagattagggtgacagc

SEQ ID NO: 7271597 - DNA, 22 bp, Homo sapiens
agtccaaggccatacagttgtg

SEQ ID NO: 7271598 - DNA, 22 bp, Homo sapiens
agtctgcattcacagcaattat

SEQ ID NO: 7271599 - DNA, 22 bp, Homo sapiens
agtctgagtatctctgagccag

SEQ ID NO: 7271600 - DNA, 21 bp, Homo sapiens
agtctgaggtggggcctagga

SEQ ID NO: 7271601 - DNA, 22 bp, Homo sapiens
ctggggagtgaaggtaattaca

SEQ ID NO: 7271602 - DNA, 22 bp, Homo sapiens
ctgggctgtcccagggcggcag

SEQ ID NO: 7271603 - DNA, 22 bp, Homo sapiens
ctgtatctgtgttggatgagtt

SEQ ID NO: 7271604 - DNA, 22 bp, Homo sapiens
ctgtccagcttggctcctgggg

SEQ ID NO: 7271605 - DNA, 22 bp, Homo sapiens
ctgtatgttccgttttgtcact

SEQ ID NO: 7271606 - DNA, 22 bp, Homo sapiens
ctgtatgttgggtaagcattgc

SEQ ID NO: 7271607 - DNA, 22 bp, Homo sapiens
ctgtatgtttctatgaatgtga

SEQ ID NO: 7271608 - DNA, 22 bp, Homo sapiens
ctgtatgtagaatagctgacaa

SEQ ID NO: 7271609 - DNA, 22 bp, Homo sapiens
ctgtatgtcttgtgaattgtag

SEQ ID NO: 7271610 - DNA, 22 bp, Homo sapiens
ctgtatgtgaaaatgtcaagtg

SEQ ID NO: 7271611 - DNA, 22 bp, Homo sapiens
ctgtatgttttctcctttggtt

SEQ ID NO: 7271612 - DNA, 22 bp, Homo sapiens
atatcaaacgaagttattttaa

SEQ ID NO: 7271613 - DNA, 23 bp, Homo sapiens
atatcacacccagtacagtctcc

SEQ ID NO: 7271614 - DNA, 22 bp, Homo sapiens
atatcagtatctatgtatttgt

SEQ ID NO: 7271615 - DNA, 22 bp, Homo sapiens
atatcacaggtgtttacctgat

SEQ ID NO: 7271616 - DNA, 22 bp, Homo sapiens
ctgggcagtttacattcctacc

SEQ ID NO: 7271617 - DNA, 22 bp, Homo sapiens
cttcagaggggactcaaagtca

SEQ ID NO: 7271618 - DNA, 22 bp, Homo sapiens
cttcagagtgcagaagattggg

SEQ ID NO: 7271619 - DNA, 22 bp, Homo sapiens
cttcagaatccagaatcagaat

SEQ ID NO: 7271620 - DNA, 22 bp, Homo sapiens
atccttcaggaaaccatcctca

SEQ ID NO: 7271621 - DNA, 22 bp, Homo sapiens
atccttcagtggaagacagtag

SEQ ID NO: 7271622 - DNA, 23 bp, Homo sapiens
cttcagcagaaacataaattctc

SEQ ID NO: 7271623 - DNA, 22 bp, Homo sapiens
atctccaggcatttcaagagac

SEQ ID NO: 7271624 - DNA, 22 bp, Homo sapiens
atctccagtgaggcagattctg

SEQ ID NO: 7271625 - DNA, 22 bp, Homo sapiens
atctccagtgcccaaaggaaat

SEQ ID NO: 7271626 - DNA, 22 bp, Homo sapiens
atctccagctggctgtgataaa

SEQ ID NO: 7271627 - DNA, 22 bp, Homo sapiens
atctccagctcgcagagctcct

SEQ ID NO: 7271628 - DNA, 22 bp, Homo sapiens
atctccagcaatggggagctct

SEQ ID NO: 7271629 - DNA, 22 bp, Homo sapiens
atctccagaggagtcatggtct

SEQ ID NO: 7271630 - DNA, 22 bp, Homo sapiens
cttcatgttctgcctgtggaag

SEQ ID NO: 7271631 - DNA, 22 bp, Homo sapiens
cttcatgagtgtacaacctgtg

SEQ ID NO: 7271632 - DNA, 22 bp, Homo sapiens
atcattactcctgtaaaattgt

SEQ ID NO: 7271633 - DNA, 22 bp, Homo sapiens
atcattctagctgttgtgttga

SEQ ID NO: 7271634 - DNA, 22 bp, Homo sapiens
atacatgatacttagtacgtag

SEQ ID NO: 7271635 - DNA, 22 bp, Homo sapiens
ctggaaattggagatgatgttt

SEQ ID NO: 7271636 - DNA, 22 bp, Homo sapiens
atacatatatggtacttcctgg

SEQ ID NO: 7271637 - DNA, 20 bp, Homo sapiens
ataattatttacttttgtgc

SEQ ID NO: 7271638 - DNA, 22 bp, Homo sapiens
atagaaaacagatgtccttaaa

SEQ ID NO: 7271639 - DNA, 22 bp, Homo sapiens
ctggccaggcttgggacagaca

SEQ ID NO: 7271640 - DNA, 22 bp, Homo sapiens
atagacgcggccgctgatgcag

SEQ ID NO: 7271641 - DNA, 22 bp, Homo sapiens
atagacatatggctttgtttct

SEQ ID NO: 7271642 - DNA, 22 bp, Homo sapiens
atagacatgcaacactttttac

SEQ ID NO: 7271643 - DNA, 22 bp, Homo sapiens
atagacatggtcttttgtcatt

SEQ ID NO: 7271644 - DNA, 22 bp, Homo sapiens
atagaatttgcactaaatctgc

SEQ ID NO: 7271645 - DNA, 20 bp, Homo sapiens
atagacaaagacatgccaga

SEQ ID NO: 7271646 - DNA, 22 bp, Homo sapiens
ataataacacctgaataggaaa

SEQ ID NO: 7271647 - DNA, 22 bp, Homo sapiens
ataataactcctgttgaagaac

SEQ ID NO: 7271648 - DNA, 22 bp, Homo sapiens
ctgcctgcttttctgggagccg

SEQ ID NO: 7271649 - DNA, 22 bp, Homo sapiens
ctgcctgcttaccatgcatcag

SEQ ID NO: 7271650 - DNA, 18 bp, Homo sapiens
ctgcctgctctccagctt

SEQ ID NO: 7271651 - DNA, 18 bp, Homo sapiens
ctgcctgctctccagctt

SEQ ID NO: 7271652 - DNA, 22 bp, Homo sapiens
ctgcctgctgattagtattgtc

SEQ ID NO: 7271653 - DNA, 22 bp, Homo sapiens
ctgcctgctgacattctttata

SEQ ID NO: 7271654 - DNA, 22 bp, Homo sapiens
ctgccctctagggatgcactgg

SEQ ID NO: 7271655 - DNA, 22 bp, Homo sapiens
ctgccctctagaggaggactga

SEQ ID NO: 7271656 - DNA, 18 bp, Homo sapiens
ctgcccagagcatttcat

SEQ ID NO: 7271657 - DNA, 17 bp, Homo sapiens
agttttgatataatggc

SEQ ID NO: 7271658 - DNA, 22 bp, Homo sapiens
agttttcacactcaccaaaagg

SEQ ID NO: 7271659 - DNA, 22 bp, Homo sapiens
agtttatttctccatttaccta

SEQ ID NO: 7271660 - DNA, 17 bp, Homo sapiens
agtttatttagccttct

SEQ ID NO: 7271661 - DNA, 22 bp, Homo sapiens
agtttatttttgataagtcttg

SEQ ID NO: 7271662 - DNA, 22 bp, Homo sapiens
agtttatttttgataagtcttg

SEQ ID NO: 7271663 - DNA, 22 bp, Homo sapiens
agtttattctgcttggccctcc

SEQ ID NO: 7271664 - DNA, 22 bp, Homo sapiens
agtttattgtatatggtagttt

SEQ ID NO: 7271665 - DNA, 20 bp, Homo sapiens
agtttattccaggagaactg

SEQ ID NO: 7271666 - DNA, 22 bp, Homo sapiens
agtttattctctggtcttagta

SEQ ID NO: 7271667 - DNA, 22 bp, Homo sapiens
agtttattctctggtcttagta

SEQ ID NO: 7271668 - DNA, 19 bp, Homo sapiens
agtttattataggtgattc

SEQ ID NO: 7271669 - DNA, 22 bp, Homo sapiens
agtgttcatttattcattcact

SEQ ID NO: 7271670 - DNA, 22 bp, Homo sapiens
agtgttagtgaaaggtgtttat

SEQ ID NO: 7271671 - DNA, 22 bp, Homo sapiens
agtttctagcctcactgtttag

SEQ ID NO: 7271672 - DNA, 22 bp, Homo sapiens
ctgatagacaatcaccatggga

SEQ ID NO: 7271673 - DNA, 22 bp, Homo sapiens
ctgatacactccctaaaatata

SEQ ID NO: 7271674 - DNA, 22 bp, Homo sapiens
ctgagtgttttcagccacggcc

SEQ ID NO: 7271675 - DNA, 22 bp, Homo sapiens
aggctccaccctacagagctcc

SEQ ID NO: 7271676 - DNA, 22 bp, Homo sapiens
aggctccaccctacagagctcc

SEQ ID NO: 7271677 - DNA, 22 bp, Homo sapiens
ccaggctgtaaacaccttcaaa

SEQ ID NO: 7271678 - DNA, 22 bp, Homo sapiens
aggctccaccagtcaggtgcat

SEQ ID NO: 7271679 - DNA, 22 bp, Homo sapiens
aggctccaccccgccagacctt

SEQ ID NO: 7271680 - DNA, 22 bp, Homo sapiens
aggctccaccagtcaggtgcat

SEQ ID NO: 7271681 - DNA, 22 bp, Homo sapiens
aggctccaaattaccaagctct

SEQ ID NO: 7271682 - DNA, 22 bp, Homo sapiens
aggctcagcctgggcctagagc

SEQ ID NO: 7271683 - DNA, 22 bp, Homo sapiens
aggctcagcctgggcctagagc

SEQ ID NO: 7271684 - DNA, 22 bp, Homo sapiens
aggctcagtatagctggcaagt

SEQ ID NO: 7271685 - DNA, 20 bp, Homo sapiens
aggctgagggtgattgtgtc

SEQ ID NO: 7271686 - DNA, 22 bp, Homo sapiens
aggctgaggggcgagggaccct

SEQ ID NO: 7271687 - DNA, 22 bp, Homo sapiens
aggctgaggggcgagggaccct

SEQ ID NO: 7271688 - DNA, 22 bp, Homo sapiens
aggctgaggcgggtagatcacc

SEQ ID NO: 7271689 - DNA, 22 bp, Homo sapiens
aggctgaggcgggaggatcact

SEQ ID NO: 7271690 - DNA, 22 bp, Homo sapiens
aggctctgtgcatcctccccaa

SEQ ID NO: 7271691 - DNA, 22 bp, Homo sapiens
aggctctgtgcagcctgcatct

SEQ ID NO: 7271692 - DNA, 22 bp, Homo sapiens
aggctctgtgatccacaatgag

SEQ ID NO: 7271693 - DNA, 22 bp, Homo sapiens
aggctgaggtgtgctgtgatcg

SEQ ID NO: 7271694 - DNA, 22 bp, Homo sapiens
aggctgagtcaagttagggtga

SEQ ID NO: 7271695 - DNA, 22 bp, Homo sapiens
aggctgaggtaggaggatcgct

SEQ ID NO: 7271696 - DNA, 22 bp, Homo sapiens
ccatggcttacagatggagcat

SEQ ID NO: 7271697 - DNA, 17 bp, Homo sapiens
aggctggctcacaggga

SEQ ID NO: 7271698 - DNA, 22 bp, Homo sapiens
cccagagcatgtgctgcctttg

SEQ ID NO: 7271699 - DNA, 19 bp, Homo sapiens
cccagagcatcctgaactt

SEQ ID NO: 7271700 - DNA, 22 bp, Homo sapiens
cccagagccgctcccctacttc

SEQ ID NO: 7271701 - DNA, 22 bp, Homo sapiens
ccagcctgaaatgcctcatcct

SEQ ID NO: 7271702 - DNA, 22 bp, Homo sapiens
ccaggacaagtgtggccatggc

SEQ ID NO: 7271703 - DNA, 22 bp, Homo sapiens
ccaggacaagtgtggccatggc

SEQ ID NO: 7271704 - DNA, 22 bp, Homo sapiens
aggccctgggagcagagatgca

SEQ ID NO: 7271705 - DNA, 22 bp, Homo sapiens
aggccctggcccccagagattc

SEQ ID NO: 7271706 - DNA, 22 bp, Homo sapiens
ccagcttttcttatcattataa

SEQ ID NO: 7271707 - DNA, 22 bp, Homo sapiens
ccaggagatgggagcatctaaa

SEQ ID NO: 7271708 - DNA, 22 bp, Homo sapiens
ccaggagataagctgagtttat

SEQ ID NO: 7271709 - DNA, 19 bp, Homo sapiens
ccaggagagcttggagaag

SEQ ID NO: 7271710 - DNA, 22 bp, Homo sapiens
ccaggagatgatgttggggatt

SEQ ID NO: 7271711 - DNA, 22 bp, Homo sapiens
ccaggagatgggaaagtagcag

SEQ ID NO: 7271712 - DNA, 22 bp, Homo sapiens
ccaggagatttttccatagcac

SEQ ID NO: 7271713 - DNA, 22 bp, Homo sapiens
ccaggagagcgccctcccggcc

SEQ ID NO: 7271714 - DNA, 22 bp, Homo sapiens
ccaggagagctctaaatggctg

SEQ ID NO: 7271715 - DNA, 22 bp, Homo sapiens
ccaggagagctctcgttcagtg

SEQ ID NO: 7271716 - DNA, 22 bp, Homo sapiens
ccaggagagcattgcacagagg

SEQ ID NO: 7271717 - DNA, 22 bp, Homo sapiens
ccaggagagcaggcgtgcagct

SEQ ID NO: 7271718 - DNA, 22 bp, Homo sapiens
ccagcagaggggcggagtgcag

SEQ ID NO: 7271719 - DNA, 22 bp, Homo sapiens
ccagcagagcatggggaggaag

SEQ ID NO: 7271720 - DNA, 22 bp, Homo sapiens
ccagagcagatgtggccttggt

SEQ ID NO: 7271721 - DNA, 20 bp, Homo sapiens
ccacaggagtccagtcgacc

SEQ ID NO: 7271722 - DNA, 22 bp, Homo sapiens
aggcagggtcttgctatgttgc

SEQ ID NO: 7271723 - DNA, 22 bp, Homo sapiens
aggcaggctggtctgaagagtg

SEQ ID NO: 7271724 - DNA, 22 bp, Homo sapiens
cccaggatggggctgcagttat

SEQ ID NO: 7271725 - DNA, 22 bp, Homo sapiens
cccaggatgtcgaggctgcagt

SEQ ID NO: 7271726 - DNA, 22 bp, Homo sapiens
cccaggagtttgagttcagcat

SEQ ID NO: 7271727 - DNA, 20 bp, Homo sapiens
cccaggagtttgctcttact

SEQ ID NO: 7271728 - DNA, 22 bp, Homo sapiens
cccaggagttggaggctgcagt

SEQ ID NO: 7271729 - DNA, 23 bp, Homo sapiens
cccaggagtttcactgcaaaggt

SEQ ID NO: 7271730 - DNA, 21 bp, Homo sapiens
cccagggaagccgcagtcacc

SEQ ID NO: 7271731 - DNA, 22 bp, Homo sapiens
cccagggaagccatttctgact

SEQ ID NO: 7271732 - DNA, 22 bp, Homo sapiens
agggaagaagctggtagtaggt

SEQ ID NO: 7271733 - DNA, 22 bp, Homo sapiens
agggaagaaaatccatcgctgc

SEQ ID NO: 7271734 - DNA, 22 bp, Homo sapiens
cccaggagttggaggctacggt

SEQ ID NO: 7271735 - DNA, 22 bp, Homo sapiens
aggcttgaaatgaaatctgtaa

SEQ ID NO: 7271736 - DNA, 22 bp, Homo sapiens
ccctggaggagcttagagcttg

SEQ ID NO: 7271737 - DNA, 22 bp, Homo sapiens
ccctggaaggagatgggacatg

SEQ ID NO: 7271738 - DNA, 22 bp, Homo sapiens
agggcagagatctgagtgggca

SEQ ID NO: 7271739 - DNA, 18 bp, Homo sapiens
agggagttttagggaagg

SEQ ID NO: 7271740 - DNA, 22 bp, Homo sapiens
agggatggaagacttgaagacc

SEQ ID NO: 7271741 - DNA, 22 bp, Homo sapiens
agggagtggttaagaaggtgca

SEQ ID NO: 7271742 - DNA, 23 bp, Homo sapiens
agggctgatgccattgcagctct

SEQ ID NO: 7271743 - DNA, 22 bp, Homo sapiens
cctctgggaagccagtcctgct

SEQ ID NO: 7271744 - DNA, 22 bp, Homo sapiens
cctctgggcggagatctgctgc

SEQ ID NO: 7271745 - DNA, 22 bp, Homo sapiens
aggggctgggacagagccaagc

SEQ ID NO: 7271746 - DNA, 22 bp, Homo sapiens
cctgaggattgttggtgcttcc

SEQ ID NO: 7271747 - DNA, 22 bp, Homo sapiens
cctgaggacacacgctgcagga

SEQ ID NO: 7271748 - DNA, 22 bp, Homo sapiens
cctgaggacagtgtgaccatgg

SEQ ID NO: 7271749 - DNA, 22 bp, Homo sapiens
cctcctctgtgcagctgtgggt

SEQ ID NO: 7271750 - DNA, 22 bp, Homo sapiens
agggccctctgggcactgtggc

SEQ ID NO: 7271751 - DNA, 22 bp, Homo sapiens
ccctggaggctggaggcagtag

SEQ ID NO: 7271752 - DNA, 22 bp, Homo sapiens
ccctggaggctggaggcagtag

SEQ ID NO: 7271753 - DNA, 22 bp, Homo sapiens
ccctggaggcaaaggttgcagt

SEQ ID NO: 7271754 - DNA, 22 bp, Homo sapiens
ccctggaggcggagcttgcagt

SEQ ID NO: 7271755 - DNA, 22 bp, Homo sapiens
ccgaggtcctggacttggccct

SEQ ID NO: 7271756 - DNA, 22 bp, Homo sapiens
ccgcccacactaaatatgagcg

SEQ ID NO: 7271757 - DNA, 22 bp, Homo sapiens
aggacatgtttgtatcttcctt

SEQ ID NO: 7271758 - DNA, 22 bp, Homo sapiens
aggacaggattgagctgaactg

SEQ ID NO: 7271759 - DNA, 22 bp, Homo sapiens
aggagaaggaagtgcatcacta

SEQ ID NO: 7271760 - DNA, 22 bp, Homo sapiens
cagtgctcctgatgtacccttg

SEQ ID NO: 7271761 - DNA, 22 bp, Homo sapiens
cagtggcatacttggctgatat

SEQ ID NO: 7271762 - DNA, 22 bp, Homo sapiens
cagtgctcatagctgttcctcc

SEQ ID NO: 7271763 - DNA, 22 bp, Homo sapiens
aggactcctgctgggaatggct

SEQ ID NO: 7271764 - DNA, 22 bp, Homo sapiens
cagtggcgtgatctctgctcac

SEQ ID NO: 7271765 - DNA, 22 bp, Homo sapiens
catagtaaataatgcagatgat

SEQ ID NO: 7271766 - DNA, 22 bp, Homo sapiens
cataggctcttcagagaactga

SEQ ID NO: 7271767 - DNA, 22 bp, Homo sapiens
catataaatacaacatgtgtta

SEQ ID NO: 7271768 - DNA, 22 bp, Homo sapiens
aggagggagcttaagccaggca

SEQ ID NO: 7271769 - DNA, 22 bp, Homo sapiens
aggattcgggcataaagccatt

SEQ ID NO: 7271770 - DNA, 22 bp, Homo sapiens
catggcagaaacctgagctgct

SEQ ID NO: 7271771 - DNA, 22 bp, Homo sapiens
catggagataaactgaaatatt

SEQ ID NO: 7271772 - DNA, 22 bp, Homo sapiens
catggaattttctaggcataaa

SEQ ID NO: 7271773 - DNA, 22 bp, Homo sapiens
catggaatggttgaatgacgaa

SEQ ID NO: 7271774 - DNA, 20 bp, Homo sapiens
aggaggggatagaatcaaag

SEQ ID NO: 7271775 - DNA, 20 bp, Homo sapiens
aggaggggatagaatcaaag

SEQ ID NO: 7271776 - DNA, 16 bp, Homo sapiens
aggaggggaattagga

SEQ ID NO: 7271777 - DNA, 16 bp, Homo sapiens
aggaggggaattagga

SEQ ID NO: 7271778 - DNA, 22 bp, Homo sapiens
aggaggggcaatgatagtctgg

SEQ ID NO: 7271779 - DNA, 22 bp, Homo sapiens
aggaggggcaatgatagtctgg

SEQ ID NO: 7271780 - DNA, 22 bp, Homo sapiens
catgtcaataaatataactgca

SEQ ID NO: 7271781 - DNA, 22 bp, Homo sapiens
catggctgaaattcttcgcttg

SEQ ID NO: 7271782 - DNA, 22 bp, Homo sapiens
catgggggtctggacaacaggc

SEQ ID NO: 7271783 - DNA, 22 bp, Homo sapiens
cattaaaatatctcatggtgtt

SEQ ID NO: 7271784 - DNA, 23 bp, Homo sapiens
catgtttttctatctcagcgtgt

SEQ ID NO: 7271785 - DNA, 22 bp, Homo sapiens
cattaaaatatctcatggtgtt

SEQ ID NO: 7271786 - DNA, 19 bp, Homo sapiens
aggcagcaggccagggatg

SEQ ID NO: 7271787 - DNA, 19 bp, Homo sapiens
aggcagcaggccagggatg

SEQ ID NO: 7271788 - DNA, 21 bp, Homo sapiens
aggcagcaggatccagggaca

SEQ ID NO: 7271789 - DNA, 21 bp, Homo sapiens
aggcagcaggatccagggaca

SEQ ID NO: 7271790 - DNA, 22 bp, Homo sapiens
ccaaggacccgagcctgcggga

SEQ ID NO: 7271791 - DNA, 22 bp, Homo sapiens
ccaaggtggctacagccctgca

SEQ ID NO: 7271792 - DNA, 22 bp, Homo sapiens
ccaagggctgctgaggtgtcca

SEQ ID NO: 7271793 - DNA, 23 bp, Homo sapiens
aggcagcaggttgtccagggtga

SEQ ID NO: 7271794 - DNA, 23 bp, Homo sapiens
aggcagcaggttgtccagggtga

SEQ ID NO: 7271795 - DNA, 23 bp, Homo sapiens
aggcagcaggttgtccagggtga

SEQ ID NO: 7271796 - DNA, 22 bp, Homo sapiens
aggcagcagggccactggctga

SEQ ID NO: 7271797 - DNA, 22 bp, Homo sapiens
agctgcagcactccagtagccg

SEQ ID NO: 7271798 - DNA, 22 bp, Homo sapiens
caggaaggaccgtccagatcag

SEQ ID NO: 7271799 - DNA, 22 bp, Homo sapiens
caggaaggcccacctgtcctgt

SEQ ID NO: 7271800 - DNA, 22 bp, Homo sapiens
caggaaggcgcggctgtgcctg

SEQ ID NO: 7271801 - DNA, 19 bp, Homo sapiens
caggaaggggcgaatctgg

SEQ ID NO: 7271802 - DNA, 22 bp, Homo sapiens
agctgccacatgcccaagggca

SEQ ID NO: 7271803 - DNA, 22 bp, Homo sapiens
agctgcagtcaagctgggccac

SEQ ID NO: 7271804 - DNA, 22 bp, Homo sapiens
cagctctgtaaattccttcatc

SEQ ID NO: 7271805 - DNA, 22 bp, Homo sapiens
cagctgacagtgaggtgggggc

SEQ ID NO: 7271806 - DNA, 22 bp, Homo sapiens
cagctgaattcttcagactcca

SEQ ID NO: 7271807 - DNA, 22 bp, Homo sapiens
cagctgacccagtgaggaggca

SEQ ID NO: 7271808 - DNA, 22 bp, Homo sapiens
cagctgacttcataggaagaca

SEQ ID NO: 7271809 - DNA, 22 bp, Homo sapiens
cagctgacccgtgggaggcggg

SEQ ID NO: 7271810 - DNA, 22 bp, Homo sapiens
cagctgacgccagagtggaatt

SEQ ID NO: 7271811 - DNA, 23 bp, Homo sapiens
agctgaggctgtgggtgtcagag

SEQ ID NO: 7271812 - DNA, 22 bp, Homo sapiens
cagctgagaagtgatagctgca

SEQ ID NO: 7271813 - DNA, 22 bp, Homo sapiens
agctgctgcggaaagatgccac

SEQ ID NO: 7271814 - DNA, 22 bp, Homo sapiens
agctgccactgagggtgcacag

SEQ ID NO: 7271815 - DNA, 21 bp, Homo sapiens
agctgccaccctagcttctga

SEQ ID NO: 7271816 - DNA, 21 bp, Homo sapiens
agctgccaccctagcttctga

SEQ ID NO: 7271817 - DNA, 22 bp, Homo sapiens
caggccagcttcctgacatcct

SEQ ID NO: 7271818 - DNA, 22 bp, Homo sapiens
caggccagcagggcctccgtgg

SEQ ID NO: 7271819 - DNA, 22 bp, Homo sapiens
caggctgcggtcggctctggtc

SEQ ID NO: 7271820 - DNA, 22 bp, Homo sapiens
caggctgagctctggcctgggc

SEQ ID NO: 7271821 - DNA, 22 bp, Homo sapiens
caggctgcggccgtgtgagcat

SEQ ID NO: 7271822 - DNA, 22 bp, Homo sapiens
agctgtgattatccactggaat

SEQ ID NO: 7271823 - DNA, 22 bp, Homo sapiens
agctgtgaccttcaagagctac

SEQ ID NO: 7271824 - DNA, 22 bp, Homo sapiens
caggctggagttacctttaggg

SEQ ID NO: 7271825 - DNA, 22 bp, Homo sapiens
cagggtgactgccctggccact

SEQ ID NO: 7271826 - DNA, 22 bp, Homo sapiens
cagggtcttggcgccatcaccc

SEQ ID NO: 7271827 - DNA, 22 bp, Homo sapiens
caggggctctaatgcatgatca

SEQ ID NO: 7271828 - DNA, 20 bp, Homo sapiens
caggtgattccctggggaat

SEQ ID NO: 7271829 - DNA, 22 bp, Homo sapiens
caggtgagctctatctagggag

SEQ ID NO: 7271830 - DNA, 22 bp, Homo sapiens
caggtgaccctctcacctgctt

SEQ ID NO: 7271831 - DNA, 22 bp, Homo sapiens
agcagccacagtctgggacagg

SEQ ID NO: 7271832 - DNA, 21 bp, Homo sapiens
agcagcagggaagcctcatcc

SEQ ID NO: 7271833 - DNA, 22 bp, Homo sapiens
agcagcaggcttaaggaaaagt

SEQ ID NO: 7271834 - DNA, 22 bp, Homo sapiens
agcagcagggacaaaggaacag

SEQ ID NO: 7271835 - DNA, 22 bp, Homo sapiens
agcagcagggctctgcccgtgc

SEQ ID NO: 7271836 - DNA, 22 bp, Homo sapiens
agcagcagggcatgtcttactc

SEQ ID NO: 7271837 - DNA, 22 bp, Homo sapiens
caatttttgtacttatagtact

SEQ ID NO: 7271838 - DNA, 22 bp, Homo sapiens
agcagcagggtcattgctcttt

SEQ ID NO: 7271839 - DNA, 22 bp, Homo sapiens
agcagcagggtgatagtgccca

SEQ ID NO: 7271840 - DNA, 20 bp, Homo sapiens
cacaagagaatacacactgg

SEQ ID NO: 7271841 - DNA, 22 bp, Homo sapiens
caattttttccatgctcttaca

SEQ ID NO: 7271842 - DNA, 22 bp, Homo sapiens
agcagcaggctgggatgagtct

SEQ ID NO: 7271843 - DNA, 22 bp, Homo sapiens
agcagcaggctgtgtggactga

SEQ ID NO: 7271844 - DNA, 22 bp, Homo sapiens
agcagcaggctagggaactgct

SEQ ID NO: 7271845 - DNA, 22 bp, Homo sapiens
agcagcaggattttcgttggga

SEQ ID NO: 7271846 - DNA, 23 bp, Homo sapiens
agcagcaggaggtattgataagg

SEQ ID NO: 7271847 - DNA, 22 bp, Homo sapiens
agcagcaggaggctgtccacca

SEQ ID NO: 7271848 - DNA, 22 bp, Homo sapiens
agcagcaggagccgtggggtga

SEQ ID NO: 7271849 - DNA, 22 bp, Homo sapiens
agcagcaggaggccattgtctt

SEQ ID NO: 7271850 - DNA, 22 bp, Homo sapiens
agcagcagctctgttgccctac

SEQ ID NO: 7271851 - DNA, 20 bp, Homo sapiens
agcagcagatgttggaggtg

SEQ ID NO: 7271852 - DNA, 22 bp, Homo sapiens
caagcagagactagatagctgt

SEQ ID NO: 7271853 - DNA, 17 bp, Homo sapiens
caagagagatgactgga

SEQ ID NO: 7271854 - DNA, 17 bp, Homo sapiens
caagagagatgactgga

SEQ ID NO: 7271855 - DNA, 22 bp, Homo sapiens
agcacagtttcttttccttgtc

SEQ ID NO: 7271856 - DNA, 22 bp, Homo sapiens
caaatagtatgagcaatgattc

SEQ ID NO: 7271857 - DNA, 22 bp, Homo sapiens
agcacatgcacagtgctacact

SEQ ID NO: 7271858 - DNA, 21 bp, Homo sapiens
agcacagctttaagccatgtg

SEQ ID NO: 7271859 - DNA, 22 bp, Homo sapiens
agcaaagcatcactccaatctg

SEQ ID NO: 7271860 - DNA, 22 bp, Homo sapiens
agcaaagcagtggctaagctga

SEQ ID NO: 7271861 - DNA, 22 bp, Homo sapiens
agcaaagcactttgcatacata

SEQ ID NO: 7271862 - DNA, 22 bp, Homo sapiens
caaatattccaggtacatccct

SEQ ID NO: 7271863 - DNA, 22 bp, Homo sapiens
caaatagtttttcatgtattat

SEQ ID NO: 7271864 - DNA, 22 bp, Homo sapiens
caaatagtgtcacattgtgagg

SEQ ID NO: 7271865 - DNA, 22 bp, Homo sapiens
caaattaccctcaacatctaga

SEQ ID NO: 7271866 - DNA, 22 bp, Homo sapiens
agcaccagagctatgggcctgc

SEQ ID NO: 7271867 - DNA, 22 bp, Homo sapiens
agcaccagcaactatgggctgc

SEQ ID NO: 7271868 - DNA, 23 bp, Homo sapiens
agcaccaggaacagtgtggtcct

SEQ ID NO: 7271869 - DNA, 22 bp, Homo sapiens
caactttaaatggctatgtctg

SEQ ID NO: 7271870 - DNA, 22 bp, Homo sapiens
caactttaatttgggtgtcaga

SEQ ID NO: 7271871 - DNA, 22 bp, Homo sapiens
caactttagaccccaagtagct

SEQ ID NO: 7271872 - DNA, 23 bp, Homo sapiens
cactgccttcagttgcttcacct

SEQ ID NO: 7271873 - DNA, 22 bp, Homo sapiens
cactgctacctctgcctcccgg

SEQ ID NO: 7271874 - DNA, 22 bp, Homo sapiens
cactgctacctctgcctcccgg

SEQ ID NO: 7271875 - DNA, 22 bp, Homo sapiens
agcagggctggggcacgagcca

SEQ ID NO: 7271876 - DNA, 21 bp, Homo sapiens
agcagctgcagtttctatctg

SEQ ID NO: 7271877 - DNA, 22 bp, Homo sapiens
cacaatttttcttaggtcctgg

SEQ ID NO: 7271878 - DNA, 22 bp, Homo sapiens
cacaattttcctttaagtgtat

SEQ ID NO: 7271879 - DNA, 22 bp, Homo sapiens
agcagctgatcaaagcacttat

SEQ ID NO: 7271880 - DNA, 22 bp, Homo sapiens
agcaggcagcctaggaagtgaa

SEQ ID NO: 7271881 - DNA, 22 bp, Homo sapiens
cacagtgtttgatttaggggcc

SEQ ID NO: 7271882 - DNA, 22 bp, Homo sapiens
agcaggcaggaatggtggaaca

SEQ ID NO: 7271883 - DNA, 22 bp, Homo sapiens
agccacctcctgctctgctcac

SEQ ID NO: 7271884 - DNA, 22 bp, Homo sapiens
agccagagactttacctgtgca

SEQ ID NO: 7271885 - DNA, 22 bp, Homo sapiens
cagacagggttttggtctttgg

SEQ ID NO: 7271886 - DNA, 22 bp, Homo sapiens
cagacaggaagttcagaagaaa

SEQ ID NO: 7271887 - DNA, 23 bp, Homo sapiens
agccacttctatcttgctcctgg

SEQ ID NO: 7271888 - DNA, 21 bp, Homo sapiens
cagaggcaggtcctgggacgg

SEQ ID NO: 7271889 - DNA, 22 bp, Homo sapiens
cagaggcagtggggttgctcct

SEQ ID NO: 7271890 - DNA, 22 bp, Homo sapiens
cagaggcatactcccagtcttg

SEQ ID NO: 7271891 - DNA, 22 bp, Homo sapiens
agcccaggcagagggatgcttg

SEQ ID NO: 7271892 - DNA, 20 bp, Homo sapiens
cagaggcattttcagactct

SEQ ID NO: 7271893 - DNA, 22 bp, Homo sapiens
cagaggcatactcccagtcttg

SEQ ID NO: 7271894 - DNA, 22 bp, Homo sapiens
cagaggcatactcccagtcttg

SEQ ID NO: 7271895 - DNA, 22 bp, Homo sapiens
cagaggctgacaaaatattgct

SEQ ID NO: 7271896 - DNA, 22 bp, Homo sapiens
agcccaggctggagtgcagtgg

SEQ ID NO: 7271897 - DNA, 22 bp, Homo sapiens
agcccagggaaccaggaagtgg

SEQ ID NO: 7271898 - DNA, 22 bp, Homo sapiens
cagagaaaaaatcctgctctca

SEQ ID NO: 7271899 - DNA, 22 bp, Homo sapiens
agcctgagccccatccagctga

SEQ ID NO: 7271900 - DNA, 22 bp, Homo sapiens
cagcaggatatggtggagagag

SEQ ID NO: 7271901 - DNA, 22 bp, Homo sapiens
cagcaggatatggtggagagag

SEQ ID NO: 7271902 - DNA, 22 bp, Homo sapiens
agcctggatcctaggctcagct

SEQ ID NO: 7271903 - DNA, 22 bp, Homo sapiens
agcctggattcgtgcatccaca

SEQ ID NO: 7271904 - DNA, 22 bp, Homo sapiens
cagaggtcaggttggacattat

SEQ ID NO: 7271905 - DNA, 21 bp, Homo sapiens
cagaggtcatcctgaggacaa

SEQ ID NO: 7271906 - DNA, 22 bp, Homo sapiens
cagaggtctgacactgaatggt

SEQ ID NO: 7271907 - DNA, 22 bp, Homo sapiens
cagaggtcaagatctgaagtga

SEQ ID NO: 7271908 - DNA, 22 bp, Homo sapiens
agcctctgtagaaagcagtgtg

SEQ ID NO: 7271909 - DNA, 22 bp, Homo sapiens
agcctctgtgactcacaggtca

SEQ ID NO: 7271910 - DNA, 22 bp, Homo sapiens
agcctctgctggccctggcact

SEQ ID NO: 7271911 - DNA, 22 bp, Homo sapiens
agcctctggccctagactgctt

SEQ ID NO: 7271912 - DNA, 23 bp, Homo sapiens
cagccctgaaatcgaggtgacac

SEQ ID NO: 7271913 - DNA, 22 bp, Homo sapiens
cagccctgagagaaccatctat

SEQ ID NO: 7271914 - DNA, 22 bp, Homo sapiens
cagccctgcacgctgcctccgc

SEQ ID NO: 7271915 - DNA, 21 bp, Homo sapiens
cagcagtgtgtctgagctaga

SEQ ID NO: 7271916 - DNA, 22 bp, Homo sapiens
cagcagttcaatccagtgcacg

SEQ ID NO: 7271917 - DNA, 22 bp, Homo sapiens
cagcagtgtggaagctgagggg

SEQ ID NO: 7271918 - DNA, 22 bp, Homo sapiens
cagcagttcacacttaacaagt

SEQ ID NO: 7271919 - DNA, 22 bp, Homo sapiens
cagcagttttgaagtgtggaga

SEQ ID NO: 7271920 - DNA, 19 bp, Homo sapiens
cagctcaggactcagcccc

SEQ ID NO: 7271921 - DNA, 22 bp, Homo sapiens
attgctaggaacaggttgcacc

SEQ ID NO: 7271922 - DNA, 22 bp, Homo sapiens
attgctaggaacaggttgcacc

SEQ ID NO: 7271923 - DNA, 22 bp, Homo sapiens
agaggtcagatttctcctggtg

SEQ ID NO: 7271924 - DNA, 22 bp, Homo sapiens
atttattgaagcttattacgtt

SEQ ID NO: 7271925 - DNA, 22 bp, Homo sapiens
agatacatatagaaaacatcaa

SEQ ID NO: 7271926 - DNA, 22 bp, Homo sapiens
atttgtgggactataatgcagg

SEQ ID NO: 7271927 - DNA, 22 bp, Homo sapiens
atttgtctttggacctgtgaga

SEQ ID NO: 7271928 - DNA, 22 bp, Homo sapiens
caaaagtaatgtatgctcatcg

SEQ ID NO: 7271929 - DNA, 22 bp, Homo sapiens
atttgtttatcgtcgattgtag

SEQ ID NO: 7271930 - DNA, 16 bp, Homo sapiens
atttccagattatgca

SEQ ID NO: 7271931 - DNA, 22 bp, Homo sapiens
agaggcctttctgttgagtgaa

SEQ ID NO: 7271932 - DNA, 22 bp, Homo sapiens
agaggcggagcttgcagtgagc

SEQ ID NO: 7271933 - DNA, 22 bp, Homo sapiens
agaggcggaggttgcagtgagc

SEQ ID NO: 7271934 - DNA, 21 bp, Homo sapiens
agaggcggggttttggaggcc

SEQ ID NO: 7271935 - DNA, 22 bp, Homo sapiens
agaggcggagcttgcagtgagc

SEQ ID NO: 7271936 - DNA, 22 bp, Homo sapiens
agaggcggaggttgcagtgagc

SEQ ID NO: 7271937 - DNA, 22 bp, Homo sapiens
attcagtagaagttagctatta

SEQ ID NO: 7271938 - DNA, 17 bp, Homo sapiens
agaggcagatacttgga

SEQ ID NO: 7271939 - DNA, 22 bp, Homo sapiens
agaggcagcagtcatactacag

SEQ ID NO: 7271940 - DNA, 22 bp, Homo sapiens
agaggcaggaggttgacttgag

SEQ ID NO: 7271941 - DNA, 22 bp, Homo sapiens
agaggcaggaagagctgatttt

SEQ ID NO: 7271942 - DNA, 22 bp, Homo sapiens
agaggcagccgtatttcaaagg

SEQ ID NO: 7271943 - DNA, 22 bp, Homo sapiens
agaggcaggaagagctgatttt

SEQ ID NO: 7271944 - DNA, 22 bp, Homo sapiens
attccattgtgtaaggatatcg

SEQ ID NO: 7271945 - DNA, 22 bp, Homo sapiens
attccagttctcctctctaaag

SEQ ID NO: 7271946 - DNA, 22 bp, Homo sapiens
attccagttgggttctaataca

SEQ ID NO: 7271947 - DNA, 22 bp, Homo sapiens
attccagttgggttctaataca

SEQ ID NO: 7271948 - DNA, 22 bp, Homo sapiens
attccagtccaaatgttttcct

SEQ ID NO: 7271949 - DNA, 22 bp, Homo sapiens
attccagaataccggcaagatg

SEQ ID NO: 7271950 - DNA, 17 bp, Homo sapiens
agagggaaaatgcggtt

SEQ ID NO: 7271951 - DNA, 22 bp, Homo sapiens
attattatatagggaaagtccc

SEQ ID NO: 7271952 - DNA, 22 bp, Homo sapiens
attattatatagggaaagtccc

SEQ ID NO: 7271953 - DNA, 22 bp, Homo sapiens
attataggcttgagccaccgtg

SEQ ID NO: 7271954 - DNA, 22 bp, Homo sapiens
attattattgttgatgttaggg

SEQ ID NO: 7271955 - DNA, 22 bp, Homo sapiens
attattattgttgatgttaggg

SEQ ID NO: 7271956 - DNA, 22 bp, Homo sapiens
agaggcagaagtgttcaaaccc

SEQ ID NO: 7271957 - DNA, 20 bp, Homo sapiens
agaggaggattattttattc

SEQ ID NO: 7271958 - DNA, 22 bp, Homo sapiens
agaggaggaagagctttaaaat

SEQ ID NO: 7271959 - DNA, 22 bp, Homo sapiens
agaggaggcagcttaactcagt

SEQ ID NO: 7271960 - DNA, 22 bp, Homo sapiens
agaggacagacggaaagtgcca

SEQ ID NO: 7271961 - DNA, 22 bp, Homo sapiens
agaggacaggttttccatgggc

SEQ ID NO: 7271962 - DNA, 22 bp, Homo sapiens
atgtgtatatttattgtagttt

SEQ ID NO: 7271963 - DNA, 22 bp, Homo sapiens
agagctgttaattttgcactgg

SEQ ID NO: 7271964 - DNA, 22 bp, Homo sapiens
agagatgctgtgggtagaggca

SEQ ID NO: 7271965 - DNA, 22 bp, Homo sapiens
agagatgcccttgaaaggatta

SEQ ID NO: 7271966 - DNA, 22 bp, Homo sapiens
agagatgcattcagcatggatg

SEQ ID NO: 7271967 - DNA, 19 bp, Homo sapiens
agagatgctaagagtcttt

SEQ ID NO: 7271968 - DNA, 22 bp, Homo sapiens
agagatgcggttccatggttat

SEQ ID NO: 7271969 - DNA, 22 bp, Homo sapiens
atgtgggaaatacaagctaaaa

SEQ ID NO: 7271970 - DNA, 22 bp, Homo sapiens
atgtgtacacacatatatgtat

SEQ ID NO: 7271971 - DNA, 22 bp, Homo sapiens
atgtatttgcttgttatggatt

SEQ ID NO: 7271972 - DNA, 22 bp, Homo sapiens
atgtcaaagcagactgagagcg

SEQ ID NO: 7271973 - DNA, 22 bp, Homo sapiens
atggcagcctgagcagaggaat

SEQ ID NO: 7271974 - DNA, 22 bp, Homo sapiens
agagatgaagggcattccccag

SEQ ID NO: 7271975 - DNA, 22 bp, Homo sapiens
agagacagaggcaatatagctt

SEQ ID NO: 7271976 - DNA, 22 bp, Homo sapiens
agagacagggttttgtcgtgtt

SEQ ID NO: 7271977 - DNA, 22 bp, Homo sapiens
agaagttgtaggtttgcatatt

SEQ ID NO: 7271978 - DNA, 22 bp, Homo sapiens
agaaggcttaaaacatggaata

SEQ ID NO: 7271979 - DNA, 22 bp, Homo sapiens
agaagtcatttatgttagatga

SEQ ID NO: 7271980 - DNA, 22 bp, Homo sapiens
atgaaagatgatttaaagtact

SEQ ID NO: 7271981 - DNA, 18 bp, Homo sapiens
agaattgctgcttcttct

SEQ ID NO: 7271982 - DNA, 22 bp, Homo sapiens
agacaaagacagcatctcaggt

SEQ ID NO: 7271983 - DNA, 22 bp, Homo sapiens
agacaaataactttttatgtcc

SEQ ID NO: 7271984 - DNA, 22 bp, Homo sapiens
agacaaatggagtatgagcaac

SEQ ID NO: 7271985 - DNA, 22 bp, Homo sapiens
agacaaatggtaattatgtcta

SEQ ID NO: 7271986 - DNA, 22 bp, Homo sapiens
agacaaatggtaattatgtcta

SEQ ID NO: 7271987 - DNA, 22 bp, Homo sapiens
agacaggagagggaactgccgg

SEQ ID NO: 7271988 - DNA, 22 bp, Homo sapiens
agacagctgggaaatggagtgt

SEQ ID NO: 7271989 - DNA, 22 bp, Homo sapiens
agacagcatgagcctgctgatg

SEQ ID NO: 7271990 - DNA, 22 bp, Homo sapiens
agacagctaataaatgagtgtg

SEQ ID NO: 7271991 - DNA, 22 bp, Homo sapiens
agacagcatgatacatgatgct

SEQ ID NO: 7271992 - DNA, 22 bp, Homo sapiens
atgcacatgtggctttatgtat

SEQ ID NO: 7271993 - DNA, 22 bp, Homo sapiens
atgacaaaagaagacatgaggt

SEQ ID NO: 7271994 - DNA, 22 bp, Homo sapiens
agctgagagcccctgccctgtg

SEQ ID NO: 7271995 - DNA, 17 bp, Homo sapiens
agctgaccagatggact

SEQ ID NO: 7271996 - DNA, 22 bp, Homo sapiens
acaggagaattatctggaacaa

SEQ ID NO: 7271997 - DNA, 22 bp, Homo sapiens
agctggcaccaaatatagtaaa

SEQ ID NO: 7271998 - DNA, 22 bp, Homo sapiens
acaggcagggacctcttgagtt

SEQ ID NO: 7271999 - DNA, 22 bp, Homo sapiens
acagggaccttggaagctggaa

SEQ ID NO: 7272000 - DNA, 22 bp, Homo sapiens
acagggacctgtgagctccata

SEQ ID NO: 7272001 - DNA, 22 bp, Homo sapiens
acaggcaggcgggacagcccga

SEQ ID NO: 7272002 - DNA, 22 bp, Homo sapiens
acaggcaggagctccccattcc

SEQ ID NO: 7272003 - DNA, 22 bp, Homo sapiens
acaggcagatgttttagttgta

SEQ ID NO: 7272004 - DNA, 22 bp, Homo sapiens
acaggcagcaaaatcagcctca

SEQ ID NO: 7272005 - DNA, 22 bp, Homo sapiens
acaggcagcaaaatcagcctca

SEQ ID NO: 7272006 - DNA, 22 bp, Homo sapiens
acagggctcccagcaggtctgt

SEQ ID NO: 7272007 - DNA, 22 bp, Homo sapiens
aggaagagcatctttgggtctg

SEQ ID NO: 7272008 - DNA, 22 bp, Homo sapiens
aggatggattctgtatgtggga

SEQ ID NO: 7272009 - DNA, 22 bp, Homo sapiens
aggatgagccgcgcaagctgac

SEQ ID NO: 7272010 - DNA, 22 bp, Homo sapiens
acagtgtgttctgggacctcca

SEQ ID NO: 7272011 - DNA, 22 bp, Homo sapiens
acagtgttacttgatagtgtat

SEQ ID NO: 7272012 - DNA, 22 bp, Homo sapiens
acagtgtgttggaggagactgt

SEQ ID NO: 7272013 - DNA, 22 bp, Homo sapiens
aggatgaggctggcaggtcttg

SEQ ID NO: 7272014 - DNA, 17 bp, Homo sapiens
aggcagctcagaacatc

SEQ ID NO: 7272015 - DNA, 22 bp, Homo sapiens
aggcagctaagatggataatga

SEQ ID NO: 7272016 - DNA, 22 bp, Homo sapiens
aggcagctagagagtgaaactg

SEQ ID NO: 7272017 - DNA, 22 bp, Homo sapiens
aggcagctggacataactaacc

SEQ ID NO: 7272018 - DNA, 22 bp, Homo sapiens
aggcagctggaggcagagacta

SEQ ID NO: 7272019 - DNA, 22 bp, Homo sapiens
aggcagctggaaaactccaggc

SEQ ID NO: 7272020 - DNA, 22 bp, Homo sapiens
aggcagctgccctctccttcct

SEQ ID NO: 7272021 - DNA, 21 bp, Homo sapiens
aggcagctggaaggcctggct

SEQ ID NO: 7272022 - DNA, 22 bp, Homo sapiens
aggcagctgaggtctggcgccc

SEQ ID NO: 7272023 - DNA, 22 bp, Homo sapiens
aggcagctgaccacagtatgat

SEQ ID NO: 7272024 - DNA, 21 bp, Homo sapiens
aggcagctcaggcccagagag

SEQ ID NO: 7272025 - DNA, 22 bp, Homo sapiens
aggcagctctgtggcctcccag

SEQ ID NO: 7272026 - DNA, 22 bp, Homo sapiens
acagtcctgttgtcaaagcaat

SEQ ID NO: 7272027 - DNA, 22 bp, Homo sapiens
acagtctacttgagcttgtata

SEQ ID NO: 7272028 - DNA, 22 bp, Homo sapiens
acagtcattagatacaatgtct

SEQ ID NO: 7272029 - DNA, 22 bp, Homo sapiens
acagtgtggttgtttctggtta

SEQ ID NO: 7272030 - DNA, 23 bp, Homo sapiens
acagtgtggtggacaaggagcag

SEQ ID NO: 7272031 - DNA, 22 bp, Homo sapiens
acagtgtgtcctaaaggtctgg

SEQ ID NO: 7272032 - DNA, 22 bp, Homo sapiens
acagtgtggtttgagcactggg

SEQ ID NO: 7272033 - DNA, 22 bp, Homo sapiens
acagtgtgtgggaaatgtgact

SEQ ID NO: 7272034 - DNA, 22 bp, Homo sapiens
acagtgtgtgctttcccttacg

SEQ ID NO: 7272035 - DNA, 22 bp, Homo sapiens
acagtgtggtgatggcacttgc

SEQ ID NO: 7272036 - DNA, 22 bp, Homo sapiens
acagtgtggggtgagatggaac

SEQ ID NO: 7272037 - DNA, 22 bp, Homo sapiens
acagtgtggaaagtcaacttga

SEQ ID NO: 7272038 - DNA, 22 bp, Homo sapiens
acagtgtgggacattaggaaat

SEQ ID NO: 7272039 - DNA, 22 bp, Homo sapiens
acagtgtgacaattgtgtcaga

SEQ ID NO: 7272040 - DNA, 22 bp, Homo sapiens
acagtgtgatgggcctgcctga

SEQ ID NO: 7272041 - DNA, 22 bp, Homo sapiens
acagtgtgcaagaaatggggga

SEQ ID NO: 7272042 - DNA, 16 bp, Homo sapiens
acagtgtgctaagcat

SEQ ID NO: 7272043 - DNA, 21 bp, Homo sapiens
acagtgtgcttctctccctcc

SEQ ID NO: 7272044 - DNA, 22 bp, Homo sapiens
acagtctggaagcagggggcaa

SEQ ID NO: 7272045 - DNA, 22 bp, Homo sapiens
aggagcactgagccagcatggg

SEQ ID NO: 7272046 - DNA, 22 bp, Homo sapiens
aggagcactaattcctgcagag

SEQ ID NO: 7272047 - DNA, 22 bp, Homo sapiens
aggagcagaactgattctgact

SEQ ID NO: 7272048 - DNA, 19 bp, Homo sapiens
aggagcactgccagcacca

SEQ ID NO: 7272049 - DNA, 22 bp, Homo sapiens
aggagcagaatttaatgtgcag

SEQ ID NO: 7272050 - DNA, 22 bp, Homo sapiens
aggagcagaatttaatgtgcag

SEQ ID NO: 7272051 - DNA, 22 bp, Homo sapiens
acagtaaaaagccttagaattt

SEQ ID NO: 7272052 - DNA, 22 bp, Homo sapiens
aggcttgtcagaatggattaga

SEQ ID NO: 7272053 - DNA, 22 bp, Homo sapiens
aggcttgtctcagaagatgctg

SEQ ID NO: 7272054 - DNA, 22 bp, Homo sapiens
aggcttgtttgaggatagtaat

SEQ ID NO: 7272055 - DNA, 18 bp, Homo sapiens
agggagagaccgcgggtc

SEQ ID NO: 7272056 - DNA, 17 bp, Homo sapiens
accagcctctcctgggg

SEQ ID NO: 7272057 - DNA, 22 bp, Homo sapiens
accagcctcctagctgctcctg

SEQ ID NO: 7272058 - DNA, 22 bp, Homo sapiens
accagcctggccaacatggcaa

SEQ ID NO: 7272059 - DNA, 21 bp, Homo sapiens
agggcagattagctgtaagag

SEQ ID NO: 7272060 - DNA, 22 bp, Homo sapiens
agggcagcacaaggcatggact

SEQ ID NO: 7272061 - DNA, 22 bp, Homo sapiens
agggcagcaatgcagctgctgc

SEQ ID NO: 7272062 - DNA, 22 bp, Homo sapiens
agggcagcagcccatggctctg

SEQ ID NO: 7272063 - DNA, 22 bp, Homo sapiens
agggcagcagctcctcctagct

SEQ ID NO: 7272064 - DNA, 22 bp, Homo sapiens
agggcagcagcggcccaggcct

SEQ ID NO: 7272065 - DNA, 22 bp, Homo sapiens
agggcagcagcggcccaggcct

SEQ ID NO: 7272066 - DNA, 22 bp, Homo sapiens
acccaggacaaaataaccaggt

SEQ ID NO: 7272067 - DNA, 22 bp, Homo sapiens
acccaggaaaacatggtgcaga

SEQ ID NO: 7272068 - DNA, 22 bp, Homo sapiens
acccaggacatgggcacccgtg

SEQ ID NO: 7272069 - DNA, 22 bp, Homo sapiens
acccaggacacagagatgaccc

SEQ ID NO: 7272070 - DNA, 22 bp, Homo sapiens
agggctgccatttctggcccaa

SEQ ID NO: 7272071 - DNA, 22 bp, Homo sapiens
acccaggagagagctataaaat

SEQ ID NO: 7272072 - DNA, 22 bp, Homo sapiens
acccaggagacggaggtgcagt

SEQ ID NO: 7272073 - DNA, 22 bp, Homo sapiens
acccaggagacaggttgcagtg

SEQ ID NO: 7272074 - DNA, 22 bp, Homo sapiens
acccaggactctcttccagtag

SEQ ID NO: 7272075 - DNA, 22 bp, Homo sapiens
acccaggacttggcaacctcat

SEQ ID NO: 7272076 - DNA, 22 bp, Homo sapiens
accaggctccccttggatcctg

SEQ ID NO: 7272077 - DNA, 22 bp, Homo sapiens
accaggctggagtgcagtggcg

SEQ ID NO: 7272078 - DNA, 22 bp, Homo sapiens
acccagcatgacacctgcacat

SEQ ID NO: 7272079 - DNA, 22 bp, Homo sapiens
acccagccacagcattgaggga

SEQ ID NO: 7272080 - DNA, 22 bp, Homo sapiens
acccagccatgttcagttctct

SEQ ID NO: 7272081 - DNA, 22 bp, Homo sapiens
acccagcccagaatctggggcc

SEQ ID NO: 7272082 - DNA, 19 bp, Homo sapiens
acccagcccaggagtggca

SEQ ID NO: 7272083 - DNA, 19 bp, Homo sapiens
acccagcccaggagtggca

SEQ ID NO: 7272084 - DNA, 22 bp, Homo sapiens
acccagcctacaaagctcacct

SEQ ID NO: 7272085 - DNA, 22 bp, Homo sapiens
aggctgagaaagtgggaagatg

SEQ ID NO: 7272086 - DNA, 22 bp, Homo sapiens
aggctgagaaagtgggaagatg

SEQ ID NO: 7272087 - DNA, 22 bp, Homo sapiens
aggctgaaaacgagatggcaat

SEQ ID NO: 7272088 - DNA, 22 bp, Homo sapiens
acatttgacatttagtatcagc

SEQ ID NO: 7272089 - DNA, 22 bp, Homo sapiens
aggctgaggagggatgttgctt

SEQ ID NO: 7272090 - DNA, 22 bp, Homo sapiens
acatttctttctattcagtagc

SEQ ID NO: 7272091 - DNA, 22 bp, Homo sapiens
aggctgagctggtagtgagtac

SEQ ID NO: 7272092 - DNA, 22 bp, Homo sapiens
aggctgagctggcccttgaaat

SEQ ID NO: 7272093 - DNA, 22 bp, Homo sapiens
acatcagtccaccactgcagtt

SEQ ID NO: 7272094 - DNA, 18 bp, Homo sapiens
acatcagttaccaggcca

SEQ ID NO: 7272095 - DNA, 22 bp, Homo sapiens
acatcagtcttttgcatacata

SEQ ID NO: 7272096 - DNA, 22 bp, Homo sapiens
acatcagtgctcttggttcttg

SEQ ID NO: 7272097 - DNA, 21 bp, Homo sapiens
acatccagggtcctcactgcc

SEQ ID NO: 7272098 - DNA, 22 bp, Homo sapiens
acatccagatctcagcatggct

SEQ ID NO: 7272099 - DNA, 22 bp, Homo sapiens
acatcagtaattaagtctcaag

SEQ ID NO: 7272100 - DNA, 22 bp, Homo sapiens
acatcagtaactgtaaaacagg

SEQ ID NO: 7272101 - DNA, 22 bp, Homo sapiens
acatgtttgataaatatttggg

SEQ ID NO: 7272102 - DNA, 22 bp, Homo sapiens
acatgtttgcctgcaggcttag

SEQ ID NO: 7272103 - DNA, 22 bp, Homo sapiens
acatgtttggctctatgctata

SEQ ID NO: 7272104 - DNA, 19 bp, Homo sapiens
acatgttttgcagaacagc

SEQ ID NO: 7272105 - DNA, 22 bp, Homo sapiens
acatgtttaagtttgttatatg

SEQ ID NO: 7272106 - DNA, 22 bp, Homo sapiens
acatgtttacattaggtgatat

SEQ ID NO: 7272107 - DNA, 22 bp, Homo sapiens
acatgtttaagtttaatgaaaa

SEQ ID NO: 7272108 - DNA, 22 bp, Homo sapiens
atattcttccaaaacatcattt

SEQ ID NO: 7272109 - DNA, 22 bp, Homo sapiens
atatttcatggggttccatact

SEQ ID NO: 7272110 - DNA, 22 bp, Homo sapiens
agaaaataaattgatggtggaa

SEQ ID NO: 7272111 - DNA, 22 bp, Homo sapiens
agaaaagttttctgagactgac

SEQ ID NO: 7272112 - DNA, 22 bp, Homo sapiens
atattccagttatatcaaatca

SEQ ID NO: 7272113 - DNA, 22 bp, Homo sapiens
atattctagccaaagtgtgagc

SEQ ID NO: 7272114 - DNA, 22 bp, Homo sapiens
atattctataagcagttggaag

SEQ ID NO: 7272115 - DNA, 22 bp, Homo sapiens
atatggaatggtaatctacaat

SEQ ID NO: 7272116 - DNA, 22 bp, Homo sapiens
atatggatgagataatgagcca

SEQ ID NO: 7272117 - DNA, 18 bp, Homo sapiens
atatgcttgagctaagga

SEQ ID NO: 7272118 - DNA, 22 bp, Homo sapiens
actttcatttgtaataaacttc

SEQ ID NO: 7272119 - DNA, 22 bp, Homo sapiens
actttcatttgtgaagactgta

SEQ ID NO: 7272120 - DNA, 22 bp, Homo sapiens
actttcaattcactgagatata

SEQ ID NO: 7272121 - DNA, 22 bp, Homo sapiens
actttcaacttggtgggagagc

SEQ ID NO: 7272122 - DNA, 22 bp, Homo sapiens
actttcaagccctctagagaca

SEQ ID NO: 7272123 - DNA, 22 bp, Homo sapiens
atcgtattacctttgggattag

SEQ ID NO: 7272124 - DNA, 22 bp, Homo sapiens
atctcacatcctcagtagtgca

SEQ ID NO: 7272125 - DNA, 22 bp, Homo sapiens
atcgcaagtttaaaaatctttg

SEQ ID NO: 7272126 - DNA, 22 bp, Homo sapiens
agaacagcttgcctttaataga

SEQ ID NO: 7272127 - DNA, 19 bp, Homo sapiens
agaacagctttttgtgaca

SEQ ID NO: 7272128 - DNA, 22 bp, Homo sapiens
agaacagaagggaggaaggcct

SEQ ID NO: 7272129 - DNA, 22 bp, Homo sapiens
agaacagcagtagtatacagta

SEQ ID NO: 7272130 - DNA, 22 bp, Homo sapiens
atacatgttgagaaaatatctg

SEQ ID NO: 7272131 - DNA, 22 bp, Homo sapiens
acttcttcttcagctgggggat

SEQ ID NO: 7272132 - DNA, 22 bp, Homo sapiens
acttcttcttcagctgggggat

SEQ ID NO: 7272133 - DNA, 22 bp, Homo sapiens
acttctgataaagagcatgtgc

SEQ ID NO: 7272134 - DNA, 22 bp, Homo sapiens
acttctgattacacatgggcct

SEQ ID NO: 7272135 - DNA, 22 bp, Homo sapiens
acttctgattaaggatgaatgc

SEQ ID NO: 7272136 - DNA, 19 bp, Homo sapiens
acttctgaggaactgcaca

SEQ ID NO: 7272137 - DNA, 22 bp, Homo sapiens
acttctgagaaatttaaggaca

SEQ ID NO: 7272138 - DNA, 22 bp, Homo sapiens
acttctgaagcagagatttggg

SEQ ID NO: 7272139 - DNA, 22 bp, Homo sapiens
ataatggaaaagatcatttcct

SEQ ID NO: 7272140 - DNA, 22 bp, Homo sapiens
ataatggactcagtaatagtga

SEQ ID NO: 7272141 - DNA, 22 bp, Homo sapiens
atacagatgttgaatgttatat

SEQ ID NO: 7272142 - DNA, 22 bp, Homo sapiens
ataatgaatgcagagttatttt

SEQ ID NO: 7272143 - DNA, 22 bp, Homo sapiens
actgtagagaatctgagaaaaa

SEQ ID NO: 7272144 - DNA, 22 bp, Homo sapiens
actgtacatgtaaacattgtca

SEQ ID NO: 7272145 - DNA, 22 bp, Homo sapiens
actgtcaaatgcaatgaactca

SEQ ID NO: 7272146 - DNA, 22 bp, Homo sapiens
aggtctcctcatattctgcctc

SEQ ID NO: 7272147 - DNA, 22 bp, Homo sapiens
aggtctccttgtgggtcttgcc

SEQ ID NO: 7272148 - DNA, 22 bp, Homo sapiens
accctcccatttccatgtagca

SEQ ID NO: 7272149 - DNA, 22 bp, Homo sapiens
accctccccaagaggtcgtgcc

SEQ ID NO: 7272150 - DNA, 22 bp, Homo sapiens
acctgccagaatccaagccaca

SEQ ID NO: 7272151 - DNA, 22 bp, Homo sapiens
acctgcaggggtgctctctggg

SEQ ID NO: 7272152 - DNA, 22 bp, Homo sapiens
acctgcaggggtgctctctggg

SEQ ID NO: 7272153 - DNA, 22 bp, Homo sapiens
acctgcaggtgtttccacactt

SEQ ID NO: 7272154 - DNA, 19 bp, Homo sapiens
acctgcagtaataattcct

SEQ ID NO: 7272155 - DNA, 22 bp, Homo sapiens
acctgcagtggccactcctaat

SEQ ID NO: 7272156 - DNA, 22 bp, Homo sapiens
acctgcagtggccactcctaat

SEQ ID NO: 7272157 - DNA, 22 bp, Homo sapiens
acctgcagctaaagatgtaggg

SEQ ID NO: 7272158 - DNA, 22 bp, Homo sapiens
acctgcagccacttctctcctt

SEQ ID NO: 7272159 - DNA, 22 bp, Homo sapiens
acctgcaggcacaggtgtgcgc

SEQ ID NO: 7272160 - DNA, 22 bp, Homo sapiens
acctgcagctgagaaaatgact

SEQ ID NO: 7272161 - DNA, 22 bp, Homo sapiens
agtcaaccggtattagtctgtt

SEQ ID NO: 7272162 - DNA, 22 bp, Homo sapiens
agtcaaagatgaccgagttcct

SEQ ID NO: 7272163 - DNA, 22 bp, Homo sapiens
agtcaaagaagatggttccaaa

SEQ ID NO: 7272164 - DNA, 22 bp, Homo sapiens
agtcaaagggtatttggattga

SEQ ID NO: 7272165 - DNA, 22 bp, Homo sapiens
actagggaaagttatgttcaca

SEQ ID NO: 7272166 - DNA, 22 bp, Homo sapiens
acgatgctcaactatatgaatt

SEQ ID NO: 7272167 - DNA, 22 bp, Homo sapiens
acgatgctggattatctcaagg

SEQ ID NO: 7272168 - DNA, 22 bp, Homo sapiens
agtgcatacccttctaaaaagt

SEQ ID NO: 7272169 - DNA, 22 bp, Homo sapiens
actgagctcttgactgggagtt

SEQ ID NO: 7272170 - DNA, 20 bp, Homo sapiens
actgagctgcatggagagga

SEQ ID NO: 7272171 - DNA, 22 bp, Homo sapiens
actgaggacagtgaggagggct

SEQ ID NO: 7272172 - DNA, 22 bp, Homo sapiens
actgaggattagcccaggctag

SEQ ID NO: 7272173 - DNA, 22 bp, Homo sapiens
agtctttaatgatcatgtattt

SEQ ID NO: 7272174 - DNA, 23 bp, Homo sapiens
actcgtggaattctctgcgatcg

SEQ ID NO: 7272175 - DNA, 22 bp, Homo sapiens
agtcccatgccaaatgcatcct

SEQ ID NO: 7272176 - DNA, 22 bp, Homo sapiens
agtcccatgaggaatggggacg

SEQ ID NO: 7272177 - DNA, 18 bp, Homo sapiens
agtcccatcttcagctct

SEQ ID NO: 7272178 - DNA, 21 bp, Homo sapiens
agtcccatccggtaagcaagc

SEQ ID NO: 7272179 - DNA, 22 bp, Homo sapiens
agtcccatcagatgatatgaga

SEQ ID NO: 7272180 - DNA, 22 bp, Homo sapiens
agtcccatatccgggttcaggg

SEQ ID NO: 7272181 - DNA, 22 bp, Homo sapiens
agtgtagggtggtcagagcaga

SEQ ID NO: 7272182 - DNA, 22 bp, Homo sapiens
actgcacttcagcctgggtgtc

SEQ ID NO: 7272183 - DNA, 22 bp, Homo sapiens
actgcacttcagcctgggtgac

SEQ ID NO: 7272184 - DNA, 22 bp, Homo sapiens
agtggcagtagatgagctggtt

SEQ ID NO: 7272185 - DNA, 22 bp, Homo sapiens
agtggcagagctgggatttggg

SEQ ID NO: 7272186 - DNA, 21 bp, Homo sapiens
agtgtaggtcattagctgttg

SEQ ID NO: 7272187 - DNA, 22 bp, Homo sapiens
agtgttgcatgaggcagtacca

SEQ ID NO: 7272188 - DNA, 22 bp, Homo sapiens
agtgttcttcttcaaagctctg

SEQ ID NO: 7272189 - DNA, 22 bp, Homo sapiens
agtgtttaatgccttttccagc

SEQ ID NO: 7272190 - DNA, 22 bp, Homo sapiens
agtgtttaaactgaagtgatga

SEQ ID NO: 7272191 - DNA, 22 bp, Homo sapiens
aagcacagtgggcagagcagcc

SEQ ID NO: 7272192 - DNA, 22 bp, Homo sapiens
aagcacagtaaaagcagatttt

SEQ ID NO: 7272193 - DNA, 22 bp, Homo sapiens
aagcacagaaaaggagcatgga

SEQ ID NO: 7272194 - DNA, 22 bp, Homo sapiens
aagcacaggagacgcacagcca

SEQ ID NO: 7272195 - DNA, 22 bp, Homo sapiens
aagcacagggactcaggaccgg

SEQ ID NO: 7272196 - DNA, 22 bp, Homo sapiens
acagcagctaaaggtgtctcct

SEQ ID NO: 7272197 - DNA, 22 bp, Homo sapiens
acagcagcttgtctgttcttta

SEQ ID NO: 7272198 - DNA, 22 bp, Homo sapiens
acagcagctgccttcaggctct

SEQ ID NO: 7272199 - DNA, 22 bp, Homo sapiens
aagcagagtccccttcccatgg

SEQ ID NO: 7272200 - DNA, 22 bp, Homo sapiens
acagaattgaaagtataatctg

SEQ ID NO: 7272201 - DNA, 22 bp, Homo sapiens
acagaggttaggatgggttgta

SEQ ID NO: 7272202 - DNA, 22 bp, Homo sapiens
aagcagcctggcatgatgcttt

SEQ ID NO: 7272203 - DNA, 19 bp, Homo sapiens
aagcagccctggcaagagc

SEQ ID NO: 7272204 - DNA, 22 bp, Homo sapiens
aagaataagaggatttagaaca

SEQ ID NO: 7272205 - DNA, 22 bp, Homo sapiens
aagaataaattaagatacttag

SEQ ID NO: 7272206 - DNA, 21 bp, Homo sapiens
aagaaagataattaaggaccc

SEQ ID NO: 7272207 - DNA, 22 bp, Homo sapiens
aacttatacccagggcagaaat

SEQ ID NO: 7272208 - DNA, 22 bp, Homo sapiens
aagaaagcattagacaggcatt

SEQ ID NO: 7272209 - DNA, 22 bp, Homo sapiens
aatgttttatagctcaagcaat

SEQ ID NO: 7272210 - DNA, 22 bp, Homo sapiens
aatgttttctctgtgaacacat

SEQ ID NO: 7272211 - DNA, 22 bp, Homo sapiens
aagaagcactttcctacatgtt

SEQ ID NO: 7272212 - DNA, 22 bp, Homo sapiens
aatgttttgcattagttttcta

SEQ ID NO: 7272213 - DNA, 22 bp, Homo sapiens
aatgttttagattactgctggg

SEQ ID NO: 7272214 - DNA, 22 bp, Homo sapiens
aagaaatgcacacaactgctgg

SEQ ID NO: 7272215 - DNA, 22 bp, Homo sapiens
aagagatgaaggtcctgactgt

SEQ ID NO: 7272216 - DNA, 22 bp, Homo sapiens
aagagaggggttgcatggaaat

SEQ ID NO: 7272217 - DNA, 22 bp, Homo sapiens
aagagagggacttattaaagtc

SEQ ID NO: 7272218 - DNA, 17 bp, Homo sapiens
aagagaggctgagctgg

SEQ ID NO: 7272219 - DNA, 22 bp, Homo sapiens
aagagaggacatggtgaacctg

SEQ ID NO: 7272220 - DNA, 22 bp, Homo sapiens
acaaagagggaccagtgacttg

SEQ ID NO: 7272221 - DNA, 22 bp, Homo sapiens
aagagagaacacagcttgggca

SEQ ID NO: 7272222 - DNA, 22 bp, Homo sapiens
acaaagctagagaagagaattg

SEQ ID NO: 7272223 - DNA, 22 bp, Homo sapiens
aagagctggattgtgctgcaga

SEQ ID NO: 7272224 - DNA, 22 bp, Homo sapiens
aagagcagtgttttactcagct

SEQ ID NO: 7272225 - DNA, 19 bp, Homo sapiens
aagagcagggaaagaattg

SEQ ID NO: 7272226 - DNA, 22 bp, Homo sapiens
acaaggctctaatttcattgaa

SEQ ID NO: 7272227 - DNA, 22 bp, Homo sapiens
acaaggctaatttggaagatac

SEQ ID NO: 7272228 - DNA, 23 bp, Homo sapiens
acaaggctctgttctgcagtttc

SEQ ID NO: 7272229 - DNA, 22 bp, Homo sapiens
acaaggctatgaagtattagtt

SEQ ID NO: 7272230 - DNA, 22 bp, Homo sapiens
acaaggctctggagaagcagaa

SEQ ID NO: 7272231 - DNA, 22 bp, Homo sapiens
acaaggctggctgggaaaaact

SEQ ID NO: 7272232 - DNA, 22 bp, Homo sapiens
acaaggctgaacagtgaagccg

SEQ ID NO: 7272233 - DNA, 22 bp, Homo sapiens
acaaggctgctgtgattgggaa

SEQ ID NO: 7272234 - DNA, 22 bp, Homo sapiens
acaaggctgtggggagaactga

SEQ ID NO: 7272235 - DNA, 19 bp, Homo sapiens
acaaggctgggagagcgcc

SEQ ID NO: 7272236 - DNA, 22 bp, Homo sapiens
acaaggctgtgggagaacctct

SEQ ID NO: 7272237 - DNA, 22 bp, Homo sapiens
aaatgtgatactgttcttttta

SEQ ID NO: 7272238 - DNA, 22 bp, Homo sapiens
aagctgaggatacatgaagcct

SEQ ID NO: 7272239 - DNA, 22 bp, Homo sapiens
aagctgagccagtggcaagtgc

SEQ ID NO: 7272240 - DNA, 22 bp, Homo sapiens
aagctgaggctcccctgaggga

SEQ ID NO: 7272241 - DNA, 22 bp, Homo sapiens
aagctgaggcccatggcaaggt

SEQ ID NO: 7272242 - DNA, 22 bp, Homo sapiens
aagctgaggtcaagtagctagt

SEQ ID NO: 7272243 - DNA, 22 bp, Homo sapiens
aaatgtgttcctttgctacaga

SEQ ID NO: 7272244 - DNA, 22 bp, Homo sapiens
aaatgtttctacttgtgagcat

SEQ ID NO: 7272245 - DNA, 22 bp, Homo sapiens
aaatgttttgctcccatgtggt

SEQ ID NO: 7272246 - DNA, 22 bp, Homo sapiens
aaggtatttagtgtgaaagcta

SEQ ID NO: 7272247 - DNA, 23 bp, Homo sapiens
aaggtatttattttaaaggtaag

SEQ ID NO: 7272248 - DNA, 22 bp, Homo sapiens
aacaaatgacctgatttcttcc

SEQ ID NO: 7272249 - DNA, 22 bp, Homo sapiens
aagtccaaggctgggtgcagtg

SEQ ID NO: 7272250 - DNA, 22 bp, Homo sapiens
aacaggcaacagttgactctga

SEQ ID NO: 7272251 - DNA, 22 bp, Homo sapiens
aacagtaaagacagaatttatc

SEQ ID NO: 7272252 - DNA, 22 bp, Homo sapiens
aaccaccattctctcctcttcc

SEQ ID NO: 7272253 - DNA, 22 bp, Homo sapiens
aatataatgctgttttatgcca

SEQ ID NO: 7272254 - DNA, 20 bp, Homo sapiens
aatataattctctgaattta

SEQ ID NO: 7272255 - DNA, 22 bp, Homo sapiens
aacggctgtggctggcggcagc

SEQ ID NO: 7272256 - DNA, 21 bp, Homo sapiens
aatcatacaaaacatgtcagg

SEQ ID NO: 7272257 - DNA, 22 bp, Homo sapiens
aatcattcttatttcacagcaa

SEQ ID NO: 7272258 - DNA, 19 bp, Homo sapiens
aactgtaaagatctgtagc

SEQ ID NO: 7272259 - DNA, 22 bp, Homo sapiens
aactgttacatagttatagatc

SEQ ID NO: 7272260 - DNA, 23 bp, Homo sapiens
aacttaatactgggataagatgc

SEQ ID NO: 7272261 - DNA, 22 bp, Homo sapiens
aacttaaacccactcatgtaga

SEQ ID NO: 7272262 - DNA, 22 bp, Homo sapiens
aactgcttatctttggtagatg

SEQ ID NO: 7272263 - DNA, 22 bp, Homo sapiens
aactgcttcttactgctgggca

SEQ ID NO: 7272264 - DNA, 22 bp, Homo sapiens
aatgatatgcaaattatcatca

SEQ ID NO: 7272265 - DNA, 22 bp, Homo sapiens
aaaccgcaattacttttgcgtc

SEQ ID NO: 7272266 - DNA, 22 bp, Homo sapiens
aaacctttaccagactagcaag

SEQ ID NO: 7272267 - DNA, 22 bp, Homo sapiens
aaacaatgttgtctccaagagg

SEQ ID NO: 7272268 - DNA, 22 bp, Homo sapiens
aaacaatgttgctgggtgcggt

SEQ ID NO: 7272269 - DNA, 22 bp, Homo sapiens
aaacaatttccacctctcctga

SEQ ID NO: 7272270 - DNA, 22 bp, Homo sapiens
aaacaatgtctaaggtgcacag

SEQ ID NO: 7272271 - DNA, 23 bp, Homo sapiens
aaacaatgtcatcaggacttggt

SEQ ID NO: 7272272 - DNA, 22 bp, Homo sapiens
aaacaatgtagattaccattta

SEQ ID NO: 7272273 - DNA, 22 bp, Homo sapiens
aaacaatgttcctatattagag

SEQ ID NO: 7272274 - DNA, 22 bp, Homo sapiens
aaacaatgtacacatgaatgtt

SEQ ID NO: 7272275 - DNA, 22 bp, Homo sapiens
aaacaatgtacatttataatgc

SEQ ID NO: 7272276 - DNA, 17 bp, Homo sapiens
aaacaatgcagacaagc

SEQ ID NO: 7272277 - DNA, 22 bp, Homo sapiens
aaacaatgagcttttacacact

SEQ ID NO: 7272278 - DNA, 22 bp, Homo sapiens
aaacaatgacaacacagctgcg

SEQ ID NO: 7272279 - DNA, 21 bp, Homo sapiens
aaactgaagagacaggaactt

SEQ ID NO: 7272280 - DNA, 17 bp, Homo sapiens
aaactgaaaaattcact

SEQ ID NO: 7272281 - DNA, 22 bp, Homo sapiens
aaactcttcatatacatatgct

SEQ ID NO: 7272282 - DNA, 22 bp, Homo sapiens
aaagaggcaatcaatgtagcaa

SEQ ID NO: 7272283 - DNA, 22 bp, Homo sapiens
aaaaatctatgactgcttctcc

SEQ ID NO: 7272284 - DNA, 23 bp, Homo sapiens
aaaatcttctgcctatgaagaaa

SEQ ID NO: 7272285 - DNA, 22 bp, Homo sapiens
aaaatcttgtgacttaggaagg

SEQ ID NO: 7272286 - DNA, 22 bp, Homo sapiens
aaaagtatagggtttggagtca

SEQ ID NO: 7272287 - DNA, 22 bp, Homo sapiens
aaacaagtcactttatcttgaa

SEQ ID NO: 7272288 - DNA, 22 bp, Homo sapiens
aaacaatccaggaacctgttta

SEQ ID NO: 7272289 - DNA, 22 bp, Homo sapiens
aaacaatgaaattcattcttca

SEQ ID NO: 7272290 - DNA, 22 bp, Homo sapiens
aaacaatgaaatatttttatgg

SEQ ID NO: 7272291 - DNA, 22 bp, Homo sapiens
aaatgtattgcataggatattt

SEQ ID NO: 7272292 - DNA, 19 bp, Homo sapiens
aagcatggtgcctcacctc

SEQ ID NO: 7272293 - DNA, 22 bp, Homo sapiens
aaatgcacaggttttaaatcct

SEQ ID NO: 7272294 - DNA, 22 bp, Homo sapiens
aagcacagataaaacaggattc

SEQ ID NO: 7272295 - DNA, 22 bp, Homo sapiens
aaatcccactcagaaactgcca

SEQ ID NO: 7272296 - DNA, 22 bp, Homo sapiens
aaataattatagcgagtctatc

SEQ ID NO: 7272297 - DNA, 22 bp, Homo sapiens
aaataagttaaactagaatgat

SEQ ID NO: 7272298 - DNA, 22 bp, Homo sapiens
aaataagttaaactagaatgat

SEQ ID NO: 7272299 - DNA, 22 bp, Homo sapiens
aaataagtagtttagtgttgtg

SEQ ID NO: 7272300 - DNA, 22 bp, Homo sapiens
aaagtattcaaaaatatttggt

SEQ ID NO: 7272301 - DNA, 22 bp, Homo sapiens
aaagtattcttgactgtttttc

SEQ ID NO: 7272302 - DNA, 22 bp, Homo sapiens
aaagtatttgtgatttttacca

SEQ ID NO: 7272303 - DNA, 22 bp, Homo sapiens
aaagctcttggattttagactc

SEQ ID NO: 7272304 - DNA, 22 bp, Homo sapiens
aaagccatgaatgttatagagg

SEQ ID NO: 7272305 - DNA, 22 bp, Homo sapiens
aaagccatgggtctttggcata

SEQ ID NO: 7272306 - DNA, 22 bp, Homo sapiens
aaagctgctgccaatcaggctt

SEQ ID NO: 7272307 - DNA, 22 bp, Homo sapiens
aaattttagtaaggaagttgag

SEQ ID NO: 7272308 - DNA, 22 bp, Homo sapiens
aaagataatgtttccttattct

SEQ ID NO: 7272309 - DNA, 22 bp, Homo sapiens
aaagataatgtttccttattct

SEQ ID NO: 7272310 - DNA, 22 bp, Homo sapiens
aaagatcacgtcccaggactcg

SEQ ID NO: 7272311 - DNA, 22 bp, Homo sapiens
aattttattagaaggcaagggg

SEQ ID NO: 7272312 - DNA, 22 bp, Homo sapiens
aattttattaactggatgtagc

SEQ ID NO: 7272313 - DNA, 22 bp, Homo sapiens
aattttcacagtgctgtgagat

SEQ ID NO: 7272314 - DNA, 21 bp, Homo sapiens
agaggccctcggactgggcgt

SEQ ID NO: 7272315 - DNA, 22 bp, Homo sapiens
acaaatatggtactcggagaaa

SEQ ID NO: 7272316 - DNA, 19 bp, Homo sapiens
acaaatgatgttgcactga

SEQ ID NO: 7272317 - DNA, 22 bp, Homo sapiens
acaaacagagttgaaaaatagg

SEQ ID NO: 7272318 - DNA, 22 bp, Homo sapiens
acaaatggactctcatcttttg

SEQ ID NO: 7272319 - DNA, 22 bp, Homo sapiens
acaaatggaacaatgaagactg

SEQ ID NO: 7272320 - DNA, 22 bp, Homo sapiens
acaaatgtggacatggataatg

SEQ ID NO: 7272321 - DNA, 22 bp, Homo sapiens
acaaatgtctcctcttttgtta

SEQ ID NO: 7272322 - DNA, 22 bp, Homo sapiens
acaaggctttggagggttctta

SEQ ID NO: 7272323 - DNA, 22 bp, Homo sapiens
acaaatgtgtctaattgtgcct

SEQ ID NO: 7272324 - DNA, 22 bp, Homo sapiens
acaagttaccaaaaaagattca

SEQ ID NO: 7272325 - DNA, 22 bp, Homo sapiens
acaattctctcatatcttatta

SEQ ID NO: 7272326 - DNA, 22 bp, Homo sapiens
acaatgttttgaaacatctagg

SEQ ID NO: 7272327 - DNA, 22 bp, Homo sapiens
acaatgtttttgttcaaagagt

SEQ ID NO: 7272328 - DNA, 22 bp, Homo sapiens
agcacaggtacggagatgctac

SEQ ID NO: 7272329 - DNA, 22 bp, Homo sapiens
agcacaggtacggagatgctac

SEQ ID NO: 7272330 - DNA, 21 bp, Homo sapiens
agcaaggcagcctctcagcct

SEQ ID NO: 7272331 - DNA, 22 bp, Homo sapiens
agcaaggaaactatggagagat

SEQ ID NO: 7272332 - DNA, 23 bp, Homo sapiens
agaaggtgggcctgctgagttat

SEQ ID NO: 7272333 - DNA, 22 bp, Homo sapiens
agaaggggagaagctaccagga

SEQ ID NO: 7272334 - DNA, 22 bp, Homo sapiens
agacaggccactctggtctggt

SEQ ID NO: 7272335 - DNA, 22 bp, Homo sapiens
agacaggctgctgtctgctagg

SEQ ID NO: 7272336 - DNA, 19 bp, Homo sapiens
agacagagctcagtgggtt

SEQ ID NO: 7272337 - DNA, 22 bp, Homo sapiens
agacagagatactatgttgtca

SEQ ID NO: 7272338 - DNA, 22 bp, Homo sapiens
aatgcaatgcagcacctccttg

SEQ ID NO: 7272339 - DNA, 22 bp, Homo sapiens
aatgtattctctttataagata

SEQ ID NO: 7272340 - DNA, 22 bp, Homo sapiens
agacagggagggagcgcggctg

SEQ ID NO: 7272341 - DNA, 22 bp, Homo sapiens
aatgttgttggctcttcatgat

SEQ ID NO: 7272342 - DNA, 22 bp, Homo sapiens
aattatattgtggtgtgaatgt

SEQ ID NO: 7272343 - DNA, 22 bp, Homo sapiens
aattggaaaaagacttaattgc

SEQ ID NO: 7272344 - DNA, 22 bp, Homo sapiens
aattatatgttaatcttcaatt

SEQ ID NO: 7272345 - DNA, 22 bp, Homo sapiens
acacatttctctttttgtaagt

SEQ ID NO: 7272346 - DNA, 22 bp, Homo sapiens
acagaaattgggcaaatggaag

SEQ ID NO: 7272347 - DNA, 22 bp, Homo sapiens
agccacaggccatgagatacca

SEQ ID NO: 7272348 - DNA, 22 bp, Homo sapiens
agcagttacgggcctatctagg

SEQ ID NO: 7272349 - DNA, 22 bp, Homo sapiens
agcagtgttttgattctgggag

SEQ ID NO: 7272350 - DNA, 22 bp, Homo sapiens
agcagtgttggtgggagcatct

SEQ ID NO: 7272351 - DNA, 20 bp, Homo sapiens
agcagtgtttcttgactcta

SEQ ID NO: 7272352 - DNA, 22 bp, Homo sapiens
agcagtgttctaatctggctag

SEQ ID NO: 7272353 - DNA, 20 bp, Homo sapiens
agcagtgtggggagactgtg

SEQ ID NO: 7272354 - DNA, 22 bp, Homo sapiens
agcagtgtgcttcgtttcatga

SEQ ID NO: 7272355 - DNA, 22 bp, Homo sapiens
acaattctgggtatttatatag

SEQ ID NO: 7272356 - DNA, 22 bp, Homo sapiens
agcacctgcctgcattggctat

SEQ ID NO: 7272357 - DNA, 22 bp, Homo sapiens
acaatttatccattgtatagtt

SEQ ID NO: 7272358 - DNA, 20 bp, Homo sapiens
acaatttcctcactatatgc

SEQ ID NO: 7272359 - DNA, 22 bp, Homo sapiens
agcaccctggggaagcacaaag

SEQ ID NO: 7272360 - DNA, 22 bp, Homo sapiens
acacatatatttgcatatacac

SEQ ID NO: 7272361 - DNA, 22 bp, Homo sapiens
acacatatgtatgcatcatgtg

SEQ ID NO: 7272362 - DNA, 23 bp, Homo sapiens
agcagcagtgagaggtgtcttac

SEQ ID NO: 7272363 - DNA, 22 bp, Homo sapiens
agcagcagtgtggtttggggaa

SEQ ID NO: 7272364 - DNA, 22 bp, Homo sapiens
agcagcagtgacagccgaaagc

SEQ ID NO: 7272365 - DNA, 22 bp, Homo sapiens
agcagcagtcctttgtgtaatt

SEQ ID NO: 7272366 - DNA, 22 bp, Homo sapiens
agcagcagtgtgtggtcatgtt

SEQ ID NO: 7272367 - DNA, 22 bp, Homo sapiens
agcagcagtgttctggaattct

SEQ ID NO: 7272368 - DNA, 22 bp, Homo sapiens
acacaggcatagccatacatgt

SEQ ID NO: 7272369 - DNA, 22 bp, Homo sapiens
agcagcaggtgacctcgatgcc

SEQ ID NO: 7272370 - DNA, 22 bp, Homo sapiens
agcagcaggtgacctcgatgcc

SEQ ID NO: 7272371 - DNA, 22 bp, Homo sapiens
agcagcaggtgcttctggatct

SEQ ID NO: 7272372 - DNA, 22 bp, Homo sapiens
agcagcagtacatataagacta

SEQ ID NO: 7272373 - DNA, 22 bp, Homo sapiens
agcagcaggtgcttctggatct

SEQ ID NO: 7272374 - DNA, 22 bp, Homo sapiens
agcagcagtatccttccccggc

SEQ ID NO: 7272375 - DNA, 22 bp, Homo sapiens
agcagcagtcatgcctatgctc

SEQ ID NO: 7272376 - DNA, 22 bp, Homo sapiens
agccacagtcaacctgtccata

SEQ ID NO: 7272377 - DNA, 22 bp, Homo sapiens
agccacagtcaacctgtccata

SEQ ID NO: 7272378 - DNA, 22 bp, Homo sapiens
acagagcatataaagtgctttg

SEQ ID NO: 7272379 - DNA, 22 bp, Homo sapiens
agcctgagtgcttaggactgtt

SEQ ID NO: 7272380 - DNA, 22 bp, Homo sapiens
agcccctgctgggtgtagctca

SEQ ID NO: 7272381 - DNA, 22 bp, Homo sapiens
agctcaagcgtgggctgggcgc

SEQ ID NO: 7272382 - DNA, 22 bp, Homo sapiens
agctcaagagtagttcgagggg

SEQ ID NO: 7272383 - DNA, 22 bp, Homo sapiens
agctccttgaaggcagtagctg

SEQ ID NO: 7272384 - DNA, 22 bp, Homo sapiens
agctccttgaaggcagtagctg

SEQ ID NO: 7272385 - DNA, 22 bp, Homo sapiens
agctcctgttctgagagcagga

SEQ ID NO: 7272386 - DNA, 20 bp, Homo sapiens
agctcctttgtgtccaggat

SEQ ID NO: 7272387 - DNA, 22 bp, Homo sapiens
agctccttgaagggctctggga

SEQ ID NO: 7272388 - DNA, 22 bp, Homo sapiens
agctccttgcaggttgccttgg

SEQ ID NO: 7272389 - DNA, 23 bp, Homo sapiens
agctcctttgaaagtatgttttt

SEQ ID NO: 7272390 - DNA, 21 bp, Homo sapiens
acagcaagccttcacatgagt

SEQ ID NO: 7272391 - DNA, 17 bp, Homo sapiens
agcctgctgatctcaca

SEQ ID NO: 7272392 - DNA, 22 bp, Homo sapiens
acttgaattaggccttgagaga

SEQ ID NO: 7272393 - DNA, 22 bp, Homo sapiens
aatacaatcaaattcactagca

SEQ ID NO: 7272394 - DNA, 22 bp, Homo sapiens
aatatcaacagtgtccttctaa

SEQ ID NO: 7272395 - DNA, 22 bp, Homo sapiens
aatatatgtggtattgaccagc

SEQ ID NO: 7272396 - DNA, 22 bp, Homo sapiens
aatcataattgtatacattcat

SEQ ID NO: 7272397 - DNA, 22 bp, Homo sapiens
aatcataattgtatacattcat

SEQ ID NO: 7272398 - DNA, 22 bp, Homo sapiens
aatcccagctactcaggaagtt

SEQ ID NO: 7272399 - DNA, 22 bp, Homo sapiens
aatgacatggagcatcttttca

SEQ ID NO: 7272400 - DNA, 22 bp, Homo sapiens
aatgagatgttgaattattgtt

SEQ ID NO: 7272401 - DNA, 20 bp, Homo sapiens
aatgagattccttatgatag

SEQ ID NO: 7272402 - DNA, 22 bp, Homo sapiens
aatgagatggcaatgacttaaa

SEQ ID NO: 7272403 - DNA, 21 bp, Homo sapiens
agaagggattgtggtaaagat

SEQ ID NO: 7272404 - DNA, 22 bp, Homo sapiens
agaagggaactcagagatgatt

SEQ ID NO: 7272405 - DNA, 22 bp, Homo sapiens
aagtggaagagaagttatctta

SEQ ID NO: 7272406 - DNA, 22 bp, Homo sapiens
aagtcacagctaaatagctaag

SEQ ID NO: 7272407 - DNA, 22 bp, Homo sapiens
aagtcacagagttggaagtcag

SEQ ID NO: 7272408 - DNA, 22 bp, Homo sapiens
aagtcacattctgaggtattgg

SEQ ID NO: 7272409 - DNA, 22 bp, Homo sapiens
actccaggttttttcactgaag

SEQ ID NO: 7272410 - DNA, 22 bp, Homo sapiens
actccaggttttctctcaagtt

SEQ ID NO: 7272411 - DNA, 20 bp, Homo sapiens
actccaggtggcatgaggac

SEQ ID NO: 7272412 - DNA, 22 bp, Homo sapiens
aataattagtgggacagagaac

SEQ ID NO: 7272413 - DNA, 22 bp, Homo sapiens
aataattatttgagagcagacc

SEQ ID NO: 7272414 - DNA, 22 bp, Homo sapiens
aagtttatccctctcacagtta

SEQ ID NO: 7272415 - DNA, 22 bp, Homo sapiens
aagtttcaaatgttgattatgc

SEQ ID NO: 7272416 - DNA, 22 bp, Homo sapiens
aagtttcatgtggaggtagact

SEQ ID NO: 7272417 - DNA, 22 bp, Homo sapiens
aagtttcatgacttggttatta

SEQ ID NO: 7272418 - DNA, 22 bp, Homo sapiens
aataagaatttacttgtcaaga

SEQ ID NO: 7272419 - DNA, 22 bp, Homo sapiens
aataagatcctgaagatatgtt

SEQ ID NO: 7272420 - DNA, 22 bp, Homo sapiens
aagtcacaagcatatatgcatt

SEQ ID NO: 7272421 - DNA, 22 bp, Homo sapiens
aaggtagatgttgtcatgccca

SEQ ID NO: 7272422 - DNA, 22 bp, Homo sapiens
accatgccagtggcagccagac

SEQ ID NO: 7272423 - DNA, 22 bp, Homo sapiens
accatgtcatttattggccaaa

SEQ ID NO: 7272424 - DNA, 22 bp, Homo sapiens
accatgtcatttattggccaaa

SEQ ID NO: 7272425 - DNA, 22 bp, Homo sapiens
accatcctgaaaccttcatgct

SEQ ID NO: 7272426 - DNA, 22 bp, Homo sapiens
aaggctgtttgagcactggagc

SEQ ID NO: 7272427 - DNA, 22 bp, Homo sapiens
aaggcttctttgcaggctttag

SEQ ID NO: 7272428 - DNA, 22 bp, Homo sapiens
aaggctgggaaacatgcaggcc

SEQ ID NO: 7272429 - DNA, 22 bp, Homo sapiens
aaggctggtttccttgatgttt

SEQ ID NO: 7272430 - DNA, 22 bp, Homo sapiens
acatgtgtggacatgaatctac

SEQ ID NO: 7272431 - DNA, 22 bp, Homo sapiens
acatgtgtctaagaatgaaaga

SEQ ID NO: 7272432 - DNA, 22 bp, Homo sapiens
aaggctgaggagggcctgcagg

SEQ ID NO: 7272433 - DNA, 22 bp, Homo sapiens
aaggctgaggcagtgaggcaga

SEQ ID NO: 7272434 - DNA, 22 bp, Homo sapiens
aaggctgaggctggagaattac

SEQ ID NO: 7272435 - DNA, 22 bp, Homo sapiens
aaggctgattagactgatagct

SEQ ID NO: 7272436 - DNA, 16 bp, Homo sapiens
aaggctgattttccct

SEQ ID NO: 7272437 - DNA, 22 bp, Homo sapiens
aaggctgagggctgtacctggc

SEQ ID NO: 7272438 - DNA, 22 bp, Homo sapiens
aaggctgaggtagggcctaaaa

SEQ ID NO: 7272439 - DNA, 22 bp, Homo sapiens
aaggctgagtaaaacagagaac

SEQ ID NO: 7272440 - DNA, 22 bp, Homo sapiens
aagggcaggaaaagatggatgt

SEQ ID NO: 7272441 - DNA, 22 bp, Homo sapiens
acagtacataatcctgagtctg

SEQ ID NO: 7272442 - DNA, 22 bp, Homo sapiens
acaggcagttgaggtttgtgtg

SEQ ID NO: 7272443 - DNA, 22 bp, Homo sapiens
acaggcaggtcctgtcccagct

SEQ ID NO: 7272444 - DNA, 22 bp, Homo sapiens
acaggcaggtcctgtcccagct

SEQ ID NO: 7272445 - DNA, 22 bp, Homo sapiens
aaggcagctttaaaaaagatgc

SEQ ID NO: 7272446 - DNA, 22 bp, Homo sapiens
aaggcagcttcaccacagcatt

SEQ ID NO: 7272447 - DNA, 22 bp, Homo sapiens
aaggcagggaaagtggattagg

SEQ ID NO: 7272448 - DNA, 22 bp, Homo sapiens
aaggcagccgtgtgactgcatg

SEQ ID NO: 7272449 - DNA, 22 bp, Homo sapiens
aaggcagcctctgccagccggg

SEQ ID NO: 7272450 - DNA, 22 bp, Homo sapiens
aaggcagctcagctcatggcag

SEQ ID NO: 7272451 - DNA, 22 bp, Homo sapiens
aaggcagcctttgtttgattga

SEQ ID NO: 7272452 - DNA, 22 bp, Homo sapiens
aaggcagccttttgagttgatt

SEQ ID NO: 7272453 - DNA, 18 bp, Homo sapiens
tcaggagacacagacgca

SEQ ID NO: 7272454 - DNA, 22 bp, Homo sapiens
tcaggagaatcagggctgtcct

SEQ ID NO: 7272455 - DNA, 22 bp, Homo sapiens
tcaggagacaaagggtgcggag

SEQ ID NO: 7272456 - DNA, 22 bp, Homo sapiens
tcaggagactggcagtgcccac

SEQ ID NO: 7272457 - DNA, 22 bp, Homo sapiens
tcaggagacattcttaaagtag

SEQ ID NO: 7272458 - DNA, 22 bp, Homo sapiens
tcaggagaaaatatcaggaagt

SEQ ID NO: 7272459 - DNA, 22 bp, Homo sapiens
tcaggagaaagccaattagagt

SEQ ID NO: 7272460 - DNA, 22 bp, Homo sapiens
tcaggagaaggcaatgtggaaa

SEQ ID NO: 7272461 - DNA, 22 bp, Homo sapiens
tcaggagaacttccttctaccc

SEQ ID NO: 7272462 - DNA, 22 bp, Homo sapiens
tcagcatgttcttaggtcacag

SEQ ID NO: 7272463 - DNA, 22 bp, Homo sapiens
tcagctctgcctgtggaggcac

SEQ ID NO: 7272464 - DNA, 22 bp, Homo sapiens
tcagcaaaggaccagcacaggc

SEQ ID NO: 7272465 - DNA, 17 bp, Homo sapiens
tcagcaaagacaaagga

SEQ ID NO: 7272466 - DNA, 22 bp, Homo sapiens
tcagatggtcattcactagggt

SEQ ID NO: 7272467 - DNA, 20 bp, Homo sapiens
tcagatgggagtgagccatc

SEQ ID NO: 7272468 - DNA, 22 bp, Homo sapiens
tcagatgggttttgaaggatgt

SEQ ID NO: 7272469 - DNA, 18 bp, Homo sapiens
tcagatttaactgtatcc

SEQ ID NO: 7272470 - DNA, 22 bp, Homo sapiens
tcagaattagagctcttcttga

SEQ ID NO: 7272471 - DNA, 22 bp, Homo sapiens
tcagaattaagctcttggtcag

SEQ ID NO: 7272472 - DNA, 23 bp, Homo sapiens
tcagaattccagtttctttgaag

SEQ ID NO: 7272473 - DNA, 19 bp, Homo sapiens
tcagaattctgtctcttga

SEQ ID NO: 7272474 - DNA, 22 bp, Homo sapiens
tcagacagaaagatgagtatgg

SEQ ID NO: 7272475 - DNA, 22 bp, Homo sapiens
tcagacacagatgagacaagga

SEQ ID NO: 7272476 - DNA, 22 bp, Homo sapiens
tcagaaaccagctctctcaatt

SEQ ID NO: 7272477 - DNA, 22 bp, Homo sapiens
tcagaaacactcttcttctgtc

SEQ ID NO: 7272478 - DNA, 22 bp, Homo sapiens
tcagaacaggttgtactatgtc

SEQ ID NO: 7272479 - DNA, 22 bp, Homo sapiens
tcactgcaacctccacctcctg

SEQ ID NO: 7272480 - DNA, 22 bp, Homo sapiens
tcactgcaacctccacctcctg

SEQ ID NO: 7272481 - DNA, 22 bp, Homo sapiens
tcactgcaacctccacctcctg

SEQ ID NO: 7272482 - DNA, 22 bp, Homo sapiens
tcactgcaacctccacctcctg

SEQ ID NO: 7272483 - DNA, 22 bp, Homo sapiens
tcactgcaacctccacctcccg

SEQ ID NO: 7272484 - DNA, 22 bp, Homo sapiens
tcactgcaacctccacctcccg

SEQ ID NO: 7272485 - DNA, 22 bp, Homo sapiens
tcacattttatctattttaagt

SEQ ID NO: 7272486 - DNA, 22 bp, Homo sapiens
tcacattttatctattttaagt

SEQ ID NO: 7272487 - DNA, 22 bp, Homo sapiens
tcactgcaacctccacctcccg

SEQ ID NO: 7272488 - DNA, 22 bp, Homo sapiens
tcactgcaacctccacctcccg

SEQ ID NO: 7272489 - DNA, 22 bp, Homo sapiens
tcacatttgcaattgcattgtt

SEQ ID NO: 7272490 - DNA, 22 bp, Homo sapiens
tcacatttgtgttttattagag

SEQ ID NO: 7272491 - DNA, 22 bp, Homo sapiens
tcacatttgtgttttattagag

SEQ ID NO: 7272492 - DNA, 22 bp, Homo sapiens
tcacatttgttcttgaatctaa

SEQ ID NO: 7272493 - DNA, 22 bp, Homo sapiens
tcacatttatttcaaagttact

SEQ ID NO: 7272494 - DNA, 22 bp, Homo sapiens
tcacatttctttatgtagtctt

SEQ ID NO: 7272495 - DNA, 22 bp, Homo sapiens
tcacagtgcacccctcacaggg

SEQ ID NO: 7272496 - DNA, 22 bp, Homo sapiens
tcatttgttcatctgctcttct

SEQ ID NO: 7272497 - DNA, 22 bp, Homo sapiens
tcatttttttccggtaggaata

SEQ ID NO: 7272498 - DNA, 22 bp, Homo sapiens
tccaaacaccctccatgctgca

SEQ ID NO: 7272499 - DNA, 22 bp, Homo sapiens
tccaaagaacattgctgagacc

SEQ ID NO: 7272500 - DNA, 22 bp, Homo sapiens
tccaaagaacctggctactgtc

SEQ ID NO: 7272501 - DNA, 22 bp, Homo sapiens
tccaaagacttgctgtatgtaa

SEQ ID NO: 7272502 - DNA, 23 bp, Homo sapiens
tccaaatacctgtcaccttgtct

SEQ ID NO: 7272503 - DNA, 22 bp, Homo sapiens
tccaaatagctggatgatggtg

SEQ ID NO: 7272504 - DNA, 22 bp, Homo sapiens
tccaaataccagatgggctaat

SEQ ID NO: 7272505 - DNA, 22 bp, Homo sapiens
tccaaatataggatgtgatata

SEQ ID NO: 7272506 - DNA, 22 bp, Homo sapiens
tccaaatatagatgagttgtaa

SEQ ID NO: 7272507 - DNA, 22 bp, Homo sapiens
tccaaatatacagaatctcctc

SEQ ID NO: 7272508 - DNA, 22 bp, Homo sapiens
tccaaatagttctggaagactg

SEQ ID NO: 7272509 - DNA, 22 bp, Homo sapiens
tccaaatacatttactgtattt

SEQ ID NO: 7272510 - DNA, 22 bp, Homo sapiens
tccaactttctcctccggcttg

SEQ ID NO: 7272511 - DNA, 22 bp, Homo sapiens
tccaaatattcggtctttctga

SEQ ID NO: 7272512 - DNA, 22 bp, Homo sapiens
tccaaatattatgattatagga

SEQ ID NO: 7272513 - DNA, 22 bp, Homo sapiens
tccaaatatcttggtggttagg

SEQ ID NO: 7272514 - DNA, 22 bp, Homo sapiens
tccaaatatattcacgtcctag

SEQ ID NO: 7272515 - DNA, 22 bp, Homo sapiens
tccaaatattcatctacttctg

SEQ ID NO: 7272516 - DNA, 22 bp, Homo sapiens
tccaagcttgctttagccacag

SEQ ID NO: 7272517 - DNA, 23 bp, Homo sapiens
tccaaggttgttgtggaaggggc

SEQ ID NO: 7272518 - DNA, 22 bp, Homo sapiens
tcatttaataatttttgagtag

SEQ ID NO: 7272519 - DNA, 22 bp, Homo sapiens
tcattgccatggcatttgcaga

SEQ ID NO: 7272520 - DNA, 22 bp, Homo sapiens
tcatttcagtggcacagaagat

SEQ ID NO: 7272521 - DNA, 22 bp, Homo sapiens
tcatttccctcctacaaagagg

SEQ ID NO: 7272522 - DNA, 22 bp, Homo sapiens
tcatttctattgctactgtctg

SEQ ID NO: 7272523 - DNA, 22 bp, Homo sapiens
tcatttctgagccttccatgat

SEQ ID NO: 7272524 - DNA, 22 bp, Homo sapiens
tcagtacagcttagtcttctca

SEQ ID NO: 7272525 - DNA, 21 bp, Homo sapiens
tcaggagagcccatctacaaa

SEQ ID NO: 7272526 - DNA, 22 bp, Homo sapiens
tcaggagagagttgggtaggct

SEQ ID NO: 7272527 - DNA, 22 bp, Homo sapiens
tcaggagagagaaattggggct

SEQ ID NO: 7272528 - DNA, 22 bp, Homo sapiens
tcaggagacttatgtcacagtg

SEQ ID NO: 7272529 - DNA, 22 bp, Homo sapiens
tcaggagagaaagaatacaatt

SEQ ID NO: 7272530 - DNA, 22 bp, Homo sapiens
tcaggagagtgttcagtggagg

SEQ ID NO: 7272531 - DNA, 17 bp, Homo sapiens
tcaggctgggtgcagtg

SEQ ID NO: 7272532 - DNA, 22 bp, Homo sapiens
tcaggctggtccccacagtgga

SEQ ID NO: 7272533 - DNA, 20 bp, Homo sapiens
tcaggctggtgggctttccc

SEQ ID NO: 7272534 - DNA, 22 bp, Homo sapiens
tcaggctggtggtcagatggct

SEQ ID NO: 7272535 - DNA, 22 bp, Homo sapiens
tcaggctgtaaatggtgtgggt

SEQ ID NO: 7272536 - DNA, 22 bp, Homo sapiens
tcaggctgtagggcccctggag

SEQ ID NO: 7272537 - DNA, 22 bp, Homo sapiens
tcaggctgttagccacctcctc

SEQ ID NO: 7272538 - DNA, 22 bp, Homo sapiens
tcaggctgttcctgtccaaaat

SEQ ID NO: 7272539 - DNA, 22 bp, Homo sapiens
tcatcttctattaatagggaga

SEQ ID NO: 7272540 - DNA, 22 bp, Homo sapiens
tcatgaaaatagatcagaaatt

SEQ ID NO: 7272541 - DNA, 22 bp, Homo sapiens
tcatctttaccccttgcttcaa

SEQ ID NO: 7272542 - DNA, 22 bp, Homo sapiens
tcatacattcagcagatatttg

SEQ ID NO: 7272543 - DNA, 22 bp, Homo sapiens
tcatacatcttgtatatctatc

SEQ ID NO: 7272544 - DNA, 22 bp, Homo sapiens
tcatacatctgtcctggagctc

SEQ ID NO: 7272545 - DNA, 18 bp, Homo sapiens
tcatagaagtgaatcaga

SEQ ID NO: 7272546 - DNA, 22 bp, Homo sapiens
tcagtgtttcctagagcatata

SEQ ID NO: 7272547 - DNA, 22 bp, Homo sapiens
tcagtgtttcctgtggtacagc

SEQ ID NO: 7272548 - DNA, 22 bp, Homo sapiens
tcagtgtttcctgtggtacagc

SEQ ID NO: 7272549 - DNA, 22 bp, Homo sapiens
tcagtgtttggtttcagaattg

SEQ ID NO: 7272550 - DNA, 22 bp, Homo sapiens
tcagtgtttgaacccagggtta

SEQ ID NO: 7272551 - DNA, 22 bp, Homo sapiens
tcagtgttttaactgtctttta

SEQ ID NO: 7272552 - DNA, 22 bp, Homo sapiens
tcagtgtttgtggcaaatgtta

SEQ ID NO: 7272553 - DNA, 22 bp, Homo sapiens
tcagtgttttaactgtctttta

SEQ ID NO: 7272554 - DNA, 22 bp, Homo sapiens
tcagtgttttccagggtctact

SEQ ID NO: 7272555 - DNA, 22 bp, Homo sapiens
tcagtgttttccagggtctact

SEQ ID NO: 7272556 - DNA, 22 bp, Homo sapiens
tcagtgtttttaaagcaatata

SEQ ID NO: 7272557 - DNA, 22 bp, Homo sapiens
tcagtgttcttatttaattagg

SEQ ID NO: 7272558 - DNA, 22 bp, Homo sapiens
tcagtgttctggatttggggca

SEQ ID NO: 7272559 - DNA, 22 bp, Homo sapiens
tcagtgttgaattttttgcaaa

SEQ ID NO: 7272560 - DNA, 22 bp, Homo sapiens
tcagtgttggcattcagaaatg

SEQ ID NO: 7272561 - DNA, 22 bp, Homo sapiens
tcagtgttggagataattgcac

SEQ ID NO: 7272562 - DNA, 22 bp, Homo sapiens
tcagtgtttattcaatgttatt

SEQ ID NO: 7272563 - DNA, 22 bp, Homo sapiens
tcagtgtttaccgtatgttgtt

SEQ ID NO: 7272564 - DNA, 22 bp, Homo sapiens
tcagtgtttattgcggtgtgta

SEQ ID NO: 7272565 - DNA, 22 bp, Homo sapiens
tcagtgtttcagtttggaaatg

SEQ ID NO: 7272566 - DNA, 22 bp, Homo sapiens
tcagtgttggtcaagaatcagt

SEQ ID NO: 7272567 - DNA, 22 bp, Homo sapiens
tcagtgttggctacatctgcct

SEQ ID NO: 7272568 - DNA, 22 bp, Homo sapiens
tcagtgtttacatgcatccttg

SEQ ID NO: 7272569 - DNA, 22 bp, Homo sapiens
tcagtgttgtgcacatacaaaa

SEQ ID NO: 7272570 - DNA, 22 bp, Homo sapiens
tccatgtgttttcctgtccaca

SEQ ID NO: 7272571 - DNA, 22 bp, Homo sapiens
tcccagccggtgcctgggtccc

SEQ ID NO: 7272572 - DNA, 23 bp, Homo sapiens
tcccagcctcttctcttgcatac

SEQ ID NO: 7272573 - DNA, 22 bp, Homo sapiens
tcccagcctcctgacagttttg

SEQ ID NO: 7272574 - DNA, 23 bp, Homo sapiens
tcccagcctcttctcttgcatac

SEQ ID NO: 7272575 - DNA, 22 bp, Homo sapiens
tcccagccggtgcctgggtccc

SEQ ID NO: 7272576 - DNA, 22 bp, Homo sapiens
tcccagcccaggtatgatgata

SEQ ID NO: 7272577 - DNA, 22 bp, Homo sapiens
tcccagccttccttgtggtgaa

SEQ ID NO: 7272578 - DNA, 22 bp, Homo sapiens
tcccagcctttctttctccagc

SEQ ID NO: 7272579 - DNA, 22 bp, Homo sapiens
tcccagcctttctttctccagc

SEQ ID NO: 7272580 - DNA, 22 bp, Homo sapiens
tcccagcctggaccctgccagt

SEQ ID NO: 7272581 - DNA, 22 bp, Homo sapiens
tcccagcctgacagtgcatcaa

SEQ ID NO: 7272582 - DNA, 22 bp, Homo sapiens
tcccagccttccagtctggttt

SEQ ID NO: 7272583 - DNA, 22 bp, Homo sapiens
tcccagccttatctcccctggc

SEQ ID NO: 7272584 - DNA, 22 bp, Homo sapiens
tccaggctggagtgcagtggcg

SEQ ID NO: 7272585 - DNA, 22 bp, Homo sapiens
tccaggctggagtgcagtggca

SEQ ID NO: 7272586 - DNA, 22 bp, Homo sapiens
tccaggctagagtgcagtggcc

SEQ ID NO: 7272587 - DNA, 22 bp, Homo sapiens
tccaggctagaagtcacaggcc

SEQ ID NO: 7272588 - DNA, 22 bp, Homo sapiens
tccagtatgactgatgtccttc

SEQ ID NO: 7272589 - DNA, 22 bp, Homo sapiens
tccaggtgtatttactgaagta

SEQ ID NO: 7272590 - DNA, 19 bp, Homo sapiens
tccaggtggagagacaccc

SEQ ID NO: 7272591 - DNA, 22 bp, Homo sapiens
tcccaggctaggcctctgcgtt

SEQ ID NO: 7272592 - DNA, 20 bp, Homo sapiens
tccctccctccagctctggg

SEQ ID NO: 7272593 - DNA, 18 bp, Homo sapiens
tccctccctgctgtggcc

SEQ ID NO: 7272594 - DNA, 19 bp, Homo sapiens
tccctccctgtaatctcac

SEQ ID NO: 7272595 - DNA, 22 bp, Homo sapiens
tccctctgtgttgggcatgcct

SEQ ID NO: 7272596 - DNA, 22 bp, Homo sapiens
tccctgaaacataatagatgcc

SEQ ID NO: 7272597 - DNA, 22 bp, Homo sapiens
tccctccccacttctgagcttt

SEQ ID NO: 7272598 - DNA, 22 bp, Homo sapiens
tccctccccacttctgagcttt

SEQ ID NO: 7272599 - DNA, 22 bp, Homo sapiens
tccctggctgggggctgccttg

SEQ ID NO: 7272600 - DNA, 22 bp, Homo sapiens
tcctcagaatggatggcagggg

SEQ ID NO: 7272601 - DNA, 22 bp, Homo sapiens
tcctcagaatcacctggcagct

SEQ ID NO: 7272602 - DNA, 22 bp, Homo sapiens
tcctcagaatcacctggcagct

SEQ ID NO: 7272603 - DNA, 22 bp, Homo sapiens
tcctcacatggtgagccacaca

SEQ ID NO: 7272604 - DNA, 22 bp, Homo sapiens
tcctcacagggcaggaaggagg

SEQ ID NO: 7272605 - DNA, 22 bp, Homo sapiens
tcctcacagtcaacactttgag

SEQ ID NO: 7272606 - DNA, 22 bp, Homo sapiens
tcctcacacccataccactgac

SEQ ID NO: 7272607 - DNA, 22 bp, Homo sapiens
tcctcacaagcatcctgtctca

SEQ ID NO: 7272608 - DNA, 22 bp, Homo sapiens
tcctcacactatagatgaggat

SEQ ID NO: 7272609 - DNA, 22 bp, Homo sapiens
tcctcacagagtggcaggcaat

SEQ ID NO: 7272610 - DNA, 22 bp, Homo sapiens
tcctcacagatgggtgcatagc

SEQ ID NO: 7272611 - DNA, 22 bp, Homo sapiens
tcctcacagcatgaccaggcag

SEQ ID NO: 7272612 - DNA, 22 bp, Homo sapiens
tcctcacagctggttcattcag

SEQ ID NO: 7272613 - DNA, 22 bp, Homo sapiens
tcctcacaagcaagcacaggta

SEQ ID NO: 7272614 - DNA, 22 bp, Homo sapiens
tcctcagatataaatgagggtg

SEQ ID NO: 7272615 - DNA, 22 bp, Homo sapiens
tcctcagacaccctgctggctt

SEQ ID NO: 7272616 - DNA, 22 bp, Homo sapiens
tcctcagcaaacacttcactct

SEQ ID NO: 7272617 - DNA, 22 bp, Homo sapiens
tcctcaggtcaaagcaggagaa

SEQ ID NO: 7272618 - DNA, 22 bp, Homo sapiens
tcctgcagctgcagacctgggg

SEQ ID NO: 7272619 - DNA, 22 bp, Homo sapiens
tcctgcagctgaagctcatgtg

SEQ ID NO: 7272620 - DNA, 22 bp, Homo sapiens
tcctgcagctctgagaagcatc

SEQ ID NO: 7272621 - DNA, 18 bp, Homo sapiens
tcctgcagcttctatgta

SEQ ID NO: 7272622 - DNA, 22 bp, Homo sapiens
tcctgcaggcttgagtcctcag

SEQ ID NO: 7272623 - DNA, 22 bp, Homo sapiens
tcctgcaggcctgttcccagta

SEQ ID NO: 7272624 - DNA, 22 bp, Homo sapiens
tcctgcaggtggatgattctct

SEQ ID NO: 7272625 - DNA, 20 bp, Homo sapiens
tcctgcagtcgctagcgccc

SEQ ID NO: 7272626 - DNA, 22 bp, Homo sapiens
tcctgcagagccgccctcaggt

SEQ ID NO: 7272627 - DNA, 22 bp, Homo sapiens
tcctgcagagtcccactgattt

SEQ ID NO: 7272628 - DNA, 23 bp, Homo sapiens
tcctgcagataagctggttgaca

SEQ ID NO: 7272629 - DNA, 22 bp, Homo sapiens
tcctgcagatcaaagcctttga

SEQ ID NO: 7272630 - DNA, 22 bp, Homo sapiens
tcctgcagccattagaggtcaa

SEQ ID NO: 7272631 - DNA, 22 bp, Homo sapiens
tcctgattaggtttccatagct

SEQ ID NO: 7272632 - DNA, 19 bp, Homo sapiens
tcctgcagaccagacctgt

SEQ ID NO: 7272633 - DNA, 22 bp, Homo sapiens
tcctgcagagacagaggcctca

SEQ ID NO: 7272634 - DNA, 22 bp, Homo sapiens
tcctgcagacctcagtcaggtc

SEQ ID NO: 7272635 - DNA, 22 bp, Homo sapiens
tcctgcctagcaggtgacctat

SEQ ID NO: 7272636 - DNA, 22 bp, Homo sapiens
tcctgcctctccatgctaacta

SEQ ID NO: 7272637 - DNA, 22 bp, Homo sapiens
tcctcttctgtggattccctga

SEQ ID NO: 7272638 - DNA, 22 bp, Homo sapiens
tcctcttctgcctatatctgcc

SEQ ID NO: 7272639 - DNA, 22 bp, Homo sapiens
tcctcttctgcccatcagaggc

SEQ ID NO: 7272640 - DNA, 22 bp, Homo sapiens
tcctcttcagagggacctcggg

SEQ ID NO: 7272641 - DNA, 22 bp, Homo sapiens
tcctcttcaaaaggatttcctt

SEQ ID NO: 7272642 - DNA, 22 bp, Homo sapiens
tcctcttcaaaatagctctgaa

SEQ ID NO: 7272643 - DNA, 19 bp, Homo sapiens
tcctgaaaacttctggaat

SEQ ID NO: 7272644 - DNA, 22 bp, Homo sapiens
tcctgaaattctggttgtcact

SEQ ID NO: 7272645 - DNA, 22 bp, Homo sapiens
tcctgagtgagagctgggaggt

SEQ ID NO: 7272646 - DNA, 22 bp, Homo sapiens
tcctgaggctaaagtgcagtgg

SEQ ID NO: 7272647 - DNA, 22 bp, Homo sapiens
tcctgaggcctctgtgatgtga

SEQ ID NO: 7272648 - DNA, 22 bp, Homo sapiens
tcctgaggagaagagtgctagg

SEQ ID NO: 7272649 - DNA, 22 bp, Homo sapiens
tcctgaggatggttgaagtgca

SEQ ID NO: 7272650 - DNA, 22 bp, Homo sapiens
tcctgaggccctgttagggtct

SEQ ID NO: 7272651 - DNA, 22 bp, Homo sapiens
tcctgaggcacaatcctagaat

SEQ ID NO: 7272652 - DNA, 22 bp, Homo sapiens
tcctgaggaccctgtcaggggc

SEQ ID NO: 7272653 - DNA, 22 bp, Homo sapiens
tcctgaggactaacaggaagga

SEQ ID NO: 7272654 - DNA, 22 bp, Homo sapiens
tcctgagagtcaagaatgcagg

SEQ ID NO: 7272655 - DNA, 20 bp, Homo sapiens
tcctgagaggctcttggaga

SEQ ID NO: 7272656 - DNA, 23 bp, Homo sapiens
tcctgagatgagacagtgctgcc

SEQ ID NO: 7272657 - DNA, 22 bp, Homo sapiens
tcctgagatgagacagtgctgc

SEQ ID NO: 7272658 - DNA, 22 bp, Homo sapiens
tcctgagatccttttagggatc

SEQ ID NO: 7272659 - DNA, 22 bp, Homo sapiens
tcctgagccctggggtcagtgt

SEQ ID NO: 7272660 - DNA, 22 bp, Homo sapiens
tataaaatggcatcagctccaa

SEQ ID NO: 7272661 - DNA, 22 bp, Homo sapiens
tatgaattctcttgtgtatagt

SEQ ID NO: 7272662 - DNA, 22 bp, Homo sapiens
tatgaaacattcatacaaataa

SEQ ID NO: 7272663 - DNA, 22 bp, Homo sapiens
tatgtacatcgttgaattcaaa

SEQ ID NO: 7272664 - DNA, 22 bp, Homo sapiens
tatggaaagggagtttaatttg

SEQ ID NO: 7272665 - DNA, 22 bp, Homo sapiens
tatgctttacttttcattgtga

SEQ ID NO: 7272666 - DNA, 22 bp, Homo sapiens
tatgctttcattcatatgtgag

SEQ ID NO: 7272667 - DNA, 22 bp, Homo sapiens
tatgctttggtagagagttgtg

SEQ ID NO: 7272668 - DNA, 20 bp, Homo sapiens
tatgctttttataagattga

SEQ ID NO: 7272669 - DNA, 22 bp, Homo sapiens
tatgcttttaacctgtaactga

SEQ ID NO: 7272670 - DNA, 23 bp, Homo sapiens
tatgtcatgagcatattgaatgt

SEQ ID NO: 7272671 - DNA, 22 bp, Homo sapiens
tattaattcttgccaattctcc

SEQ ID NO: 7272672 - DNA, 22 bp, Homo sapiens
tatgtattattcatcagtggga

SEQ ID NO: 7272673 - DNA, 22 bp, Homo sapiens
tatgtattctcagatttactaa

SEQ ID NO: 7272674 - DNA, 22 bp, Homo sapiens
tatgtcaaagttaagaaatagg

SEQ ID NO: 7272675 - DNA, 22 bp, Homo sapiens
tatgtcaaaaaagattatgttt

SEQ ID NO: 7272676 - DNA, 22 bp, Homo sapiens
tatttgatgaaggtaaagtctt

SEQ ID NO: 7272677 - DNA, 22 bp, Homo sapiens
tatttgcaacataaaactctga

SEQ ID NO: 7272678 - DNA, 22 bp, Homo sapiens
tatttaattagtgattgtagag

SEQ ID NO: 7272679 - DNA, 22 bp, Homo sapiens
tattgtatcttctgtttagaag

SEQ ID NO: 7272680 - DNA, 22 bp, Homo sapiens
tattttgaggtatttttgagct

SEQ ID NO: 7272681 - DNA, 22 bp, Homo sapiens
tcaaagatgatgctgaagttat

SEQ ID NO: 7272682 - DNA, 22 bp, Homo sapiens
tcaaaggcggtccaggaataaa

SEQ ID NO: 7272683 - DNA, 20 bp, Homo sapiens
tcaaagaagattcagctcaa

SEQ ID NO: 7272684 - DNA, 22 bp, Homo sapiens
tcaaataccagcaatttcatgt

SEQ ID NO: 7272685 - DNA, 22 bp, Homo sapiens
tcaaatctcattgcctaaaact

SEQ ID NO: 7272686 - DNA, 21 bp, Homo sapiens
tcaaatcctgctgttaccact

SEQ ID NO: 7272687 - DNA, 22 bp, Homo sapiens
tcaaatcaccaaactcactggc

SEQ ID NO: 7272688 - DNA, 22 bp, Homo sapiens
tcaaatattggctatttcacat

SEQ ID NO: 7272689 - DNA, 22 bp, Homo sapiens
tcaaataatgccattcatcatc

SEQ ID NO: 7272690 - DNA, 22 bp, Homo sapiens
tcaaagtaccagagtgaactga

SEQ ID NO: 7272691 - DNA, 22 bp, Homo sapiens
tcaaagtagccggatggaattt

SEQ ID NO: 7272692 - DNA, 19 bp, Homo sapiens
tcaaaggcttttaggagac

SEQ ID NO: 7272693 - DNA, 22 bp, Homo sapiens
tagctgcttcagtctaggtctc

SEQ ID NO: 7272694 - DNA, 19 bp, Homo sapiens
tagcagctgccaaaggaga

SEQ ID NO: 7272695 - DNA, 19 bp, Homo sapiens
tagatactgatgaactcca

SEQ ID NO: 7272696 - DNA, 22 bp, Homo sapiens
tagactagaggatcagcaaggg

SEQ ID NO: 7272697 - DNA, 22 bp, Homo sapiens
tagaagaacatgtcaaactata

SEQ ID NO: 7272698 - DNA, 22 bp, Homo sapiens
tagaacttagcactagacttgt

SEQ ID NO: 7272699 - DNA, 22 bp, Homo sapiens
tagtttatgctgctgcagtgag

SEQ ID NO: 7272700 - DNA, 22 bp, Homo sapiens
tagtttatagttagcgagcacg

SEQ ID NO: 7272701 - DNA, 22 bp, Homo sapiens
tagttatggagtaattttaagc

SEQ ID NO: 7272702 - DNA, 19 bp, Homo sapiens
tagggctggccgggcggtg

SEQ ID NO: 7272703 - DNA, 22 bp, Homo sapiens
tagggcagagtccaggatgggc

SEQ ID NO: 7272704 - DNA, 23 bp, Homo sapiens
tagggcagctgggagggacatgc

SEQ ID NO: 7272705 - DNA, 22 bp, Homo sapiens
taggcagaaaggaaggcaagtt

SEQ ID NO: 7272706 - DNA, 20 bp, Homo sapiens
taggcagagctgtgcagcct

SEQ ID NO: 7272707 - DNA, 22 bp, Homo sapiens
taggcagcttaggttagaagtg

SEQ ID NO: 7272708 - DNA, 20 bp, Homo sapiens
taggcagcttgacccttggt

SEQ ID NO: 7272709 - DNA, 22 bp, Homo sapiens
taggcagcagtgctatgattct

SEQ ID NO: 7272710 - DNA, 22 bp, Homo sapiens
taggcagcatggattctgaata

SEQ ID NO: 7272711 - DNA, 22 bp, Homo sapiens
taggcagccagcatcagttggg

SEQ ID NO: 7272712 - DNA, 22 bp, Homo sapiens
taggcagcgcttggctgtgctt

SEQ ID NO: 7272713 - DNA, 22 bp, Homo sapiens
taggcagctgcaaacttcggtc

SEQ ID NO: 7272714 - DNA, 22 bp, Homo sapiens
taggcagatgttaacaggaaaa

SEQ ID NO: 7272715 - DNA, 21 bp, Homo sapiens
taggcagaggagcaggtatct

SEQ ID NO: 7272716 - DNA, 22 bp, Homo sapiens
gtgttatttgagtgggagcgtg

SEQ ID NO: 7272717 - DNA, 22 bp, Homo sapiens
gtgttgatgacattttagaaac

SEQ ID NO: 7272718 - DNA, 22 bp, Homo sapiens
gttaaataacctcatgtccgtt

SEQ ID NO: 7272719 - DNA, 22 bp, Homo sapiens
gttatatatagtatttctctga

SEQ ID NO: 7272720 - DNA, 22 bp, Homo sapiens
gttatacatatgtgttaacaaa

SEQ ID NO: 7272721 - DNA, 22 bp, Homo sapiens
gttatattggcagaagagaaga

SEQ ID NO: 7272722 - DNA, 22 bp, Homo sapiens
gttatcatgcttcatcatcact

SEQ ID NO: 7272723 - DNA, 22 bp, Homo sapiens
gttcttcatcttaaccatctgt

SEQ ID NO: 7272724 - DNA, 22 bp, Homo sapiens
gttcttcatcattaacactctg

SEQ ID NO: 7272725 - DNA, 22 bp, Homo sapiens
gttcttcatcattttagatagg

SEQ ID NO: 7272726 - DNA, 22 bp, Homo sapiens
gttcttcagtcacatcacagaa

SEQ ID NO: 7272727 - DNA, 22 bp, Homo sapiens
gttcttcagtaaaattaaatgt

SEQ ID NO: 7272728 - DNA, 22 bp, Homo sapiens
gttcttcaggctgtgctctaga

SEQ ID NO: 7272729 - DNA, 22 bp, Homo sapiens
gtttatctgcactctcttgtag

SEQ ID NO: 7272730 - DNA, 22 bp, Homo sapiens
gtttatctagtgaagtgaagaa

SEQ ID NO: 7272731 - DNA, 22 bp, Homo sapiens
gtttattaactgtcaagtgatt

SEQ ID NO: 7272732 - DNA, 22 bp, Homo sapiens
gtttatggagggggtgaaggca

SEQ ID NO: 7272733 - DNA, 22 bp, Homo sapiens
gtttgtgtaacatgatgatgat

SEQ ID NO: 7272734 - DNA, 22 bp, Homo sapiens
gtttgatttgatccggagagat

SEQ ID NO: 7272735 - DNA, 22 bp, Homo sapiens
gtttgattcaagaacaaagagt

SEQ ID NO: 7272736 - DNA, 22 bp, Homo sapiens
taaaacttaactatccagatta

SEQ ID NO: 7272737 - DNA, 22 bp, Homo sapiens
taaatgcaaagcttggcgctta

SEQ ID NO: 7272738 - DNA, 22 bp, Homo sapiens
taaatgcaagggaaaggcaaga

SEQ ID NO: 7272739 - DNA, 22 bp, Homo sapiens
taaatgcaagtgctcctgggag

SEQ ID NO: 7272740 - DNA, 22 bp, Homo sapiens
taaatgcaatgtgctttaccag

SEQ ID NO: 7272741 - DNA, 22 bp, Homo sapiens
taaatgcagattcctgagccta

SEQ ID NO: 7272742 - DNA, 22 bp, Homo sapiens
taaatgcagcagtttctgttct

SEQ ID NO: 7272743 - DNA, 22 bp, Homo sapiens
taaatgcagtacaaattgttct

SEQ ID NO: 7272744 - DNA, 22 bp, Homo sapiens
taaatgcagttagtacttgcca

SEQ ID NO: 7272745 - DNA, 20 bp, Homo sapiens
taaatgcatctgttcaactg

SEQ ID NO: 7272746 - DNA, 20 bp, Homo sapiens
taaatgcatgaatgtaaggc

SEQ ID NO: 7272747 - DNA, 18 bp, Homo sapiens
taaatgcatgttaataac

SEQ ID NO: 7272748 - DNA, 22 bp, Homo sapiens
taagacttaggtcgagtttggc

SEQ ID NO: 7272749 - DNA, 18 bp, Homo sapiens
taacatgttttcattaag

SEQ ID NO: 7272750 - DNA, 22 bp, Homo sapiens
taagagaactggatagatagga

SEQ ID NO: 7272751 - DNA, 19 bp, Homo sapiens
taccagcctcctgcctgat

SEQ ID NO: 7272752 - DNA, 22 bp, Homo sapiens
tactaggaagcagctgcattgg

SEQ ID NO: 7272753 - DNA, 22 bp, Homo sapiens
tactaggaagcagctgcattgg

SEQ ID NO: 7272754 - DNA, 22 bp, Homo sapiens
tactatctcttctaacttcaga

SEQ ID NO: 7272755 - DNA, 22 bp, Homo sapiens
taccattttgaaacatttcatc

SEQ ID NO: 7272756 - DNA, 22 bp, Homo sapiens
tacttaaaactgatagaatctc

SEQ ID NO: 7272757 - DNA, 22 bp, Homo sapiens
tactgttttctataatggctgt

SEQ ID NO: 7272758 - DNA, 22 bp, Homo sapiens
tactgttttttagactcatggt

SEQ ID NO: 7272759 - DNA, 22 bp, Homo sapiens
tactctaacatttgttagatgt

SEQ ID NO: 7272760 - DNA, 22 bp, Homo sapiens
tactgaaaaagaatccagacct

SEQ ID NO: 7272761 - DNA, 22 bp, Homo sapiens
tactgtgtgattccatttacgt

SEQ ID NO: 7272762 - DNA, 22 bp, Homo sapiens
tactgtactgtcttttttgctg

SEQ ID NO: 7272763 - DNA, 22 bp, Homo sapiens
tactgtgttgtgctgaaaggga

SEQ ID NO: 7272764 - DNA, 22 bp, Homo sapiens
tactgtgtggtgagctgtctcc

SEQ ID NO: 7272765 - DNA, 22 bp, Homo sapiens
tactgtactgcagttctgcaaa

SEQ ID NO: 7272766 - DNA, 22 bp, Homo sapiens
tactgaaacttttcttcaactg

SEQ ID NO: 7272767 - DNA, 22 bp, Homo sapiens
tactgtacattccgtttgttgc

SEQ ID NO: 7272768 - DNA, 22 bp, Homo sapiens
tacagtgtccctttttcagaca

SEQ ID NO: 7272769 - DNA, 22 bp, Homo sapiens
taccaagtgtattatgctttgt

SEQ ID NO: 7272770 - DNA, 22 bp, Homo sapiens
tacatgacatttctttctgttc

SEQ ID NO: 7272771 - DNA, 22 bp, Homo sapiens
tacagtgtctggatatcaaagg

SEQ ID NO: 7272772 - DNA, 22 bp, Homo sapiens
tacagtgtgacatttctacaaa

SEQ ID NO: 7272773 - DNA, 22 bp, Homo sapiens
tacaacattgtgttgcttcata

SEQ ID NO: 7272774 - DNA, 22 bp, Homo sapiens
tacacaatctgtttttccattt

SEQ ID NO: 7272775 - DNA, 20 bp, Homo sapiens
tacagaatgcaataaaatgg

SEQ ID NO: 7272776 - DNA, 21 bp, Homo sapiens
tacagaatgcgcttcagtctg

SEQ ID NO: 7272777 - DNA, 22 bp, Homo sapiens
tacacacagaggccatgggatt

SEQ ID NO: 7272778 - DNA, 22 bp, Homo sapiens
tacacacatgcatttgccttat

SEQ ID NO: 7272779 - DNA, 22 bp, Homo sapiens
taagcctgcatgaaccatgaga

SEQ ID NO: 7272780 - DNA, 22 bp, Homo sapiens
taattctagattgacattttga

SEQ ID NO: 7272781 - DNA, 22 bp, Homo sapiens
taattcttgttcagaggtagta

SEQ ID NO: 7272782 - DNA, 22 bp, Homo sapiens
taattccaagttgagacatgca

SEQ ID NO: 7272783 - DNA, 23 bp, Homo sapiens
taattcacatatacattgcttca

SEQ ID NO: 7272784 - DNA, 22 bp, Homo sapiens
taattatttgaagacattagag

SEQ ID NO: 7272785 - DNA, 22 bp, Homo sapiens
taatccagggtattctagtttc

SEQ ID NO: 7272786 - DNA, 22 bp, Homo sapiens
taatatctacttcatagagttt

SEQ ID NO: 7272787 - DNA, 22 bp, Homo sapiens
taattattctagtcacatagca

SEQ ID NO: 7272788 - DNA, 22 bp, Homo sapiens
taattattatgacaacaattgc

SEQ ID NO: 7272789 - DNA, 22 bp, Homo sapiens
ggtgggtgagccctgggagctg

SEQ ID NO: 7272790 - DNA, 22 bp, Homo sapiens
ggtggggagtcaggcattcttg

SEQ ID NO: 7272791 - DNA, 22 bp, Homo sapiens
ggtggtggagccagctgggagt

SEQ ID NO: 7272792 - DNA, 22 bp, Homo sapiens
ggtggtggagccagctgggagt

SEQ ID NO: 7272793 - DNA, 22 bp, Homo sapiens
ggttattgtttatagagcataa

SEQ ID NO: 7272794 - DNA, 22 bp, Homo sapiens
ggttatataattcagtgctttc

SEQ ID NO: 7272795 - DNA, 22 bp, Homo sapiens
ggttggggcgagctggaggccc

SEQ ID NO: 7272796 - DNA, 22 bp, Homo sapiens
ggttcagtggaatgtgttgacc

SEQ ID NO: 7272797 - DNA, 21 bp, Homo sapiens
ggttggtgtgtccagtggcca

SEQ ID NO: 7272798 - DNA, 22 bp, Homo sapiens
ggttgtagttggaggttgtata

SEQ ID NO: 7272799 - DNA, 22 bp, Homo sapiens
gtaatttttagttcattctatc

SEQ ID NO: 7272800 - DNA, 22 bp, Homo sapiens
ggtcccagctgctcaagaggct

SEQ ID NO: 7272801 - DNA, 22 bp, Homo sapiens
ggtcccaggaatctgtgttcta

SEQ ID NO: 7272802 - DNA, 22 bp, Homo sapiens
gggtggtgtattagagctgcag

SEQ ID NO: 7272803 - DNA, 22 bp, Homo sapiens
ggtccccgtggaggctggagcg

SEQ ID NO: 7272804 - DNA, 22 bp, Homo sapiens
ggtgagggagtggaacgaggtg

SEQ ID NO: 7272805 - DNA, 22 bp, Homo sapiens
ggtggaaggcctggaaggaggc

SEQ ID NO: 7272806 - DNA, 22 bp, Homo sapiens
gggctgtgtgcccacttcccat

SEQ ID NO: 7272807 - DNA, 20 bp, Homo sapiens
ggggcagtggctcatgcctg

SEQ ID NO: 7272808 - DNA, 22 bp, Homo sapiens
ggggcccctcggacacgtgcgg

SEQ ID NO: 7272809 - DNA, 22 bp, Homo sapiens
gggtgaggcccatttgaggcca

SEQ ID NO: 7272810 - DNA, 22 bp, Homo sapiens
gggtggagaggctaagtccagt

SEQ ID NO: 7272811 - DNA, 22 bp, Homo sapiens
gggtggtggcggaggctccagg

SEQ ID NO: 7272812 - DNA, 22 bp, Homo sapiens
gtgctgattgggagctgggatt

SEQ ID NO: 7272813 - DNA, 22 bp, Homo sapiens
gtgctgcctgccagcttctggg

SEQ ID NO: 7272814 - DNA, 22 bp, Homo sapiens
gtgccaggtgctaagctgtgct

SEQ ID NO: 7272815 - DNA, 22 bp, Homo sapiens
gtctttattacaaatccttttc

SEQ ID NO: 7272816 - DNA, 16 bp, Homo sapiens
gtctttattcacttag

SEQ ID NO: 7272817 - DNA, 22 bp, Homo sapiens
gtctccagatatcctacacaac

SEQ ID NO: 7272818 - DNA, 22 bp, Homo sapiens
gtctccagaggttacatcctgt

SEQ ID NO: 7272819 - DNA, 22 bp, Homo sapiens
gtctatatattgcttgaataat

SEQ ID NO: 7272820 - DNA, 22 bp, Homo sapiens
gtgaggagtctgaagcacataa

SEQ ID NO: 7272821 - DNA, 22 bp, Homo sapiens
gtcaaagaaacgcaccttacat

SEQ ID NO: 7272822 - DNA, 22 bp, Homo sapiens
gtcaaaatgagctttgttattg

SEQ ID NO: 7272823 - DNA, 22 bp, Homo sapiens
gtcaaatatactaagaggtaaa

SEQ ID NO: 7272824 - DNA, 22 bp, Homo sapiens
gtagtttacagaagaggagcaa

SEQ ID NO: 7272825 - DNA, 22 bp, Homo sapiens
gtattttcatgatttcagacca

SEQ ID NO: 7272826 - DNA, 22 bp, Homo sapiens
gtaggcagataggagtgcagcc

SEQ ID NO: 7272827 - DNA, 22 bp, Homo sapiens
gtacaatagcagttttcccttt

SEQ ID NO: 7272828 - DNA, 22 bp, Homo sapiens
gtagtcccagctaccccggagg

SEQ ID NO: 7272829 - DNA, 22 bp, Homo sapiens
gtcactgtatccaggttccagc

SEQ ID NO: 7272830 - DNA, 20 bp, Homo sapiens
gtcagaggaccctagagcga

SEQ ID NO: 7272831 - DNA, 22 bp, Homo sapiens
gtcgtggagctcacagtgtgcc

SEQ ID NO: 7272832 - DNA, 22 bp, Homo sapiens
gtcgtggagctcacagtgtgcc

SEQ ID NO: 7272833 - DNA, 22 bp, Homo sapiens
gtccaggctgacccctagagga

SEQ ID NO: 7272834 - DNA, 22 bp, Homo sapiens
gggaagcaggtgcagctcgcct

SEQ ID NO: 7272835 - DNA, 22 bp, Homo sapiens
gggaagatagtgttgagggccc

SEQ ID NO: 7272836 - DNA, 22 bp, Homo sapiens
ggctgtggacactgagctcaga

SEQ ID NO: 7272837 - DNA, 22 bp, Homo sapiens
ggctggagacaacgtcctgccc

SEQ ID NO: 7272838 - DNA, 22 bp, Homo sapiens
ggctggaggagaatgggtgtga

SEQ ID NO: 7272839 - DNA, 22 bp, Homo sapiens
ggctggcagtgtgagagaggga

SEQ ID NO: 7272840 - DNA, 21 bp, Homo sapiens
ggctgcagggagccctggggt

SEQ ID NO: 7272841 - DNA, 22 bp, Homo sapiens
ggctgcaggcttccctccagca

SEQ ID NO: 7272842 - DNA, 22 bp, Homo sapiens
ggctgcaggttggttggcagct

SEQ ID NO: 7272843 - DNA, 22 bp, Homo sapiens
ggctgcagggcagctggtgtgg

SEQ ID NO: 7272844 - DNA, 22 bp, Homo sapiens
ggctgcagttgtgtgaaggccg

SEQ ID NO: 7272845 - DNA, 22 bp, Homo sapiens
ggctgcataggcagaagctgtg

SEQ ID NO: 7272846 - DNA, 20 bp, Homo sapiens
gggcagagccagccagtccc

SEQ ID NO: 7272847 - DNA, 22 bp, Homo sapiens
gggcagagagctggaactcctt

SEQ ID NO: 7272848 - DNA, 22 bp, Homo sapiens
gggcagagactcagaaacagaa

SEQ ID NO: 7272849 - DNA, 22 bp, Homo sapiens
gggcagaggctctggcccatcc

SEQ ID NO: 7272850 - DNA, 21 bp, Homo sapiens
gggcagaggggcctcctgggt

SEQ ID NO: 7272851 - DNA, 22 bp, Homo sapiens
ggcagcactgcagcttgttggg

SEQ ID NO: 7272852 - DNA, 22 bp, Homo sapiens
ggcagcagaactggccctgtat

SEQ ID NO: 7272853 - DNA, 22 bp, Homo sapiens
ggcagcactgcagcttgttggg

SEQ ID NO: 7272854 - DNA, 20 bp, Homo sapiens
ggcagcaattcaccctatcc

SEQ ID NO: 7272855 - DNA, 22 bp, Homo sapiens
ggcagatgttgcagtgagcaga

SEQ ID NO: 7272856 - DNA, 22 bp, Homo sapiens
ggcagatgttgcagtgagcaga

SEQ ID NO: 7272857 - DNA, 22 bp, Homo sapiens
ggcagcaactcggagagaagag

SEQ ID NO: 7272858 - DNA, 22 bp, Homo sapiens
ggcagcaactcattattcctgt

SEQ ID NO: 7272859 - DNA, 22 bp, Homo sapiens
ggcagaggtgaagttcacaagg

SEQ ID NO: 7272860 - DNA, 22 bp, Homo sapiens
ggcagatggagaagcagcaggt

SEQ ID NO: 7272861 - DNA, 22 bp, Homo sapiens
ggaggagtcagttgggctgctt

SEQ ID NO: 7272862 - DNA, 22 bp, Homo sapiens
ggaggatgagctacgaggagct

SEQ ID NO: 7272863 - DNA, 22 bp, Homo sapiens
ggaggaggtgggttaagttgta

SEQ ID NO: 7272864 - DNA, 22 bp, Homo sapiens
ggaggaggggtttacattggaa

SEQ ID NO: 7272865 - DNA, 22 bp, Homo sapiens
ggaggatgccaagctgtgcaca

SEQ ID NO: 7272866 - DNA, 17 bp, Homo sapiens
ggaggcaacagacaggg

SEQ ID NO: 7272867 - DNA, 22 bp, Homo sapiens
ggaggcagaacttcccgtcagt

SEQ ID NO: 7272868 - DNA, 22 bp, Homo sapiens
ggcaccaggctgggcataggcc

SEQ ID NO: 7272869 - DNA, 22 bp, Homo sapiens
ggcaccaggggatgtaatgtcc

SEQ ID NO: 7272870 - DNA, 22 bp, Homo sapiens
ggcaccagggaaggaaggctgg

SEQ ID NO: 7272871 - DNA, 22 bp, Homo sapiens
ggcaccagggcaagggtctttc

SEQ ID NO: 7272872 - DNA, 22 bp, Homo sapiens
ggcaccagggacaatcctcttc

SEQ ID NO: 7272873 - DNA, 22 bp, Homo sapiens
ggcagctcacgggcatggggtg

SEQ ID NO: 7272874 - DNA, 22 bp, Homo sapiens
ggcagctagtttaagaaagagg

SEQ ID NO: 7272875 - DNA, 22 bp, Homo sapiens
ggcagctattccaagcagcact

SEQ ID NO: 7272876 - DNA, 21 bp, Homo sapiens
ggcagcgtgtggacaggaagg

SEQ ID NO: 7272877 - DNA, 20 bp, Homo sapiens
ggcagcgggttcgggcgcag

SEQ ID NO: 7272878 - DNA, 22 bp, Homo sapiens
ggcagctaggggcagggaattc

SEQ ID NO: 7272879 - DNA, 22 bp, Homo sapiens
ggcagccttgagggaggcctgg

SEQ ID NO: 7272880 - DNA, 22 bp, Homo sapiens
ggcagcgagtcgccaagtctcg

SEQ ID NO: 7272881 - DNA, 21 bp, Homo sapiens
ggcagctcagcagatggggac

SEQ ID NO: 7272882 - DNA, 20 bp, Homo sapiens
ggcaggctttatatggaggg

SEQ ID NO: 7272883 - DNA, 18 bp, Homo sapiens
ggcagggaaaagataggg

SEQ ID NO: 7272884 - DNA, 21 bp, Homo sapiens
ggcagcctctgtggaagggga

SEQ ID NO: 7272885 - DNA, 21 bp, Homo sapiens
ggcagcctgacccccagagag

SEQ ID NO: 7272886 - DNA, 22 bp, Homo sapiens
ggcagccttgactagtgactta

SEQ ID NO: 7272887 - DNA, 17 bp, Homo sapiens
ggcagcctcaggcgttt

SEQ ID NO: 7272888 - DNA, 22 bp, Homo sapiens
ggcagtgcaaggctggcacagt

SEQ ID NO: 7272889 - DNA, 18 bp, Homo sapiens
ggcagtgcagtctcaggg

SEQ ID NO: 7272890 - DNA, 22 bp, Homo sapiens
ggcagtgcctgatgctgcagga

SEQ ID NO: 7272891 - DNA, 22 bp, Homo sapiens
ggcagtggaggaccctgtgtct

SEQ ID NO: 7272892 - DNA, 22 bp, Homo sapiens
ggcagggaagctggcatcacgg

SEQ ID NO: 7272893 - DNA, 22 bp, Homo sapiens
ggctcacgcaattatcccggcc

SEQ ID NO: 7272894 - DNA, 22 bp, Homo sapiens
ggctcagaaacctctggtgtct

SEQ ID NO: 7272895 - DNA, 22 bp, Homo sapiens
ggctcagagacctgcgatctga

SEQ ID NO: 7272896 - DNA, 22 bp, Homo sapiens
ggctcagatggtttgttctaga

SEQ ID NO: 7272897 - DNA, 22 bp, Homo sapiens
ggctctgcccaggtggacagca

SEQ ID NO: 7272898 - DNA, 22 bp, Homo sapiens
ggctctgccatttcctagctgc

SEQ ID NO: 7272899 - DNA, 22 bp, Homo sapiens
ggctctgccacttcttggctgt

SEQ ID NO: 7272900 - DNA, 22 bp, Homo sapiens
ggccagctgggccaccaggtgc

SEQ ID NO: 7272901 - DNA, 22 bp, Homo sapiens
ggccagctcttgtccacggagg

SEQ ID NO: 7272902 - DNA, 22 bp, Homo sapiens
ggccagctctgcacagcagctg

SEQ ID NO: 7272903 - DNA, 22 bp, Homo sapiens
ggcccaggctggagtgcagtgg

SEQ ID NO: 7272904 - DNA, 20 bp, Homo sapiens
ggccacagggtgctggtgga

SEQ ID NO: 7272905 - DNA, 22 bp, Homo sapiens
ggccacagggctgaacgtggac

SEQ ID NO: 7272906 - DNA, 22 bp, Homo sapiens
ggccacagcaatgctgtgatgt

SEQ ID NO: 7272907 - DNA, 22 bp, Homo sapiens
ggccacagagggcgggatgctg

SEQ ID NO: 7272908 - DNA, 22 bp, Homo sapiens
ggccagagtctatatgcagaca

SEQ ID NO: 7272909 - DNA, 22 bp, Homo sapiens
ggccacctaggagccacagtga

SEQ ID NO: 7272910 - DNA, 19 bp, Homo sapiens
ggccacctctcttcccagg

SEQ ID NO: 7272911 - DNA, 22 bp, Homo sapiens
gcttttggccagatggggaaac

SEQ ID NO: 7272912 - DNA, 22 bp, Homo sapiens
gctttagaaatgagtaaattag

SEQ ID NO: 7272913 - DNA, 22 bp, Homo sapiens
gctttagaaatatcactgtgga

SEQ ID NO: 7272914 - DNA, 22 bp, Homo sapiens
gctttagagaagaaaggttgct

SEQ ID NO: 7272915 - DNA, 22 bp, Homo sapiens
gctttagacataaagttcttca

SEQ ID NO: 7272916 - DNA, 22 bp, Homo sapiens
gctttagaagacactctgtttt

SEQ ID NO: 7272917 - DNA, 22 bp, Homo sapiens
gctttagaaatgtaggagatac

SEQ ID NO: 7272918 - DNA, 22 bp, Homo sapiens
gctttagatctgactttctgtg

SEQ ID NO: 7272919 - DNA, 22 bp, Homo sapiens
gctttagatagatttagtcttt

SEQ ID NO: 7272920 - DNA, 22 bp, Homo sapiens
gctttagatactcccaatgtcc

SEQ ID NO: 7272921 - DNA, 22 bp, Homo sapiens
gctttagagcccagcttggtgg

SEQ ID NO: 7272922 - DNA, 21 bp, Homo sapiens
gctttagatttagtgagccag

SEQ ID NO: 7272923 - DNA, 22 bp, Homo sapiens
gctttaatgaagtcacgcaaag

SEQ ID NO: 7272924 - DNA, 22 bp, Homo sapiens
gctttaatgcaatttcacctca

SEQ ID NO: 7272925 - DNA, 22 bp, Homo sapiens
gctttaatgcttcgtggggcca

SEQ ID NO: 7272926 - DNA, 22 bp, Homo sapiens
gctgtgtgctaggatatgtttt

SEQ ID NO: 7272927 - DNA, 22 bp, Homo sapiens
gctgtagatggactggcatcca

SEQ ID NO: 7272928 - DNA, 22 bp, Homo sapiens
gctgtaggtaaggatggcaaag

SEQ ID NO: 7272929 - DNA, 22 bp, Homo sapiens
gctgtatgtgaggccacagtga

SEQ ID NO: 7272930 - DNA, 22 bp, Homo sapiens
gctgtatgtttatttgggaatt

SEQ ID NO: 7272931 - DNA, 22 bp, Homo sapiens
gctgtatgagttcatgtgtaga

SEQ ID NO: 7272932 - DNA, 22 bp, Homo sapiens
gctgtatgtgaggccacagtga

SEQ ID NO: 7272933 - DNA, 22 bp, Homo sapiens
gctggtccagggcctctgtggg

SEQ ID NO: 7272934 - DNA, 22 bp, Homo sapiens
gctggtccactccctggaggct

SEQ ID NO: 7272935 - DNA, 22 bp, Homo sapiens
ggagccaggcatatcggggcac

SEQ ID NO: 7272936 - DNA, 22 bp, Homo sapiens
ggagccagtttagacctcagtt

SEQ ID NO: 7272937 - DNA, 18 bp, Homo sapiens
ggagcccagaggacagga

SEQ ID NO: 7272938 - DNA, 18 bp, Homo sapiens
ggagcccagaggtgagtt

SEQ ID NO: 7272939 - DNA, 22 bp, Homo sapiens
ggagctgttggcagctatcttg

SEQ ID NO: 7272940 - DNA, 22 bp, Homo sapiens
ggaggaggggtgactgaatgct

SEQ ID NO: 7272941 - DNA, 22 bp, Homo sapiens
ggaggaggggcgctttgtctat

SEQ ID NO: 7272942 - DNA, 22 bp, Homo sapiens
ggagctgtaacgagccattgct

SEQ ID NO: 7272943 - DNA, 22 bp, Homo sapiens
ggagctgtgttatccattccca

SEQ ID NO: 7272944 - DNA, 22 bp, Homo sapiens
ggagctgtgggacgctgtccca

SEQ ID NO: 7272945 - DNA, 22 bp, Homo sapiens
ggactttagcagctggagagga

SEQ ID NO: 7272946 - DNA, 22 bp, Homo sapiens
ggacaggctgcatctgagcatg

SEQ ID NO: 7272947 - DNA, 22 bp, Homo sapiens
ggaaggcttgagttcccaggtc

SEQ ID NO: 7272948 - DNA, 22 bp, Homo sapiens
ggaaggctctgttccttgactt

SEQ ID NO: 7272949 - DNA, 22 bp, Homo sapiens
ggaaggctttgaggggtgctgg

SEQ ID NO: 7272950 - DNA, 22 bp, Homo sapiens
ggacaggataagagacactgcc

SEQ ID NO: 7272951 - DNA, 22 bp, Homo sapiens
ggaaaaatagagtatactttaa

SEQ ID NO: 7272952 - DNA, 22 bp, Homo sapiens
ggaaaaatgacacatatctcaa

SEQ ID NO: 7272953 - DNA, 22 bp, Homo sapiens
ggaaggaagtgcagactttaaa

SEQ ID NO: 7272954 - DNA, 22 bp, Homo sapiens
gctcccagcattgcttcccagg

SEQ ID NO: 7272955 - DNA, 20 bp, Homo sapiens
gctcccagcctgcagtcccc

SEQ ID NO: 7272956 - DNA, 20 bp, Homo sapiens
gctcccagcctgcagtcccc

SEQ ID NO: 7272957 - DNA, 22 bp, Homo sapiens
gctctcttggtggctgtcctgg

SEQ ID NO: 7272958 - DNA, 22 bp, Homo sapiens
gctctgtcaacagctagctgtg

SEQ ID NO: 7272959 - DNA, 21 bp, Homo sapiens
gctctgtccctgctgtgtgtc

SEQ ID NO: 7272960 - DNA, 22 bp, Homo sapiens
gctaggctcggaagcagcaggg

SEQ ID NO: 7272961 - DNA, 22 bp, Homo sapiens
gctagctgggtttcactgtgga

SEQ ID NO: 7272962 - DNA, 22 bp, Homo sapiens
gctcagttatccgtgtgtgact

SEQ ID NO: 7272963 - DNA, 22 bp, Homo sapiens
gctcccagactgaccagaggtg

SEQ ID NO: 7272964 - DNA, 22 bp, Homo sapiens
gctcccagactgaccagaggtg

SEQ ID NO: 7272965 - DNA, 22 bp, Homo sapiens
gctcccagatttcagccttgtg

SEQ ID NO: 7272966 - DNA, 22 bp, Homo sapiens
gctcccagcaattgaggcagcc

SEQ ID NO: 7272967 - DNA, 20 bp, Homo sapiens
gctcagggcctgggtctgga

SEQ ID NO: 7272968 - DNA, 22 bp, Homo sapiens
gctaggttggggaagttctcct

SEQ ID NO: 7272969 - DNA, 22 bp, Homo sapiens
gctgcaggctgtggcaggggag

SEQ ID NO: 7272970 - DNA, 22 bp, Homo sapiens
gctgcaggctctgcaggaattg

SEQ ID NO: 7272971 - DNA, 22 bp, Homo sapiens
gctgcagggagctggaaggctc

SEQ ID NO: 7272972 - DNA, 22 bp, Homo sapiens
gctgcagggagctggaaggctc

SEQ ID NO: 7272973 - DNA, 22 bp, Homo sapiens
gctgcctcccagagccctgcag

SEQ ID NO: 7272974 - DNA, 22 bp, Homo sapiens
gctgcctcccagagccctgcag

SEQ ID NO: 7272975 - DNA, 22 bp, Homo sapiens
gctgcctccactggctcccagt

SEQ ID NO: 7272976 - DNA, 22 bp, Homo sapiens
gctgcctccactggctcccagt

SEQ ID NO: 7272977 - DNA, 22 bp, Homo sapiens
gctgcctcccccatggctggaa

SEQ ID NO: 7272978 - DNA, 22 bp, Homo sapiens
gctgcctcccccatggctggaa

SEQ ID NO: 7272979 - DNA, 22 bp, Homo sapiens
gctgcctccgccggctccacag

SEQ ID NO: 7272980 - DNA, 22 bp, Homo sapiens
gctgcctccgccggctccacag

SEQ ID NO: 7272981 - DNA, 23 bp, Homo sapiens
gctgcctcctacaaaagcccagc

SEQ ID NO: 7272982 - DNA, 22 bp, Homo sapiens
gctgcctcctgaaagcgctctg

SEQ ID NO: 7272983 - DNA, 22 bp, Homo sapiens
gctgcctcctgaaagcgctctg

SEQ ID NO: 7272984 - DNA, 22 bp, Homo sapiens
gctgcctcctgagatttgggca

SEQ ID NO: 7272985 - DNA, 22 bp, Homo sapiens
gctgcctcctgagatttgggca

SEQ ID NO: 7272986 - DNA, 22 bp, Homo sapiens
gctgcctctcctgagttgacag

SEQ ID NO: 7272987 - DNA, 22 bp, Homo sapiens
gctgcctctcctgagttgacag

SEQ ID NO: 7272988 - DNA, 22 bp, Homo sapiens
gctgcctctgcacagctcactc

SEQ ID NO: 7272989 - DNA, 22 bp, Homo sapiens
gctgcctctgcacagctcactc

SEQ ID NO: 7272990 - DNA, 22 bp, Homo sapiens
gctgcctctgcgactctgggcg

SEQ ID NO: 7272991 - DNA, 22 bp, Homo sapiens
gctgcctctgtagctttggacc

SEQ ID NO: 7272992 - DNA, 22 bp, Homo sapiens
gctgcctctgcgactctgggcg

SEQ ID NO: 7272993 - DNA, 20 bp, Homo sapiens
gctgaggggtctatggcata

SEQ ID NO: 7272994 - DNA, 22 bp, Homo sapiens
gctgaggtggtgatggttcatc

SEQ ID NO: 7272995 - DNA, 22 bp, Homo sapiens
gctgaggtggctgccttagtaa

SEQ ID NO: 7272996 - DNA, 18 bp, Homo sapiens
gctgaggtggtgtcagag

SEQ ID NO: 7272997 - DNA, 22 bp, Homo sapiens
gctgaggtgtcaccttgctggg

SEQ ID NO: 7272998 - DNA, 20 bp, Homo sapiens
gctgaggtttcttcctatat

SEQ ID NO: 7272999 - DNA, 22 bp, Homo sapiens
gctgaggtttcaggagtggcag

SEQ ID NO: 7273000 - DNA, 22 bp, Homo sapiens
gctgagtcagattgcagtcttg

SEQ ID NO: 7273001 - DNA, 22 bp, Homo sapiens
gctgaggttttctgcctgctca

SEQ ID NO: 7273002 - DNA, 22 bp, Homo sapiens
gctgagttgaaagcagaggata

SEQ ID NO: 7273003 - DNA, 22 bp, Homo sapiens
gctgagtgtaatgatggcagag

SEQ ID NO: 7273004 - DNA, 22 bp, Homo sapiens
gctgagtgaggtccagagcttg

SEQ ID NO: 7273005 - DNA, 22 bp, Homo sapiens
gctgagtgattcatacgctgct

SEQ ID NO: 7273006 - DNA, 22 bp, Homo sapiens
gctggaggtttcacctgagttt

SEQ ID NO: 7273007 - DNA, 22 bp, Homo sapiens
gctggaggtagggaggtcctgt

SEQ ID NO: 7273008 - DNA, 22 bp, Homo sapiens
gctggcagggtggttgagagag

SEQ ID NO: 7273009 - DNA, 22 bp, Homo sapiens
gctggcagtgtattgttagctg

SEQ ID NO: 7273010 - DNA, 23 bp, Homo sapiens
gctgcctctgttggtcttcagtt

SEQ ID NO: 7273011 - DNA, 23 bp, Homo sapiens
gctgcctctgttggtcttcagtt

SEQ ID NO: 7273012 - DNA, 22 bp, Homo sapiens
gctgcctctgtagctttggacc

SEQ ID NO: 7273013 - DNA, 22 bp, Homo sapiens
gctgctgggaatgaacagtgtt

SEQ ID NO: 7273014 - DNA, 22 bp, Homo sapiens
gctgctggggccttccctcggg

SEQ ID NO: 7273015 - DNA, 22 bp, Homo sapiens
gctggagctgcagcctgggcct

SEQ ID NO: 7273016 - DNA, 22 bp, Homo sapiens
gcagacaggcccagtggaggga

SEQ ID NO: 7273017 - DNA, 22 bp, Homo sapiens
gcagacagcatgttgggctatt

SEQ ID NO: 7273018 - DNA, 22 bp, Homo sapiens
gcagacagatgagggtgctggg

SEQ ID NO: 7273019 - DNA, 23 bp, Homo sapiens
gcagacagagcagactaagacaa

SEQ ID NO: 7273020 - DNA, 22 bp, Homo sapiens
gcagaaggatccgcaggtgcaa

SEQ ID NO: 7273021 - DNA, 22 bp, Homo sapiens
gcaccagcctgagcctcttgca

SEQ ID NO: 7273022 - DNA, 22 bp, Homo sapiens
gcagagtgccgagatggaagcg

SEQ ID NO: 7273023 - DNA, 22 bp, Homo sapiens
gcagagtgatggaatgtgggtg

SEQ ID NO: 7273024 - DNA, 22 bp, Homo sapiens
gcagagtgaagggagaggtgtg

SEQ ID NO: 7273025 - DNA, 22 bp, Homo sapiens
gcagacagggctacagaggtac

SEQ ID NO: 7273026 - DNA, 22 bp, Homo sapiens
gcagaggtgctcagtggcagaa

SEQ ID NO: 7273027 - DNA, 22 bp, Homo sapiens
gcagaggtggatgcaattgggg

SEQ ID NO: 7273028 - DNA, 22 bp, Homo sapiens
gcacagagtgggtgagatgtgg

SEQ ID NO: 7273029 - DNA, 22 bp, Homo sapiens
gcacagagacagtcctgagatc

SEQ ID NO: 7273030 - DNA, 22 bp, Homo sapiens
gcacagagggcagtgagcctct

SEQ ID NO: 7273031 - DNA, 22 bp, Homo sapiens
gagtcaagtccagtgaggctga

SEQ ID NO: 7273032 - DNA, 22 bp, Homo sapiens
gcaaggacctttgagcgtgcca

SEQ ID NO: 7273033 - DNA, 22 bp, Homo sapiens
gcaaggactccctgggtcattc

SEQ ID NO: 7273034 - DNA, 22 bp, Homo sapiens
gcaaggatgtactgcaatagga

SEQ ID NO: 7273035 - DNA, 20 bp, Homo sapiens
gcaaggctccaaggggtgtg

SEQ ID NO: 7273036 - DNA, 22 bp, Homo sapiens
gcaaggctcccgcagcccaggg

SEQ ID NO: 7273037 - DNA, 18 bp, Homo sapiens
gcaaggctcaggccaggc

SEQ ID NO: 7273038 - DNA, 21 bp, Homo sapiens
gcaaggctcattcttgttgta

SEQ ID NO: 7273039 - DNA, 22 bp, Homo sapiens
gcaaggctcacattgaactgaa

SEQ ID NO: 7273040 - DNA, 22 bp, Homo sapiens
gcagggcagctgaagctaggtg

SEQ ID NO: 7273041 - DNA, 22 bp, Homo sapiens
gcagctgtactggcagcattgt

SEQ ID NO: 7273042 - DNA, 22 bp, Homo sapiens
gcagctgtcactttcacaatgc

SEQ ID NO: 7273043 - DNA, 22 bp, Homo sapiens
gcagggcagggcaagaactggg

SEQ ID NO: 7273044 - DNA, 22 bp, Homo sapiens
gcagcagaagtagaagtacagg

SEQ ID NO: 7273045 - DNA, 22 bp, Homo sapiens
gcagcagcaggcgctcggccgt

SEQ ID NO: 7273046 - DNA, 21 bp, Homo sapiens
gcagccagccgagaccatgcc

SEQ ID NO: 7273047 - DNA, 22 bp, Homo sapiens
gcagccagtatcctctgagatt

SEQ ID NO: 7273048 - DNA, 22 bp, Homo sapiens
gcagccagtgggatgagaaaga

SEQ ID NO: 7273049 - DNA, 23 bp, Homo sapiens
gcagctggttagaagggaaggag

SEQ ID NO: 7273050 - DNA, 22 bp, Homo sapiens
gccagagaatgaaaatcagatt

SEQ ID NO: 7273051 - DNA, 19 bp, Homo sapiens
gccaggctccatagccggc

SEQ ID NO: 7273052 - DNA, 22 bp, Homo sapiens
gccaggctaagaaaggtgtgat

SEQ ID NO: 7273053 - DNA, 22 bp, Homo sapiens
gccaggcatgtcctctgcagaa

SEQ ID NO: 7273054 - DNA, 22 bp, Homo sapiens
gccaggcattattccgatccct

SEQ ID NO: 7273055 - DNA, 21 bp, Homo sapiens
gcagtttatgtaatatgcact

SEQ ID NO: 7273056 - DNA, 22 bp, Homo sapiens
gcattctttttaggaggttcct

SEQ ID NO: 7273057 - DNA, 22 bp, Homo sapiens
gcagtgtttgtgttctcacatg

SEQ ID NO: 7273058 - DNA, 22 bp, Homo sapiens
gcagtgtttgtgttctcacatg

SEQ ID NO: 7273059 - DNA, 22 bp, Homo sapiens
gcagtgttttacagaccagcat

SEQ ID NO: 7273060 - DNA, 22 bp, Homo sapiens
gcagtgtttttcaatgcttcca

SEQ ID NO: 7273061 - DNA, 22 bp, Homo sapiens
gcagtgtttttcaatgcttcca

SEQ ID NO: 7273062 - DNA, 22 bp, Homo sapiens
gcagtttactgtcaataactct

SEQ ID NO: 7273063 - DNA, 22 bp, Homo sapiens
gcagttctacttatccatagac

SEQ ID NO: 7273064 - DNA, 22 bp, Homo sapiens
gcagtgttggcaggatggggct

SEQ ID NO: 7273065 - DNA, 22 bp, Homo sapiens
gcagtgttggtttgctctgcag

SEQ ID NO: 7273066 - DNA, 22 bp, Homo sapiens
gcagtgttgtgatccaggtctt

SEQ ID NO: 7273067 - DNA, 22 bp, Homo sapiens
gcagtgttgtgatccaggtctt

SEQ ID NO: 7273068 - DNA, 22 bp, Homo sapiens
gcagtgttgttaaaagattaga

SEQ ID NO: 7273069 - DNA, 22 bp, Homo sapiens
gcagtgtttacatattagaaac

SEQ ID NO: 7273070 - DNA, 22 bp, Homo sapiens
gcagtgtttcaaatcaaaggca

SEQ ID NO: 7273071 - DNA, 22 bp, Homo sapiens
gcagtgtttcagtgctttttct

SEQ ID NO: 7273072 - DNA, 22 bp, Homo sapiens
gcagtgtttcccagagatggaa

SEQ ID NO: 7273073 - DNA, 23 bp, Homo sapiens
gcagtgtttgcttcatcttatcc

SEQ ID NO: 7273074 - DNA, 22 bp, Homo sapiens
gcagtgtttggatccatagcga

SEQ ID NO: 7273075 - DNA, 22 bp, Homo sapiens
gccacctctttgtctctgccgc

SEQ ID NO: 7273076 - DNA, 22 bp, Homo sapiens
gccacctggacagctgtgccct

SEQ ID NO: 7273077 - DNA, 22 bp, Homo sapiens
gccacctggactcagagccagg

SEQ ID NO: 7273078 - DNA, 22 bp, Homo sapiens
gcctccaccgaacgctctcttg

SEQ ID NO: 7273079 - DNA, 22 bp, Homo sapiens
gcctccacccctggggagtgga

SEQ ID NO: 7273080 - DNA, 22 bp, Homo sapiens
gcctccactgatcagacttgac

SEQ ID NO: 7273081 - DNA, 22 bp, Homo sapiens
gcctccacttctttagtatgac

SEQ ID NO: 7273082 - DNA, 21 bp, Homo sapiens
gcctgcagttttgaagccctt

SEQ ID NO: 7273083 - DNA, 22 bp, Homo sapiens
gcctgcagtgagtgcagaaggt

SEQ ID NO: 7273084 - DNA, 19 bp, Homo sapiens
gccctgagtaagctaggag

SEQ ID NO: 7273085 - DNA, 22 bp, Homo sapiens
gcccctctccttgtgcacctgc

SEQ ID NO: 7273086 - DNA, 23 bp, Homo sapiens
gccctgctcctggctgggaggga

SEQ ID NO: 7273087 - DNA, 17 bp, Homo sapiens
gccctgcctgctgccct

SEQ ID NO: 7273088 - DNA, 22 bp, Homo sapiens
gccctgctgctggcagaggcgc

SEQ ID NO: 7273089 - DNA, 22 bp, Homo sapiens
gccctgctgtttagagagctac

SEQ ID NO: 7273090 - DNA, 20 bp, Homo sapiens
gcctccacactcacccctta

SEQ ID NO: 7273091 - DNA, 20 bp, Homo sapiens
gcctccaccccaggcttcag

SEQ ID NO: 7273092 - DNA, 18 bp, Homo sapiens
gcctccaccatggagggt

SEQ ID NO: 7273093 - DNA, 22 bp, Homo sapiens
gcctcagttgatctgtgtgagc

SEQ ID NO: 7273094 - DNA, 22 bp, Homo sapiens
ctggtgtttattacaggtgctc

SEQ ID NO: 7273095 - DNA, 22 bp, Homo sapiens
ctggtgtttatctgactgccta

SEQ ID NO: 7273096 - DNA, 22 bp, Homo sapiens
ctggtgttgtccgggtgagagt

SEQ ID NO: 7273097 - DNA, 22 bp, Homo sapiens
ctggtgttggagcaaatgcagg

SEQ ID NO: 7273098 - DNA, 22 bp, Homo sapiens
ctggtaggggtgactgttatcg

SEQ ID NO: 7273099 - DNA, 22 bp, Homo sapiens
ctgggtgtcaggagacatgatg

SEQ ID NO: 7273100 - DNA, 22 bp, Homo sapiens
ctgggtgtagcccagtatgagg

SEQ ID NO: 7273101 - DNA, 22 bp, Homo sapiens
ctgggtgttgggtactgaccgt

SEQ ID NO: 7273102 - DNA, 22 bp, Homo sapiens
ctgggtgtagatggaagtttgg

SEQ ID NO: 7273103 - DNA, 22 bp, Homo sapiens
ctggggtcagggatcagagagc

SEQ ID NO: 7273104 - DNA, 22 bp, Homo sapiens
ctggggtggtgcaggcctcatg

SEQ ID NO: 7273105 - DNA, 22 bp, Homo sapiens
ctgggggccttacggaactcca

SEQ ID NO: 7273106 - DNA, 22 bp, Homo sapiens
ctgggcctcatgcacagagatg

SEQ ID NO: 7273107 - DNA, 22 bp, Homo sapiens
ctgggctcaaatcctggccctg

SEQ ID NO: 7273108 - DNA, 22 bp, Homo sapiens
ctgggctcagtggctcatggct

SEQ ID NO: 7273109 - DNA, 22 bp, Homo sapiens
ctgggatgggaactgagaatca

SEQ ID NO: 7273110 - DNA, 22 bp, Homo sapiens
ctgtgaattaagtattgttatc

SEQ ID NO: 7273111 - DNA, 20 bp, Homo sapiens
ctgtggaattttaccatgcg

SEQ ID NO: 7273112 - DNA, 22 bp, Homo sapiens
ctgtggaattgatgcttagtgt

SEQ ID NO: 7273113 - DNA, 22 bp, Homo sapiens
ctgtccccacccaaatctcatc

SEQ ID NO: 7273114 - DNA, 22 bp, Homo sapiens
ctgtcccctgtgctttcacttg

SEQ ID NO: 7273115 - DNA, 22 bp, Homo sapiens
ctgtccccgcgagtccagagct

SEQ ID NO: 7273116 - DNA, 22 bp, Homo sapiens
ctgtccatggtgctggacggtc

SEQ ID NO: 7273117 - DNA, 22 bp, Homo sapiens
ctgtccatattcaaggggtagg

SEQ ID NO: 7273118 - DNA, 22 bp, Homo sapiens
ctgtggctttctctgcctcctt

SEQ ID NO: 7273119 - DNA, 22 bp, Homo sapiens
ctgtggctttgcagggcttgtt

SEQ ID NO: 7273120 - DNA, 22 bp, Homo sapiens
ctgtggctttctctgcctcctt

SEQ ID NO: 7273121 - DNA, 22 bp, Homo sapiens
ctgtggcttctgggtcagttca

SEQ ID NO: 7273122 - DNA, 22 bp, Homo sapiens
ctgtggcttctgcttgggcctc

SEQ ID NO: 7273123 - DNA, 22 bp, Homo sapiens
ctgtggcttctaggtccccgat

SEQ ID NO: 7273124 - DNA, 22 bp, Homo sapiens
ctgtgtgagtgactgcatctca

SEQ ID NO: 7273125 - DNA, 22 bp, Homo sapiens
ctgtggtggcacagcgggctgg

SEQ ID NO: 7273126 - DNA, 20 bp, Homo sapiens
ctgtggtgagcaggagagta

SEQ ID NO: 7273127 - DNA, 22 bp, Homo sapiens
ctgtggtcaccaggctggggcc

SEQ ID NO: 7273128 - DNA, 22 bp, Homo sapiens
ctgtgtttctgagaagtgggga

SEQ ID NO: 7273129 - DNA, 22 bp, Homo sapiens
ctgtgtttttggtctgatctat

SEQ ID NO: 7273130 - DNA, 22 bp, Homo sapiens
ctgtgttttgagatattattaa

SEQ ID NO: 7273131 - DNA, 22 bp, Homo sapiens
ctgtgtttggacaacttttcag

SEQ ID NO: 7273132 - DNA, 22 bp, Homo sapiens
ctgtgtttgacaggcggtctcc

SEQ ID NO: 7273133 - DNA, 22 bp, Homo sapiens
gaaactttcatgaatataagat

SEQ ID NO: 7273134 - DNA, 22 bp, Homo sapiens
gaaagaatcaactatgtctctg

SEQ ID NO: 7273135 - DNA, 22 bp, Homo sapiens
gaaactagatgtattagagatt

SEQ ID NO: 7273136 - DNA, 22 bp, Homo sapiens
gaaaccctgagaggtggtctgg

SEQ ID NO: 7273137 - DNA, 22 bp, Homo sapiens
gaaattattgctagagactgca

SEQ ID NO: 7273138 - DNA, 22 bp, Homo sapiens
gaaattcaggacaaagactctt

SEQ ID NO: 7273139 - DNA, 22 bp, Homo sapiens
gaacttcttctttaagagactc

SEQ ID NO: 7273140 - DNA, 22 bp, Homo sapiens
gaacttcttcaacataatggac

SEQ ID NO: 7273141 - DNA, 22 bp, Homo sapiens
gaacttgagcaacactgagtga

SEQ ID NO: 7273142 - DNA, 22 bp, Homo sapiens
gaactttaaaacaaagtacagt

SEQ ID NO: 7273143 - DNA, 22 bp, Homo sapiens
gaacttgttgtaagaaaatatg

SEQ ID NO: 7273144 - DNA, 22 bp, Homo sapiens
gaactttaaaacaaagtacagt

SEQ ID NO: 7273145 - DNA, 22 bp, Homo sapiens
gaaatacaggaatgccacacag

SEQ ID NO: 7273146 - DNA, 22 bp, Homo sapiens
gaaatattcttgtcttgttttc

SEQ ID NO: 7273147 - DNA, 22 bp, Homo sapiens
gaaatattacagtggaggggat

SEQ ID NO: 7273148 - DNA, 22 bp, Homo sapiens
gaaatatttctcttgagcccct

SEQ ID NO: 7273149 - DNA, 22 bp, Homo sapiens
gaaatattgtactggagatgtt

SEQ ID NO: 7273150 - DNA, 22 bp, Homo sapiens
gaaatattgggactcagagctt

SEQ ID NO: 7273151 - DNA, 22 bp, Homo sapiens
cttcacagtctttatttcctcc

SEQ ID NO: 7273152 - DNA, 22 bp, Homo sapiens
cttcacagtcaccctgctgtgt

SEQ ID NO: 7273153 - DNA, 22 bp, Homo sapiens
cttcacagtaaatccagaagaa

SEQ ID NO: 7273154 - DNA, 22 bp, Homo sapiens
cttcacagaataaactcattat

SEQ ID NO: 7273155 - DNA, 22 bp, Homo sapiens
cttcacagagtccctgattgtt

SEQ ID NO: 7273156 - DNA, 22 bp, Homo sapiens
cttcttcaacctgaaagtttca

SEQ ID NO: 7273157 - DNA, 22 bp, Homo sapiens
cttcttcaagagaatgggagac

SEQ ID NO: 7273158 - DNA, 22 bp, Homo sapiens
cttcttcagcacaatattgatg

SEQ ID NO: 7273159 - DNA, 22 bp, Homo sapiens
cttcttcacactggtctgaagc

SEQ ID NO: 7273160 - DNA, 22 bp, Homo sapiens
cttcttcaatagcaagcgcata

SEQ ID NO: 7273161 - DNA, 22 bp, Homo sapiens
cttcttcatctgtaaaacttgg

SEQ ID NO: 7273162 - DNA, 22 bp, Homo sapiens
cttcttcatctgtaaaacttgg

SEQ ID NO: 7273163 - DNA, 22 bp, Homo sapiens
cttcttcagttgcatgtattgg

SEQ ID NO: 7273164 - DNA, 22 bp, Homo sapiens
cttcttcataggcagtcctgtt

SEQ ID NO: 7273165 - DNA, 20 bp, Homo sapiens
cttcttcagtagtttgttct

SEQ ID NO: 7273166 - DNA, 20 bp, Homo sapiens
cttcttcagcctatgcttca

SEQ ID NO: 7273167 - DNA, 22 bp, Homo sapiens
cttcccagaccttagagtgcag

SEQ ID NO: 7273168 - DNA, 22 bp, Homo sapiens
ctttccaatgcatttccaatgt

SEQ ID NO: 7273169 - DNA, 22 bp, Homo sapiens
ctttccaagaatgcagatacct

SEQ ID NO: 7273170 - DNA, 23 bp, Homo sapiens
ctttcctttctttgacacccagc

SEQ ID NO: 7273171 - DNA, 22 bp, Homo sapiens
cttgcttcattagtgtcttagt

SEQ ID NO: 7273172 - DNA, 22 bp, Homo sapiens
cttcttcatgtattgatagtct

SEQ ID NO: 7273173 - DNA, 20 bp, Homo sapiens
cttcttcattaaccctactg

SEQ ID NO: 7273174 - DNA, 19 bp, Homo sapiens
cttcttcttggcagccaag

SEQ ID NO: 7273175 - DNA, 22 bp, Homo sapiens
cttgcctccctcagctcacagc

SEQ ID NO: 7273176 - DNA, 22 bp, Homo sapiens
cttgcctccctcagctcacagc

SEQ ID NO: 7273177 - DNA, 18 bp, Homo sapiens
gagaggagccagaatttt

SEQ ID NO: 7273178 - DNA, 22 bp, Homo sapiens
gagaggagtagacactttggtt

SEQ ID NO: 7273179 - DNA, 22 bp, Homo sapiens
gagaggaggtggctatgacagc

SEQ ID NO: 7273180 - DNA, 22 bp, Homo sapiens
gagagcaggaggcagcgggacg

SEQ ID NO: 7273181 - DNA, 18 bp, Homo sapiens
gagagcccagcaggtggt

SEQ ID NO: 7273182 - DNA, 22 bp, Homo sapiens
gagagcaggaggcagcgggacg

SEQ ID NO: 7273183 - DNA, 22 bp, Homo sapiens
gagagacccagacaccatgcat

SEQ ID NO: 7273184 - DNA, 22 bp, Homo sapiens
gagagaccttgctaagtgcctt

SEQ ID NO: 7273185 - DNA, 22 bp, Homo sapiens
gagagacctcagaaacaatcta

SEQ ID NO: 7273186 - DNA, 22 bp, Homo sapiens
gagagacagcacacagtgtggg

SEQ ID NO: 7273187 - DNA, 22 bp, Homo sapiens
gagaagctctagaggtgttttt

SEQ ID NO: 7273188 - DNA, 18 bp, Homo sapiens
gagaagctgattgaatgc

SEQ ID NO: 7273189 - DNA, 22 bp, Homo sapiens
gagaagccgagtcagctgagcc

SEQ ID NO: 7273190 - DNA, 22 bp, Homo sapiens
gagaacagtgttgtattttttc

SEQ ID NO: 7273191 - DNA, 22 bp, Homo sapiens
gagaactcagacgcaggtcatg

SEQ ID NO: 7273192 - DNA, 22 bp, Homo sapiens
gagaacttcaggattattcaag

SEQ ID NO: 7273193 - DNA, 22 bp, Homo sapiens
gagaacaggctctggagtcaga

SEQ ID NO: 7273194 - DNA, 22 bp, Homo sapiens
gagaacaggctctggagtcaga

SEQ ID NO: 7273195 - DNA, 22 bp, Homo sapiens
gagcaaggtagctctctggggc

SEQ ID NO: 7273196 - DNA, 22 bp, Homo sapiens
gagcaaggatggccggggccgt

SEQ ID NO: 7273197 - DNA, 22 bp, Homo sapiens
gagcaaggagggtggggccttt

SEQ ID NO: 7273198 - DNA, 22 bp, Homo sapiens
gagcaaggatgggtctatagta

SEQ ID NO: 7273199 - DNA, 22 bp, Homo sapiens
gagaggcaggcgctgcaatggt

SEQ ID NO: 7273200 - DNA, 22 bp, Homo sapiens
gagaggagttactatttccgag

SEQ ID NO: 7273201 - DNA, 22 bp, Homo sapiens
gagaggcagaggcctgaaaccg

SEQ ID NO: 7273202 - DNA, 22 bp, Homo sapiens
gagaggatccacaaaccaggaa

SEQ ID NO: 7273203 - DNA, 22 bp, Homo sapiens
gagcaccaaggctctgccatgg

SEQ ID NO: 7273204 - DNA, 22 bp, Homo sapiens
gacctggaggatcctcttcttg

SEQ ID NO: 7273205 - DNA, 22 bp, Homo sapiens
gacatgtttgctatagggattt

SEQ ID NO: 7273206 - DNA, 22 bp, Homo sapiens
gacatgttgaagaatatttgga

SEQ ID NO: 7273207 - DNA, 22 bp, Homo sapiens
gacatgttatctctggcttcaa

SEQ ID NO: 7273208 - DNA, 20 bp, Homo sapiens
gacatgtctttctcacacaa

SEQ ID NO: 7273209 - DNA, 22 bp, Homo sapiens
gaccttcttgctgtgtcctaac

SEQ ID NO: 7273210 - DNA, 23 bp, Homo sapiens
gacctggctttgaatcttgactc

SEQ ID NO: 7273211 - DNA, 22 bp, Homo sapiens
gacctggcctgcacagccctta

SEQ ID NO: 7273212 - DNA, 22 bp, Homo sapiens
gacctggggtaagcttggcaac

SEQ ID NO: 7273213 - DNA, 17 bp, Homo sapiens
gacatcagtacttacag

SEQ ID NO: 7273214 - DNA, 22 bp, Homo sapiens
gacatcaggcctgcagtctggg

SEQ ID NO: 7273215 - DNA, 22 bp, Homo sapiens
gacatcaggaagacatgagagg

SEQ ID NO: 7273216 - DNA, 22 bp, Homo sapiens
gacatcaggaagacatgagagg

SEQ ID NO: 7273217 - DNA, 22 bp, Homo sapiens
gacagctggcagtggaaaggtg

SEQ ID NO: 7273218 - DNA, 22 bp, Homo sapiens
gacagcagggacatgtaggaag

SEQ ID NO: 7273219 - DNA, 22 bp, Homo sapiens
gacagccaggtctgatgaccca

SEQ ID NO: 7273220 - DNA, 22 bp, Homo sapiens
gacagcagccacagggagaggg

SEQ ID NO: 7273221 - DNA, 18 bp, Homo sapiens
gacagcagcttttgttct

SEQ ID NO: 7273222 - DNA, 18 bp, Homo sapiens
gacaaatgcaatttaaag

SEQ ID NO: 7273223 - DNA, 22 bp, Homo sapiens
gaatttatctacgttaagtatg

SEQ ID NO: 7273224 - DNA, 22 bp, Homo sapiens
gaattaattgtgtggtttgaat

SEQ ID NO: 7273225 - DNA, 22 bp, Homo sapiens
gaagaagtatttttgtcctgtt

SEQ ID NO: 7273226 - DNA, 22 bp, Homo sapiens
gagtaaggctgctgatggagtg

SEQ ID NO: 7273227 - DNA, 22 bp, Homo sapiens
gaggtggaaggcaggaacaaat

SEQ ID NO: 7273228 - DNA, 22 bp, Homo sapiens
gagggtgggccagatatgaggg

SEQ ID NO: 7273229 - DNA, 22 bp, Homo sapiens
gagggtgggtttcttgcacgtc

SEQ ID NO: 7273230 - DNA, 22 bp, Homo sapiens
gaggctagagcaggggctcaat

SEQ ID NO: 7273231 - DNA, 22 bp, Homo sapiens
gaggctagatgtttgctgggag

SEQ ID NO: 7273232 - DNA, 22 bp, Homo sapiens
gaggcggaggttgcagtgagcc

SEQ ID NO: 7273233 - DNA, 22 bp, Homo sapiens
gaggcggaggttgcagtgagct

SEQ ID NO: 7273234 - DNA, 22 bp, Homo sapiens
gaggctggttctgaagtactgt

SEQ ID NO: 7273235 - DNA, 22 bp, Homo sapiens
gaggctggtaggaaaggaaaca

SEQ ID NO: 7273236 - DNA, 19 bp, Homo sapiens
gaggcgaggcgtgcaggag

SEQ ID NO: 7273237 - DNA, 22 bp, Homo sapiens
gaggcgagaagctggagatggt

SEQ ID NO: 7273238 - DNA, 22 bp, Homo sapiens
gagggaatggtgtgcaagaggt

SEQ ID NO: 7273239 - DNA, 22 bp, Homo sapiens
gagggccagcagcctcagcatg

SEQ ID NO: 7273240 - DNA, 22 bp, Homo sapiens
gagggccagcagcctcagcatg

SEQ ID NO: 7273241 - DNA, 22 bp, Homo sapiens
gagggccaggcagcaagaaggc

SEQ ID NO: 7273242 - DNA, 22 bp, Homo sapiens
gagctcagcccaaagagcagtg

SEQ ID NO: 7273243 - DNA, 22 bp, Homo sapiens
gagctcaggagcatcagaagaa

SEQ ID NO: 7273244 - DNA, 22 bp, Homo sapiens
gagctcattcattcattgcctg

SEQ ID NO: 7273245 - DNA, 22 bp, Homo sapiens
gagctcattcattcattgcctg

SEQ ID NO: 7273246 - DNA, 22 bp, Homo sapiens
gagcaggcattctagtggctga

SEQ ID NO: 7273247 - DNA, 22 bp, Homo sapiens
gagctgtgcttataccaattca

SEQ ID NO: 7273248 - DNA, 17 bp, Homo sapiens
gaggacagggaagtagg

SEQ ID NO: 7273249 - DNA, 22 bp, Homo sapiens
gagctgtccgcccctgggccga

SEQ ID NO: 7273250 - DNA, 22 bp, Homo sapiens
gagctgtccaagatggtcgtaa

SEQ ID NO: 7273251 - DNA, 22 bp, Homo sapiens
gagctgggatttgaacctggga

SEQ ID NO: 7273252 - DNA, 22 bp, Homo sapiens
gagctcctggattgctcctagg

SEQ ID NO: 7273253 - DNA, 22 bp, Homo sapiens
gagctgggcctcagaacacagt

SEQ ID NO: 7273254 - DNA, 22 bp, Homo sapiens
gagctccagggaacagcagcta

SEQ ID NO: 7273255 - DNA, 22 bp, Homo sapiens
gagctccagggaacagcagcta

SEQ ID NO: 7273256 - DNA, 22 bp, Homo sapiens
gaggagagagggactgtctgca

SEQ ID NO: 7273257 - DNA, 18 bp, Homo sapiens
gaggatggaaggagatgc

SEQ ID NO: 7273258 - DNA, 18 bp, Homo sapiens
gaggatggaaggagatgc

SEQ ID NO: 7273259 - DNA, 22 bp, Homo sapiens
gaggagagaacattcctccata

SEQ ID NO: 7273260 - DNA, 22 bp, Homo sapiens
gaggagagaagctaacggtgct

SEQ ID NO: 7273261 - DNA, 22 bp, Homo sapiens
gaggcatgcagagctggagcag

SEQ ID NO: 7273262 - DNA, 22 bp, Homo sapiens
gaggcatggcctgaggctagga

SEQ ID NO: 7273263 - DNA, 22 bp, Homo sapiens
gaggcaacacatttggaaagca

SEQ ID NO: 7273264 - DNA, 22 bp, Homo sapiens
gaggatggaggtgtgagctatg

SEQ ID NO: 7273265 - DNA, 22 bp, Homo sapiens
gaggatggaggcagttagggcc

SEQ ID NO: 7273266 - DNA, 22 bp, Homo sapiens
gaggatggaggcagttagggcc

SEQ ID NO: 7273267 - DNA, 22 bp, Homo sapiens
gaggatggtatgaggcaagcaa

SEQ ID NO: 7273268 - DNA, 22 bp, Homo sapiens
gaggccagagttccccgagtca

SEQ ID NO: 7273269 - DNA, 22 bp, Homo sapiens
gaggccagaagtgcctcgggct

SEQ ID NO: 7273270 - DNA, 22 bp, Homo sapiens
gaggccacttcctactggagga

SEQ ID NO: 7273271 - DNA, 22 bp, Homo sapiens
cggggccctggggctgaaggtc

SEQ ID NO: 7273272 - DNA, 22 bp, Homo sapiens
cgggcaaggcgagactaggccc

SEQ ID NO: 7273273 - DNA, 22 bp, Homo sapiens
ttcaaatacattctttgccact

SEQ ID NO: 7273274 - DNA, 22 bp, Homo sapiens
cggagtcttgctatgttgccca

SEQ ID NO: 7273275 - DNA, 22 bp, Homo sapiens
cggagaggtgggggcagcatct

SEQ ID NO: 7273276 - DNA, 22 bp, Homo sapiens
cggagtcttgctatgttgccca

SEQ ID NO: 7273277 - DNA, 22 bp, Homo sapiens
cggagaggacctgcaactcgct

SEQ ID NO: 7273278 - DNA, 22 bp, Homo sapiens
cggcagagccctgagtcagcct

SEQ ID NO: 7273279 - DNA, 22 bp, Homo sapiens
cggcagagacggcgctttgaac

SEQ ID NO: 7273280 - DNA, 22 bp, Homo sapiens
cggcagagcggcgagcccctcc

SEQ ID NO: 7273281 - DNA, 22 bp, Homo sapiens
cggcagcaaaggaagccaggtc

SEQ ID NO: 7273282 - DNA, 22 bp, Homo sapiens
cggcagagtgtgtgcgtgcatg

SEQ ID NO: 7273283 - DNA, 22 bp, Homo sapiens
cggcagagcttcctgctcagcg

SEQ ID NO: 7273284 - DNA, 18 bp, Homo sapiens
cggcagagtgcttctagc

SEQ ID NO: 7273285 - DNA, 22 bp, Homo sapiens
cggcagctcgagggccacccgt

SEQ ID NO: 7273286 - DNA, 22 bp, Homo sapiens
cggcagctccgcgccgtaggac

SEQ ID NO: 7273287 - DNA, 22 bp, Homo sapiens
cggcagcatcgaaactacattc

SEQ ID NO: 7273288 - DNA, 22 bp, Homo sapiens
cggcagctgattgcagagcacc

SEQ ID NO: 7273289 - DNA, 22 bp, Homo sapiens
ttatccaacatgacttatgtcc

SEQ ID NO: 7273290 - DNA, 22 bp, Homo sapiens
ttatccaagcagaagctgcaca

SEQ ID NO: 7273291 - DNA, 22 bp, Homo sapiens
ccttttctatgtaccagcagtg

SEQ ID NO: 7273292 - DNA, 22 bp, Homo sapiens
ccttttgctctcccatccagaa

SEQ ID NO: 7273293 - DNA, 22 bp, Homo sapiens
ccttttgctctcccatccagaa

SEQ ID NO: 7273294 - DNA, 22 bp, Homo sapiens
ccttttgagacttccactgtgt

SEQ ID NO: 7273295 - DNA, 22 bp, Homo sapiens
ttattgcaaaggaagagcttga

SEQ ID NO: 7273296 - DNA, 22 bp, Homo sapiens
ttattgcaaccttttctggtgt

SEQ ID NO: 7273297 - DNA, 22 bp, Homo sapiens
ttatttcatataatgttatcaa

SEQ ID NO: 7273298 - DNA, 22 bp, Homo sapiens
ttatttattgtgtacctactgt

SEQ ID NO: 7273299 - DNA, 23 bp, Homo sapiens
ttattgcaaggtaaaattgctga

SEQ ID NO: 7273300 - DNA, 17 bp, Homo sapiens
ttattgcagtgctgaag

SEQ ID NO: 7273301 - DNA, 22 bp, Homo sapiens
ttatttcatgtaaaatttatgt

SEQ ID NO: 7273302 - DNA, 22 bp, Homo sapiens
ccttacaatgcagtttacttag

SEQ ID NO: 7273303 - DNA, 21 bp, Homo sapiens
cctgtgtgtgtccctttaaga

SEQ ID NO: 7273304 - DNA, 22 bp, Homo sapiens
ttaagatagaacccagtagtct

SEQ ID NO: 7273305 - DNA, 22 bp, Homo sapiens
ttaagatagaacccagtagtct

SEQ ID NO: 7273306 - DNA, 22 bp, Homo sapiens
ccttgactgccttcaggctggg

SEQ ID NO: 7273307 - DNA, 22 bp, Homo sapiens
ccttgagccagggagctggcag

SEQ ID NO: 7273308 - DNA, 22 bp, Homo sapiens
ttatattagttagacttgctgt

SEQ ID NO: 7273309 - DNA, 22 bp, Homo sapiens
ttataaagtgagaagtgctatg

SEQ ID NO: 7273310 - DNA, 22 bp, Homo sapiens
ttataaaggtttgtgcatattt

SEQ ID NO: 7273311 - DNA, 22 bp, Homo sapiens
ttatcacttatgagctttttgc

SEQ ID NO: 7273312 - DNA, 22 bp, Homo sapiens
ttatattgtgtaataagtgaag

SEQ ID NO: 7273313 - DNA, 22 bp, Homo sapiens
ttacataacggtatgaaaaatg

SEQ ID NO: 7273314 - DNA, 22 bp, Homo sapiens
ctccactcaccagatgccagga

SEQ ID NO: 7273315 - DNA, 22 bp, Homo sapiens
ctccactcaacaagcccagtgt

SEQ ID NO: 7273316 - DNA, 22 bp, Homo sapiens
ctccagagtcacactgcctggg

SEQ ID NO: 7273317 - DNA, 22 bp, Homo sapiens
ctccagagggtcagactctgag

SEQ ID NO: 7273318 - DNA, 22 bp, Homo sapiens
ctccagaggccctatcccacta

SEQ ID NO: 7273319 - DNA, 22 bp, Homo sapiens
ctccagaggaaagcacatagtg

SEQ ID NO: 7273320 - DNA, 22 bp, Homo sapiens
ttgcccagagtccacagcgtac

SEQ ID NO: 7273321 - DNA, 22 bp, Homo sapiens
ttgcccaggctggagtgcagta

SEQ ID NO: 7273322 - DNA, 22 bp, Homo sapiens
ttgcccaggctggagtgcagtg

SEQ ID NO: 7273323 - DNA, 18 bp, Homo sapiens
ctcagggtgaccaatgca

SEQ ID NO: 7273324 - DNA, 22 bp, Homo sapiens
ttgcagaacttaaagacagagt

SEQ ID NO: 7273325 - DNA, 22 bp, Homo sapiens
ctcagccccaatttgccctctt

SEQ ID NO: 7273326 - DNA, 22 bp, Homo sapiens
cgtttattttgaagattccact

SEQ ID NO: 7273327 - DNA, 22 bp, Homo sapiens
ctaaaaatccacactaggtgaa

SEQ ID NO: 7273328 - DNA, 22 bp, Homo sapiens
ttctatttccagtccttcagag

SEQ ID NO: 7273329 - DNA, 22 bp, Homo sapiens
ttctatttcttaatcttggctg

SEQ ID NO: 7273330 - DNA, 17 bp, Homo sapiens
ctcagagcaggacagaa

SEQ ID NO: 7273331 - DNA, 21 bp, Homo sapiens
ctcagagcagttcagagggat

SEQ ID NO: 7273332 - DNA, 22 bp, Homo sapiens
ctatacatcccaatttcagaga

SEQ ID NO: 7273333 - DNA, 22 bp, Homo sapiens
ctggagcaaaagtgactcctct

SEQ ID NO: 7273334 - DNA, 22 bp, Homo sapiens
ctggagccccaggctgtgcaga

SEQ ID NO: 7273335 - DNA, 22 bp, Homo sapiens
ctggaaggggcagtctttgggc

SEQ ID NO: 7273336 - DNA, 22 bp, Homo sapiens
ctggaagggaaatctcttggca

SEQ ID NO: 7273337 - DNA, 22 bp, Homo sapiens
ctggaagggagcactgtagaga

SEQ ID NO: 7273338 - DNA, 22 bp, Homo sapiens
ctgcgcaggggtggcgccagaa

SEQ ID NO: 7273339 - DNA, 22 bp, Homo sapiens
ctgcgcagcaatcagagaggag

SEQ ID NO: 7273340 - DNA, 21 bp, Homo sapiens
ctgctctgacagtgaggccag

SEQ ID NO: 7273341 - DNA, 22 bp, Homo sapiens
ctgccttgtcttgttttcaggg

SEQ ID NO: 7273342 - DNA, 22 bp, Homo sapiens
ctgccttggccctagttcatgg

SEQ ID NO: 7273343 - DNA, 22 bp, Homo sapiens
ctgctctgaccctttcaccttc

SEQ ID NO: 7273344 - DNA, 22 bp, Homo sapiens
ctgctctgtggtccatgagaca

SEQ ID NO: 7273345 - DNA, 22 bp, Homo sapiens
ctgctctgttcccccatcatct

SEQ ID NO: 7273346 - DNA, 22 bp, Homo sapiens
ctgcctggggaatgtgaggatt

SEQ ID NO: 7273347 - DNA, 22 bp, Homo sapiens
ctgccttcatctctgagctggg

SEQ ID NO: 7273348 - DNA, 22 bp, Homo sapiens
ctgccttgaaaatgaagcttta

SEQ ID NO: 7273349 - DNA, 22 bp, Homo sapiens
ctgctgtcaaaaatcactccat

SEQ ID NO: 7273350 - DNA, 22 bp, Homo sapiens
ctgctgtccaggagtgccctgt

SEQ ID NO: 7273351 - DNA, 22 bp, Homo sapiens
ttttgcttgagtgcacaaaatg

SEQ ID NO: 7273352 - DNA, 22 bp, Homo sapiens
ttttgcttgagtgcacaaaatg

SEQ ID NO: 7273353 - DNA, 22 bp, Homo sapiens
ttttgcttttgtaacacagtgt

SEQ ID NO: 7273354 - DNA, 22 bp, Homo sapiens
ctcttcttatggccgtggctga

SEQ ID NO: 7273355 - DNA, 22 bp, Homo sapiens
ctcttcttatggccgtggctga

SEQ ID NO: 7273356 - DNA, 22 bp, Homo sapiens
ctcttcttatggccgtggctga

SEQ ID NO: 7273357 - DNA, 22 bp, Homo sapiens
ctcttcttgaaagaggaattca

SEQ ID NO: 7273358 - DNA, 22 bp, Homo sapiens
ctgaggccgtctgggtctgcag

SEQ ID NO: 7273359 - DNA, 22 bp, Homo sapiens
ctgagcatccagcaggtactgc

SEQ ID NO: 7273360 - DNA, 22 bp, Homo sapiens
ctgagcatttgtgcagcttctc

SEQ ID NO: 7273361 - DNA, 22 bp, Homo sapiens
ctgaggctcaagggcaggtggg

SEQ ID NO: 7273362 - DNA, 22 bp, Homo sapiens
ctgaggctaacctcgagagaca

SEQ ID NO: 7273363 - DNA, 22 bp, Homo sapiens
ctgaggcctgggggcgtggacg

SEQ ID NO: 7273364 - DNA, 22 bp, Homo sapiens
ctgaggctggagtgcagtggtg

SEQ ID NO: 7273365 - DNA, 22 bp, Homo sapiens
ctgaggtcaggagttcaagctg

SEQ ID NO: 7273366 - DNA, 22 bp, Homo sapiens
ctgaggtcctcagagggaaagg

SEQ ID NO: 7273367 - DNA, 22 bp, Homo sapiens
ctgaggtctagacaccccaggg

SEQ ID NO: 7273368 - DNA, 22 bp, Homo sapiens
ctgaggtccttgactgcttgcc

SEQ ID NO: 7273369 - DNA, 22 bp, Homo sapiens
ctgaggctcagcgtgaggaaag

SEQ ID NO: 7273370 - DNA, 22 bp, Homo sapiens
ctgaggctgagacaggtgaaat

SEQ ID NO: 7273371 - DNA, 22 bp, Homo sapiens
ctgaggtgagaggaggccatgt

SEQ ID NO: 7273372 - DNA, 22 bp, Homo sapiens
ctgaggtctattttgaaactgc

SEQ ID NO: 7273373 - DNA, 22 bp, Homo sapiens
ctgaggtctctttccatagtga

SEQ ID NO: 7273374 - DNA, 23 bp, Homo sapiens
ctgaggtctgcaattctagtagt

SEQ ID NO: 7273375 - DNA, 22 bp, Homo sapiens
ctgaggtggcatcctagctcta

SEQ ID NO: 7273376 - DNA, 22 bp, Homo sapiens
ctgcccaggctgaaggaacatc

SEQ ID NO: 7273377 - DNA, 22 bp, Homo sapiens
ctgcccaggaaggagaggatgg

SEQ ID NO: 7273378 - DNA, 22 bp, Homo sapiens
ctgccccagcctggggccttct

SEQ ID NO: 7273379 - DNA, 22 bp, Homo sapiens
ctgccccatggtccctggtggg

SEQ ID NO: 7273380 - DNA, 22 bp, Homo sapiens
ctgccatgttacctgcacaggt

SEQ ID NO: 7273381 - DNA, 18 bp, Homo sapiens
ctgccatgtcctactgtc

SEQ ID NO: 7273382 - DNA, 22 bp, Homo sapiens
ctgcccaggaaccagaggggca

SEQ ID NO: 7273383 - DNA, 20 bp, Homo sapiens
ctgcccagccactgagggat

SEQ ID NO: 7273384 - DNA, 21 bp, Homo sapiens
ctgcaggatgctgaagccagg

SEQ ID NO: 7273385 - DNA, 23 bp, Homo sapiens
tttgttcatcattagagtctagc

SEQ ID NO: 7273386 - DNA, 19 bp, Homo sapiens
ctctgggctgcatcttggt

SEQ ID NO: 7273387 - DNA, 22 bp, Homo sapiens
ctctgtgtggtcctctgtattg

SEQ ID NO: 7273388 - DNA, 22 bp, Homo sapiens
tttgttctaacttctgcagaca

SEQ ID NO: 7273389 - DNA, 22 bp, Homo sapiens
ctctgtgctcccatgctagtaa

SEQ ID NO: 7273390 - DNA, 22 bp, Homo sapiens
ctctgcagagcctccagcccag

SEQ ID NO: 7273391 - DNA, 22 bp, Homo sapiens
ctctgcactgtccggctttctt

SEQ ID NO: 7273392 - DNA, 22 bp, Homo sapiens
tttgcaaagtgactattatatg

SEQ ID NO: 7273393 - DNA, 22 bp, Homo sapiens
tttgcaaagaaattattgctgt

SEQ ID NO: 7273394 - DNA, 18 bp, Homo sapiens
tttgcaaaggaagtatgg

SEQ ID NO: 7273395 - DNA, 22 bp, Homo sapiens
ctccaggagggggatggctgta

SEQ ID NO: 7273396 - DNA, 22 bp, Homo sapiens
tttattcacttcagtgccaaag

SEQ ID NO: 7273397 - DNA, 22 bp, Homo sapiens
tttattcactggggtctgcccg

SEQ ID NO: 7273398 - DNA, 22 bp, Homo sapiens
tttatgtaagtggaatgatgcc

SEQ ID NO: 7273399 - DNA, 22 bp, Homo sapiens
tttcagtttatgtcttgaatta

SEQ ID NO: 7273400 - DNA, 22 bp, Homo sapiens
tttcagtttccagctttgtcat

SEQ ID NO: 7273401 - DNA, 22 bp, Homo sapiens
tttattcagcagcagcagtggt

SEQ ID NO: 7273402 - DNA, 22 bp, Homo sapiens
tttattcatcatctgttcatat

SEQ ID NO: 7273403 - DNA, 22 bp, Homo sapiens
tttattcatcatctgttcatat

SEQ ID NO: 7273404 - DNA, 22 bp, Homo sapiens
tttctacacttcgtggtgtttt

SEQ ID NO: 7273405 - DNA, 22 bp, Homo sapiens
tttctacagctggtgcaacttt

SEQ ID NO: 7273406 - DNA, 22 bp, Homo sapiens
tttcattacgtgtttgacttgt

SEQ ID NO: 7273407 - DNA, 22 bp, Homo sapiens
tttccaagagcttatttctgaa

SEQ ID NO: 7273408 - DNA, 22 bp, Homo sapiens
tttccaagactccagttctccc

SEQ ID NO: 7273409 - DNA, 22 bp, Homo sapiens
tttctcaaggtgtcatgtattt

SEQ ID NO: 7273410 - DNA, 22 bp, Homo sapiens
tttctcaaggtgtcatgtattt

SEQ ID NO: 7273411 - DNA, 22 bp, Homo sapiens
tttctcaagttcagatatttga

SEQ ID NO: 7273412 - DNA, 22 bp, Homo sapiens
tttctcaagttcagatatttga

SEQ ID NO: 7273413 - DNA, 22 bp, Homo sapiens
ctctctgttatgctttcatgaa

SEQ ID NO: 7273414 - DNA, 22 bp, Homo sapiens
ccacccttccattcttcctctt

SEQ ID NO: 7273415 - DNA, 22 bp, Homo sapiens
tcggactcggcaaggctatgca

SEQ ID NO: 7273416 - DNA, 22 bp, Homo sapiens
ccaccagcttcagcagccgcgg

SEQ ID NO: 7273417 - DNA, 22 bp, Homo sapiens
tcctttccagcctcacctcagc

SEQ ID NO: 7273418 - DNA, 22 bp, Homo sapiens
ccaccagctttgccaccctgct

SEQ ID NO: 7273419 - DNA, 22 bp, Homo sapiens
tcctctccatgtctcacgccac

SEQ ID NO: 7273420 - DNA, 22 bp, Homo sapiens
tcctgactaggagggctaaggt

SEQ ID NO: 7273421 - DNA, 22 bp, Homo sapiens
tctcaaatttgttagataaaat

SEQ ID NO: 7273422 - DNA, 22 bp, Homo sapiens
tctcaaatttgctggaccagta

SEQ ID NO: 7273423 - DNA, 22 bp, Homo sapiens
tctcaaatttatacagagttca

SEQ ID NO: 7273424 - DNA, 22 bp, Homo sapiens
tctcaaattcccttttcctcct

SEQ ID NO: 7273425 - DNA, 22 bp, Homo sapiens
tctcaaatgtaaagcatgattt

SEQ ID NO: 7273426 - DNA, 22 bp, Homo sapiens
tctccacaccagaaggagctga

SEQ ID NO: 7273427 - DNA, 20 bp, Homo sapiens
tctcagtttctagagtcagg

SEQ ID NO: 7273428 - DNA, 22 bp, Homo sapiens
tctcagtttcctcatatgtaaa

SEQ ID NO: 7273429 - DNA, 18 bp, Homo sapiens
tctccacttctgtgagaa

SEQ ID NO: 7273430 - DNA, 22 bp, Homo sapiens
tctccaggaaagacactggact

SEQ ID NO: 7273431 - DNA, 19 bp, Homo sapiens
tctccagctttgggctttt

SEQ ID NO: 7273432 - DNA, 22 bp, Homo sapiens
ccagagagctacaaggcataaa

SEQ ID NO: 7273433 - DNA, 22 bp, Homo sapiens
ccagagagattgcttctaaaga

SEQ ID NO: 7273434 - DNA, 22 bp, Homo sapiens
tctccctctttgtctgctttgg

SEQ ID NO: 7273435 - DNA, 22 bp, Homo sapiens
tctcccttggtcacagattcct

SEQ ID NO: 7273436 - DNA, 22 bp, Homo sapiens
ccagcccttcccaactggccag

SEQ ID NO: 7273437 - DNA, 22 bp, Homo sapiens
ccagccctgtttatgtgtcact

SEQ ID NO: 7273438 - DNA, 19 bp, Homo sapiens
ccagccctgtcacttcttg

SEQ ID NO: 7273439 - DNA, 22 bp, Homo sapiens
ccagcccttagataaacctggc

SEQ ID NO: 7273440 - DNA, 22 bp, Homo sapiens
ccagccctgcctctcagggccc

SEQ ID NO: 7273441 - DNA, 22 bp, Homo sapiens
ccagccctcactgaggcctctc

SEQ ID NO: 7273442 - DNA, 22 bp, Homo sapiens
ccagccacagcttccagctcct

SEQ ID NO: 7273443 - DNA, 20 bp, Homo sapiens
ccagcatgtacacatgtgga

SEQ ID NO: 7273444 - DNA, 22 bp, Homo sapiens
ccagcatggcacctgagatgag

SEQ ID NO: 7273445 - DNA, 18 bp, Homo sapiens
ccagcatgccagaggctg

SEQ ID NO: 7273446 - DNA, 22 bp, Homo sapiens
ccagcatgagacgatgatgaag

SEQ ID NO: 7273447 - DNA, 22 bp, Homo sapiens
ccagcatcgacttcctgcctga

SEQ ID NO: 7273448 - DNA, 22 bp, Homo sapiens
tctctgtgttgcaggaaaatct

SEQ ID NO: 7273449 - DNA, 22 bp, Homo sapiens
ccagcagggcagtgccctggac

SEQ ID NO: 7273450 - DNA, 22 bp, Homo sapiens
ccagcagagtctaggaaggagg

SEQ ID NO: 7273451 - DNA, 22 bp, Homo sapiens
tctctgcccatcctcagtccac

SEQ ID NO: 7273452 - DNA, 22 bp, Homo sapiens
tctctgcccatcctcagtccac

SEQ ID NO: 7273453 - DNA, 22 bp, Homo sapiens
tctctcttgtcaccccatctgc

SEQ ID NO: 7273454 - DNA, 22 bp, Homo sapiens
tctcctggctcaccaggctgga

SEQ ID NO: 7273455 - DNA, 22 bp, Homo sapiens
tcccagccacaggtgtagccct

SEQ ID NO: 7273456 - DNA, 22 bp, Homo sapiens
tcccagccacagtttccacctg

SEQ ID NO: 7273457 - DNA, 22 bp, Homo sapiens
tcccagccaggctctaccactt

SEQ ID NO: 7273458 - DNA, 22 bp, Homo sapiens
tcccagccaggctctaccactt

SEQ ID NO: 7273459 - DNA, 22 bp, Homo sapiens
tcccagccattcctttaggtgt

SEQ ID NO: 7273460 - DNA, 22 bp, Homo sapiens
tcccagcccagacttctccagt

SEQ ID NO: 7273461 - DNA, 22 bp, Homo sapiens
tcccagcccagacttctccagt

SEQ ID NO: 7273462 - DNA, 22 bp, Homo sapiens
tcccagcccagatttgtgtgac

SEQ ID NO: 7273463 - DNA, 22 bp, Homo sapiens
tcccaggagcaccttttgagcc

SEQ ID NO: 7273464 - DNA, 22 bp, Homo sapiens
tcccaggacttccagttggagg

SEQ ID NO: 7273465 - DNA, 22 bp, Homo sapiens
tcccaggacccaggcattcaca

SEQ ID NO: 7273466 - DNA, 22 bp, Homo sapiens
tcccaggacatgggctctgctc

SEQ ID NO: 7273467 - DNA, 22 bp, Homo sapiens
tcccaggacaggccacatggaa

SEQ ID NO: 7273468 - DNA, 22 bp, Homo sapiens
tcccaggaattgaagccagtgt

SEQ ID NO: 7273469 - DNA, 22 bp, Homo sapiens
tcccaggaatgtctgaaagtga

SEQ ID NO: 7273470 - DNA, 23 bp, Homo sapiens
tcccaggaatctgcatttttaac

SEQ ID NO: 7273471 - DNA, 22 bp, Homo sapiens
cattcattagaatagatatgta

SEQ ID NO: 7273472 - DNA, 22 bp, Homo sapiens
catgtttactaccaggagaatg

SEQ ID NO: 7273473 - DNA, 22 bp, Homo sapiens
catgttttctaggctttcacaa

SEQ ID NO: 7273474 - DNA, 22 bp, Homo sapiens
catgttgattagagagcttaga

SEQ ID NO: 7273475 - DNA, 22 bp, Homo sapiens
catgttatttatccattaaaca

SEQ ID NO: 7273476 - DNA, 22 bp, Homo sapiens
tcctcccctcagggcaacggat

SEQ ID NO: 7273477 - DNA, 22 bp, Homo sapiens
tcctcagcttttatttcacttg

SEQ ID NO: 7273478 - DNA, 22 bp, Homo sapiens
tcctcagctttggtttactcat

SEQ ID NO: 7273479 - DNA, 22 bp, Homo sapiens
tccctcactggttctgcatccc

SEQ ID NO: 7273480 - DNA, 22 bp, Homo sapiens
tcccaggatctgagggcagaga

SEQ ID NO: 7273481 - DNA, 22 bp, Homo sapiens
tcccaggaggtgcttcctagga

SEQ ID NO: 7273482 - DNA, 16 bp, Homo sapiens
tcccaggaggcggaac

SEQ ID NO: 7273483 - DNA, 22 bp, Homo sapiens
cattgaaatatggaaactgatg

SEQ ID NO: 7273484 - DNA, 22 bp, Homo sapiens
tccccagcattgagggtctctc

SEQ ID NO: 7273485 - DNA, 22 bp, Homo sapiens
tccccagcattgagggtctctc

SEQ ID NO: 7273486 - DNA, 22 bp, Homo sapiens
tccccagccgtgaaggagagga

SEQ ID NO: 7273487 - DNA, 22 bp, Homo sapiens
tccccagccgtgaaggagagga

SEQ ID NO: 7273488 - DNA, 22 bp, Homo sapiens
tccccagctctgtgcttccact

SEQ ID NO: 7273489 - DNA, 22 bp, Homo sapiens
tcccggcgctgggaggtgggtc

SEQ ID NO: 7273490 - DNA, 19 bp, Homo sapiens
tccccagcacctctgagtc

SEQ ID NO: 7273491 - DNA, 22 bp, Homo sapiens
catgtgttttgtcatttcaata

SEQ ID NO: 7273492 - DNA, 22 bp, Homo sapiens
catgtgtttcgagactgttgag

SEQ ID NO: 7273493 - DNA, 22 bp, Homo sapiens
catgtgttaatctttctgcaaa

SEQ ID NO: 7273494 - DNA, 22 bp, Homo sapiens
catgtgttaatctttctgcaaa

SEQ ID NO: 7273495 - DNA, 18 bp, Homo sapiens
tccaggctccaggctaac

SEQ ID NO: 7273496 - DNA, 22 bp, Homo sapiens
tccaggctcagtcaagcacttc

SEQ ID NO: 7273497 - DNA, 17 bp, Homo sapiens
tccagcctcctctgctg

SEQ ID NO: 7273498 - DNA, 22 bp, Homo sapiens
tccagctcttcagttctgcaaa

SEQ ID NO: 7273499 - DNA, 22 bp, Homo sapiens
tccagcctcctatttaccctaa

SEQ ID NO: 7273500 - DNA, 22 bp, Homo sapiens
tccagcctcatttctcctgctt

SEQ ID NO: 7273501 - DNA, 22 bp, Homo sapiens
tccagcctaatgttcttcccac

SEQ ID NO: 7273502 - DNA, 22 bp, Homo sapiens
tccagcctaggggaacagctgc

SEQ ID NO: 7273503 - DNA, 19 bp, Homo sapiens
tcatgcaatcagtgaactg

SEQ ID NO: 7273504 - DNA, 22 bp, Homo sapiens
tcatgacaggtgagtttttagg

SEQ ID NO: 7273505 - DNA, 22 bp, Homo sapiens
tcatgcaagaataataggaagg

SEQ ID NO: 7273506 - DNA, 22 bp, Homo sapiens
tcatgcaagaataataggaagg

SEQ ID NO: 7273507 - DNA, 20 bp, Homo sapiens
tcatgcaagattcataaagg

SEQ ID NO: 7273508 - DNA, 22 bp, Homo sapiens
tcatttatgcaggaatggcata

SEQ ID NO: 7273509 - DNA, 22 bp, Homo sapiens
tcattcttgatcactagttagt

SEQ ID NO: 7273510 - DNA, 22 bp, Homo sapiens
tcattctttaccaagttgtcac

SEQ ID NO: 7273511 - DNA, 22 bp, Homo sapiens
tcattccttaacattcatttgc

SEQ ID NO: 7273512 - DNA, 17 bp, Homo sapiens
tccaagccagcttgcct

SEQ ID NO: 7273513 - DNA, 22 bp, Homo sapiens
tccacaggtcctctttgcaaag

SEQ ID NO: 7273514 - DNA, 22 bp, Homo sapiens
tccacatgaccattgtgctcct

SEQ ID NO: 7273515 - DNA, 23 bp, Homo sapiens
tcagcagcagaagtgctgggatg

SEQ ID NO: 7273516 - DNA, 21 bp, Homo sapiens
tcagcagcatctgcctagagt

SEQ ID NO: 7273517 - DNA, 22 bp, Homo sapiens
tcaggaaagagtaatgtataca

SEQ ID NO: 7273518 - DNA, 22 bp, Homo sapiens
tcagcttttgtcagaaattgta

SEQ ID NO: 7273519 - DNA, 22 bp, Homo sapiens
cagtttatagttgttatgtgtg

SEQ ID NO: 7273520 - DNA, 22 bp, Homo sapiens
tcagctttgatctcaggcaatc

SEQ ID NO: 7273521 - DNA, 22 bp, Homo sapiens
cagtggcaggggaagcaggtgt

SEQ ID NO: 7273522 - DNA, 22 bp, Homo sapiens
cagtgggacatgggcactgggc

SEQ ID NO: 7273523 - DNA, 22 bp, Homo sapiens
cagtgtttgtggaattcaggtg

SEQ ID NO: 7273524 - DNA, 22 bp, Homo sapiens
cagtgtgcctgaatcaagtgtt

SEQ ID NO: 7273525 - DNA, 22 bp, Homo sapiens
tatttccacctattattttctg

SEQ ID NO: 7273526 - DNA, 22 bp, Homo sapiens
tatttccaagctgaatccaatg

SEQ ID NO: 7273527 - DNA, 22 bp, Homo sapiens
tatttccaaaagcctattatga

SEQ ID NO: 7273528 - DNA, 22 bp, Homo sapiens
tatttccaagctgaatccaatg

SEQ ID NO: 7273529 - DNA, 22 bp, Homo sapiens
cagtcccagacccagaaggtgg

SEQ ID NO: 7273530 - DNA, 22 bp, Homo sapiens
cagtcccagaagagcctgggag

SEQ ID NO: 7273531 - DNA, 22 bp, Homo sapiens
cagtcccagacatagtaaggga

SEQ ID NO: 7273532 - DNA, 20 bp, Homo sapiens
cagtccactggagttcctac

SEQ ID NO: 7273533 - DNA, 22 bp, Homo sapiens
cagtcccaaggaggaagcagtc

SEQ ID NO: 7273534 - DNA, 19 bp, Homo sapiens
cagtcccaaattcttgtca

SEQ ID NO: 7273535 - DNA, 20 bp, Homo sapiens
cagtcccaatccagggccag

SEQ ID NO: 7273536 - DNA, 22 bp, Homo sapiens
cagtcccaccaggatcgctctt

SEQ ID NO: 7273537 - DNA, 22 bp, Homo sapiens
cagtcccacaagatctccacaa

SEQ ID NO: 7273538 - DNA, 22 bp, Homo sapiens
cagtcccactagtgccaatacc

SEQ ID NO: 7273539 - DNA, 22 bp, Homo sapiens
tatttcagtcacttcttctctg

SEQ ID NO: 7273540 - DNA, 22 bp, Homo sapiens
tatttcaggtatggtgtgaaat

SEQ ID NO: 7273541 - DNA, 22 bp, Homo sapiens
tcacagtgtggcaactcacaga

SEQ ID NO: 7273542 - DNA, 22 bp, Homo sapiens
tcacagttactccttcagatga

SEQ ID NO: 7273543 - DNA, 22 bp, Homo sapiens
cagtgcatgtggcactctccag

SEQ ID NO: 7273544 - DNA, 22 bp, Homo sapiens
cagtgcatgcacacacatggta

SEQ ID NO: 7273545 - DNA, 22 bp, Homo sapiens
tcacagtttccataggtcagca

SEQ ID NO: 7273546 - DNA, 22 bp, Homo sapiens
tcacagttgattgaaacacagc

SEQ ID NO: 7273547 - DNA, 22 bp, Homo sapiens
tcacagttcaactagttcagat

SEQ ID NO: 7273548 - DNA, 22 bp, Homo sapiens
cagtgacgtaaactgcatgtgc

SEQ ID NO: 7273549 - DNA, 22 bp, Homo sapiens
tatttgaaagtgtacaaaaact

SEQ ID NO: 7273550 - DNA, 22 bp, Homo sapiens
tcaatgactggtccaaggtggc

SEQ ID NO: 7273551 - DNA, 22 bp, Homo sapiens
tcacaaatattttaacagtagg

SEQ ID NO: 7273552 - DNA, 22 bp, Homo sapiens
tcacaagaatttgtagatgaaa

SEQ ID NO: 7273553 - DNA, 22 bp, Homo sapiens
tcacaaatgaggaaatcgagca

SEQ ID NO: 7273554 - DNA, 22 bp, Homo sapiens
tcacaaatcgaagccttataat

SEQ ID NO: 7273555 - DNA, 22 bp, Homo sapiens
tcacaaatgaggaaatcgagca

SEQ ID NO: 7273556 - DNA, 22 bp, Homo sapiens
gtgaggggtggctgagcagttt

SEQ ID NO: 7273557 - DNA, 22 bp, Homo sapiens
tactcaaactcactaagacaga

SEQ ID NO: 7273558 - DNA, 22 bp, Homo sapiens
tactcattgattcctttactca

SEQ ID NO: 7273559 - DNA, 22 bp, Homo sapiens
tactgtgacagagtacttaaac

SEQ ID NO: 7273560 - DNA, 22 bp, Homo sapiens
tactgtgaatacaaaataaatt

SEQ ID NO: 7273561 - DNA, 19 bp, Homo sapiens
tagaggagaagggaagtgg

SEQ ID NO: 7273562 - DNA, 22 bp, Homo sapiens
caggctggtcccagagcattgc

SEQ ID NO: 7273563 - DNA, 22 bp, Homo sapiens
tagataatttggcatcatattg

SEQ ID NO: 7273564 - DNA, 22 bp, Homo sapiens
tagctcctggctgcagggcctc

SEQ ID NO: 7273565 - DNA, 22 bp, Homo sapiens
tagctcctccccatccaggttc

SEQ ID NO: 7273566 - DNA, 18 bp, Homo sapiens
taggagagaatttattta

SEQ ID NO: 7273567 - DNA, 22 bp, Homo sapiens
taggagagctgaactattgtct

SEQ ID NO: 7273568 - DNA, 22 bp, Homo sapiens
taggagaggtgaatggcacact

SEQ ID NO: 7273569 - DNA, 22 bp, Homo sapiens
taggagcttttggagtcctgtg

SEQ ID NO: 7273570 - DNA, 22 bp, Homo sapiens
cagggctcaccactgggatcct

SEQ ID NO: 7273571 - DNA, 22 bp, Homo sapiens
cagggctcagggactgcagaaa

SEQ ID NO: 7273572 - DNA, 21 bp, Homo sapiens
tagggcaggcattggaagaga

SEQ ID NO: 7273573 - DNA, 22 bp, Homo sapiens
tagggcaggtgaagaaaagcta

SEQ ID NO: 7273574 - DNA, 22 bp, Homo sapiens
tagggcaggggaggaatctgaa

SEQ ID NO: 7273575 - DNA, 22 bp, Homo sapiens
tatcataagttaattaaacagt

SEQ ID NO: 7273576 - DNA, 22 bp, Homo sapiens
tatcatcttgttgtcatgcagc

SEQ ID NO: 7273577 - DNA, 22 bp, Homo sapiens
tagtctggacttcttagtgtca

SEQ ID NO: 7273578 - DNA, 22 bp, Homo sapiens
caggggagttttatgcaacaga

SEQ ID NO: 7273579 - DNA, 22 bp, Homo sapiens
ccggcgtctcttccacttccta

SEQ ID NO: 7273580 - DNA, 22 bp, Homo sapiens
ccctggaggaaaatctgaggct

SEQ ID NO: 7273581 - DNA, 22 bp, Homo sapiens
cctcacagcctcatgcccagcc

SEQ ID NO: 7273582 - DNA, 22 bp, Homo sapiens
cctcacagccctcctctagcac

SEQ ID NO: 7273583 - DNA, 22 bp, Homo sapiens
ccggctcggcgaccaggctgaa

SEQ ID NO: 7273584 - DNA, 22 bp, Homo sapiens
ccgggggcgggacgagcttgac

SEQ ID NO: 7273585 - DNA, 22 bp, Homo sapiens
ccgggttgaggttcccatagat

SEQ ID NO: 7273586 - DNA, 22 bp, Homo sapiens
tggcctcagattattgcacagt

SEQ ID NO: 7273587 - DNA, 22 bp, Homo sapiens
tggcctcaatctgtcctccagc

SEQ ID NO: 7273588 - DNA, 22 bp, Homo sapiens
cctcccctgctcagaactctgg

SEQ ID NO: 7273589 - DNA, 22 bp, Homo sapiens
tggctcagcgcggcctggtctt

SEQ ID NO: 7273590 - DNA, 22 bp, Homo sapiens
tggctcagcgcggcctggtctt

SEQ ID NO: 7273591 - DNA, 22 bp, Homo sapiens
tggctcagccattcgtgttgcc

SEQ ID NO: 7273592 - DNA, 22 bp, Homo sapiens
tgctttcagatatctgtttcaa

SEQ ID NO: 7273593 - DNA, 22 bp, Homo sapiens
tgctttattttaaatatgccat

SEQ ID NO: 7273594 - DNA, 22 bp, Homo sapiens
tgcctgctaggccctgctgggt

SEQ ID NO: 7273595 - DNA, 19 bp, Homo sapiens
tgcctgctcctggcttcca

SEQ ID NO: 7273596 - DNA, 22 bp, Homo sapiens
tgcctccaccattgctcacttt

SEQ ID NO: 7273597 - DNA, 22 bp, Homo sapiens
tgcctccaacagcccatcctag

SEQ ID NO: 7273598 - DNA, 22 bp, Homo sapiens
tgcctccatgtttcagcatcta

SEQ ID NO: 7273599 - DNA, 22 bp, Homo sapiens
tgcctccaggaggggcagctct

SEQ ID NO: 7273600 - DNA, 17 bp, Homo sapiens
tgcctccagcagggtga

SEQ ID NO: 7273601 - DNA, 23 bp, Homo sapiens
tgcctccaccgagggccaggcat

SEQ ID NO: 7273602 - DNA, 22 bp, Homo sapiens
tggaaggctttgctgtccttgc

SEQ ID NO: 7273603 - DNA, 22 bp, Homo sapiens
tggaaggcttggaatacttcca

SEQ ID NO: 7273604 - DNA, 22 bp, Homo sapiens
tggaaggcctgttgtgtcctag

SEQ ID NO: 7273605 - DNA, 22 bp, Homo sapiens
tggaaggctgtgattactgtgc

SEQ ID NO: 7273606 - DNA, 22 bp, Homo sapiens
tggaaggcagtgatattgttga

SEQ ID NO: 7273607 - DNA, 22 bp, Homo sapiens
tggaaggcaggacctgccttgg

SEQ ID NO: 7273608 - DNA, 20 bp, Homo sapiens
tggaaggcatctgcattatt

SEQ ID NO: 7273609 - DNA, 22 bp, Homo sapiens
cccgggaggaggaagttgcagt

SEQ ID NO: 7273610 - DNA, 22 bp, Homo sapiens
cccgggaggcagaggttgcagt

SEQ ID NO: 7273611 - DNA, 22 bp, Homo sapiens
cccgggaggcggaggttgcagt

SEQ ID NO: 7273612 - DNA, 22 bp, Homo sapiens
cccgggaggtggaggttgcagt

SEQ ID NO: 7273613 - DNA, 22 bp, Homo sapiens
cccgggttgtccgcgcgtccgg

SEQ ID NO: 7273614 - DNA, 22 bp, Homo sapiens
tggaggggcaatggagcgcgga

SEQ ID NO: 7273615 - DNA, 19 bp, Homo sapiens
tggaggggtttgaatgtgg

SEQ ID NO: 7273616 - DNA, 19 bp, Homo sapiens
tggaggggtttgaatgtgg

SEQ ID NO: 7273617 - DNA, 22 bp, Homo sapiens
ccctggagctagtctgagcaga

SEQ ID NO: 7273618 - DNA, 22 bp, Homo sapiens
tggaggggcaatggagcgcgga

SEQ ID NO: 7273619 - DNA, 22 bp, Homo sapiens
ccctgccttggggtccacaccg

SEQ ID NO: 7273620 - DNA, 22 bp, Homo sapiens
ccctgccttcttggcctttaaa

SEQ ID NO: 7273621 - DNA, 22 bp, Homo sapiens
ccctgccttgttggagcctatg

SEQ ID NO: 7273622 - DNA, 22 bp, Homo sapiens
ccctgcagagagtgcttttgtg

SEQ ID NO: 7273623 - DNA, 22 bp, Homo sapiens
ccctgcagagaccactgacctt

SEQ ID NO: 7273624 - DNA, 22 bp, Homo sapiens
ccctgcagcattctctaactgg

SEQ ID NO: 7273625 - DNA, 22 bp, Homo sapiens
ccctgcagatcagtgagaactt

SEQ ID NO: 7273626 - DNA, 22 bp, Homo sapiens
ccctgcagatctagggtccttc

SEQ ID NO: 7273627 - DNA, 22 bp, Homo sapiens
ccctgcagagccagccctgacc

SEQ ID NO: 7273628 - DNA, 22 bp, Homo sapiens
ccctgcagtgtgacctcaccta

SEQ ID NO: 7273629 - DNA, 22 bp, Homo sapiens
ccctgcctacagggttttcttt

SEQ ID NO: 7273630 - DNA, 22 bp, Homo sapiens
tgtcaaccacttcattatgaga

SEQ ID NO: 7273631 - DNA, 16 bp, Homo sapiens
cctggaggtcacttca

SEQ ID NO: 7273632 - DNA, 18 bp, Homo sapiens
cctggaggtcttcggggt

SEQ ID NO: 7273633 - DNA, 18 bp, Homo sapiens
cctggagctccacagcaa

SEQ ID NO: 7273634 - DNA, 22 bp, Homo sapiens
cctgctttgagatgggcagcag

SEQ ID NO: 7273635 - DNA, 22 bp, Homo sapiens
cctgcttcagggatgatggcac

SEQ ID NO: 7273636 - DNA, 22 bp, Homo sapiens
tgtaatttcctgatgttagaac

SEQ ID NO: 7273637 - DNA, 22 bp, Homo sapiens
cctgccagggccagaggccagc

SEQ ID NO: 7273638 - DNA, 18 bp, Homo sapiens
cctgccagtctggagcag

SEQ ID NO: 7273639 - DNA, 22 bp, Homo sapiens
cctgctgtcccctgagcctgga

SEQ ID NO: 7273640 - DNA, 22 bp, Homo sapiens
cctgctgtctctgggcaggcag

SEQ ID NO: 7273641 - DNA, 22 bp, Homo sapiens
cctgctgtctgctgtgttaagc

SEQ ID NO: 7273642 - DNA, 22 bp, Homo sapiens
cctgctgtgaaactggcatatg

SEQ ID NO: 7273643 - DNA, 22 bp, Homo sapiens
cctgctgggcctgagcaatgag

SEQ ID NO: 7273644 - DNA, 22 bp, Homo sapiens
cctgccttccagccttgggctc

SEQ ID NO: 7273645 - DNA, 22 bp, Homo sapiens
tggctctgaccaggtagaggag

SEQ ID NO: 7273646 - DNA, 21 bp, Homo sapiens
tggctctgaaagagtgctgca

SEQ ID NO: 7273647 - DNA, 23 bp, Homo sapiens
tggctctctcagtgctgcagagg

SEQ ID NO: 7273648 - DNA, 22 bp, Homo sapiens
cctcttctgcttcaggagcact

SEQ ID NO: 7273649 - DNA, 22 bp, Homo sapiens
cctgattcagtggtgcccagag

SEQ ID NO: 7273650 - DNA, 22 bp, Homo sapiens
cctgattctgatgcctcatgga

SEQ ID NO: 7273651 - DNA, 22 bp, Homo sapiens
cctgattctgccactactagcc

SEQ ID NO: 7273652 - DNA, 22 bp, Homo sapiens
cctgcaagagcggagaagccag

SEQ ID NO: 7273653 - DNA, 22 bp, Homo sapiens
cctgcacatgtgtgcgcctgta

SEQ ID NO: 7273654 - DNA, 22 bp, Homo sapiens
cctgaggtcagccattcttgcc

SEQ ID NO: 7273655 - DNA, 22 bp, Homo sapiens
cctgaggtcacaacttgcttat

SEQ ID NO: 7273656 - DNA, 22 bp, Homo sapiens
cctgaggtcatgcatttccaac

SEQ ID NO: 7273657 - DNA, 22 bp, Homo sapiens
cctgaggtcagcggttcccaca

SEQ ID NO: 7273658 - DNA, 22 bp, Homo sapiens
cctgacaggagaagcgcagcat

SEQ ID NO: 7273659 - DNA, 22 bp, Homo sapiens
cctgagaatgtttaacagagaa

SEQ ID NO: 7273660 - DNA, 22 bp, Homo sapiens
cctgagaataattctccatagc

SEQ ID NO: 7273661 - DNA, 22 bp, Homo sapiens
cccaagagcttctaggacgctg

SEQ ID NO: 7273662 - DNA, 22 bp, Homo sapiens
cccaagaggtggaggttgcagt

SEQ ID NO: 7273663 - DNA, 22 bp, Homo sapiens
ccatggcaatggtcagtctatt

SEQ ID NO: 7273664 - DNA, 19 bp, Homo sapiens
ccatggagagagatgcatt

SEQ ID NO: 7273665 - DNA, 16 bp, Homo sapiens
tgatgacagatatggc

SEQ ID NO: 7273666 - DNA, 22 bp, Homo sapiens
tgatgacagtgttacagctcca

SEQ ID NO: 7273667 - DNA, 22 bp, Homo sapiens
tgatgacaggcagggttaagtg

SEQ ID NO: 7273668 - DNA, 22 bp, Homo sapiens
tgatgacagcatggaccccagg

SEQ ID NO: 7273669 - DNA, 22 bp, Homo sapiens
tgatgacaatgttgctgcaata

SEQ ID NO: 7273670 - DNA, 22 bp, Homo sapiens
tgatgacaaactttcctgatgc

SEQ ID NO: 7273671 - DNA, 22 bp, Homo sapiens
tgaggcagtgctgggaagcctg

SEQ ID NO: 7273672 - DNA, 22 bp, Homo sapiens
tgaggcagtgatgtttaagcac

SEQ ID NO: 7273673 - DNA, 18 bp, Homo sapiens
tgaggcagtcagtgatgg

SEQ ID NO: 7273674 - DNA, 22 bp, Homo sapiens
tgaggcagtcaccccctcctgc

SEQ ID NO: 7273675 - DNA, 22 bp, Homo sapiens
tgaggcagtattttagtgactt

SEQ ID NO: 7273676 - DNA, 22 bp, Homo sapiens
tgaggcagtcaccccctcctgc

SEQ ID NO: 7273677 - DNA, 22 bp, Homo sapiens
tgaggcagtattttagtgactt

SEQ ID NO: 7273678 - DNA, 22 bp, Homo sapiens
tgaggcaggtaagcaagttttg

SEQ ID NO: 7273679 - DNA, 22 bp, Homo sapiens
ccagtgttccagagagctgatg

SEQ ID NO: 7273680 - DNA, 22 bp, Homo sapiens
tgaggcaggtggattacaaggt

SEQ ID NO: 7273681 - DNA, 22 bp, Homo sapiens
tgaggcagtattctccattcca

SEQ ID NO: 7273682 - DNA, 22 bp, Homo sapiens
tgaggcagtattctccattcca

SEQ ID NO: 7273683 - DNA, 22 bp, Homo sapiens
ccagtgtgttagtggatttccc

SEQ ID NO: 7273684 - DNA, 23 bp, Homo sapiens
ccagtgtggtaggtccacaggtg

SEQ ID NO: 7273685 - DNA, 22 bp, Homo sapiens
ccagtgtggtaggtccacaggt

SEQ ID NO: 7273686 - DNA, 22 bp, Homo sapiens
ccagtgtgtttttctctgactc

SEQ ID NO: 7273687 - DNA, 22 bp, Homo sapiens
ccagtgtgtttaatgcattcca

SEQ ID NO: 7273688 - DNA, 22 bp, Homo sapiens
ccagtgtgttccctgcctcact

SEQ ID NO: 7273689 - DNA, 22 bp, Homo sapiens
ccagtgttattttagagtgtga

SEQ ID NO: 7273690 - DNA, 22 bp, Homo sapiens
ccagtgttagagactgatacag

SEQ ID NO: 7273691 - DNA, 22 bp, Homo sapiens
ccagtgttacggcttgaactat

SEQ ID NO: 7273692 - DNA, 22 bp, Homo sapiens
ccagtgttcatcaagaaaatgt

SEQ ID NO: 7273693 - DNA, 22 bp, Homo sapiens
ccagtgttcataattttacact

SEQ ID NO: 7273694 - DNA, 22 bp, Homo sapiens
ccagtgttcagtatgcattaag

SEQ ID NO: 7273695 - DNA, 22 bp, Homo sapiens
ccagtgttcaatacatatttgt

SEQ ID NO: 7273696 - DNA, 22 bp, Homo sapiens
tgcagaggtgaaagactagcaa

SEQ ID NO: 7273697 - DNA, 22 bp, Homo sapiens
tgcagaggtgtgcattcttaag

SEQ ID NO: 7273698 - DNA, 15 bp, Homo sapiens
tgcagaggtacctgg

SEQ ID NO: 7273699 - DNA, 22 bp, Homo sapiens
tgcagaggtgttgctgagataa

SEQ ID NO: 7273700 - DNA, 22 bp, Homo sapiens
cccaccagccatctgagagtgt

SEQ ID NO: 7273701 - DNA, 22 bp, Homo sapiens
cccaccagtacagatggtagat

SEQ ID NO: 7273702 - DNA, 22 bp, Homo sapiens
cccacagggctgctgatggcag

SEQ ID NO: 7273703 - DNA, 22 bp, Homo sapiens
cccacagggctgctgatggcag

SEQ ID NO: 7273704 - DNA, 22 bp, Homo sapiens
cccacaggctaggggtagggca

SEQ ID NO: 7273705 - DNA, 22 bp, Homo sapiens
cccacaggtggaagcctcggaa

SEQ ID NO: 7273706 - DNA, 22 bp, Homo sapiens
cccacaggccctgctgccttga

SEQ ID NO: 7273707 - DNA, 22 bp, Homo sapiens
cccacaggcaggggcagagaca

SEQ ID NO: 7273708 - DNA, 22 bp, Homo sapiens
cccagagaatctttcagaaagg

SEQ ID NO: 7273709 - DNA, 22 bp, Homo sapiens
tgcagaggtttccaggcaagtt

SEQ ID NO: 7273710 - DNA, 22 bp, Homo sapiens
tgcagaggtttgtggtgttgct

SEQ ID NO: 7273711 - DNA, 22 bp, Homo sapiens
tgcagaggtttttaatacattt

SEQ ID NO: 7273712 - DNA, 22 bp, Homo sapiens
cccagcactcagcaggctcata

SEQ ID NO: 7273713 - DNA, 22 bp, Homo sapiens
tgcagcagtcagtcaggcctgg

SEQ ID NO: 7273714 - DNA, 22 bp, Homo sapiens
tgcagcaggttccaaagggtta

SEQ ID NO: 7273715 - DNA, 22 bp, Homo sapiens
tgcagcaggtgacaacgagtgg

SEQ ID NO: 7273716 - DNA, 22 bp, Homo sapiens
tgcagcaggtatggcaagctcc

SEQ ID NO: 7273717 - DNA, 21 bp, Homo sapiens
tgcatatataagtgcatacac

SEQ ID NO: 7273718 - DNA, 22 bp, Homo sapiens
cccaggagacatatagaaggac

SEQ ID NO: 7273719 - DNA, 22 bp, Homo sapiens
cccaggagacagaaacagaggt

SEQ ID NO: 7273720 - DNA, 22 bp, Homo sapiens
cccaggagaatatttttgggtc

SEQ ID NO: 7273721 - DNA, 21 bp, Homo sapiens
cccaggaggagctccggctcc

SEQ ID NO: 7273722 - DNA, 22 bp, Homo sapiens
cccaggaggacattccataccc

SEQ ID NO: 7273723 - DNA, 22 bp, Homo sapiens
cccaggagatctggatctcgtc

SEQ ID NO: 7273724 - DNA, 22 bp, Homo sapiens
cccaggaggaggaaaaagctcg

SEQ ID NO: 7273725 - DNA, 22 bp, Homo sapiens
cccaggaggcagaagttgcagt

SEQ ID NO: 7273726 - DNA, 22 bp, Homo sapiens
cccaggaggcagagcttgcagt

SEQ ID NO: 7273727 - DNA, 22 bp, Homo sapiens
cccaggaggcagagatagcagt

SEQ ID NO: 7273728 - DNA, 22 bp, Homo sapiens
cccaggaggcagaggttgcagt

SEQ ID NO: 7273729 - DNA, 22 bp, Homo sapiens
cccaggaggcgcaggttgcggt

SEQ ID NO: 7273730 - DNA, 19 bp, Homo sapiens
cccaggaggcggaggttgc

SEQ ID NO: 7273731 - DNA, 22 bp, Homo sapiens
cccaggaggcctgcctggccgg

SEQ ID NO: 7273732 - DNA, 22 bp, Homo sapiens
cccaggaggcagatgttgcagt

SEQ ID NO: 7273733 - DNA, 22 bp, Homo sapiens
cccaggaggccaaggttgcagt

SEQ ID NO: 7273734 - DNA, 22 bp, Homo sapiens
cccaggaggcagaggttggagc

SEQ ID NO: 7273735 - DNA, 22 bp, Homo sapiens
tgcccaggatctggcgatgctc

SEQ ID NO: 7273736 - DNA, 21 bp, Homo sapiens
cccaggaggctgagaagagca

SEQ ID NO: 7273737 - DNA, 22 bp, Homo sapiens
cccaggaggcggaggttgcagt

SEQ ID NO: 7273738 - DNA, 22 bp, Homo sapiens
cccaggaggcggaggttgtggt

SEQ ID NO: 7273739 - DNA, 22 bp, Homo sapiens
cccaggagtaagtgacattgtt

SEQ ID NO: 7273740 - DNA, 19 bp, Homo sapiens
cccaggagtctggctggtt

SEQ ID NO: 7273741 - DNA, 21 bp, Homo sapiens
cccaggagtcctatttaaatg

SEQ ID NO: 7273742 - DNA, 22 bp, Homo sapiens
cccaggaggttggggctacagt

SEQ ID NO: 7273743 - DNA, 22 bp, Homo sapiens
cccaggagttagaggttgtggt

SEQ ID NO: 7273744 - DNA, 22 bp, Homo sapiens
tgccctggttacactggagtcc

SEQ ID NO: 7273745 - DNA, 20 bp, Homo sapiens
cccaggagtgagcagcttta

SEQ ID NO: 7273746 - DNA, 22 bp, Homo sapiens
tgcctcagtctaaagtctctca

SEQ ID NO: 7273747 - DNA, 23 bp, Homo sapiens
tgcctcagtggaatgtgagggtg

SEQ ID NO: 7273748 - DNA, 22 bp, Homo sapiens
cccagctcaagcagagagctaa

SEQ ID NO: 7273749 - DNA, 22 bp, Homo sapiens
cccagctcatcaggagccgccc

SEQ ID NO: 7273750 - DNA, 22 bp, Homo sapiens
cccaggaattggaggctgcagt

SEQ ID NO: 7273751 - DNA, 22 bp, Homo sapiens
cccaggagaatataatgttctt

SEQ ID NO: 7273752 - DNA, 21 bp, Homo sapiens
cccaggagaagaaaagatgca

SEQ ID NO: 7273753 - DNA, 22 bp, Homo sapiens
cccaggaccgcgcggctgagcg

SEQ ID NO: 7273754 - DNA, 22 bp, Homo sapiens
cccagccaaggtgctggtgttg

SEQ ID NO: 7273755 - DNA, 22 bp, Homo sapiens
cccagccagcctcttcccatat

SEQ ID NO: 7273756 - DNA, 22 bp, Homo sapiens
cccagccaagtgatctgaccgc

SEQ ID NO: 7273757 - DNA, 22 bp, Homo sapiens
cccagcatggagtgaggactca

SEQ ID NO: 7273758 - DNA, 22 bp, Homo sapiens
cccagcagtaaccagtggaaat

SEQ ID NO: 7273759 - DNA, 22 bp, Homo sapiens
tgcagcagtttaatgcagggtt

SEQ ID NO: 7273760 - DNA, 22 bp, Homo sapiens
tgcagcagtgttccttggcttg

SEQ ID NO: 7273761 - DNA, 17 bp, Homo sapiens
tgcagcagttcccatct

SEQ ID NO: 7273762 - DNA, 22 bp, Homo sapiens
cccagcccatctcaaaggtcta

SEQ ID NO: 7273763 - DNA, 19 bp, Homo sapiens
cccagccaggtcttgcatc

SEQ ID NO: 7273764 - DNA, 19 bp, Homo sapiens
cccagccaggtcttgcatc

SEQ ID NO: 7273765 - DNA, 22 bp, Homo sapiens
ccagtgtggactctctcctttg

SEQ ID NO: 7273766 - DNA, 22 bp, Homo sapiens
ccaggtcctgttttcaccacag

SEQ ID NO: 7273767 - DNA, 22 bp, Homo sapiens
tgagcacctaccttgtccagtg

SEQ ID NO: 7273768 - DNA, 22 bp, Homo sapiens
ccaggtaggagagagggatcct

SEQ ID NO: 7273769 - DNA, 22 bp, Homo sapiens
ccaggtaaattacctactgaat

SEQ ID NO: 7273770 - DNA, 22 bp, Homo sapiens
ccagggtctctgctgcctgaga

SEQ ID NO: 7273771 - DNA, 22 bp, Homo sapiens
ccagggtctctgctgcctgaga

SEQ ID NO: 7273772 - DNA, 22 bp, Homo sapiens
tgaccctgagagctgaatggct

SEQ ID NO: 7273773 - DNA, 22 bp, Homo sapiens
tgaccacagacccaatgactac

SEQ ID NO: 7273774 - DNA, 22 bp, Homo sapiens
tgacccatggtctgatcatagg

SEQ ID NO: 7273775 - DNA, 22 bp, Homo sapiens
tgacccaggtgagctgtgacca

SEQ ID NO: 7273776 - DNA, 22 bp, Homo sapiens
tgacatgctaagattatgttat

SEQ ID NO: 7273777 - DNA, 22 bp, Homo sapiens
tgacatgaaactgtgttgctac

SEQ ID NO: 7273778 - DNA, 22 bp, Homo sapiens
tgacatctgccagtttggtcgt

SEQ ID NO: 7273779 - DNA, 22 bp, Homo sapiens
tgacatctcattttgttgttgt

SEQ ID NO: 7273780 - DNA, 21 bp, Homo sapiens
tgaaggagaggaccgagtgct

SEQ ID NO: 7273781 - DNA, 22 bp, Homo sapiens
tgaaggagaattaataggcatt

SEQ ID NO: 7273782 - DNA, 22 bp, Homo sapiens
tgaaggagaattaataggcatt

SEQ ID NO: 7273783 - DNA, 22 bp, Homo sapiens
tgacagagtcggggcaagctgt

SEQ ID NO: 7273784 - DNA, 22 bp, Homo sapiens
ccaggctgctcacaagctgccc

SEQ ID NO: 7273785 - DNA, 22 bp, Homo sapiens
tgaaatgcaacagttatttttg

SEQ ID NO: 7273786 - DNA, 22 bp, Homo sapiens
ccaggctgagcatgattggagc

SEQ ID NO: 7273787 - DNA, 22 bp, Homo sapiens
ccaggctgcagtcaaggggcat

SEQ ID NO: 7273788 - DNA, 22 bp, Homo sapiens
ccaggctgcagtcaaggggcat

SEQ ID NO: 7273789 - DNA, 22 bp, Homo sapiens
ccaggctgccgaggaaagaaag

SEQ ID NO: 7273790 - DNA, 22 bp, Homo sapiens
ccaggctgccgaggaaagaaag

SEQ ID NO: 7273791 - DNA, 22 bp, Homo sapiens
ccaggctccgcatagaccccac

SEQ ID NO: 7273792 - DNA, 22 bp, Homo sapiens
tgaaagcagcaccaataccatt

SEQ ID NO: 7273793 - DNA, 17 bp, Homo sapiens
tgaagatgcatggcagc

SEQ ID NO: 7273794 - DNA, 22 bp, Homo sapiens
tctttaatataaaggaatgaat

SEQ ID NO: 7273795 - DNA, 22 bp, Homo sapiens
tctttaatatctgccccagagc

SEQ ID NO: 7273796 - DNA, 22 bp, Homo sapiens
ccaggctcacagcatcccagga

SEQ ID NO: 7273797 - DNA, 22 bp, Homo sapiens
ccaggctcacctggagcccctg

SEQ ID NO: 7273798 - DNA, 21 bp, Homo sapiens
tcttgtccttgctctcccact

SEQ ID NO: 7273799 - DNA, 22 bp, Homo sapiens
tcttgcctcttcccctttccat

SEQ ID NO: 7273800 - DNA, 18 bp, Homo sapiens
tcttgcctgcaccctctc

SEQ ID NO: 7273801 - DNA, 20 bp, Homo sapiens
tctgcagataagggaaagac

SEQ ID NO: 7273802 - DNA, 22 bp, Homo sapiens
ccagcccttgagatggaaggga

SEQ ID NO: 7273803 - DNA, 22 bp, Homo sapiens
tctgcagagcattatagcaaaa

SEQ ID NO: 7273804 - DNA, 22 bp, Homo sapiens
tttgatttactggatattctca

SEQ ID NO: 7273805 - DNA, 22 bp, Homo sapiens
tttgcttgttcaagatttctgt

SEQ ID NO: 7273806 - DNA, 22 bp, Homo sapiens
tttgatccgttgctggtgagga

SEQ ID NO: 7273807 - DNA, 22 bp, Homo sapiens
tttgagttgcttatttaatagg

SEQ ID NO: 7273808 - DNA, 22 bp, Homo sapiens
tttgaggttagctagcagatca

SEQ ID NO: 7273809 - DNA, 22 bp, Homo sapiens
tttgaggacattttagaaagtt

SEQ ID NO: 7273810 - DNA, 22 bp, Homo sapiens
tttgaatgcaggacatacagaa

SEQ ID NO: 7273811 - DNA, 22 bp, Homo sapiens
tttgaatatgtgcttgttaaat

SEQ ID NO: 7273812 - DNA, 22 bp, Homo sapiens
tttgaatatacttcaaacaaag

SEQ ID NO: 7273813 - DNA, 22 bp, Homo sapiens
tttgaagagccacagtgaaatt

SEQ ID NO: 7273814 - DNA, 22 bp, Homo sapiens
tttgaagactactgggagtgaa

SEQ ID NO: 7273815 - DNA, 22 bp, Homo sapiens
tttcctctgactgctcccctgc

SEQ ID NO: 7273816 - DNA, 22 bp, Homo sapiens
tttcctctccggggcctccagg

SEQ ID NO: 7273817 - DNA, 22 bp, Homo sapiens
tttcctcctagcctccagccgc

SEQ ID NO: 7273818 - DNA, 22 bp, Homo sapiens
tttcctctccaccaggaggtct

SEQ ID NO: 7273819 - DNA, 22 bp, Homo sapiens
tttcttttgctgagaggggcac

SEQ ID NO: 7273820 - DNA, 22 bp, Homo sapiens
tttcttttgaatagtgtgtggt

SEQ ID NO: 7273821 - DNA, 22 bp, Homo sapiens
ttttcatttttgtagatgcaag

SEQ ID NO: 7273822 - DNA, 22 bp, Homo sapiens
ttttcattgttactatgagcta

SEQ ID NO: 7273823 - DNA, 22 bp, Homo sapiens
ttttcattagaatgactgagaa

SEQ ID NO: 7273824 - DNA, 22 bp, Homo sapiens
ttttcatctctgctttgtacct

SEQ ID NO: 7273825 - DNA, 22 bp, Homo sapiens
ttttcatgtcatgtccttgagg

SEQ ID NO: 7273826 - DNA, 22 bp, Homo sapiens
ttttattggagtgataccaagc

SEQ ID NO: 7273827 - DNA, 22 bp, Homo sapiens
ttttattgcaataaagtgtgta

SEQ ID NO: 7273828 - DNA, 21 bp, Homo sapiens
ttttattgatgaatggccact

SEQ ID NO: 7273829 - DNA, 22 bp, Homo sapiens
ttttattatctttgaatgggac

SEQ ID NO: 7273830 - DNA, 22 bp, Homo sapiens
ttttattgcaataaagtgtgta

SEQ ID NO: 7273831 - DNA, 22 bp, Homo sapiens
ttttattagtggctagatgggg

SEQ ID NO: 7273832 - DNA, 22 bp, Homo sapiens
tttgttcaaaaattataagata

SEQ ID NO: 7273833 - DNA, 22 bp, Homo sapiens
tttgtgttgtacttctgtgcat

SEQ ID NO: 7273834 - DNA, 22 bp, Homo sapiens
tttgttcaatccagacaatagc

SEQ ID NO: 7273835 - DNA, 22 bp, Homo sapiens
ttttaaatctccagttgacccc

SEQ ID NO: 7273836 - DNA, 22 bp, Homo sapiens
ttttaattcaaagtgaatagtg

SEQ ID NO: 7273837 - DNA, 22 bp, Homo sapiens
tttttataactcttttgtgaca

SEQ ID NO: 7273838 - DNA, 22 bp, Homo sapiens
tttttagagtgttaccagtata

SEQ ID NO: 7273839 - DNA, 22 bp, Homo sapiens
tttttagaattggctgagaatt

SEQ ID NO: 7273840 - DNA, 22 bp, Homo sapiens
tttttagagtgttaccagtata

SEQ ID NO: 7273841 - DNA, 22 bp, Homo sapiens
tttttagattactcagccacca

SEQ ID NO: 7273842 - DNA, 22 bp, Homo sapiens
tttttagattactcagccacca

SEQ ID NO: 7273843 - DNA, 22 bp, Homo sapiens
tttttcagccatgaattacact

SEQ ID NO: 7273844 - DNA, 22 bp, Homo sapiens
ttgtggctgtgcaccgctgcct

SEQ ID NO: 7273845 - DNA, 22 bp, Homo sapiens
ttgtggctcatcttcagctccc

SEQ ID NO: 7273846 - DNA, 22 bp, Homo sapiens
ttgtccattttattggatggtg

SEQ ID NO: 7273847 - DNA, 23 bp, Homo sapiens
ttgtcctgccgatctctgagaat

SEQ ID NO: 7273848 - DNA, 23 bp, Homo sapiens
ttgtcctgccgatctctgagaat

SEQ ID NO: 7273849 - DNA, 22 bp, Homo sapiens
ttgtcatgatccttctgttagg

SEQ ID NO: 7273850 - DNA, 22 bp, Homo sapiens
ttgtccaaggtcccacagttag

SEQ ID NO: 7273851 - DNA, 22 bp, Homo sapiens
ttgtacagaccctgaaaagctc

SEQ ID NO: 7273852 - DNA, 22 bp, Homo sapiens
ttgtacagaaaaaattcttggt

SEQ ID NO: 7273853 - DNA, 22 bp, Homo sapiens
ttggagatatcacaccttcaca

SEQ ID NO: 7273854 - DNA, 22 bp, Homo sapiens
ttggcaggaatattgcagaggt

SEQ ID NO: 7273855 - DNA, 22 bp, Homo sapiens
ttggcatcagtgtaggacctgt

SEQ ID NO: 7273856 - DNA, 22 bp, Homo sapiens
ttggcattcatgggacaacaaa

SEQ ID NO: 7273857 - DNA, 22 bp, Homo sapiens
ttggccatctaagcccagccac

SEQ ID NO: 7273858 - DNA, 22 bp, Homo sapiens
ttgggcaggtgtggctctcctt

SEQ ID NO: 7273859 - DNA, 22 bp, Homo sapiens
ttgggcagtgattagttcatga

SEQ ID NO: 7273860 - DNA, 20 bp, Homo sapiens
ttggacagacgcattgacac

SEQ ID NO: 7273861 - DNA, 22 bp, Homo sapiens
ttgcttcagaagttctgcttgt

SEQ ID NO: 7273862 - DNA, 22 bp, Homo sapiens
ttggaaacgtcaccttttcctt

SEQ ID NO: 7273863 - DNA, 22 bp, Homo sapiens
ttgctctgtcagggcctcagtc

SEQ ID NO: 7273864 - DNA, 22 bp, Homo sapiens
ttgcaggaaactgagtgtgagc

SEQ ID NO: 7273865 - DNA, 22 bp, Homo sapiens
ttgcaggattttagagatgaca

SEQ ID NO: 7273866 - DNA, 22 bp, Homo sapiens
ttgacaatgtcctttgaatttc

SEQ ID NO: 7273867 - DNA, 22 bp, Homo sapiens
ttgacacagatcaatattcaac

SEQ ID NO: 7273868 - DNA, 22 bp, Homo sapiens
ttgcagagaggttaggaactca

SEQ ID NO: 7273869 - DNA, 22 bp, Homo sapiens
ttgcagagccatgaggctggct

SEQ ID NO: 7273870 - DNA, 22 bp, Homo sapiens
ttgcagagtggttgtgaggatt

SEQ ID NO: 7273871 - DNA, 22 bp, Homo sapiens
ttgacacagttttctcattaag

SEQ ID NO: 7273872 - DNA, 22 bp, Homo sapiens
tttaatgtagcgtgaaatgatt

SEQ ID NO: 7273873 - DNA, 22 bp, Homo sapiens
tttacagtcaccaaactttgct

SEQ ID NO: 7273874 - DNA, 22 bp, Homo sapiens
tttacagtctatgttgaattaa

SEQ ID NO: 7273875 - DNA, 22 bp, Homo sapiens
tttaaataggactcctgggggt

SEQ ID NO: 7273876 - DNA, 22 bp, Homo sapiens
tttaaatgcagacgttgattca

SEQ ID NO: 7273877 - DNA, 22 bp, Homo sapiens
tttaaatgctttaagcaagggt

SEQ ID NO: 7273878 - DNA, 22 bp, Homo sapiens
tttaaatgtttatagagagtac

SEQ ID NO: 7273879 - DNA, 22 bp, Homo sapiens
tttaaatgtttaaaactcgtga

SEQ ID NO: 7273880 - DNA, 22 bp, Homo sapiens
tttaaatgttcatgatactgaa

SEQ ID NO: 7273881 - DNA, 22 bp, Homo sapiens
tttaaatgtgttcttagtagct

SEQ ID NO: 7273882 - DNA, 22 bp, Homo sapiens
tttaaatggcattttcccagat

SEQ ID NO: 7273883 - DNA, 17 bp, Homo sapiens
tttaaactactacaagg

SEQ ID NO: 7273884 - DNA, 22 bp, Homo sapiens
tttaccaaatagattatgtcag

SEQ ID NO: 7273885 - DNA, 22 bp, Homo sapiens
tttagaagttcacacatttaaa

SEQ ID NO: 7273886 - DNA, 22 bp, Homo sapiens
tttagataatgctcaagcaatt

SEQ ID NO: 7273887 - DNA, 22 bp, Homo sapiens
tttatatttcccaggattggcc

SEQ ID NO: 7273888 - DNA, 22 bp, Homo sapiens
tttatattgtaaaaatggttct

SEQ ID NO: 7273889 - DNA, 22 bp, Homo sapiens
tttattcaagatgaggttcatg

SEQ ID NO: 7273890 - DNA, 22 bp, Homo sapiens
tttatctattgtattgttgatg

SEQ ID NO: 7273891 - DNA, 22 bp, Homo sapiens
tttatccattcaccagttgaac

SEQ ID NO: 7273892 - DNA, 22 bp, Homo sapiens
tttatccatatcattaaaatct

SEQ ID NO: 7273893 - DNA, 22 bp, Homo sapiens
tttatcacagaataagaagtca

SEQ ID NO: 7273894 - DNA, 23 bp, Homo sapiens
tttatccaactctgtaatctctc

SEQ ID NO: 7273895 - DNA, 22 bp, Homo sapiens
tttatccagaatcaggattttt

SEQ ID NO: 7273896 - DNA, 21 bp, Homo sapiens
tttcattgaatgagataaggt

SEQ ID NO: 7273897 - DNA, 22 bp, Homo sapiens
tttcccagttccctgctctata

SEQ ID NO: 7273898 - DNA, 22 bp, Homo sapiens
tttcatcttccttggcataggt

SEQ ID NO: 7273899 - DNA, 22 bp, Homo sapiens
tttcatgagattcctccacatc

SEQ ID NO: 7273900 - DNA, 22 bp, Homo sapiens
tttcatgaggggcaaaatctca

SEQ ID NO: 7273901 - DNA, 22 bp, Homo sapiens
tttcatggctaggactagagtg

SEQ ID NO: 7273902 - DNA, 22 bp, Homo sapiens
tttcatgcacaaatgagcaagg

SEQ ID NO: 7273903 - DNA, 22 bp, Homo sapiens
tttcagaaagctgaacatatga

SEQ ID NO: 7273904 - DNA, 22 bp, Homo sapiens
tttcactagaacgttcttgttt

SEQ ID NO: 7273905 - DNA, 22 bp, Homo sapiens
tttcacagctgggaagagatat

SEQ ID NO: 7273906 - DNA, 19 bp, Homo sapiens
tttattcacctttaccttg

SEQ ID NO: 7273907 - DNA, 20 bp, Homo sapiens
tttattcacagagaagagtt

SEQ ID NO: 7273908 - DNA, 22 bp, Homo sapiens
tttattctataggcattaagca

SEQ ID NO: 7273909 - DNA, 22 bp, Homo sapiens
tttattctataggcattaagca

SEQ ID NO: 7273910 - DNA, 22 bp, Homo sapiens
tttattcttgagagtgagaaga

SEQ ID NO: 7273911 - DNA, 22 bp, Homo sapiens
tttattctgtgctacatgaaga

SEQ ID NO: 7273912 - DNA, 22 bp, Homo sapiens
tttattctgtgctacatgaaga

SEQ ID NO: 7273913 - DNA, 22 bp, Homo sapiens
tttattgacttcagtgagtctt

SEQ ID NO: 7273914 - DNA, 22 bp, Homo sapiens
tttattgacccaaagcgagagt

SEQ ID NO: 7273915 - DNA, 22 bp, Homo sapiens
tttcacagaaaggataacatta

SEQ ID NO: 7273916 - DNA, 22 bp, Homo sapiens
tttcacagagaaatataacagg

SEQ ID NO: 7273917 - DNA, 23 bp, Homo sapiens
tttcaactcctgccattatttct

SEQ ID NO: 7273918 - DNA, 23 bp, Homo sapiens
ttgaatttctcttgcaatattta

SEQ ID NO: 7273919 - DNA, 17 bp, Homo sapiens
ttgaactgctgagtcag

SEQ ID NO: 7273920 - DNA, 22 bp, Homo sapiens
ttgaactgtaagcatgtctgcc

SEQ ID NO: 7273921 - DNA, 22 bp, Homo sapiens
ttgaactggtagttggaaatct

SEQ ID NO: 7273922 - DNA, 22 bp, Homo sapiens
ttgaacattggcaatttcatat

SEQ ID NO: 7273923 - DNA, 22 bp, Homo sapiens
ttgaaatatttgggagtgtttg

SEQ ID NO: 7273924 - DNA, 22 bp, Homo sapiens
ttcttttctttaggcattgtgt

SEQ ID NO: 7273925 - DNA, 22 bp, Homo sapiens
ttcttcaattttccatatactg

SEQ ID NO: 7273926 - DNA, 22 bp, Homo sapiens
ttcttcaatgtgccctgttttc

SEQ ID NO: 7273927 - DNA, 22 bp, Homo sapiens
ttcttcaaccatctacataaac

SEQ ID NO: 7273928 - DNA, 22 bp, Homo sapiens
ttcttcaacaaggacactgtta

SEQ ID NO: 7273929 - DNA, 22 bp, Homo sapiens
ttcttcaaatagcagggagtca

SEQ ID NO: 7273930 - DNA, 22 bp, Homo sapiens
ttcttcaaaacaacactggcct

SEQ ID NO: 7273931 - DNA, 22 bp, Homo sapiens
ttcttcaaacaaaagtggcatg

SEQ ID NO: 7273932 - DNA, 21 bp, Homo sapiens
ttcttcaaagaagaaggcaca

SEQ ID NO: 7273933 - DNA, 22 bp, Homo sapiens
ttctgtgtcttcttgttctgtg

SEQ ID NO: 7273934 - DNA, 22 bp, Homo sapiens
ttctgtgaatcttttttcccac

SEQ ID NO: 7273935 - DNA, 22 bp, Homo sapiens
ttctgtgaatcttttttcccac

SEQ ID NO: 7273936 - DNA, 22 bp, Homo sapiens
ttctgtgattgacatgtggctt

SEQ ID NO: 7273937 - DNA, 22 bp, Homo sapiens
ttctgtgtgcttactggtgttc

SEQ ID NO: 7273938 - DNA, 22 bp, Homo sapiens
ttctgtgtgccagagttgtgct

SEQ ID NO: 7273939 - DNA, 22 bp, Homo sapiens
ttcttatagaagcaaccattgt

SEQ ID NO: 7273940 - DNA, 22 bp, Homo sapiens
ttcctgaatgctgttgtgctgt

SEQ ID NO: 7273941 - DNA, 22 bp, Homo sapiens
ttcctgaatataaagacactag

SEQ ID NO: 7273942 - DNA, 22 bp, Homo sapiens
ttcctgagcaccagacactgca

SEQ ID NO: 7273943 - DNA, 22 bp, Homo sapiens
ttcctgagggccccagaggagg

SEQ ID NO: 7273944 - DNA, 22 bp, Homo sapiens
ttcctgcaaaactactagtagc

SEQ ID NO: 7273945 - DNA, 23 bp, Homo sapiens
ttcctgagtgctggagagagtgc

SEQ ID NO: 7273946 - DNA, 22 bp, Homo sapiens
ttccttgaccactgcataatga

SEQ ID NO: 7273947 - DNA, 22 bp, Homo sapiens
ttccttgaatgagtcatggaaa

SEQ ID NO: 7273948 - DNA, 22 bp, Homo sapiens
ttccttgaaagtttgaactgac

SEQ ID NO: 7273949 - DNA, 22 bp, Homo sapiens
ttccttgttcctaggagatcaa

SEQ ID NO: 7273950 - DNA, 22 bp, Homo sapiens
ttctcctctgttggccttccct

SEQ ID NO: 7273951 - DNA, 22 bp, Homo sapiens
ttctccagaccctcctgcagac

SEQ ID NO: 7273952 - DNA, 22 bp, Homo sapiens
ttctccaacacaagcatgatgt

SEQ ID NO: 7273953 - DNA, 22 bp, Homo sapiens
ttctctgcagctcctggctggg

SEQ ID NO: 7273954 - DNA, 22 bp, Homo sapiens
ttctctgagtacgtttcagtgt

SEQ ID NO: 7273955 - DNA, 19 bp, Homo sapiens
ttctctgctacattctcag

SEQ ID NO: 7273956 - DNA, 22 bp, Homo sapiens
ttctctgctacatactagggct

SEQ ID NO: 7273957 - DNA, 22 bp, Homo sapiens
ttcagcaagaccaccatgtacc

SEQ ID NO: 7273958 - DNA, 22 bp, Homo sapiens
ttcagagagtttgtgagtcctt

SEQ ID NO: 7273959 - DNA, 22 bp, Homo sapiens
ttcagagaagcaaaggcagatt

SEQ ID NO: 7273960 - DNA, 22 bp, Homo sapiens
ttcaaagataatgtagcatttt

SEQ ID NO: 7273961 - DNA, 22 bp, Homo sapiens
ttcacagcttaataaggctcag

SEQ ID NO: 7273962 - DNA, 22 bp, Homo sapiens
ttcatttaatttgtgtattaac

SEQ ID NO: 7273963 - DNA, 22 bp, Homo sapiens
ttcattgtgaacacattctgcc

SEQ ID NO: 7273964 - DNA, 22 bp, Homo sapiens
ttcattgtactttaagagatgc

SEQ ID NO: 7273965 - DNA, 22 bp, Homo sapiens
ttcattgctattcactgtactg

SEQ ID NO: 7273966 - DNA, 22 bp, Homo sapiens
ttcattgcagttcttcaggtta

SEQ ID NO: 7273967 - DNA, 22 bp, Homo sapiens
ttcagttttattgtactgctat

SEQ ID NO: 7273968 - DNA, 22 bp, Homo sapiens
ttccaggaacagatgaaggttg

SEQ ID NO: 7273969 - DNA, 22 bp, Homo sapiens
ttccagtgaaacatgaggtgtg

SEQ ID NO: 7273970 - DNA, 22 bp, Homo sapiens
ttccagtgactaagcttctgct

SEQ ID NO: 7273971 - DNA, 22 bp, Homo sapiens
ttatataaagataacttttctt

SEQ ID NO: 7273972 - DNA, 22 bp, Homo sapiens
ttatagaaggagcattcactta

SEQ ID NO: 7273973 - DNA, 22 bp, Homo sapiens
ttatactaaaacgcattgaatt

SEQ ID NO: 7273974 - DNA, 22 bp, Homo sapiens
ttatacatgtgttttgagatga

SEQ ID NO: 7273975 - DNA, 22 bp, Homo sapiens
ttaggaaagggttttctaacag

SEQ ID NO: 7273976 - DNA, 22 bp, Homo sapiens
tcctgcctgcaatcccagcact

SEQ ID NO: 7273977 - DNA, 22 bp, Homo sapiens
tcctgcctgtttacctgtactt

SEQ ID NO: 7273978 - DNA, 22 bp, Homo sapiens
ttattacaatgcagaaaataga

SEQ ID NO: 7273979 - DNA, 22 bp, Homo sapiens
ttattatgtggatgaaagatgt

SEQ ID NO: 7273980 - DNA, 22 bp, Homo sapiens
ttattctttaaacatatatgtt

SEQ ID NO: 7273981 - DNA, 22 bp, Homo sapiens
ttattatagattatgcaagatt

SEQ ID NO: 7273982 - DNA, 22 bp, Homo sapiens
ttattatgtgctagagaatgta

SEQ ID NO: 7273983 - DNA, 22 bp, Homo sapiens
ttattgtgtcttggtttatctt

SEQ ID NO: 7273984 - DNA, 22 bp, Homo sapiens
ttcaaacagtgtagaatatatg

SEQ ID NO: 7273985 - DNA, 22 bp, Homo sapiens
ttattcttttctccagaatccc

SEQ ID NO: 7273986 - DNA, 22 bp, Homo sapiens
ttattgactgaaatgagagtga

SEQ ID NO: 7273987 - DNA, 22 bp, Homo sapiens
ttattgactgaaatgagagtga

SEQ ID NO: 7273988 - DNA, 22 bp, Homo sapiens
ttattgacttgtttgtcctggt

SEQ ID NO: 7273989 - DNA, 22 bp, Homo sapiens
ttattgactgatcagagaggga

SEQ ID NO: 7273990 - DNA, 22 bp, Homo sapiens
ttattggagctggaggctgttt

SEQ ID NO: 7273991 - DNA, 22 bp, Homo sapiens
gtgcatgtcggggtgcatgtca

SEQ ID NO: 7273992 - DNA, 20 bp, Homo sapiens
gtgctgagggctgggcaatg

SEQ ID NO: 7273993 - DNA, 22 bp, Homo sapiens
gtgctgaggtgggtgggcagcc

SEQ ID NO: 7273994 - DNA, 21 bp, Homo sapiens
cagctccactaaagcagctgt

SEQ ID NO: 7273995 - DNA, 22 bp, Homo sapiens
cagctccatcttgcttatacca

SEQ ID NO: 7273996 - DNA, 22 bp, Homo sapiens
cagctcccagaactgaccatgt

SEQ ID NO: 7273997 - DNA, 22 bp, Homo sapiens
gtgctgaggatacagctgtgaa

SEQ ID NO: 7273998 - DNA, 22 bp, Homo sapiens
gtgctgagcatcatgaggcact

SEQ ID NO: 7273999 - DNA, 22 bp, Homo sapiens
gtgctgagcacaccttggagca

SEQ ID NO: 7274000 - DNA, 22 bp, Homo sapiens
gtgctgagcacagctgcccagg

SEQ ID NO: 7274001 - DNA, 22 bp, Homo sapiens
gtgctgagattacaggtgtgag

SEQ ID NO: 7274002 - DNA, 22 bp, Homo sapiens
gtgcctggtatgtaggtagcgg

SEQ ID NO: 7274003 - DNA, 22 bp, Homo sapiens
cagctcctctgttagccctggg

SEQ ID NO: 7274004 - DNA, 22 bp, Homo sapiens
cagctcctgaggactgctggga

SEQ ID NO: 7274005 - DNA, 22 bp, Homo sapiens
cagctcctctggccagccctgc

SEQ ID NO: 7274006 - DNA, 22 bp, Homo sapiens
cagctcccgccatcgggaggca

SEQ ID NO: 7274007 - DNA, 22 bp, Homo sapiens
gtctctgtcttaggccaggcct

SEQ ID NO: 7274008 - DNA, 22 bp, Homo sapiens
gtctttgctgtctttgctctca

SEQ ID NO: 7274009 - DNA, 22 bp, Homo sapiens
gtctttggagaggtgccatttc

SEQ ID NO: 7274010 - DNA, 22 bp, Homo sapiens
gtgaggtcaccggccgttgcca

SEQ ID NO: 7274011 - DNA, 22 bp, Homo sapiens
gtgaggtcaaagccttgggtat

SEQ ID NO: 7274012 - DNA, 22 bp, Homo sapiens
gtgcaaagtgcatggggaaggg

SEQ ID NO: 7274013 - DNA, 22 bp, Homo sapiens
gtgcaaagcttaacattctgca

SEQ ID NO: 7274014 - DNA, 22 bp, Homo sapiens
gtgcagctgtggtggagccagg

SEQ ID NO: 7274015 - DNA, 22 bp, Homo sapiens
gtgcagctgcaggagtcaggtc

SEQ ID NO: 7274016 - DNA, 22 bp, Homo sapiens
cagcatgattggtgtctggtga

SEQ ID NO: 7274017 - DNA, 22 bp, Homo sapiens
cagcatgatcccagttgattgc

SEQ ID NO: 7274018 - DNA, 22 bp, Homo sapiens
cagcatgatgagtgcagtttgg

SEQ ID NO: 7274019 - DNA, 22 bp, Homo sapiens
cagcatgatgctcacacaaaac

SEQ ID NO: 7274020 - DNA, 22 bp, Homo sapiens
cagcatgagaaaatgaatcaga

SEQ ID NO: 7274021 - DNA, 22 bp, Homo sapiens
cagcatgaaaagtgttgctatc

SEQ ID NO: 7274022 - DNA, 22 bp, Homo sapiens
cagcatgaaacaattgagccca

SEQ ID NO: 7274023 - DNA, 22 bp, Homo sapiens
cagcatgaatgtgttcgtaggg

SEQ ID NO: 7274024 - DNA, 22 bp, Homo sapiens
cagcatgacagtctgcagcaga

SEQ ID NO: 7274025 - DNA, 22 bp, Homo sapiens
cagcagagctgggctttgaatt

SEQ ID NO: 7274026 - DNA, 20 bp, Homo sapiens
cagcagtggatgagagtttt

SEQ ID NO: 7274027 - DNA, 22 bp, Homo sapiens
cagcagtgacaagactaagaag

SEQ ID NO: 7274028 - DNA, 22 bp, Homo sapiens
cagcagtgatgtgtgagggttc

SEQ ID NO: 7274029 - DNA, 21 bp, Homo sapiens
cagcaggtggagcctcttgtc

SEQ ID NO: 7274030 - DNA, 22 bp, Homo sapiens
cagaggacctgtgtggccagag

SEQ ID NO: 7274031 - DNA, 22 bp, Homo sapiens
cagaggcagccgggggagaacg

SEQ ID NO: 7274032 - DNA, 22 bp, Homo sapiens
cagaggcaggaagatgggcagt

SEQ ID NO: 7274033 - DNA, 22 bp, Homo sapiens
cagaggcaggaagatgggcagt

SEQ ID NO: 7274034 - DNA, 22 bp, Homo sapiens
cagaggcagccgggggagaacg

SEQ ID NO: 7274035 - DNA, 22 bp, Homo sapiens
cagaggcagaatggagatttgg

SEQ ID NO: 7274036 - DNA, 22 bp, Homo sapiens
gggctcagtctgcggcgcgcgg

SEQ ID NO: 7274037 - DNA, 22 bp, Homo sapiens
cagagctgtcatttgccagtga

SEQ ID NO: 7274038 - DNA, 22 bp, Homo sapiens
cagagagagtcaaatctttgct

SEQ ID NO: 7274039 - DNA, 22 bp, Homo sapiens
cagagcagcagagcttccatgg

SEQ ID NO: 7274040 - DNA, 22 bp, Homo sapiens
ggtggcagggagtgtccctggg

SEQ ID NO: 7274041 - DNA, 18 bp, Homo sapiens
ggtggcaggtcagatgcc

SEQ ID NO: 7274042 - DNA, 22 bp, Homo sapiens
cagatgcttttgattctggggt

SEQ ID NO: 7274043 - DNA, 22 bp, Homo sapiens
cagatgcttgttggctggtctc

SEQ ID NO: 7274044 - DNA, 22 bp, Homo sapiens
cagatgcttggaggacacttgg

SEQ ID NO: 7274045 - DNA, 22 bp, Homo sapiens
gtaactttggatttagggtacc

SEQ ID NO: 7274046 - DNA, 22 bp, Homo sapiens
cagcagagaaattaaacttctg

SEQ ID NO: 7274047 - DNA, 22 bp, Homo sapiens
cagcagagaaattacatatttg

SEQ ID NO: 7274048 - DNA, 22 bp, Homo sapiens
cagcagagaccaagtgatttga

SEQ ID NO: 7274049 - DNA, 22 bp, Homo sapiens
ggtgtctatgattcagtttatg

SEQ ID NO: 7274050 - DNA, 22 bp, Homo sapiens
cagatgcttcgtgggtgagcac

SEQ ID NO: 7274051 - DNA, 16 bp, Homo sapiens
cagatgcttgctggca

SEQ ID NO: 7274052 - DNA, 22 bp, Homo sapiens
cagatgctgctcacctgattat

SEQ ID NO: 7274053 - DNA, 20 bp, Homo sapiens
cagatgctggatcttggtcc

SEQ ID NO: 7274054 - DNA, 22 bp, Homo sapiens
cagatgctggtatgggggaggt

SEQ ID NO: 7274055 - DNA, 22 bp, Homo sapiens
cagatgctatagtgctgccata

SEQ ID NO: 7274056 - DNA, 22 bp, Homo sapiens
cagatgctatgtattatgtatg

SEQ ID NO: 7274057 - DNA, 22 bp, Homo sapiens
cagatgctgcctgggaatgtct

SEQ ID NO: 7274058 - DNA, 22 bp, Homo sapiens
cagatgctgctatttcaccctg

SEQ ID NO: 7274059 - DNA, 18 bp, Homo sapiens
cagatgctaggcctccag

SEQ ID NO: 7274060 - DNA, 22 bp, Homo sapiens
cagatacagctagctccgtggc

SEQ ID NO: 7274061 - DNA, 22 bp, Homo sapiens
ggtgagaggcagaggacagctt

SEQ ID NO: 7274062 - DNA, 22 bp, Homo sapiens
cagaggctgatggctgtagcca

SEQ ID NO: 7274063 - DNA, 22 bp, Homo sapiens
cagaggctgagcagtcagtttg

SEQ ID NO: 7274064 - DNA, 22 bp, Homo sapiens
cagaggcaggataagaactgcg

SEQ ID NO: 7274065 - DNA, 22 bp, Homo sapiens
ggggtcttgggtagcatataga

SEQ ID NO: 7274066 - DNA, 21 bp, Homo sapiens
ggagtttttctggaagggact

SEQ ID NO: 7274067 - DNA, 22 bp, Homo sapiens
ggcagctgcaaatctgctctgt

SEQ ID NO: 7274068 - DNA, 22 bp, Homo sapiens
ggatacagcggcttctgcgcga

SEQ ID NO: 7274069 - DNA, 22 bp, Homo sapiens
ggcaggtgtggtgaccagagat

SEQ ID NO: 7274070 - DNA, 22 bp, Homo sapiens
ggcagtagccagggactggcag

SEQ ID NO: 7274071 - DNA, 22 bp, Homo sapiens
ggcagtcaagagggagtctgaa

SEQ ID NO: 7274072 - DNA, 22 bp, Homo sapiens
ggcagtcacaggggagactggg

SEQ ID NO: 7274073 - DNA, 19 bp, Homo sapiens
ggccccagccagggtatca

SEQ ID NO: 7274074 - DNA, 22 bp, Homo sapiens
ggcgagggagcagtgcggtggg

SEQ ID NO: 7274075 - DNA, 22 bp, Homo sapiens
ggcgccccatatagttcttaat

SEQ ID NO: 7274076 - DNA, 22 bp, Homo sapiens
ggcgcccccttcaaacagagca

SEQ ID NO: 7274077 - DNA, 22 bp, Homo sapiens
ggccagcctggggctcccagac

SEQ ID NO: 7274078 - DNA, 22 bp, Homo sapiens
caccacagcatccactagaagg

SEQ ID NO: 7274079 - DNA, 22 bp, Homo sapiens
cacccagcttttgcatcctccg

SEQ ID NO: 7274080 - DNA, 22 bp, Homo sapiens
cacccaggcaaggattctgcaa

SEQ ID NO: 7274081 - DNA, 22 bp, Homo sapiens
cacccaggcaaggattctgcaa

SEQ ID NO: 7274082 - DNA, 22 bp, Homo sapiens
cagaacagaatcgtgtggtgag

SEQ ID NO: 7274083 - DNA, 22 bp, Homo sapiens
cagaacagaaacgttgttccat

SEQ ID NO: 7274084 - DNA, 22 bp, Homo sapiens
ggctgggacgatgaggattagt

SEQ ID NO: 7274085 - DNA, 22 bp, Homo sapiens
ggctgggagccccacagagtca

SEQ ID NO: 7274086 - DNA, 21 bp, Homo sapiens
ggctgctgtcaccgctgtcac

SEQ ID NO: 7274087 - DNA, 22 bp, Homo sapiens
ggctgctgtactgatgtcagtt

SEQ ID NO: 7274088 - DNA, 22 bp, Homo sapiens
ggctgctggtaggggtaggaag

SEQ ID NO: 7274089 - DNA, 22 bp, Homo sapiens
ggctgctggtggaatggtaggc

SEQ ID NO: 7274090 - DNA, 19 bp, Homo sapiens
ggctgctggttacagaggc

SEQ ID NO: 7274091 - DNA, 22 bp, Homo sapiens
cagaacagtcgcctgcatggat

SEQ ID NO: 7274092 - DNA, 22 bp, Homo sapiens
cagaagagtagctgaacaagtt

SEQ ID NO: 7274093 - DNA, 22 bp, Homo sapiens
cagaagaggactgggtagctca

SEQ ID NO: 7274094 - DNA, 22 bp, Homo sapiens
cagaacagtacctagcacatag

SEQ ID NO: 7274095 - DNA, 19 bp, Homo sapiens
cagaacaggaccaggggcc

SEQ ID NO: 7274096 - DNA, 19 bp, Homo sapiens
cagaacagaggtcatggcc

SEQ ID NO: 7274097 - DNA, 22 bp, Homo sapiens
cagaacagagcctgaatctctc

SEQ ID NO: 7274098 - DNA, 22 bp, Homo sapiens
ggcttggaccagtcacagtggt

SEQ ID NO: 7274099 - DNA, 22 bp, Homo sapiens
ggcttggaaattgcaggacaca

SEQ ID NO: 7274100 - DNA, 22 bp, Homo sapiens
ggcttggaaatggtaatgagct

SEQ ID NO: 7274101 - DNA, 23 bp, Homo sapiens
ggcttgagctggaacagcttggt

SEQ ID NO: 7274102 - DNA, 23 bp, Homo sapiens
ggcttgagctggaacagcttggt

SEQ ID NO: 7274103 - DNA, 22 bp, Homo sapiens
ggctgcagccctcgcctagcca

SEQ ID NO: 7274104 - DNA, 22 bp, Homo sapiens
ggctgcagcggattggggattg

SEQ ID NO: 7274105 - DNA, 22 bp, Homo sapiens
ggctgcagatagccagccacca

SEQ ID NO: 7274106 - DNA, 22 bp, Homo sapiens
ggctgcagattgtagtctgtta

SEQ ID NO: 7274107 - DNA, 22 bp, Homo sapiens
ggctgaggctcatgccatcttg

SEQ ID NO: 7274108 - DNA, 22 bp, Homo sapiens
ggctgcagaggcgatctgaggt

SEQ ID NO: 7274109 - DNA, 22 bp, Homo sapiens
ggctgcagaggcgatctgaggt

SEQ ID NO: 7274110 - DNA, 22 bp, Homo sapiens
cactgcctccccaggctccaca

SEQ ID NO: 7274111 - DNA, 22 bp, Homo sapiens
ggctgcggatctaaggctggga

SEQ ID NO: 7274112 - DNA, 22 bp, Homo sapiens
ggcgctcagtgttgccccagag

SEQ ID NO: 7274113 - DNA, 22 bp, Homo sapiens
cactgcaacctccacctcctgg

SEQ ID NO: 7274114 - DNA, 22 bp, Homo sapiens
cactgcctccccaggctccaca

SEQ ID NO: 7274115 - DNA, 22 bp, Homo sapiens
ggagcaggagtctcttgaattt

SEQ ID NO: 7274116 - DNA, 22 bp, Homo sapiens
cacagcattcacagaaagacat

SEQ ID NO: 7274117 - DNA, 22 bp, Homo sapiens
cacagcattaactgggacagct

SEQ ID NO: 7274118 - DNA, 22 bp, Homo sapiens
cacagcataatgaaatatactt

SEQ ID NO: 7274119 - DNA, 22 bp, Homo sapiens
cacagccttactgagatccact

SEQ ID NO: 7274120 - DNA, 22 bp, Homo sapiens
ggaggggatttagtagatgcta

SEQ ID NO: 7274121 - DNA, 22 bp, Homo sapiens
ggaggggatggtttgaccctgg

SEQ ID NO: 7274122 - DNA, 22 bp, Homo sapiens
cacaggagagctgggaggtgcc

SEQ ID NO: 7274123 - DNA, 22 bp, Homo sapiens
ggagagtgggagcaactgttgc

SEQ ID NO: 7274124 - DNA, 21 bp, Homo sapiens
ggacagctgcgcgcagggctc

SEQ ID NO: 7274125 - DNA, 22 bp, Homo sapiens
ggacagctctgccaggagctca

SEQ ID NO: 7274126 - DNA, 22 bp, Homo sapiens
ggacagctgctttcaggccaca

SEQ ID NO: 7274127 - DNA, 22 bp, Homo sapiens
ggacaagcctgtgagtgggttt

SEQ ID NO: 7274128 - DNA, 22 bp, Homo sapiens
ggaagagaatgatggctatggg

SEQ ID NO: 7274129 - DNA, 22 bp, Homo sapiens
caatggaagaatctgacctgca

SEQ ID NO: 7274130 - DNA, 21 bp, Homo sapiens
caatggcgagatcttggctca

SEQ ID NO: 7274131 - DNA, 22 bp, Homo sapiens
gcttccagacgatcatgtaaga

SEQ ID NO: 7274132 - DNA, 22 bp, Homo sapiens
gcttccagagagccccgcctgg

SEQ ID NO: 7274133 - DNA, 22 bp, Homo sapiens
gcttccagcaaacactggctgc

SEQ ID NO: 7274134 - DNA, 19 bp, Homo sapiens
gcttccagcactgcaggag

SEQ ID NO: 7274135 - DNA, 22 bp, Homo sapiens
gcttccagccttttctcctctg

SEQ ID NO: 7274136 - DNA, 22 bp, Homo sapiens
gcttccaggcttcctacctttg

SEQ ID NO: 7274137 - DNA, 22 bp, Homo sapiens
caagttgtacagattgtattag

SEQ ID NO: 7274138 - DNA, 22 bp, Homo sapiens
gctggtgtttcccgcggctcca

SEQ ID NO: 7274139 - DNA, 22 bp, Homo sapiens
gctggtgcattagctgcagttc

SEQ ID NO: 7274140 - DNA, 22 bp, Homo sapiens
gctgaggtggagattgcagtga

SEQ ID NO: 7274141 - DNA, 19 bp, Homo sapiens
gctgaggtggaggaaggag

SEQ ID NO: 7274142 - DNA, 20 bp, Homo sapiens
gctggcagatgtcttgagat

SEQ ID NO: 7274143 - DNA, 22 bp, Homo sapiens
caaattcctcagaatcagaaaa

SEQ ID NO: 7274144 - DNA, 20 bp, Homo sapiens
gctgaggtccctgtggtttt

SEQ ID NO: 7274145 - DNA, 22 bp, Homo sapiens
gctgaggtccagcattcgccta

SEQ ID NO: 7274146 - DNA, 20 bp, Homo sapiens
gctgaggtcattatgcctca

SEQ ID NO: 7274147 - DNA, 23 bp, Homo sapiens
gctgaggtcctgctgagtggtgg

SEQ ID NO: 7274148 - DNA, 22 bp, Homo sapiens
gctgaggtgaggctggaaagga

SEQ ID NO: 7274149 - DNA, 23 bp, Homo sapiens
gctgaggtacatttacaggaaga

SEQ ID NO: 7274150 - DNA, 22 bp, Homo sapiens
gctgaggtaggaggttgcagtg

SEQ ID NO: 7274151 - DNA, 22 bp, Homo sapiens
gctgaggtcaggagctgtgggg

SEQ ID NO: 7274152 - DNA, 22 bp, Homo sapiens
gctggctgtgattttgccaaca

SEQ ID NO: 7274153 - DNA, 22 bp, Homo sapiens
attgttatgaaaataagatgtt

SEQ ID NO: 7274154 - DNA, 20 bp, Homo sapiens
gcagtgctggtgcctctgct

SEQ ID NO: 7274155 - DNA, 18 bp, Homo sapiens
gcagtgccagcctctcct

SEQ ID NO: 7274156 - DNA, 22 bp, Homo sapiens
atttaaatgcttaagagggttt

SEQ ID NO: 7274157 - DNA, 22 bp, Homo sapiens
gccactgtcatcttgtgaagca

SEQ ID NO: 7274158 - DNA, 22 bp, Homo sapiens
attggcagttagtgacgaggct

SEQ ID NO: 7274159 - DNA, 22 bp, Homo sapiens
gcaggctgtggtatgttgggca

SEQ ID NO: 7274160 - DNA, 22 bp, Homo sapiens
gcaggctgtgaggctcagatgg

SEQ ID NO: 7274161 - DNA, 22 bp, Homo sapiens
gcaggctgtgaggctcagatgg

SEQ ID NO: 7274162 - DNA, 22 bp, Homo sapiens
gcaggctgtctaaagttagagt

SEQ ID NO: 7274163 - DNA, 22 bp, Homo sapiens
gcaggctggtctgaccatccct

SEQ ID NO: 7274164 - DNA, 22 bp, Homo sapiens
gcaggctgtagacaccaaacta

SEQ ID NO: 7274165 - DNA, 22 bp, Homo sapiens
gcaggagcagtcaggggcagct

SEQ ID NO: 7274166 - DNA, 22 bp, Homo sapiens
gcaggcggatcactggaagtca

SEQ ID NO: 7274167 - DNA, 22 bp, Homo sapiens
gcagatgcatcttggtttaaac

SEQ ID NO: 7274168 - DNA, 22 bp, Homo sapiens
gcagatgccagatcatgcaggg

SEQ ID NO: 7274169 - DNA, 22 bp, Homo sapiens
gcagatgccagatcatgcaggg

SEQ ID NO: 7274170 - DNA, 22 bp, Homo sapiens
gcagatgcaactgcaggtgagt

SEQ ID NO: 7274171 - DNA, 22 bp, Homo sapiens
gcagatgctgagatttatttct

SEQ ID NO: 7274172 - DNA, 22 bp, Homo sapiens
gcagccaggtttgaggaccact

SEQ ID NO: 7274173 - DNA, 22 bp, Homo sapiens
gcagcctgggcaacagagtgag

SEQ ID NO: 7274174 - DNA, 18 bp, Homo sapiens
gcaggagatgggtggggt

SEQ ID NO: 7274175 - DNA, 22 bp, Homo sapiens
gcaggagagtctgtgccaggtt

SEQ ID NO: 7274176 - DNA, 22 bp, Homo sapiens
gcagaggcctaggtggaaggcc

SEQ ID NO: 7274177 - DNA, 22 bp, Homo sapiens
gcagaagggaataaggagcttt

SEQ ID NO: 7274178 - DNA, 22 bp, Homo sapiens
gcagaagtcagaccatctgaat

SEQ ID NO: 7274179 - DNA, 22 bp, Homo sapiens
gcagaggctgtagggaaggttg

SEQ ID NO: 7274180 - DNA, 22 bp, Homo sapiens
gcagaggcctaggtggaaggcc

SEQ ID NO: 7274181 - DNA, 22 bp, Homo sapiens
gcagaggcctgaaggtggcggg

SEQ ID NO: 7274182 - DNA, 22 bp, Homo sapiens
gcagaggctccattttacagat

SEQ ID NO: 7274183 - DNA, 22 bp, Homo sapiens
gcaaatggagtgaagagctgga

SEQ ID NO: 7274184 - DNA, 22 bp, Homo sapiens
gcaaacaagctgcctgaagatt

SEQ ID NO: 7274185 - DNA, 21 bp, Homo sapiens
gcaaatgttcaggaaaaaaga

SEQ ID NO: 7274186 - DNA, 22 bp, Homo sapiens
gcaaaaattccagggacgactc

SEQ ID NO: 7274187 - DNA, 22 bp, Homo sapiens
caaatctatatgttgatattct

SEQ ID NO: 7274188 - DNA, 22 bp, Homo sapiens
caaatgaatttccctgcaaatg

SEQ ID NO: 7274189 - DNA, 22 bp, Homo sapiens
gctgaggacatcatggaaggaa

SEQ ID NO: 7274190 - DNA, 22 bp, Homo sapiens
gctgaggaaaccaatgctcaga

SEQ ID NO: 7274191 - DNA, 22 bp, Homo sapiens
gctgaggaaaggctggaaggga

SEQ ID NO: 7274192 - DNA, 22 bp, Homo sapiens
gctgagctgggacagtcctggg

SEQ ID NO: 7274193 - DNA, 22 bp, Homo sapiens
gctgagctgaggcagggctggg

SEQ ID NO: 7274194 - DNA, 22 bp, Homo sapiens
gctcaaagaccagacagaggag

SEQ ID NO: 7274195 - DNA, 22 bp, Homo sapiens
gctcaaagaatattcagaatga

SEQ ID NO: 7274196 - DNA, 22 bp, Homo sapiens
gctcaaagcactttgcaaatat

SEQ ID NO: 7274197 - DNA, 22 bp, Homo sapiens
gctcaaagcaccctggaataag

SEQ ID NO: 7274198 - DNA, 22 bp, Homo sapiens
gctcaaagaggcctccaaatcc

SEQ ID NO: 7274199 - DNA, 22 bp, Homo sapiens
gctcaaaggctatcaatagtgt

SEQ ID NO: 7274200 - DNA, 21 bp, Homo sapiens
gctcaaagggcttgccatgct

SEQ ID NO: 7274201 - DNA, 22 bp, Homo sapiens
gcgttggggaccccgaagctgg

SEQ ID NO: 7274202 - DNA, 22 bp, Homo sapiens
gcgccccatctacagtactttt

SEQ ID NO: 7274203 - DNA, 22 bp, Homo sapiens
gcgcaggagccgcggagggccg

SEQ ID NO: 7274204 - DNA, 22 bp, Homo sapiens
gcctggctctgagtttctctcc

SEQ ID NO: 7274205 - DNA, 22 bp, Homo sapiens
gcctggctcctaaggactggct

SEQ ID NO: 7274206 - DNA, 21 bp, Homo sapiens
gcctggctctcactggcctgg

SEQ ID NO: 7274207 - DNA, 17 bp, Homo sapiens
gctccttctaacttcca

SEQ ID NO: 7274208 - DNA, 22 bp, Homo sapiens
gctccttctggctcccttttgg

SEQ ID NO: 7274209 - DNA, 17 bp, Homo sapiens
gctccaggcgtgagtga

SEQ ID NO: 7274210 - DNA, 22 bp, Homo sapiens
gctccaggctgctctgtcccat

SEQ ID NO: 7274211 - DNA, 22 bp, Homo sapiens
gctccaggcagcatagtggatg

SEQ ID NO: 7274212 - DNA, 22 bp, Homo sapiens
gctccaggccacggcttcttgg

SEQ ID NO: 7274213 - DNA, 20 bp, Homo sapiens
gctcaggtttgggctttgtg

SEQ ID NO: 7274214 - DNA, 22 bp, Homo sapiens
gctccaggccccagcgttccgc

SEQ ID NO: 7274215 - DNA, 22 bp, Homo sapiens
gctccaggcgagctggaccaga

SEQ ID NO: 7274216 - DNA, 22 bp, Homo sapiens
gctcagggtcccttggtgctgg

SEQ ID NO: 7274217 - DNA, 22 bp, Homo sapiens
gctcaggtagatggggttgtcc

SEQ ID NO: 7274218 - DNA, 22 bp, Homo sapiens
gctcaggtcttacccatgcctg

SEQ ID NO: 7274219 - DNA, 18 bp, Homo sapiens
gctcaggtatagacaggg

SEQ ID NO: 7274220 - DNA, 23 bp, Homo sapiens
gctcaggtggctcagggactgat

SEQ ID NO: 7274221 - DNA, 22 bp, Homo sapiens
gctcaggtgttacctcctctag

SEQ ID NO: 7274222 - DNA, 20 bp, Homo sapiens
gctcaggtgacagtcaggag

SEQ ID NO: 7274223 - DNA, 22 bp, Homo sapiens
atttgattagctgtgtaatttt

SEQ ID NO: 7274224 - DNA, 22 bp, Homo sapiens
atttgattagctgtgtaatttt

SEQ ID NO: 7274225 - DNA, 22 bp, Homo sapiens
atttgatttgtagatagtgtag

SEQ ID NO: 7274226 - DNA, 22 bp, Homo sapiens
atttgatttgtagatagtgtag

SEQ ID NO: 7274227 - DNA, 22 bp, Homo sapiens
atttgattagctgtgtaatttt

SEQ ID NO: 7274228 - DNA, 22 bp, Homo sapiens
atttgagaaaggagggaacttt

SEQ ID NO: 7274229 - DNA, 22 bp, Homo sapiens
atttgcaaagtcgtatctgtga

SEQ ID NO: 7274230 - DNA, 22 bp, Homo sapiens
attttaataagatccatttggt

SEQ ID NO: 7274231 - DNA, 22 bp, Homo sapiens
gcctggctccctctgcagctcc

SEQ ID NO: 7274232 - DNA, 22 bp, Homo sapiens
gcctggctcctaagagcacaac

SEQ ID NO: 7274233 - DNA, 22 bp, Homo sapiens
gcctggctccctctgcagctcc

SEQ ID NO: 7274234 - DNA, 22 bp, Homo sapiens
gcctgcctagaattgcagcttt

SEQ ID NO: 7274235 - DNA, 22 bp, Homo sapiens
gcctgcccacggggctggcata

SEQ ID NO: 7274236 - DNA, 22 bp, Homo sapiens
attttactactccaattaatga

SEQ ID NO: 7274237 - DNA, 22 bp, Homo sapiens
attttactaagtggatatctgt

SEQ ID NO: 7274238 - DNA, 22 bp, Homo sapiens
attttactaagtggatatctgt

SEQ ID NO: 7274239 - DNA, 18 bp, Homo sapiens
gccagagggaagcaggtg

SEQ ID NO: 7274240 - DNA, 22 bp, Homo sapiens
atttacagtttagcatttcaag

SEQ ID NO: 7274241 - DNA, 22 bp, Homo sapiens
atttacataatagactttaggt

SEQ ID NO: 7274242 - DNA, 22 bp, Homo sapiens
gcccagccacagtcactttcat

SEQ ID NO: 7274243 - DNA, 22 bp, Homo sapiens
gcccagccacagtcactttcat

SEQ ID NO: 7274244 - DNA, 22 bp, Homo sapiens
gcccagccagagctgtgtgatg

SEQ ID NO: 7274245 - DNA, 22 bp, Homo sapiens
gcccagcccagaaaggttcgga

SEQ ID NO: 7274246 - DNA, 22 bp, Homo sapiens
gcccaggagttgaagggctgac

SEQ ID NO: 7274247 - DNA, 22 bp, Homo sapiens
gcccaggagttcaagtctagtg

SEQ ID NO: 7274248 - DNA, 22 bp, Homo sapiens
gcccaggagttcaaggctgcag

SEQ ID NO: 7274249 - DNA, 22 bp, Homo sapiens
gcccaggaggttgggctgtgca

SEQ ID NO: 7274250 - DNA, 22 bp, Homo sapiens
gcccaggaggtggaggtgcagt

SEQ ID NO: 7274251 - DNA, 22 bp, Homo sapiens
gcccagcccctgggtggacgtg

SEQ ID NO: 7274252 - DNA, 23 bp, Homo sapiens
gccctccctcccaggtgggtgtt

SEQ ID NO: 7274253 - DNA, 22 bp, Homo sapiens
gccctcccctctgggtggtgag

SEQ ID NO: 7274254 - DNA, 22 bp, Homo sapiens
gccctccctacagcctatttct

SEQ ID NO: 7274255 - DNA, 22 bp, Homo sapiens
atgtacaatctatcacaagaag

SEQ ID NO: 7274256 - DNA, 21 bp, Homo sapiens
atgtcaaatgctttattttat

SEQ ID NO: 7274257 - DNA, 22 bp, Homo sapiens
atgtaatttatgttatccataa

SEQ ID NO: 7274258 - DNA, 22 bp, Homo sapiens
gagctttacttctgactggtgc

SEQ ID NO: 7274259 - DNA, 22 bp, Homo sapiens
gagaggtgaaggctgccctggg

SEQ ID NO: 7274260 - DNA, 22 bp, Homo sapiens
gagcagctcgagaaggaagcag

SEQ ID NO: 7274261 - DNA, 22 bp, Homo sapiens
gagcagctccagccgcatgact

SEQ ID NO: 7274262 - DNA, 22 bp, Homo sapiens
gagcagctcaggcacttagcca

SEQ ID NO: 7274263 - DNA, 22 bp, Homo sapiens
gagaggctgcatatgcacactg

SEQ ID NO: 7274264 - DNA, 22 bp, Homo sapiens
gagaggctggcagtgccaggtt

SEQ ID NO: 7274265 - DNA, 22 bp, Homo sapiens
gagaggctgatcctgcagagaa

SEQ ID NO: 7274266 - DNA, 22 bp, Homo sapiens
gagaggtagaggctctgcttaa

SEQ ID NO: 7274267 - DNA, 19 bp, Homo sapiens
gagcgcagagggcagggga

SEQ ID NO: 7274268 - DNA, 22 bp, Homo sapiens
gagcgatgtgggtatgtagaag

SEQ ID NO: 7274269 - DNA, 22 bp, Homo sapiens
gagcagctctgggtgacccagt

SEQ ID NO: 7274270 - DNA, 22 bp, Homo sapiens
gagcagctctgtgcctggagac

SEQ ID NO: 7274271 - DNA, 22 bp, Homo sapiens
gagcagctgagctggaatgaga

SEQ ID NO: 7274272 - DNA, 22 bp, Homo sapiens
gagcagtagagtacatggctcc

SEQ ID NO: 7274273 - DNA, 17 bp, Homo sapiens
gagtgcagacacaagca

SEQ ID NO: 7274274 - DNA, 22 bp, Homo sapiens
gagtgcagatgaacagaagatt

SEQ ID NO: 7274275 - DNA, 22 bp, Homo sapiens
gagtgcagatgccagccccagt

SEQ ID NO: 7274276 - DNA, 22 bp, Homo sapiens
gagtgcagatgccagccccagt

SEQ ID NO: 7274277 - DNA, 21 bp, Homo sapiens
gagtgcagcaaggtagagtct

SEQ ID NO: 7274278 - DNA, 21 bp, Homo sapiens
gagtgcagcaaggtagagtct

SEQ ID NO: 7274279 - DNA, 21 bp, Homo sapiens
gagtgcaggtctgatgccatc

SEQ ID NO: 7274280 - DNA, 22 bp, Homo sapiens
gagtgcaggcctgagcaccatc

SEQ ID NO: 7274281 - DNA, 22 bp, Homo sapiens
gagtgcaggcctgagcaccatc

SEQ ID NO: 7274282 - DNA, 22 bp, Homo sapiens
atgtttcaaatatatagagttg

SEQ ID NO: 7274283 - DNA, 22 bp, Homo sapiens
atgtttcaccagcaaattacct

SEQ ID NO: 7274284 - DNA, 22 bp, Homo sapiens
atgtttcagatacagatcaaat

SEQ ID NO: 7274285 - DNA, 22 bp, Homo sapiens
gagttacacagaagtcagtttg

SEQ ID NO: 7274286 - DNA, 22 bp, Homo sapiens
gaggccacagtcctgaggcatc

SEQ ID NO: 7274287 - DNA, 22 bp, Homo sapiens
gaggtagcatgctggaagggac

SEQ ID NO: 7274288 - DNA, 22 bp, Homo sapiens
gaggtagccacagatagagact

SEQ ID NO: 7274289 - DNA, 22 bp, Homo sapiens
gaggtagcgagtggacagtgca

SEQ ID NO: 7274290 - DNA, 22 bp, Homo sapiens
gaggttggggctgcagtgagct

SEQ ID NO: 7274291 - DNA, 22 bp, Homo sapiens
gagggggcgtgcaaggctccgc

SEQ ID NO: 7274292 - DNA, 22 bp, Homo sapiens
atgctttagtgtcaagtttggg

SEQ ID NO: 7274293 - DNA, 22 bp, Homo sapiens
gacagtgtgaacatctaatagt

SEQ ID NO: 7274294 - DNA, 22 bp, Homo sapiens
gaccctcctactaccctggaaa

SEQ ID NO: 7274295 - DNA, 21 bp, Homo sapiens
gaccccagaccagcagacaca

SEQ ID NO: 7274296 - DNA, 22 bp, Homo sapiens
gaccctggagccgtctgaggca

SEQ ID NO: 7274297 - DNA, 22 bp, Homo sapiens
gaatgtttgactaaaggtagct

SEQ ID NO: 7274298 - DNA, 22 bp, Homo sapiens
gaagcagagcctaaggcagaca

SEQ ID NO: 7274299 - DNA, 22 bp, Homo sapiens
gaagcacatggctatagctatt

SEQ ID NO: 7274300 - DNA, 22 bp, Homo sapiens
atgccctgctctcgggaaggga

SEQ ID NO: 7274301 - DNA, 22 bp, Homo sapiens
atgccctgagcaggccttcaag

SEQ ID NO: 7274302 - DNA, 22 bp, Homo sapiens
atgccctggacttctagtattc

SEQ ID NO: 7274303 - DNA, 22 bp, Homo sapiens
atgcctccgcatgtgcctttga

SEQ ID NO: 7274304 - DNA, 22 bp, Homo sapiens
atgcctccctgtccttcagttc

SEQ ID NO: 7274305 - DNA, 22 bp, Homo sapiens
atgcctcccctgtgtcttttat

SEQ ID NO: 7274306 - DNA, 22 bp, Homo sapiens
atgcctccaagattcttacgtt

SEQ ID NO: 7274307 - DNA, 22 bp, Homo sapiens
atgcctccttctgaaacagggc

SEQ ID NO: 7274308 - DNA, 22 bp, Homo sapiens
atgcctcctgtgccactgtgat

SEQ ID NO: 7274309 - DNA, 22 bp, Homo sapiens
atgcctcctcaaatctgccaca

SEQ ID NO: 7274310 - DNA, 22 bp, Homo sapiens
atgcctctgctcttggtcctca

SEQ ID NO: 7274311 - DNA, 22 bp, Homo sapiens
atcttcccaggctggggagagg

SEQ ID NO: 7274312 - DNA, 22 bp, Homo sapiens
cttgagaagagatttatatttg

SEQ ID NO: 7274313 - DNA, 22 bp, Homo sapiens
atgaatattgaatgtcttatga

SEQ ID NO: 7274314 - DNA, 22 bp, Homo sapiens
cttgaggttttgactcagcttt

SEQ ID NO: 7274315 - DNA, 23 bp, Homo sapiens
cttgagctcaggaagagctgagt

SEQ ID NO: 7274316 - DNA, 22 bp, Homo sapiens
cttgagcacagcggcttcagga

SEQ ID NO: 7274317 - DNA, 22 bp, Homo sapiens
gaaaacatccagagatagacct

SEQ ID NO: 7274318 - DNA, 22 bp, Homo sapiens
atgaatgggtcattatttgatc

SEQ ID NO: 7274319 - DNA, 22 bp, Homo sapiens
atgaattgaggaaaacagtcgt

SEQ ID NO: 7274320 - DNA, 22 bp, Homo sapiens
atgcacaagaggctagaaaaga

SEQ ID NO: 7274321 - DNA, 22 bp, Homo sapiens
gaacattactgcttgggagagg

SEQ ID NO: 7274322 - DNA, 22 bp, Homo sapiens
gaactttaatcccttgggctta

SEQ ID NO: 7274323 - DNA, 22 bp, Homo sapiens
gaactttaggattttcacaggt

SEQ ID NO: 7274324 - DNA, 22 bp, Homo sapiens
gaactttataactgtaaatgtc

SEQ ID NO: 7274325 - DNA, 22 bp, Homo sapiens
gaactttaattagcttttgtct

SEQ ID NO: 7274326 - DNA, 22 bp, Homo sapiens
gaactttaccatttaggtaact

SEQ ID NO: 7274327 - DNA, 22 bp, Homo sapiens
gaactttattccagaagaaagc

SEQ ID NO: 7274328 - DNA, 22 bp, Homo sapiens
gaactttatcaaaagttgttta

SEQ ID NO: 7274329 - DNA, 22 bp, Homo sapiens
gaactttattccagaagaaagc

SEQ ID NO: 7274330 - DNA, 22 bp, Homo sapiens
gaactttgtggggctgagagga

SEQ ID NO: 7274331 - DNA, 22 bp, Homo sapiens
atgaggcagtctggcctgaggg

SEQ ID NO: 7274332 - DNA, 22 bp, Homo sapiens
ctggtcatgccaggtttgctgc

SEQ ID NO: 7274333 - DNA, 22 bp, Homo sapiens
atcagcaggtgctggtggagac

SEQ ID NO: 7274334 - DNA, 22 bp, Homo sapiens
atcagcagtgtctacctcggtg

SEQ ID NO: 7274335 - DNA, 22 bp, Homo sapiens
atcagcagatgctcaatgaaca

SEQ ID NO: 7274336 - DNA, 22 bp, Homo sapiens
atcacaaagggttttctctgag

SEQ ID NO: 7274337 - DNA, 22 bp, Homo sapiens
atcatacagcctttgttagtgt

SEQ ID NO: 7274338 - DNA, 22 bp, Homo sapiens
atcatacagcctttgttagtgt

SEQ ID NO: 7274339 - DNA, 22 bp, Homo sapiens
cttaacatcctgcatttttctt

SEQ ID NO: 7274340 - DNA, 22 bp, Homo sapiens
atccatgaaggtacttctcagg

SEQ ID NO: 7274341 - DNA, 20 bp, Homo sapiens
atccatgagagtctggattc

SEQ ID NO: 7274342 - DNA, 22 bp, Homo sapiens
atccatgatcaatttattacta

SEQ ID NO: 7274343 - DNA, 22 bp, Homo sapiens
cttaataataggtgaggctatg

SEQ ID NO: 7274344 - DNA, 22 bp, Homo sapiens
cttagatgaagtcacagaaccc

SEQ ID NO: 7274345 - DNA, 22 bp, Homo sapiens
atccatgattagtaggataaag

SEQ ID NO: 7274346 - DNA, 22 bp, Homo sapiens
cttatgatcctaaattgcaggt

SEQ ID NO: 7274347 - DNA, 22 bp, Homo sapiens
cttcaagtcgccaaatgctgaa

SEQ ID NO: 7274348 - DNA, 22 bp, Homo sapiens
cttccttgcggcccctgcctag

SEQ ID NO: 7274349 - DNA, 22 bp, Homo sapiens
cttccttgctgtctgctccagg

SEQ ID NO: 7274350 - DNA, 19 bp, Homo sapiens
cttccttgctccccatgtg

SEQ ID NO: 7274351 - DNA, 22 bp, Homo sapiens
cttccttctgaagcatagaagc

SEQ ID NO: 7274352 - DNA, 22 bp, Homo sapiens
cttccttctgaagcatagaagc

SEQ ID NO: 7274353 - DNA, 22 bp, Homo sapiens
cttctgagatgttgttttacag

SEQ ID NO: 7274354 - DNA, 22 bp, Homo sapiens
cttctgagatgttgttttacag

SEQ ID NO: 7274355 - DNA, 22 bp, Homo sapiens
cttccttgtggtccttctcatt

SEQ ID NO: 7274356 - DNA, 22 bp, Homo sapiens
cttccttggcttctggggtgtg

SEQ ID NO: 7274357 - DNA, 21 bp, Homo sapiens
atctcgggcttctcgcccagc

SEQ ID NO: 7274358 - DNA, 22 bp, Homo sapiens
cttctgagatgttgttttacag

SEQ ID NO: 7274359 - DNA, 22 bp, Homo sapiens
cttctgtgcttcacagttgcca

SEQ ID NO: 7274360 - DNA, 22 bp, Homo sapiens
cttctgcccctgtagcctgagt

SEQ ID NO: 7274361 - DNA, 22 bp, Homo sapiens
atagtttgaaggctgttctact

SEQ ID NO: 7274362 - DNA, 22 bp, Homo sapiens
ctggcctttcgtgagagctggg

SEQ ID NO: 7274363 - DNA, 22 bp, Homo sapiens
atagtttgtgaaacacagcagt

SEQ ID NO: 7274364 - DNA, 19 bp, Homo sapiens
ctggctcttgggtggagga

SEQ ID NO: 7274365 - DNA, 22 bp, Homo sapiens
ctggctcttggctagggagagt

SEQ ID NO: 7274366 - DNA, 22 bp, Homo sapiens
ctggctcttggctagggagagt

SEQ ID NO: 7274367 - DNA, 22 bp, Homo sapiens
ctggctgaatcctagtctcata

SEQ ID NO: 7274368 - DNA, 22 bp, Homo sapiens
ctggctgacaccttgatagcag

SEQ ID NO: 7274369 - DNA, 22 bp, Homo sapiens
ctggctctttcctagctaggct

SEQ ID NO: 7274370 - DNA, 22 bp, Homo sapiens
ctggctctttcagccgctggag

SEQ ID NO: 7274371 - DNA, 22 bp, Homo sapiens
atataatacaacctgctaagtg

SEQ ID NO: 7274372 - DNA, 19 bp, Homo sapiens
ctggctgcaatgccagggt

SEQ ID NO: 7274373 - DNA, 22 bp, Homo sapiens
ctggctgagctagagtccatgg

SEQ ID NO: 7274374 - DNA, 22 bp, Homo sapiens
ctggctgaggcagagcctgggg

SEQ ID NO: 7274375 - DNA, 22 bp, Homo sapiens
ctggctgagttactccactgag

SEQ ID NO: 7274376 - DNA, 22 bp, Homo sapiens
ctggctgaggtcaccagtagct

SEQ ID NO: 7274377 - DNA, 22 bp, Homo sapiens
atacacatgtgtatgtgcatgc

SEQ ID NO: 7274378 - DNA, 22 bp, Homo sapiens
atacacatgtgtatgtgcatgc

SEQ ID NO: 7274379 - DNA, 22 bp, Homo sapiens
ctggcaagtactgggccagctc

SEQ ID NO: 7274380 - DNA, 22 bp, Homo sapiens
atacatgtgctatgttggtgta

SEQ ID NO: 7274381 - DNA, 22 bp, Homo sapiens
atacatgtgccgcgttggtgtg

SEQ ID NO: 7274382 - DNA, 22 bp, Homo sapiens
atacatgtgccatgttggtgta

SEQ ID NO: 7274383 - DNA, 22 bp, Homo sapiens
ataaagcaatagattgtgtaat

SEQ ID NO: 7274384 - DNA, 22 bp, Homo sapiens
ataaagcaaataggactattgc

SEQ ID NO: 7274385 - DNA, 22 bp, Homo sapiens
ataaagatttctttttctctac

SEQ ID NO: 7274386 - DNA, 22 bp, Homo sapiens
ataaactttagcggaaggagga

SEQ ID NO: 7274387 - DNA, 22 bp, Homo sapiens
ataaacttgagtctcagagtat

SEQ ID NO: 7274388 - DNA, 22 bp, Homo sapiens
ctgcagggaccacaagcaggtt

SEQ ID NO: 7274389 - DNA, 22 bp, Homo sapiens
agttcttcataaccttactgtg

SEQ ID NO: 7274390 - DNA, 22 bp, Homo sapiens
ataaaaaggacagatgtggtct

SEQ ID NO: 7274391 - DNA, 22 bp, Homo sapiens
ataaaaatgagggcggtagcta

SEQ ID NO: 7274392 - DNA, 22 bp, Homo sapiens
agttctagaagacttttccatt

SEQ ID NO: 7274393 - DNA, 22 bp, Homo sapiens
agttctcaagacaattacctgt

SEQ ID NO: 7274394 - DNA, 21 bp, Homo sapiens
atacacatacacataaatgtg

SEQ ID NO: 7274395 - DNA, 22 bp, Homo sapiens
atacacatatgtgtgtatatgt

SEQ ID NO: 7274396 - DNA, 18 bp, Homo sapiens
ctgctgtgtcgtctgggc

SEQ ID NO: 7274397 - DNA, 22 bp, Homo sapiens
ctgctgtgtcagagtccagggg

SEQ ID NO: 7274398 - DNA, 22 bp, Homo sapiens
ctgctgtgggttaagacactgt

SEQ ID NO: 7274399 - DNA, 22 bp, Homo sapiens
ctgctgtgggttaagacactgt

SEQ ID NO: 7274400 - DNA, 22 bp, Homo sapiens
ctgcctggtctcaggcatgggg

SEQ ID NO: 7274401 - DNA, 22 bp, Homo sapiens
ctgcctggtctcaggcatgggg

SEQ ID NO: 7274402 - DNA, 22 bp, Homo sapiens
agtggggagtttccagatgtgt

SEQ ID NO: 7274403 - DNA, 22 bp, Homo sapiens
agtggtcaaagactagatttca

SEQ ID NO: 7274404 - DNA, 22 bp, Homo sapiens
agtgggtgtagtcttcctcctg

SEQ ID NO: 7274405 - DNA, 22 bp, Homo sapiens
agtgtatttgagcatctcctta

SEQ ID NO: 7274406 - DNA, 22 bp, Homo sapiens
agtgtattcagaatgtagcaaa

SEQ ID NO: 7274407 - DNA, 22 bp, Homo sapiens
agtgtgagatgattgaggagca

SEQ ID NO: 7274408 - DNA, 22 bp, Homo sapiens
agtgtgagaacggactaataaa

SEQ ID NO: 7274409 - DNA, 23 bp, Homo sapiens
agtgtgacttttttgactgtcac

SEQ ID NO: 7274410 - DNA, 19 bp, Homo sapiens
agtgtgagactccatctca

SEQ ID NO: 7274411 - DNA, 22 bp, Homo sapiens
agtgtgagccctggagtggtgc

SEQ ID NO: 7274412 - DNA, 22 bp, Homo sapiens
agtgtgagattaaaccgaatca

SEQ ID NO: 7274413 - DNA, 22 bp, Homo sapiens
agtgtgagctaatagcagagcc

SEQ ID NO: 7274414 - DNA, 22 bp, Homo sapiens
agtgtgagcctacaggccaaag

SEQ ID NO: 7274415 - DNA, 22 bp, Homo sapiens
agtgtgaggggttctttgatat

SEQ ID NO: 7274416 - DNA, 22 bp, Homo sapiens
agtgtgagtaattcagggaggg

SEQ ID NO: 7274417 - DNA, 22 bp, Homo sapiens
agtgtctttgtctctcaagcac

SEQ ID NO: 7274418 - DNA, 22 bp, Homo sapiens
agtgtctttgacacattcaaag

SEQ ID NO: 7274419 - DNA, 22 bp, Homo sapiens
ctgagctgcagtcctggctctg

SEQ ID NO: 7274420 - DNA, 22 bp, Homo sapiens
agttcccaggtgatgctgatgt

SEQ ID NO: 7274421 - DNA, 22 bp, Homo sapiens
ctgagctctaatgtcagccttg

SEQ ID NO: 7274422 - DNA, 22 bp, Homo sapiens
agtgtttggggtgattgtaacc

SEQ ID NO: 7274423 - DNA, 19 bp, Homo sapiens
agtgtttcatgtgctttta

SEQ ID NO: 7274424 - DNA, 22 bp, Homo sapiens
agtgtttctggcaaatgaaagt

SEQ ID NO: 7274425 - DNA, 22 bp, Homo sapiens
agtgtttgcatctcattgattt

SEQ ID NO: 7274426 - DNA, 22 bp, Homo sapiens
agtgtgggccacgcagctgagc

SEQ ID NO: 7274427 - DNA, 22 bp, Homo sapiens
agtgtttcaagtgatgctttgg

SEQ ID NO: 7274428 - DNA, 22 bp, Homo sapiens
agtgtttcaagtgatgctttgg

SEQ ID NO: 7274429 - DNA, 22 bp, Homo sapiens
agtgtgagttacaaagtgtgaa

SEQ ID NO: 7274430 - DNA, 22 bp, Homo sapiens
agtgtgagtttggttgagactt

SEQ ID NO: 7274431 - DNA, 22 bp, Homo sapiens
agtgtgagtgctcatgtccatc

SEQ ID NO: 7274432 - DNA, 19 bp, Homo sapiens
agtgtgagtaattggagtt

SEQ ID NO: 7274433 - DNA, 22 bp, Homo sapiens
agtgtgagtaattgagtctgtc

SEQ ID NO: 7274434 - DNA, 22 bp, Homo sapiens
agtgcatttggggtagtggaag

SEQ ID NO: 7274435 - DNA, 19 bp, Homo sapiens
agtgccttgctctctaggt

SEQ ID NO: 7274436 - DNA, 22 bp, Homo sapiens
agtgccctgctggggcaggaga

SEQ ID NO: 7274437 - DNA, 22 bp, Homo sapiens
agtgccctggcccagctggacc

SEQ ID NO: 7274438 - DNA, 22 bp, Homo sapiens
agtgccctgggccttccaggac

SEQ ID NO: 7274439 - DNA, 22 bp, Homo sapiens
agtggcaggcggagatgtagga

SEQ ID NO: 7274440 - DNA, 22 bp, Homo sapiens
agtggcagtggggcagggccct

SEQ ID NO: 7274441 - DNA, 22 bp, Homo sapiens
agtggacattctgcacttggag

SEQ ID NO: 7274442 - DNA, 22 bp, Homo sapiens
agtgaggggcagctgagtgggc

SEQ ID NO: 7274443 - DNA, 22 bp, Homo sapiens
agtgagggatgaagaactgcgg

SEQ ID NO: 7274444 - DNA, 22 bp, Homo sapiens
agtgaggggattcaggcaaggt

SEQ ID NO: 7274445 - DNA, 22 bp, Homo sapiens
ctattctaagctcagaatccca

SEQ ID NO: 7274446 - DNA, 22 bp, Homo sapiens
ctattctagtctgtcatgtcca

SEQ ID NO: 7274447 - DNA, 22 bp, Homo sapiens
ctattctagattacagtataaa

SEQ ID NO: 7274448 - DNA, 22 bp, Homo sapiens
agtcctgggtctggagaatgga

SEQ ID NO: 7274449 - DNA, 22 bp, Homo sapiens
ctagcctgggatttgaacttat

SEQ ID NO: 7274450 - DNA, 22 bp, Homo sapiens
agtcacatggactcaggatgac

SEQ ID NO: 7274451 - DNA, 23 bp, Homo sapiens
agtaaagcaattgttggcgagag

SEQ ID NO: 7274452 - DNA, 22 bp, Homo sapiens
agtaaactgtgggtacagatgt

SEQ ID NO: 7274453 - DNA, 22 bp, Homo sapiens
agtaaagcagagttgcagtaca

SEQ ID NO: 7274454 - DNA, 18 bp, Homo sapiens
agtaaagcttattacatg

SEQ ID NO: 7274455 - DNA, 22 bp, Homo sapiens
agtaaataacagagaaaatggg

SEQ ID NO: 7274456 - DNA, 22 bp, Homo sapiens
agtaaatcagacctcattatgt

SEQ ID NO: 7274457 - DNA, 22 bp, Homo sapiens
agtaaaaattgaggtgcaaaat

SEQ ID NO: 7274458 - DNA, 22 bp, Homo sapiens
ccttctctctgaagaccccaaa

SEQ ID NO: 7274459 - DNA, 22 bp, Homo sapiens
agtcaaggctattatgtgggaa

SEQ ID NO: 7274460 - DNA, 22 bp, Homo sapiens
agtagcaatggctctgagctat

SEQ ID NO: 7274461 - DNA, 22 bp, Homo sapiens
ccttccagatgtaagagctgat

SEQ ID NO: 7274462 - DNA, 22 bp, Homo sapiens
ccttccaggctggaggcttggg

SEQ ID NO: 7274463 - DNA, 21 bp, Homo sapiens
aggtcagcccagctctggaag

SEQ ID NO: 7274464 - DNA, 22 bp, Homo sapiens
aggtcagcatgagtagaaggta

SEQ ID NO: 7274465 - DNA, 23 bp, Homo sapiens
aggtcagcaggcaaggaaatggc

SEQ ID NO: 7274466 - DNA, 22 bp, Homo sapiens
aggtcagcaggccaggggcgaa

SEQ ID NO: 7274467 - DNA, 22 bp, Homo sapiens
aggtaaattcagcagtgacatt

SEQ ID NO: 7274468 - DNA, 22 bp, Homo sapiens
cctgaggtttttggatagttgt

SEQ ID NO: 7274469 - DNA, 21 bp, Homo sapiens
cctgaggtttctggcctctgt

SEQ ID NO: 7274470 - DNA, 22 bp, Homo sapiens
cctgaggtggctgcagcactgc

SEQ ID NO: 7274471 - DNA, 18 bp, Homo sapiens
cctgaggtgggaggaagg

SEQ ID NO: 7274472 - DNA, 19 bp, Homo sapiens
cctgaggtggggtggaagg

SEQ ID NO: 7274473 - DNA, 22 bp, Homo sapiens
cctgaggttatccatctacctg

SEQ ID NO: 7274474 - DNA, 22 bp, Homo sapiens
cctgaggttgaagtataaattg

SEQ ID NO: 7274475 - DNA, 22 bp, Homo sapiens
agctggtcttaaatgtgtccag

SEQ ID NO: 7274476 - DNA, 22 bp, Homo sapiens
caggcagagtgagaagcccttg

SEQ ID NO: 7274477 - DNA, 22 bp, Homo sapiens
caggcagagtgagaagcccttg

SEQ ID NO: 7274478 - DNA, 22 bp, Homo sapiens
caggcagaggtaccaagattga

SEQ ID NO: 7274479 - DNA, 22 bp, Homo sapiens
agctggagattctggggacagt

SEQ ID NO: 7274480 - DNA, 22 bp, Homo sapiens
agctgccctttatgatgctgaa

SEQ ID NO: 7274481 - DNA, 22 bp, Homo sapiens
agctgcccttaataggcattca

SEQ ID NO: 7274482 - DNA, 22 bp, Homo sapiens
agctgccctgtggggagggttg

SEQ ID NO: 7274483 - DNA, 22 bp, Homo sapiens
agctgccctggtaagattgatg

SEQ ID NO: 7274484 - DNA, 22 bp, Homo sapiens
agctgccgatgcccagctgcat

SEQ ID NO: 7274485 - DNA, 22 bp, Homo sapiens
agctgccctgggctggagatgg

SEQ ID NO: 7274486 - DNA, 20 bp, Homo sapiens
agctgcccctgggcactgcc

SEQ ID NO: 7274487 - DNA, 22 bp, Homo sapiens
agctcttttgctctccaagttt

SEQ ID NO: 7274488 - DNA, 22 bp, Homo sapiens
caggaaaaggagactttagcac

SEQ ID NO: 7274489 - DNA, 23 bp, Homo sapiens
aggaatgtgcccacccatctcct

SEQ ID NO: 7274490 - DNA, 22 bp, Homo sapiens
caggtcctcacgcctcaccctt

SEQ ID NO: 7274491 - DNA, 22 bp, Homo sapiens
aggaaaacacagtattgatgga

SEQ ID NO: 7274492 - DNA, 22 bp, Homo sapiens
agctttattcatgatttcaggg

SEQ ID NO: 7274493 - DNA, 22 bp, Homo sapiens
agctttcacgatttggaacagg

SEQ ID NO: 7274494 - DNA, 22 bp, Homo sapiens
caggcttgagggcaggcccagt

SEQ ID NO: 7274495 - DNA, 22 bp, Homo sapiens
aggatgagaagattggaatctt

SEQ ID NO: 7274496 - DNA, 22 bp, Homo sapiens
catgtgtctttatggagccaca

SEQ ID NO: 7274497 - DNA, 16 bp, Homo sapiens
aggcagagatttaccc

SEQ ID NO: 7274498 - DNA, 22 bp, Homo sapiens
aggcagagagcagtggccgtct

SEQ ID NO: 7274499 - DNA, 22 bp, Homo sapiens
aggcactgactcaagggagcca

SEQ ID NO: 7274500 - DNA, 23 bp, Homo sapiens
aggcagagccaaggtcaaaaccc

SEQ ID NO: 7274501 - DNA, 20 bp, Homo sapiens
aggcagagcgcacttttaga

SEQ ID NO: 7274502 - DNA, 22 bp, Homo sapiens
aggcagagctaggaagaattgt

SEQ ID NO: 7274503 - DNA, 22 bp, Homo sapiens
aggcagagctgatgttctgtga

SEQ ID NO: 7274504 - DNA, 22 bp, Homo sapiens
aggcagaggagaatgatcttcc

SEQ ID NO: 7274505 - DNA, 22 bp, Homo sapiens
aggcagaggagaatgatcttcc

SEQ ID NO: 7274506 - DNA, 22 bp, Homo sapiens
aggcagaggaagggtggatttg

SEQ ID NO: 7274507 - DNA, 22 bp, Homo sapiens
aggcagagctgggttttgaaat

SEQ ID NO: 7274508 - DNA, 22 bp, Homo sapiens
aggcagagctgggttttgaaat

SEQ ID NO: 7274509 - DNA, 22 bp, Homo sapiens
aggcagcttaagccctggccca

SEQ ID NO: 7274510 - DNA, 22 bp, Homo sapiens
aggcagcttctgattagcagcg

SEQ ID NO: 7274511 - DNA, 22 bp, Homo sapiens
aggcagctttcagtgtctctca

SEQ ID NO: 7274512 - DNA, 22 bp, Homo sapiens
aggcagctttaactggtagtag

SEQ ID NO: 7274513 - DNA, 22 bp, Homo sapiens
aggcagctttgtagtaaagcta

SEQ ID NO: 7274514 - DNA, 22 bp, Homo sapiens
aggcagctttctggtgcaccat

SEQ ID NO: 7274515 - DNA, 22 bp, Homo sapiens
aggcagctttctgtaggggtgt

SEQ ID NO: 7274516 - DNA, 22 bp, Homo sapiens
aggcagcgtagcaaggctagta

SEQ ID NO: 7274517 - DNA, 21 bp, Homo sapiens
aggcagcgtgagggccactca

SEQ ID NO: 7274518 - DNA, 22 bp, Homo sapiens
aggcagctggcagcacccaggg

SEQ ID NO: 7274519 - DNA, 22 bp, Homo sapiens
aggcagctgtgaggactggatt

SEQ ID NO: 7274520 - DNA, 23 bp, Homo sapiens
aggcagctgggtagcatctttct

SEQ ID NO: 7274521 - DNA, 20 bp, Homo sapiens
aggcagctggccaggcaggt

SEQ ID NO: 7274522 - DNA, 20 bp, Homo sapiens
aggcagctgggaaatgaggg

SEQ ID NO: 7274523 - DNA, 22 bp, Homo sapiens
aggcaggctcaggcccatgctt

SEQ ID NO: 7274524 - DNA, 22 bp, Homo sapiens
aggcaggctcaatgcccagtct

SEQ ID NO: 7274525 - DNA, 22 bp, Homo sapiens
aggcaggctgctatggagtaga

SEQ ID NO: 7274526 - DNA, 22 bp, Homo sapiens
aggcaggctctgggtatgtgca

SEQ ID NO: 7274527 - DNA, 22 bp, Homo sapiens
ccaaaccatccatctccaggct

SEQ ID NO: 7274528 - DNA, 22 bp, Homo sapiens
ccaaaatattagtgcttaagta

SEQ ID NO: 7274529 - DNA, 22 bp, Homo sapiens
aggcaggccctctggaaaggta

SEQ ID NO: 7274530 - DNA, 22 bp, Homo sapiens
aggcaggcccctgagaatagac

SEQ ID NO: 7274531 - DNA, 22 bp, Homo sapiens
aggagctgggctgctgctggga

SEQ ID NO: 7274532 - DNA, 22 bp, Homo sapiens
aggagctgggagaaggactaaa

SEQ ID NO: 7274533 - DNA, 22 bp, Homo sapiens
aggagctggcctagaaaggaga

SEQ ID NO: 7274534 - DNA, 22 bp, Homo sapiens
aggagctgatagtctatggaga

SEQ ID NO: 7274535 - DNA, 22 bp, Homo sapiens
aggagcagcttctgaaccatgt

SEQ ID NO: 7274536 - DNA, 22 bp, Homo sapiens
cagtgcttttcaaagttctatg

SEQ ID NO: 7274537 - DNA, 22 bp, Homo sapiens
cagtctgaacactgggctactc

SEQ ID NO: 7274538 - DNA, 22 bp, Homo sapiens
aggaggctgggcacagtggcct

SEQ ID NO: 7274539 - DNA, 22 bp, Homo sapiens
aggaggtcagagccccatgctg

SEQ ID NO: 7274540 - DNA, 22 bp, Homo sapiens
aggagtgggggcgagaagttaa

SEQ ID NO: 7274541 - DNA, 22 bp, Homo sapiens
aggagtggtgcaggacctgcca

SEQ ID NO: 7274542 - DNA, 22 bp, Homo sapiens
ccctgctttgcacccaggctgg

SEQ ID NO: 7274543 - DNA, 22 bp, Homo sapiens
cctcagcttgatttctgcagag

SEQ ID NO: 7274544 - DNA, 22 bp, Homo sapiens
agggcgtggtggtgctggagca

SEQ ID NO: 7274545 - DNA, 22 bp, Homo sapiens
cctcaggatccgcaggtgcagt

SEQ ID NO: 7274546 - DNA, 20 bp, Homo sapiens
cctcaggatgagggtgagca

SEQ ID NO: 7274547 - DNA, 22 bp, Homo sapiens
agggtaggtgtaagatagccct

SEQ ID NO: 7274548 - DNA, 22 bp, Homo sapiens
agggtcaaaggaaaggcccaca

SEQ ID NO: 7274549 - DNA, 22 bp, Homo sapiens
cctgaggtctagagtcagggtg

SEQ ID NO: 7274550 - DNA, 22 bp, Homo sapiens
agggtagggccgtagggccatg

SEQ ID NO: 7274551 - DNA, 22 bp, Homo sapiens
agggtaggaactgagtggaagg

SEQ ID NO: 7274552 - DNA, 22 bp, Homo sapiens
agggtagggcccggagacagac

SEQ ID NO: 7274553 - DNA, 22 bp, Homo sapiens
aggggatgatcctcccgcagcg

SEQ ID NO: 7274554 - DNA, 22 bp, Homo sapiens
ccctcacagtctaggagcagct

SEQ ID NO: 7274555 - DNA, 22 bp, Homo sapiens
ccccttccacagtgcttcctaa

SEQ ID NO: 7274556 - DNA, 22 bp, Homo sapiens
ccctaggctgaggccagggtgc

SEQ ID NO: 7274557 - DNA, 22 bp, Homo sapiens
ccccttccaggaagcagaatcg

SEQ ID NO: 7274558 - DNA, 22 bp, Homo sapiens
ccccagcacaggctcctcagat

SEQ ID NO: 7274559 - DNA, 22 bp, Homo sapiens
cccatgaggtggaggttgcagt

SEQ ID NO: 7274560 - DNA, 22 bp, Homo sapiens
cccatgaggtggaggttgcagt

SEQ ID NO: 7274561 - DNA, 17 bp, Homo sapiens
cccatgagcccactccc

SEQ ID NO: 7274562 - DNA, 22 bp, Homo sapiens
cccatgagattctgaatttggc

SEQ ID NO: 7274563 - DNA, 22 bp, Homo sapiens
cccatgagacctggtttaaggc

SEQ ID NO: 7274564 - DNA, 22 bp, Homo sapiens
ccctgctgtgcctgactgccat

SEQ ID NO: 7274565 - DNA, 22 bp, Homo sapiens
ccctgctgtccctcagtcctgc

SEQ ID NO: 7274566 - DNA, 22 bp, Homo sapiens
cccaggagatggaggttgcagt

SEQ ID NO: 7274567 - DNA, 22 bp, Homo sapiens
cccaggagatgcactccattgg

SEQ ID NO: 7274568 - DNA, 22 bp, Homo sapiens
cccaggaatgggaaggaggaat

SEQ ID NO: 7274569 - DNA, 22 bp, Homo sapiens
cccaggagccatctgtcttggc

SEQ ID NO: 7274570 - DNA, 23 bp, Homo sapiens
cccaggagcctgagtcctctctg

SEQ ID NO: 7274571 - DNA, 19 bp, Homo sapiens
cccaggagcagtattgatg

SEQ ID NO: 7274572 - DNA, 22 bp, Homo sapiens
cccaggagatggtgcgtggtct

SEQ ID NO: 7274573 - DNA, 22 bp, Homo sapiens
cccaggaggtcaaggctgcagt

SEQ ID NO: 7274574 - DNA, 22 bp, Homo sapiens
cccaggaggtagaggttgcagt

SEQ ID NO: 7274575 - DNA, 22 bp, Homo sapiens
cccaggagcttctctctgcctc

SEQ ID NO: 7274576 - DNA, 22 bp, Homo sapiens
cccaggagcttctctctgcctc

SEQ ID NO: 7274577 - DNA, 20 bp, Homo sapiens
cccaggagctgtgccccatc

SEQ ID NO: 7274578 - DNA, 23 bp, Homo sapiens
cccaggagcctgagtcctctctg

SEQ ID NO: 7274579 - DNA, 22 bp, Homo sapiens
cccaggaatgaggggcggaggc

SEQ ID NO: 7274580 - DNA, 22 bp, Homo sapiens
aggctgtgaactctatgctgaa

SEQ ID NO: 7274581 - DNA, 22 bp, Homo sapiens
aggctgtagtgcatgtgctatg

SEQ ID NO: 7274582 - DNA, 22 bp, Homo sapiens
cccatcggcaaggtaggtgatt

SEQ ID NO: 7274583 - DNA, 22 bp, Homo sapiens
cccatagaaggggaagtgctac

SEQ ID NO: 7274584 - DNA, 22 bp, Homo sapiens
cccagggaagccatttctgact

SEQ ID NO: 7274585 - DNA, 22 bp, Homo sapiens
cccaggcttttctcttgcccca

SEQ ID NO: 7274586 - DNA, 22 bp, Homo sapiens
cccaggaggtggagcttgcagt

SEQ ID NO: 7274587 - DNA, 22 bp, Homo sapiens
cccaggaggtcgaagctgcagt

SEQ ID NO: 7274588 - DNA, 22 bp, Homo sapiens
aggctggccctactggctgcct

SEQ ID NO: 7274589 - DNA, 22 bp, Homo sapiens
aggctggcgacatctggcgggc

SEQ ID NO: 7274590 - DNA, 22 bp, Homo sapiens
ccatttgtttcccttgggaaac

SEQ ID NO: 7274591 - DNA, 22 bp, Homo sapiens
ccatttgttttcgctaccatgg

SEQ ID NO: 7274592 - DNA, 22 bp, Homo sapiens
ccatttgtgatgtggcagcatc

SEQ ID NO: 7274593 - DNA, 22 bp, Homo sapiens
ccatttgtcacctctgcactcc

SEQ ID NO: 7274594 - DNA, 22 bp, Homo sapiens
ccatttgtattactgccccagg

SEQ ID NO: 7274595 - DNA, 22 bp, Homo sapiens
ccatttgtattactgccccagg

SEQ ID NO: 7274596 - DNA, 21 bp, Homo sapiens
ccatttgtaggtttccctctg

SEQ ID NO: 7274597 - DNA, 22 bp, Homo sapiens
ccatttgtaccatttctttgta

SEQ ID NO: 7274598 - DNA, 22 bp, Homo sapiens
ccatttgtaaccttagagcaat

SEQ ID NO: 7274599 - DNA, 22 bp, Homo sapiens
ccatttgttgtgtattaatatt

SEQ ID NO: 7274600 - DNA, 22 bp, Homo sapiens
ccatttgttgagaacgtgcctt

SEQ ID NO: 7274601 - DNA, 22 bp, Homo sapiens
ccatttgttcgcccagctccaa

SEQ ID NO: 7274602 - DNA, 22 bp, Homo sapiens
ccatttgtggtttatttgctct

SEQ ID NO: 7274603 - DNA, 22 bp, Homo sapiens
ccatttgtgcttcttcaaagca

SEQ ID NO: 7274604 - DNA, 19 bp, Homo sapiens
aggctggagacaccaggcc

SEQ ID NO: 7274605 - DNA, 22 bp, Homo sapiens
aggctgctcagtagatggagct

SEQ ID NO: 7274606 - DNA, 22 bp, Homo sapiens
aggctggagcaagggggcatat

SEQ ID NO: 7274607 - DNA, 22 bp, Homo sapiens
aggctggagacccgccaagaaa

SEQ ID NO: 7274608 - DNA, 22 bp, Homo sapiens
aggctggagagtgcagtggcgt

SEQ ID NO: 7274609 - DNA, 22 bp, Homo sapiens
aggctggagtacagtggctatt

SEQ ID NO: 7274610 - DNA, 22 bp, Homo sapiens
aggctgagctgacctggtttgg

SEQ ID NO: 7274611 - DNA, 22 bp, Homo sapiens
aggctgaggatccctgtgttct

SEQ ID NO: 7274612 - DNA, 22 bp, Homo sapiens
aggctgaggcaagaggatcact

SEQ ID NO: 7274613 - DNA, 22 bp, Homo sapiens
aggctgaggcaagaggatcact

SEQ ID NO: 7274614 - DNA, 22 bp, Homo sapiens
aggctgaggatcgtactttcca

SEQ ID NO: 7274615 - DNA, 22 bp, Homo sapiens
aggctgaggcaggtggatcacc

SEQ ID NO: 7274616 - DNA, 22 bp, Homo sapiens
aggctgaggcaggtggatcacc

SEQ ID NO: 7274617 - DNA, 20 bp, Homo sapiens
ccagggctggctcctgggat

SEQ ID NO: 7274618 - DNA, 22 bp, Homo sapiens
ccaggctgtaaacaccttcaaa

SEQ ID NO: 7274619 - DNA, 22 bp, Homo sapiens
ccagggcctgccacttagcaag

SEQ ID NO: 7274620 - DNA, 22 bp, Homo sapiens
aggcgtgggaggatctgaggcc

SEQ ID NO: 7274621 - DNA, 22 bp, Homo sapiens
aggctaagatgtggtctgagca

SEQ ID NO: 7274622 - DNA, 22 bp, Homo sapiens
aggctaaggagtgtgatgctca

SEQ ID NO: 7274623 - DNA, 22 bp, Homo sapiens
aggctaagggatgactggagtg

SEQ ID NO: 7274624 - DNA, 22 bp, Homo sapiens
ccaggctgctgttggtgtccgc

SEQ ID NO: 7274625 - DNA, 22 bp, Homo sapiens
ccaggctgctgttggtgtccgc

SEQ ID NO: 7274626 - DNA, 22 bp, Homo sapiens
aggctagactttggcgaagcac

SEQ ID NO: 7274627 - DNA, 22 bp, Homo sapiens
ccaggctgcttagccttatctt

SEQ ID NO: 7274628 - DNA, 22 bp, Homo sapiens
ccaggctgctttattactctgt

SEQ ID NO: 7274629 - DNA, 22 bp, Homo sapiens
ccaggctgctttattactctgt

SEQ ID NO: 7274630 - DNA, 22 bp, Homo sapiens
ccaggctggaatcaatattctg

SEQ ID NO: 7274631 - DNA, 22 bp, Homo sapiens
ccaggctggagtatagtggcgc

SEQ ID NO: 7274632 - DNA, 22 bp, Homo sapiens
ccaggctggagtatagtggcgc

SEQ ID NO: 7274633 - DNA, 21 bp, Homo sapiens
ccaggctgggagggcagttcc

SEQ ID NO: 7274634 - DNA, 22 bp, Homo sapiens
ccaggctgggcggggaacctgg

SEQ ID NO: 7274635 - DNA, 22 bp, Homo sapiens
ccaggctgggctacaagttgag

SEQ ID NO: 7274636 - DNA, 15 bp, Homo sapiens
ccaggctgggtgagc

SEQ ID NO: 7274637 - DNA, 22 bp, Homo sapiens
ccaggctggtctgaatttctag

SEQ ID NO: 7274638 - DNA, 22 bp, Homo sapiens
ccagctctggcttcttgctggg

SEQ ID NO: 7274639 - DNA, 22 bp, Homo sapiens
ccagctctgtaagctgtgaaat

SEQ ID NO: 7274640 - DNA, 22 bp, Homo sapiens
ccagctctgtaagctgtgaaat

SEQ ID NO: 7274641 - DNA, 22 bp, Homo sapiens
ccagcaggagatgcctgtgtct

SEQ ID NO: 7274642 - DNA, 22 bp, Homo sapiens
ccagcaggagatgcctgtgtct

SEQ ID NO: 7274643 - DNA, 22 bp, Homo sapiens
ccagctcttttggctgagtgag

SEQ ID NO: 7274644 - DNA, 22 bp, Homo sapiens
aggcggaagatggccccataga

SEQ ID NO: 7274645 - DNA, 22 bp, Homo sapiens
aggcggctggtgtcctgcaggt

SEQ ID NO: 7274646 - DNA, 22 bp, Homo sapiens
aggcggctccgggagtgtgggc

SEQ ID NO: 7274647 - DNA, 22 bp, Homo sapiens
aggcggtgtgctttgcagagca

SEQ ID NO: 7274648 - DNA, 22 bp, Homo sapiens
aggcggtggccaaggagcggga

SEQ ID NO: 7274649 - DNA, 22 bp, Homo sapiens
ccagagctaaacacacaggctg

SEQ ID NO: 7274650 - DNA, 22 bp, Homo sapiens
ccagagctgaggagatgggctt

SEQ ID NO: 7274651 - DNA, 22 bp, Homo sapiens
ccagagctccagggctacagaa

SEQ ID NO: 7274652 - DNA, 21 bp, Homo sapiens
ccagactggcctatgtggtag

SEQ ID NO: 7274653 - DNA, 18 bp, Homo sapiens
aggcaggctggagtgact

SEQ ID NO: 7274654 - DNA, 22 bp, Homo sapiens
ccagaaagataggaaatcaagt

SEQ ID NO: 7274655 - DNA, 21 bp, Homo sapiens
agcggcagaccctgcatttga

SEQ ID NO: 7274656 - DNA, 22 bp, Homo sapiens
agcggcagcagatgtgatcagg

SEQ ID NO: 7274657 - DNA, 22 bp, Homo sapiens
agctaagacttagtgacttagt

SEQ ID NO: 7274658 - DNA, 22 bp, Homo sapiens
agcctgggccctgcctcttctc

SEQ ID NO: 7274659 - DNA, 22 bp, Homo sapiens
agctacttccctgtaggaaaca

SEQ ID NO: 7274660 - DNA, 22 bp, Homo sapiens
agctacccgaggacaggctaag

SEQ ID NO: 7274661 - DNA, 22 bp, Homo sapiens
cagatgtcatttcccatgcagc

SEQ ID NO: 7274662 - DNA, 22 bp, Homo sapiens
cagatgtgcatgatgggaaggg

SEQ ID NO: 7274663 - DNA, 22 bp, Homo sapiens
agctcctgggccatcacaacca

SEQ ID NO: 7274664 - DNA, 22 bp, Homo sapiens
agctctttagagtctcccttct

SEQ ID NO: 7274665 - DNA, 22 bp, Homo sapiens
agctccagcccatctgctcgtg

SEQ ID NO: 7274666 - DNA, 22 bp, Homo sapiens
agctagcctaggcagagtgcat

SEQ ID NO: 7274667 - DNA, 22 bp, Homo sapiens
agctagctttaactcttagaca

SEQ ID NO: 7274668 - DNA, 22 bp, Homo sapiens
agctccagcctcttctggaggt

SEQ ID NO: 7274669 - DNA, 22 bp, Homo sapiens
agccagagagtgttggagatgt

SEQ ID NO: 7274670 - DNA, 21 bp, Homo sapiens
agccagctatcacacagcatt

SEQ ID NO: 7274671 - DNA, 22 bp, Homo sapiens
cagagaccctaggcaggtgaca

SEQ ID NO: 7274672 - DNA, 22 bp, Homo sapiens
cagagccattatggagacttgc

SEQ ID NO: 7274673 - DNA, 22 bp, Homo sapiens
cagagctcagagctgccaggca

SEQ ID NO: 7274674 - DNA, 22 bp, Homo sapiens
cagatgaaggcctgaatgtcta

SEQ ID NO: 7274675 - DNA, 22 bp, Homo sapiens
cagatgaagtaggtgacgagca

SEQ ID NO: 7274676 - DNA, 22 bp, Homo sapiens
cagatggctgccaagatgggct

SEQ ID NO: 7274677 - DNA, 22 bp, Homo sapiens
agcccagggacagggcggatgt

SEQ ID NO: 7274678 - DNA, 22 bp, Homo sapiens
agcccaggttgaggctgcagtg

SEQ ID NO: 7274679 - DNA, 22 bp, Homo sapiens
agcagggcagctgatgcgcacg

SEQ ID NO: 7274680 - DNA, 22 bp, Homo sapiens
agcagggcaaagtcaggctaac

SEQ ID NO: 7274681 - DNA, 22 bp, Homo sapiens
caccagccccctcacgctgtca

SEQ ID NO: 7274682 - DNA, 22 bp, Homo sapiens
caccagccagagtgacagctcc

SEQ ID NO: 7274683 - DNA, 22 bp, Homo sapiens
caccagctacagactactgtgt

SEQ ID NO: 7274684 - DNA, 22 bp, Homo sapiens
agcagggctctgccatgggccc

SEQ ID NO: 7274685 - DNA, 22 bp, Homo sapiens
cactgtgggcctgtcgtgggtg

SEQ ID NO: 7274686 - DNA, 19 bp, Homo sapiens
cactgtggtccttcactgc

SEQ ID NO: 7274687 - DNA, 22 bp, Homo sapiens
cactgttttattccaacatagg

SEQ ID NO: 7274688 - DNA, 22 bp, Homo sapiens
agcatgcttattttatctcatt

SEQ ID NO: 7274689 - DNA, 22 bp, Homo sapiens
agcatgctgggtcatttttgcc

SEQ ID NO: 7274690 - DNA, 22 bp, Homo sapiens
agcatgctatattgattgtagt

SEQ ID NO: 7274691 - DNA, 22 bp, Homo sapiens
agcatgcaggaaccacatggca

SEQ ID NO: 7274692 - DNA, 22 bp, Homo sapiens
agcatcagagagaagttaacta

SEQ ID NO: 7274693 - DNA, 22 bp, Homo sapiens
agcatataggaaatgttgaatc

SEQ ID NO: 7274694 - DNA, 22 bp, Homo sapiens
agcagtggcatacattttgagt

SEQ ID NO: 7274695 - DNA, 22 bp, Homo sapiens
agcatgaaaggcgtgccaactt

SEQ ID NO: 7274696 - DNA, 22 bp, Homo sapiens
agcatgaaagcataggacagtc

SEQ ID NO: 7274697 - DNA, 22 bp, Homo sapiens
agcagtgaaacagctgcatatg

SEQ ID NO: 7274698 - DNA, 22 bp, Homo sapiens
agcaggtgttagggatccaatg

SEQ ID NO: 7274699 - DNA, 21 bp, Homo sapiens
agcagaggctgcctggtgact

SEQ ID NO: 7274700 - DNA, 21 bp, Homo sapiens
agcagaggggacatgtttgat

SEQ ID NO: 7274701 - DNA, 21 bp, Homo sapiens
agcagaggggacatgtttgat

SEQ ID NO: 7274702 - DNA, 16 bp, Homo sapiens
agcagaggtgagtgaa

SEQ ID NO: 7274703 - DNA, 22 bp, Homo sapiens
agcagaggtgtttattatggga

SEQ ID NO: 7274704 - DNA, 22 bp, Homo sapiens
agcagaggtgtttattatggga

SEQ ID NO: 7274705 - DNA, 22 bp, Homo sapiens
agcagaggtttgttggaaacct

SEQ ID NO: 7274706 - DNA, 22 bp, Homo sapiens
agcagaggtttgttggaaacct

SEQ ID NO: 7274707 - DNA, 21 bp, Homo sapiens
agcagaggcagaatgtatgca

SEQ ID NO: 7274708 - DNA, 22 bp, Homo sapiens
agcagaggaggatttagttagg

SEQ ID NO: 7274709 - DNA, 21 bp, Homo sapiens
agcagaggctgcctggtgact

SEQ ID NO: 7274710 - DNA, 21 bp, Homo sapiens
agcagaggcagaatgtatgca

SEQ ID NO: 7274711 - DNA, 22 bp, Homo sapiens
agcagaggaggatttagttagg

SEQ ID NO: 7274712 - DNA, 22 bp, Homo sapiens
agcagaggacagttcttaggaa

SEQ ID NO: 7274713 - DNA, 22 bp, Homo sapiens
agcacctgtggctcatgctcgt

SEQ ID NO: 7274714 - DNA, 19 bp, Homo sapiens
agcacctgtgagagcctgg

SEQ ID NO: 7274715 - DNA, 19 bp, Homo sapiens
agcagcagaagtgtgcctt

SEQ ID NO: 7274716 - DNA, 22 bp, Homo sapiens
agcagcagagctctggtctgca

SEQ ID NO: 7274717 - DNA, 22 bp, Homo sapiens
agcagcagagctctggtctgca

SEQ ID NO: 7274718 - DNA, 22 bp, Homo sapiens
agcagcagaggtcagaaaggta

SEQ ID NO: 7274719 - DNA, 22 bp, Homo sapiens
agcagcagatccaaaaaatgtg

SEQ ID NO: 7274720 - DNA, 22 bp, Homo sapiens
agcagcagatcaaacaggcttg

SEQ ID NO: 7274721 - DNA, 22 bp, Homo sapiens
agcagcccgaggatcatgtgtc

SEQ ID NO: 7274722 - DNA, 21 bp, Homo sapiens
agcagcagatctggtgagggc

SEQ ID NO: 7274723 - DNA, 22 bp, Homo sapiens
cacagagattagaattagacta

SEQ ID NO: 7274724 - DNA, 22 bp, Homo sapiens
agacaaggcccccttgggctct

SEQ ID NO: 7274725 - DNA, 21 bp, Homo sapiens
agacagaacaactgctctcca

SEQ ID NO: 7274726 - DNA, 22 bp, Homo sapiens
atgaggccagggtgccatgaaa

SEQ ID NO: 7274727 - DNA, 22 bp, Homo sapiens
agaatcaattagattctatgag

SEQ ID NO: 7274728 - DNA, 21 bp, Homo sapiens
atctgcttaggtttgttcaga

SEQ ID NO: 7274729 - DNA, 22 bp, Homo sapiens
atctgcttgaatgagcaacagg

SEQ ID NO: 7274730 - DNA, 19 bp, Homo sapiens
atctgcctgttatcacata

SEQ ID NO: 7274731 - DNA, 22 bp, Homo sapiens
atgccttttcgggtacttctct

SEQ ID NO: 7274732 - DNA, 22 bp, Homo sapiens
agacgagggcccccaggacagc

SEQ ID NO: 7274733 - DNA, 22 bp, Homo sapiens
agacgagggcctggcacacagt

SEQ ID NO: 7274734 - DNA, 22 bp, Homo sapiens
agacctggattccaatcctacc

SEQ ID NO: 7274735 - DNA, 22 bp, Homo sapiens
atgcatttttgagtatgaatga

SEQ ID NO: 7274736 - DNA, 22 bp, Homo sapiens
atgcatttttgagtatgaatga

SEQ ID NO: 7274737 - DNA, 22 bp, Homo sapiens
agagaagggtgtagcctgggcc

SEQ ID NO: 7274738 - DNA, 19 bp, Homo sapiens
agacttttgtaagttgaga

SEQ ID NO: 7274739 - DNA, 22 bp, Homo sapiens
agagaggctgggcgtagggctt

SEQ ID NO: 7274740 - DNA, 19 bp, Homo sapiens
agagaggctgtgtgaggga

SEQ ID NO: 7274741 - DNA, 22 bp, Homo sapiens
agagagggcatagaaaaaggga

SEQ ID NO: 7274742 - DNA, 22 bp, Homo sapiens
agagaggttaaggagctcttgt

SEQ ID NO: 7274743 - DNA, 21 bp, Homo sapiens
agagagggagatgaaacatcc

SEQ ID NO: 7274744 - DNA, 22 bp, Homo sapiens
agagagcccgggccagggcaca

SEQ ID NO: 7274745 - DNA, 22 bp, Homo sapiens
agagagcattgaggaaatcttc

SEQ ID NO: 7274746 - DNA, 22 bp, Homo sapiens
agagagcatggcacagaggggt

SEQ ID NO: 7274747 - DNA, 22 bp, Homo sapiens
agagacagacacatcgggctgc

SEQ ID NO: 7274748 - DNA, 22 bp, Homo sapiens
agagacaccgcgcatcatggct

SEQ ID NO: 7274749 - DNA, 21 bp, Homo sapiens
agagacagagaaagtaacatt

SEQ ID NO: 7274750 - DNA, 22 bp, Homo sapiens
agagaattggagcagtgacagg

SEQ ID NO: 7274751 - DNA, 22 bp, Homo sapiens
agagattgtgctactcacccaa

SEQ ID NO: 7274752 - DNA, 22 bp, Homo sapiens
agagcagaggcatggccgtggg

SEQ ID NO: 7274753 - DNA, 20 bp, Homo sapiens
agagcagcagttggtgaggt

SEQ ID NO: 7274754 - DNA, 22 bp, Homo sapiens
agagcagcacgttgtccccaca

SEQ ID NO: 7274755 - DNA, 22 bp, Homo sapiens
agagcagatggccagggggcct

SEQ ID NO: 7274756 - DNA, 22 bp, Homo sapiens
agagctggctgctgcggtgctt

SEQ ID NO: 7274757 - DNA, 22 bp, Homo sapiens
agatcatatgaaaaatttcaag

SEQ ID NO: 7274758 - DNA, 22 bp, Homo sapiens
agatcatatgcagtaatgaact

SEQ ID NO: 7274759 - DNA, 22 bp, Homo sapiens
agatgattatgatagcactgtt

SEQ ID NO: 7274760 - DNA, 22 bp, Homo sapiens
agatgctttcctgatatttatg

SEQ ID NO: 7274761 - DNA, 22 bp, Homo sapiens
agatgctttttaggtattacct

SEQ ID NO: 7274762 - DNA, 22 bp, Homo sapiens
agatgcttcagtgtttaattta

SEQ ID NO: 7274763 - DNA, 22 bp, Homo sapiens
agatgcttaagttttcagtgta

SEQ ID NO: 7274764 - DNA, 22 bp, Homo sapiens
agatgcttactatggttgtatg

SEQ ID NO: 7274765 - DNA, 19 bp, Homo sapiens
agatggcaaaatgcaaaga

SEQ ID NO: 7274766 - DNA, 17 bp, Homo sapiens
agatggcaggaggcaga

SEQ ID NO: 7274767 - DNA, 17 bp, Homo sapiens
agatggcaggaggcaga

SEQ ID NO: 7274768 - DNA, 22 bp, Homo sapiens
agatggcaggggtacctggaag

SEQ ID NO: 7274769 - DNA, 22 bp, Homo sapiens
agatggctctcaagtctgatta

SEQ ID NO: 7274770 - DNA, 22 bp, Homo sapiens
attggtagttttgtatttctct

SEQ ID NO: 7274771 - DNA, 22 bp, Homo sapiens
attggtcagagtaaatttattt

SEQ ID NO: 7274772 - DNA, 22 bp, Homo sapiens
attggccatttgcatgtattat

SEQ ID NO: 7274773 - DNA, 22 bp, Homo sapiens
agagtgctttctgtttcctgta

SEQ ID NO: 7274774 - DNA, 22 bp, Homo sapiens
agatcacagtggcaactccctt

SEQ ID NO: 7274775 - DNA, 22 bp, Homo sapiens
agatcacagtggcaactccctt

SEQ ID NO: 7274776 - DNA, 22 bp, Homo sapiens
agatattctgcctaacaggttt

SEQ ID NO: 7274777 - DNA, 22 bp, Homo sapiens
attttagttttagcatccatgc

SEQ ID NO: 7274778 - DNA, 22 bp, Homo sapiens
attttatctgcttactttcagg

SEQ ID NO: 7274779 - DNA, 22 bp, Homo sapiens
attttatctgcttactttcagg

SEQ ID NO: 7274780 - DNA, 22 bp, Homo sapiens
attttagtacctcaagtatcca

SEQ ID NO: 7274781 - DNA, 22 bp, Homo sapiens
attttcagagacatctggactt

SEQ ID NO: 7274782 - DNA, 22 bp, Homo sapiens
attttcagaacattcattcact

SEQ ID NO: 7274783 - DNA, 22 bp, Homo sapiens
agcaaatattttgttgaagtgc

SEQ ID NO: 7274784 - DNA, 22 bp, Homo sapiens
agatgtgtttctagttcctgca

SEQ ID NO: 7274785 - DNA, 20 bp, Homo sapiens
agcaagaacgttctgaggga

SEQ ID NO: 7274786 - DNA, 22 bp, Homo sapiens
agcaagaagctttgctgtgata

SEQ ID NO: 7274787 - DNA, 22 bp, Homo sapiens
agcaagaagggcaaggaagttt

SEQ ID NO: 7274788 - DNA, 17 bp, Homo sapiens
agcaacttctcccacag

SEQ ID NO: 7274789 - DNA, 22 bp, Homo sapiens
agcaagaaatcttcagtgttct

SEQ ID NO: 7274790 - DNA, 22 bp, Homo sapiens
agcaagaaaatctctgtccaat

SEQ ID NO: 7274791 - DNA, 20 bp, Homo sapiens
agcaagagtaaggacagcga

SEQ ID NO: 7274792 - DNA, 22 bp, Homo sapiens
agcaagaatatttctgccactg

SEQ ID NO: 7274793 - DNA, 21 bp, Homo sapiens
agcaagaatcaggaaggctct

SEQ ID NO: 7274794 - DNA, 20 bp, Homo sapiens
agcaagaaggttgtgggagc

SEQ ID NO: 7274795 - DNA, 22 bp, Homo sapiens
caaagataatcacagaataccc

SEQ ID NO: 7274796 - DNA, 22 bp, Homo sapiens
caaagatgccaaaaggaagaca

SEQ ID NO: 7274797 - DNA, 23 bp, Homo sapiens
caaagatgattggaacatggctt

SEQ ID NO: 7274798 - DNA, 22 bp, Homo sapiens
agagtgcagataagagaatgtt

SEQ ID NO: 7274799 - DNA, 22 bp, Homo sapiens
agagtgctaaaatcttatcttt

SEQ ID NO: 7274800 - DNA, 22 bp, Homo sapiens
agagtgctcagatgcatgtctt

SEQ ID NO: 7274801 - DNA, 22 bp, Homo sapiens
agagtgcaaccgaaacaagcag

SEQ ID NO: 7274802 - DNA, 22 bp, Homo sapiens
agagtccatatgtgggaggagt

SEQ ID NO: 7274803 - DNA, 22 bp, Homo sapiens
agagtccatgaagacagctgag

SEQ ID NO: 7274804 - DNA, 18 bp, Homo sapiens
agagtccagggtgaggtg

SEQ ID NO: 7274805 - DNA, 22 bp, Homo sapiens
agagtcaagtagggcatgggct

SEQ ID NO: 7274806 - DNA, 22 bp, Homo sapiens
agagtccaccctggggtcaggc

SEQ ID NO: 7274807 - DNA, 22 bp, Homo sapiens
agagggcagtctcagattggga

SEQ ID NO: 7274808 - DNA, 22 bp, Homo sapiens
agagggcagtctcagattggga

SEQ ID NO: 7274809 - DNA, 22 bp, Homo sapiens
agagggcagggcggtaagtcct

SEQ ID NO: 7274810 - DNA, 22 bp, Homo sapiens
agagggctggacgcaggttgga

SEQ ID NO: 7274811 - DNA, 22 bp, Homo sapiens
agaggggaaggatgtgatgtga

SEQ ID NO: 7274812 - DNA, 22 bp, Homo sapiens
agaggggaagtaatgaatgata

SEQ ID NO: 7274813 - DNA, 22 bp, Homo sapiens
agagggcttccctaggagtgag

SEQ ID NO: 7274814 - DNA, 22 bp, Homo sapiens
agaggggctcaagcagtggtct

SEQ ID NO: 7274815 - DNA, 22 bp, Homo sapiens
agaggggcagggtctccggatt

SEQ ID NO: 7274816 - DNA, 18 bp, Homo sapiens
agaggggaggtaagtctg

SEQ ID NO: 7274817 - DNA, 22 bp, Homo sapiens
agaggggagtcctaatctgatt

SEQ ID NO: 7274818 - DNA, 22 bp, Homo sapiens
agaggggagagctaagcaattc

SEQ ID NO: 7274819 - DNA, 22 bp, Homo sapiens
agaggggacagccacctgcccg

SEQ ID NO: 7274820 - DNA, 23 bp, Homo sapiens
agaggggagcatctgctggctga

SEQ ID NO: 7274821 - DNA, 22 bp, Homo sapiens
agaggggaggcgaaccagagtc

SEQ ID NO: 7274822 - DNA, 22 bp, Homo sapiens
agaggcaccgtctgcagcgtgc

SEQ ID NO: 7274823 - DNA, 21 bp, Homo sapiens
attacagcagtggccaaatgc

SEQ ID NO: 7274824 - DNA, 23 bp, Homo sapiens
agaggcaggagtggcttgcccgg

SEQ ID NO: 7274825 - DNA, 22 bp, Homo sapiens
agaggcaagattatcagggcat

SEQ ID NO: 7274826 - DNA, 22 bp, Homo sapiens
agaggcacagaggcagtcccct

SEQ ID NO: 7274827 - DNA, 22 bp, Homo sapiens
agaggcaagttcagagctagga

SEQ ID NO: 7274828 - DNA, 22 bp, Homo sapiens
agaggctgcacttgctcatgat

SEQ ID NO: 7274829 - DNA, 23 bp, Homo sapiens
agaggcaggagtggcttgcccgg

SEQ ID NO: 7274830 - DNA, 22 bp, Homo sapiens
agaggccactttgcctgtgatg

SEQ ID NO: 7274831 - DNA, 22 bp, Homo sapiens
agtacatatagtaatttagcca

SEQ ID NO: 7274832 - DNA, 22 bp, Homo sapiens
agtaccatgcttcctgactggt

SEQ ID NO: 7274833 - DNA, 22 bp, Homo sapiens
actcctgccacacagatgctgt

SEQ ID NO: 7274834 - DNA, 22 bp, Homo sapiens
actctctctgatggaactttag

SEQ ID NO: 7274835 - DNA, 22 bp, Homo sapiens
actctaaaccccactctgctgg

SEQ ID NO: 7274836 - DNA, 22 bp, Homo sapiens
acccttccaaatgagcttatta

SEQ ID NO: 7274837 - DNA, 22 bp, Homo sapiens
aggtccacagttcagctgccca

SEQ ID NO: 7274838 - DNA, 20 bp, Homo sapiens
aggtccactgaggctgcctc

SEQ ID NO: 7274839 - DNA, 22 bp, Homo sapiens
acgagaggtccttagaatctgt

SEQ ID NO: 7274840 - DNA, 22 bp, Homo sapiens
acgaaggaatgtgcttgagcat

SEQ ID NO: 7274841 - DNA, 22 bp, Homo sapiens
aggtgacatgaaaaatgttgag

SEQ ID NO: 7274842 - DNA, 22 bp, Homo sapiens
aggtgactggtttatctggcag

SEQ ID NO: 7274843 - DNA, 22 bp, Homo sapiens
actagaaaattcctagaaacta

SEQ ID NO: 7274844 - DNA, 22 bp, Homo sapiens
actgcccattaaaggtgctttg

SEQ ID NO: 7274845 - DNA, 22 bp, Homo sapiens
actgcctcttggtgctgagaga

SEQ ID NO: 7274846 - DNA, 22 bp, Homo sapiens
actgcctcttggtgctgagaga

SEQ ID NO: 7274847 - DNA, 22 bp, Homo sapiens
actgggcatcccatggcagagc

SEQ ID NO: 7274848 - DNA, 22 bp, Homo sapiens
actgggcagggaaggagaccga

SEQ ID NO: 7274849 - DNA, 22 bp, Homo sapiens
actgcacttcaccctgggtgac

SEQ ID NO: 7274850 - DNA, 22 bp, Homo sapiens
agtgctctcatgctgactatta

SEQ ID NO: 7274851 - DNA, 22 bp, Homo sapiens
agtgctctgggtccactccaga

SEQ ID NO: 7274852 - DNA, 22 bp, Homo sapiens
agtgctctgatctccttgggtt

SEQ ID NO: 7274853 - DNA, 22 bp, Homo sapiens
actgcactccagcctgggtgat

SEQ ID NO: 7274854 - DNA, 22 bp, Homo sapiens
actctgctaaatgtaagttggt

SEQ ID NO: 7274855 - DNA, 22 bp, Homo sapiens
actttctgcagtgttggaaatg

SEQ ID NO: 7274856 - DNA, 22 bp, Homo sapiens
atacatcatttcccatcaatcg

SEQ ID NO: 7274857 - DNA, 22 bp, Homo sapiens
atacatcatgctccatatattt

SEQ ID NO: 7274858 - DNA, 22 bp, Homo sapiens
atacaaagacaaatctcaatct

SEQ ID NO: 7274859 - DNA, 22 bp, Homo sapiens
actttaattaatgaactgtggc

SEQ ID NO: 7274860 - DNA, 21 bp, Homo sapiens
actttaatatacatgaggagg

SEQ ID NO: 7274861 - DNA, 20 bp, Homo sapiens
actttacagagaagactgac

SEQ ID NO: 7274862 - DNA, 22 bp, Homo sapiens
atacatatccacaggagataaa

SEQ ID NO: 7274863 - DNA, 22 bp, Homo sapiens
actttacacatcttttctcatt

SEQ ID NO: 7274864 - DNA, 22 bp, Homo sapiens
acttccttttgggaaactgttt

SEQ ID NO: 7274865 - DNA, 22 bp, Homo sapiens
acttccagctaggttctgctaa

SEQ ID NO: 7274866 - DNA, 22 bp, Homo sapiens
ataaaaactgacccatcctttg

SEQ ID NO: 7274867 - DNA, 22 bp, Homo sapiens
agaacagtcgtggtgagagaaa

SEQ ID NO: 7274868 - DNA, 22 bp, Homo sapiens
atccccagaaaataggtgccta

SEQ ID NO: 7274869 - DNA, 22 bp, Homo sapiens
atccagctttgtctggtcttcg

SEQ ID NO: 7274870 - DNA, 22 bp, Homo sapiens
agaaggcacagtgctgctaaga

SEQ ID NO: 7274871 - DNA, 21 bp, Homo sapiens
agaaggcaaaagcagacatct

SEQ ID NO: 7274872 - DNA, 22 bp, Homo sapiens
agaaggcactcacactggcacg

SEQ ID NO: 7274873 - DNA, 22 bp, Homo sapiens
agaagccaagaacagacagtgc

SEQ ID NO: 7274874 - DNA, 22 bp, Homo sapiens
agaaaaagtcaaggaattggac

SEQ ID NO: 7274875 - DNA, 18 bp, Homo sapiens
atcagtcctgggagggta

SEQ ID NO: 7274876 - DNA, 22 bp, Homo sapiens
atcagtccacttgatgaaatcg

SEQ ID NO: 7274877 - DNA, 22 bp, Homo sapiens
atcagtccaccatactcatctt

SEQ ID NO: 7274878 - DNA, 22 bp, Homo sapiens
atcagtatattccttggtcttt

SEQ ID NO: 7274879 - DNA, 22 bp, Homo sapiens
agaaatcatgactaagagcagt

SEQ ID NO: 7274880 - DNA, 22 bp, Homo sapiens
agaaagccaatctgtaaagtct

SEQ ID NO: 7274881 - DNA, 22 bp, Homo sapiens
agaaagcccacccagaagatgt

SEQ ID NO: 7274882 - DNA, 22 bp, Homo sapiens
atcagcaatctcgtgtattagg

SEQ ID NO: 7274883 - DNA, 22 bp, Homo sapiens
agaaagccttatgtacagaggc

SEQ ID NO: 7274884 - DNA, 22 bp, Homo sapiens
agaaagcctcaatcttcaggcc

SEQ ID NO: 7274885 - DNA, 22 bp, Homo sapiens
agaaagcccaggagaacagatt

SEQ ID NO: 7274886 - DNA, 22 bp, Homo sapiens
aggctccagcccaaggctgcag

SEQ ID NO: 7274887 - DNA, 22 bp, Homo sapiens
aggctccagcagccagaggaag

SEQ ID NO: 7274888 - DNA, 22 bp, Homo sapiens
aggctccagcagccagaggaag

SEQ ID NO: 7274889 - DNA, 22 bp, Homo sapiens
aggctccagcccaaggctgcag

SEQ ID NO: 7274890 - DNA, 23 bp, Homo sapiens
aggctccactccctgggatgtgg

SEQ ID NO: 7274891 - DNA, 20 bp, Homo sapiens
aggccctgccagggacggag

SEQ ID NO: 7274892 - DNA, 22 bp, Homo sapiens
aggccagcagcatgacggcatc

SEQ ID NO: 7274893 - DNA, 22 bp, Homo sapiens
aggccagccctcacctgtgttc

SEQ ID NO: 7274894 - DNA, 22 bp, Homo sapiens
aggccagccctgggctgagaga

SEQ ID NO: 7274895 - DNA, 22 bp, Homo sapiens
aggccagccctgggctgagaga

SEQ ID NO: 7274896 - DNA, 22 bp, Homo sapiens
acatgaaaaatgtttgcagttt

SEQ ID NO: 7274897 - DNA, 22 bp, Homo sapiens
acatgaaaactggttccttcag

SEQ ID NO: 7274898 - DNA, 22 bp, Homo sapiens
acatgaaaagactatctgatta

SEQ ID NO: 7274899 - DNA, 22 bp, Homo sapiens
aggccagcctcaggcagggacc

SEQ ID NO: 7274900 - DNA, 22 bp, Homo sapiens
acatacatggtgctttcttggt

SEQ ID NO: 7274901 - DNA, 22 bp, Homo sapiens
acatacatgggattaaaaaatt

SEQ ID NO: 7274902 - DNA, 21 bp, Homo sapiens
acatacattatctttttaaaa

SEQ ID NO: 7274903 - DNA, 22 bp, Homo sapiens
aggcagtgttcttctaagggca

SEQ ID NO: 7274904 - DNA, 20 bp, Homo sapiens
aggcagttagaaggagatga

SEQ ID NO: 7274905 - DNA, 22 bp, Homo sapiens
aggccagcacgacagccgcagg

SEQ ID NO: 7274906 - DNA, 22 bp, Homo sapiens
aggccacaagaactaccccatc

SEQ ID NO: 7274907 - DNA, 22 bp, Homo sapiens
accaagctagaacattacaggc

SEQ ID NO: 7274908 - DNA, 22 bp, Homo sapiens
accacaggaattgctctgtggt

SEQ ID NO: 7274909 - DNA, 22 bp, Homo sapiens
accaggagagattttattgaga

SEQ ID NO: 7274910 - DNA, 22 bp, Homo sapiens
accaggagaggcacttgcaatg

SEQ ID NO: 7274911 - DNA, 22 bp, Homo sapiens
accaggagacatgaccaatgag

SEQ ID NO: 7274912 - DNA, 19 bp, Homo sapiens
accaggagacagtgagctt

SEQ ID NO: 7274913 - DNA, 23 bp, Homo sapiens
accaggagaaaagctttgcggga

SEQ ID NO: 7274914 - DNA, 22 bp, Homo sapiens
accaggagccacaggaggagcc

SEQ ID NO: 7274915 - DNA, 20 bp, Homo sapiens
accaggagatggaggcaggg

SEQ ID NO: 7274916 - DNA, 22 bp, Homo sapiens
accaggagcattttttattagt

SEQ ID NO: 7274917 - DNA, 23 bp, Homo sapiens
accaggagccaagatctccctgg

SEQ ID NO: 7274918 - DNA, 22 bp, Homo sapiens
accaggaggcctggagcacaaa

SEQ ID NO: 7274919 - DNA, 22 bp, Homo sapiens
accaggagccatagagtcaggc

SEQ ID NO: 7274920 - DNA, 22 bp, Homo sapiens
accaggaggaagtgttaatgat

SEQ ID NO: 7274921 - DNA, 22 bp, Homo sapiens
accaggaggccttggttctgag

SEQ ID NO: 7274922 - DNA, 22 bp, Homo sapiens
accaggaggctacactgtccca

SEQ ID NO: 7274923 - DNA, 22 bp, Homo sapiens
accaggagttgggggtgggacc

SEQ ID NO: 7274924 - DNA, 22 bp, Homo sapiens
accaggagtctagcctagtcaa

SEQ ID NO: 7274925 - DNA, 22 bp, Homo sapiens
accaggagtagaatatctgtga

SEQ ID NO: 7274926 - DNA, 19 bp, Homo sapiens
accaggagtatcagagctg

SEQ ID NO: 7274927 - DNA, 22 bp, Homo sapiens
accaggagtaacagtgagtggt

SEQ ID NO: 7274928 - DNA, 22 bp, Homo sapiens
accaggagggaccctggtggcc

SEQ ID NO: 7274929 - DNA, 22 bp, Homo sapiens
accaggaggtgtttgctcaagt

SEQ ID NO: 7274930 - DNA, 22 bp, Homo sapiens
accccagcgcatatggtctgcg

SEQ ID NO: 7274931 - DNA, 22 bp, Homo sapiens
accccagccctgcttctgggag

SEQ ID NO: 7274932 - DNA, 22 bp, Homo sapiens
accctggaggtggaggtgcagt

SEQ ID NO: 7274933 - DNA, 22 bp, Homo sapiens
acagcccagctctttctctgca

SEQ ID NO: 7274934 - DNA, 22 bp, Homo sapiens
agctgcttcaaaatgggctcct

SEQ ID NO: 7274935 - DNA, 22 bp, Homo sapiens
acagcctgcagccccaggtcgc

SEQ ID NO: 7274936 - DNA, 22 bp, Homo sapiens
agctgcaggagtcgcctaggat

SEQ ID NO: 7274937 - DNA, 22 bp, Homo sapiens
agctccagttacttacctagag

SEQ ID NO: 7274938 - DNA, 22 bp, Homo sapiens
agctccagtttcctgactgagc

SEQ ID NO: 7274939 - DNA, 20 bp, Homo sapiens
agctccagtgctgacgcttc

SEQ ID NO: 7274940 - DNA, 22 bp, Homo sapiens
agctgtgtaggatcataacacg

SEQ ID NO: 7274941 - DNA, 22 bp, Homo sapiens
aggaaaaacctgttaatggtag

SEQ ID NO: 7274942 - DNA, 22 bp, Homo sapiens
agcttcataattccttgactca

SEQ ID NO: 7274943 - DNA, 22 bp, Homo sapiens
acatacatcaagtatcacaaga

SEQ ID NO: 7274944 - DNA, 22 bp, Homo sapiens
acatacatatgtttaaatgcat

SEQ ID NO: 7274945 - DNA, 23 bp, Homo sapiens
acatacatggagataaagtgatg

SEQ ID NO: 7274946 - DNA, 22 bp, Homo sapiens
aggagggagatgcccatcctgg

SEQ ID NO: 7274947 - DNA, 22 bp, Homo sapiens
aggagggacctaggaatattgc

SEQ ID NO: 7274948 - DNA, 20 bp, Homo sapiens
aggagggacctggattggcg

SEQ ID NO: 7274949 - DNA, 21 bp, Homo sapiens
aggaggggtctttcccactga

SEQ ID NO: 7274950 - DNA, 22 bp, Homo sapiens
aggaggggcatagaaatgtaat

SEQ ID NO: 7274951 - DNA, 22 bp, Homo sapiens
aggaggggcatagaaatgtaat

SEQ ID NO: 7274952 - DNA, 22 bp, Homo sapiens
aggagggacaccaatatatgtt

SEQ ID NO: 7274953 - DNA, 22 bp, Homo sapiens
aggaggggttctcgggtgctga

SEQ ID NO: 7274954 - DNA, 21 bp, Homo sapiens
aggaggggtctttcccactga

SEQ ID NO: 7274955 - DNA, 22 bp, Homo sapiens
aggaggggttctcgggtgctga

SEQ ID NO: 7274956 - DNA, 22 bp, Homo sapiens
aggcaaagaggatattttgggg

SEQ ID NO: 7274957 - DNA, 22 bp, Homo sapiens
aggcaaagcgataccagagcta

SEQ ID NO: 7274958 - DNA, 20 bp, Homo sapiens
aggatggcaagcaagtgcat

SEQ ID NO: 7274959 - DNA, 22 bp, Homo sapiens
aggaaggcacattgttggctaa

SEQ ID NO: 7274960 - DNA, 20 bp, Homo sapiens
aggaaggctgttggccttgc

SEQ ID NO: 7274961 - DNA, 22 bp, Homo sapiens
aggaaggcttctttggtcttct

SEQ ID NO: 7274962 - DNA, 22 bp, Homo sapiens
aggaagctaaccagggagtgag

SEQ ID NO: 7274963 - DNA, 22 bp, Homo sapiens
aggaagctagagccaccggact

SEQ ID NO: 7274964 - DNA, 22 bp, Homo sapiens
aggaagctcaaagccatgatgt

SEQ ID NO: 7274965 - DNA, 22 bp, Homo sapiens
aggagctgcagattctgccttg

SEQ ID NO: 7274966 - DNA, 22 bp, Homo sapiens
agcagaaaattggaaatgacaa

SEQ ID NO: 7274967 - DNA, 22 bp, Homo sapiens
agcagcagctcattcttcctgt

SEQ ID NO: 7274968 - DNA, 22 bp, Homo sapiens
agcagcagttgctgacgttcta

SEQ ID NO: 7274969 - DNA, 22 bp, Homo sapiens
agcagcagattcagcaggaatg

SEQ ID NO: 7274970 - DNA, 22 bp, Homo sapiens
agcagcagattatggtctacat

SEQ ID NO: 7274971 - DNA, 23 bp, Homo sapiens
agcagcagcaattaagtggatat

SEQ ID NO: 7274972 - DNA, 21 bp, Homo sapiens
agcagcagcagtggggcttct

SEQ ID NO: 7274973 - DNA, 19 bp, Homo sapiens
agcagcagcaccagggatt

SEQ ID NO: 7274974 - DNA, 22 bp, Homo sapiens
agcagcagcattgagcgcttgt

SEQ ID NO: 7274975 - DNA, 22 bp, Homo sapiens
agcagcagccgtagccttatta

SEQ ID NO: 7274976 - DNA, 19 bp, Homo sapiens
agcagcagctaccacttgt

SEQ ID NO: 7274977 - DNA, 22 bp, Homo sapiens
agcagcagctcagttctcagct

SEQ ID NO: 7274978 - DNA, 21 bp, Homo sapiens
agcaggtgaacctccagtaca

SEQ ID NO: 7274979 - DNA, 22 bp, Homo sapiens
agcagggctttgcagacttggg

SEQ ID NO: 7274980 - DNA, 22 bp, Homo sapiens
agcatcagcctctgtcctggag

SEQ ID NO: 7274981 - DNA, 22 bp, Homo sapiens
agcagttatgtgtctcttgact

SEQ ID NO: 7274982 - DNA, 22 bp, Homo sapiens
agcagttatattactctcaggt

SEQ ID NO: 7274983 - DNA, 23 bp, Homo sapiens
agcaggcatctgtggcacaaggc

SEQ ID NO: 7274984 - DNA, 22 bp, Homo sapiens
agcagggcccactaggggagat

SEQ ID NO: 7274985 - DNA, 22 bp, Homo sapiens
agcagctgaaaggcaaacttct

SEQ ID NO: 7274986 - DNA, 17 bp, Homo sapiens
agcagctgaagcagcca

SEQ ID NO: 7274987 - DNA, 22 bp, Homo sapiens
agctcagggcgatctgtctcgg

SEQ ID NO: 7274988 - DNA, 22 bp, Homo sapiens
agctcaagttcttttaccatat

SEQ ID NO: 7274989 - DNA, 23 bp, Homo sapiens
agctcaaggcagtccacatttcc

SEQ ID NO: 7274990 - DNA, 22 bp, Homo sapiens
agctcaagctacacacagagtc

SEQ ID NO: 7274991 - DNA, 22 bp, Homo sapiens
agctcaagtgcagttgggggat

SEQ ID NO: 7274992 - DNA, 22 bp, Homo sapiens
agctcaagtgcaagcattctat

SEQ ID NO: 7274993 - DNA, 22 bp, Homo sapiens
agctcaagtatttgggatttgt

SEQ ID NO: 7274994 - DNA, 22 bp, Homo sapiens
agcctgtgagggatgctgcagt

SEQ ID NO: 7274995 - DNA, 22 bp, Homo sapiens
agccctgccctgccatgtggca

SEQ ID NO: 7274996 - DNA, 22 bp, Homo sapiens
agccctgccattctctggagct

SEQ ID NO: 7274997 - DNA, 22 bp, Homo sapiens
agccctgccctgccatgtggca

SEQ ID NO: 7274998 - DNA, 22 bp, Homo sapiens
agccctgcaggaggtgggagag

SEQ ID NO: 7274999 - DNA, 22 bp, Homo sapiens
agccctgcacagttcgggagga

SEQ ID NO: 7275000 - DNA, 22 bp, Homo sapiens
agcccctgtttttccagtcaga

SEQ ID NO: 7275001 - DNA, 22 bp, Homo sapiens
agccctgcacaggtctgtggct

SEQ ID NO: 7275002 - DNA, 22 bp, Homo sapiens
agcctgctggaccaagctcatg

SEQ ID NO: 7275003 - DNA, 22 bp, Homo sapiens
agcccaggtctcaaagtacagg

SEQ ID NO: 7275004 - DNA, 22 bp, Homo sapiens
agcccaggtccagttcactgca

SEQ ID NO: 7275005 - DNA, 22 bp, Homo sapiens
agcccaggttctaaagccaaac

SEQ ID NO: 7275006 - DNA, 22 bp, Homo sapiens
agcccaggtgaggggttcgaaa

SEQ ID NO: 7275007 - DNA, 22 bp, Homo sapiens
agccaggctactccttgctgac

SEQ ID NO: 7275008 - DNA, 22 bp, Homo sapiens
agcatgaaaacatgaaacagca

SEQ ID NO: 7275009 - DNA, 23 bp, Homo sapiens
agatccatgtgggctggaaactg

SEQ ID NO: 7275010 - DNA, 22 bp, Homo sapiens
agatatcacctctaggctggtg

SEQ ID NO: 7275011 - DNA, 22 bp, Homo sapiens
agatatatttaaggtaataagt

SEQ ID NO: 7275012 - DNA, 20 bp, Homo sapiens
agattattcctaagatttct

SEQ ID NO: 7275013 - DNA, 22 bp, Homo sapiens
agatgttttggagacactaacc

SEQ ID NO: 7275014 - DNA, 22 bp, Homo sapiens
acaaaaaccgtggattcagcat

SEQ ID NO: 7275015 - DNA, 22 bp, Homo sapiens
agaggttgggtctgaggtgaga

SEQ ID NO: 7275016 - DNA, 22 bp, Homo sapiens
agagtactgcctcagttatgaa

SEQ ID NO: 7275017 - DNA, 21 bp, Homo sapiens
agagtctgcatttctgacaag

SEQ ID NO: 7275018 - DNA, 22 bp, Homo sapiens
aattttgtgtgggatcaaagga

SEQ ID NO: 7275019 - DNA, 22 bp, Homo sapiens
agagggcatgcttggtggcctg

SEQ ID NO: 7275020 - DNA, 22 bp, Homo sapiens
aatttatttcctgccagtacac

SEQ ID NO: 7275021 - DNA, 19 bp, Homo sapiens
agaggcagtctccaacagg

SEQ ID NO: 7275022 - DNA, 21 bp, Homo sapiens
agaggcaggcattaagtacac

SEQ ID NO: 7275023 - DNA, 22 bp, Homo sapiens
agaggcagtatacaatccgagc

SEQ ID NO: 7275024 - DNA, 22 bp, Homo sapiens
agagcagctgtgacatggacag

SEQ ID NO: 7275025 - DNA, 22 bp, Homo sapiens
agagcagctggggcagagacca

SEQ ID NO: 7275026 - DNA, 22 bp, Homo sapiens
aattcagtaatcattaatgatg

SEQ ID NO: 7275027 - DNA, 22 bp, Homo sapiens
aatggaatgcctcacatgtatt

SEQ ID NO: 7275028 - DNA, 22 bp, Homo sapiens
aatggaatacctaggtggccca

SEQ ID NO: 7275029 - DNA, 22 bp, Homo sapiens
aatggaatacctaggtggccca

SEQ ID NO: 7275030 - DNA, 22 bp, Homo sapiens
aatggaacttgtaattatgtcc

SEQ ID NO: 7275031 - DNA, 22 bp, Homo sapiens
aatgaaaattggaccctagaac

SEQ ID NO: 7275032 - DNA, 22 bp, Homo sapiens
agaataaaatagtctgaagatg

SEQ ID NO: 7275033 - DNA, 22 bp, Homo sapiens
agaatcaggacctgtggctgtc

SEQ ID NO: 7275034 - DNA, 22 bp, Homo sapiens
agaatttttgattatctactcg

SEQ ID NO: 7275035 - DNA, 22 bp, Homo sapiens
agagatctctgaagctgctgct

SEQ ID NO: 7275036 - DNA, 22 bp, Homo sapiens
agagatctagcacctgctggtc

SEQ ID NO: 7275037 - DNA, 21 bp, Homo sapiens
agagaaagtcatggctgtggc

SEQ ID NO: 7275038 - DNA, 20 bp, Homo sapiens
agagagacctaggcctagtc

SEQ ID NO: 7275039 - DNA, 17 bp, Homo sapiens
agagagagcatgccacc

SEQ ID NO: 7275040 - DNA, 22 bp, Homo sapiens
agagagagggaaactgctaaac

SEQ ID NO: 7275041 - DNA, 22 bp, Homo sapiens
agacactgccacttctgttccc

SEQ ID NO: 7275042 - DNA, 22 bp, Homo sapiens
agacactgatgttcagctcaat

SEQ ID NO: 7275043 - DNA, 22 bp, Homo sapiens
agactggggttctggcaaggag

SEQ ID NO: 7275044 - DNA, 23 bp, Homo sapiens
agactgaggctgccagggtcaga

SEQ ID NO: 7275045 - DNA, 22 bp, Homo sapiens
acaggtgattcaggctctggga

SEQ ID NO: 7275046 - DNA, 22 bp, Homo sapiens
acaggtgatgacatttgaacca

SEQ ID NO: 7275047 - DNA, 18 bp, Homo sapiens
acaggtgatatcttgaga

SEQ ID NO: 7275048 - DNA, 22 bp, Homo sapiens
acaggtgataagaaaactcgct

SEQ ID NO: 7275049 - DNA, 22 bp, Homo sapiens
acagtgtccccagctctgtgag

SEQ ID NO: 7275050 - DNA, 23 bp, Homo sapiens
acagggcttatctgtcactcatc

SEQ ID NO: 7275051 - DNA, 22 bp, Homo sapiens
acaggtgaggatctgagcctca

SEQ ID NO: 7275052 - DNA, 22 bp, Homo sapiens
acaggtgacttgcattttcaca

SEQ ID NO: 7275053 - DNA, 22 bp, Homo sapiens
acaggtgagggagctttgtgcc

SEQ ID NO: 7275054 - DNA, 22 bp, Homo sapiens
acaggtgaggggttctaggctg

SEQ ID NO: 7275055 - DNA, 22 bp, Homo sapiens
acaggtgacctgctcatatgaa

SEQ ID NO: 7275056 - DNA, 22 bp, Homo sapiens
acaggtgaagtattacactaag

SEQ ID NO: 7275057 - DNA, 22 bp, Homo sapiens
acaggctgaaagttaagttctg

SEQ ID NO: 7275058 - DNA, 22 bp, Homo sapiens
acaggctgacttcctgccatgt

SEQ ID NO: 7275059 - DNA, 22 bp, Homo sapiens
acaggctgagcgtccatcttca

SEQ ID NO: 7275060 - DNA, 22 bp, Homo sapiens
acaggctgacttcctgccatgt

SEQ ID NO: 7275061 - DNA, 22 bp, Homo sapiens
acaggctgaggatgattgcatc

SEQ ID NO: 7275062 - DNA, 22 bp, Homo sapiens
acaggctgagcgtccatcttca

SEQ ID NO: 7275063 - DNA, 22 bp, Homo sapiens
acaggctgaggatgattgcatc

SEQ ID NO: 7275064 - DNA, 22 bp, Homo sapiens
acaggctgccacttgcatccaa

SEQ ID NO: 7275065 - DNA, 22 bp, Homo sapiens
acaggctgatagaccataaata

SEQ ID NO: 7275066 - DNA, 22 bp, Homo sapiens
acaggctgatagaccataaata

SEQ ID NO: 7275067 - DNA, 22 bp, Homo sapiens
acaggctgttggggtccagggt

SEQ ID NO: 7275068 - DNA, 21 bp, Homo sapiens
acaggagaccgcctggcagtc

SEQ ID NO: 7275069 - DNA, 22 bp, Homo sapiens
acaggagaccctgctggttctg

SEQ ID NO: 7275070 - DNA, 22 bp, Homo sapiens
acaggagaccctgctggttctg

SEQ ID NO: 7275071 - DNA, 22 bp, Homo sapiens
acaggaaattggcatatcagtt

SEQ ID NO: 7275072 - DNA, 20 bp, Homo sapiens
acagatgaggaaaatgaagt

SEQ ID NO: 7275073 - DNA, 22 bp, Homo sapiens
acagattttaaatttgtagttg

SEQ ID NO: 7275074 - DNA, 20 bp, Homo sapiens
acaggagatctgaggaaagg

SEQ ID NO: 7275075 - DNA, 22 bp, Homo sapiens
acaggcagagaactcagccaga

SEQ ID NO: 7275076 - DNA, 22 bp, Homo sapiens
acaggcagagaactcagccaga

SEQ ID NO: 7275077 - DNA, 22 bp, Homo sapiens
aagtaaaatgtttcctttatta

SEQ ID NO: 7275078 - DNA, 22 bp, Homo sapiens
accagctggtcacctgggcact

SEQ ID NO: 7275079 - DNA, 22 bp, Homo sapiens
acattcttaacagttaaaaact

SEQ ID NO: 7275080 - DNA, 22 bp, Homo sapiens
aagggcagcctgactcacggtc

SEQ ID NO: 7275081 - DNA, 22 bp, Homo sapiens
acattatagttgctacagagta

SEQ ID NO: 7275082 - DNA, 22 bp, Homo sapiens
acatactttagcactgcattgt

SEQ ID NO: 7275083 - DNA, 22 bp, Homo sapiens
aatcttgagtgttactctcatt

SEQ ID NO: 7275084 - DNA, 22 bp, Homo sapiens
aatcttgagggactcatgaggt

SEQ ID NO: 7275085 - DNA, 22 bp, Homo sapiens
aatctttaaggactcagtctct

SEQ ID NO: 7275086 - DNA, 22 bp, Homo sapiens
aatcttctacttgacagttctc

SEQ ID NO: 7275087 - DNA, 22 bp, Homo sapiens
aatcttctttcttaacagtaca

SEQ ID NO: 7275088 - DNA, 22 bp, Homo sapiens
aatctttccctattaaatgtgg

SEQ ID NO: 7275089 - DNA, 22 bp, Homo sapiens
aatatgtgggtgctaatcaaaa

SEQ ID NO: 7275090 - DNA, 22 bp, Homo sapiens
aatatgcagcatgatgaagtaa

SEQ ID NO: 7275091 - DNA, 22 bp, Homo sapiens
agaaaataatttcttggctggt

SEQ ID NO: 7275092 - DNA, 22 bp, Homo sapiens
agaaaccagacttggcccattt

SEQ ID NO: 7275093 - DNA, 22 bp, Homo sapiens
agaaaattactccagagacaag

SEQ ID NO: 7275094 - DNA, 22 bp, Homo sapiens
actgtggcctgctgtatgggct

SEQ ID NO: 7275095 - DNA, 22 bp, Homo sapiens
actgtggccggaacagtgggac

SEQ ID NO: 7275096 - DNA, 22 bp, Homo sapiens
actgtggccttgtgggttcagg

SEQ ID NO: 7275097 - DNA, 22 bp, Homo sapiens
actgtggctaattcatttggtc

SEQ ID NO: 7275098 - DNA, 22 bp, Homo sapiens
actgtggcgtcaggaagaaatt

SEQ ID NO: 7275099 - DNA, 22 bp, Homo sapiens
actgtggccaaagcctctggga

SEQ ID NO: 7275100 - DNA, 22 bp, Homo sapiens
actgtggcactaggcaccttac

SEQ ID NO: 7275101 - DNA, 22 bp, Homo sapiens
acttatcagttgtctctaatgt

SEQ ID NO: 7275102 - DNA, 22 bp, Homo sapiens
acttataagagtgctatgggga

SEQ ID NO: 7275103 - DNA, 22 bp, Homo sapiens
aatatgaattattgttacaagt

SEQ ID NO: 7275104 - DNA, 22 bp, Homo sapiens
aatatcagcacttttgtggtat

SEQ ID NO: 7275105 - DNA, 22 bp, Homo sapiens
aatatcagtatattgtatcagt

SEQ ID NO: 7275106 - DNA, 22 bp, Homo sapiens
acttccagtgtctgctgctagc

SEQ ID NO: 7275107 - DNA, 22 bp, Homo sapiens
aagtctgactagaatctctccc

SEQ ID NO: 7275108 - DNA, 22 bp, Homo sapiens
acctggcttcaaccatcatttg

SEQ ID NO: 7275109 - DNA, 22 bp, Homo sapiens
acctggctgttctcatttctag

SEQ ID NO: 7275110 - DNA, 22 bp, Homo sapiens
accttgatgcctttccaagatg

SEQ ID NO: 7275111 - DNA, 22 bp, Homo sapiens
aataaatcaatcctattggtag

SEQ ID NO: 7275112 - DNA, 22 bp, Homo sapiens
actcatggtagcacaggctgtg

SEQ ID NO: 7275113 - DNA, 22 bp, Homo sapiens
aagttttatgggaagatgtgca

SEQ ID NO: 7275114 - DNA, 22 bp, Homo sapiens
aagtttggtccttctaagaaga

SEQ ID NO: 7275115 - DNA, 22 bp, Homo sapiens
acagaagcagccgtcacagata

SEQ ID NO: 7275116 - DNA, 22 bp, Homo sapiens
aagatacattttcttcagagaa

SEQ ID NO: 7275117 - DNA, 22 bp, Homo sapiens
aagatacatcattcaggagtga

SEQ ID NO: 7275118 - DNA, 22 bp, Homo sapiens
acactagctaaatgctgattaa

SEQ ID NO: 7275119 - DNA, 22 bp, Homo sapiens
aagatacattatgtctctctga

SEQ ID NO: 7275120 - DNA, 22 bp, Homo sapiens
aagcacatgaaaatgtgaagct

SEQ ID NO: 7275121 - DNA, 22 bp, Homo sapiens
aagcacattatagctatctagg

SEQ ID NO: 7275122 - DNA, 22 bp, Homo sapiens
acagatgaaaaagcttgtggat

SEQ ID NO: 7275123 - DNA, 18 bp, Homo sapiens
acagaggcagacatgtat

SEQ ID NO: 7275124 - DNA, 17 bp, Homo sapiens
acagagcacatcaagat

SEQ ID NO: 7275125 - DNA, 22 bp, Homo sapiens
aagaggaggattgatgtgggag

SEQ ID NO: 7275126 - DNA, 22 bp, Homo sapiens
aagaggagtagatgtggttggt

SEQ ID NO: 7275127 - DNA, 22 bp, Homo sapiens
aagaggcagtggtgatgaatgg

SEQ ID NO: 7275128 - DNA, 22 bp, Homo sapiens
aagaggcagaaatatcgctgaa

SEQ ID NO: 7275129 - DNA, 22 bp, Homo sapiens
aagatacatcaaagcaaattgg

SEQ ID NO: 7275130 - DNA, 22 bp, Homo sapiens
acactaatgagaaaggaattaa

SEQ ID NO: 7275131 - DNA, 22 bp, Homo sapiens
acactaaggttggagtcacagt

SEQ ID NO: 7275132 - DNA, 22 bp, Homo sapiens
acaactttctgggttatctgat

SEQ ID NO: 7275133 - DNA, 22 bp, Homo sapiens
acaagaagggtgattaggggca

SEQ ID NO: 7275134 - DNA, 22 bp, Homo sapiens
aagacaatgtttctgatagata

SEQ ID NO: 7275135 - DNA, 22 bp, Homo sapiens
aagacaatgcattactaagaag

SEQ ID NO: 7275136 - DNA, 22 bp, Homo sapiens
aagacaatttgatactagttgc

SEQ ID NO: 7275137 - DNA, 22 bp, Homo sapiens
aattcaaagactagaattttgc

SEQ ID NO: 7275138 - DNA, 22 bp, Homo sapiens
aagaattggtttcctctgtcat

SEQ ID NO: 7275139 - DNA, 22 bp, Homo sapiens
aagaattggtcacatgctacaa

SEQ ID NO: 7275140 - DNA, 22 bp, Homo sapiens
aagaattttccagcatgtcagt

SEQ ID NO: 7275141 - DNA, 22 bp, Homo sapiens
aatgttttgtatgcctctgagc

SEQ ID NO: 7275142 - DNA, 22 bp, Homo sapiens
aatgttatgtggttcaacttaa

SEQ ID NO: 7275143 - DNA, 21 bp, Homo sapiens
aactttagaaagactgggaag

SEQ ID NO: 7275144 - DNA, 22 bp, Homo sapiens
aactttcagaatcctatgcatt

SEQ ID NO: 7275145 - DNA, 22 bp, Homo sapiens
aatgtgaactttgtcatgtaac

SEQ ID NO: 7275146 - DNA, 22 bp, Homo sapiens
aatgtcttttaaatgttgaggt

SEQ ID NO: 7275147 - DNA, 22 bp, Homo sapiens
aatgtatttgatgtattagcct

SEQ ID NO: 7275148 - DNA, 22 bp, Homo sapiens
aatgtattctgggaaaatgtta

SEQ ID NO: 7275149 - DNA, 22 bp, Homo sapiens
aactcttaattttcatgaaatg

SEQ ID NO: 7275150 - DNA, 22 bp, Homo sapiens
aactctatttaccctactaaac

SEQ ID NO: 7275151 - DNA, 22 bp, Homo sapiens
aaattattacaagctagttggc

SEQ ID NO: 7275152 - DNA, 22 bp, Homo sapiens
aaattataggtgccaccttgga

SEQ ID NO: 7275153 - DNA, 22 bp, Homo sapiens
aaattgttgatctacagtaagg

SEQ ID NO: 7275154 - DNA, 22 bp, Homo sapiens
aaatttaaaaagcagcattgca

SEQ ID NO: 7275155 - DNA, 22 bp, Homo sapiens
aagccagtggcttctccctgct

SEQ ID NO: 7275156 - DNA, 22 bp, Homo sapiens
aagcccagatgagatccctgga

SEQ ID NO: 7275157 - DNA, 22 bp, Homo sapiens
aagctttatgacttggagacag

SEQ ID NO: 7275158 - DNA, 22 bp, Homo sapiens
aacaaatgtgttttgtaattaa

SEQ ID NO: 7275159 - DNA, 22 bp, Homo sapiens
aacaaggcacaagctggctgtt

SEQ ID NO: 7275160 - DNA, 22 bp, Homo sapiens
aacaaggcaagtctgtgagcat

SEQ ID NO: 7275161 - DNA, 22 bp, Homo sapiens
aagggaggccagaggttttgca

SEQ ID NO: 7275162 - DNA, 22 bp, Homo sapiens
aagggaggaggatttattgtac

SEQ ID NO: 7275163 - DNA, 22 bp, Homo sapiens
aagtatgtcaatcatacttcaa

SEQ ID NO: 7275164 - DNA, 22 bp, Homo sapiens
aacaatgctgaactgaggaaag

SEQ ID NO: 7275165 - DNA, 22 bp, Homo sapiens
aacaatgcctgatgacctcctg

SEQ ID NO: 7275166 - DNA, 22 bp, Homo sapiens
aacaatgccacattaagtgtat

SEQ ID NO: 7275167 - DNA, 16 bp, Homo sapiens
aacaatgccaatccag

SEQ ID NO: 7275168 - DNA, 22 bp, Homo sapiens
aacaatgccaacagcatgctgg

SEQ ID NO: 7275169 - DNA, 22 bp, Homo sapiens
aacaatgcagttaatgggaaga

SEQ ID NO: 7275170 - DNA, 22 bp, Homo sapiens
aacaatgcactatcgtaagtgg

SEQ ID NO: 7275171 - DNA, 22 bp, Homo sapiens
aactccaggcagggaggccact

SEQ ID NO: 7275172 - DNA, 22 bp, Homo sapiens
aacatttcagcaaataagaaca

SEQ ID NO: 7275173 - DNA, 22 bp, Homo sapiens
aatatttgaacagtcactgagt

SEQ ID NO: 7275174 - DNA, 22 bp, Homo sapiens
aacattctggttctaaaaacct

SEQ ID NO: 7275175 - DNA, 22 bp, Homo sapiens
aataaaatggtcagttttctca

SEQ ID NO: 7275176 - DNA, 22 bp, Homo sapiens
aagtttgcatagattaagcatt

SEQ ID NO: 7275177 - DNA, 22 bp, Homo sapiens
aagtatttcgttctgaaaaagt

SEQ ID NO: 7275178 - DNA, 22 bp, Homo sapiens
aacattctattttgctaaaaca

SEQ ID NO: 7275179 - DNA, 22 bp, Homo sapiens
aacatgcaatgtctgaaaatcc

SEQ ID NO: 7275180 - DNA, 22 bp, Homo sapiens
aactcaaagatgcatgacgctt

SEQ ID NO: 7275181 - DNA, 22 bp, Homo sapiens
aactcaaagatgcatgacgctt

SEQ ID NO: 7275182 - DNA, 22 bp, Homo sapiens
aactcaaagatgcatgacgctt

SEQ ID NO: 7275183 - DNA, 22 bp, Homo sapiens
aactcagacatgtataaagact

SEQ ID NO: 7275184 - DNA, 22 bp, Homo sapiens
aactgataatggacacataaaa

SEQ ID NO: 7275185 - DNA, 22 bp, Homo sapiens
aaagcacatgagtagtgtagta

SEQ ID NO: 7275186 - DNA, 22 bp, Homo sapiens
aacacaaagaagctgcaggatc

SEQ ID NO: 7275187 - DNA, 22 bp, Homo sapiens
aaatatcatttataacttttaa

SEQ ID NO: 7275188 - DNA, 18 bp, Homo sapiens
aagaggaggagcaggttg

SEQ ID NO: 7275189 - DNA, 22 bp, Homo sapiens
aagaggaggacggttcccagaa

SEQ ID NO: 7275190 - DNA, 18 bp, Homo sapiens
aagaggaggaaacccagg

SEQ ID NO: 7275191 - DNA, 22 bp, Homo sapiens
aagaggagacttcagcaacttg

SEQ ID NO: 7275192 - DNA, 22 bp, Homo sapiens
aagcaaatgtgggtgcagaatt

SEQ ID NO: 7275193 - DNA, 22 bp, Homo sapiens
aagcaaatatttctagagactg

SEQ ID NO: 7275194 - DNA, 22 bp, Homo sapiens
aagcaaatgtgggtgcagaatt

SEQ ID NO: 7275195 - DNA, 22 bp, Homo sapiens
aagcaaaggcaggagcttgtga

SEQ ID NO: 7275196 - DNA, 22 bp, Homo sapiens
aagcactgagcacagtggctga

SEQ ID NO: 7275197 - DNA, 22 bp, Homo sapiens
aagcactgggaggaggctgaga

SEQ ID NO: 7275198 - DNA, 22 bp, Homo sapiens
aagcagatctgatagggccctg

SEQ ID NO: 7275199 - DNA, 22 bp, Homo sapiens
aagcagatgccaagatttacca

SEQ ID NO: 7275200 - DNA, 22 bp, Homo sapiens
aagcagattggggatttccatg

SEQ ID NO: 7275201 - DNA, 23 bp, Homo sapiens
aacttttagagtttaacagtgtt

SEQ ID NO: 7275202 - DNA, 22 bp, Homo sapiens
aagaaagtgctttgtaaattat

SEQ ID NO: 7275203 - DNA, 22 bp, Homo sapiens
aagaaataagacttctctgtcc

SEQ ID NO: 7275204 - DNA, 22 bp, Homo sapiens
aagaatgtcaagcagaaggtct

SEQ ID NO: 7275205 - DNA, 22 bp, Homo sapiens
aagaggagaaaggctggctttg

SEQ ID NO: 7275206 - DNA, 22 bp, Homo sapiens
aagagcatcaatgactcgcagt

SEQ ID NO: 7275207 - DNA, 22 bp, Homo sapiens
aagagcagtgttttactcagct

SEQ ID NO: 7275208 - DNA, 20 bp, Homo sapiens
aagagaggaagttatactag

SEQ ID NO: 7275209 - DNA, 17 bp, Homo sapiens
aagacagaagccatgag

SEQ ID NO: 7275210 - DNA, 22 bp, Homo sapiens
aagacagagactctgcaacagg

SEQ ID NO: 7275211 - DNA, 17 bp, Homo sapiens
aagacagaagccatgag

SEQ ID NO: 7275212 - DNA, 23 bp, Homo sapiens
aaagatgtgagtattcatatggc

SEQ ID NO: 7275213 - DNA, 22 bp, Homo sapiens
aaatacagattctgactcagag

SEQ ID NO: 7275214 - DNA, 22 bp, Homo sapiens
aaatataatttctgcctcaata

SEQ ID NO: 7275215 - DNA, 19 bp, Homo sapiens
aaactaaggggaaatgttt

SEQ ID NO: 7275216 - DNA, 22 bp, Homo sapiens
aaatccaggtagtttggtttga

SEQ ID NO: 7275217 - DNA, 22 bp, Homo sapiens
aaatgcctgaatggtatttggt

SEQ ID NO: 7275218 - DNA, 22 bp, Homo sapiens
aaatgcctctgggttattctag

SEQ ID NO: 7275219 - DNA, 22 bp, Homo sapiens
aaatgcctctgctgtacacaat

SEQ ID NO: 7275220 - DNA, 22 bp, Homo sapiens
aaatgcctgtgtaaattctagc

SEQ ID NO: 7275221 - DNA, 22 bp, Homo sapiens
aaacatgaatagatattaaaca

SEQ ID NO: 7275222 - DNA, 22 bp, Homo sapiens
aaaccacatgccttcaaatgct

SEQ ID NO: 7275223 - DNA, 22 bp, Homo sapiens
aaactttaaatttgtacctctg

SEQ ID NO: 7275224 - DNA, 22 bp, Homo sapiens
aaactttaagacagtcctcaag

SEQ ID NO: 7275225 - DNA, 22 bp, Homo sapiens
aaactttaggaaggaatttaca

SEQ ID NO: 7275226 - DNA, 22 bp, Homo sapiens
aaagaactacctgtatgatatt

SEQ ID NO: 7275227 - DNA, 22 bp, Homo sapiens
aaacttgaacccagctcaggct

SEQ ID NO: 7275228 - DNA, 23 bp, Homo sapiens
aaacttgctatggctgaaatcat

SEQ ID NO: 7275229 - DNA, 19 bp, Homo sapiens
aaagatctgggattgagac

SEQ ID NO: 7275230 - DNA, 22 bp, Homo sapiens
aaagaagggacagactgcctct

SEQ ID NO: 7275231 - DNA, 22 bp, Homo sapiens
aaaagtctgctctcatttcaga

SEQ ID NO: 7275232 - DNA, 19 bp, Homo sapiens
aaaaacttagtccagaaag

SEQ ID NO: 7275233 - DNA, 22 bp, Homo sapiens
aaacaactcggcaactgctttt

SEQ ID NO: 7275234 - DNA, 22 bp, Homo sapiens
tcaggtcccactgctagtaagt

SEQ ID NO: 7275235 - DNA, 22 bp, Homo sapiens
tcaggtccagctcctgtgcctc

SEQ ID NO: 7275236 - DNA, 22 bp, Homo sapiens
tcaggcctttgaacttggagtg

SEQ ID NO: 7275237 - DNA, 22 bp, Homo sapiens
tcaggctgaaaggactccagtt

SEQ ID NO: 7275238 - DNA, 22 bp, Homo sapiens
tcaggctgaaggaggcctatct

SEQ ID NO: 7275239 - DNA, 22 bp, Homo sapiens
tcaggctgaatcatcctagctt

SEQ ID NO: 7275240 - DNA, 22 bp, Homo sapiens
tcagggacttacaaaccagaag

SEQ ID NO: 7275241 - DNA, 22 bp, Homo sapiens
tcaggctgaccaggttttgctc

SEQ ID NO: 7275242 - DNA, 22 bp, Homo sapiens
tcaggctgagaaaatctggacc

SEQ ID NO: 7275243 - DNA, 23 bp, Homo sapiens
tcagtttgtataatccatatgca

SEQ ID NO: 7275244 - DNA, 22 bp, Homo sapiens
tcatcaaagcgcttggagtagg

SEQ ID NO: 7275245 - DNA, 22 bp, Homo sapiens
tcaggagatgtaaccttagctg

SEQ ID NO: 7275246 - DNA, 22 bp, Homo sapiens
tcaggagatggtctttataggc

SEQ ID NO: 7275247 - DNA, 22 bp, Homo sapiens
tcaggcagatgcagggatggat

SEQ ID NO: 7275248 - DNA, 22 bp, Homo sapiens
tcaggcaggaagcccctgcaca

SEQ ID NO: 7275249 - DNA, 22 bp, Homo sapiens
tcaggcaggaagcccctgcaca

SEQ ID NO: 7275250 - DNA, 22 bp, Homo sapiens
tcaggcagcattaaacttcagc

SEQ ID NO: 7275251 - DNA, 22 bp, Homo sapiens
tcaggcaggatcccagggaagg

SEQ ID NO: 7275252 - DNA, 22 bp, Homo sapiens
tcaggcaggcagagggcaaatg

SEQ ID NO: 7275253 - DNA, 21 bp, Homo sapiens
tcaggcaggcgcagagggaag

SEQ ID NO: 7275254 - DNA, 22 bp, Homo sapiens
tcaggcaggctcagaggaaaac

SEQ ID NO: 7275255 - DNA, 21 bp, Homo sapiens
tcaggcaggtcccactgaaca

SEQ ID NO: 7275256 - DNA, 22 bp, Homo sapiens
tcaggcaggtggctggctatgg

SEQ ID NO: 7275257 - DNA, 22 bp, Homo sapiens
tcaggcaggttggctgcaggtc

SEQ ID NO: 7275258 - DNA, 22 bp, Homo sapiens
tcacagcctggtcactctgccc

SEQ ID NO: 7275259 - DNA, 23 bp, Homo sapiens
tcacatatcaagaaagtggtaga

SEQ ID NO: 7275260 - DNA, 20 bp, Homo sapiens
tcacatcctctcccaacatg

SEQ ID NO: 7275261 - DNA, 22 bp, Homo sapiens
tcacagcaccaggatctctcca

SEQ ID NO: 7275262 - DNA, 22 bp, Homo sapiens
tcacagcaccctgaggtgctgg

SEQ ID NO: 7275263 - DNA, 22 bp, Homo sapiens
tcacagagatgaacttttgata

SEQ ID NO: 7275264 - DNA, 22 bp, Homo sapiens
tcacagagagtgacttgttgct

SEQ ID NO: 7275265 - DNA, 22 bp, Homo sapiens
tcacagcaaatgctgcttctca

SEQ ID NO: 7275266 - DNA, 22 bp, Homo sapiens
tcacagaatttttgcttccagt

SEQ ID NO: 7275267 - DNA, 20 bp, Homo sapiens
tcaaaataggtgtgggcgga

SEQ ID NO: 7275268 - DNA, 22 bp, Homo sapiens
tcaaaatcaaagatacttgaaa

SEQ ID NO: 7275269 - DNA, 18 bp, Homo sapiens
tcaaaatatttctgtgga

SEQ ID NO: 7275270 - DNA, 22 bp, Homo sapiens
tcacaatttggatacagctatg

SEQ ID NO: 7275271 - DNA, 22 bp, Homo sapiens
tcactacaacctccgcctcctg

SEQ ID NO: 7275272 - DNA, 22 bp, Homo sapiens
tcacatgagtattattttccaa

SEQ ID NO: 7275273 - DNA, 22 bp, Homo sapiens
tcacatgagtattattttccaa

SEQ ID NO: 7275274 - DNA, 22 bp, Homo sapiens
tcacccaggtaatagcagtttg

SEQ ID NO: 7275275 - DNA, 22 bp, Homo sapiens
tcaccttgtgatctccctgcct

SEQ ID NO: 7275276 - DNA, 21 bp, Homo sapiens
tcacgtggtcacatgagcttt

SEQ ID NO: 7275277 - DNA, 22 bp, Homo sapiens
tcaccggcagacgtggcctgat

SEQ ID NO: 7275278 - DNA, 22 bp, Homo sapiens
tcaccgaggctggagtgcagtg

SEQ ID NO: 7275279 - DNA, 22 bp, Homo sapiens
tcagaacattctcattgactgc

SEQ ID NO: 7275280 - DNA, 22 bp, Homo sapiens
tcccttcctcataggcagaagg

SEQ ID NO: 7275281 - DNA, 22 bp, Homo sapiens
tccctgccctcagtgcacccgg

SEQ ID NO: 7275282 - DNA, 22 bp, Homo sapiens
tccctgccagtcctggtctgaa

SEQ ID NO: 7275283 - DNA, 22 bp, Homo sapiens
tccctgagggcagctcaagtcc

SEQ ID NO: 7275284 - DNA, 22 bp, Homo sapiens
tcccaggattttaggctctcag

SEQ ID NO: 7275285 - DNA, 22 bp, Homo sapiens
tcccaggatgtttatggctggt

SEQ ID NO: 7275286 - DNA, 23 bp, Homo sapiens
tcctcctgacacagcctgagtga

SEQ ID NO: 7275287 - DNA, 22 bp, Homo sapiens
tcctcctgctgttagtcttgaa

SEQ ID NO: 7275288 - DNA, 22 bp, Homo sapiens
tccgggagctgaacgtcttgcg

SEQ ID NO: 7275289 - DNA, 22 bp, Homo sapiens
tccgggttttacactcacatca

SEQ ID NO: 7275290 - DNA, 22 bp, Homo sapiens
tccgggttttacactcacatca

SEQ ID NO: 7275291 - DNA, 22 bp, Homo sapiens
tccggggcttccccgcagtgcc

SEQ ID NO: 7275292 - DNA, 22 bp, Homo sapiens
tccacagacgtgttattagttg

SEQ ID NO: 7275293 - DNA, 22 bp, Homo sapiens
tccacagatgcctttaggagta

SEQ ID NO: 7275294 - DNA, 22 bp, Homo sapiens
tccacagcacaaagccagtgtg

SEQ ID NO: 7275295 - DNA, 22 bp, Homo sapiens
tccacaggctgaggcccttctg

SEQ ID NO: 7275296 - DNA, 22 bp, Homo sapiens
tccacagggatgttgagttctt

SEQ ID NO: 7275297 - DNA, 22 bp, Homo sapiens
tcatgtgtcctagttcatataa

SEQ ID NO: 7275298 - DNA, 22 bp, Homo sapiens
tcatgtgtcctagttcatataa

SEQ ID NO: 7275299 - DNA, 22 bp, Homo sapiens
tcatggctggaagctcagttag

SEQ ID NO: 7275300 - DNA, 22 bp, Homo sapiens
tcatgtgtctgccagtgtttat

SEQ ID NO: 7275301 - DNA, 22 bp, Homo sapiens
tccactccttatgccagacggt

SEQ ID NO: 7275302 - DNA, 22 bp, Homo sapiens
tccacgctgtgtgaccttgggc

SEQ ID NO: 7275303 - DNA, 18 bp, Homo sapiens
tccaccagtcaatctgtc

SEQ ID NO: 7275304 - DNA, 22 bp, Homo sapiens
tccaccagagccttcccatgct

SEQ ID NO: 7275305 - DNA, 22 bp, Homo sapiens
tccaccagagccctctttgcgg

SEQ ID NO: 7275306 - DNA, 22 bp, Homo sapiens
tccaccagcagcctgtcagcct

SEQ ID NO: 7275307 - DNA, 22 bp, Homo sapiens
tccaccagagccttcccatgct

SEQ ID NO: 7275308 - DNA, 22 bp, Homo sapiens
tccaccagccaggcccaggctg

SEQ ID NO: 7275309 - DNA, 22 bp, Homo sapiens
tccaccagccaggcccaggctg

SEQ ID NO: 7275310 - DNA, 22 bp, Homo sapiens
tccaccagcttcttcaccagct

SEQ ID NO: 7275311 - DNA, 22 bp, Homo sapiens
tccaccagggtttcatctccct

SEQ ID NO: 7275312 - DNA, 22 bp, Homo sapiens
tccaccaggctccatgttcagt

SEQ ID NO: 7275313 - DNA, 22 bp, Homo sapiens
tccaccaggctccatgttcagt

SEQ ID NO: 7275314 - DNA, 23 bp, Homo sapiens
tccaggagcatgctggctggcga

SEQ ID NO: 7275315 - DNA, 23 bp, Homo sapiens
tccaggagaacccctgtctgtcc

SEQ ID NO: 7275316 - DNA, 20 bp, Homo sapiens
tccaggagaactgggagccg

SEQ ID NO: 7275317 - DNA, 22 bp, Homo sapiens
tccaggagctcatccacgtcaa

SEQ ID NO: 7275318 - DNA, 22 bp, Homo sapiens
tccaggaggaggaaggctgcca

SEQ ID NO: 7275319 - DNA, 22 bp, Homo sapiens
tccaggaggactgagggggctg

SEQ ID NO: 7275320 - DNA, 22 bp, Homo sapiens
tccaggagaaaactgacggtgg

SEQ ID NO: 7275321 - DNA, 23 bp, Homo sapiens
tccagcctcttgctctcacatgc

SEQ ID NO: 7275322 - DNA, 22 bp, Homo sapiens
tccagcctgaactttgtccaga

SEQ ID NO: 7275323 - DNA, 19 bp, Homo sapiens
tccagcctgctgtttctct

SEQ ID NO: 7275324 - DNA, 22 bp, Homo sapiens
tccagccttccttttcactctc

SEQ ID NO: 7275325 - DNA, 21 bp, Homo sapiens
tccagcctttccctcacttcc

SEQ ID NO: 7275326 - DNA, 22 bp, Homo sapiens
tccagcccatccctagcctggg

SEQ ID NO: 7275327 - DNA, 19 bp, Homo sapiens
tccagcccctctgtgtgtg

SEQ ID NO: 7275328 - DNA, 22 bp, Homo sapiens
tccagcccgactgggcctgccg

SEQ ID NO: 7275329 - DNA, 19 bp, Homo sapiens
tcccaggaaccttttattt

SEQ ID NO: 7275330 - DNA, 17 bp, Homo sapiens
tcccaggaacagggaat

SEQ ID NO: 7275331 - DNA, 19 bp, Homo sapiens
tcccaggaagcaaatgtca

SEQ ID NO: 7275332 - DNA, 22 bp, Homo sapiens
tcccaggaagatcccagggacc

SEQ ID NO: 7275333 - DNA, 22 bp, Homo sapiens
tcccaggatgttggcggcaggt

SEQ ID NO: 7275334 - DNA, 22 bp, Homo sapiens
tcccaggatgtgcgtgccgccg

SEQ ID NO: 7275335 - DNA, 22 bp, Homo sapiens
tcccaggatgaagacagtgttg

SEQ ID NO: 7275336 - DNA, 22 bp, Homo sapiens
tcccaggaatccgtcctctaga

SEQ ID NO: 7275337 - DNA, 22 bp, Homo sapiens
tcccaggaaggattcggcattt

SEQ ID NO: 7275338 - DNA, 22 bp, Homo sapiens
tcccaggaaaacactcgaggac

SEQ ID NO: 7275339 - DNA, 22 bp, Homo sapiens
tcccagctgtgtggaggagatg

SEQ ID NO: 7275340 - DNA, 22 bp, Homo sapiens
tcccagctactctagaggctga

SEQ ID NO: 7275341 - DNA, 22 bp, Homo sapiens
tcccagctcacatatggtaact

SEQ ID NO: 7275342 - DNA, 22 bp, Homo sapiens
tcccagctgagattgagcaagg

SEQ ID NO: 7275343 - DNA, 22 bp, Homo sapiens
tcccagcctttcttttctgctg

SEQ ID NO: 7275344 - DNA, 22 bp, Homo sapiens
tcccagcctttcttttctgctg

SEQ ID NO: 7275345 - DNA, 22 bp, Homo sapiens
tccaggaggcagggctgtgccc

SEQ ID NO: 7275346 - DNA, 22 bp, Homo sapiens
tccaggaggcacctttggacca

SEQ ID NO: 7275347 - DNA, 18 bp, Homo sapiens
tccagtcccagctctgcc

SEQ ID NO: 7275348 - DNA, 22 bp, Homo sapiens
tccagtccatggcctcagtctt

SEQ ID NO: 7275349 - DNA, 22 bp, Homo sapiens
tccagtcctatctgcccttgga

SEQ ID NO: 7275350 - DNA, 22 bp, Homo sapiens
tattgcaattggcagagtgcta

SEQ ID NO: 7275351 - DNA, 22 bp, Homo sapiens
tattgcagaatgtgagttggca

SEQ ID NO: 7275352 - DNA, 22 bp, Homo sapiens
tattgcagaattcgctggaaca

SEQ ID NO: 7275353 - DNA, 22 bp, Homo sapiens
tatttcagggagaataaatttg

SEQ ID NO: 7275354 - DNA, 22 bp, Homo sapiens
tatttcagcacatgggataggt

SEQ ID NO: 7275355 - DNA, 22 bp, Homo sapiens
tatttcagcaagaagaatgtgg

SEQ ID NO: 7275356 - DNA, 22 bp, Homo sapiens
tatttcagccctactacttggc

SEQ ID NO: 7275357 - DNA, 22 bp, Homo sapiens
tatttctaagagatatctgtac

SEQ ID NO: 7275358 - DNA, 22 bp, Homo sapiens
tatttctaagagatatctgtac

SEQ ID NO: 7275359 - DNA, 22 bp, Homo sapiens
tatttccatgttagaactaagt

SEQ ID NO: 7275360 - DNA, 22 bp, Homo sapiens
tatttccaggccccactctaga

SEQ ID NO: 7275361 - DNA, 22 bp, Homo sapiens
tatttccagcagtaagaagaca

SEQ ID NO: 7275362 - DNA, 22 bp, Homo sapiens
tatttgtcacctatggctgtcc

SEQ ID NO: 7275363 - DNA, 22 bp, Homo sapiens
tatttgtccttattaagatctg

SEQ ID NO: 7275364 - DNA, 22 bp, Homo sapiens
tattttcattctgtgtgactgt

SEQ ID NO: 7275365 - DNA, 22 bp, Homo sapiens
tattttcatcttgtccttggat

SEQ ID NO: 7275366 - DNA, 22 bp, Homo sapiens
tattttcaccttctctggatat

SEQ ID NO: 7275367 - DNA, 22 bp, Homo sapiens
tatgtgttgaatttgaacgtta

SEQ ID NO: 7275368 - DNA, 22 bp, Homo sapiens
tatgtgttatttggtatacatt

SEQ ID NO: 7275369 - DNA, 17 bp, Homo sapiens
tatgtgtgtttgcagca

SEQ ID NO: 7275370 - DNA, 22 bp, Homo sapiens
tatgctctcctcccagtcccag

SEQ ID NO: 7275371 - DNA, 22 bp, Homo sapiens
tatgcccttacaatgagcacaa

SEQ ID NO: 7275372 - DNA, 22 bp, Homo sapiens
tatgcccttcttggtggctcag

SEQ ID NO: 7275373 - DNA, 22 bp, Homo sapiens
tatgttattttcatacaacaga

SEQ ID NO: 7275374 - DNA, 22 bp, Homo sapiens
tatgttattttcatacaacaga

SEQ ID NO: 7275375 - DNA, 22 bp, Homo sapiens
tattcacaaaatgaggtcctca

SEQ ID NO: 7275376 - DNA, 22 bp, Homo sapiens
tattcacatgtacatatgctca

SEQ ID NO: 7275377 - DNA, 22 bp, Homo sapiens
tattcatgagataggcagtttt

SEQ ID NO: 7275378 - DNA, 22 bp, Homo sapiens
tattgagttacagaaaatactt

SEQ ID NO: 7275379 - DNA, 22 bp, Homo sapiens
tataccatgtgtgcacactccc

SEQ ID NO: 7275380 - DNA, 22 bp, Homo sapiens
tagtgtatgtctaacatacact

SEQ ID NO: 7275381 - DNA, 22 bp, Homo sapiens
tagtgtatgttcagcttatatg

SEQ ID NO: 7275382 - DNA, 22 bp, Homo sapiens
tagtgtttagtacatatgcata

SEQ ID NO: 7275383 - DNA, 22 bp, Homo sapiens
tagttaaagccctaaattgata

SEQ ID NO: 7275384 - DNA, 22 bp, Homo sapiens
tatatgatgccaaataacctgt

SEQ ID NO: 7275385 - DNA, 22 bp, Homo sapiens
tatattaacacccacttgcctc

SEQ ID NO: 7275386 - DNA, 22 bp, Homo sapiens
tatattaaaccctctctgtagg

SEQ ID NO: 7275387 - DNA, 22 bp, Homo sapiens
tatattaaagtgctttgcagtg

SEQ ID NO: 7275388 - DNA, 22 bp, Homo sapiens
tatgcataggtatctatactca

SEQ ID NO: 7275389 - DNA, 22 bp, Homo sapiens
tatgcatagatattatcagcca

SEQ ID NO: 7275390 - DNA, 22 bp, Homo sapiens
tatgccactgctctccatccta

SEQ ID NO: 7275391 - DNA, 22 bp, Homo sapiens
tatcaacattaatattttctgg

SEQ ID NO: 7275392 - DNA, 22 bp, Homo sapiens
tatcaatacatgttatcagtgt

SEQ ID NO: 7275393 - DNA, 18 bp, Homo sapiens
tatatttcacacatattc

SEQ ID NO: 7275394 - DNA, 22 bp, Homo sapiens
tagccaggctgcagctgatccg

SEQ ID NO: 7275395 - DNA, 22 bp, Homo sapiens
tagattttgcatttctaacaag

SEQ ID NO: 7275396 - DNA, 22 bp, Homo sapiens
tagattttaggagattttactg

SEQ ID NO: 7275397 - DNA, 22 bp, Homo sapiens
tagatgctacaattttgtactc

SEQ ID NO: 7275398 - DNA, 22 bp, Homo sapiens
tagatgctactttacatagggt

SEQ ID NO: 7275399 - DNA, 22 bp, Homo sapiens
tagatgctagtagcacctgacc

SEQ ID NO: 7275400 - DNA, 22 bp, Homo sapiens
tagatgctattatggcagtgtt

SEQ ID NO: 7275401 - DNA, 22 bp, Homo sapiens
tagatgattttcagtcaaagca

SEQ ID NO: 7275402 - DNA, 22 bp, Homo sapiens
tagatgaccttgtgttaggcaa

SEQ ID NO: 7275403 - DNA, 22 bp, Homo sapiens
tagatgctgggaaggctgctgg

SEQ ID NO: 7275404 - DNA, 22 bp, Homo sapiens
tagatgctgtagaaatacttat

SEQ ID NO: 7275405 - DNA, 22 bp, Homo sapiens
tagatgctgtgggcacatggaa

SEQ ID NO: 7275406 - DNA, 22 bp, Homo sapiens
tagatgcttataaagagcatat

SEQ ID NO: 7275407 - DNA, 22 bp, Homo sapiens
tagatgcttatagggtggttaa

SEQ ID NO: 7275408 - DNA, 22 bp, Homo sapiens
tagatgctgaaacatggaggcg

SEQ ID NO: 7275409 - DNA, 22 bp, Homo sapiens
tagatgctgagcttaagagaat

SEQ ID NO: 7275410 - DNA, 20 bp, Homo sapiens
tagatgctgccataagattc

SEQ ID NO: 7275411 - DNA, 22 bp, Homo sapiens
tagatgctcgctttccccctga

SEQ ID NO: 7275412 - DNA, 22 bp, Homo sapiens
tagatgctcatgagtcagccag

SEQ ID NO: 7275413 - DNA, 22 bp, Homo sapiens
tagatgcttgtcagtttctgtc

SEQ ID NO: 7275414 - DNA, 22 bp, Homo sapiens
tagatgcttgttcagaaatagg

SEQ ID NO: 7275415 - DNA, 22 bp, Homo sapiens
tagatgcttcagaaggcctgca

SEQ ID NO: 7275416 - DNA, 22 bp, Homo sapiens
tagatgcttcatgagaaatata

SEQ ID NO: 7275417 - DNA, 22 bp, Homo sapiens
tagatgcttgcagacagaatga

SEQ ID NO: 7275418 - DNA, 22 bp, Homo sapiens
tagatgcttgctatgtatagag

SEQ ID NO: 7275419 - DNA, 22 bp, Homo sapiens
tagatgcttgggcaaaggtaga

SEQ ID NO: 7275420 - DNA, 19 bp, Homo sapiens
tagaagcactaggcaaact

SEQ ID NO: 7275421 - DNA, 22 bp, Homo sapiens
tagaagcagtaatagaaatagg

SEQ ID NO: 7275422 - DNA, 22 bp, Homo sapiens
tagaagcagcaggagtaaaggc

SEQ ID NO: 7275423 - DNA, 22 bp, Homo sapiens
taggaaatattgatttcagtca

SEQ ID NO: 7275424 - DNA, 22 bp, Homo sapiens
tagcccagaagagggaagcaac

SEQ ID NO: 7275425 - DNA, 22 bp, Homo sapiens
taggaaatgctccattgcataa

SEQ ID NO: 7275426 - DNA, 22 bp, Homo sapiens
taggaatggtgctcagcagaaa

SEQ ID NO: 7275427 - DNA, 22 bp, Homo sapiens
taggaatgggctatcccaagct

SEQ ID NO: 7275428 - DNA, 22 bp, Homo sapiens
taggaatgggcaagacaaagaa

SEQ ID NO: 7275429 - DNA, 22 bp, Homo sapiens
taggaatgaagaagtatgatat

SEQ ID NO: 7275430 - DNA, 22 bp, Homo sapiens
taggaatgatgtatttttctct

SEQ ID NO: 7275431 - DNA, 22 bp, Homo sapiens
taggctgaaaggagaggtgaag

SEQ ID NO: 7275432 - DNA, 22 bp, Homo sapiens
tagtcctgaccagctggatgtt

SEQ ID NO: 7275433 - DNA, 22 bp, Homo sapiens
tagtcctcagctgaactgctgc

SEQ ID NO: 7275434 - DNA, 22 bp, Homo sapiens
tagtcccggaactccttcaggt

SEQ ID NO: 7275435 - DNA, 22 bp, Homo sapiens
tagtgtatccagtcattcaagg

SEQ ID NO: 7275436 - DNA, 22 bp, Homo sapiens
tagtgtaatgacatttagacga

SEQ ID NO: 7275437 - DNA, 22 bp, Homo sapiens
tagtatagattgaagcagatca

SEQ ID NO: 7275438 - DNA, 22 bp, Homo sapiens
taggtttcagaggtgccgggaa

SEQ ID NO: 7275439 - DNA, 22 bp, Homo sapiens
taggtttcagaggtgccgggaa

SEQ ID NO: 7275440 - DNA, 22 bp, Homo sapiens
taggtttaggagtgaaggtgaa

SEQ ID NO: 7275441 - DNA, 22 bp, Homo sapiens
taggctggaggaagcagtgcct

SEQ ID NO: 7275442 - DNA, 22 bp, Homo sapiens
taggctggaacttaggcagagg

SEQ ID NO: 7275443 - DNA, 22 bp, Homo sapiens
taggctgagctaagagagctta

SEQ ID NO: 7275444 - DNA, 22 bp, Homo sapiens
taggctgagcttgtagatcgta

SEQ ID NO: 7275445 - DNA, 22 bp, Homo sapiens
taggctgacttgtttcataaag

SEQ ID NO: 7275446 - DNA, 22 bp, Homo sapiens
taggctgaggttgatgccaggg

SEQ ID NO: 7275447 - DNA, 18 bp, Homo sapiens
taggttacagccagccag

SEQ ID NO: 7275448 - DNA, 22 bp, Homo sapiens
tacagtttgttacattgttagt

SEQ ID NO: 7275449 - DNA, 22 bp, Homo sapiens
tacatgtatgtttatcttgaga

SEQ ID NO: 7275450 - DNA, 22 bp, Homo sapiens
tacatgtctacatgcatttttg

SEQ ID NO: 7275451 - DNA, 22 bp, Homo sapiens
tacattatttcatcagtcatct

SEQ ID NO: 7275452 - DNA, 22 bp, Homo sapiens
tactgcgccttcaccaagcggc

SEQ ID NO: 7275453 - DNA, 22 bp, Homo sapiens
tactgcatggtggagtggagct

SEQ ID NO: 7275454 - DNA, 22 bp, Homo sapiens
tactgcaaaccatttacagtag

SEQ ID NO: 7275455 - DNA, 22 bp, Homo sapiens
tactgcataactggcatgtggg

SEQ ID NO: 7275456 - DNA, 22 bp, Homo sapiens
tactgtaatgagattagcttcc

SEQ ID NO: 7275457 - DNA, 18 bp, Homo sapiens
tactggtccttttatgat

SEQ ID NO: 7275458 - DNA, 22 bp, Homo sapiens
tacctgcacagccagccatgtg

SEQ ID NO: 7275459 - DNA, 22 bp, Homo sapiens
tacctgcagcgggaatccatta

SEQ ID NO: 7275460 - DNA, 22 bp, Homo sapiens
tactaaatagtttaattcctca

SEQ ID NO: 7275461 - DNA, 22 bp, Homo sapiens
taagttttctggaataacttgg

SEQ ID NO: 7275462 - DNA, 22 bp, Homo sapiens
taagttcataagcttattctta

SEQ ID NO: 7275463 - DNA, 22 bp, Homo sapiens
taatggattaacgtccctgtcg

SEQ ID NO: 7275464 - DNA, 22 bp, Homo sapiens
tacaatttagtggtgtgtggtt

SEQ ID NO: 7275465 - DNA, 22 bp, Homo sapiens
tacaatgctgtttgtttctact

SEQ ID NO: 7275466 - DNA, 22 bp, Homo sapiens
tacaatgcattcatttttgagg

SEQ ID NO: 7275467 - DNA, 22 bp, Homo sapiens
taattttatgacagtgtatttt

SEQ ID NO: 7275468 - DNA, 22 bp, Homo sapiens
taattttaactgtgctgtttgg

SEQ ID NO: 7275469 - DNA, 22 bp, Homo sapiens
taattttaatagtatgtggcat

SEQ ID NO: 7275470 - DNA, 23 bp, Homo sapiens
gttttcaacacaataaatgtaac

SEQ ID NO: 7275471 - DNA, 22 bp, Homo sapiens
gttttataattgcttcataaga

SEQ ID NO: 7275472 - DNA, 22 bp, Homo sapiens
gttttataggctgttgctatat

SEQ ID NO: 7275473 - DNA, 22 bp, Homo sapiens
gttttataggtgaaatattact

SEQ ID NO: 7275474 - DNA, 22 bp, Homo sapiens
gttttatttccatgagagaccg

SEQ ID NO: 7275475 - DNA, 22 bp, Homo sapiens
taaagaataatacccatggagc

SEQ ID NO: 7275476 - DNA, 22 bp, Homo sapiens
taaataagttcttcattgtttg

SEQ ID NO: 7275477 - DNA, 21 bp, Homo sapiens
taaataataagttgctgagat

SEQ ID NO: 7275478 - DNA, 22 bp, Homo sapiens
taacacatatttcaagagtagt

SEQ ID NO: 7275479 - DNA, 21 bp, Homo sapiens
taacaaagacttctggtcagg

SEQ ID NO: 7275480 - DNA, 22 bp, Homo sapiens
taacaatagtgtttgctagtca

SEQ ID NO: 7275481 - DNA, 22 bp, Homo sapiens
taacttctggaaatgcatctgc

SEQ ID NO: 7275482 - DNA, 22 bp, Homo sapiens
taacttctgcacagaaaatttg

SEQ ID NO: 7275483 - DNA, 22 bp, Homo sapiens
taagaaatttagttatagaatg

SEQ ID NO: 7275484 - DNA, 22 bp, Homo sapiens
taactgtatagcttggactaaa

SEQ ID NO: 7275485 - DNA, 22 bp, Homo sapiens
gttataaaatgcacagttgttt

SEQ ID NO: 7275486 - DNA, 22 bp, Homo sapiens
gtgtgtgtatctgcctatcaca

SEQ ID NO: 7275487 - DNA, 22 bp, Homo sapiens
gtgctttaaaaataggagatga

SEQ ID NO: 7275488 - DNA, 22 bp, Homo sapiens
gtgctttactggcagtgatgta

SEQ ID NO: 7275489 - DNA, 22 bp, Homo sapiens
gtgctttccatcctccctgctg

SEQ ID NO: 7275490 - DNA, 22 bp, Homo sapiens
gtttagttgaagaaggggcagc

SEQ ID NO: 7275491 - DNA, 22 bp, Homo sapiens
gtttataaggcccaatatttct

SEQ ID NO: 7275492 - DNA, 20 bp, Homo sapiens
gtttagtgatgaatagggga

SEQ ID NO: 7275493 - DNA, 22 bp, Homo sapiens
gtttactgtcttgcacagtgca

SEQ ID NO: 7275494 - DNA, 22 bp, Homo sapiens
gttcgcatcttgatcatggact

SEQ ID NO: 7275495 - DNA, 22 bp, Homo sapiens
gttccttgtaatttgttaagga

SEQ ID NO: 7275496 - DNA, 22 bp, Homo sapiens
gttccttgtatttcagacatga

SEQ ID NO: 7275497 - DNA, 22 bp, Homo sapiens
gttccttgggaacaacgctgaa

SEQ ID NO: 7275498 - DNA, 22 bp, Homo sapiens
gttccttggaagaacttgaggt

SEQ ID NO: 7275499 - DNA, 22 bp, Homo sapiens
gtttatatgaacttcataccca

SEQ ID NO: 7275500 - DNA, 22 bp, Homo sapiens
gtttctaattggaactttgagg

SEQ ID NO: 7275501 - DNA, 22 bp, Homo sapiens
gtaaatcatggtcagaataaat

SEQ ID NO: 7275502 - DNA, 17 bp, Homo sapiens
gtaaggcttgcagatgc

SEQ ID NO: 7275503 - DNA, 22 bp, Homo sapiens
gtagctgcatattttcttagaa

SEQ ID NO: 7275504 - DNA, 22 bp, Homo sapiens
gtagctctgtttaaagttcttt

SEQ ID NO: 7275505 - DNA, 22 bp, Homo sapiens
gtagctctgtttaaagttcttt

SEQ ID NO: 7275506 - DNA, 22 bp, Homo sapiens
gtagctctgtttaaagttcttt

SEQ ID NO: 7275507 - DNA, 22 bp, Homo sapiens
gtcaaggcaacatgtagtactg

SEQ ID NO: 7275508 - DNA, 22 bp, Homo sapiens
gtagatgagctcacatgacctt

SEQ ID NO: 7275509 - DNA, 22 bp, Homo sapiens
gtagatgagctcacatgacctt

SEQ ID NO: 7275510 - DNA, 22 bp, Homo sapiens
gtagcagaatcagtgctacaga

SEQ ID NO: 7275511 - DNA, 22 bp, Homo sapiens
gtcctcagagtgggcaggtcct

SEQ ID NO: 7275512 - DNA, 22 bp, Homo sapiens
gtcagtgtgagttgattccata

SEQ ID NO: 7275513 - DNA, 22 bp, Homo sapiens
gtcagtgtgagataatcttgga

SEQ ID NO: 7275514 - DNA, 22 bp, Homo sapiens
gtcattcttaacaactcagtag

SEQ ID NO: 7275515 - DNA, 22 bp, Homo sapiens
gtcattgagtcgtcagagtctt

SEQ ID NO: 7275516 - DNA, 22 bp, Homo sapiens
gtgcctcagcaccgcctgcagc

SEQ ID NO: 7275517 - DNA, 22 bp, Homo sapiens
gtcttcttgtgttgcctgtctt

SEQ ID NO: 7275518 - DNA, 22 bp, Homo sapiens
gtcttctttaacctactaaagc

SEQ ID NO: 7275519 - DNA, 22 bp, Homo sapiens
gtcttcttgttttgaaggaaat

SEQ ID NO: 7275520 - DNA, 22 bp, Homo sapiens
gtcttcttttcagtctgcttgt

SEQ ID NO: 7275521 - DNA, 22 bp, Homo sapiens
gtgaggtcctaatagacatcga

SEQ ID NO: 7275522 - DNA, 22 bp, Homo sapiens
gtgaggtccatgttaatgggtt

SEQ ID NO: 7275523 - DNA, 22 bp, Homo sapiens
gtgaggtccagtaacttgtcca

SEQ ID NO: 7275524 - DNA, 22 bp, Homo sapiens
gtgagggaggtagatttcatca

SEQ ID NO: 7275525 - DNA, 22 bp, Homo sapiens
gtgaggtcatatagcgaactcc

SEQ ID NO: 7275526 - DNA, 22 bp, Homo sapiens
gtgaggtctttgggaggtgatt

SEQ ID NO: 7275527 - DNA, 19 bp, Homo sapiens
gtgaggtctttccttttgt

SEQ ID NO: 7275528 - DNA, 22 bp, Homo sapiens
gtgaggtcctgagaggcttgtg

SEQ ID NO: 7275529 - DNA, 22 bp, Homo sapiens
gtgaggtcctccctgctgggag

SEQ ID NO: 7275530 - DNA, 22 bp, Homo sapiens
gtgagtgttaacccactgcttc

SEQ ID NO: 7275531 - DNA, 22 bp, Homo sapiens
gtgagtctgcctagcacatcac

SEQ ID NO: 7275532 - DNA, 22 bp, Homo sapiens
gtgagtctgtggaccgggcact

SEQ ID NO: 7275533 - DNA, 22 bp, Homo sapiens
gtcttcaacaataactaccact

SEQ ID NO: 7275534 - DNA, 22 bp, Homo sapiens
gtcttcaatagagcctcaattt

SEQ ID NO: 7275535 - DNA, 22 bp, Homo sapiens
gtcttcaattgcatttgatggg

SEQ ID NO: 7275536 - DNA, 22 bp, Homo sapiens
gtctggggtgaggcccgggatt

SEQ ID NO: 7275537 - DNA, 22 bp, Homo sapiens
gtcttattgggtccaaggtggc

SEQ ID NO: 7275538 - DNA, 22 bp, Homo sapiens
ggtgaagggccttaggagacag

SEQ ID NO: 7275539 - DNA, 22 bp, Homo sapiens
ggtgaaggcacaagagggcaag

SEQ ID NO: 7275540 - DNA, 22 bp, Homo sapiens
ggtgaaggtcagagcaggaaaa

SEQ ID NO: 7275541 - DNA, 22 bp, Homo sapiens
ggtgaagggtgtcatggcattt

SEQ ID NO: 7275542 - DNA, 22 bp, Homo sapiens
ggtgaaggtggaacgcagagca

SEQ ID NO: 7275543 - DNA, 22 bp, Homo sapiens
ggtcttctggaaagcagactgt

SEQ ID NO: 7275544 - DNA, 22 bp, Homo sapiens
ggtcttcagctttgcatgtctt

SEQ ID NO: 7275545 - DNA, 22 bp, Homo sapiens
gggtccacctgagcagcagcct

SEQ ID NO: 7275546 - DNA, 19 bp, Homo sapiens
ggtcagctgggctagaggc

SEQ ID NO: 7275547 - DNA, 23 bp, Homo sapiens
gggcagttatgttgtccttggct

SEQ ID NO: 7275548 - DNA, 22 bp, Homo sapiens
gggcagtgttgtggttctctat

SEQ ID NO: 7275549 - DNA, 22 bp, Homo sapiens
gggcagttgatggaggtctgga

SEQ ID NO: 7275550 - DNA, 22 bp, Homo sapiens
gggcagtttattctagatggtt

SEQ ID NO: 7275551 - DNA, 20 bp, Homo sapiens
gggcagttcaatgccactct

SEQ ID NO: 7275552 - DNA, 20 bp, Homo sapiens
gggggccagcagcagacgcc

SEQ ID NO: 7275553 - DNA, 22 bp, Homo sapiens
gggggccagtcatctcccaaga

SEQ ID NO: 7275554 - DNA, 22 bp, Homo sapiens
gggggccatcttcaaggatgtg

SEQ ID NO: 7275555 - DNA, 22 bp, Homo sapiens
gggggccagtgtctcttccttg

SEQ ID NO: 7275556 - DNA, 22 bp, Homo sapiens
ggggcagctcccgagggcagga

SEQ ID NO: 7275557 - DNA, 18 bp, Homo sapiens
ggcactggtgatgcagag

SEQ ID NO: 7275558 - DNA, 16 bp, Homo sapiens
ggcagcagctccgtgc

SEQ ID NO: 7275559 - DNA, 22 bp, Homo sapiens
ggcagcagcaaggttggagctg

SEQ ID NO: 7275560 - DNA, 22 bp, Homo sapiens
ggcagcaggagccatctggtag

SEQ ID NO: 7275561 - DNA, 22 bp, Homo sapiens
ggcagaaggttgaagtaatttg

SEQ ID NO: 7275562 - DNA, 21 bp, Homo sapiens
ggcagaagtagcatggacggg

SEQ ID NO: 7275563 - DNA, 22 bp, Homo sapiens
ggcagcagacccctaagtctac

SEQ ID NO: 7275564 - DNA, 22 bp, Homo sapiens
ggcagaaggcaattagagactg

SEQ ID NO: 7275565 - DNA, 19 bp, Homo sapiens
ggcagaaggtgtaggggga

SEQ ID NO: 7275566 - DNA, 22 bp, Homo sapiens
ggcagaagacaggcaaatcatg

SEQ ID NO: 7275567 - DNA, 22 bp, Homo sapiens
ggcagccatgctccaggtgcag

SEQ ID NO: 7275568 - DNA, 22 bp, Homo sapiens
ggcagccatgcacgctgcctgg

SEQ ID NO: 7275569 - DNA, 22 bp, Homo sapiens
ggcagcagtccatggcccaagg

SEQ ID NO: 7275570 - DNA, 22 bp, Homo sapiens
ggcagccaggagggtgtagttt

SEQ ID NO: 7275571 - DNA, 22 bp, Homo sapiens
ggcagcaggcgacttccctatt

SEQ ID NO: 7275572 - DNA, 20 bp, Homo sapiens
ggcagcaggagtttcctctt

SEQ ID NO: 7275573 - DNA, 22 bp, Homo sapiens
ggcagcagggctgtctccctac

SEQ ID NO: 7275574 - DNA, 22 bp, Homo sapiens
ggcagcagggtctagattgatg

SEQ ID NO: 7275575 - DNA, 22 bp, Homo sapiens
ggcagcagggtagccatttctc

SEQ ID NO: 7275576 - DNA, 22 bp, Homo sapiens
ggcagcagtaggagctaatctt

SEQ ID NO: 7275577 - DNA, 22 bp, Homo sapiens
ggcagcagggtctagattgatg

SEQ ID NO: 7275578 - DNA, 22 bp, Homo sapiens
ggcagctttctcacccatgacc

SEQ ID NO: 7275579 - DNA, 22 bp, Homo sapiens
ggcagctttcaatagggttatg

SEQ ID NO: 7275580 - DNA, 20 bp, Homo sapiens
ggcagcttgggcagcagtta

SEQ ID NO: 7275581 - DNA, 22 bp, Homo sapiens
ggcagcttgtcctggaggatgg

SEQ ID NO: 7275582 - DNA, 22 bp, Homo sapiens
ggcagcttgtccttcaggagag

SEQ ID NO: 7275583 - DNA, 22 bp, Homo sapiens
ggcagcttcctgagccagcagc

SEQ ID NO: 7275584 - DNA, 22 bp, Homo sapiens
ggcagcttcctaggagagggca

SEQ ID NO: 7275585 - DNA, 19 bp, Homo sapiens
ggcagcttgggaaggtagc

SEQ ID NO: 7275586 - DNA, 22 bp, Homo sapiens
ggcagcttcttaatatggagac

SEQ ID NO: 7275587 - DNA, 18 bp, Homo sapiens
ggcagcttgactagcaac

SEQ ID NO: 7275588 - DNA, 22 bp, Homo sapiens
ggcagcttctcccaggctgttt

SEQ ID NO: 7275589 - DNA, 22 bp, Homo sapiens
ggcagctgtttgtcctcctgtt

SEQ ID NO: 7275590 - DNA, 22 bp, Homo sapiens
ggcagctgttggctctctagga

SEQ ID NO: 7275591 - DNA, 17 bp, Homo sapiens
ggcagctgtgtgcatgc

SEQ ID NO: 7275592 - DNA, 22 bp, Homo sapiens
ggagcagagcatttcacagcct

SEQ ID NO: 7275593 - DNA, 22 bp, Homo sapiens
ggagttggtggcccggaatctc

SEQ ID NO: 7275594 - DNA, 22 bp, Homo sapiens
ggatgacacagttagaaagaga

SEQ ID NO: 7275595 - DNA, 22 bp, Homo sapiens
ggatgacagctcttccatgtgg

SEQ ID NO: 7275596 - DNA, 22 bp, Homo sapiens
ggatgacagcaagggggtgaag

SEQ ID NO: 7275597 - DNA, 22 bp, Homo sapiens
ggagaggcttccagagtcgtgc

SEQ ID NO: 7275598 - DNA, 22 bp, Homo sapiens
ggatggagatgaccatggtgac

SEQ ID NO: 7275599 - DNA, 22 bp, Homo sapiens
ggatggcagacagtgagtggct

SEQ ID NO: 7275600 - DNA, 22 bp, Homo sapiens
ggatggcagtctgcatgagaaa

SEQ ID NO: 7275601 - DNA, 22 bp, Homo sapiens
ggatggcatgttgggctctgtt

SEQ ID NO: 7275602 - DNA, 22 bp, Homo sapiens
ggattctactgatcagcaccac

SEQ ID NO: 7275603 - DNA, 22 bp, Homo sapiens
ggcctgctgtgtactgatgtca

SEQ ID NO: 7275604 - DNA, 22 bp, Homo sapiens
ggcctgctccgggggctgagct

SEQ ID NO: 7275605 - DNA, 21 bp, Homo sapiens
ggccctggttacgcctcctct

SEQ ID NO: 7275606 - DNA, 22 bp, Homo sapiens
ggcctcacccatcggtgccttt

SEQ ID NO: 7275607 - DNA, 22 bp, Homo sapiens
ggccaggaagggaagatcagca

SEQ ID NO: 7275608 - DNA, 22 bp, Homo sapiens
ggccaggagaggagggcactga

SEQ ID NO: 7275609 - DNA, 22 bp, Homo sapiens
ggccaggagctgcacagggctc

SEQ ID NO: 7275610 - DNA, 22 bp, Homo sapiens
ggcatgagtggcagtgggcagt

SEQ ID NO: 7275611 - DNA, 22 bp, Homo sapiens
ggcatgagtggcagtgggcagt

SEQ ID NO: 7275612 - DNA, 22 bp, Homo sapiens
ggcatgcaaaacaactcagaga

SEQ ID NO: 7275613 - DNA, 22 bp, Homo sapiens
ggcatgctctttgtccacagta

SEQ ID NO: 7275614 - DNA, 22 bp, Homo sapiens
ggcatgctgcgtacagatgaac

SEQ ID NO: 7275615 - DNA, 22 bp, Homo sapiens
ggccagctttgagctgcaggaa

SEQ ID NO: 7275616 - DNA, 22 bp, Homo sapiens
ggccaggaagggaagatcagca

SEQ ID NO: 7275617 - DNA, 21 bp, Homo sapiens
ggcatgagggcagtgagcaga

SEQ ID NO: 7275618 - DNA, 20 bp, Homo sapiens
ggcatgagatgtgagggagg

SEQ ID NO: 7275619 - DNA, 22 bp, Homo sapiens
ggcatgagaggtcctggggatt

SEQ ID NO: 7275620 - DNA, 22 bp, Homo sapiens
ggcatgagaggtcctggggatt

SEQ ID NO: 7275621 - DNA, 22 bp, Homo sapiens
ggcatcttgttgctcaaatcta

SEQ ID NO: 7275622 - DNA, 18 bp, Homo sapiens
ggcatctgcacagcagcc

SEQ ID NO: 7275623 - DNA, 22 bp, Homo sapiens
ggcatctccaaaacatgaactc

SEQ ID NO: 7275624 - DNA, 22 bp, Homo sapiens
ggcatcgtcctgggcataggga

SEQ ID NO: 7275625 - DNA, 22 bp, Homo sapiens
ggcagtgggttccccaaggcac

SEQ ID NO: 7275626 - DNA, 22 bp, Homo sapiens
ggcaggagctcaggttggttcc

SEQ ID NO: 7275627 - DNA, 22 bp, Homo sapiens
ggcaggggtgaggccactctga

SEQ ID NO: 7275628 - DNA, 22 bp, Homo sapiens
ggctggtggggaaagaggacca

SEQ ID NO: 7275629 - DNA, 22 bp, Homo sapiens
ggctgggtacagggcagtgtgc

SEQ ID NO: 7275630 - DNA, 19 bp, Homo sapiens
ggctgggtctggcaggttc

SEQ ID NO: 7275631 - DNA, 22 bp, Homo sapiens
ggctggagaagggtggttgaca

SEQ ID NO: 7275632 - DNA, 18 bp, Homo sapiens
ggctgaggttgactagaa

SEQ ID NO: 7275633 - DNA, 22 bp, Homo sapiens
ggctgagtggctgggtctagtt

SEQ ID NO: 7275634 - DNA, 22 bp, Homo sapiens
ggctgagggttaagatcagaca

SEQ ID NO: 7275635 - DNA, 22 bp, Homo sapiens
ggctgagggtcccagaccctaa

SEQ ID NO: 7275636 - DNA, 22 bp, Homo sapiens
ggctgagggttaagatcagaca

SEQ ID NO: 7275637 - DNA, 22 bp, Homo sapiens
ggctgaggtgtggggaactata

SEQ ID NO: 7275638 - DNA, 22 bp, Homo sapiens
ggctgagggtatagctgtccca

SEQ ID NO: 7275639 - DNA, 22 bp, Homo sapiens
ggctgaggggcccagaggaaca

SEQ ID NO: 7275640 - DNA, 22 bp, Homo sapiens
ggctgagggccagggctagtct

SEQ ID NO: 7275641 - DNA, 22 bp, Homo sapiens
ggctgctgtttcagagactgtt

SEQ ID NO: 7275642 - DNA, 20 bp, Homo sapiens
ggctgctgtgggcagagagg

SEQ ID NO: 7275643 - DNA, 22 bp, Homo sapiens
ggctgctggggacgtgggagag

SEQ ID NO: 7275644 - DNA, 22 bp, Homo sapiens
ggctgctggggacgtgggagag

SEQ ID NO: 7275645 - DNA, 21 bp, Homo sapiens
ggctgctgggggttggcacag

SEQ ID NO: 7275646 - DNA, 22 bp, Homo sapiens
ggctgctgggtcatgatgcaga

SEQ ID NO: 7275647 - DNA, 22 bp, Homo sapiens
ggctgagttctcttgctgaatc

SEQ ID NO: 7275648 - DNA, 22 bp, Homo sapiens
ggctgagccatgggcactgcag

SEQ ID NO: 7275649 - DNA, 22 bp, Homo sapiens
ggctgagccactgcgcctggct

SEQ ID NO: 7275650 - DNA, 22 bp, Homo sapiens
ggctaggcaggctcagagccta

SEQ ID NO: 7275651 - DNA, 23 bp, Homo sapiens
ggctagagtggaggggaactgca

SEQ ID NO: 7275652 - DNA, 22 bp, Homo sapiens
ggctagagtggaactggagcgg

SEQ ID NO: 7275653 - DNA, 22 bp, Homo sapiens
ggctagagtggaactggagcgg

SEQ ID NO: 7275654 - DNA, 22 bp, Homo sapiens
ggcggtggttgagaggacggcg

SEQ ID NO: 7275655 - DNA, 22 bp, Homo sapiens
ggctccaggctcctatttcact

SEQ ID NO: 7275656 - DNA, 22 bp, Homo sapiens
ggctaggcgggcacatggtgga

SEQ ID NO: 7275657 - DNA, 22 bp, Homo sapiens
ggctttatagggtagaggatca

SEQ ID NO: 7275658 - DNA, 22 bp, Homo sapiens
ggctttatgcagggatagaaat

SEQ ID NO: 7275659 - DNA, 22 bp, Homo sapiens
ggctttattttgcatgaatgct

SEQ ID NO: 7275660 - DNA, 22 bp, Homo sapiens
gggaggtgattaggaccatgta

SEQ ID NO: 7275661 - DNA, 22 bp, Homo sapiens
gggaggtgatggcaagcagcgg

SEQ ID NO: 7275662 - DNA, 23 bp, Homo sapiens
gggcaccaggagcaccggacagg

SEQ ID NO: 7275663 - DNA, 22 bp, Homo sapiens
gggcaccagcggccgcactgcc

SEQ ID NO: 7275664 - DNA, 22 bp, Homo sapiens
gggcagtgacaaaggggatgaa

SEQ ID NO: 7275665 - DNA, 22 bp, Homo sapiens
gggcagtgattttccttagagg

SEQ ID NO: 7275666 - DNA, 19 bp, Homo sapiens
gggcagtggcactagggag

SEQ ID NO: 7275667 - DNA, 22 bp, Homo sapiens
gggcagtgttgctctcaaagtc

SEQ ID NO: 7275668 - DNA, 22 bp, Homo sapiens
gggcagtgttgctctcaaagtc

SEQ ID NO: 7275669 - DNA, 22 bp, Homo sapiens
gggcagtgaatattggtgggaa

SEQ ID NO: 7275670 - DNA, 22 bp, Homo sapiens
gcctggcttcccttggagcatt

SEQ ID NO: 7275671 - DNA, 22 bp, Homo sapiens
gcctggcttcccttggagcatt

SEQ ID NO: 7275672 - DNA, 21 bp, Homo sapiens
gcctggcttcacaggcactga

SEQ ID NO: 7275673 - DNA, 22 bp, Homo sapiens
gcctggcttgccagccctggcg

SEQ ID NO: 7275674 - DNA, 22 bp, Homo sapiens
gcctggcttttgcctcatgttc

SEQ ID NO: 7275675 - DNA, 22 bp, Homo sapiens
gcctggctgtctggcaaggttc

SEQ ID NO: 7275676 - DNA, 22 bp, Homo sapiens
gcctggctgtctggcaaggttc

SEQ ID NO: 7275677 - DNA, 22 bp, Homo sapiens
gcctggctggtcactgcctggc

SEQ ID NO: 7275678 - DNA, 22 bp, Homo sapiens
gcctggctggtagagggggctc

SEQ ID NO: 7275679 - DNA, 22 bp, Homo sapiens
gcctggctgggctgaatgctta

SEQ ID NO: 7275680 - DNA, 19 bp, Homo sapiens
gcctggctgggatgagccc

SEQ ID NO: 7275681 - DNA, 22 bp, Homo sapiens
gcctggctgctcagccactcac

SEQ ID NO: 7275682 - DNA, 22 bp, Homo sapiens
gcctggctagttagtgtcaggt

SEQ ID NO: 7275683 - DNA, 22 bp, Homo sapiens
gcctggctaattttggtatttt

SEQ ID NO: 7275684 - DNA, 22 bp, Homo sapiens
gcctggctacccactgaaatat

SEQ ID NO: 7275685 - DNA, 22 bp, Homo sapiens
gcctcaggcctatagctgctgt

SEQ ID NO: 7275686 - DNA, 22 bp, Homo sapiens
gctcaagagagatgcagttctt

SEQ ID NO: 7275687 - DNA, 22 bp, Homo sapiens
gctcaagacccctctgtgactg

SEQ ID NO: 7275688 - DNA, 22 bp, Homo sapiens
gctcaagactgttagcctggca

SEQ ID NO: 7275689 - DNA, 20 bp, Homo sapiens
gctcaagagcccattctgaa

SEQ ID NO: 7275690 - DNA, 22 bp, Homo sapiens
gctcaagagccagcgtctcctg

SEQ ID NO: 7275691 - DNA, 22 bp, Homo sapiens
gctcaagatgtggcctctgaag

SEQ ID NO: 7275692 - DNA, 22 bp, Homo sapiens
gctcaagaccagacaaagcctg

SEQ ID NO: 7275693 - DNA, 22 bp, Homo sapiens
gctcaagaccaagggagcgggg

SEQ ID NO: 7275694 - DNA, 22 bp, Homo sapiens
gctcaaatttcagactcatgaa

SEQ ID NO: 7275695 - DNA, 22 bp, Homo sapiens
gccttgatctgctgtgtttgag

SEQ ID NO: 7275696 - DNA, 22 bp, Homo sapiens
gcggagggcgagcccgcggagc

SEQ ID NO: 7275697 - DNA, 22 bp, Homo sapiens
gcggcggagacagcaggaagcc

SEQ ID NO: 7275698 - DNA, 22 bp, Homo sapiens
gctgatggcttgctggctgaca

SEQ ID NO: 7275699 - DNA, 22 bp, Homo sapiens
gctgaagggagtgctgagtctg

SEQ ID NO: 7275700 - DNA, 22 bp, Homo sapiens
gctgaagctgcagcaggaggaa

SEQ ID NO: 7275701 - DNA, 22 bp, Homo sapiens
gctgaagctgacacatagtgct

SEQ ID NO: 7275702 - DNA, 22 bp, Homo sapiens
gctgcagactgggaggcaggtg

SEQ ID NO: 7275703 - DNA, 18 bp, Homo sapiens
gctcaggccctagtcagt

SEQ ID NO: 7275704 - DNA, 17 bp, Homo sapiens
gctctgccccagcctct

SEQ ID NO: 7275705 - DNA, 17 bp, Homo sapiens
gctctgcctctcccacc

SEQ ID NO: 7275706 - DNA, 22 bp, Homo sapiens
gctctgctctaacattcctgac

SEQ ID NO: 7275707 - DNA, 22 bp, Homo sapiens
gctgaagagcaaggctgggtct

SEQ ID NO: 7275708 - DNA, 22 bp, Homo sapiens
gctggtagacctcactgcactc

SEQ ID NO: 7275709 - DNA, 22 bp, Homo sapiens
gctggtagacctcactgcactc

SEQ ID NO: 7275710 - DNA, 22 bp, Homo sapiens
gctgggaagtgcaagatcaagg

SEQ ID NO: 7275711 - DNA, 22 bp, Homo sapiens
gctgggacggctcagtaagaag

SEQ ID NO: 7275712 - DNA, 22 bp, Homo sapiens
gctggctgcacaggggctcact

SEQ ID NO: 7275713 - DNA, 21 bp, Homo sapiens
gctgcccaaccctgcatctcc

SEQ ID NO: 7275714 - DNA, 22 bp, Homo sapiens
gctgccatggcctcctgcaagg

SEQ ID NO: 7275715 - DNA, 22 bp, Homo sapiens
gctgccatgccacagcactcac

SEQ ID NO: 7275716 - DNA, 22 bp, Homo sapiens
gctggattggagcaatagagtc

SEQ ID NO: 7275717 - DNA, 22 bp, Homo sapiens
gctggcagagacaagaagacta

SEQ ID NO: 7275718 - DNA, 22 bp, Homo sapiens
gctggcagccaagtgaagaggg

SEQ ID NO: 7275719 - DNA, 22 bp, Homo sapiens
gcttcccacagctggactgggg

SEQ ID NO: 7275720 - DNA, 22 bp, Homo sapiens
gcttcccagcagaggaaagact

SEQ ID NO: 7275721 - DNA, 22 bp, Homo sapiens
gcttcctagcattagccattgc

SEQ ID NO: 7275722 - DNA, 21 bp, Homo sapiens
ggaagcagtggcggcaactcc

SEQ ID NO: 7275723 - DNA, 22 bp, Homo sapiens
ggaagcaggaggctggggtaaa

SEQ ID NO: 7275724 - DNA, 22 bp, Homo sapiens
ggaaggaagtaaatgatgctat

SEQ ID NO: 7275725 - DNA, 22 bp, Homo sapiens
ggaaggaaattggggcagttgt

SEQ ID NO: 7275726 - DNA, 22 bp, Homo sapiens
ggagagcttggagtgcgatttt

SEQ ID NO: 7275727 - DNA, 22 bp, Homo sapiens
ggagaggaaatgccagcacttc

SEQ ID NO: 7275728 - DNA, 22 bp, Homo sapiens
ggagaggacatggctcccacag

SEQ ID NO: 7275729 - DNA, 22 bp, Homo sapiens
ggagaggagattgtggcatttt

SEQ ID NO: 7275730 - DNA, 22 bp, Homo sapiens
ggagaggagctattgggggctc

SEQ ID NO: 7275731 - DNA, 22 bp, Homo sapiens
ggagaggatgttttagtaactt

SEQ ID NO: 7275732 - DNA, 19 bp, Homo sapiens
ggagaggctggagggatgc

SEQ ID NO: 7275733 - DNA, 22 bp, Homo sapiens
ggactctcaggctgtcggcttc

SEQ ID NO: 7275734 - DNA, 22 bp, Homo sapiens
ggacctggcaatttgcatctct

SEQ ID NO: 7275735 - DNA, 22 bp, Homo sapiens
ggactgaggcccacttgaggga

SEQ ID NO: 7275736 - DNA, 22 bp, Homo sapiens
ggactgaggacatgtgaggcat

SEQ ID NO: 7275737 - DNA, 22 bp, Homo sapiens
ggacagagcagacgagcagcgg

SEQ ID NO: 7275738 - DNA, 22 bp, Homo sapiens
gccaggagaaaaggcgaatgat

SEQ ID NO: 7275739 - DNA, 22 bp, Homo sapiens
gccaggaatttcaagagccact

SEQ ID NO: 7275740 - DNA, 22 bp, Homo sapiens
gccaggaggctgctgtgtaggc

SEQ ID NO: 7275741 - DNA, 22 bp, Homo sapiens
gccaggagccctgggcaagttc

SEQ ID NO: 7275742 - DNA, 22 bp, Homo sapiens
gccaggagccagcttcttagca

SEQ ID NO: 7275743 - DNA, 22 bp, Homo sapiens
gccaggagcatgtcattgttga

SEQ ID NO: 7275744 - DNA, 22 bp, Homo sapiens
gccaggagagctccttcaggtt

SEQ ID NO: 7275745 - DNA, 22 bp, Homo sapiens
gccaggagaatgctagcagagg

SEQ ID NO: 7275746 - DNA, 22 bp, Homo sapiens
gccaggagactccattcatttg

SEQ ID NO: 7275747 - DNA, 22 bp, Homo sapiens
gccaggtggtctggctccagag

SEQ ID NO: 7275748 - DNA, 22 bp, Homo sapiens
gccaggagttcagatgcatgtt

SEQ ID NO: 7275749 - DNA, 22 bp, Homo sapiens
gcccactggctggagtgctggt

SEQ ID NO: 7275750 - DNA, 22 bp, Homo sapiens
gccaggttgctgacgacgatct

SEQ ID NO: 7275751 - DNA, 22 bp, Homo sapiens
gccaggttgctgacgacgatct

SEQ ID NO: 7275752 - DNA, 22 bp, Homo sapiens
gcccacaggtcctacctctttc

SEQ ID NO: 7275753 - DNA, 22 bp, Homo sapiens
gccctgagcctatgagcctctc

SEQ ID NO: 7275754 - DNA, 22 bp, Homo sapiens
gccctgaggcaaaagaacagtc

SEQ ID NO: 7275755 - DNA, 22 bp, Homo sapiens
gcccagggctgcaagtggacgc

SEQ ID NO: 7275756 - DNA, 22 bp, Homo sapiens
gcccagggcagggcaagagtga

SEQ ID NO: 7275757 - DNA, 22 bp, Homo sapiens
gcccagggcttcaaagagagaa

SEQ ID NO: 7275758 - DNA, 22 bp, Homo sapiens
gcccatggacacccaagtgcca

SEQ ID NO: 7275759 - DNA, 22 bp, Homo sapiens
gcatgagactagctcatgagca

SEQ ID NO: 7275760 - DNA, 22 bp, Homo sapiens
gcatgacattcctaatcacagt

SEQ ID NO: 7275761 - DNA, 23 bp, Homo sapiens
gcatgaagtgctacgtctacagc

SEQ ID NO: 7275762 - DNA, 22 bp, Homo sapiens
gcatctaatccagtccagcatc

SEQ ID NO: 7275763 - DNA, 22 bp, Homo sapiens
gcatctaaataaacgtgggagt

SEQ ID NO: 7275764 - DNA, 22 bp, Homo sapiens
gcatctaaacttgcatcattgt

SEQ ID NO: 7275765 - DNA, 17 bp, Homo sapiens
gcagtatgatcctctgg

SEQ ID NO: 7275766 - DNA, 22 bp, Homo sapiens
gccagagagagtccctgggcct

SEQ ID NO: 7275767 - DNA, 22 bp, Homo sapiens
gccagagagactgatacatgct

SEQ ID NO: 7275768 - DNA, 22 bp, Homo sapiens
gccagagaggcaaatcctagca

SEQ ID NO: 7275769 - DNA, 22 bp, Homo sapiens
gccagcagtatgtcctggcagt

SEQ ID NO: 7275770 - DNA, 22 bp, Homo sapiens
gccagcagtccagtccttagtg

SEQ ID NO: 7275771 - DNA, 22 bp, Homo sapiens
gccagcagtcctgctgtgtgcc

SEQ ID NO: 7275772 - DNA, 22 bp, Homo sapiens
gccagccccagacatcctatcg

SEQ ID NO: 7275773 - DNA, 22 bp, Homo sapiens
gccagaggcccaaggacagctg

SEQ ID NO: 7275774 - DNA, 22 bp, Homo sapiens
gccagcagggcggagccatcta

SEQ ID NO: 7275775 - DNA, 22 bp, Homo sapiens
gccagcaggtggagagatcaag

SEQ ID NO: 7275776 - DNA, 22 bp, Homo sapiens
gcaggctgatgactggagttgg

SEQ ID NO: 7275777 - DNA, 22 bp, Homo sapiens
gcaggctgatagaggattccat

SEQ ID NO: 7275778 - DNA, 22 bp, Homo sapiens
gcaggctgaaactcggggtcta

SEQ ID NO: 7275779 - DNA, 22 bp, Homo sapiens
gcaggctgagagtccaagaagg

SEQ ID NO: 7275780 - DNA, 22 bp, Homo sapiens
gcaggctgagtattaccctagt

SEQ ID NO: 7275781 - DNA, 22 bp, Homo sapiens
gcaggctgagttgggaaaccaa

SEQ ID NO: 7275782 - DNA, 22 bp, Homo sapiens
gcagctggccctgacacgcaga

SEQ ID NO: 7275783 - DNA, 22 bp, Homo sapiens
gcaggagctggaaagtgatgtt

SEQ ID NO: 7275784 - DNA, 22 bp, Homo sapiens
gcagcaggatggccaattgcca

SEQ ID NO: 7275785 - DNA, 22 bp, Homo sapiens
gcagcaggaataggataagcaa

SEQ ID NO: 7275786 - DNA, 22 bp, Homo sapiens
gcagcagctcagttctgggagg

SEQ ID NO: 7275787 - DNA, 22 bp, Homo sapiens
gcagcagctccctatccaggct

SEQ ID NO: 7275788 - DNA, 22 bp, Homo sapiens
gcagcagcggggcccctgcgcg

SEQ ID NO: 7275789 - DNA, 23 bp, Homo sapiens
gcagaggagcaagctggacacca

SEQ ID NO: 7275790 - DNA, 22 bp, Homo sapiens
gcagaggagcaagttgctacag

SEQ ID NO: 7275791 - DNA, 22 bp, Homo sapiens
gcagctgcagagaccgggtggg

SEQ ID NO: 7275792 - DNA, 22 bp, Homo sapiens
gcagctgcagaccctcagtgct

SEQ ID NO: 7275793 - DNA, 22 bp, Homo sapiens
gcagctgcagaccctcagtgct

SEQ ID NO: 7275794 - DNA, 22 bp, Homo sapiens
gcagctgcaataggcatcaagc

SEQ ID NO: 7275795 - DNA, 22 bp, Homo sapiens
gcagctgccgtgagctcacgcc

SEQ ID NO: 7275796 - DNA, 22 bp, Homo sapiens
gcagctgccccgactgtgagtc

SEQ ID NO: 7275797 - DNA, 22 bp, Homo sapiens
gcagctgccccgactgtgagtc

SEQ ID NO: 7275798 - DNA, 22 bp, Homo sapiens
gcagcatcaggttcactgcgtg

SEQ ID NO: 7275799 - DNA, 22 bp, Homo sapiens
gcagcatctagggcactggcct

SEQ ID NO: 7275800 - DNA, 21 bp, Homo sapiens
gcagcatgagaaagccccaaa

SEQ ID NO: 7275801 - DNA, 22 bp, Homo sapiens
gcactgggaatgagggcagctt

SEQ ID NO: 7275802 - DNA, 22 bp, Homo sapiens
gcactgcctgtgagccctggtt

SEQ ID NO: 7275803 - DNA, 22 bp, Homo sapiens
gcacaggccatgggaggacagc

SEQ ID NO: 7275804 - DNA, 22 bp, Homo sapiens
gcactctgtttctcctgtcagc

SEQ ID NO: 7275805 - DNA, 22 bp, Homo sapiens
gcactctgtttctcctgtcagc

SEQ ID NO: 7275806 - DNA, 22 bp, Homo sapiens
gcagaggagatgaagatacttt

SEQ ID NO: 7275807 - DNA, 22 bp, Homo sapiens
gcagaggacacaggagggcaag

SEQ ID NO: 7275808 - DNA, 22 bp, Homo sapiens
gcagaggacagggatttagatt

SEQ ID NO: 7275809 - DNA, 22 bp, Homo sapiens
gcagaggagcaagctggacacc

SEQ ID NO: 7275810 - DNA, 23 bp, Homo sapiens
gcagaggagcaagctggacacca

SEQ ID NO: 7275811 - DNA, 22 bp, Homo sapiens
gcaagcagactgggcccctgtg

SEQ ID NO: 7275812 - DNA, 22 bp, Homo sapiens
gcacaggatgatgggttgaggg

SEQ ID NO: 7275813 - DNA, 22 bp, Homo sapiens
gaggcagcttggggctgtgggt

SEQ ID NO: 7275814 - DNA, 22 bp, Homo sapiens
gaggcagcttagggtactgact

SEQ ID NO: 7275815 - DNA, 22 bp, Homo sapiens
gaggcagcttagggtactgact

SEQ ID NO: 7275816 - DNA, 22 bp, Homo sapiens
gaggcaggcactgttatcagca

SEQ ID NO: 7275817 - DNA, 22 bp, Homo sapiens
gaggagaggccatcgttgttat

SEQ ID NO: 7275818 - DNA, 22 bp, Homo sapiens
gaggagagcctgcactttgacc

SEQ ID NO: 7275819 - DNA, 22 bp, Homo sapiens
gaggagagatggtagattgggt

SEQ ID NO: 7275820 - DNA, 22 bp, Homo sapiens
gaggagaggggctcccaagagc

SEQ ID NO: 7275821 - DNA, 22 bp, Homo sapiens
gaggagagggctgcgggcccac

SEQ ID NO: 7275822 - DNA, 22 bp, Homo sapiens
gaggagaggctggacgcggtga

SEQ ID NO: 7275823 - DNA, 22 bp, Homo sapiens
gaggagaggctggacgcggtga

SEQ ID NO: 7275824 - DNA, 22 bp, Homo sapiens
gaggagcacatgaggctgaggg

SEQ ID NO: 7275825 - DNA, 22 bp, Homo sapiens
gaggagcatgggaaggctctgg

SEQ ID NO: 7275826 - DNA, 22 bp, Homo sapiens
gaggctgaagtgtacatgggtg

SEQ ID NO: 7275827 - DNA, 22 bp, Homo sapiens
gaggctgaagtgtacatgggtg

SEQ ID NO: 7275828 - DNA, 20 bp, Homo sapiens
gaggctgaagtgtttttgct

SEQ ID NO: 7275829 - DNA, 22 bp, Homo sapiens
gaggctgaatggccagaagcca

SEQ ID NO: 7275830 - DNA, 22 bp, Homo sapiens
gaggctgagactctgaattttt

SEQ ID NO: 7275831 - DNA, 22 bp, Homo sapiens
gaggctgacggcaccatcttct

SEQ ID NO: 7275832 - DNA, 22 bp, Homo sapiens
gaggctgagagtttgttctact

SEQ ID NO: 7275833 - DNA, 22 bp, Homo sapiens
gaggctgaacaggttctcatga

SEQ ID NO: 7275834 - DNA, 22 bp, Homo sapiens
gaggcatctgggcacagaagtg

SEQ ID NO: 7275835 - DNA, 22 bp, Homo sapiens
gaggcagtttgccatgccagga

SEQ ID NO: 7275836 - DNA, 22 bp, Homo sapiens
gaggcagttcctgagtgacaag

SEQ ID NO: 7275837 - DNA, 22 bp, Homo sapiens
gaggcagtgtcggtggcaggat

SEQ ID NO: 7275838 - DNA, 22 bp, Homo sapiens
gaggcagtgtttactgccctgt

SEQ ID NO: 7275839 - DNA, 22 bp, Homo sapiens
gaggcagtgtcggtggcaggat

SEQ ID NO: 7275840 - DNA, 22 bp, Homo sapiens
gaggcagtgttgaaaaggagag

SEQ ID NO: 7275841 - DNA, 22 bp, Homo sapiens
gaggcagtatagtcattaagta

SEQ ID NO: 7275842 - DNA, 22 bp, Homo sapiens
gaggcagtgcattgtctagggg

SEQ ID NO: 7275843 - DNA, 22 bp, Homo sapiens
gaggcagtaattgtgggcaata

SEQ ID NO: 7275844 - DNA, 19 bp, Homo sapiens
gaggcagtagtcaaagctt

SEQ ID NO: 7275845 - DNA, 22 bp, Homo sapiens
gaggctgaggttgcagtgagct

SEQ ID NO: 7275846 - DNA, 22 bp, Homo sapiens
gaggctgagtagctttgtgctc

SEQ ID NO: 7275847 - DNA, 22 bp, Homo sapiens
gaggctgatgctgcctcacaga

SEQ ID NO: 7275848 - DNA, 22 bp, Homo sapiens
gaggctgattcggggaacagca

SEQ ID NO: 7275849 - DNA, 22 bp, Homo sapiens
gaggctgcccaactggagtgga

SEQ ID NO: 7275850 - DNA, 22 bp, Homo sapiens
gaggctgaggttgcagtgagcc

SEQ ID NO: 7275851 - DNA, 22 bp, Homo sapiens
gaggctgaggttgcagtgagcc

SEQ ID NO: 7275852 - DNA, 22 bp, Homo sapiens
gaggctgaggttgcagtgagct

SEQ ID NO: 7275853 - DNA, 22 bp, Homo sapiens
gaggctgaggcaggaggatcac

SEQ ID NO: 7275854 - DNA, 22 bp, Homo sapiens
gaggctgaggcggatggatcac

SEQ ID NO: 7275855 - DNA, 22 bp, Homo sapiens
gaggctgagggttagagagtca

SEQ ID NO: 7275856 - DNA, 22 bp, Homo sapiens
gaggctgaggcggatggatcac

SEQ ID NO: 7275857 - DNA, 22 bp, Homo sapiens
gagggagggactagcattctct

SEQ ID NO: 7275858 - DNA, 22 bp, Homo sapiens
gagggagggccaggtcccaacc

SEQ ID NO: 7275859 - DNA, 22 bp, Homo sapiens
gagggaggggagctccaccctc

SEQ ID NO: 7275860 - DNA, 22 bp, Homo sapiens
gagggagggaaagtttaacact

SEQ ID NO: 7275861 - DNA, 22 bp, Homo sapiens
gagggaggcatcatgaatccag

SEQ ID NO: 7275862 - DNA, 22 bp, Homo sapiens
gaggggaaagtgtgaggctgcg

SEQ ID NO: 7275863 - DNA, 22 bp, Homo sapiens
gagggaggtgatactgaacgta

SEQ ID NO: 7275864 - DNA, 22 bp, Homo sapiens
gagggagtctgtgcaaagaatt

SEQ ID NO: 7275865 - DNA, 22 bp, Homo sapiens
gagccctgacactgagggagtt

SEQ ID NO: 7275866 - DNA, 22 bp, Homo sapiens
gagccctgaacaacagcaggaa

SEQ ID NO: 7275867 - DNA, 20 bp, Homo sapiens
gagcagtggagtttccaggg

SEQ ID NO: 7275868 - DNA, 22 bp, Homo sapiens
gagaggggcccaagccacatag

SEQ ID NO: 7275869 - DNA, 22 bp, Homo sapiens
gagctgcttccagagttgagtg

SEQ ID NO: 7275870 - DNA, 22 bp, Homo sapiens
gaggagagatggtagattgggt

SEQ ID NO: 7275871 - DNA, 23 bp, Homo sapiens
gagctgagtgtagggagactagg

SEQ ID NO: 7275872 - DNA, 22 bp, Homo sapiens
gagctgagggtctaggagggtt

SEQ ID NO: 7275873 - DNA, 22 bp, Homo sapiens
gagctgagtatcccactgaagt

SEQ ID NO: 7275874 - DNA, 22 bp, Homo sapiens
gagctgaggctgaggcctcact

SEQ ID NO: 7275875 - DNA, 22 bp, Homo sapiens
gagctgaggctcaggctggcgt

SEQ ID NO: 7275876 - DNA, 22 bp, Homo sapiens
gagctgagatttgaagcaagtt

SEQ ID NO: 7275877 - DNA, 22 bp, Homo sapiens
gagctgagcagggagcctcact

SEQ ID NO: 7275878 - DNA, 22 bp, Homo sapiens
gagctgagcttaactccttgaa

SEQ ID NO: 7275879 - DNA, 22 bp, Homo sapiens
gagccctgtagcaagtcatgtc

SEQ ID NO: 7275880 - DNA, 22 bp, Homo sapiens
gacactttaggatttaaaagtc

SEQ ID NO: 7275881 - DNA, 22 bp, Homo sapiens
gaatgaattttggatggtgaag

SEQ ID NO: 7275882 - DNA, 22 bp, Homo sapiens
gaatgaatctgtaagtgacaag

SEQ ID NO: 7275883 - DNA, 22 bp, Homo sapiens
gaatgaaagatttgcattctat

SEQ ID NO: 7275884 - DNA, 18 bp, Homo sapiens
gaagggagctggaatgca

SEQ ID NO: 7275885 - DNA, 22 bp, Homo sapiens
gaaggggactggcagctgcaga

SEQ ID NO: 7275886 - DNA, 22 bp, Homo sapiens
gaagcagctttctggtgaggag

SEQ ID NO: 7275887 - DNA, 20 bp, Homo sapiens
gaagcagcttcatgtagaca

SEQ ID NO: 7275888 - DNA, 22 bp, Homo sapiens
gaagcagctggtgagatggagc

SEQ ID NO: 7275889 - DNA, 22 bp, Homo sapiens
gaagcagctgccagagatgtct

SEQ ID NO: 7275890 - DNA, 22 bp, Homo sapiens
gaagcagcgaagtggaagggac

SEQ ID NO: 7275891 - DNA, 22 bp, Homo sapiens
gaagcagccacggggagacaga

SEQ ID NO: 7275892 - DNA, 22 bp, Homo sapiens
gaagggagaaggttgggtgacg

SEQ ID NO: 7275893 - DNA, 22 bp, Homo sapiens
gaagggagaaggttgggtgacg

SEQ ID NO: 7275894 - DNA, 22 bp, Homo sapiens
gaaggcagggaatgtggtgcta

SEQ ID NO: 7275895 - DNA, 22 bp, Homo sapiens
gaaggagctaccaagactgaat

SEQ ID NO: 7275896 - DNA, 22 bp, Homo sapiens
gacagaggagaagatgctgtgg

SEQ ID NO: 7275897 - DNA, 22 bp, Homo sapiens
gacagcagaaaacttttgtgct

SEQ ID NO: 7275898 - DNA, 22 bp, Homo sapiens
gacagcagacaaaccatgtttt

SEQ ID NO: 7275899 - DNA, 22 bp, Homo sapiens
gaccaggaaagagtgtgactaa

SEQ ID NO: 7275900 - DNA, 22 bp, Homo sapiens
gactctattcctggggccatag

SEQ ID NO: 7275901 - DNA, 22 bp, Homo sapiens
gactgagggatagaggtgcttc

SEQ ID NO: 7275902 - DNA, 22 bp, Homo sapiens
gactgaggctcccctaggctca

SEQ ID NO: 7275903 - DNA, 22 bp, Homo sapiens
gactgagggacagggcagtgga

SEQ ID NO: 7275904 - DNA, 17 bp, Homo sapiens
gactgaggtaaggtgag

SEQ ID NO: 7275905 - DNA, 22 bp, Homo sapiens
gactgaggaggtaaggtttgaa

SEQ ID NO: 7275906 - DNA, 18 bp, Homo sapiens
gagagggatccctcagga

SEQ ID NO: 7275907 - DNA, 22 bp, Homo sapiens
gagagaaatgtgcagtttgggc

SEQ ID NO: 7275908 - DNA, 22 bp, Homo sapiens
gagactttttaatcactaggaa

SEQ ID NO: 7275909 - DNA, 22 bp, Homo sapiens
gactgaggtgacctaggactac

SEQ ID NO: 7275910 - DNA, 22 bp, Homo sapiens
gactgaggtgcccagaggtgac

SEQ ID NO: 7275911 - DNA, 22 bp, Homo sapiens
gagaaaggcatccttggcttca

SEQ ID NO: 7275912 - DNA, 22 bp, Homo sapiens
gagacagatgctgctggagcat

SEQ ID NO: 7275913 - DNA, 22 bp, Homo sapiens
gagacattttaaagagccatgc

SEQ ID NO: 7275914 - DNA, 23 bp, Homo sapiens
gagaaagccggctatgatcctgg

SEQ ID NO: 7275915 - DNA, 22 bp, Homo sapiens
gagaaagctaaataagttgatt

SEQ ID NO: 7275916 - DNA, 22 bp, Homo sapiens
ctttgcaaacgattaccacatg

SEQ ID NO: 7275917 - DNA, 22 bp, Homo sapiens
ctttgcaaactgtcacactttc

SEQ ID NO: 7275918 - DNA, 22 bp, Homo sapiens
ctttgcaatagaggcacacatg

SEQ ID NO: 7275919 - DNA, 22 bp, Homo sapiens
cttttccactgagcctcacaaa

SEQ ID NO: 7275920 - DNA, 22 bp, Homo sapiens
cttttacagtggacctgccatt

SEQ ID NO: 7275921 - DNA, 22 bp, Homo sapiens
gaaacaatcatcatgtgatttg

SEQ ID NO: 7275922 - DNA, 22 bp, Homo sapiens
cttctgaatggctgtgtatgct

SEQ ID NO: 7275923 - DNA, 19 bp, Homo sapiens
cttctggccctgagccacc

SEQ ID NO: 7275924 - DNA, 22 bp, Homo sapiens
ctttacaaagcaattttgtctc

SEQ ID NO: 7275925 - DNA, 23 bp, Homo sapiens
ctttaatgaaattctctgtgaag

SEQ ID NO: 7275926 - DNA, 22 bp, Homo sapiens
ctttaaataatacaaggtccag

SEQ ID NO: 7275927 - DNA, 22 bp, Homo sapiens
ctttaacagttccattcaattt

SEQ ID NO: 7275928 - DNA, 22 bp, Homo sapiens
cttcagtgttgccagggcctag

SEQ ID NO: 7275929 - DNA, 22 bp, Homo sapiens
cttcagttagtttcatgtgagc

SEQ ID NO: 7275930 - DNA, 22 bp, Homo sapiens
cttctcaaagttgtgaatcagg

SEQ ID NO: 7275931 - DNA, 22 bp, Homo sapiens
cttctagagctggagcaaatgt

SEQ ID NO: 7275932 - DNA, 23 bp, Homo sapiens
cttctagagtcagctccaagttt

SEQ ID NO: 7275933 - DNA, 17 bp, Homo sapiens
cttctagaaggcaaact

SEQ ID NO: 7275934 - DNA, 22 bp, Homo sapiens
cttccaagttgctctgctgacc

SEQ ID NO: 7275935 - DNA, 22 bp, Homo sapiens
cttccagaggaactctgcagtg

SEQ ID NO: 7275936 - DNA, 22 bp, Homo sapiens
cttccagagatccatgaatacc

SEQ ID NO: 7275937 - DNA, 22 bp, Homo sapiens
ctgtggaaggcctgtcctgaaa

SEQ ID NO: 7275938 - DNA, 21 bp, Homo sapiens
ctgtggaagggaactagaggg

SEQ ID NO: 7275939 - DNA, 21 bp, Homo sapiens
ctgtttcttgtgaagtgacac

SEQ ID NO: 7275940 - DNA, 22 bp, Homo sapiens
ctgtggaaataaacaatgctaa

SEQ ID NO: 7275941 - DNA, 22 bp, Homo sapiens
ctgtggaaaatttgtatgtaat

SEQ ID NO: 7275942 - DNA, 22 bp, Homo sapiens
cttaaaatctggcagttagcta

SEQ ID NO: 7275943 - DNA, 22 bp, Homo sapiens
cttaatgtggacctggtttcta

SEQ ID NO: 7275944 - DNA, 22 bp, Homo sapiens
cttagaaatgcagattctcagg

SEQ ID NO: 7275945 - DNA, 22 bp, Homo sapiens
cttagaaataatggtttcagtt

SEQ ID NO: 7275946 - DNA, 22 bp, Homo sapiens
ctgtcaaattcataacacttat

SEQ ID NO: 7275947 - DNA, 22 bp, Homo sapiens
ctgtctctgttgcctgtaggtg

SEQ ID NO: 7275948 - DNA, 22 bp, Homo sapiens
ctgtctggatataccttggcca

SEQ ID NO: 7275949 - DNA, 22 bp, Homo sapiens
ctggggaacaatttgccacact

SEQ ID NO: 7275950 - DNA, 22 bp, Homo sapiens
ctgggctttgaagccaggctgc

SEQ ID NO: 7275951 - DNA, 20 bp, Homo sapiens
ctggggagcctcgcggtggc

SEQ ID NO: 7275952 - DNA, 18 bp, Homo sapiens
ctggtctcccttcgcttt

SEQ ID NO: 7275953 - DNA, 22 bp, Homo sapiens
ctgtaaaacactgtagtatctg

SEQ ID NO: 7275954 - DNA, 22 bp, Homo sapiens
ctgtacaaaagaaagttcctat

SEQ ID NO: 7275955 - DNA, 22 bp, Homo sapiens
ctggtgcaggaaggagctggca

SEQ ID NO: 7275956 - DNA, 22 bp, Homo sapiens
ctgggagcgcagcaggcacaac

SEQ ID NO: 7275957 - DNA, 22 bp, Homo sapiens
ctgggcagagctaacacctgag

SEQ ID NO: 7275958 - DNA, 22 bp, Homo sapiens
ctgggcagctaccaccactgct

SEQ ID NO: 7275959 - DNA, 22 bp, Homo sapiens
ctgggcagctccataccaccca

SEQ ID NO: 7275960 - DNA, 19 bp, Homo sapiens
ctgggactcctgatacctt

SEQ ID NO: 7275961 - DNA, 22 bp, Homo sapiens
ctgcttcaccctgcctgagaac

SEQ ID NO: 7275962 - DNA, 22 bp, Homo sapiens
ctgcttcacgttgtgccttgtt

SEQ ID NO: 7275963 - DNA, 22 bp, Homo sapiens
ctgcttcagcaaagctatttgc

SEQ ID NO: 7275964 - DNA, 22 bp, Homo sapiens
ctgcttcacttcggttgcatag

SEQ ID NO: 7275965 - DNA, 19 bp, Homo sapiens
ctgcttcaggcgccttgcc

SEQ ID NO: 7275966 - DNA, 22 bp, Homo sapiens
ctgcttcatatttcatagtgat

SEQ ID NO: 7275967 - DNA, 22 bp, Homo sapiens
ctgcttcacccaactttgggat

SEQ ID NO: 7275968 - DNA, 23 bp, Homo sapiens
ctccccagtgtcctcatgcatct

SEQ ID NO: 7275969 - DNA, 22 bp, Homo sapiens
ctccccaggttcaggaggtggg

SEQ ID NO: 7275970 - DNA, 22 bp, Homo sapiens
ctccccagcattctgacttcct

SEQ ID NO: 7275971 - DNA, 22 bp, Homo sapiens
ctcccagtgttgttttctgatg

SEQ ID NO: 7275972 - DNA, 22 bp, Homo sapiens
ctcccaggggaactatcaagta

SEQ ID NO: 7275973 - DNA, 22 bp, Homo sapiens
ctcaggctgccctgacagcccc

SEQ ID NO: 7275974 - DNA, 22 bp, Homo sapiens
ctccctgcttgtttcccttcag

SEQ ID NO: 7275975 - DNA, 22 bp, Homo sapiens
ctccctcacacccttgcccaga

SEQ ID NO: 7275976 - DNA, 18 bp, Homo sapiens
tttatatggatagagacc

SEQ ID NO: 7275977 - DNA, 22 bp, Homo sapiens
tttcaaagttgggaattgtaat

SEQ ID NO: 7275978 - DNA, 22 bp, Homo sapiens
ctcgtgatccgcccacctcagc

SEQ ID NO: 7275979 - DNA, 22 bp, Homo sapiens
ctccttctcctcgggaggccag

SEQ ID NO: 7275980 - DNA, 22 bp, Homo sapiens
ctcctgtcagaagcatcctgag

SEQ ID NO: 7275981 - DNA, 22 bp, Homo sapiens
tttatattacctggaatagctt

SEQ ID NO: 7275982 - DNA, 22 bp, Homo sapiens
tttcaaagtcaatatcattacc

SEQ ID NO: 7275983 - DNA, 22 bp, Homo sapiens
ctctgctggcagcccccgggcc

SEQ ID NO: 7275984 - DNA, 22 bp, Homo sapiens
ctctgctgcccatgatggtata

SEQ ID NO: 7275985 - DNA, 19 bp, Homo sapiens
ctctgcctctggctgtggc

SEQ ID NO: 7275986 - DNA, 22 bp, Homo sapiens
ctctgcttcatccaccactggc

SEQ ID NO: 7275987 - DNA, 22 bp, Homo sapiens
ctctgctgttttgtatacaggc

SEQ ID NO: 7275988 - DNA, 19 bp, Homo sapiens
ctctgcttggtccatatgc

SEQ ID NO: 7275989 - DNA, 22 bp, Homo sapiens
ctctgcttgtatcacatttgct

SEQ ID NO: 7275990 - DNA, 21 bp, Homo sapiens
ctctgctgtctaccagctgtt

SEQ ID NO: 7275991 - DNA, 22 bp, Homo sapiens
ctctgctggtgaccactgggcc

SEQ ID NO: 7275992 - DNA, 22 bp, Homo sapiens
ctctgctgtgccgccagggcct

SEQ ID NO: 7275993 - DNA, 22 bp, Homo sapiens
tttgaataaacggttaatgttc

SEQ ID NO: 7275994 - DNA, 23 bp, Homo sapiens
tttgaagttgactgccttccaga

SEQ ID NO: 7275995 - DNA, 22 bp, Homo sapiens
tttctgcagcagactcagtgtg

SEQ ID NO: 7275996 - DNA, 22 bp, Homo sapiens
tttctgcatatgtatgtatgga

SEQ ID NO: 7275997 - DNA, 22 bp, Homo sapiens
tttctgatatactgtagaatcc

SEQ ID NO: 7275998 - DNA, 22 bp, Homo sapiens
ctctgagctgaaacatgagcat

SEQ ID NO: 7275999 - DNA, 20 bp, Homo sapiens
ctctcacagctccctcagcc

SEQ ID NO: 7276000 - DNA, 22 bp, Homo sapiens
ctctcaaatgtcattcctctat

SEQ ID NO: 7276001 - DNA, 22 bp, Homo sapiens
ctgcatcacagcaggaggcaca

SEQ ID NO: 7276002 - DNA, 22 bp, Homo sapiens
ctgcagtgcctgccactgagcc

SEQ ID NO: 7276003 - DNA, 23 bp, Homo sapiens
ctgagggctggtctgaagtctgc

SEQ ID NO: 7276004 - DNA, 22 bp, Homo sapiens
ctgagggctggagctgaggcct

SEQ ID NO: 7276005 - DNA, 22 bp, Homo sapiens
ctgagggccttggctcctgccc

SEQ ID NO: 7276006 - DNA, 22 bp, Homo sapiens
ctgagggccttctatgctgagc

SEQ ID NO: 7276007 - DNA, 21 bp, Homo sapiens
ctgagggccgcagctgggctc

SEQ ID NO: 7276008 - DNA, 21 bp, Homo sapiens
ctgcaggtgctgccatcaggg

SEQ ID NO: 7276009 - DNA, 22 bp, Homo sapiens
ctgcaggttaggagcactcctt

SEQ ID NO: 7276010 - DNA, 20 bp, Homo sapiens
ctgccctgccctgggtcctg

SEQ ID NO: 7276011 - DNA, 22 bp, Homo sapiens
ctgctctaatatcagatagact

SEQ ID NO: 7276012 - DNA, 22 bp, Homo sapiens
ctgctctagagagcattagtca

SEQ ID NO: 7276013 - DNA, 22 bp, Homo sapiens
ctgctcggcgcgcatggctgcc

SEQ ID NO: 7276014 - DNA, 22 bp, Homo sapiens
ctgctctaactgcattagtttt

SEQ ID NO: 7276015 - DNA, 19 bp, Homo sapiens
ctgctctccttgacttgga

SEQ ID NO: 7276016 - DNA, 22 bp, Homo sapiens
ctgctgcttttgcgggagaaca

SEQ ID NO: 7276017 - DNA, 22 bp, Homo sapiens
ctgctgcttagcatagcagagg

SEQ ID NO: 7276018 - DNA, 22 bp, Homo sapiens
ctgctggaagtttgctgtggat

SEQ ID NO: 7276019 - DNA, 20 bp, Homo sapiens
ctgctccacccggctctcag

SEQ ID NO: 7276020 - DNA, 22 bp, Homo sapiens
ctgctccacctccgggtcaggc

SEQ ID NO: 7276021 - DNA, 22 bp, Homo sapiens
ctgctccacacctccatttcct

SEQ ID NO: 7276022 - DNA, 22 bp, Homo sapiens
ctgctccacaccgtccatactc

SEQ ID NO: 7276023 - DNA, 22 bp, Homo sapiens
ctgctcctccccatcaggcagc

SEQ ID NO: 7276024 - DNA, 22 bp, Homo sapiens
ctgcggtgggctgggctgtccc

SEQ ID NO: 7276025 - DNA, 22 bp, Homo sapiens
ctgcctgccttggcctccagga

SEQ ID NO: 7276026 - DNA, 22 bp, Homo sapiens
ctgcctgccacgttcagctgta

SEQ ID NO: 7276027 - DNA, 22 bp, Homo sapiens
ctgcctgcatcccacagtgggg

SEQ ID NO: 7276028 - DNA, 22 bp, Homo sapiens
ctgcctgcatgctgccatagct

SEQ ID NO: 7276029 - DNA, 22 bp, Homo sapiens
ctgcctgcactgcctggctcca

SEQ ID NO: 7276030 - DNA, 22 bp, Homo sapiens
ctgcctcttgacagatcgtggc

SEQ ID NO: 7276031 - DNA, 22 bp, Homo sapiens
ctgcctcttgacagatcgtggc

SEQ ID NO: 7276032 - DNA, 22 bp, Homo sapiens
ctgaaactccatgagaaattgc

SEQ ID NO: 7276033 - DNA, 22 bp, Homo sapiens
tttttcttgtgctggatctaat

SEQ ID NO: 7276034 - DNA, 22 bp, Homo sapiens
tttttcttaaatgtgggttggc

SEQ ID NO: 7276035 - DNA, 22 bp, Homo sapiens
ctgaagtcatacactgttctga

SEQ ID NO: 7276036 - DNA, 19 bp, Homo sapiens
ctgaagtcttttcagctgg

SEQ ID NO: 7276037 - DNA, 22 bp, Homo sapiens
ctgaagttattgtacaaatttg

SEQ ID NO: 7276038 - DNA, 22 bp, Homo sapiens
ctgaagtcagatggcacaaggt

SEQ ID NO: 7276039 - DNA, 22 bp, Homo sapiens
ttttctcaggtgcttatctaag

SEQ ID NO: 7276040 - DNA, 22 bp, Homo sapiens
ttttcagtttgcactgcagtgc

SEQ ID NO: 7276041 - DNA, 22 bp, Homo sapiens
tttttctgagaatatgagagga

SEQ ID NO: 7276042 - DNA, 22 bp, Homo sapiens
ctgagcttccagttcctccagg

SEQ ID NO: 7276043 - DNA, 22 bp, Homo sapiens
ctgagctgttactctgtcctcg

SEQ ID NO: 7276044 - DNA, 22 bp, Homo sapiens
ctgagctgtttaatcccagata

SEQ ID NO: 7276045 - DNA, 22 bp, Homo sapiens
ctgaggaagacagcagctgtgt

SEQ ID NO: 7276046 - DNA, 22 bp, Homo sapiens
ctgaggacattgatgaggcaat

SEQ ID NO: 7276047 - DNA, 22 bp, Homo sapiens
ctgagggcagtgatgaaggtga

SEQ ID NO: 7276048 - DNA, 22 bp, Homo sapiens
ctgagggccctgaagcttggca

SEQ ID NO: 7276049 - DNA, 22 bp, Homo sapiens
ctgagggcaccgacagagtgga

SEQ ID NO: 7276050 - DNA, 18 bp, Homo sapiens
ctgagggcaacagaggct

SEQ ID NO: 7276051 - DNA, 18 bp, Homo sapiens
ctgaggctggcaggagcc

SEQ ID NO: 7276052 - DNA, 22 bp, Homo sapiens
ctgaggctgggcatggggtcca

SEQ ID NO: 7276053 - DNA, 22 bp, Homo sapiens
ctgagcgcgggacctgaggctg

SEQ ID NO: 7276054 - DNA, 22 bp, Homo sapiens
ctgagatcccaggcagggtggc

SEQ ID NO: 7276055 - DNA, 22 bp, Homo sapiens
ctgagatctttatacgaggcac

SEQ ID NO: 7276056 - DNA, 22 bp, Homo sapiens
ctgagatggccactgggtctca

SEQ ID NO: 7276057 - DNA, 22 bp, Homo sapiens
ctgagatggagttttgctcttg

SEQ ID NO: 7276058 - DNA, 22 bp, Homo sapiens
ctgagatggagtttcgctcttc

SEQ ID NO: 7276059 - DNA, 20 bp, Homo sapiens
ctgagagtctgtgcttagtc

SEQ ID NO: 7276060 - DNA, 22 bp, Homo sapiens
ctgagagtattggcaggcttgg

SEQ ID NO: 7276061 - DNA, 22 bp, Homo sapiens
ctgaagttcatacaatggccat

SEQ ID NO: 7276062 - DNA, 22 bp, Homo sapiens
ctgaagttctacaagcctcagg

SEQ ID NO: 7276063 - DNA, 22 bp, Homo sapiens
ctgagagatgatatagcttaat

SEQ ID NO: 7276064 - DNA, 22 bp, Homo sapiens
cggctggtgtcgggcacagcaa

SEQ ID NO: 7276065 - DNA, 22 bp, Homo sapiens
ttccacggggctccccgctctt

SEQ ID NO: 7276066 - DNA, 19 bp, Homo sapiens
ttccaccatcactctgttt

SEQ ID NO: 7276067 - DNA, 20 bp, Homo sapiens
cgcagcagtggaagtggaat

SEQ ID NO: 7276068 - DNA, 22 bp, Homo sapiens
cgcagcagccccgtggtaggtg

SEQ ID NO: 7276069 - DNA, 22 bp, Homo sapiens
ttcagtttctaaatgctcctct

SEQ ID NO: 7276070 - DNA, 22 bp, Homo sapiens
ttcagtttcgttatctatgaga

SEQ ID NO: 7276071 - DNA, 22 bp, Homo sapiens
ttccagaaatctttcagctcaa

SEQ ID NO: 7276072 - DNA, 22 bp, Homo sapiens
ctagttctagatccctgaggaa

SEQ ID NO: 7276073 - DNA, 22 bp, Homo sapiens
ctagtgtgtctatgtctgttcc

SEQ ID NO: 7276074 - DNA, 22 bp, Homo sapiens
ttctccttgaaaagctgcatct

SEQ ID NO: 7276075 - DNA, 22 bp, Homo sapiens
ttctatttttgtggaactgtag

SEQ ID NO: 7276076 - DNA, 22 bp, Homo sapiens
ttgaagttgtagttcagtgaag

SEQ ID NO: 7276077 - DNA, 19 bp, Homo sapiens
ttgaatatgcaaactgaag

SEQ ID NO: 7276078 - DNA, 22 bp, Homo sapiens
ttcttcatgctgttgctgcttg

SEQ ID NO: 7276079 - DNA, 22 bp, Homo sapiens
ttcttcagtgcccctctagtag

SEQ ID NO: 7276080 - DNA, 22 bp, Homo sapiens
ttcttcagtgtagcaactgtat

SEQ ID NO: 7276081 - DNA, 21 bp, Homo sapiens
ttcttcagtttaatataaaat

SEQ ID NO: 7276082 - DNA, 22 bp, Homo sapiens
ttcttcagtttggtaaatgtaa

SEQ ID NO: 7276083 - DNA, 22 bp, Homo sapiens
ttgaaatatcaagttattagtg

SEQ ID NO: 7276084 - DNA, 22 bp, Homo sapiens
ttgaaatatcaagttattagtg

SEQ ID NO: 7276085 - DNA, 22 bp, Homo sapiens
ttctcttttgtgatgtgagatg

SEQ ID NO: 7276086 - DNA, 22 bp, Homo sapiens
ttctgaaagccaattcattgaa

SEQ ID NO: 7276087 - DNA, 22 bp, Homo sapiens
ttctgaaccattgagcactgcc

SEQ ID NO: 7276088 - DNA, 22 bp, Homo sapiens
ttcttaactcaaatatatatcc

SEQ ID NO: 7276089 - DNA, 22 bp, Homo sapiens
ttcttaactggaaaatgtcaga

SEQ ID NO: 7276090 - DNA, 23 bp, Homo sapiens
ttcttacaaggctggcccacttg

SEQ ID NO: 7276091 - DNA, 22 bp, Homo sapiens
ttcttcaggatacgtcatccag

SEQ ID NO: 7276092 - DNA, 22 bp, Homo sapiens
ttcttcagtcccactagccaca

SEQ ID NO: 7276093 - DNA, 22 bp, Homo sapiens
ttcttcagtcccactagccaca

SEQ ID NO: 7276094 - DNA, 22 bp, Homo sapiens
ttcttcagtctaggcctttctt

SEQ ID NO: 7276095 - DNA, 22 bp, Homo sapiens
ttcttcagggaagcttgttaat

SEQ ID NO: 7276096 - DNA, 23 bp, Homo sapiens
ttgcacattggagctggtcttct

SEQ ID NO: 7276097 - DNA, 22 bp, Homo sapiens
ttgcactaggaaaaggcagcca

SEQ ID NO: 7276098 - DNA, 22 bp, Homo sapiens
ttgctggcttgaagatagagga

SEQ ID NO: 7276099 - DNA, 22 bp, Homo sapiens
ctcagaaagcaatctggtgagg

SEQ ID NO: 7276100 - DNA, 22 bp, Homo sapiens
ttgatttttttctactatgcgc

SEQ ID NO: 7276101 - DNA, 23 bp, Homo sapiens
cctggggagctgtatccagagtg

SEQ ID NO: 7276102 - DNA, 22 bp, Homo sapiens
tgttttcctcctggtttctgcc

SEQ ID NO: 7276103 - DNA, 21 bp, Homo sapiens
tgttttccaccttgaggcaag

SEQ ID NO: 7276104 - DNA, 22 bp, Homo sapiens
tgtttctgggtgtgtctcacct

SEQ ID NO: 7276105 - DNA, 22 bp, Homo sapiens
tgtttcttctcacacaaactca

SEQ ID NO: 7276106 - DNA, 19 bp, Homo sapiens
tgtttcttcctccatctga

SEQ ID NO: 7276107 - DNA, 22 bp, Homo sapiens
tgttgcctggggaagctctgat

SEQ ID NO: 7276108 - DNA, 20 bp, Homo sapiens
tgttgattggtgtcatctca

SEQ ID NO: 7276109 - DNA, 22 bp, Homo sapiens
tgttgattagtgtttagactta

SEQ ID NO: 7276110 - DNA, 22 bp, Homo sapiens
tgttcccaagataagattatga

SEQ ID NO: 7276111 - DNA, 22 bp, Homo sapiens
tgttgattagtgtttagactta

SEQ ID NO: 7276112 - DNA, 22 bp, Homo sapiens
tggttccaagatggctgccaca

SEQ ID NO: 7276113 - DNA, 22 bp, Homo sapiens
tggttccaatcgcactggctca

SEQ ID NO: 7276114 - DNA, 22 bp, Homo sapiens
tggttcctacgcacattgaatt

SEQ ID NO: 7276115 - DNA, 22 bp, Homo sapiens
tggttccactaacctgagagcc

SEQ ID NO: 7276116 - DNA, 22 bp, Homo sapiens
cctgcgtccacggctgggagac

SEQ ID NO: 7276117 - DNA, 22 bp, Homo sapiens
cctgccttcccagcttggcttt

SEQ ID NO: 7276118 - DNA, 23 bp, Homo sapiens
cctgctcaggcgtgtgccctgct

SEQ ID NO: 7276119 - DNA, 22 bp, Homo sapiens
cctgctcagccccagctcaccc

SEQ ID NO: 7276120 - DNA, 22 bp, Homo sapiens
cctgctcagagcgtcttgtgtg

SEQ ID NO: 7276121 - DNA, 22 bp, Homo sapiens
ttaaaatagccagtgcccctct

SEQ ID NO: 7276122 - DNA, 22 bp, Homo sapiens
cctgtcacgatgactgcactct

SEQ ID NO: 7276123 - DNA, 22 bp, Homo sapiens
cctgtatggctattccttggac

SEQ ID NO: 7276124 - DNA, 22 bp, Homo sapiens
ttaatgaaacattgactatgat

SEQ ID NO: 7276125 - DNA, 22 bp, Homo sapiens
ttaatgaatatgacaggagagg

SEQ ID NO: 7276126 - DNA, 22 bp, Homo sapiens
ttacaatctgattgtctcatct

SEQ ID NO: 7276127 - DNA, 22 bp, Homo sapiens
cctgtggctgccacttgggtga

SEQ ID NO: 7276128 - DNA, 22 bp, Homo sapiens
cgatgacagtgagttccttctt

SEQ ID NO: 7276129 - DNA, 22 bp, Homo sapiens
cgagtccagggttaggagtccg

SEQ ID NO: 7276130 - DNA, 22 bp, Homo sapiens
ttatgtactctgcaatgtttga

SEQ ID NO: 7276131 - DNA, 22 bp, Homo sapiens
ttatgtatgaatatagtagaag

SEQ ID NO: 7276132 - DNA, 22 bp, Homo sapiens
ttatgtacctgaattagtaaag

SEQ ID NO: 7276133 - DNA, 22 bp, Homo sapiens
ttatttttaaaagttcacacag

SEQ ID NO: 7276134 - DNA, 17 bp, Homo sapiens
ttattttttgggctgag

SEQ ID NO: 7276135 - DNA, 19 bp, Homo sapiens
cgcagagggcttctgagag

SEQ ID NO: 7276136 - DNA, 22 bp, Homo sapiens
cgcagagggcaggcagtgctgg

SEQ ID NO: 7276137 - DNA, 22 bp, Homo sapiens
cgcagagggagccgcgggctgc

SEQ ID NO: 7276138 - DNA, 22 bp, Homo sapiens
ttatttcattgatttctaagac

SEQ ID NO: 7276139 - DNA, 22 bp, Homo sapiens
ttatttcattgatttctaagac

SEQ ID NO: 7276140 - DNA, 22 bp, Homo sapiens
ttattcacctctattagactca

SEQ ID NO: 7276141 - DNA, 22 bp, Homo sapiens
ttattcactcatttaacattat

SEQ ID NO: 7276142 - DNA, 22 bp, Homo sapiens
ttattcagattggctacaggat

SEQ ID NO: 7276143 - DNA, 22 bp, Homo sapiens
ttattattttgtgtacagcaaa

SEQ ID NO: 7276144 - DNA, 22 bp, Homo sapiens
ttattcaccagtgtaaaacact

SEQ ID NO: 7276145 - DNA, 22 bp, Homo sapiens
ttattcacatgggctcattcta

SEQ ID NO: 7276146 - DNA, 22 bp, Homo sapiens
ttatctacgtatttaaactctt

SEQ ID NO: 7276147 - DNA, 22 bp, Homo sapiens
ttatcctggattatatatgtga

SEQ ID NO: 7276148 - DNA, 22 bp, Homo sapiens
cctttaatttacaatgttaatt

SEQ ID NO: 7276149 - DNA, 18 bp, Homo sapiens
ccttctgacgcttgagaa

SEQ ID NO: 7276150 - DNA, 22 bp, Homo sapiens
ccttctgagcttcaatttcagt

SEQ ID NO: 7276151 - DNA, 22 bp, Homo sapiens
ccttctgagtgtggacccctgt

SEQ ID NO: 7276152 - DNA, 22 bp, Homo sapiens
ccttctgataactgtgaaattg

SEQ ID NO: 7276153 - DNA, 22 bp, Homo sapiens
ccttctgatactgacatcattt

SEQ ID NO: 7276154 - DNA, 22 bp, Homo sapiens
ccttcttctgtgtggcccaaga

SEQ ID NO: 7276155 - DNA, 22 bp, Homo sapiens
ttacctaaaatagctcaattta

SEQ ID NO: 7276156 - DNA, 22 bp, Homo sapiens
ccaggagcagatatggacataa

SEQ ID NO: 7276157 - DNA, 22 bp, Homo sapiens
tctgttcctggtctctggagct

SEQ ID NO: 7276158 - DNA, 22 bp, Homo sapiens
tctgttccatgttttgttccat

SEQ ID NO: 7276159 - DNA, 22 bp, Homo sapiens
ccagcaccttgatcttggagtt

SEQ ID NO: 7276160 - DNA, 22 bp, Homo sapiens
ccaggagagcagaagcccaggc

SEQ ID NO: 7276161 - DNA, 22 bp, Homo sapiens
ccaggagagcaaaggtcactct

SEQ ID NO: 7276162 - DNA, 22 bp, Homo sapiens
tctggggagtcaaagagacctg

SEQ ID NO: 7276163 - DNA, 22 bp, Homo sapiens
tctggggaccatggcatctaaa

SEQ ID NO: 7276164 - DNA, 22 bp, Homo sapiens
tctggggagggagccacaggtc

SEQ ID NO: 7276165 - DNA, 22 bp, Homo sapiens
ccaggcagcaaattttctgaat

SEQ ID NO: 7276166 - DNA, 22 bp, Homo sapiens
ccaggcagagtgctccagaaag

SEQ ID NO: 7276167 - DNA, 22 bp, Homo sapiens
ccaggcagaatgaaacccctgt

SEQ ID NO: 7276168 - DNA, 19 bp, Homo sapiens
tcttctgacttcaagaaac

SEQ ID NO: 7276169 - DNA, 22 bp, Homo sapiens
tcttctgaaggtaggaagcatt

SEQ ID NO: 7276170 - DNA, 22 bp, Homo sapiens
tcttctgatgccagtaaccatg

SEQ ID NO: 7276171 - DNA, 22 bp, Homo sapiens
ccaggcagcctgctccattctg

SEQ ID NO: 7276172 - DNA, 22 bp, Homo sapiens
ccaggcaggcagcgttctcagg

SEQ ID NO: 7276173 - DNA, 22 bp, Homo sapiens
ccaggcctgattgggaatcttg

SEQ ID NO: 7276174 - DNA, 21 bp, Homo sapiens
ccaggctggccatggtattga

SEQ ID NO: 7276175 - DNA, 22 bp, Homo sapiens
ccaggctgtgcttttcataaat

SEQ ID NO: 7276176 - DNA, 22 bp, Homo sapiens
ccaggctgtaagagtgatgttg

SEQ ID NO: 7276177 - DNA, 22 bp, Homo sapiens
ccaggctgtaagagtgatgttg

SEQ ID NO: 7276178 - DNA, 22 bp, Homo sapiens
ccaggctgtggtttagatagag

SEQ ID NO: 7276179 - DNA, 22 bp, Homo sapiens
ccaggctgtggtttagatagag

SEQ ID NO: 7276180 - DNA, 22 bp, Homo sapiens
ccaggctgttttcaaacttggg

SEQ ID NO: 7276181 - DNA, 22 bp, Homo sapiens
ccagggctgccgcatccctggt

SEQ ID NO: 7276182 - DNA, 22 bp, Homo sapiens
ccagggcaacgctgtctcagag

SEQ ID NO: 7276183 - DNA, 22 bp, Homo sapiens
ccagggagtttccaatctgaga

SEQ ID NO: 7276184 - DNA, 22 bp, Homo sapiens
tgagcagtaggtctgaatagtg

SEQ ID NO: 7276185 - DNA, 22 bp, Homo sapiens
tgagcagtcagacaagcatcac

SEQ ID NO: 7276186 - DNA, 17 bp, Homo sapiens
tgagcagtagaagatgc

SEQ ID NO: 7276187 - DNA, 22 bp, Homo sapiens
tgagcaggtgagtctagggcag

SEQ ID NO: 7276188 - DNA, 21 bp, Homo sapiens
ccagtgctacagctgcctgac

SEQ ID NO: 7276189 - DNA, 22 bp, Homo sapiens
ccagtgctaaggtagcctctgc

SEQ ID NO: 7276190 - DNA, 22 bp, Homo sapiens
tgagccatgggactccaaggga

SEQ ID NO: 7276191 - DNA, 22 bp, Homo sapiens
tgagccatgggactccaaggga

SEQ ID NO: 7276192 - DNA, 22 bp, Homo sapiens
tgagtttagtgtgagacttatc

SEQ ID NO: 7276193 - DNA, 22 bp, Homo sapiens
ccatccctgggccatgtcccct

SEQ ID NO: 7276194 - DNA, 22 bp, Homo sapiens
tgaggtcatggctgatatttcc

SEQ ID NO: 7276195 - DNA, 22 bp, Homo sapiens
tgaggtcctgcatgttgaggtc

SEQ ID NO: 7276196 - DNA, 22 bp, Homo sapiens
ccagtgttttccagtttgccca

SEQ ID NO: 7276197 - DNA, 22 bp, Homo sapiens
tgaggctgacaaaagatgaggt

SEQ ID NO: 7276198 - DNA, 22 bp, Homo sapiens
tgaggcccagccgccctgagag

SEQ ID NO: 7276199 - DNA, 22 bp, Homo sapiens
tgaggcccatctgagattttga

SEQ ID NO: 7276200 - DNA, 20 bp, Homo sapiens
tgaggcccagcagagtcggg

SEQ ID NO: 7276201 - DNA, 22 bp, Homo sapiens
tgaggcagtgtgagataataaa

SEQ ID NO: 7276202 - DNA, 22 bp, Homo sapiens
tgcaatatcagattcaacacat

SEQ ID NO: 7276203 - DNA, 22 bp, Homo sapiens
tgcaatattttatatccaacaa

SEQ ID NO: 7276204 - DNA, 22 bp, Homo sapiens
tgcaatatgttgcattgtatgg

SEQ ID NO: 7276205 - DNA, 22 bp, Homo sapiens
tgcaaatattgggacagtctag

SEQ ID NO: 7276206 - DNA, 22 bp, Homo sapiens
cccaaggacacgggcagggaca

SEQ ID NO: 7276207 - DNA, 22 bp, Homo sapiens
cccaaggaagacgcttgtgata

SEQ ID NO: 7276208 - DNA, 19 bp, Homo sapiens
tgcagagagaggcaaagaa

SEQ ID NO: 7276209 - DNA, 22 bp, Homo sapiens
tgcagagagatatggcaagagg

SEQ ID NO: 7276210 - DNA, 22 bp, Homo sapiens
tgcagagaaaccagtggaggac

SEQ ID NO: 7276211 - DNA, 22 bp, Homo sapiens
tgcactttgcaggcatggaaac

SEQ ID NO: 7276212 - DNA, 22 bp, Homo sapiens
tgcactgatgttttgccaagga

SEQ ID NO: 7276213 - DNA, 22 bp, Homo sapiens
cccagagctccggtcctgccca

SEQ ID NO: 7276214 - DNA, 22 bp, Homo sapiens
tgcaggaatcagaggggaagcg

SEQ ID NO: 7276215 - DNA, 22 bp, Homo sapiens
tgcaggaatcagaggggaagcg

SEQ ID NO: 7276216 - DNA, 22 bp, Homo sapiens
cccagcaggaggaggttgcagt

SEQ ID NO: 7276217 - DNA, 22 bp, Homo sapiens
cctctccagttttaacgtgacc

SEQ ID NO: 7276218 - DNA, 22 bp, Homo sapiens
tggctttacatcaaattgagta

SEQ ID NO: 7276219 - DNA, 22 bp, Homo sapiens
tgggacagggaatctgatcccc

SEQ ID NO: 7276220 - DNA, 22 bp, Homo sapiens
tgggacaggatgaccagaaggt

SEQ ID NO: 7276221 - DNA, 22 bp, Homo sapiens
tgggacaggaggcctctggaga

SEQ ID NO: 7276222 - DNA, 22 bp, Homo sapiens
tgggatagaaatttagaacaag

SEQ ID NO: 7276223 - DNA, 19 bp, Homo sapiens
tggcagtgtggcttccaga

SEQ ID NO: 7276224 - DNA, 22 bp, Homo sapiens
tggcagtgtgggaggaaggtac

SEQ ID NO: 7276225 - DNA, 22 bp, Homo sapiens
tggcagtgtcttgctggggcag

SEQ ID NO: 7276226 - DNA, 22 bp, Homo sapiens
tggcagtgtcttgctggggcag

SEQ ID NO: 7276227 - DNA, 22 bp, Homo sapiens
tggcagtgtcttatcaggagtg

SEQ ID NO: 7276228 - DNA, 22 bp, Homo sapiens
tggcagtgtcttatcaggagtg

SEQ ID NO: 7276229 - DNA, 22 bp, Homo sapiens
tggcagtgtataggtggctcct

SEQ ID NO: 7276230 - DNA, 22 bp, Homo sapiens
tggcagtgtataggtggctcct

SEQ ID NO: 7276231 - DNA, 22 bp, Homo sapiens
tggcagtgtcctactggttggt

SEQ ID NO: 7276232 - DNA, 22 bp, Homo sapiens
tggcagtgtcctactggttggt

SEQ ID NO: 7276233 - DNA, 22 bp, Homo sapiens
tggcagtggctttgctggtgga

SEQ ID NO: 7276234 - DNA, 22 bp, Homo sapiens
tggcagtggctttgctggtgga

SEQ ID NO: 7276235 - DNA, 22 bp, Homo sapiens
tggcagtggctcagagtgcaga

SEQ ID NO: 7276236 - DNA, 22 bp, Homo sapiens
tggcagtgggaagctggaagtc

SEQ ID NO: 7276237 - DNA, 22 bp, Homo sapiens
tggcagtggtgtctgcacaggc

SEQ ID NO: 7276238 - DNA, 22 bp, Homo sapiens
tggcagtggtgtctgcacaggc

SEQ ID NO: 7276239 - DNA, 22 bp, Homo sapiens
tggcagtggtaccggctctcag

SEQ ID NO: 7276240 - DNA, 22 bp, Homo sapiens
tggcagtgggaatggacaaaca

SEQ ID NO: 7276241 - DNA, 22 bp, Homo sapiens
tggcagtgggaagctggaagtc

SEQ ID NO: 7276242 - DNA, 22 bp, Homo sapiens
cctccatgtaaaggtcccctca

SEQ ID NO: 7276243 - DNA, 22 bp, Homo sapiens
tgggtccacaaacatcagatat

SEQ ID NO: 7276244 - DNA, 22 bp, Homo sapiens
cctgcaggtttcccccggacgg

SEQ ID NO: 7276245 - DNA, 22 bp, Homo sapiens
cctgcaggtccccggatgcgca

SEQ ID NO: 7276246 - DNA, 22 bp, Homo sapiens
cctgcaggttgcagaggcggaa

SEQ ID NO: 7276247 - DNA, 22 bp, Homo sapiens
cctgcatccgaaagtgatcata

SEQ ID NO: 7276248 - DNA, 19 bp, Homo sapiens
cctgcagggatgagaggtt

SEQ ID NO: 7276249 - DNA, 22 bp, Homo sapiens
cctgcaggggagagacttctag

SEQ ID NO: 7276250 - DNA, 22 bp, Homo sapiens
cctgcagggtgctgccacagat

SEQ ID NO: 7276251 - DNA, 22 bp, Homo sapiens
cctgcaggtaaggctaactgcc

SEQ ID NO: 7276252 - DNA, 22 bp, Homo sapiens
cctgcctcatcaacttgtcgtg

SEQ ID NO: 7276253 - DNA, 22 bp, Homo sapiens
cctgcctcaggactctgcatat

SEQ ID NO: 7276254 - DNA, 22 bp, Homo sapiens
cctgcctcaggactctgcatat

SEQ ID NO: 7276255 - DNA, 22 bp, Homo sapiens
cctgcctcccagaggtcctcta

SEQ ID NO: 7276256 - DNA, 22 bp, Homo sapiens
cctgcctcatcaacttgtcgtg

SEQ ID NO: 7276257 - DNA, 22 bp, Homo sapiens
cctgcctcccagaggtcctcta

SEQ ID NO: 7276258 - DNA, 23 bp, Homo sapiens
cctgcctccccatcagttataca

SEQ ID NO: 7276259 - DNA, 23 bp, Homo sapiens
cctgcctccccatcagttataca

SEQ ID NO: 7276260 - DNA, 22 bp, Homo sapiens
tgggccgtggagcactctgaga

SEQ ID NO: 7276261 - DNA, 22 bp, Homo sapiens
cctgcaggctgcaggccagttc

SEQ ID NO: 7276262 - DNA, 22 bp, Homo sapiens
cctgcagggaatcgaggcagaa

SEQ ID NO: 7276263 - DNA, 22 bp, Homo sapiens
tggggagcacggtagggaaatg

SEQ ID NO: 7276264 - DNA, 22 bp, Homo sapiens
cctgaggtcatggtccagtgtt

SEQ ID NO: 7276265 - DNA, 21 bp, Homo sapiens
cctgagtgagacctggcccgt

SEQ ID NO: 7276266 - DNA, 22 bp, Homo sapiens
ccctggctgcttgtagtctggc

SEQ ID NO: 7276267 - DNA, 22 bp, Homo sapiens
tggcagagaacacacatgattc

SEQ ID NO: 7276268 - DNA, 22 bp, Homo sapiens
ccctggctgcgtgatggatgaa

SEQ ID NO: 7276269 - DNA, 22 bp, Homo sapiens
ccctggagtgtgacgaggcatt

SEQ ID NO: 7276270 - DNA, 22 bp, Homo sapiens
ccctggagtcctggcagttgat

SEQ ID NO: 7276271 - DNA, 23 bp, Homo sapiens
ccctggagtaaattcttggaagg

SEQ ID NO: 7276272 - DNA, 22 bp, Homo sapiens
ccctggaggttgaggctgcagt

SEQ ID NO: 7276273 - DNA, 22 bp, Homo sapiens
ccctggaggttgaggctgcagt

SEQ ID NO: 7276274 - DNA, 22 bp, Homo sapiens
ccctggaggtggaggttgcagg

SEQ ID NO: 7276275 - DNA, 22 bp, Homo sapiens
ccctggaggtcagaggcctggg

SEQ ID NO: 7276276 - DNA, 22 bp, Homo sapiens
ccctggaggtcagaggcctggg

SEQ ID NO: 7276277 - DNA, 19 bp, Homo sapiens
tggcagggagagtttgaag

SEQ ID NO: 7276278 - DNA, 22 bp, Homo sapiens
cccttgggtgccagccacaagt

SEQ ID NO: 7276279 - DNA, 22 bp, Homo sapiens
cccttggccactgcgccagtga

SEQ ID NO: 7276280 - DNA, 22 bp, Homo sapiens
ccctggctggaaattaagtagt

SEQ ID NO: 7276281 - DNA, 19 bp, Homo sapiens
tggcaggcccaggatggac

SEQ ID NO: 7276282 - DNA, 23 bp, Homo sapiens
tggaggaaacacatcagaagacc

SEQ ID NO: 7276283 - DNA, 21 bp, Homo sapiens
tggaggaataaagcacagaag

SEQ ID NO: 7276284 - DNA, 22 bp, Homo sapiens
tggaggaagttgctggaagtca

SEQ ID NO: 7276285 - DNA, 22 bp, Homo sapiens
tggaggaagtggctggccagaa

SEQ ID NO: 7276286 - DNA, 22 bp, Homo sapiens
tggaggcatttgatgttcataa

SEQ ID NO: 7276287 - DNA, 22 bp, Homo sapiens
tggagacatgggcgaatctaag

SEQ ID NO: 7276288 - DNA, 22 bp, Homo sapiens
ccctccctgaagaagttactct

SEQ ID NO: 7276289 - DNA, 22 bp, Homo sapiens
ccctccctgtgtgcctcatttg

SEQ ID NO: 7276290 - DNA, 22 bp, Homo sapiens
ccccagctgagatttgaggaga

SEQ ID NO: 7276291 - DNA, 22 bp, Homo sapiens
ccccaggacacatggaccaagt

SEQ ID NO: 7276292 - DNA, 22 bp, Homo sapiens
ccccaggaagcctcagatttgc

SEQ ID NO: 7276293 - DNA, 22 bp, Homo sapiens
ccccagctgcatacttgccaag

SEQ ID NO: 7276294 - DNA, 22 bp, Homo sapiens
cccagtgttccttgaggggctg

SEQ ID NO: 7276295 - DNA, 22 bp, Homo sapiens
cccagtgtctgggcctgcaggg

SEQ ID NO: 7276296 - DNA, 22 bp, Homo sapiens
cccagtgtgatgaggttgctaa

SEQ ID NO: 7276297 - DNA, 22 bp, Homo sapiens
cccagtgtgcccctcctgcagc

SEQ ID NO: 7276298 - DNA, 22 bp, Homo sapiens
cccagtgtggttctttggagaa

SEQ ID NO: 7276299 - DNA, 22 bp, Homo sapiens
cccagtgtggttgtgaattctg

SEQ ID NO: 7276300 - DNA, 22 bp, Homo sapiens
cccagtgtctcttgtgcctttc

SEQ ID NO: 7276301 - DNA, 22 bp, Homo sapiens
cccagtgtctccaacatcagat

SEQ ID NO: 7276302 - DNA, 22 bp, Homo sapiens
cccagtgtcaccaacaggacac

SEQ ID NO: 7276303 - DNA, 22 bp, Homo sapiens
cccagtgtcattctaagggagg

SEQ ID NO: 7276304 - DNA, 20 bp, Homo sapiens
cccagtgtccagccttgcca

SEQ ID NO: 7276305 - DNA, 22 bp, Homo sapiens
ccccaggagcttgttttagaga

SEQ ID NO: 7276306 - DNA, 22 bp, Homo sapiens
ccccaggacgtggccctcatag

SEQ ID NO: 7276307 - DNA, 16 bp, Homo sapiens
ccccaggacttggcac

SEQ ID NO: 7276308 - DNA, 22 bp, Homo sapiens
ccccaggagatttgggagcaca

SEQ ID NO: 7276309 - DNA, 22 bp, Homo sapiens
ccccaggagaaatcttaaacta

SEQ ID NO: 7276310 - DNA, 22 bp, Homo sapiens
tgcttccttgatcattcccaaa

SEQ ID NO: 7276311 - DNA, 22 bp, Homo sapiens
tgcttccttgagctctccaatc

SEQ ID NO: 7276312 - DNA, 22 bp, Homo sapiens
tgcttccttcccgttcttctcc

SEQ ID NO: 7276313 - DNA, 22 bp, Homo sapiens
tgcttcctgaggccgtcttctc

SEQ ID NO: 7276314 - DNA, 22 bp, Homo sapiens
tgcttcctatccacacaatgcc

SEQ ID NO: 7276315 - DNA, 22 bp, Homo sapiens
tgcttgctggaggcagacagaa

SEQ ID NO: 7276316 - DNA, 18 bp, Homo sapiens
tgcttggagcatttacca

SEQ ID NO: 7276317 - DNA, 22 bp, Homo sapiens
ccctccccacaaagcttcacac

SEQ ID NO: 7276318 - DNA, 22 bp, Homo sapiens
ccctccctctgctgggtgtaga

SEQ ID NO: 7276319 - DNA, 20 bp, Homo sapiens
cccagtgaagcatggaagag

SEQ ID NO: 7276320 - DNA, 22 bp, Homo sapiens
cccagtcctaaagcagacgcca

SEQ ID NO: 7276321 - DNA, 22 bp, Homo sapiens
tgctcaggtcgttctgcccctt

SEQ ID NO: 7276322 - DNA, 22 bp, Homo sapiens
tgctgcctggtttcttcttgct

SEQ ID NO: 7276323 - DNA, 22 bp, Homo sapiens
tgctgcctggagccttttgttt

SEQ ID NO: 7276324 - DNA, 22 bp, Homo sapiens
caggtggggggcttccgagcct

SEQ ID NO: 7276325 - DNA, 22 bp, Homo sapiens
tatgcaaatcattagatttcct

SEQ ID NO: 7276326 - DNA, 22 bp, Homo sapiens
tatgaacttttgatgtgacatg

SEQ ID NO: 7276327 - DNA, 22 bp, Homo sapiens
tatgaactctggagtctgagtg

SEQ ID NO: 7276328 - DNA, 23 bp, Homo sapiens
tatgaactgcattgctggtgtgt

SEQ ID NO: 7276329 - DNA, 22 bp, Homo sapiens
tagttttacttgcgatgataat

SEQ ID NO: 7276330 - DNA, 22 bp, Homo sapiens
tagtgttctaagaacatccatg

SEQ ID NO: 7276331 - DNA, 22 bp, Homo sapiens
tcacattctcagcatctataca

SEQ ID NO: 7276332 - DNA, 22 bp, Homo sapiens
cagtggcaatgggacagagcac

SEQ ID NO: 7276333 - DNA, 22 bp, Homo sapiens
cagtggcagagaacagagacct

SEQ ID NO: 7276334 - DNA, 22 bp, Homo sapiens
cagtgcataatctaaatggggg

SEQ ID NO: 7276335 - DNA, 22 bp, Homo sapiens
cagtgctgttgtaagctcattg

SEQ ID NO: 7276336 - DNA, 22 bp, Homo sapiens
tcacatgcttgaggaaagaaaa

SEQ ID NO: 7276337 - DNA, 22 bp, Homo sapiens
tcaaattctattctatactcag

SEQ ID NO: 7276338 - DNA, 22 bp, Homo sapiens
cagtgaaatcacaactttagtt

SEQ ID NO: 7276339 - DNA, 22 bp, Homo sapiens
cagtctggcacagcacactgaa

SEQ ID NO: 7276340 - DNA, 22 bp, Homo sapiens
cagtctgggactgagctccacc

SEQ ID NO: 7276341 - DNA, 22 bp, Homo sapiens
cagtcccagctgctcagaaggc

SEQ ID NO: 7276342 - DNA, 22 bp, Homo sapiens
cagtcccagggttggttcagct

SEQ ID NO: 7276343 - DNA, 15 bp, Homo sapiens
cagtcccagggaccc

SEQ ID NO: 7276344 - DNA, 22 bp, Homo sapiens
cagtcccagtttgagactctgg

SEQ ID NO: 7276345 - DNA, 22 bp, Homo sapiens
cagtcccatctcccaggtggct

SEQ ID NO: 7276346 - DNA, 22 bp, Homo sapiens
cagtcccatgagcccagaacat

SEQ ID NO: 7276347 - DNA, 22 bp, Homo sapiens
tcaaaggataactgagggcagt

SEQ ID NO: 7276348 - DNA, 22 bp, Homo sapiens
tcaaaggcattgccaataagta

SEQ ID NO: 7276349 - DNA, 22 bp, Homo sapiens
tcaaagcttagataatttcttt

SEQ ID NO: 7276350 - DNA, 23 bp, Homo sapiens
cagggaggagatactgtgtatct

SEQ ID NO: 7276351 - DNA, 22 bp, Homo sapiens
cagggaggatgggctgttttgc

SEQ ID NO: 7276352 - DNA, 22 bp, Homo sapiens
cagggaggctgtcttatgcctg

SEQ ID NO: 7276353 - DNA, 22 bp, Homo sapiens
cagggagggaggaaaatttgct

SEQ ID NO: 7276354 - DNA, 22 bp, Homo sapiens
cagggagggacaattgtcacct

SEQ ID NO: 7276355 - DNA, 22 bp, Homo sapiens
tagcagcaattacacagtccgt

SEQ ID NO: 7276356 - DNA, 22 bp, Homo sapiens
tagcatgtcagtcgccacacgt

SEQ ID NO: 7276357 - DNA, 22 bp, Homo sapiens
tagcagttagagttgactgcaa

SEQ ID NO: 7276358 - DNA, 22 bp, Homo sapiens
tagcagttaatctgagccaaga

SEQ ID NO: 7276359 - DNA, 22 bp, Homo sapiens
tagaaagcagtatctccatttt

SEQ ID NO: 7276360 - DNA, 22 bp, Homo sapiens
tagacaggagtcaggctagaat

SEQ ID NO: 7276361 - DNA, 22 bp, Homo sapiens
caggctgattaggcctcgtcca

SEQ ID NO: 7276362 - DNA, 22 bp, Homo sapiens
caggctgaggcagtagggtttg

SEQ ID NO: 7276363 - DNA, 22 bp, Homo sapiens
caggctgagggttaggccttag

SEQ ID NO: 7276364 - DNA, 22 bp, Homo sapiens
caggctgatagggtccaaagtt

SEQ ID NO: 7276365 - DNA, 22 bp, Homo sapiens
caggctgatcagggctgggatg

SEQ ID NO: 7276366 - DNA, 22 bp, Homo sapiens
tacccagggcttttctgatgca

SEQ ID NO: 7276367 - DNA, 22 bp, Homo sapiens
tacccaggaggaaactgaggct

SEQ ID NO: 7276368 - DNA, 22 bp, Homo sapiens
tacccaggagaaacagcagggc

SEQ ID NO: 7276369 - DNA, 22 bp, Homo sapiens
tacccaggggctgagcagaggt

SEQ ID NO: 7276370 - DNA, 22 bp, Homo sapiens
caggctgcagcagcagtggccc

SEQ ID NO: 7276371 - DNA, 22 bp, Homo sapiens
tagaaagaacttcatgtaaaac

SEQ ID NO: 7276372 - DNA, 22 bp, Homo sapiens
tacctctcggggtctgtttgtg

SEQ ID NO: 7276373 - DNA, 22 bp, Homo sapiens
caggccctcgcccgcagcgacc

SEQ ID NO: 7276374 - DNA, 22 bp, Homo sapiens
cagctctgctgggaggatgcag

SEQ ID NO: 7276375 - DNA, 22 bp, Homo sapiens
tacagtttctcattatgctctc

SEQ ID NO: 7276376 - DNA, 22 bp, Homo sapiens
caggctcccaccctcctgcagc

SEQ ID NO: 7276377 - DNA, 22 bp, Homo sapiens
tacagctaggcaaaaatgacat

SEQ ID NO: 7276378 - DNA, 22 bp, Homo sapiens
caggcctgtgacaccgtgtctg

SEQ ID NO: 7276379 - DNA, 23 bp, Homo sapiens
catggaaaactgaaagctgacct

SEQ ID NO: 7276380 - DNA, 22 bp, Homo sapiens
catgtaaaaagaagaatctgga

SEQ ID NO: 7276381 - DNA, 22 bp, Homo sapiens
catgtaaaacactcagaacagt

SEQ ID NO: 7276382 - DNA, 22 bp, Homo sapiens
catgtaatcctggggagatgaa

SEQ ID NO: 7276383 - DNA, 22 bp, Homo sapiens
catgtaaagcatccttctaggg

SEQ ID NO: 7276384 - DNA, 19 bp, Homo sapiens
tccagatgatatggattac

SEQ ID NO: 7276385 - DNA, 22 bp, Homo sapiens
tccagatggatttaagacctaa

SEQ ID NO: 7276386 - DNA, 20 bp, Homo sapiens
tccagcaccctcacagagaa

SEQ ID NO: 7276387 - DNA, 22 bp, Homo sapiens
tccagcactcgcccagggcttg

SEQ ID NO: 7276388 - DNA, 22 bp, Homo sapiens
catgctttgggtcagaaatgcc

SEQ ID NO: 7276389 - DNA, 22 bp, Homo sapiens
catgcttttttctagtataaat

SEQ ID NO: 7276390 - DNA, 22 bp, Homo sapiens
catgctgattcttcctgagctt

SEQ ID NO: 7276391 - DNA, 22 bp, Homo sapiens
tccaagatcaaggtgttggcag

SEQ ID NO: 7276392 - DNA, 22 bp, Homo sapiens
tccaagatgtcggtcctgtcca

SEQ ID NO: 7276393 - DNA, 22 bp, Homo sapiens
tccaagatggttggtgtggtgg

SEQ ID NO: 7276394 - DNA, 20 bp, Homo sapiens
tccaggctcctccacttagt

SEQ ID NO: 7276395 - DNA, 22 bp, Homo sapiens
tccaggcttcacgtctgccctc

SEQ ID NO: 7276396 - DNA, 22 bp, Homo sapiens
catgtggtattgtgagatccac

SEQ ID NO: 7276397 - DNA, 22 bp, Homo sapiens
catgtggttcaagtactccaca

SEQ ID NO: 7276398 - DNA, 22 bp, Homo sapiens
catgttttgtgtacagaatatt

SEQ ID NO: 7276399 - DNA, 22 bp, Homo sapiens
catgtgctgtagcagagaggaa

SEQ ID NO: 7276400 - DNA, 22 bp, Homo sapiens
tccaggcttgagaccaggctct

SEQ ID NO: 7276401 - DNA, 22 bp, Homo sapiens
tccagggttgtgggcttcagca

SEQ ID NO: 7276402 - DNA, 22 bp, Homo sapiens
tccagggtgtgtttactggggt

SEQ ID NO: 7276403 - DNA, 22 bp, Homo sapiens
tccagggttgtgggcttcagca

SEQ ID NO: 7276404 - DNA, 21 bp, Homo sapiens
tccagggtcagaagttcagtg

SEQ ID NO: 7276405 - DNA, 22 bp, Homo sapiens
tcaggcagaaaaatcactaatt

SEQ ID NO: 7276406 - DNA, 22 bp, Homo sapiens
cagtgtcctcagccagcagcta

SEQ ID NO: 7276407 - DNA, 22 bp, Homo sapiens
tcaggcagaattatcaaaagat

SEQ ID NO: 7276408 - DNA, 22 bp, Homo sapiens
tcaggcagaccaccgtgggcag

SEQ ID NO: 7276409 - DNA, 22 bp, Homo sapiens
tcaggcagagctgtggagctct

SEQ ID NO: 7276410 - DNA, 22 bp, Homo sapiens
tcaggcagaggatggggagcgt

SEQ ID NO: 7276411 - DNA, 22 bp, Homo sapiens
tcaggctgatttcttttgaggg

SEQ ID NO: 7276412 - DNA, 22 bp, Homo sapiens
tcaggctgcagctgtcagcagc

SEQ ID NO: 7276413 - DNA, 22 bp, Homo sapiens
tcaggctgcagtggcaaaagac

SEQ ID NO: 7276414 - DNA, 22 bp, Homo sapiens
tcaggctgcatctgtaagggtg

SEQ ID NO: 7276415 - DNA, 22 bp, Homo sapiens
tcaggctgcccgttcagggctc

SEQ ID NO: 7276416 - DNA, 18 bp, Homo sapiens
tcaggctgccctgtgtct

SEQ ID NO: 7276417 - DNA, 22 bp, Homo sapiens
tcagtgtgagtaccatgctcag

SEQ ID NO: 7276418 - DNA, 19 bp, Homo sapiens
tcagtgtgacttggtcagt

SEQ ID NO: 7276419 - DNA, 22 bp, Homo sapiens
tcagtgtgaggtcttccacccg

SEQ ID NO: 7276420 - DNA, 22 bp, Homo sapiens
tcagtgtgaggtcttccacccg

SEQ ID NO: 7276421 - DNA, 22 bp, Homo sapiens
tcagtgtgaattcattttagat

SEQ ID NO: 7276422 - DNA, 22 bp, Homo sapiens
tcagtgtggaaaatcctttggc

SEQ ID NO: 7276423 - DNA, 22 bp, Homo sapiens
tcagtgtgtaattctttgtttc

SEQ ID NO: 7276424 - DNA, 22 bp, Homo sapiens
catcagtcagtctcttcagtat

SEQ ID NO: 7276425 - DNA, 22 bp, Homo sapiens
catcagtcagtcaacgcagttt

SEQ ID NO: 7276426 - DNA, 22 bp, Homo sapiens
catcagtctgtgaagagggcta

SEQ ID NO: 7276427 - DNA, 22 bp, Homo sapiens
catcagtctgaaagccagggag

SEQ ID NO: 7276428 - DNA, 22 bp, Homo sapiens
catcagtctagattctagtacc

SEQ ID NO: 7276429 - DNA, 22 bp, Homo sapiens
catcagtcccacggagcagccc

SEQ ID NO: 7276430 - DNA, 22 bp, Homo sapiens
tcagtgtgtagtaaattgtagg

SEQ ID NO: 7276431 - DNA, 22 bp, Homo sapiens
tcagtgtgtctctgcatttggg

SEQ ID NO: 7276432 - DNA, 22 bp, Homo sapiens
tcatacacctatctctctgtgc

SEQ ID NO: 7276433 - DNA, 22 bp, Homo sapiens
tcatcagaggcatctggcaagg

SEQ ID NO: 7276434 - DNA, 22 bp, Homo sapiens
tcataattgtatacatttatgg

SEQ ID NO: 7276435 - DNA, 22 bp, Homo sapiens
cattttcagcacccatctgaaa

SEQ ID NO: 7276436 - DNA, 22 bp, Homo sapiens
cattttatcctctgggaagcta

SEQ ID NO: 7276437 - DNA, 22 bp, Homo sapiens
catttgtctctaggaagtgagg

SEQ ID NO: 7276438 - DNA, 22 bp, Homo sapiens
catttgtcatcactgagctgcc

SEQ ID NO: 7276439 - DNA, 22 bp, Homo sapiens
cattttcatgagtttctgttca

SEQ ID NO: 7276440 - DNA, 22 bp, Homo sapiens
tcctgagggcattttggtgact

SEQ ID NO: 7276441 - DNA, 22 bp, Homo sapiens
tcctgagggcgattcagcaggt

SEQ ID NO: 7276442 - DNA, 22 bp, Homo sapiens
tcctgagggctcggggctcatg

SEQ ID NO: 7276443 - DNA, 22 bp, Homo sapiens
tccatacacattgaattttagt

SEQ ID NO: 7276444 - DNA, 22 bp, Homo sapiens
catttattggcatgtagtaggt

SEQ ID NO: 7276445 - DNA, 20 bp, Homo sapiens
catttcattgtgtcttcact

SEQ ID NO: 7276446 - DNA, 22 bp, Homo sapiens
catttccactctgggagtcaga

SEQ ID NO: 7276447 - DNA, 20 bp, Homo sapiens
catttcattgtgtcttcact

SEQ ID NO: 7276448 - DNA, 22 bp, Homo sapiens
catttcatagttgtcacaataa

SEQ ID NO: 7276449 - DNA, 22 bp, Homo sapiens
catttccagctcctgcatcatg

SEQ ID NO: 7276450 - DNA, 22 bp, Homo sapiens
catttccacttctgaaaactgg

SEQ ID NO: 7276451 - DNA, 22 bp, Homo sapiens
tcctggctaatgctgctgatgg

SEQ ID NO: 7276452 - DNA, 22 bp, Homo sapiens
ccaccaggcactcacagggaag

SEQ ID NO: 7276453 - DNA, 22 bp, Homo sapiens
tcctggctccactgagcaggcc

SEQ ID NO: 7276454 - DNA, 22 bp, Homo sapiens
tcctggctcaggcccctggtgc

SEQ ID NO: 7276455 - DNA, 22 bp, Homo sapiens
tcctggctagttttgctgaaat

SEQ ID NO: 7276456 - DNA, 22 bp, Homo sapiens
ccacaggctgctgcaggtcccg

SEQ ID NO: 7276457 - DNA, 22 bp, Homo sapiens
ccacaggctgctgcaggtcccg

SEQ ID NO: 7276458 - DNA, 22 bp, Homo sapiens
ccacagctgaccgcaggtgagc

SEQ ID NO: 7276459 - DNA, 22 bp, Homo sapiens
ccacagctgaccgcaggtgagc

SEQ ID NO: 7276460 - DNA, 22 bp, Homo sapiens
tcctgccttcatactgctgtat

SEQ ID NO: 7276461 - DNA, 22 bp, Homo sapiens
tcctgccttgcctgggacatca

SEQ ID NO: 7276462 - DNA, 22 bp, Homo sapiens
tcctgccttagagcaaggaaaa

SEQ ID NO: 7276463 - DNA, 21 bp, Homo sapiens
tcctgccttagtccagagcag

SEQ ID NO: 7276464 - DNA, 22 bp, Homo sapiens
tcctgaggtggattgagcagag

SEQ ID NO: 7276465 - DNA, 22 bp, Homo sapiens
tcctgagggctgcagtcatagg

SEQ ID NO: 7276466 - DNA, 22 bp, Homo sapiens
tcctgaggtgctcagccaggaa

SEQ ID NO: 7276467 - DNA, 22 bp, Homo sapiens
ccagatgtccctctcaggtttg

SEQ ID NO: 7276468 - DNA, 22 bp, Homo sapiens
ccagagagggcgccacctggag

SEQ ID NO: 7276469 - DNA, 19 bp, Homo sapiens
ccagagcccgccagatggg

SEQ ID NO: 7276470 - DNA, 22 bp, Homo sapiens
ccagagccggctccctcagctt

SEQ ID NO: 7276471 - DNA, 23 bp, Homo sapiens
tctcagttccagaggctacaagt

SEQ ID NO: 7276472 - DNA, 22 bp, Homo sapiens
tctcagtgtgttttctctcaga

SEQ ID NO: 7276473 - DNA, 22 bp, Homo sapiens
ttttccagattggacttagtcc

SEQ ID NO: 7276474 - DNA, 22 bp, Homo sapiens
ttttccagagctgtctcttgca

SEQ ID NO: 7276475 - DNA, 22 bp, Homo sapiens
ttttcctcacctaactcaaggt

SEQ ID NO: 7276476 - DNA, 22 bp, Homo sapiens
ttttcctcaggaatgctaagct

SEQ ID NO: 7276477 - DNA, 22 bp, Homo sapiens
ttttacagttccatgcaaagcg

SEQ ID NO: 7276478 - DNA, 22 bp, Homo sapiens
tttgtcttatccaatctctcag

SEQ ID NO: 7276479 - DNA, 22 bp, Homo sapiens
tttgtccttgaatcaattcaca

SEQ ID NO: 7276480 - DNA, 22 bp, Homo sapiens
ttttattgggagtcctctactg

SEQ ID NO: 7276481 - DNA, 22 bp, Homo sapiens
ttttattgggagtcctctactg

SEQ ID NO: 7276482 - DNA, 22 bp, Homo sapiens
ttttattgtcaatgaagacaga

SEQ ID NO: 7276483 - DNA, 22 bp, Homo sapiens
ttttattggtaatgataaaagt

SEQ ID NO: 7276484 - DNA, 22 bp, Homo sapiens
ttttattgtcaatgaagacaga

SEQ ID NO: 7276485 - DNA, 22 bp, Homo sapiens
ttttattgtctgtattgcctat

SEQ ID NO: 7276486 - DNA, 22 bp, Homo sapiens
ttttattgtctcccagttctgg

SEQ ID NO: 7276487 - DNA, 22 bp, Homo sapiens
ttttattgtctcccagttctgg

SEQ ID NO: 7276488 - DNA, 23 bp, Homo sapiens
ttttccagaatcgactctgtaga

SEQ ID NO: 7276489 - DNA, 20 bp, Homo sapiens
ttttccagaaagtatcattg

SEQ ID NO: 7276490 - DNA, 16 bp, Homo sapiens
ttttattgtgacagcc

SEQ ID NO: 7276491 - DNA, 22 bp, Homo sapiens
ttttattgtctgtattgcctat

SEQ ID NO: 7276492 - DNA, 16 bp, Homo sapiens
ttttattgtgacagcc

SEQ ID NO: 7276493 - DNA, 22 bp, Homo sapiens
tttgcagtgtcagcttctgtgt

SEQ ID NO: 7276494 - DNA, 19 bp, Homo sapiens
tttgcagtggttcctttgt

SEQ ID NO: 7276495 - DNA, 20 bp, Homo sapiens
tttgagaccagtctgcccaa

SEQ ID NO: 7276496 - DNA, 20 bp, Homo sapiens
tttgagaccagtctgcccaa

SEQ ID NO: 7276497 - DNA, 22 bp, Homo sapiens
tttggggagacatggccagctg

SEQ ID NO: 7276498 - DNA, 22 bp, Homo sapiens
tttggggaaccactgaggtagg

SEQ ID NO: 7276499 - DNA, 22 bp, Homo sapiens
tttgggctggtttgccatgccc

SEQ ID NO: 7276500 - DNA, 22 bp, Homo sapiens
tttgaaatatgaggcattatga

SEQ ID NO: 7276501 - DNA, 22 bp, Homo sapiens
tttgaaattaagatattgtcca

SEQ ID NO: 7276502 - DNA, 22 bp, Homo sapiens
tttctaggcacagtgtcttccc

SEQ ID NO: 7276503 - DNA, 22 bp, Homo sapiens
tttctagggctcttgtcttctg

SEQ ID NO: 7276504 - DNA, 22 bp, Homo sapiens
tttctataactggactggattg

SEQ ID NO: 7276505 - DNA, 22 bp, Homo sapiens
tttctagtctcgatctcttaat

SEQ ID NO: 7276506 - DNA, 22 bp, Homo sapiens
tttctaggtcttccatactgcc

SEQ ID NO: 7276507 - DNA, 22 bp, Homo sapiens
tttgacatggaataactcattt

SEQ ID NO: 7276508 - DNA, 22 bp, Homo sapiens
tttgaacttctacctgtcatat

SEQ ID NO: 7276509 - DNA, 22 bp, Homo sapiens
tttgaagactactgggagtgaa

SEQ ID NO: 7276510 - DNA, 22 bp, Homo sapiens
tttgacagcagataaaataaaa

SEQ ID NO: 7276511 - DNA, 23 bp, Homo sapiens
tttgaacatttctagattacata

SEQ ID NO: 7276512 - DNA, 22 bp, Homo sapiens
tttgaacatgctgcatgataat

SEQ ID NO: 7276513 - DNA, 22 bp, Homo sapiens
tttgaacaggagtatctatagt

SEQ ID NO: 7276514 - DNA, 22 bp, Homo sapiens
ttgggctcaggagtttgagacc

SEQ ID NO: 7276515 - DNA, 22 bp, Homo sapiens
ttgggctcaggagtttgagacc

SEQ ID NO: 7276516 - DNA, 22 bp, Homo sapiens
ttggcttttatgcagcttaggt

SEQ ID NO: 7276517 - DNA, 18 bp, Homo sapiens
ttggctttgagaactggt

SEQ ID NO: 7276518 - DNA, 21 bp, Homo sapiens
ttggcctgatatcttggagca

SEQ ID NO: 7276519 - DNA, 22 bp, Homo sapiens
ttgttcctgccaagccaagcct

SEQ ID NO: 7276520 - DNA, 22 bp, Homo sapiens
ttgtgcatgatgcatacatggt

SEQ ID NO: 7276521 - DNA, 22 bp, Homo sapiens
ttgtattaattgaaatgaatgc

SEQ ID NO: 7276522 - DNA, 22 bp, Homo sapiens
ttgtatgtctcaatatcctgtc

SEQ ID NO: 7276523 - DNA, 22 bp, Homo sapiens
ttgtatgtggcaaatgggggag

SEQ ID NO: 7276524 - DNA, 22 bp, Homo sapiens
ttgtatgtttctgtgcacatga

SEQ ID NO: 7276525 - DNA, 22 bp, Homo sapiens
ttgtatgtaccacaggtggtgg

SEQ ID NO: 7276526 - DNA, 22 bp, Homo sapiens
ttggggtaaaatgtcgtaagag

SEQ ID NO: 7276527 - DNA, 22 bp, Homo sapiens
ttggggtaagtttgtcaagctg

SEQ ID NO: 7276528 - DNA, 22 bp, Homo sapiens
ttggaattcaagttgtagctta

SEQ ID NO: 7276529 - DNA, 22 bp, Homo sapiens
ttggaattcaagttgtagctta

SEQ ID NO: 7276530 - DNA, 23 bp, Homo sapiens
ttggcaaagcctatgaagtcctc

SEQ ID NO: 7276531 - DNA, 22 bp, Homo sapiens
ttggcaaaatttaaagaagtga

SEQ ID NO: 7276532 - DNA, 22 bp, Homo sapiens
ttgctttatgtgtatgacttga

SEQ ID NO: 7276533 - DNA, 22 bp, Homo sapiens
ttgcatttgagaaagttctcct

SEQ ID NO: 7276534 - DNA, 22 bp, Homo sapiens
ttgaggtctttgagcaaacgca

SEQ ID NO: 7276535 - DNA, 20 bp, Homo sapiens
ttgaggtcaaggactaggcc

SEQ ID NO: 7276536 - DNA, 22 bp, Homo sapiens
ttgaggtcaaagaagtgagtgg

SEQ ID NO: 7276537 - DNA, 22 bp, Homo sapiens
ttgaggtcccaaacccactgag

SEQ ID NO: 7276538 - DNA, 22 bp, Homo sapiens
ttgaggtccagtctccacccac

SEQ ID NO: 7276539 - DNA, 22 bp, Homo sapiens
ttgaggtccaggtgtgggcagg

SEQ ID NO: 7276540 - DNA, 22 bp, Homo sapiens
ttgaggtcatctgaagtactag

SEQ ID NO: 7276541 - DNA, 22 bp, Homo sapiens
ttgaggtcatatatatttggca

SEQ ID NO: 7276542 - DNA, 22 bp, Homo sapiens
ttgaggtcaattctgtttcctg

SEQ ID NO: 7276543 - DNA, 22 bp, Homo sapiens
ttgaggtcaagtaaccactgga

SEQ ID NO: 7276544 - DNA, 22 bp, Homo sapiens
ttgaggtctgagactgtgcagg

SEQ ID NO: 7276545 - DNA, 22 bp, Homo sapiens
ttgaggtctctacagaagagtg

SEQ ID NO: 7276546 - DNA, 23 bp, Homo sapiens
ttgaggtcggctctctgagcctg

SEQ ID NO: 7276547 - DNA, 22 bp, Homo sapiens
ttgaggtccctgccttgccttc

SEQ ID NO: 7276548 - DNA, 22 bp, Homo sapiens
ttgaggtccccagtacccactg

SEQ ID NO: 7276549 - DNA, 22 bp, Homo sapiens
ttgaggtcttgagtactgggga

SEQ ID NO: 7276550 - DNA, 22 bp, Homo sapiens
ttgaggtcttcattcttgggca

SEQ ID NO: 7276551 - DNA, 22 bp, Homo sapiens
ttgaggtcttcaggatcaggct

SEQ ID NO: 7276552 - DNA, 22 bp, Homo sapiens
ttgaggtcttcagctgacacct

SEQ ID NO: 7276553 - DNA, 22 bp, Homo sapiens
ttgaggtctgtgtaggcagcaa

SEQ ID NO: 7276554 - DNA, 22 bp, Homo sapiens
ttgaggtctgtgataaaagtca

SEQ ID NO: 7276555 - DNA, 22 bp, Homo sapiens
ttgaggtctggcagtagcgttg

SEQ ID NO: 7276556 - DNA, 22 bp, Homo sapiens
ttgcattttggttgtaaatatg

SEQ ID NO: 7276557 - DNA, 22 bp, Homo sapiens
ttgcttcagtagctctttaaag

SEQ ID NO: 7276558 - DNA, 22 bp, Homo sapiens
tttagcattaagcttttcaaat

SEQ ID NO: 7276559 - DNA, 22 bp, Homo sapiens
tttacagctgctggcaagcttg

SEQ ID NO: 7276560 - DNA, 20 bp, Homo sapiens
tttatctgtgggagtggaga

SEQ ID NO: 7276561 - DNA, 22 bp, Homo sapiens
tttagtgtagcattcagagtca

SEQ ID NO: 7276562 - DNA, 22 bp, Homo sapiens
tttagtgtaattctgccttttg

SEQ ID NO: 7276563 - DNA, 22 bp, Homo sapiens
tttattgtcttcgtggtgccta

SEQ ID NO: 7276564 - DNA, 22 bp, Homo sapiens
tttattgtctatgaactgcttg

SEQ ID NO: 7276565 - DNA, 22 bp, Homo sapiens
tttattgggcctggaggatcta

SEQ ID NO: 7276566 - DNA, 22 bp, Homo sapiens
tttattgccctgtagtacagga

SEQ ID NO: 7276567 - DNA, 22 bp, Homo sapiens
tttattggatggatggatggat

SEQ ID NO: 7276568 - DNA, 22 bp, Homo sapiens
tttaacttagaagagatatcct

SEQ ID NO: 7276569 - DNA, 22 bp, Homo sapiens
tttaacatgttcaagaaacata

SEQ ID NO: 7276570 - DNA, 22 bp, Homo sapiens
ttgtttaaaagaaatcatagaa

SEQ ID NO: 7276571 - DNA, 22 bp, Homo sapiens
tttacactgcttgaacaatctc

SEQ ID NO: 7276572 - DNA, 22 bp, Homo sapiens
tttacacttgaggaaactgagg

SEQ ID NO: 7276573 - DNA, 23 bp, Homo sapiens
tttcacagcttttattctgcatc

SEQ ID NO: 7276574 - DNA, 22 bp, Homo sapiens
tttcagtgtatcttccaaaagc

SEQ ID NO: 7276575 - DNA, 22 bp, Homo sapiens
tttcagtttttgctcgatgtat

SEQ ID NO: 7276576 - DNA, 22 bp, Homo sapiens
tttcacattagatatgtcattt

SEQ ID NO: 7276577 - DNA, 22 bp, Homo sapiens
tttcacaactgcttatttgaga

SEQ ID NO: 7276578 - DNA, 22 bp, Homo sapiens
tttcaataacaaagctcatttt

SEQ ID NO: 7276579 - DNA, 20 bp, Homo sapiens
tttcaagtcagcaattctca

SEQ ID NO: 7276580 - DNA, 22 bp, Homo sapiens
tttcatctctctaaaagacagt

SEQ ID NO: 7276581 - DNA, 22 bp, Homo sapiens
tttccagggctctgtagaagaa

SEQ ID NO: 7276582 - DNA, 22 bp, Homo sapiens
tttccaggtattaatactgtat

SEQ ID NO: 7276583 - DNA, 22 bp, Homo sapiens
tttccagagggtgctcagggcg

SEQ ID NO: 7276584 - DNA, 22 bp, Homo sapiens
tttccagattaagataccactt

SEQ ID NO: 7276585 - DNA, 22 bp, Homo sapiens
tttcatctgtgctgccaagact

SEQ ID NO: 7276586 - DNA, 17 bp, Homo sapiens
tttcatctgggaccacc

SEQ ID NO: 7276587 - DNA, 22 bp, Homo sapiens
tttcccaattgagaggttctgt

SEQ ID NO: 7276588 - DNA, 22 bp, Homo sapiens
tttcccaagtgtaaacatggca

SEQ ID NO: 7276589 - DNA, 22 bp, Homo sapiens
tttcccaagaaaaataattgga

SEQ ID NO: 7276590 - DNA, 22 bp, Homo sapiens
tttccatgatcgttatagaact

SEQ ID NO: 7276591 - DNA, 22 bp, Homo sapiens
tttccatgtgtactggccagaa

SEQ ID NO: 7276592 - DNA, 22 bp, Homo sapiens
tttccatgttatcttgcagact

SEQ ID NO: 7276593 - DNA, 22 bp, Homo sapiens
tttccatgttggtgaaatgagg

SEQ ID NO: 7276594 - DNA, 22 bp, Homo sapiens
tttccatgttggtgaaatgagg

SEQ ID NO: 7276595 - DNA, 22 bp, Homo sapiens
tttccttgcctcctgtccttct

SEQ ID NO: 7276596 - DNA, 22 bp, Homo sapiens
tttccttgcacattggtttcca

SEQ ID NO: 7276597 - DNA, 22 bp, Homo sapiens
tttcccagaggtatgaataagt

SEQ ID NO: 7276598 - DNA, 20 bp, Homo sapiens
ttatgtgtacctgtgctccc

SEQ ID NO: 7276599 - DNA, 22 bp, Homo sapiens
ttatgtgtgtacatgcatatgt

SEQ ID NO: 7276600 - DNA, 22 bp, Homo sapiens
ttatgtgtgtacatgcatatgt

SEQ ID NO: 7276601 - DNA, 22 bp, Homo sapiens
tcctctccaggtgagccgaaat

SEQ ID NO: 7276602 - DNA, 22 bp, Homo sapiens
ttatttaaaagtggtaagattc

SEQ ID NO: 7276603 - DNA, 22 bp, Homo sapiens
ttatttaaaagtggtaagattc

SEQ ID NO: 7276604 - DNA, 22 bp, Homo sapiens
ttatttaatgtgatctgaagag

SEQ ID NO: 7276605 - DNA, 22 bp, Homo sapiens
ttatttaattttctcactcaga

SEQ ID NO: 7276606 - DNA, 22 bp, Homo sapiens
ttatttgtggcatatgagacga

SEQ ID NO: 7276607 - DNA, 21 bp, Homo sapiens
ttcaaaatggtgtgtttgtct

SEQ ID NO: 7276608 - DNA, 22 bp, Homo sapiens
ttcaaaattgttctaagctctg

SEQ ID NO: 7276609 - DNA, 22 bp, Homo sapiens
ttcaagatccagcacaacagtg

SEQ ID NO: 7276610 - DNA, 22 bp, Homo sapiens
ttcaagatgacccagtcacacg

SEQ ID NO: 7276611 - DNA, 22 bp, Homo sapiens
ttcagaagtagctaagcagtca

SEQ ID NO: 7276612 - DNA, 22 bp, Homo sapiens
ttcagaatatttgttttacatg

SEQ ID NO: 7276613 - DNA, 22 bp, Homo sapiens
ttcaatatgatattagctgtgg

SEQ ID NO: 7276614 - DNA, 22 bp, Homo sapiens
ttcaatatctctaagaatgagg

SEQ ID NO: 7276615 - DNA, 22 bp, Homo sapiens
ttcaatgatttttagggatcat

SEQ ID NO: 7276616 - DNA, 22 bp, Homo sapiens
ttcagacagttttcagattcat

SEQ ID NO: 7276617 - DNA, 22 bp, Homo sapiens
ttcagacacagcgctgggaaat

SEQ ID NO: 7276618 - DNA, 22 bp, Homo sapiens
ttcagaatgtgaccttatttgg

SEQ ID NO: 7276619 - DNA, 22 bp, Homo sapiens
ttcatattcaaatactctgctt

SEQ ID NO: 7276620 - DNA, 22 bp, Homo sapiens
ttcatcaatgtgtttaataatg

SEQ ID NO: 7276621 - DNA, 22 bp, Homo sapiens
ttcatagcagtccctttctggg

SEQ ID NO: 7276622 - DNA, 22 bp, Homo sapiens
ttcccagaatgaatggatggag

SEQ ID NO: 7276623 - DNA, 22 bp, Homo sapiens
ttccatgcctctatttagaatt

SEQ ID NO: 7276624 - DNA, 22 bp, Homo sapiens
ttccatgcctagaacaggattc

SEQ ID NO: 7276625 - DNA, 22 bp, Homo sapiens
ttccatgagctctgagttcaca

SEQ ID NO: 7276626 - DNA, 18 bp, Homo sapiens
ttccatgattcctttcac

SEQ ID NO: 7276627 - DNA, 22 bp, Homo sapiens
ttccatgcaagaagtatggctc

SEQ ID NO: 7276628 - DNA, 22 bp, Homo sapiens
ttccatgaaagtgaaatggagc

SEQ ID NO: 7276629 - DNA, 22 bp, Homo sapiens
ttccatgaaatgtgttatgctt

SEQ ID NO: 7276630 - DNA, 22 bp, Homo sapiens
ttccatgaaggagactgagaag

SEQ ID NO: 7276631 - DNA, 22 bp, Homo sapiens
ttccatgaaggagactgagaag

SEQ ID NO: 7276632 - DNA, 22 bp, Homo sapiens
ttccatgaagggcagcctctca

SEQ ID NO: 7276633 - DNA, 22 bp, Homo sapiens
ttccatgacaccgagggaagtc

SEQ ID NO: 7276634 - DNA, 22 bp, Homo sapiens
ttccatgactgaagcaggggcg

SEQ ID NO: 7276635 - DNA, 22 bp, Homo sapiens
ttccatgaaagtgaaatggagc

SEQ ID NO: 7276636 - DNA, 19 bp, Homo sapiens
ttcccaggaaaggggtgca

SEQ ID NO: 7276637 - DNA, 22 bp, Homo sapiens
ttccccagtagtgacaatcaaa

SEQ ID NO: 7276638 - DNA, 22 bp, Homo sapiens
ttccccagtaacatacatgtga

SEQ ID NO: 7276639 - DNA, 20 bp, Homo sapiens
ttcatcagcaaagcacagca

SEQ ID NO: 7276640 - DNA, 22 bp, Homo sapiens
ttcatcaggcatcatgctcaag

SEQ ID NO: 7276641 - DNA, 22 bp, Homo sapiens
ttccaagagctttaattgttga

SEQ ID NO: 7276642 - DNA, 22 bp, Homo sapiens
ttccaagagtaaattcaaattg

SEQ ID NO: 7276643 - DNA, 22 bp, Homo sapiens
ttccaatgacatttgttttaaa

SEQ ID NO: 7276644 - DNA, 22 bp, Homo sapiens
ttgaaaacagcgtagattcaca

SEQ ID NO: 7276645 - DNA, 22 bp, Homo sapiens
ttgaaaagcaaatgatgggtag

SEQ ID NO: 7276646 - DNA, 22 bp, Homo sapiens
ttgaaacttagaaattgagctg

SEQ ID NO: 7276647 - DNA, 22 bp, Homo sapiens
ttgaaagacttctcctgtgaaa

SEQ ID NO: 7276648 - DNA, 22 bp, Homo sapiens
ttgaaagatagtgaagccagcc

SEQ ID NO: 7276649 - DNA, 22 bp, Homo sapiens
ttgagggtctggatctgctgct

SEQ ID NO: 7276650 - DNA, 18 bp, Homo sapiens
ttgagggaggggcagagt

SEQ ID NO: 7276651 - DNA, 22 bp, Homo sapiens
ttgagactgagtctcgccctgt

SEQ ID NO: 7276652 - DNA, 22 bp, Homo sapiens
ttgagactcgagtctctcagac

SEQ ID NO: 7276653 - DNA, 22 bp, Homo sapiens
ttgagacagtggggtgttgccg

SEQ ID NO: 7276654 - DNA, 22 bp, Homo sapiens
ttgagaaggtggtcatttgcaa

SEQ ID NO: 7276655 - DNA, 22 bp, Homo sapiens
ttcttcttcatttctgacgatg

SEQ ID NO: 7276656 - DNA, 22 bp, Homo sapiens
ttcttcttcaagtgctgcattc

SEQ ID NO: 7276657 - DNA, 22 bp, Homo sapiens
ttcttcttaatgtcctgggaac

SEQ ID NO: 7276658 - DNA, 22 bp, Homo sapiens
ttcttcttgaaactttaggttg

SEQ ID NO: 7276659 - DNA, 22 bp, Homo sapiens
ttcttcttctggctgcacctgg

SEQ ID NO: 7276660 - DNA, 22 bp, Homo sapiens
ttcttcagcctaccttgacctc

SEQ ID NO: 7276661 - DNA, 22 bp, Homo sapiens
ttcttcagcctaccttgacctc

SEQ ID NO: 7276662 - DNA, 22 bp, Homo sapiens
ttcttcagcccatatcttccag

SEQ ID NO: 7276663 - DNA, 22 bp, Homo sapiens
ttctgggagagaaagggccttg

SEQ ID NO: 7276664 - DNA, 22 bp, Homo sapiens
ttcttcagactccctctttaag

SEQ ID NO: 7276665 - DNA, 22 bp, Homo sapiens
ttcttcctctgtaaaaggtgac

SEQ ID NO: 7276666 - DNA, 21 bp, Homo sapiens
ttctgggaaatgagctggggc

SEQ ID NO: 7276667 - DNA, 22 bp, Homo sapiens
ttctgggacatctggacagttt

SEQ ID NO: 7276668 - DNA, 22 bp, Homo sapiens
ttccctctcacttaaagcttgg

SEQ ID NO: 7276669 - DNA, 22 bp, Homo sapiens
ttctctttgacattattcaggt

SEQ ID NO: 7276670 - DNA, 22 bp, Homo sapiens
ttctgatgcatgggtctctgtt

SEQ ID NO: 7276671 - DNA, 20 bp, Homo sapiens
ttctgcctagggttagcctg

SEQ ID NO: 7276672 - DNA, 22 bp, Homo sapiens
ttctcttcatctcagtaaatgt

SEQ ID NO: 7276673 - DNA, 22 bp, Homo sapiens
cagagctgcaaatgcccctccg

SEQ ID NO: 7276674 - DNA, 22 bp, Homo sapiens
cagagctgagtcttcaaggttg

SEQ ID NO: 7276675 - DNA, 21 bp, Homo sapiens
gggctttttatttagcactgt

SEQ ID NO: 7276676 - DNA, 22 bp, Homo sapiens
cagagctgctcatggtggccag

SEQ ID NO: 7276677 - DNA, 22 bp, Homo sapiens
cagagctgcgctttttcctggt

SEQ ID NO: 7276678 - DNA, 22 bp, Homo sapiens
cagagctgcagattgaaggcat

SEQ ID NO: 7276679 - DNA, 22 bp, Homo sapiens
cagagcccatcctatactctcc

SEQ ID NO: 7276680 - DNA, 22 bp, Homo sapiens
gggtgccttggtgtgctgtagg

SEQ ID NO: 7276681 - DNA, 22 bp, Homo sapiens
gggtgcggtccccacagcccgt

SEQ ID NO: 7276682 - DNA, 22 bp, Homo sapiens
cagaggcttggcattatcatgc

SEQ ID NO: 7276683 - DNA, 22 bp, Homo sapiens
cagagctggtgtgtcctggcat

SEQ ID NO: 7276684 - DNA, 22 bp, Homo sapiens
cagacaggcaggtgctgctttg

SEQ ID NO: 7276685 - DNA, 22 bp, Homo sapiens
cagacaggcaggtgagagctcc

SEQ ID NO: 7276686 - DNA, 22 bp, Homo sapiens
cagacaggaattctggcgtggt

SEQ ID NO: 7276687 - DNA, 17 bp, Homo sapiens
cagacaggctgtcaccc

SEQ ID NO: 7276688 - DNA, 22 bp, Homo sapiens
cagacaggggtaaccttcctca

SEQ ID NO: 7276689 - DNA, 22 bp, Homo sapiens
cagacagggccctgtgatggta

SEQ ID NO: 7276690 - DNA, 22 bp, Homo sapiens
gggcaaggcagaagagttggag

SEQ ID NO: 7276691 - DNA, 22 bp, Homo sapiens
gggaggggttgcatgtttgagt

SEQ ID NO: 7276692 - DNA, 22 bp, Homo sapiens
gggaggggttgcatgtttgagt

SEQ ID NO: 7276693 - DNA, 22 bp, Homo sapiens
ggcttttgaattccaaggcatt

SEQ ID NO: 7276694 - DNA, 22 bp, Homo sapiens
ggcttttgctgtgttttccaga

SEQ ID NO: 7276695 - DNA, 22 bp, Homo sapiens
ggcttttgtttcagctctgcta

SEQ ID NO: 7276696 - DNA, 22 bp, Homo sapiens
cagaaggcatagatgaaggcct

SEQ ID NO: 7276697 - DNA, 22 bp, Homo sapiens
cagaagggacagggtttgtaga

SEQ ID NO: 7276698 - DNA, 22 bp, Homo sapiens
cactggcctaagcgcctcagcc

SEQ ID NO: 7276699 - DNA, 22 bp, Homo sapiens
gggtgggactgaagtctgaggg

SEQ ID NO: 7276700 - DNA, 22 bp, Homo sapiens
cagagtatccctttagaattaa

SEQ ID NO: 7276701 - DNA, 21 bp, Homo sapiens
gggtgggaggacacagcaggc

SEQ ID NO: 7276702 - DNA, 20 bp, Homo sapiens
gggtgggagagtctgagggt

SEQ ID NO: 7276703 - DNA, 22 bp, Homo sapiens
gtaaaattctagcatctgaaag

SEQ ID NO: 7276704 - DNA, 20 bp, Homo sapiens
gtaaaatatggtctttgggt

SEQ ID NO: 7276705 - DNA, 20 bp, Homo sapiens
gtaaaatatggtctttgggt

SEQ ID NO: 7276706 - DNA, 23 bp, Homo sapiens
ggttccaggaacacagcctgatg

SEQ ID NO: 7276707 - DNA, 22 bp, Homo sapiens
cagcagcagagatactggtttc

SEQ ID NO: 7276708 - DNA, 21 bp, Homo sapiens
cagcagagtaatgcattcgta

SEQ ID NO: 7276709 - DNA, 22 bp, Homo sapiens
cagcaggatttgaaaggaagag

SEQ ID NO: 7276710 - DNA, 22 bp, Homo sapiens
cagcaggaccattgaggcatca

SEQ ID NO: 7276711 - DNA, 22 bp, Homo sapiens
cagcagcctggagggggccacg

SEQ ID NO: 7276712 - DNA, 22 bp, Homo sapiens
cagcagcctggcccctcctcgg

SEQ ID NO: 7276713 - DNA, 22 bp, Homo sapiens
cagccaccatacagcagaagct

SEQ ID NO: 7276714 - DNA, 22 bp, Homo sapiens
cagccactgtggtctagctgca

SEQ ID NO: 7276715 - DNA, 20 bp, Homo sapiens
caaggcagaccagagtgagt

SEQ ID NO: 7276716 - DNA, 22 bp, Homo sapiens
caaggcagcccgctgaaccaca

SEQ ID NO: 7276717 - DNA, 20 bp, Homo sapiens
gctgtggcaaagctttgtgt

SEQ ID NO: 7276718 - DNA, 22 bp, Homo sapiens
gcttctgaggaaggctcagcct

SEQ ID NO: 7276719 - DNA, 22 bp, Homo sapiens
gcttctgacagcacctgaactt

SEQ ID NO: 7276720 - DNA, 22 bp, Homo sapiens
caatttctcgaactctaatcca

SEQ ID NO: 7276721 - DNA, 22 bp, Homo sapiens
gcttccaggtcattctcaccct

SEQ ID NO: 7276722 - DNA, 22 bp, Homo sapiens
cacaatttgttttatcagtatt

SEQ ID NO: 7276723 - DNA, 22 bp, Homo sapiens
cacaatttgttttatcagtatt

SEQ ID NO: 7276724 - DNA, 22 bp, Homo sapiens
cacaatttggtgctaaagaaag

SEQ ID NO: 7276725 - DNA, 22 bp, Homo sapiens
cacaatttgtttgctcttagtc

SEQ ID NO: 7276726 - DNA, 22 bp, Homo sapiens
cacaatttgtattttgcatcca

SEQ ID NO: 7276727 - DNA, 22 bp, Homo sapiens
cacaatttccttgcttcacttt

SEQ ID NO: 7276728 - DNA, 22 bp, Homo sapiens
cacaatttccttgcttcacttt

SEQ ID NO: 7276729 - DNA, 22 bp, Homo sapiens
cacaatttggggtgcccactgt

SEQ ID NO: 7276730 - DNA, 22 bp, Homo sapiens
cacaatttggacttcactggtt

SEQ ID NO: 7276731 - DNA, 18 bp, Homo sapiens
cacaatttacagatgaca

SEQ ID NO: 7276732 - DNA, 22 bp, Homo sapiens
cacaatttcagttgcatgcaac

SEQ ID NO: 7276733 - DNA, 22 bp, Homo sapiens
cacaatttccattgagcagcag

SEQ ID NO: 7276734 - DNA, 22 bp, Homo sapiens
cacaatttccaagtcatgttat

SEQ ID NO: 7276735 - DNA, 22 bp, Homo sapiens
cacaatgtatatgtatatcaaa

SEQ ID NO: 7276736 - DNA, 22 bp, Homo sapiens
cacaatgtggtttgtcatcttt

SEQ ID NO: 7276737 - DNA, 22 bp, Homo sapiens
caagagttgagggatgtcagtt

SEQ ID NO: 7276738 - DNA, 22 bp, Homo sapiens
caagataaagccaccagaagct

SEQ ID NO: 7276739 - DNA, 22 bp, Homo sapiens
caagaggctaaactgggctatt

SEQ ID NO: 7276740 - DNA, 22 bp, Homo sapiens
caagagctggagaggcagtcta

SEQ ID NO: 7276741 - DNA, 22 bp, Homo sapiens
caagatgaagtgaagattagaa

SEQ ID NO: 7276742 - DNA, 22 bp, Homo sapiens
caagatgaatgatgaagtgtgt

SEQ ID NO: 7276743 - DNA, 22 bp, Homo sapiens
caagatgactttgggggattaa

SEQ ID NO: 7276744 - DNA, 22 bp, Homo sapiens
caagatgacaaggctggaggct

SEQ ID NO: 7276745 - DNA, 22 bp, Homo sapiens
caagatgaggtcatactggaat

SEQ ID NO: 7276746 - DNA, 22 bp, Homo sapiens
caagatgaaattgtgatatttt

SEQ ID NO: 7276747 - DNA, 22 bp, Homo sapiens
caagatgaaactacagggagga

SEQ ID NO: 7276748 - DNA, 22 bp, Homo sapiens
caagatgtggtgggctgagttt

SEQ ID NO: 7276749 - DNA, 22 bp, Homo sapiens
caagatgtgcctaatcagacct

SEQ ID NO: 7276750 - DNA, 22 bp, Homo sapiens
caagatgatccctgaaggcagc

SEQ ID NO: 7276751 - DNA, 22 bp, Homo sapiens
gctgctggcactggagtgagcc

SEQ ID NO: 7276752 - DNA, 22 bp, Homo sapiens
gctgctggccccacatgctcca

SEQ ID NO: 7276753 - DNA, 22 bp, Homo sapiens
caagagctgcaaatagcgtgac

SEQ ID NO: 7276754 - DNA, 22 bp, Homo sapiens
gctgccttcccggaatgtcatc

SEQ ID NO: 7276755 - DNA, 20 bp, Homo sapiens
gctgccttgtcctgcttggt

SEQ ID NO: 7276756 - DNA, 22 bp, Homo sapiens
gctgcctgccttgcctggagga

SEQ ID NO: 7276757 - DNA, 22 bp, Homo sapiens
gctgccttcccaggcctttgct

SEQ ID NO: 7276758 - DNA, 22 bp, Homo sapiens
caacatataatatttgagttct

SEQ ID NO: 7276759 - DNA, 22 bp, Homo sapiens
caacatataatatttgagttct

SEQ ID NO: 7276760 - DNA, 22 bp, Homo sapiens
caacatatataaggatttacta

SEQ ID NO: 7276761 - DNA, 22 bp, Homo sapiens
caacatatgattttgtatataa

SEQ ID NO: 7276762 - DNA, 22 bp, Homo sapiens
gctgcaggtttgtctagtctgg

SEQ ID NO: 7276763 - DNA, 22 bp, Homo sapiens
caaagtatatttcatagtctca

SEQ ID NO: 7276764 - DNA, 22 bp, Homo sapiens
caaagtatgaaccagtttctct

SEQ ID NO: 7276765 - DNA, 22 bp, Homo sapiens
gctcctcttctcccactgaatg

SEQ ID NO: 7276766 - DNA, 20 bp, Homo sapiens
gctgaggtggaggaaggaga

SEQ ID NO: 7276767 - DNA, 22 bp, Homo sapiens
gctgaggtggaggaaggagacc

SEQ ID NO: 7276768 - DNA, 22 bp, Homo sapiens
gctgcagagggaggggctcgca

SEQ ID NO: 7276769 - DNA, 22 bp, Homo sapiens
ggcacaggagtcacagcatttc

SEQ ID NO: 7276770 - DNA, 22 bp, Homo sapiens
ggcacagggagccgcagttgca

SEQ ID NO: 7276771 - DNA, 22 bp, Homo sapiens
ggcacagggggctgaggactag

SEQ ID NO: 7276772 - DNA, 22 bp, Homo sapiens
ggcagagcattcgatggacctg

SEQ ID NO: 7276773 - DNA, 22 bp, Homo sapiens
ggcagagcagccccagggtttg

SEQ ID NO: 7276774 - DNA, 20 bp, Homo sapiens
ggcactggaagcacacagga

SEQ ID NO: 7276775 - DNA, 22 bp, Homo sapiens
ggcagagcttgcagtgagccga

SEQ ID NO: 7276776 - DNA, 22 bp, Homo sapiens
cacagtgtagactaataataga

SEQ ID NO: 7276777 - DNA, 22 bp, Homo sapiens
ggcagagctctggactgagaac

SEQ ID NO: 7276778 - DNA, 22 bp, Homo sapiens
ggcagagccttctggagctcgc

SEQ ID NO: 7276779 - DNA, 22 bp, Homo sapiens
ggcagcagtggctgctattgtc

SEQ ID NO: 7276780 - DNA, 22 bp, Homo sapiens
ggcagcagtggctgctattgtc

SEQ ID NO: 7276781 - DNA, 22 bp, Homo sapiens
ggcagcagttacaaatgtgcag

SEQ ID NO: 7276782 - DNA, 22 bp, Homo sapiens
cacagtgtgactgaccttcagc

SEQ ID NO: 7276783 - DNA, 22 bp, Homo sapiens
cacagtgtctgtgcttcagtgt

SEQ ID NO: 7276784 - DNA, 22 bp, Homo sapiens
cacagtgtctgtgcttcagtgt

SEQ ID NO: 7276785 - DNA, 22 bp, Homo sapiens
ggcagatggaagaggctgggtc

SEQ ID NO: 7276786 - DNA, 22 bp, Homo sapiens
cacagtgtgggcatggtgcctg

SEQ ID NO: 7276787 - DNA, 22 bp, Homo sapiens
ggcagcatctctggcagcagct

SEQ ID NO: 7276788 - DNA, 22 bp, Homo sapiens
ggcagcatatattcagtgggca

SEQ ID NO: 7276789 - DNA, 22 bp, Homo sapiens
ggatgggagcagaggacgacca

SEQ ID NO: 7276790 - DNA, 22 bp, Homo sapiens
ggatgttgattgaatggccatt

SEQ ID NO: 7276791 - DNA, 22 bp, Homo sapiens
ggatgttctggggttctcttgt

SEQ ID NO: 7276792 - DNA, 22 bp, Homo sapiens
cacagctgtatccaggagatcc

SEQ ID NO: 7276793 - DNA, 22 bp, Homo sapiens
ggaggcgatcctgggaaacacc

SEQ ID NO: 7276794 - DNA, 22 bp, Homo sapiens
ggcagccagagggcagctggat

SEQ ID NO: 7276795 - DNA, 22 bp, Homo sapiens
ggcagctgagatcatgctgttg

SEQ ID NO: 7276796 - DNA, 22 bp, Homo sapiens
ggcagctgagatcatgctgttg

SEQ ID NO: 7276797 - DNA, 22 bp, Homo sapiens
ggcagctgacctagcaccatcc

SEQ ID NO: 7276798 - DNA, 22 bp, Homo sapiens
cacccactgagctcatgtccca

SEQ ID NO: 7276799 - DNA, 22 bp, Homo sapiens
caccatttaagaaagccaaatt

SEQ ID NO: 7276800 - DNA, 22 bp, Homo sapiens
ggcagtgtccttgcagctctac

SEQ ID NO: 7276801 - DNA, 22 bp, Homo sapiens
ggcagtggttagaaacatgagc

SEQ ID NO: 7276802 - DNA, 22 bp, Homo sapiens
ggcagtgttctggttgtcagga

SEQ ID NO: 7276803 - DNA, 22 bp, Homo sapiens
ggcagtgtggcataacatgtag

SEQ ID NO: 7276804 - DNA, 22 bp, Homo sapiens
caccccagcttctcaggataga

SEQ ID NO: 7276805 - DNA, 22 bp, Homo sapiens
ggcagttgttggccacgggtgg

SEQ ID NO: 7276806 - DNA, 22 bp, Homo sapiens
cacccaggctggaatgcagtgg

SEQ ID NO: 7276807 - DNA, 22 bp, Homo sapiens
ggcatcagcccggtcctgggct

SEQ ID NO: 7276808 - DNA, 22 bp, Homo sapiens
cactgagctgatagaattccag

SEQ ID NO: 7276809 - DNA, 21 bp, Homo sapiens
cactggaattttctgtgacat

SEQ ID NO: 7276810 - DNA, 22 bp, Homo sapiens
atcttgatcaaggctatcatga

SEQ ID NO: 7276811 - DNA, 22 bp, Homo sapiens
cttttattttgaattaagggct

SEQ ID NO: 7276812 - DNA, 22 bp, Homo sapiens
cttttattttgaattaagggct

SEQ ID NO: 7276813 - DNA, 22 bp, Homo sapiens
atgaaatggtggttttccattt

SEQ ID NO: 7276814 - DNA, 22 bp, Homo sapiens
cttgctcattaagtagctcaca

SEQ ID NO: 7276815 - DNA, 22 bp, Homo sapiens
cttgatctacatagtgaaaccc

SEQ ID NO: 7276816 - DNA, 22 bp, Homo sapiens
cttgatctacatagtgaaaccc

SEQ ID NO: 7276817 - DNA, 22 bp, Homo sapiens
cttgcctgggactgaggcattt

SEQ ID NO: 7276818 - DNA, 22 bp, Homo sapiens
atctacccactgaacacaatat

SEQ ID NO: 7276819 - DNA, 22 bp, Homo sapiens
atctagattaggtataagagct

SEQ ID NO: 7276820 - DNA, 22 bp, Homo sapiens
cttggcagctacacaggtaaga

SEQ ID NO: 7276821 - DNA, 20 bp, Homo sapiens
atcttcttggccagcttgct

SEQ ID NO: 7276822 - DNA, 22 bp, Homo sapiens
cttgtaatggcagagacctgtc

SEQ ID NO: 7276823 - DNA, 22 bp, Homo sapiens
atgagtatatgatatggtttgg

SEQ ID NO: 7276824 - DNA, 22 bp, Homo sapiens
atgaggtcacagtgtttggcat

SEQ ID NO: 7276825 - DNA, 22 bp, Homo sapiens
atgaggtcatcttgaagtaggg

SEQ ID NO: 7276826 - DNA, 22 bp, Homo sapiens
atgaggtcatcctggagtaagg

SEQ ID NO: 7276827 - DNA, 23 bp, Homo sapiens
atgaggtcagccataagacggaa

SEQ ID NO: 7276828 - DNA, 22 bp, Homo sapiens
atgaggtcttattgcagtagtt

SEQ ID NO: 7276829 - DNA, 22 bp, Homo sapiens
atgaggtctggcaatcagaaac

SEQ ID NO: 7276830 - DNA, 22 bp, Homo sapiens
atgaggtccagggaagttaaat

SEQ ID NO: 7276831 - DNA, 22 bp, Homo sapiens
atgaggtcattcttggattaca

SEQ ID NO: 7276832 - DNA, 17 bp, Homo sapiens
atgaggtcattaagata

SEQ ID NO: 7276833 - DNA, 22 bp, Homo sapiens
atgagtgtgaagttagctcagt

SEQ ID NO: 7276834 - DNA, 22 bp, Homo sapiens
atgagttcatactttcagtacc

SEQ ID NO: 7276835 - DNA, 22 bp, Homo sapiens
atgagcttccagacaaaggcat

SEQ ID NO: 7276836 - DNA, 19 bp, Homo sapiens
gaaagatttcagttgagga

SEQ ID NO: 7276837 - DNA, 20 bp, Homo sapiens
atgcaaactcacaaaatacc

SEQ ID NO: 7276838 - DNA, 22 bp, Homo sapiens
atgcaaaataaggcagaaacat

SEQ ID NO: 7276839 - DNA, 22 bp, Homo sapiens
atgcaaaagtaattgcaatttt

SEQ ID NO: 7276840 - DNA, 22 bp, Homo sapiens
atgcaaagcaccacactaagat

SEQ ID NO: 7276841 - DNA, 22 bp, Homo sapiens
atgcagctgtcagggagaacat

SEQ ID NO: 7276842 - DNA, 22 bp, Homo sapiens
atgcagctgtgggcaagaaatg

SEQ ID NO: 7276843 - DNA, 22 bp, Homo sapiens
atgcatctatgacttagacatt

SEQ ID NO: 7276844 - DNA, 22 bp, Homo sapiens
atgcatgcagggaagacagtag

SEQ ID NO: 7276845 - DNA, 22 bp, Homo sapiens
atgcatgaaagaatccaagcct

SEQ ID NO: 7276846 - DNA, 22 bp, Homo sapiens
gaggctgctttgatgacaggag

SEQ ID NO: 7276847 - DNA, 22 bp, Homo sapiens
atgtgtcatttttctgtgcata

SEQ ID NO: 7276848 - DNA, 22 bp, Homo sapiens
gaggggaagacttctggacagt

SEQ ID NO: 7276849 - DNA, 22 bp, Homo sapiens
gaggggagacagggaaatcagt

SEQ ID NO: 7276850 - DNA, 22 bp, Homo sapiens
atgtgtgtatatatagtcattt

SEQ ID NO: 7276851 - DNA, 22 bp, Homo sapiens
atgtgtgtatatatagtcattt

SEQ ID NO: 7276852 - DNA, 22 bp, Homo sapiens
atgtgtgtgcatttctctccct

SEQ ID NO: 7276853 - DNA, 22 bp, Homo sapiens
atgtcttttatgattacgggat

SEQ ID NO: 7276854 - DNA, 22 bp, Homo sapiens
atgtctttgccatagttcatat

SEQ ID NO: 7276855 - DNA, 22 bp, Homo sapiens
gaggctgctgttagccctgggc

SEQ ID NO: 7276856 - DNA, 22 bp, Homo sapiens
gaggctgccccttcctcagctg

SEQ ID NO: 7276857 - DNA, 22 bp, Homo sapiens
atgtctttattaatatcatgcc

SEQ ID NO: 7276858 - DNA, 22 bp, Homo sapiens
atgtctttcaaattctgcctag

SEQ ID NO: 7276859 - DNA, 18 bp, Homo sapiens
atgtacatttgctaaagc

SEQ ID NO: 7276860 - DNA, 22 bp, Homo sapiens
atgtacatttagatcatttctg

SEQ ID NO: 7276861 - DNA, 19 bp, Homo sapiens
atgtacccagtgtcaatcc

SEQ ID NO: 7276862 - DNA, 17 bp, Homo sapiens
gaggagctccagtaggt

SEQ ID NO: 7276863 - DNA, 22 bp, Homo sapiens
gaggccagggatgcaatgagag

SEQ ID NO: 7276864 - DNA, 22 bp, Homo sapiens
gaggccaggggcctggagatga

SEQ ID NO: 7276865 - DNA, 22 bp, Homo sapiens
gaggagctgggctgagagggtc

SEQ ID NO: 7276866 - DNA, 22 bp, Homo sapiens
gaggagctggctgtcgggaggc

SEQ ID NO: 7276867 - DNA, 22 bp, Homo sapiens
gaggagctgggtcagggagaca

SEQ ID NO: 7276868 - DNA, 22 bp, Homo sapiens
gagctggggcagcttaggagtg

SEQ ID NO: 7276869 - DNA, 23 bp, Homo sapiens
atggtcagaattttccagctgag

SEQ ID NO: 7276870 - DNA, 22 bp, Homo sapiens
atggctggaggccgggcttcct

SEQ ID NO: 7276871 - DNA, 22 bp, Homo sapiens
atgggttcaagtgattctcctg

SEQ ID NO: 7276872 - DNA, 22 bp, Homo sapiens
atggacatttgagttatttcca

SEQ ID NO: 7276873 - DNA, 22 bp, Homo sapiens
atggacagtgtgaagcagatag

SEQ ID NO: 7276874 - DNA, 22 bp, Homo sapiens
atggaatgtgaacatgatggca

SEQ ID NO: 7276875 - DNA, 22 bp, Homo sapiens
atggaatggcctgtcataatct

SEQ ID NO: 7276876 - DNA, 21 bp, Homo sapiens
atggaaattggcaaatgctac

SEQ ID NO: 7276877 - DNA, 22 bp, Homo sapiens
atggaaatgttccatatattga

SEQ ID NO: 7276878 - DNA, 22 bp, Homo sapiens
atggaaatgttaagtcagtccg

SEQ ID NO: 7276879 - DNA, 22 bp, Homo sapiens
atggaaattaagatttgtctca

SEQ ID NO: 7276880 - DNA, 22 bp, Homo sapiens
atggaaatgtaacttctgattc

SEQ ID NO: 7276881 - DNA, 22 bp, Homo sapiens
atggaaatgatggaacattaaa

SEQ ID NO: 7276882 - DNA, 22 bp, Homo sapiens
atggaaaaggctgatttcatta

SEQ ID NO: 7276883 - DNA, 22 bp, Homo sapiens
gacagaggtgtccttgagtcca

SEQ ID NO: 7276884 - DNA, 22 bp, Homo sapiens
gacagaggctggagcacctcct

SEQ ID NO: 7276885 - DNA, 22 bp, Homo sapiens
gagaggaagccagggggtgttg

SEQ ID NO: 7276886 - DNA, 22 bp, Homo sapiens
gagagctgtccggctgagcagc

SEQ ID NO: 7276887 - DNA, 22 bp, Homo sapiens
atggcagttgtatgggctgtat

SEQ ID NO: 7276888 - DNA, 22 bp, Homo sapiens
gagaacagatttttctgctgtc

SEQ ID NO: 7276889 - DNA, 22 bp, Homo sapiens
atggcagggcacagctctagtt

SEQ ID NO: 7276890 - DNA, 22 bp, Homo sapiens
atggcagggcagcctctcagag

SEQ ID NO: 7276891 - DNA, 22 bp, Homo sapiens
atggcagtgacttgaagggtag

SEQ ID NO: 7276892 - DNA, 22 bp, Homo sapiens
atggcagtcagagacaggcaga

SEQ ID NO: 7276893 - DNA, 22 bp, Homo sapiens
gagcagtgactggagcatgaga

SEQ ID NO: 7276894 - DNA, 22 bp, Homo sapiens
atggccagtctgttggacagca

SEQ ID NO: 7276895 - DNA, 22 bp, Homo sapiens
gagccagctatgtagcaagagg

SEQ ID NO: 7276896 - DNA, 22 bp, Homo sapiens
attattgttttaatagtagaga

SEQ ID NO: 7276897 - DNA, 22 bp, Homo sapiens
attatttatcctcttggtctat

SEQ ID NO: 7276898 - DNA, 22 bp, Homo sapiens
attctcaaaacataacttcact

SEQ ID NO: 7276899 - DNA, 22 bp, Homo sapiens
attctattaatatttctaggaa

SEQ ID NO: 7276900 - DNA, 22 bp, Homo sapiens
attctgtgtgtactgagatggg

SEQ ID NO: 7276901 - DNA, 22 bp, Homo sapiens
attcttaattgccatgctgtat

SEQ ID NO: 7276902 - DNA, 22 bp, Homo sapiens
attcttattatagtaaaacagt

SEQ ID NO: 7276903 - DNA, 22 bp, Homo sapiens
attcttacaaagcagagtctgt

SEQ ID NO: 7276904 - DNA, 22 bp, Homo sapiens
attcttcacacctgttcctgtt

SEQ ID NO: 7276905 - DNA, 22 bp, Homo sapiens
attcttcacaaatatatagaag

SEQ ID NO: 7276906 - DNA, 22 bp, Homo sapiens
attcttatttaaatagagtctg

SEQ ID NO: 7276907 - DNA, 22 bp, Homo sapiens
attcttcaaagagtgtcaaagt

SEQ ID NO: 7276908 - DNA, 22 bp, Homo sapiens
attcttcacatggataggatct

SEQ ID NO: 7276909 - DNA, 22 bp, Homo sapiens
attcttcacataagtgctgtac

SEQ ID NO: 7276910 - DNA, 22 bp, Homo sapiens
attcttcaccatggataatttg

SEQ ID NO: 7276911 - DNA, 22 bp, Homo sapiens
attcttcacctgagtcagtcta

SEQ ID NO: 7276912 - DNA, 22 bp, Homo sapiens
attcttcactgtttcagaatga

SEQ ID NO: 7276913 - DNA, 22 bp, Homo sapiens
attgcagaacatgaggtcttct

SEQ ID NO: 7276914 - DNA, 22 bp, Homo sapiens
attgacaggagagcttggagtg

SEQ ID NO: 7276915 - DNA, 22 bp, Homo sapiens
attgaagattaaatgcttcctt

SEQ ID NO: 7276916 - DNA, 22 bp, Homo sapiens
attcttcagcaggggacactat

SEQ ID NO: 7276917 - DNA, 22 bp, Homo sapiens
attcttcagcaggggacactat

SEQ ID NO: 7276918 - DNA, 22 bp, Homo sapiens
attcttcagaatatctggcact

SEQ ID NO: 7276919 - DNA, 22 bp, Homo sapiens
attgaaaaatgactattgctta

SEQ ID NO: 7276920 - DNA, 22 bp, Homo sapiens
gcaaggctgacctctctagact

SEQ ID NO: 7276921 - DNA, 22 bp, Homo sapiens
gcaaggctgagcacatttgcat

SEQ ID NO: 7276922 - DNA, 22 bp, Homo sapiens
gcaaggctgctgccacccatct

SEQ ID NO: 7276923 - DNA, 22 bp, Homo sapiens
gcaaggctgcccacttcaaaag

SEQ ID NO: 7276924 - DNA, 22 bp, Homo sapiens
gcaaggctgggagatgaggcct

SEQ ID NO: 7276925 - DNA, 22 bp, Homo sapiens
gcaaggctggtggtggtgaagt

SEQ ID NO: 7276926 - DNA, 22 bp, Homo sapiens
gcaactttagaaaaatctataa

SEQ ID NO: 7276927 - DNA, 22 bp, Homo sapiens
attaatatcctgctggctaaat

SEQ ID NO: 7276928 - DNA, 22 bp, Homo sapiens
attaagatgtgggaaaatttaa

SEQ ID NO: 7276929 - DNA, 22 bp, Homo sapiens
gatgatgctctagtggagtttt

SEQ ID NO: 7276930 - DNA, 22 bp, Homo sapiens
attaattttacctttgtaaaca

SEQ ID NO: 7276931 - DNA, 22 bp, Homo sapiens
attattcttatgtcatcatggc

SEQ ID NO: 7276932 - DNA, 20 bp, Homo sapiens
attattcatacatgtgtgac

SEQ ID NO: 7276933 - DNA, 22 bp, Homo sapiens
attattcaatgttatttcagtg

SEQ ID NO: 7276934 - DNA, 21 bp, Homo sapiens
gcaaggcttttgtgtttccca

SEQ ID NO: 7276935 - DNA, 22 bp, Homo sapiens
gcaaggctgttgctgctgcaag

SEQ ID NO: 7276936 - DNA, 22 bp, Homo sapiens
gcaaggctgtgcactttgcatt

SEQ ID NO: 7276937 - DNA, 22 bp, Homo sapiens
gcaaggctttgtgaattttaaa

SEQ ID NO: 7276938 - DNA, 22 bp, Homo sapiens
atgtttttaaatagacttacag

SEQ ID NO: 7276939 - DNA, 22 bp, Homo sapiens
atgttttattaccaacttgtac

SEQ ID NO: 7276940 - DNA, 22 bp, Homo sapiens
atgtgtttataattactcaatc

SEQ ID NO: 7276941 - DNA, 22 bp, Homo sapiens
atgtgtttggttatatggtatt

SEQ ID NO: 7276942 - DNA, 22 bp, Homo sapiens
atgtgtttgtacctttaaatat

SEQ ID NO: 7276943 - DNA, 22 bp, Homo sapiens
atgtgttttggtggatcattca

SEQ ID NO: 7276944 - DNA, 22 bp, Homo sapiens
atgtgttttggtaatttctgct

SEQ ID NO: 7276945 - DNA, 22 bp, Homo sapiens
atgtgttttggtaatttctgct

SEQ ID NO: 7276946 - DNA, 22 bp, Homo sapiens
atgtgtgtgtttaatcctcaaa

SEQ ID NO: 7276947 - DNA, 22 bp, Homo sapiens
attaaatactgcaggctaagca

SEQ ID NO: 7276948 - DNA, 22 bp, Homo sapiens
attaaaattccaaggtatgcca

SEQ ID NO: 7276949 - DNA, 22 bp, Homo sapiens
atgtttttggcttcaagtttct

SEQ ID NO: 7276950 - DNA, 22 bp, Homo sapiens
atgtttttggaaatgggaacat

SEQ ID NO: 7276951 - DNA, 22 bp, Homo sapiens
atgtttttgagatacaaacaga

SEQ ID NO: 7276952 - DNA, 22 bp, Homo sapiens
atgtttttcataccagtgttgg

SEQ ID NO: 7276953 - DNA, 22 bp, Homo sapiens
attaaatgttggcatattttgt

SEQ ID NO: 7276954 - DNA, 23 bp, Homo sapiens
atttctaggggattttctggtgc

SEQ ID NO: 7276955 - DNA, 22 bp, Homo sapiens
atttccttgcaagtttctgtaa

SEQ ID NO: 7276956 - DNA, 20 bp, Homo sapiens
atttcagtgtttgcaatttc

SEQ ID NO: 7276957 - DNA, 22 bp, Homo sapiens
atttcaggtacctgtgggatcc

SEQ ID NO: 7276958 - DNA, 21 bp, Homo sapiens
atttcagagcacacaagtaaa

SEQ ID NO: 7276959 - DNA, 22 bp, Homo sapiens
atttcagatgaccaaatggaaa

SEQ ID NO: 7276960 - DNA, 22 bp, Homo sapiens
atttcagattcagaaatgtagg

SEQ ID NO: 7276961 - DNA, 22 bp, Homo sapiens
atttattgagacttaacaaccc

SEQ ID NO: 7276962 - DNA, 22 bp, Homo sapiens
atttattgagagggaggggaat

SEQ ID NO: 7276963 - DNA, 22 bp, Homo sapiens
atttattgagagggaggggaat

SEQ ID NO: 7276964 - DNA, 22 bp, Homo sapiens
atttattgagcctttcctatgt

SEQ ID NO: 7276965 - DNA, 22 bp, Homo sapiens
atttattgagagggaggggaat

SEQ ID NO: 7276966 - DNA, 22 bp, Homo sapiens
atttattgagacttaacaaccc

SEQ ID NO: 7276967 - DNA, 22 bp, Homo sapiens
atttattggtttgcatggtgaa

SEQ ID NO: 7276968 - DNA, 22 bp, Homo sapiens
atttattggatgcttacttggg

SEQ ID NO: 7276969 - DNA, 22 bp, Homo sapiens
atttattgagcctttcctatgt

SEQ ID NO: 7276970 - DNA, 22 bp, Homo sapiens
atttattggatgcttacttggg

SEQ ID NO: 7276971 - DNA, 22 bp, Homo sapiens
attggaaatacagtagaaaaat

SEQ ID NO: 7276972 - DNA, 22 bp, Homo sapiens
atttaatttgtgtctttagctg

SEQ ID NO: 7276973 - DNA, 22 bp, Homo sapiens
atttaatttatagatgtggata

SEQ ID NO: 7276974 - DNA, 22 bp, Homo sapiens
attggcagaaacagcagggcca

SEQ ID NO: 7276975 - DNA, 22 bp, Homo sapiens
attggcaggaaccgaggagggg

SEQ ID NO: 7276976 - DNA, 22 bp, Homo sapiens
atttaatttacatttgacagag

SEQ ID NO: 7276977 - DNA, 22 bp, Homo sapiens
gccaggagggaaaggacaattt

SEQ ID NO: 7276978 - DNA, 22 bp, Homo sapiens
gccaggaggcttaactggacag

SEQ ID NO: 7276979 - DNA, 22 bp, Homo sapiens
gccaggaggggagagtgtgtca

SEQ ID NO: 7276980 - DNA, 19 bp, Homo sapiens
gccaggagggctctggctg

SEQ ID NO: 7276981 - DNA, 22 bp, Homo sapiens
atttacagaaacttaatcatag

SEQ ID NO: 7276982 - DNA, 22 bp, Homo sapiens
gccaggagtgtgtggctatgtt

SEQ ID NO: 7276983 - DNA, 22 bp, Homo sapiens
gccaggagtgtcccactcattt

SEQ ID NO: 7276984 - DNA, 22 bp, Homo sapiens
gccaggaggtcagcccctcaac

SEQ ID NO: 7276985 - DNA, 17 bp, Homo sapiens
gccaggaggtttgagct

SEQ ID NO: 7276986 - DNA, 23 bp, Homo sapiens
gccaggagtgggtagactaatgc

SEQ ID NO: 7276987 - DNA, 21 bp, Homo sapiens
gccaggagtagattacattta

SEQ ID NO: 7276988 - DNA, 20 bp, Homo sapiens
gccaggagggtgtgatgagc

SEQ ID NO: 7276989 - DNA, 22 bp, Homo sapiens
caaaccttgcagaactgggcag

SEQ ID NO: 7276990 - DNA, 17 bp, Homo sapiens
gcgcagctcctggcgcg

SEQ ID NO: 7276991 - DNA, 22 bp, Homo sapiens
gcgcaccacctccaggtggccg

SEQ ID NO: 7276992 - DNA, 22 bp, Homo sapiens
gcgagtgccgagagggcagggc

SEQ ID NO: 7276993 - DNA, 22 bp, Homo sapiens
gcctgtcctatacaggcggctg

SEQ ID NO: 7276994 - DNA, 22 bp, Homo sapiens
gcctctctctacccagtatgat

SEQ ID NO: 7276995 - DNA, 18 bp, Homo sapiens
gcctgctctgctctcccc

SEQ ID NO: 7276996 - DNA, 22 bp, Homo sapiens
gcctgctctggaatccatgtaa

SEQ ID NO: 7276997 - DNA, 22 bp, Homo sapiens
gcctgctggaggagcctcaggg

SEQ ID NO: 7276998 - DNA, 22 bp, Homo sapiens
gcctggagctcatgtgggcatt

SEQ ID NO: 7276999 - DNA, 22 bp, Homo sapiens
gcctggagctcggctgagggcg

SEQ ID NO: 7277000 - DNA, 22 bp, Homo sapiens
gcctccacttttgctggcttct

SEQ ID NO: 7277001 - DNA, 21 bp, Homo sapiens
gcctctccaaatcctgccttc

SEQ ID NO: 7277002 - DNA, 22 bp, Homo sapiens
gcctccccaaagtgctgacagc

SEQ ID NO: 7277003 - DNA, 22 bp, Homo sapiens
agtgctggcccatagctgctgg

SEQ ID NO: 7277004 - DNA, 22 bp, Homo sapiens
agtgctgggctatctactgcta

SEQ ID NO: 7277005 - DNA, 22 bp, Homo sapiens
ctctcctttgaagcaactgtat

SEQ ID NO: 7277006 - DNA, 17 bp, Homo sapiens
ctctccttcctctgagg

SEQ ID NO: 7277007 - DNA, 22 bp, Homo sapiens
ctctctatggatgcagtttttc

SEQ ID NO: 7277008 - DNA, 22 bp, Homo sapiens
agtgctggagggaggcaggttc

SEQ ID NO: 7277009 - DNA, 22 bp, Homo sapiens
agtgctggattacaggcgtgag

SEQ ID NO: 7277010 - DNA, 23 bp, Homo sapiens
agtgctgaattgaaagctccagg

SEQ ID NO: 7277011 - DNA, 22 bp, Homo sapiens
agtgctatcgagttctaatgct

SEQ ID NO: 7277012 - DNA, 22 bp, Homo sapiens
ctccagagagtccagctctggg

SEQ ID NO: 7277013 - DNA, 22 bp, Homo sapiens
agtgctgactctgggcacagtg

SEQ ID NO: 7277014 - DNA, 22 bp, Homo sapiens
agtgctgagtgattgcaaagga

SEQ ID NO: 7277015 - DNA, 23 bp, Homo sapiens
agtgctggagaagcttctggctt

SEQ ID NO: 7277016 - DNA, 22 bp, Homo sapiens
ctcgcatgccctgcctcatcca

SEQ ID NO: 7277017 - DNA, 22 bp, Homo sapiens
ctcgcaagtcgctccggttact

SEQ ID NO: 7277018 - DNA, 22 bp, Homo sapiens
ctccttctgggcctggcagtgg

SEQ ID NO: 7277019 - DNA, 22 bp, Homo sapiens
ctccttctgggcctggcagtgg

SEQ ID NO: 7277020 - DNA, 22 bp, Homo sapiens
ctcctgcatgctcacatatgcc

SEQ ID NO: 7277021 - DNA, 22 bp, Homo sapiens
ctcttcttggcccccatgaggg

SEQ ID NO: 7277022 - DNA, 22 bp, Homo sapiens
ctcttagtaatgccatgaagca

SEQ ID NO: 7277023 - DNA, 22 bp, Homo sapiens
ctcttcttgtctctggttagaa

SEQ ID NO: 7277024 - DNA, 22 bp, Homo sapiens
ctcttctttagtccagaccatc

SEQ ID NO: 7277025 - DNA, 22 bp, Homo sapiens
ctctgtcctccacctgctttca

SEQ ID NO: 7277026 - DNA, 22 bp, Homo sapiens
ctctgtcctccacctgctttca

SEQ ID NO: 7277027 - DNA, 22 bp, Homo sapiens
ctctgtcccagacccacctctc

SEQ ID NO: 7277028 - DNA, 22 bp, Homo sapiens
ctctgtcccagacccacctctc

SEQ ID NO: 7277029 - DNA, 22 bp, Homo sapiens
ctctgtctatcccattctgtgc

SEQ ID NO: 7277030 - DNA, 22 bp, Homo sapiens
ctctgtccttgcacagttccta

SEQ ID NO: 7277031 - DNA, 22 bp, Homo sapiens
ctctgtgagggtctgtacagaa

SEQ ID NO: 7277032 - DNA, 22 bp, Homo sapiens
ctctgtatagaaaggaaacatt

SEQ ID NO: 7277033 - DNA, 22 bp, Homo sapiens
ctctgtcaggctgcagatgctc

SEQ ID NO: 7277034 - DNA, 22 bp, Homo sapiens
ctcaaagagccaggtaatcacc

SEQ ID NO: 7277035 - DNA, 21 bp, Homo sapiens
ctcaaagaccaaaagtgtaga

SEQ ID NO: 7277036 - DNA, 23 bp, Homo sapiens
ctcaacatccattcttgcccttc

SEQ ID NO: 7277037 - DNA, 22 bp, Homo sapiens
ctcaaatccccgttcctcattc

SEQ ID NO: 7277038 - DNA, 23 bp, Homo sapiens
ctcaaccctagtaagggagtagg

SEQ ID NO: 7277039 - DNA, 22 bp, Homo sapiens
cgggtcacctatcaattttgtg

SEQ ID NO: 7277040 - DNA, 22 bp, Homo sapiens
cgggttcacgccattctcctgc

SEQ ID NO: 7277041 - DNA, 22 bp, Homo sapiens
cgggttcacgccattctcctgc

SEQ ID NO: 7277042 - DNA, 22 bp, Homo sapiens
cgggttcacgccattctcctgc

SEQ ID NO: 7277043 - DNA, 22 bp, Homo sapiens
ctcagaagaacaaaggctctac

SEQ ID NO: 7277044 - DNA, 22 bp, Homo sapiens
ctcagaagctctgctcctttgc

SEQ ID NO: 7277045 - DNA, 22 bp, Homo sapiens
ctcagacatttgtagaaagtgc

SEQ ID NO: 7277046 - DNA, 22 bp, Homo sapiens
ctcagcaagattaagcagcttg

SEQ ID NO: 7277047 - DNA, 22 bp, Homo sapiens
ctcagcaaccctagaacatttg

SEQ ID NO: 7277048 - DNA, 22 bp, Homo sapiens
ctcagcaacccacacacggtct

SEQ ID NO: 7277049 - DNA, 22 bp, Homo sapiens
ctcagccccagcccagatagca

SEQ ID NO: 7277050 - DNA, 22 bp, Homo sapiens
ctcagctccagccctcagcagc

SEQ ID NO: 7277051 - DNA, 22 bp, Homo sapiens
agtctcagccacacagacctat

SEQ ID NO: 7277052 - DNA, 22 bp, Homo sapiens
ctccactctggggtgggtgaga

SEQ ID NO: 7277053 - DNA, 22 bp, Homo sapiens
ctccactcaccgaggcagagca

SEQ ID NO: 7277054 - DNA, 22 bp, Homo sapiens
ctccactcaggtgcttaagttg

SEQ ID NO: 7277055 - DNA, 22 bp, Homo sapiens
ctcagtgtgaatgctcagtaaa

SEQ ID NO: 7277056 - DNA, 22 bp, Homo sapiens
aggtgctgtttgtcagcagttt

SEQ ID NO: 7277057 - DNA, 22 bp, Homo sapiens
aggtgctgtgctatgcacttgt

SEQ ID NO: 7277058 - DNA, 22 bp, Homo sapiens
cgaggcagacaaaagttggaag

SEQ ID NO: 7277059 - DNA, 18 bp, Homo sapiens
cgaggcaggcggatcacg

SEQ ID NO: 7277060 - DNA, 22 bp, Homo sapiens
cgaggcaggcaggcggaggata

SEQ ID NO: 7277061 - DNA, 22 bp, Homo sapiens
cgaggcagaggctgaaacggct

SEQ ID NO: 7277062 - DNA, 22 bp, Homo sapiens
cgaggcagggaagctgcaaaag

SEQ ID NO: 7277063 - DNA, 22 bp, Homo sapiens
agtatattgctcttaatcatag

SEQ ID NO: 7277064 - DNA, 22 bp, Homo sapiens
agtatatgccagagagatagct

SEQ ID NO: 7277065 - DNA, 22 bp, Homo sapiens
cggctcactgcagctccgcctc

SEQ ID NO: 7277066 - DNA, 22 bp, Homo sapiens
cggctcactgcagctccgcctc

SEQ ID NO: 7277067 - DNA, 22 bp, Homo sapiens
cggaggggatacattttctgaa

SEQ ID NO: 7277068 - DNA, 22 bp, Homo sapiens
cggccaagccggggccccgaag

SEQ ID NO: 7277069 - DNA, 22 bp, Homo sapiens
cggaggggtttgaacagaggag

SEQ ID NO: 7277070 - DNA, 22 bp, Homo sapiens
cggaggggtttgaacagaggag

SEQ ID NO: 7277071 - DNA, 22 bp, Homo sapiens
cggaggggatacattttctgaa

SEQ ID NO: 7277072 - DNA, 20 bp, Homo sapiens
agggtgagacatgagcctcc

SEQ ID NO: 7277073 - DNA, 22 bp, Homo sapiens
cctggctggatggagcccctgg

SEQ ID NO: 7277074 - DNA, 22 bp, Homo sapiens
cctggctggactggaccgtggc

SEQ ID NO: 7277075 - DNA, 22 bp, Homo sapiens
cctgctctgccaagtcctcttt

SEQ ID NO: 7277076 - DNA, 22 bp, Homo sapiens
cctgctctggtttagtcagtct

SEQ ID NO: 7277077 - DNA, 22 bp, Homo sapiens
cctgctctaaatctcatggaac

SEQ ID NO: 7277078 - DNA, 20 bp, Homo sapiens
cctgctgagccagtgtgagg

SEQ ID NO: 7277079 - DNA, 22 bp, Homo sapiens
atatgcaagcacatagaatact

SEQ ID NO: 7277080 - DNA, 22 bp, Homo sapiens
ctgggcaggatacttcatggga

SEQ ID NO: 7277081 - DNA, 22 bp, Homo sapiens
ctgggcagtggtggcatctttg

SEQ ID NO: 7277082 - DNA, 22 bp, Homo sapiens
ctgggcagtggtggcatctttg

SEQ ID NO: 7277083 - DNA, 22 bp, Homo sapiens
ctgggcagtggtggcccttccc

SEQ ID NO: 7277084 - DNA, 22 bp, Homo sapiens
atatggcagaccaattagaagc

SEQ ID NO: 7277085 - DNA, 22 bp, Homo sapiens
atatgacagaatgtgtgtgtat

SEQ ID NO: 7277086 - DNA, 22 bp, Homo sapiens
atatgagtttcccacttctgga

SEQ ID NO: 7277087 - DNA, 22 bp, Homo sapiens
atatgacataaaatcatttttg

SEQ ID NO: 7277088 - DNA, 22 bp, Homo sapiens
atatatcatgagtaaaacttga

SEQ ID NO: 7277089 - DNA, 22 bp, Homo sapiens
atatgtatgtacgcacatattc

SEQ ID NO: 7277090 - DNA, 22 bp, Homo sapiens
atatgtattgagtgccaactgt

SEQ ID NO: 7277091 - DNA, 23 bp, Homo sapiens
atatgtcatgcaccagcacttta

SEQ ID NO: 7277092 - DNA, 22 bp, Homo sapiens
atatgtgtatggatttctatct

SEQ ID NO: 7277093 - DNA, 22 bp, Homo sapiens
atatgtgtgtatttcttactag

SEQ ID NO: 7277094 - DNA, 22 bp, Homo sapiens
atataatacaacctgctaagtg

SEQ ID NO: 7277095 - DNA, 22 bp, Homo sapiens
ctgggaagggagtcaagatact

SEQ ID NO: 7277096 - DNA, 22 bp, Homo sapiens
ctgggtaagttcctaaggctca

SEQ ID NO: 7277097 - DNA, 22 bp, Homo sapiens
ctgggtcccacagcctgctggg

SEQ ID NO: 7277098 - DNA, 22 bp, Homo sapiens
ctgggtcctggtgctgagttct

SEQ ID NO: 7277099 - DNA, 22 bp, Homo sapiens
ctgtgcacttctctttatttgt

SEQ ID NO: 7277100 - DNA, 22 bp, Homo sapiens
ctgtctctgtcttaactcccag

SEQ ID NO: 7277101 - DNA, 22 bp, Homo sapiens
atccctgccctcatggagctta

SEQ ID NO: 7277102 - DNA, 17 bp, Homo sapiens
atccccagcatctagaa

SEQ ID NO: 7277103 - DNA, 22 bp, Homo sapiens
atccccagactttagatttctc

SEQ ID NO: 7277104 - DNA, 22 bp, Homo sapiens
atccccagggagtgagctgtct

SEQ ID NO: 7277105 - DNA, 22 bp, Homo sapiens
atccccaggggcattcaagctt

SEQ ID NO: 7277106 - DNA, 22 bp, Homo sapiens
atcattctattgttgagctgcc

SEQ ID NO: 7277107 - DNA, 22 bp, Homo sapiens
atcattctagtccttatggtct

SEQ ID NO: 7277108 - DNA, 22 bp, Homo sapiens
ataatatttgcattactgtgat

SEQ ID NO: 7277109 - DNA, 22 bp, Homo sapiens
ataatatttgcattactgtgat

SEQ ID NO: 7277110 - DNA, 22 bp, Homo sapiens
ctgcttgacctgttgttctcac

SEQ ID NO: 7277111 - DNA, 22 bp, Homo sapiens
atacaactttatctgtaatgag

SEQ ID NO: 7277112 - DNA, 22 bp, Homo sapiens
ctgctctgctgatcagtgtctc

SEQ ID NO: 7277113 - DNA, 22 bp, Homo sapiens
ataaatcagttagtgccccact

SEQ ID NO: 7277114 - DNA, 18 bp, Homo sapiens
ctgcccagagcacttgtg

SEQ ID NO: 7277115 - DNA, 22 bp, Homo sapiens
ctgcccagaagccagatgggca

SEQ ID NO: 7277116 - DNA, 22 bp, Homo sapiens
atacttgaggtagcaacttaag

SEQ ID NO: 7277117 - DNA, 22 bp, Homo sapiens
atactttctgaccaattaattg

SEQ ID NO: 7277118 - DNA, 22 bp, Homo sapiens
ctggagtcttcagcttgctgcc

SEQ ID NO: 7277119 - DNA, 22 bp, Homo sapiens
ctggagtgatactcagaatgtg

SEQ ID NO: 7277120 - DNA, 22 bp, Homo sapiens
ctggagtgcagtggcatgatca

SEQ ID NO: 7277121 - DNA, 22 bp, Homo sapiens
ctggagcattttctgcttctgc

SEQ ID NO: 7277122 - DNA, 22 bp, Homo sapiens
ctggagcatccatgcccagggt

SEQ ID NO: 7277123 - DNA, 22 bp, Homo sapiens
agttggagtgaacatgagattg

SEQ ID NO: 7277124 - DNA, 21 bp, Homo sapiens
agttgctgctgctgcaggtga

SEQ ID NO: 7277125 - DNA, 22 bp, Homo sapiens
agttgctgcttctctctagaga

SEQ ID NO: 7277126 - DNA, 22 bp, Homo sapiens
ctgaggccgttggtgggcctta

SEQ ID NO: 7277127 - DNA, 22 bp, Homo sapiens
ctgaggcctaagacatgaatga

SEQ ID NO: 7277128 - DNA, 22 bp, Homo sapiens
agttgggtttgtgtcagttgca

SEQ ID NO: 7277129 - DNA, 22 bp, Homo sapiens
ctgagggtcaacttgattgtat

SEQ ID NO: 7277130 - DNA, 22 bp, Homo sapiens
ctgaggctttgtgtgcatgcct

SEQ ID NO: 7277131 - DNA, 22 bp, Homo sapiens
ctgaggtcaattaatcaacaac

SEQ ID NO: 7277132 - DNA, 22 bp, Homo sapiens
ctgaggtcagagtttagtctgg

SEQ ID NO: 7277133 - DNA, 22 bp, Homo sapiens
ctgaggtcaccccactggctgt

SEQ ID NO: 7277134 - DNA, 22 bp, Homo sapiens
ctgaggtagctgtgaatgttct

SEQ ID NO: 7277135 - DNA, 22 bp, Homo sapiens
ctgaggtatgtgggactagcct

SEQ ID NO: 7277136 - DNA, 23 bp, Homo sapiens
ctgaggtaaaatattctgaagga

SEQ ID NO: 7277137 - DNA, 22 bp, Homo sapiens
ctgaggcctcgttggctggaac

SEQ ID NO: 7277138 - DNA, 22 bp, Homo sapiens
ctgaggcctctctcctgggctt

SEQ ID NO: 7277139 - DNA, 22 bp, Homo sapiens
ctgaggctgggcttgccttctt

SEQ ID NO: 7277140 - DNA, 22 bp, Homo sapiens
ctgaggctgggctgagggtata

SEQ ID NO: 7277141 - DNA, 18 bp, Homo sapiens
ctgaggcttagagaggtt

SEQ ID NO: 7277142 - DNA, 22 bp, Homo sapiens
ctgaggcttctctagttcagct

SEQ ID NO: 7277143 - DNA, 22 bp, Homo sapiens
ctgaggcttgtcctctcagctt

SEQ ID NO: 7277144 - DNA, 22 bp, Homo sapiens
agtttgtaagttcattatgagt

SEQ ID NO: 7277145 - DNA, 22 bp, Homo sapiens
agtttgaattgaaatgcagatg

SEQ ID NO: 7277146 - DNA, 22 bp, Homo sapiens
agtttgaaatgttggcaatatt

SEQ ID NO: 7277147 - DNA, 22 bp, Homo sapiens
agtttgaaagtattgacagaag

SEQ ID NO: 7277148 - DNA, 22 bp, Homo sapiens
ctgcagagcaagttctctgttg

SEQ ID NO: 7277149 - DNA, 22 bp, Homo sapiens
agttgtcccggtctagccactt

SEQ ID NO: 7277150 - DNA, 20 bp, Homo sapiens
ataaaataactgccacaaga

SEQ ID NO: 7277151 - DNA, 20 bp, Homo sapiens
ataaaataactgccacaaga

SEQ ID NO: 7277152 - DNA, 22 bp, Homo sapiens
ataaatatcactgttgtccctc

SEQ ID NO: 7277153 - DNA, 22 bp, Homo sapiens
ctgccaggcagggagatggctg

SEQ ID NO: 7277154 - DNA, 22 bp, Homo sapiens
ctgccaggcagcagagggagaa

SEQ ID NO: 7277155 - DNA, 22 bp, Homo sapiens
ctgccaggcactgggctctgca

SEQ ID NO: 7277156 - DNA, 22 bp, Homo sapiens
ctgccaggcacgtgcagcatca

SEQ ID NO: 7277157 - DNA, 22 bp, Homo sapiens
ctgccaggactgacgtcttcag

SEQ ID NO: 7277158 - DNA, 22 bp, Homo sapiens
aggctccatgcaaaggctgttt

SEQ ID NO: 7277159 - DNA, 22 bp, Homo sapiens
ccaggccctgctcctcacacca

SEQ ID NO: 7277160 - DNA, 22 bp, Homo sapiens
aggctccattccaggagctaga

SEQ ID NO: 7277161 - DNA, 22 bp, Homo sapiens
aggctccattttcctgcagctg

SEQ ID NO: 7277162 - DNA, 22 bp, Homo sapiens
aggctccattttcctgcagctg

SEQ ID NO: 7277163 - DNA, 22 bp, Homo sapiens
ccaggctctgagcctcactctt

SEQ ID NO: 7277164 - DNA, 22 bp, Homo sapiens
ccaggcatccattgcttcctct

SEQ ID NO: 7277165 - DNA, 23 bp, Homo sapiens
ccagtgattgcctggaaggaggt

SEQ ID NO: 7277166 - DNA, 22 bp, Homo sapiens
aggctgagcctgggcgtggtgg

SEQ ID NO: 7277167 - DNA, 22 bp, Homo sapiens
aggctgagcggggtcccagagc

SEQ ID NO: 7277168 - DNA, 23 bp, Homo sapiens
aggctgagctctcccagcttcag

SEQ ID NO: 7277169 - DNA, 22 bp, Homo sapiens
aggctgaggcaggtggatcatt

SEQ ID NO: 7277170 - DNA, 22 bp, Homo sapiens
aggctgaggcaggtggatcact

SEQ ID NO: 7277171 - DNA, 22 bp, Homo sapiens
aggctgaggcaggtggatcatt

SEQ ID NO: 7277172 - DNA, 22 bp, Homo sapiens
aggctgaggcaggtggatcact

SEQ ID NO: 7277173 - DNA, 22 bp, Homo sapiens
aggctgaggcgggaggatcact

SEQ ID NO: 7277174 - DNA, 22 bp, Homo sapiens
aggctgagataggtggatcatt

SEQ ID NO: 7277175 - DNA, 22 bp, Homo sapiens
aggctgagataggtggatcatt

SEQ ID NO: 7277176 - DNA, 22 bp, Homo sapiens
aggctgagagcaacgtgtcaga

SEQ ID NO: 7277177 - DNA, 22 bp, Homo sapiens
aggctgagccacggggctggct

SEQ ID NO: 7277178 - DNA, 22 bp, Homo sapiens
aggctgagcaaagggccttacc

SEQ ID NO: 7277179 - DNA, 22 bp, Homo sapiens
aggctgagactgtgcattagtg

SEQ ID NO: 7277180 - DNA, 20 bp, Homo sapiens
aggctctgccattgtccctg

SEQ ID NO: 7277181 - DNA, 20 bp, Homo sapiens
aggctctgccattgtccctg

SEQ ID NO: 7277182 - DNA, 20 bp, Homo sapiens
aggctctgcctgcaggccca

SEQ ID NO: 7277183 - DNA, 22 bp, Homo sapiens
aggctctgcagtccatcccgtg

SEQ ID NO: 7277184 - DNA, 22 bp, Homo sapiens
aggctctgatgcaagcccaggg

SEQ ID NO: 7277185 - DNA, 22 bp, Homo sapiens
aggctctgagtagagctgccag

SEQ ID NO: 7277186 - DNA, 22 bp, Homo sapiens
aggcagtgctcaagacagcagc

SEQ ID NO: 7277187 - DNA, 22 bp, Homo sapiens
aggcagtgctcaagacagcagc

SEQ ID NO: 7277188 - DNA, 22 bp, Homo sapiens
aggcagtgcctggaccccagct

SEQ ID NO: 7277189 - DNA, 22 bp, Homo sapiens
aggcagtgcctggaccccagct

SEQ ID NO: 7277190 - DNA, 22 bp, Homo sapiens
aggcagtgcatgcaaaggtcgg

SEQ ID NO: 7277191 - DNA, 22 bp, Homo sapiens
aggcagtgcatgcaaaggtcgg

SEQ ID NO: 7277192 - DNA, 22 bp, Homo sapiens
aggcagtgcagagtcctcttct

SEQ ID NO: 7277193 - DNA, 22 bp, Homo sapiens
aggcagtgagaaatagcaagat

SEQ ID NO: 7277194 - DNA, 22 bp, Homo sapiens
aggcagtgagcagggtgtcatg

SEQ ID NO: 7277195 - DNA, 22 bp, Homo sapiens
aggcagtgagtgtgacttcaca

SEQ ID NO: 7277196 - DNA, 22 bp, Homo sapiens
aggcagtgatgagtcatgaata

SEQ ID NO: 7277197 - DNA, 22 bp, Homo sapiens
aggcagtggagaaggtttgtga

SEQ ID NO: 7277198 - DNA, 22 bp, Homo sapiens
aggcagtggagctggaataggc

SEQ ID NO: 7277199 - DNA, 22 bp, Homo sapiens
aggcagtggagctggaataggc

SEQ ID NO: 7277200 - DNA, 22 bp, Homo sapiens
aggcagtggaaggagaaagcaa

SEQ ID NO: 7277201 - DNA, 22 bp, Homo sapiens
aggcagtggaaggagaaagcaa

SEQ ID NO: 7277202 - DNA, 22 bp, Homo sapiens
aggcagtgctgtgccctgaacc

SEQ ID NO: 7277203 - DNA, 22 bp, Homo sapiens
aggcagtgctgtgccctgaacc

SEQ ID NO: 7277204 - DNA, 22 bp, Homo sapiens
aggcagtggatgtcaggaatgg

SEQ ID NO: 7277205 - DNA, 22 bp, Homo sapiens
aggcagtggatgtcaggaatgg

SEQ ID NO: 7277206 - DNA, 22 bp, Homo sapiens
aggcagtggctgagaccagggg

SEQ ID NO: 7277207 - DNA, 22 bp, Homo sapiens
aggcagccctgtgctggatgct

SEQ ID NO: 7277208 - DNA, 22 bp, Homo sapiens
aggcagccatctgcaggaagga

SEQ ID NO: 7277209 - DNA, 22 bp, Homo sapiens
aggcagcccacaggacacagga

SEQ ID NO: 7277210 - DNA, 22 bp, Homo sapiens
aggcaggttggtgagaagactg

SEQ ID NO: 7277211 - DNA, 22 bp, Homo sapiens
aggcagtctatctctggagcct

SEQ ID NO: 7277212 - DNA, 22 bp, Homo sapiens
aggcagtctagtccccaggcaa

SEQ ID NO: 7277213 - DNA, 22 bp, Homo sapiens
aggcagtggctgagaccagggg

SEQ ID NO: 7277214 - DNA, 22 bp, Homo sapiens
aggcagtggcttttgttgtgtt

SEQ ID NO: 7277215 - DNA, 23 bp, Homo sapiens
aggcagtggtggtaacatgtcaa

SEQ ID NO: 7277216 - DNA, 23 bp, Homo sapiens
aggcagtgggggccactttgctt

SEQ ID NO: 7277217 - DNA, 22 bp, Homo sapiens
aggcagtttctgggacagcata

SEQ ID NO: 7277218 - DNA, 22 bp, Homo sapiens
aggcagtttatccccagagcct

SEQ ID NO: 7277219 - DNA, 22 bp, Homo sapiens
aggcagttgttgctgagcagct

SEQ ID NO: 7277220 - DNA, 22 bp, Homo sapiens
aggcagttgtagagagggctct

SEQ ID NO: 7277221 - DNA, 21 bp, Homo sapiens
aggcatctaaagagagtagac

SEQ ID NO: 7277222 - DNA, 21 bp, Homo sapiens
aggcatctaaagagagtagac

SEQ ID NO: 7277223 - DNA, 22 bp, Homo sapiens
aggcatctgagtttgcaagctt

SEQ ID NO: 7277224 - DNA, 22 bp, Homo sapiens
ccactgctagagatgcatcccc

SEQ ID NO: 7277225 - DNA, 22 bp, Homo sapiens
aggcatgactttggctgaagaa

SEQ ID NO: 7277226 - DNA, 22 bp, Homo sapiens
aggccagcttctaccctctgtt

SEQ ID NO: 7277227 - DNA, 22 bp, Homo sapiens
aggccagcgctgctagctcccg

SEQ ID NO: 7277228 - DNA, 23 bp, Homo sapiens
aggccagcgcagacaccgagcac

SEQ ID NO: 7277229 - DNA, 22 bp, Homo sapiens
aggccagctatgactctgctcc

SEQ ID NO: 7277230 - DNA, 22 bp, Homo sapiens
aggccagcaagaaagagagtct

SEQ ID NO: 7277231 - DNA, 22 bp, Homo sapiens
aggccagctctacccttggact

SEQ ID NO: 7277232 - DNA, 22 bp, Homo sapiens
aggccagctctacccttggact

SEQ ID NO: 7277233 - DNA, 22 bp, Homo sapiens
aggccagctgccacccggtccg

SEQ ID NO: 7277234 - DNA, 22 bp, Homo sapiens
aggccagcttccagaggggcag

SEQ ID NO: 7277235 - DNA, 22 bp, Homo sapiens
aggccagctgttactagagcca

SEQ ID NO: 7277236 - DNA, 22 bp, Homo sapiens
aggctgttctaggagagtggga

SEQ ID NO: 7277237 - DNA, 22 bp, Homo sapiens
aggctgtgtttcccctggagct

SEQ ID NO: 7277238 - DNA, 22 bp, Homo sapiens
cccagctccttgtttgcatctc

SEQ ID NO: 7277239 - DNA, 22 bp, Homo sapiens
cccagctcgccgccgatgtgcg

SEQ ID NO: 7277240 - DNA, 22 bp, Homo sapiens
cccagctccttggatgggcagg

SEQ ID NO: 7277241 - DNA, 22 bp, Homo sapiens
cccagcctgatctcggccagct

SEQ ID NO: 7277242 - DNA, 18 bp, Homo sapiens
cccagcctctcctttcta

SEQ ID NO: 7277243 - DNA, 22 bp, Homo sapiens
cccagcctctggattctgccct

SEQ ID NO: 7277244 - DNA, 22 bp, Homo sapiens
cccagcctctgggctcacccaa

SEQ ID NO: 7277245 - DNA, 22 bp, Homo sapiens
cccagcctctgggttctgccgg

SEQ ID NO: 7277246 - DNA, 22 bp, Homo sapiens
cccagcctctgtttgctcctct

SEQ ID NO: 7277247 - DNA, 22 bp, Homo sapiens
cccagcctcagctttacttcca

SEQ ID NO: 7277248 - DNA, 22 bp, Homo sapiens
cccagcatcccagtgggcagca

SEQ ID NO: 7277249 - DNA, 22 bp, Homo sapiens
ccatgagcttcaactgacacag

SEQ ID NO: 7277250 - DNA, 22 bp, Homo sapiens
ccatgagcttcctatatagggt

SEQ ID NO: 7277251 - DNA, 22 bp, Homo sapiens
ccatgagccaggctgaggaagc

SEQ ID NO: 7277252 - DNA, 22 bp, Homo sapiens
ccatgagacagcaactgaaagt

SEQ ID NO: 7277253 - DNA, 22 bp, Homo sapiens
ccagtttttccagtgctttctg

SEQ ID NO: 7277254 - DNA, 22 bp, Homo sapiens
aggcttagaaattcagctgagt

SEQ ID NO: 7277255 - DNA, 19 bp, Homo sapiens
agggaaggattctgtcatt

SEQ ID NO: 7277256 - DNA, 22 bp, Homo sapiens
ccccagggtcagtgtgtggagg

SEQ ID NO: 7277257 - DNA, 22 bp, Homo sapiens
ccccatgaagtagggtctctga

SEQ ID NO: 7277258 - DNA, 22 bp, Homo sapiens
ccccatcctattcatgtttctg

SEQ ID NO: 7277259 - DNA, 23 bp, Homo sapiens
cctcccaggctgcgagtcccgag

SEQ ID NO: 7277260 - DNA, 20 bp, Homo sapiens
cctccaggcacacccatgtg

SEQ ID NO: 7277261 - DNA, 22 bp, Homo sapiens
cctcccagtgcctccagagcag

SEQ ID NO: 7277262 - DNA, 22 bp, Homo sapiens
cctctccttgcacccgtcccgc

SEQ ID NO: 7277263 - DNA, 22 bp, Homo sapiens
cctcaaataagttttatttatc

SEQ ID NO: 7277264 - DNA, 20 bp, Homo sapiens
cctcaaataagtgccagcat

SEQ ID NO: 7277265 - DNA, 22 bp, Homo sapiens
cctcaagatgcactgaacatat

SEQ ID NO: 7277266 - DNA, 22 bp, Homo sapiens
cctcaaattgtcaaataagaat

SEQ ID NO: 7277267 - DNA, 22 bp, Homo sapiens
cctcaaattggcattaattaag

SEQ ID NO: 7277268 - DNA, 22 bp, Homo sapiens
cctcaaattgctcagcgtctag

SEQ ID NO: 7277269 - DNA, 23 bp, Homo sapiens
cctcaaatgtagcctttttccca

SEQ ID NO: 7277270 - DNA, 22 bp, Homo sapiens
cctcaaatctttagagttattt

SEQ ID NO: 7277271 - DNA, 22 bp, Homo sapiens
cctcaaatagcccccagtctag

SEQ ID NO: 7277272 - DNA, 21 bp, Homo sapiens
cctcaagtgcctcctgctgct

SEQ ID NO: 7277273 - DNA, 22 bp, Homo sapiens
cctcaagtcaattctgtctcgc

SEQ ID NO: 7277274 - DNA, 18 bp, Homo sapiens
cctcacagacttccatgt

SEQ ID NO: 7277275 - DNA, 22 bp, Homo sapiens
agggcagcccttctgggagggc

SEQ ID NO: 7277276 - DNA, 22 bp, Homo sapiens
agggcagccattgagggattct

SEQ ID NO: 7277277 - DNA, 22 bp, Homo sapiens
agggcagctctcacctctggcc

SEQ ID NO: 7277278 - DNA, 22 bp, Homo sapiens
agggcagcctctcagcctaggt

SEQ ID NO: 7277279 - DNA, 22 bp, Homo sapiens
ccctggcccctcactccgaggc

SEQ ID NO: 7277280 - DNA, 22 bp, Homo sapiens
ccctgggctcagagcaggtagc

SEQ ID NO: 7277281 - DNA, 22 bp, Homo sapiens
aggaggcactcactctcagggt

SEQ ID NO: 7277282 - DNA, 22 bp, Homo sapiens
catgaggtgataaagctgggat

SEQ ID NO: 7277283 - DNA, 22 bp, Homo sapiens
catgcagcaggatctcattccc

SEQ ID NO: 7277284 - DNA, 22 bp, Homo sapiens
catgcagcagaataatgactat

SEQ ID NO: 7277285 - DNA, 22 bp, Homo sapiens
catgcagatgtcatgaggcatg

SEQ ID NO: 7277286 - DNA, 22 bp, Homo sapiens
catgcagcggcgtttggtttaa

SEQ ID NO: 7277287 - DNA, 22 bp, Homo sapiens
catgcagcctgtgaacagtgtc

SEQ ID NO: 7277288 - DNA, 22 bp, Homo sapiens
catgcaggaggaaaaagcagct

SEQ ID NO: 7277289 - DNA, 22 bp, Homo sapiens
catggcggtcaggatgtaggtg

SEQ ID NO: 7277290 - DNA, 19 bp, Homo sapiens
aggcagaggcttggctagc

SEQ ID NO: 7277291 - DNA, 19 bp, Homo sapiens
aggcagcacccagtccttg

SEQ ID NO: 7277292 - DNA, 22 bp, Homo sapiens
aggcagcatttgaatccaggtc

SEQ ID NO: 7277293 - DNA, 22 bp, Homo sapiens
aggcagcatttgaatccaggtc

SEQ ID NO: 7277294 - DNA, 22 bp, Homo sapiens
aggcagccaatcagaggctgac

SEQ ID NO: 7277295 - DNA, 22 bp, Homo sapiens
aggcagcagtcatgaggaaaga

SEQ ID NO: 7277296 - DNA, 19 bp, Homo sapiens
aggcagcattctggggctt

SEQ ID NO: 7277297 - DNA, 22 bp, Homo sapiens
aggcagcatttctgcttatcca

SEQ ID NO: 7277298 - DNA, 22 bp, Homo sapiens
aggcagcagtcatgaggaaaga

SEQ ID NO: 7277299 - DNA, 18 bp, Homo sapiens
aggcagcagcatcttctc

SEQ ID NO: 7277300 - DNA, 22 bp, Homo sapiens
aggcagcagaggttgaggaaag

SEQ ID NO: 7277301 - DNA, 22 bp, Homo sapiens
aggcagcagaaaacaaatggtt

SEQ ID NO: 7277302 - DNA, 22 bp, Homo sapiens
aggcagcagactgttaatcaga

SEQ ID NO: 7277303 - DNA, 22 bp, Homo sapiens
aggcagcagcttgctggttgcc

SEQ ID NO: 7277304 - DNA, 18 bp, Homo sapiens
cagtcccaaaccttagga

SEQ ID NO: 7277305 - DNA, 22 bp, Homo sapiens
cagtcctctgcaacaccccttc

SEQ ID NO: 7277306 - DNA, 17 bp, Homo sapiens
cagtcctctgctctaag

SEQ ID NO: 7277307 - DNA, 22 bp, Homo sapiens
cagtcctgaggaagagctgctg

SEQ ID NO: 7277308 - DNA, 20 bp, Homo sapiens
aggacagcagctgccacttg

SEQ ID NO: 7277309 - DNA, 22 bp, Homo sapiens
aggacagcagtgctggcacttg

SEQ ID NO: 7277310 - DNA, 22 bp, Homo sapiens
aggaaggaagagacaccatttg

SEQ ID NO: 7277311 - DNA, 22 bp, Homo sapiens
aggaagctggtgtgaggatgaa

SEQ ID NO: 7277312 - DNA, 22 bp, Homo sapiens
aggaagctggggtgttcttcat

SEQ ID NO: 7277313 - DNA, 22 bp, Homo sapiens
aggaagcttagtgaaaggacca

SEQ ID NO: 7277314 - DNA, 22 bp, Homo sapiens
aggaagctgctggagtagtgtg

SEQ ID NO: 7277315 - DNA, 20 bp, Homo sapiens
aggaagctgagatgtagagg

SEQ ID NO: 7277316 - DNA, 22 bp, Homo sapiens
aggaagctgcctgggatgggaa

SEQ ID NO: 7277317 - DNA, 22 bp, Homo sapiens
aggactgacttttgccatgaaa

SEQ ID NO: 7277318 - DNA, 22 bp, Homo sapiens
aggacagcccttgagagcacat

SEQ ID NO: 7277319 - DNA, 22 bp, Homo sapiens
aggacagcagttggtgaggttc

SEQ ID NO: 7277320 - DNA, 22 bp, Homo sapiens
aggagaggtctcccttccccag

SEQ ID NO: 7277321 - DNA, 22 bp, Homo sapiens
aggagaggctctaactctgtgt

SEQ ID NO: 7277322 - DNA, 22 bp, Homo sapiens
aggagagggtggcattaagttt

SEQ ID NO: 7277323 - DNA, 22 bp, Homo sapiens
aggagaggggtaggattaattt

SEQ ID NO: 7277324 - DNA, 22 bp, Homo sapiens
aggagaggcatcaagaaaatcg

SEQ ID NO: 7277325 - DNA, 22 bp, Homo sapiens
aggagaggaatcattattacaa

SEQ ID NO: 7277326 - DNA, 22 bp, Homo sapiens
aggagagctggtgtctggaatc

SEQ ID NO: 7277327 - DNA, 22 bp, Homo sapiens
aggagagaatgttccaggcttg

SEQ ID NO: 7277328 - DNA, 22 bp, Homo sapiens
aggagctcttgatgcttgaggg

SEQ ID NO: 7277329 - DNA, 22 bp, Homo sapiens
aggagctgaaacttctcatatg

SEQ ID NO: 7277330 - DNA, 22 bp, Homo sapiens
aggaactctgtctccagagttg

SEQ ID NO: 7277331 - DNA, 22 bp, Homo sapiens
aggaactgatttataactttag

SEQ ID NO: 7277332 - DNA, 22 bp, Homo sapiens
aggaagctcctggagagccagt

SEQ ID NO: 7277333 - DNA, 22 bp, Homo sapiens
aggaagctccatgaaggcagag

SEQ ID NO: 7277334 - DNA, 20 bp, Homo sapiens
aggaactttgtagaatacaa

SEQ ID NO: 7277335 - DNA, 22 bp, Homo sapiens
caggcctcaggggctcaggctg

SEQ ID NO: 7277336 - DNA, 22 bp, Homo sapiens
agctgtgtggtgtctgacagct

SEQ ID NO: 7277337 - DNA, 22 bp, Homo sapiens
cagctttgcaggctggtcagtg

SEQ ID NO: 7277338 - DNA, 22 bp, Homo sapiens
cagcttttggcaggatgaccag

SEQ ID NO: 7277339 - DNA, 22 bp, Homo sapiens
cagcttttaggactgtgagaaa

SEQ ID NO: 7277340 - DNA, 21 bp, Homo sapiens
agctgcagtcaagccagaggt

SEQ ID NO: 7277341 - DNA, 22 bp, Homo sapiens
agctgcaggcctctcctgggga

SEQ ID NO: 7277342 - DNA, 22 bp, Homo sapiens
agctgcaggcccatgctcagtc

SEQ ID NO: 7277343 - DNA, 22 bp, Homo sapiens
agctgaggctctgagagggaag

SEQ ID NO: 7277344 - DNA, 23 bp, Homo sapiens
agctgaggcagaggggcattctc

SEQ ID NO: 7277345 - DNA, 22 bp, Homo sapiens
agctgaggcatgatgctatcag

SEQ ID NO: 7277346 - DNA, 22 bp, Homo sapiens
agctgaggcatggacaggctgc

SEQ ID NO: 7277347 - DNA, 22 bp, Homo sapiens
agctgaggccacgagtgaaggg

SEQ ID NO: 7277348 - DNA, 22 bp, Homo sapiens
agctgaggcctgatttcgccgt

SEQ ID NO: 7277349 - DNA, 22 bp, Homo sapiens
agctctctgataaattgataaa

SEQ ID NO: 7277350 - DNA, 22 bp, Homo sapiens
agctctgacattgattctcagc

SEQ ID NO: 7277351 - DNA, 22 bp, Homo sapiens
cagctcctgcctgggcagctgt

SEQ ID NO: 7277352 - DNA, 22 bp, Homo sapiens
cagcttctgtctgattagcaag

SEQ ID NO: 7277353 - DNA, 22 bp, Homo sapiens
cagcttctgtcctagaaactgg

SEQ ID NO: 7277354 - DNA, 22 bp, Homo sapiens
cagctcctgttggtcttgagga

SEQ ID NO: 7277355 - DNA, 22 bp, Homo sapiens
cagctcctgttggtcttgagga

SEQ ID NO: 7277356 - DNA, 22 bp, Homo sapiens
caggaggttgtaagagcaggcc

SEQ ID NO: 7277357 - DNA, 22 bp, Homo sapiens
caggaggttggtagcagtagat

SEQ ID NO: 7277358 - DNA, 22 bp, Homo sapiens
caggaggttgagggtgcagtga

SEQ ID NO: 7277359 - DNA, 22 bp, Homo sapiens
caggaggtggagctcaagtggt

SEQ ID NO: 7277360 - DNA, 22 bp, Homo sapiens
caggaggtacatagattcagat

SEQ ID NO: 7277361 - DNA, 22 bp, Homo sapiens
caggaggtgacttccaggggtt

SEQ ID NO: 7277362 - DNA, 22 bp, Homo sapiens
caggaggtgaaggagaaccagt

SEQ ID NO: 7277363 - DNA, 22 bp, Homo sapiens
agctggcttctctgcagacatt

SEQ ID NO: 7277364 - DNA, 22 bp, Homo sapiens
agctggcatactttgctaggaa

SEQ ID NO: 7277365 - DNA, 22 bp, Homo sapiens
agctggcagtcatcctagtgag

SEQ ID NO: 7277366 - DNA, 22 bp, Homo sapiens
caggacagagcccagactgtgt

SEQ ID NO: 7277367 - DNA, 21 bp, Homo sapiens
caggaaaagcggaagtctagc

SEQ ID NO: 7277368 - DNA, 22 bp, Homo sapiens
atgggaggatgctcgggtgctc

SEQ ID NO: 7277369 - DNA, 22 bp, Homo sapiens
atgtacatactgcattttcaaa

SEQ ID NO: 7277370 - DNA, 22 bp, Homo sapiens
atggaaatatctttagagctta

SEQ ID NO: 7277371 - DNA, 23 bp, Homo sapiens
atggaaatagcatgtgtcattta

SEQ ID NO: 7277372 - DNA, 22 bp, Homo sapiens
atggaaatcaggttcatccaag

SEQ ID NO: 7277373 - DNA, 22 bp, Homo sapiens
atggaaatccaagtcaccgtag

SEQ ID NO: 7277374 - DNA, 22 bp, Homo sapiens
atggaaatcgatgtctaagtta

SEQ ID NO: 7277375 - DNA, 22 bp, Homo sapiens
atggaaatcgatgtctaagtta

SEQ ID NO: 7277376 - DNA, 22 bp, Homo sapiens
agacggcacctgggcagcttac

SEQ ID NO: 7277377 - DNA, 22 bp, Homo sapiens
atggacaggtggataggtggat

SEQ ID NO: 7277378 - DNA, 22 bp, Homo sapiens
agactctgagacatgaaccatc

SEQ ID NO: 7277379 - DNA, 22 bp, Homo sapiens
agactacaggagaaactcactc

SEQ ID NO: 7277380 - DNA, 22 bp, Homo sapiens
atgcttgagccagaaacagaaa

SEQ ID NO: 7277381 - DNA, 22 bp, Homo sapiens
atggaaagggaagcaaggaaca

SEQ ID NO: 7277382 - DNA, 22 bp, Homo sapiens
atggaaagtgcatggaagtcat

SEQ ID NO: 7277383 - DNA, 22 bp, Homo sapiens
atggctgggtcaccatcagggt

SEQ ID NO: 7277384 - DNA, 22 bp, Homo sapiens
atggagttctttaaattcacag

SEQ ID NO: 7277385 - DNA, 22 bp, Homo sapiens
atggcagatggctggagcaggt

SEQ ID NO: 7277386 - DNA, 22 bp, Homo sapiens
atggacagtgctgcttcagagg

SEQ ID NO: 7277387 - DNA, 17 bp, Homo sapiens
agacagtgagtgccttg

SEQ ID NO: 7277388 - DNA, 22 bp, Homo sapiens
agacaggtagcaggacagatat

SEQ ID NO: 7277389 - DNA, 22 bp, Homo sapiens
agaatcaggaagacagcctggc

SEQ ID NO: 7277390 - DNA, 22 bp, Homo sapiens
agaatgctaaatggattcttct

SEQ ID NO: 7277391 - DNA, 22 bp, Homo sapiens
agaatgcttgtacctttgtttt

SEQ ID NO: 7277392 - DNA, 22 bp, Homo sapiens
agaatgctttggatatattgga

SEQ ID NO: 7277393 - DNA, 20 bp, Homo sapiens
agaatgctttttgcattgca

SEQ ID NO: 7277394 - DNA, 22 bp, Homo sapiens
atcttggggaatcctctgtgta

SEQ ID NO: 7277395 - DNA, 22 bp, Homo sapiens
atctttaatttggatcagggcc

SEQ ID NO: 7277396 - DNA, 22 bp, Homo sapiens
agaagaatacttgatgttcatg

SEQ ID NO: 7277397 - DNA, 22 bp, Homo sapiens
agaagagagtcctaccccatac

SEQ ID NO: 7277398 - DNA, 22 bp, Homo sapiens
agaaggctaaagaaacagattg

SEQ ID NO: 7277399 - DNA, 22 bp, Homo sapiens
agaaggctaaagaaacagattg

SEQ ID NO: 7277400 - DNA, 22 bp, Homo sapiens
agaaggctccaagtagagtttg

SEQ ID NO: 7277401 - DNA, 23 bp, Homo sapiens
atttacaggttaaatgaaatcag

SEQ ID NO: 7277402 - DNA, 22 bp, Homo sapiens
atttattattgtggttacttct

SEQ ID NO: 7277403 - DNA, 22 bp, Homo sapiens
atttattattgtggttacttct

SEQ ID NO: 7277404 - DNA, 22 bp, Homo sapiens
atttattgaacactgactatgt

SEQ ID NO: 7277405 - DNA, 22 bp, Homo sapiens
atttattgaacactgactatgt

SEQ ID NO: 7277406 - DNA, 22 bp, Homo sapiens
agaggtagaggttgcagtgagc

SEQ ID NO: 7277407 - DNA, 22 bp, Homo sapiens
attcttcatacagacaagtcct

SEQ ID NO: 7277408 - DNA, 22 bp, Homo sapiens
attcttcatacctactgaggtt

SEQ ID NO: 7277409 - DNA, 22 bp, Homo sapiens
attcttcatcactaccttgtga

SEQ ID NO: 7277410 - DNA, 22 bp, Homo sapiens
agagggtgggcacgtgatggat

SEQ ID NO: 7277411 - DNA, 22 bp, Homo sapiens
attcttcattgttgattcatgt

SEQ ID NO: 7277412 - DNA, 22 bp, Homo sapiens
attcttcatttactgttacttg

SEQ ID NO: 7277413 - DNA, 22 bp, Homo sapiens
attcttcattgttgattcatgt

SEQ ID NO: 7277414 - DNA, 23 bp, Homo sapiens
attcttcattatcttctagaaaa

SEQ ID NO: 7277415 - DNA, 22 bp, Homo sapiens
attcttcatcagagatgcacta

SEQ ID NO: 7277416 - DNA, 22 bp, Homo sapiens
atttaaattttctgatggagag

SEQ ID NO: 7277417 - DNA, 22 bp, Homo sapiens
agatgaagatgccactaagacc

SEQ ID NO: 7277418 - DNA, 22 bp, Homo sapiens
agatgaagatgccactaagacc

SEQ ID NO: 7277419 - DNA, 22 bp, Homo sapiens
agatgacaaatcaggggacggg

SEQ ID NO: 7277420 - DNA, 22 bp, Homo sapiens
atttcattgaagttaattcttc

SEQ ID NO: 7277421 - DNA, 22 bp, Homo sapiens
atttcattgaagttaattcttc

SEQ ID NO: 7277422 - DNA, 23 bp, Homo sapiens
agatgaaagcttcccatcacagt

SEQ ID NO: 7277423 - DNA, 22 bp, Homo sapiens
atttattgaagcttattacgtt

SEQ ID NO: 7277424 - DNA, 22 bp, Homo sapiens
agatggttgtcgcaaatgaatg

SEQ ID NO: 7277425 - DNA, 22 bp, Homo sapiens
atttccaaaaccacttattgcc

SEQ ID NO: 7277426 - DNA, 19 bp, Homo sapiens
atttccaagaattggagag

SEQ ID NO: 7277427 - DNA, 22 bp, Homo sapiens
atttccaagaaagctttaggat

SEQ ID NO: 7277428 - DNA, 21 bp, Homo sapiens
atttccaagggtacctaagat

SEQ ID NO: 7277429 - DNA, 22 bp, Homo sapiens
atttccaaggtaattttgagta

SEQ ID NO: 7277430 - DNA, 22 bp, Homo sapiens
atttccaatctctgcatatggg

SEQ ID NO: 7277431 - DNA, 23 bp, Homo sapiens
agatgtcttagaaactgaagctg

SEQ ID NO: 7277432 - DNA, 22 bp, Homo sapiens
agatgtctcccatggttttgac

SEQ ID NO: 7277433 - DNA, 19 bp, Homo sapiens
agatgtctatttgactatc

SEQ ID NO: 7277434 - DNA, 22 bp, Homo sapiens
atttgcttgtgctatgaaagtt

SEQ ID NO: 7277435 - DNA, 22 bp, Homo sapiens
atttgcttctgtgaaatcaagt

SEQ ID NO: 7277436 - DNA, 22 bp, Homo sapiens
atttgcttatctccacagttgt

SEQ ID NO: 7277437 - DNA, 22 bp, Homo sapiens
atttgctttcaggtataaaagg

SEQ ID NO: 7277438 - DNA, 22 bp, Homo sapiens
atttgctttaaggtataaaagg

SEQ ID NO: 7277439 - DNA, 22 bp, Homo sapiens
attaaagaaacccagcatgtga

SEQ ID NO: 7277440 - DNA, 22 bp, Homo sapiens
attaaagacagcagatggatgg

SEQ ID NO: 7277441 - DNA, 22 bp, Homo sapiens
attaaagttgaaattgaactga

SEQ ID NO: 7277442 - DNA, 22 bp, Homo sapiens
attagcatattaaatagtcatt

SEQ ID NO: 7277443 - DNA, 22 bp, Homo sapiens
atgtgtatgagtgtgcttcttt

SEQ ID NO: 7277444 - DNA, 18 bp, Homo sapiens
atgtgtctttcttgtttg

SEQ ID NO: 7277445 - DNA, 22 bp, Homo sapiens
atgtgtatccatctgtctattt

SEQ ID NO: 7277446 - DNA, 22 bp, Homo sapiens
atgtgtctttgagactctgcta

SEQ ID NO: 7277447 - DNA, 22 bp, Homo sapiens
atgtgtgctcttgagccttcac

SEQ ID NO: 7277448 - DNA, 22 bp, Homo sapiens
attcagatcatatttatagctt

SEQ ID NO: 7277449 - DNA, 22 bp, Homo sapiens
agagggcaagtgtagtccagta

SEQ ID NO: 7277450 - DNA, 22 bp, Homo sapiens
agagggatggccccgtaactca

SEQ ID NO: 7277451 - DNA, 22 bp, Homo sapiens
agagggataatatgtattgtaa

SEQ ID NO: 7277452 - DNA, 22 bp, Homo sapiens
agagggatcaccctgtttctgg

SEQ ID NO: 7277453 - DNA, 22 bp, Homo sapiens
agagggagtgaaatggaataga

SEQ ID NO: 7277454 - DNA, 22 bp, Homo sapiens
agagggtgaatgagatagaaaa

SEQ ID NO: 7277455 - DNA, 22 bp, Homo sapiens
agagggtgctggagagacattg

SEQ ID NO: 7277456 - DNA, 22 bp, Homo sapiens
caactgaaaagattctacgcag

SEQ ID NO: 7277457 - DNA, 22 bp, Homo sapiens
caactgaactgatatcaactat

SEQ ID NO: 7277458 - DNA, 22 bp, Homo sapiens
agcagcagaaggtttgcaccca

SEQ ID NO: 7277459 - DNA, 22 bp, Homo sapiens
agcagcagaagggagacccagg

SEQ ID NO: 7277460 - DNA, 22 bp, Homo sapiens
agcagcagaaagttgatggcag

SEQ ID NO: 7277461 - DNA, 22 bp, Homo sapiens
caaggcagttccccagagggct

SEQ ID NO: 7277462 - DNA, 22 bp, Homo sapiens
caaggcaggtctgaggaggttg

SEQ ID NO: 7277463 - DNA, 22 bp, Homo sapiens
agcagcagggtgtaattgggca

SEQ ID NO: 7277464 - DNA, 22 bp, Homo sapiens
caaggcatgaaaggagtgagtg

SEQ ID NO: 7277465 - DNA, 22 bp, Homo sapiens
caatcttagagagattctttta

SEQ ID NO: 7277466 - DNA, 22 bp, Homo sapiens
agcagcattatgatatatctta

SEQ ID NO: 7277467 - DNA, 22 bp, Homo sapiens
attttctattctgctggtttag

SEQ ID NO: 7277468 - DNA, 22 bp, Homo sapiens
attttctatgttgtaattgtta

SEQ ID NO: 7277469 - DNA, 22 bp, Homo sapiens
agcaatttttgattttcagtgt

SEQ ID NO: 7277470 - DNA, 22 bp, Homo sapiens
caaatgatactgtttttagtct

SEQ ID NO: 7277471 - DNA, 22 bp, Homo sapiens
caaatgatagagccgattatca

SEQ ID NO: 7277472 - DNA, 22 bp, Homo sapiens
caaatgatagagccgattatca

SEQ ID NO: 7277473 - DNA, 22 bp, Homo sapiens
agcactgttatgggatgactta

SEQ ID NO: 7277474 - DNA, 22 bp, Homo sapiens
cacagtcaccttatcaggatgt

SEQ ID NO: 7277475 - DNA, 22 bp, Homo sapiens
agcagggcctctggcactggtc

SEQ ID NO: 7277476 - DNA, 22 bp, Homo sapiens
agcagttttcctgagctcctca

SEQ ID NO: 7277477 - DNA, 22 bp, Homo sapiens
agcagtttctcttgtatcttca

SEQ ID NO: 7277478 - DNA, 20 bp, Homo sapiens
agcagtttcctaactcagct

SEQ ID NO: 7277479 - DNA, 22 bp, Homo sapiens
agcagttttatgcgattgtttc

SEQ ID NO: 7277480 - DNA, 22 bp, Homo sapiens
caccagggtacaatttcgcaga

SEQ ID NO: 7277481 - DNA, 22 bp, Homo sapiens
agcagtggcctggggctctgtg

SEQ ID NO: 7277482 - DNA, 22 bp, Homo sapiens
agcagtttagctatactgcttg

SEQ ID NO: 7277483 - DNA, 22 bp, Homo sapiens
agcagttgtagtcatggaaaat

SEQ ID NO: 7277484 - DNA, 22 bp, Homo sapiens
caccaggctggagtgcagtggc

SEQ ID NO: 7277485 - DNA, 20 bp, Homo sapiens
agcagctgtgttttcatcct

SEQ ID NO: 7277486 - DNA, 18 bp, Homo sapiens
agcagctgtgccacactg

SEQ ID NO: 7277487 - DNA, 22 bp, Homo sapiens
cacaggctgcccgcagctggga

SEQ ID NO: 7277488 - DNA, 23 bp, Homo sapiens
cacaggctgcgcataagcttctc

SEQ ID NO: 7277489 - DNA, 22 bp, Homo sapiens
cacaggctgcccgcagctggga

SEQ ID NO: 7277490 - DNA, 22 bp, Homo sapiens
agctcaagttttcaaatattat

SEQ ID NO: 7277491 - DNA, 22 bp, Homo sapiens
agctcaatgcaacctccgcctc

SEQ ID NO: 7277492 - DNA, 22 bp, Homo sapiens
cagcaggaggtgagtagcaggt

SEQ ID NO: 7277493 - DNA, 22 bp, Homo sapiens
cagcaggagcagtcagactcct

SEQ ID NO: 7277494 - DNA, 22 bp, Homo sapiens
agccttgttggtctgagtttgg

SEQ ID NO: 7277495 - DNA, 22 bp, Homo sapiens
cagccagcctctcaaccatgca

SEQ ID NO: 7277496 - DNA, 22 bp, Homo sapiens
agctcccagtctcctctccatg

SEQ ID NO: 7277497 - DNA, 22 bp, Homo sapiens
agctcccagcagagctggccac

SEQ ID NO: 7277498 - DNA, 22 bp, Homo sapiens
cagccctgggagttggggccga

SEQ ID NO: 7277499 - DNA, 22 bp, Homo sapiens
cagccctgggtccctgccctgg

SEQ ID NO: 7277500 - DNA, 22 bp, Homo sapiens
cagccctggctagggcgagggc

SEQ ID NO: 7277501 - DNA, 22 bp, Homo sapiens
agctcctcctgtgccaggccag

SEQ ID NO: 7277502 - DNA, 22 bp, Homo sapiens
cagccctggccccaggtggtct

SEQ ID NO: 7277503 - DNA, 22 bp, Homo sapiens
agctcctcctgagtgtctggga

SEQ ID NO: 7277504 - DNA, 23 bp, Homo sapiens
agcctcagccggtggcagaagtg

SEQ ID NO: 7277505 - DNA, 23 bp, Homo sapiens
agcctcagccggtggcagaagtg

SEQ ID NO: 7277506 - DNA, 22 bp, Homo sapiens
cagcacagctggctctggaagc

SEQ ID NO: 7277507 - DNA, 22 bp, Homo sapiens
cagaggctaagggtagcttggg

SEQ ID NO: 7277508 - DNA, 22 bp, Homo sapiens
cagcagaggcacgtctgtgaat

SEQ ID NO: 7277509 - DNA, 22 bp, Homo sapiens
cagcagagggagccattgaaat

SEQ ID NO: 7277510 - DNA, 22 bp, Homo sapiens
cagcagaggtggttcacattgt

SEQ ID NO: 7277511 - DNA, 22 bp, Homo sapiens
agcctggtttaagcattttata

SEQ ID NO: 7277512 - DNA, 22 bp, Homo sapiens
agcctggtttaagcattttata

SEQ ID NO: 7277513 - DNA, 22 bp, Homo sapiens
cagcagcagtggctgcagaaca

SEQ ID NO: 7277514 - DNA, 22 bp, Homo sapiens
cagagagggagcagtagtctct

SEQ ID NO: 7277515 - DNA, 22 bp, Homo sapiens
cagagctggagggaaccctggc

SEQ ID NO: 7277516 - DNA, 22 bp, Homo sapiens
agcccaggagtttgaggctgtg

SEQ ID NO: 7277517 - DNA, 22 bp, Homo sapiens
agcccaggagtttgaggctgtg

SEQ ID NO: 7277518 - DNA, 22 bp, Homo sapiens
cagagctgcttcccagtttgtg

SEQ ID NO: 7277519 - DNA, 22 bp, Homo sapiens
agcccaggaagttgaggcttgc

SEQ ID NO: 7277520 - DNA, 22 bp, Homo sapiens
agcccaggaatctgcatcttga

SEQ ID NO: 7277521 - DNA, 22 bp, Homo sapiens
agcccaggaggtggaggttgca

SEQ ID NO: 7277522 - DNA, 22 bp, Homo sapiens
agccagctccctcccctgcagg

SEQ ID NO: 7277523 - DNA, 22 bp, Homo sapiens
cagaaccaggaactgatggaga

SEQ ID NO: 7277524 - DNA, 22 bp, Homo sapiens
cagaaatgacaaagtaagagga

SEQ ID NO: 7277525 - DNA, 22 bp, Homo sapiens
agccacagcctgacttaactgt

SEQ ID NO: 7277526 - DNA, 23 bp, Homo sapiens
agccacagccagagctatctcca

SEQ ID NO: 7277527 - DNA, 22 bp, Homo sapiens
agccacagcatgtgtgtatgta

SEQ ID NO: 7277528 - DNA, 22 bp, Homo sapiens
agccacagcacattgtaagaaa

SEQ ID NO: 7277529 - DNA, 19 bp, Homo sapiens
agccacagaacttgcagga

SEQ ID NO: 7277530 - DNA, 22 bp, Homo sapiens
agccacagagagggagctgcaa

SEQ ID NO: 7277531 - DNA, 22 bp, Homo sapiens
agccacagagcaggagaccttt

SEQ ID NO: 7277532 - DNA, 21 bp, Homo sapiens
actgcaaacagcagagactga

SEQ ID NO: 7277533 - DNA, 20 bp, Homo sapiens
actgcaaagtactctttcag

SEQ ID NO: 7277534 - DNA, 22 bp, Homo sapiens
actgcaacctccgcctgccagg

SEQ ID NO: 7277535 - DNA, 22 bp, Homo sapiens
actgcaacctccgcctgccagg

SEQ ID NO: 7277536 - DNA, 22 bp, Homo sapiens
actgatgttcagccatgttctg

SEQ ID NO: 7277537 - DNA, 22 bp, Homo sapiens
actgatgtgatttcaaattcca

SEQ ID NO: 7277538 - DNA, 22 bp, Homo sapiens
actgatgttaaccctctcttct

SEQ ID NO: 7277539 - DNA, 22 bp, Homo sapiens
actgatgtgacagctgagcaga

SEQ ID NO: 7277540 - DNA, 23 bp, Homo sapiens
actgattcttgaagttgacaagt

SEQ ID NO: 7277541 - DNA, 22 bp, Homo sapiens
actgaggtaattgtgaggatta

SEQ ID NO: 7277542 - DNA, 22 bp, Homo sapiens
actggcagccacaactggcagg

SEQ ID NO: 7277543 - DNA, 22 bp, Homo sapiens
actcttcattcaagtatgcaaa

SEQ ID NO: 7277544 - DNA, 22 bp, Homo sapiens
agtctgggaactgggaacgttt

SEQ ID NO: 7277545 - DNA, 22 bp, Homo sapiens
agtctgggagaaggtgagatta

SEQ ID NO: 7277546 - DNA, 22 bp, Homo sapiens
agtctgggtgtgaatgaacttg

SEQ ID NO: 7277547 - DNA, 22 bp, Homo sapiens
actcatttaaacatttactgaa

SEQ ID NO: 7277548 - DNA, 22 bp, Homo sapiens
actcatttgacactttaaactg

SEQ ID NO: 7277549 - DNA, 21 bp, Homo sapiens
actccaaacaagttaagctgt

SEQ ID NO: 7277550 - DNA, 22 bp, Homo sapiens
actccaaaacctgcggcttggt

SEQ ID NO: 7277551 - DNA, 22 bp, Homo sapiens
actccacaccacgggggccgcc

SEQ ID NO: 7277552 - DNA, 22 bp, Homo sapiens
actccacaccacgggggccgcc

SEQ ID NO: 7277553 - DNA, 22 bp, Homo sapiens
actccacaccacgggggccgcc

SEQ ID NO: 7277554 - DNA, 22 bp, Homo sapiens
actccaggatgtagaatcagag

SEQ ID NO: 7277555 - DNA, 19 bp, Homo sapiens
actccagggatgacagaag

SEQ ID NO: 7277556 - DNA, 22 bp, Homo sapiens
actccaggcatctgcttctgct

SEQ ID NO: 7277557 - DNA, 22 bp, Homo sapiens
actccagggctccaccccagat

SEQ ID NO: 7277558 - DNA, 22 bp, Homo sapiens
actccagggctccatcccttgt

SEQ ID NO: 7277559 - DNA, 22 bp, Homo sapiens
actccagggctgaacgaggccc

SEQ ID NO: 7277560 - DNA, 22 bp, Homo sapiens
actatacattgaatgttaaggt

SEQ ID NO: 7277561 - DNA, 22 bp, Homo sapiens
actcaaatagctgcccctagtg

SEQ ID NO: 7277562 - DNA, 22 bp, Homo sapiens
actcaaatagcaacggtgagaa

SEQ ID NO: 7277563 - DNA, 22 bp, Homo sapiens
actcaaatttgtcaactgaagc

SEQ ID NO: 7277564 - DNA, 23 bp, Homo sapiens
actcaaatttcgcttggagttca

SEQ ID NO: 7277565 - DNA, 20 bp, Homo sapiens
actcaaatcacctgcctcaa

SEQ ID NO: 7277566 - DNA, 22 bp, Homo sapiens
actcaagtcataggcttctttc

SEQ ID NO: 7277567 - DNA, 22 bp, Homo sapiens
actcattgaaacttaagatcta

SEQ ID NO: 7277568 - DNA, 21 bp, Homo sapiens
actcaagtggagatgccaggt

SEQ ID NO: 7277569 - DNA, 22 bp, Homo sapiens
actaaagatgtctaaatatatt

SEQ ID NO: 7277570 - DNA, 22 bp, Homo sapiens
acctggctggttgtgattccca

SEQ ID NO: 7277571 - DNA, 23 bp, Homo sapiens
acctggctgctcaacctgcaggg

SEQ ID NO: 7277572 - DNA, 22 bp, Homo sapiens
acctgtggatcagattcttgta

SEQ ID NO: 7277573 - DNA, 22 bp, Homo sapiens
agggtggttcttttagtggaag

SEQ ID NO: 7277574 - DNA, 22 bp, Homo sapiens
agggtggtggcgatgaggacat

SEQ ID NO: 7277575 - DNA, 22 bp, Homo sapiens
atataatagtttcataaaggct

SEQ ID NO: 7277576 - DNA, 22 bp, Homo sapiens
atatataacctggataaggctt

SEQ ID NO: 7277577 - DNA, 22 bp, Homo sapiens
atatatttgagaatattcatga

SEQ ID NO: 7277578 - DNA, 22 bp, Homo sapiens
atatatttgagaatattcatga

SEQ ID NO: 7277579 - DNA, 22 bp, Homo sapiens
agaaaatttaaagagacacaca

SEQ ID NO: 7277580 - DNA, 22 bp, Homo sapiens
atatgaaaagaagtcaccattg

SEQ ID NO: 7277581 - DNA, 22 bp, Homo sapiens
atccagctttgtctggtcttcg

SEQ ID NO: 7277582 - DNA, 22 bp, Homo sapiens
atccagaacacctgtatcacca

SEQ ID NO: 7277583 - DNA, 22 bp, Homo sapiens
atcatttccctttagatcacaa

SEQ ID NO: 7277584 - DNA, 21 bp, Homo sapiens
atcattctggaaaattcaagc

SEQ ID NO: 7277585 - DNA, 22 bp, Homo sapiens
atcattctgatggtcaatgcta

SEQ ID NO: 7277586 - DNA, 22 bp, Homo sapiens
atcagcaagcatttattgagtg

SEQ ID NO: 7277587 - DNA, 22 bp, Homo sapiens
atcagcaagcatttattgagtg

SEQ ID NO: 7277588 - DNA, 23 bp, Homo sapiens
atcattctccaatctggagcagg

SEQ ID NO: 7277589 - DNA, 23 bp, Homo sapiens
atcaccagcggaagctgcagacc

SEQ ID NO: 7277590 - DNA, 22 bp, Homo sapiens
atcacaaaggctgcttcatgat

SEQ ID NO: 7277591 - DNA, 22 bp, Homo sapiens
atcacaaaggctgcttcatgat

SEQ ID NO: 7277592 - DNA, 22 bp, Homo sapiens
agaaacatttagattatatgtc

SEQ ID NO: 7277593 - DNA, 22 bp, Homo sapiens
acttcatgcagaagagagctgt

SEQ ID NO: 7277594 - DNA, 19 bp, Homo sapiens
acttcaaatcttagagaaa

SEQ ID NO: 7277595 - DNA, 22 bp, Homo sapiens
acttcagagactttatggtcca

SEQ ID NO: 7277596 - DNA, 22 bp, Homo sapiens
acttcacaggttttcataaaac

SEQ ID NO: 7277597 - DNA, 22 bp, Homo sapiens
acttcacagaaattttatgagg

SEQ ID NO: 7277598 - DNA, 22 bp, Homo sapiens
actgtgtgaaacatcaatgtgt

SEQ ID NO: 7277599 - DNA, 22 bp, Homo sapiens
actgtgtgactgttattactgt

SEQ ID NO: 7277600 - DNA, 22 bp, Homo sapiens
actgtaaaagaaggtctttgca

SEQ ID NO: 7277601 - DNA, 20 bp, Homo sapiens
actggcagcctgcctgctgt

SEQ ID NO: 7277602 - DNA, 22 bp, Homo sapiens
agttgctcaatgtggctgtgga

SEQ ID NO: 7277603 - DNA, 22 bp, Homo sapiens
actgtaaattacataagaacag

SEQ ID NO: 7277604 - DNA, 22 bp, Homo sapiens
agtttccaaatattgttttagc

SEQ ID NO: 7277605 - DNA, 21 bp, Homo sapiens
agtttcctcaactgcagaagg

SEQ ID NO: 7277606 - DNA, 22 bp, Homo sapiens
aggagcttcagagagaacctgg

SEQ ID NO: 7277607 - DNA, 22 bp, Homo sapiens
acagtgaggacagggactgtgt

SEQ ID NO: 7277608 - DNA, 17 bp, Homo sapiens
aggagtctcagatgagc

SEQ ID NO: 7277609 - DNA, 22 bp, Homo sapiens
acagtgttctgctttttaatcc

SEQ ID NO: 7277610 - DNA, 22 bp, Homo sapiens
acagtgttcttgatattacagt

SEQ ID NO: 7277611 - DNA, 22 bp, Homo sapiens
acagtgttttagaaaagcttga

SEQ ID NO: 7277612 - DNA, 22 bp, Homo sapiens
acagtgttttgtctggcagggc

SEQ ID NO: 7277613 - DNA, 22 bp, Homo sapiens
acagtgttttcttaaggagaaa

SEQ ID NO: 7277614 - DNA, 22 bp, Homo sapiens
acagtgttttatgagaattgtt

SEQ ID NO: 7277615 - DNA, 20 bp, Homo sapiens
acagtgtttttgagtagagc

SEQ ID NO: 7277616 - DNA, 22 bp, Homo sapiens
acagttatctttgaaatagaga

SEQ ID NO: 7277617 - DNA, 22 bp, Homo sapiens
aggcagcatgggcccagagtcc

SEQ ID NO: 7277618 - DNA, 22 bp, Homo sapiens
aggcagcatgggccccagctcc

SEQ ID NO: 7277619 - DNA, 22 bp, Homo sapiens
aggcagcatgggccccagctcc

SEQ ID NO: 7277620 - DNA, 16 bp, Homo sapiens
aggcagcatgttagtg

SEQ ID NO: 7277621 - DNA, 21 bp, Homo sapiens
aggcagcatctgatttatatg

SEQ ID NO: 7277622 - DNA, 21 bp, Homo sapiens
aggcagcatctgatttatatg

SEQ ID NO: 7277623 - DNA, 22 bp, Homo sapiens
aggcagcatgggcccagagtcc

SEQ ID NO: 7277624 - DNA, 22 bp, Homo sapiens
aggcagcatgctctgcttctac

SEQ ID NO: 7277625 - DNA, 22 bp, Homo sapiens
aggcagcatccagaggagaatg

SEQ ID NO: 7277626 - DNA, 22 bp, Homo sapiens
aggcagcagtgataagatagga

SEQ ID NO: 7277627 - DNA, 22 bp, Homo sapiens
aggcagcagtgataagatagga

SEQ ID NO: 7277628 - DNA, 22 bp, Homo sapiens
aggcagcaattgaaatcattgt

SEQ ID NO: 7277629 - DNA, 22 bp, Homo sapiens
aggcagctggcaaattctagag

SEQ ID NO: 7277630 - DNA, 22 bp, Homo sapiens
aggcaggcacacttcctccagg

SEQ ID NO: 7277631 - DNA, 22 bp, Homo sapiens
aggcaggcactccggaagtgtc

SEQ ID NO: 7277632 - DNA, 21 bp, Homo sapiens
aggcaggattcaaacacagag

SEQ ID NO: 7277633 - DNA, 22 bp, Homo sapiens
aggcaggcaaccacctgggaag

SEQ ID NO: 7277634 - DNA, 22 bp, Homo sapiens
agctggggctgcagagaacagg

SEQ ID NO: 7277635 - DNA, 22 bp, Homo sapiens
acagctgattggatcaaggaca

SEQ ID NO: 7277636 - DNA, 21 bp, Homo sapiens
acagccttgtgatggagacag

SEQ ID NO: 7277637 - DNA, 22 bp, Homo sapiens
acagctcctaacaaaggctctc

SEQ ID NO: 7277638 - DNA, 22 bp, Homo sapiens
acagctctccctcagagaaatg

SEQ ID NO: 7277639 - DNA, 22 bp, Homo sapiens
acagctctgagatattactatt

SEQ ID NO: 7277640 - DNA, 22 bp, Homo sapiens
agctgccccatgagaggcaggt

SEQ ID NO: 7277641 - DNA, 22 bp, Homo sapiens
agctgccttaaattactttgtg

SEQ ID NO: 7277642 - DNA, 20 bp, Homo sapiens
agctgccttcattttctaga

SEQ ID NO: 7277643 - DNA, 23 bp, Homo sapiens
acagccttctggggcttctgggc

SEQ ID NO: 7277644 - DNA, 22 bp, Homo sapiens
acagccttctcttcactgtgtc

SEQ ID NO: 7277645 - DNA, 22 bp, Homo sapiens
agctgcccagataggaggaggc

SEQ ID NO: 7277646 - DNA, 22 bp, Homo sapiens
agctgcccagctaggaagaagg

SEQ ID NO: 7277647 - DNA, 22 bp, Homo sapiens
agctgccatccgaggtgtcaga

SEQ ID NO: 7277648 - DNA, 22 bp, Homo sapiens
agctgccatcagcctttggatg

SEQ ID NO: 7277649 - DNA, 22 bp, Homo sapiens
agctgccagggactgggcatgg

SEQ ID NO: 7277650 - DNA, 22 bp, Homo sapiens
agctgccagcatcccggaaggg

SEQ ID NO: 7277651 - DNA, 22 bp, Homo sapiens
agctgccagcaagtttcaaaca

SEQ ID NO: 7277652 - DNA, 22 bp, Homo sapiens
acagcagacagtcggcttcctg

SEQ ID NO: 7277653 - DNA, 18 bp, Homo sapiens
acaggctgtgggaatggt

SEQ ID NO: 7277654 - DNA, 22 bp, Homo sapiens
acaggctggtttgtaaaagatg

SEQ ID NO: 7277655 - DNA, 22 bp, Homo sapiens
acaggctgtacttctaatcatc

SEQ ID NO: 7277656 - DNA, 22 bp, Homo sapiens
acaggctggtggtcctggccat

SEQ ID NO: 7277657 - DNA, 22 bp, Homo sapiens
acaggctggtggtcctggccat

SEQ ID NO: 7277658 - DNA, 22 bp, Homo sapiens
acaggctgggcgcttcctgcgg

SEQ ID NO: 7277659 - DNA, 22 bp, Homo sapiens
acaggctgctgggctccgtgct

SEQ ID NO: 7277660 - DNA, 22 bp, Homo sapiens
acaggctggaggaggaccaaga

SEQ ID NO: 7277661 - DNA, 22 bp, Homo sapiens
acaggctgccacttgcatccaa

SEQ ID NO: 7277662 - DNA, 22 bp, Homo sapiens
acaggctgcctaccaagtatca

SEQ ID NO: 7277663 - DNA, 22 bp, Homo sapiens
acaggctgcccgctccccacct

SEQ ID NO: 7277664 - DNA, 22 bp, Homo sapiens
acaggctgcctaccaagtatca

SEQ ID NO: 7277665 - DNA, 22 bp, Homo sapiens
acaggctgctgagccatttgct

SEQ ID NO: 7277666 - DNA, 22 bp, Homo sapiens
acaggcctcaagacacccaggt

SEQ ID NO: 7277667 - DNA, 22 bp, Homo sapiens
acaggcctcccatccggagccc

SEQ ID NO: 7277668 - DNA, 22 bp, Homo sapiens
acccgggaggcaggagtcatag

SEQ ID NO: 7277669 - DNA, 22 bp, Homo sapiens
accctcaacaaattcactctat

SEQ ID NO: 7277670 - DNA, 22 bp, Homo sapiens
accctcaagatggaagcagttt

SEQ ID NO: 7277671 - DNA, 22 bp, Homo sapiens
agggagctcacagtccagtaga

SEQ ID NO: 7277672 - DNA, 22 bp, Homo sapiens
agggagctcagttggaagcggt

SEQ ID NO: 7277673 - DNA, 22 bp, Homo sapiens
agggagctctaagtagagggac

SEQ ID NO: 7277674 - DNA, 22 bp, Homo sapiens
accattgccccctagtgtctgt

SEQ ID NO: 7277675 - DNA, 20 bp, Homo sapiens
agggcagcttgaggagccgg

SEQ ID NO: 7277676 - DNA, 22 bp, Homo sapiens
acccaggagcaggctgggcagt

SEQ ID NO: 7277677 - DNA, 20 bp, Homo sapiens
aggctggcactcctggccag

SEQ ID NO: 7277678 - DNA, 22 bp, Homo sapiens
aggctggcaaggcagatgtgtg

SEQ ID NO: 7277679 - DNA, 22 bp, Homo sapiens
aggctggagtgtgcagtggcgc

SEQ ID NO: 7277680 - DNA, 22 bp, Homo sapiens
agggaagaatcactgggatgtt

SEQ ID NO: 7277681 - DNA, 22 bp, Homo sapiens
accaggagttttgaccaggggc

SEQ ID NO: 7277682 - DNA, 23 bp, Homo sapiens
accaggagttgtctcaggaaaca

SEQ ID NO: 7277683 - DNA, 23 bp, Homo sapiens
agggagctaaaaggctggagcag

SEQ ID NO: 7277684 - DNA, 22 bp, Homo sapiens
agggagctaggatcctgaaggt

SEQ ID NO: 7277685 - DNA, 22 bp, Homo sapiens
agggaagccctggctgagaccc

SEQ ID NO: 7277686 - DNA, 22 bp, Homo sapiens
agggaagcttgttactgagaag

SEQ ID NO: 7277687 - DNA, 22 bp, Homo sapiens
agggaagaggaccagagtctct

SEQ ID NO: 7277688 - DNA, 22 bp, Homo sapiens
agggaattcactggaacgccct

SEQ ID NO: 7277689 - DNA, 22 bp, Homo sapiens
acatggaatgtgtactaagtta

SEQ ID NO: 7277690 - DNA, 22 bp, Homo sapiens
acatggcaaaagggactttaca

SEQ ID NO: 7277691 - DNA, 22 bp, Homo sapiens
acatggaagataaaaatactca

SEQ ID NO: 7277692 - DNA, 22 bp, Homo sapiens
acatggaagcaaagttctattt

SEQ ID NO: 7277693 - DNA, 20 bp, Homo sapiens
acatgcagtggtcatttcag

SEQ ID NO: 7277694 - DNA, 22 bp, Homo sapiens
acatgattttagtatcataata

SEQ ID NO: 7277695 - DNA, 22 bp, Homo sapiens
acatgcaaatgtgcatgcatgt

SEQ ID NO: 7277696 - DNA, 22 bp, Homo sapiens
acatgaaagttattctgagttg

SEQ ID NO: 7277697 - DNA, 17 bp, Homo sapiens
aggcaggcagagcggga

SEQ ID NO: 7277698 - DNA, 22 bp, Homo sapiens
acatttaacctttgaggaactg

SEQ ID NO: 7277699 - DNA, 22 bp, Homo sapiens
aggctagctttggctcagtaaa

SEQ ID NO: 7277700 - DNA, 22 bp, Homo sapiens
aggctagcaatgggagatgagt

SEQ ID NO: 7277701 - DNA, 22 bp, Homo sapiens
aggcgcagcacgtgagagttgg

SEQ ID NO: 7277702 - DNA, 23 bp, Homo sapiens
aggcgagctcttctccagcacgt

SEQ ID NO: 7277703 - DNA, 22 bp, Homo sapiens
aggctgaggctttccttggaga

SEQ ID NO: 7277704 - DNA, 22 bp, Homo sapiens
aggctgaggctggcagctccag

SEQ ID NO: 7277705 - DNA, 22 bp, Homo sapiens
aggctgaggcgggtagatcacc

SEQ ID NO: 7277706 - DNA, 22 bp, Homo sapiens
aggctgagtgctcccctagatg

SEQ ID NO: 7277707 - DNA, 20 bp, Homo sapiens
aggctgagttctatgcactt

SEQ ID NO: 7277708 - DNA, 22 bp, Homo sapiens
aggctgagggctcctgagggca

SEQ ID NO: 7277709 - DNA, 22 bp, Homo sapiens
aggctgagggctcctgagggca

SEQ ID NO: 7277710 - DNA, 22 bp, Homo sapiens
aggctgagtttctcattctcgc

SEQ ID NO: 7277711 - DNA, 22 bp, Homo sapiens
aggctgatgctggctgaggctg

SEQ ID NO: 7277712 - DNA, 22 bp, Homo sapiens
aatgggctttggccagtaggag

SEQ ID NO: 7277713 - DNA, 23 bp, Homo sapiens
aatggtcttcctccacccctctg

SEQ ID NO: 7277714 - DNA, 23 bp, Homo sapiens
agaagcagcttctggagtatcgg

SEQ ID NO: 7277715 - DNA, 22 bp, Homo sapiens
agaagcagactctgaggcaagg

SEQ ID NO: 7277716 - DNA, 22 bp, Homo sapiens
agacaatggaccaagcaccttc

SEQ ID NO: 7277717 - DNA, 22 bp, Homo sapiens
agacaattaaaaaattatgctt

SEQ ID NO: 7277718 - DNA, 22 bp, Homo sapiens
aatggcagtagttgcatgagag

SEQ ID NO: 7277719 - DNA, 19 bp, Homo sapiens
aatggcagatgccatatct

SEQ ID NO: 7277720 - DNA, 22 bp, Homo sapiens
agaccctgcattttccagggtt

SEQ ID NO: 7277721 - DNA, 22 bp, Homo sapiens
aattaaaaaaggagagcttgct

SEQ ID NO: 7277722 - DNA, 22 bp, Homo sapiens
agagacaggatatctgctcatg

SEQ ID NO: 7277723 - DNA, 22 bp, Homo sapiens
agagacagggttttgccatgtt

SEQ ID NO: 7277724 - DNA, 22 bp, Homo sapiens
agagcagtcaggctaggacact

SEQ ID NO: 7277725 - DNA, 22 bp, Homo sapiens
agagcagtcaggaacatgctta

SEQ ID NO: 7277726 - DNA, 22 bp, Homo sapiens
acaagcatgggctttgacatca

SEQ ID NO: 7277727 - DNA, 22 bp, Homo sapiens
acaatgaacgctttttaactgt

SEQ ID NO: 7277728 - DNA, 22 bp, Homo sapiens
acaatcttattagtagtataga

SEQ ID NO: 7277729 - DNA, 22 bp, Homo sapiens
acaatgaaaaaatttactgtgg

SEQ ID NO: 7277730 - DNA, 22 bp, Homo sapiens
acaatgaagataatgttgcagt

SEQ ID NO: 7277731 - DNA, 19 bp, Homo sapiens
acaatgaatgtgttctctt

SEQ ID NO: 7277732 - DNA, 22 bp, Homo sapiens
aattgagtgctagacatcatga

SEQ ID NO: 7277733 - DNA, 22 bp, Homo sapiens
aattgagtcatgctgtattgaa

SEQ ID NO: 7277734 - DNA, 22 bp, Homo sapiens
agaggctctttgcttgttctta

SEQ ID NO: 7277735 - DNA, 22 bp, Homo sapiens
agaggctcttgcccttcccaca

SEQ ID NO: 7277736 - DNA, 22 bp, Homo sapiens
agaggctctggtgggagttggt

SEQ ID NO: 7277737 - DNA, 22 bp, Homo sapiens
agaggctctgccgcctcaggta

SEQ ID NO: 7277738 - DNA, 18 bp, Homo sapiens
agaggcttaatgaatggc

SEQ ID NO: 7277739 - DNA, 22 bp, Homo sapiens
agaggcttacaaagattgatga

SEQ ID NO: 7277740 - DNA, 22 bp, Homo sapiens
agaggcttgacaatatgattgg

SEQ ID NO: 7277741 - DNA, 22 bp, Homo sapiens
acaaagtaggtcatcaaagctc

SEQ ID NO: 7277742 - DNA, 22 bp, Homo sapiens
acagattcactgcactggccat

SEQ ID NO: 7277743 - DNA, 19 bp, Homo sapiens
agctcctgattgtgcctcg

SEQ ID NO: 7277744 - DNA, 22 bp, Homo sapiens
agctcccagaaggccctgcgcc

SEQ ID NO: 7277745 - DNA, 22 bp, Homo sapiens
agctcccagagctcgagagtaa

SEQ ID NO: 7277746 - DNA, 22 bp, Homo sapiens
acagatgtacactcatatataa

SEQ ID NO: 7277747 - DNA, 22 bp, Homo sapiens
agctcctgcttgacagaagagg

SEQ ID NO: 7277748 - DNA, 22 bp, Homo sapiens
agctcctgcgcacggtgcacac

SEQ ID NO: 7277749 - DNA, 22 bp, Homo sapiens
agcctctctccagcttggcaga

SEQ ID NO: 7277750 - DNA, 22 bp, Homo sapiens
agcctctgactgtcagcaaggt

SEQ ID NO: 7277751 - DNA, 22 bp, Homo sapiens
acagatgaggcccatcagtctg

SEQ ID NO: 7277752 - DNA, 22 bp, Homo sapiens
acactttatgtctagatctggg

SEQ ID NO: 7277753 - DNA, 22 bp, Homo sapiens
acactgaagagcactttcaaag

SEQ ID NO: 7277754 - DNA, 22 bp, Homo sapiens
acactgaatgtttaagaacttg

SEQ ID NO: 7277755 - DNA, 22 bp, Homo sapiens
acacattaaaacgtctacaatg

SEQ ID NO: 7277756 - DNA, 19 bp, Homo sapiens
acacatgtgtgttatgtgc

SEQ ID NO: 7277757 - DNA, 22 bp, Homo sapiens
acacatgtatatgcttgtgtgt

SEQ ID NO: 7277758 - DNA, 18 bp, Homo sapiens
acacaggctgacagcacc

SEQ ID NO: 7277759 - DNA, 22 bp, Homo sapiens
agcagctgagccccagctgtga

SEQ ID NO: 7277760 - DNA, 22 bp, Homo sapiens
acaatgcaccagcatcttcacc

SEQ ID NO: 7277761 - DNA, 23 bp, Homo sapiens
agcagcaaaaatttatctttctg

SEQ ID NO: 7277762 - DNA, 22 bp, Homo sapiens
agcagatggagaatggagtcag

SEQ ID NO: 7277763 - DNA, 22 bp, Homo sapiens
aagctctctgtcccctggactg

SEQ ID NO: 7277764 - DNA, 22 bp, Homo sapiens
acagccttattgcgagcaaggc

SEQ ID NO: 7277765 - DNA, 22 bp, Homo sapiens
acagcctgtgtaccagctggga

SEQ ID NO: 7277766 - DNA, 22 bp, Homo sapiens
acatatgatattgaggatctca

SEQ ID NO: 7277767 - DNA, 22 bp, Homo sapiens
acatatgcgatcataggatgca

SEQ ID NO: 7277768 - DNA, 19 bp, Homo sapiens
acatatgtggatatacatg

SEQ ID NO: 7277769 - DNA, 22 bp, Homo sapiens
aaggcagagattagcagaatga

SEQ ID NO: 7277770 - DNA, 22 bp, Homo sapiens
acagtgtttcacttaaccgttt

SEQ ID NO: 7277771 - DNA, 22 bp, Homo sapiens
acagtgtttatgtacagattgt

SEQ ID NO: 7277772 - DNA, 22 bp, Homo sapiens
acagtgtttaagagatggcatt

SEQ ID NO: 7277773 - DNA, 22 bp, Homo sapiens
acagtgtttggcaatgcatgca

SEQ ID NO: 7277774 - DNA, 22 bp, Homo sapiens
acagtgttcttggcgctgagtg

SEQ ID NO: 7277775 - DNA, 22 bp, Homo sapiens
acagtgtttaaaaatcagatct

SEQ ID NO: 7277776 - DNA, 22 bp, Homo sapiens
acagtgtttaaaataatatgct

SEQ ID NO: 7277777 - DNA, 22 bp, Homo sapiens
acagtgttgtggctcttaatag

SEQ ID NO: 7277778 - DNA, 22 bp, Homo sapiens
acagtgttgtatttagtttgat

SEQ ID NO: 7277779 - DNA, 22 bp, Homo sapiens
acagtgttgaggtgcttgtttc

SEQ ID NO: 7277780 - DNA, 22 bp, Homo sapiens
acagtctgtcccccaggtgcta

SEQ ID NO: 7277781 - DNA, 22 bp, Homo sapiens
aaggagagagctttgctggaac

SEQ ID NO: 7277782 - DNA, 22 bp, Homo sapiens
aaggagagtacaggagttggta

SEQ ID NO: 7277783 - DNA, 22 bp, Homo sapiens
aaggagaggttgtccgtgttgt

SEQ ID NO: 7277784 - DNA, 22 bp, Homo sapiens
aaggagagagctttgctggaac

SEQ ID NO: 7277785 - DNA, 22 bp, Homo sapiens
aaggagagtacaggagttggta

SEQ ID NO: 7277786 - DNA, 22 bp, Homo sapiens
aaggctcggcaatgtgcggctc

SEQ ID NO: 7277787 - DNA, 22 bp, Homo sapiens
acattgtttgagaatacagatg

SEQ ID NO: 7277788 - DNA, 19 bp, Homo sapiens
aaggctggagaaggcctct

SEQ ID NO: 7277789 - DNA, 22 bp, Homo sapiens
aaggctggcaatatatttgtta

SEQ ID NO: 7277790 - DNA, 22 bp, Homo sapiens
aaggctggagatggttggaatg

SEQ ID NO: 7277791 - DNA, 21 bp, Homo sapiens
acattttctgttttaggaagt

SEQ ID NO: 7277792 - DNA, 22 bp, Homo sapiens
accctgagtcagacagcctgac

SEQ ID NO: 7277793 - DNA, 20 bp, Homo sapiens
accctgaggctccccagcct

SEQ ID NO: 7277794 - DNA, 22 bp, Homo sapiens
accctgagaaagtcacatgcat

SEQ ID NO: 7277795 - DNA, 22 bp, Homo sapiens
acccaggatgataatgttcaca

SEQ ID NO: 7277796 - DNA, 22 bp, Homo sapiens
acccaggaggcagaggttgcag

SEQ ID NO: 7277797 - DNA, 22 bp, Homo sapiens
acccaggaggtgacacagggct

SEQ ID NO: 7277798 - DNA, 22 bp, Homo sapiens
acccaggaggcaaggttgcagt

SEQ ID NO: 7277799 - DNA, 22 bp, Homo sapiens
acccaggagctctggggtcctc

SEQ ID NO: 7277800 - DNA, 22 bp, Homo sapiens
acccaggagccgtgagaggtta

SEQ ID NO: 7277801 - DNA, 22 bp, Homo sapiens
acccaggatagagtgctgcagt

SEQ ID NO: 7277802 - DNA, 22 bp, Homo sapiens
acccaggataatctgtgtatct

SEQ ID NO: 7277803 - DNA, 22 bp, Homo sapiens
acccaggaggtggaggctgcag

SEQ ID NO: 7277804 - DNA, 22 bp, Homo sapiens
acccagagtcagacagccatgg

SEQ ID NO: 7277805 - DNA, 22 bp, Homo sapiens
actatacaccaaaatattaagg

SEQ ID NO: 7277806 - DNA, 23 bp, Homo sapiens
actataaagttgttctgatttac

SEQ ID NO: 7277807 - DNA, 22 bp, Homo sapiens
actcagaagatgtgggtagata

SEQ ID NO: 7277808 - DNA, 22 bp, Homo sapiens
actatacagtatgtacgtgcac

SEQ ID NO: 7277809 - DNA, 22 bp, Homo sapiens
actctaatgctaatagtatttt

SEQ ID NO: 7277810 - DNA, 22 bp, Homo sapiens
actctaaatagcctcttaaaca

SEQ ID NO: 7277811 - DNA, 22 bp, Homo sapiens
actctcagggacagggtctggg

SEQ ID NO: 7277812 - DNA, 23 bp, Homo sapiens
actctcaggttctttccagcagg

SEQ ID NO: 7277813 - DNA, 22 bp, Homo sapiens
actgcactccagcctgggtgac

SEQ ID NO: 7277814 - DNA, 22 bp, Homo sapiens
actgaggtttttagtgttaaat

SEQ ID NO: 7277815 - DNA, 22 bp, Homo sapiens
actgaggtttcattttatcgct

SEQ ID NO: 7277816 - DNA, 22 bp, Homo sapiens
actgaggtttacttgaaggaga

SEQ ID NO: 7277817 - DNA, 22 bp, Homo sapiens
actgaggttgtagtaggaattc

SEQ ID NO: 7277818 - DNA, 22 bp, Homo sapiens
actgaggttgaaatagtgatgt

SEQ ID NO: 7277819 - DNA, 22 bp, Homo sapiens
actgaggttattgcaataaaat

SEQ ID NO: 7277820 - DNA, 21 bp, Homo sapiens
actgaggttagatgccttgcc

SEQ ID NO: 7277821 - DNA, 20 bp, Homo sapiens
actgaggttagataacaggt

SEQ ID NO: 7277822 - DNA, 22 bp, Homo sapiens
actgcactccaacctgggtgac

SEQ ID NO: 7277823 - DNA, 22 bp, Homo sapiens
actctgctgtttactctctata

SEQ ID NO: 7277824 - DNA, 22 bp, Homo sapiens
actctgctgtctgatggcagga

SEQ ID NO: 7277825 - DNA, 22 bp, Homo sapiens
actctgctgataggtcctcaga

SEQ ID NO: 7277826 - DNA, 23 bp, Homo sapiens
actgaggtactgaggttgtgaca

SEQ ID NO: 7277827 - DNA, 22 bp, Homo sapiens
actgaggtagggcacacctagg

SEQ ID NO: 7277828 - DNA, 22 bp, Homo sapiens
actgaggtataattgacataac

SEQ ID NO: 7277829 - DNA, 22 bp, Homo sapiens
actgaggtctatcatgagccag

SEQ ID NO: 7277830 - DNA, 22 bp, Homo sapiens
actgaggtcatgcatagtttct

SEQ ID NO: 7277831 - DNA, 22 bp, Homo sapiens
actgaggtcaggggtatgtgat

SEQ ID NO: 7277832 - DNA, 22 bp, Homo sapiens
actgaggtctcaggtggggaag

SEQ ID NO: 7277833 - DNA, 22 bp, Homo sapiens
actgaggtggggtctgcttgga

SEQ ID NO: 7277834 - DNA, 23 bp, Homo sapiens
aatgatttcatgatgatagcagc

SEQ ID NO: 7277835 - DNA, 22 bp, Homo sapiens
aatgattgcaaacattgagaac

SEQ ID NO: 7277836 - DNA, 22 bp, Homo sapiens
aatgatttcccctacacagaag

SEQ ID NO: 7277837 - DNA, 22 bp, Homo sapiens
aatcagaatcagttgacacagc

SEQ ID NO: 7277838 - DNA, 22 bp, Homo sapiens
aatcagcaaaggtcagctctaa

SEQ ID NO: 7277839 - DNA, 22 bp, Homo sapiens
aatcaggcacagcgactgcagc

SEQ ID NO: 7277840 - DNA, 22 bp, Homo sapiens
aatcagtattggtatagaatga

SEQ ID NO: 7277841 - DNA, 22 bp, Homo sapiens
aatatagttctggtattgttaa

SEQ ID NO: 7277842 - DNA, 22 bp, Homo sapiens
aatatagtgttagctcatttga

SEQ ID NO: 7277843 - DNA, 23 bp, Homo sapiens
actttattgaccccaggtcagtt

SEQ ID NO: 7277844 - DNA, 22 bp, Homo sapiens
actgttgaagtgccagcttgat

SEQ ID NO: 7277845 - DNA, 22 bp, Homo sapiens
actttgaaatgtgtaagagaga

SEQ ID NO: 7277846 - DNA, 22 bp, Homo sapiens
aagatgcttccactgcagtggc

SEQ ID NO: 7277847 - DNA, 22 bp, Homo sapiens
aagatgcttgcaaatttctgaa

SEQ ID NO: 7277848 - DNA, 22 bp, Homo sapiens
aagatgcttgagaactgtttga

SEQ ID NO: 7277849 - DNA, 22 bp, Homo sapiens
aagatgctcttaatgggtttat

SEQ ID NO: 7277850 - DNA, 22 bp, Homo sapiens
aagatgctggcaggaatagcta

SEQ ID NO: 7277851 - DNA, 22 bp, Homo sapiens
aagatgcttattgctcctgcag

SEQ ID NO: 7277852 - DNA, 22 bp, Homo sapiens
aagatgcagcttccacttttgc

SEQ ID NO: 7277853 - DNA, 22 bp, Homo sapiens
aagatgcagcaaactacttttt

SEQ ID NO: 7277854 - DNA, 22 bp, Homo sapiens
aagatgctaattgtggaagttg

SEQ ID NO: 7277855 - DNA, 22 bp, Homo sapiens
aagatgacagatgcttagagtc

SEQ ID NO: 7277856 - DNA, 22 bp, Homo sapiens
aagatgaccctgagggcaattg

SEQ ID NO: 7277857 - DNA, 22 bp, Homo sapiens
aagatgactatttatctgtaag

SEQ ID NO: 7277858 - DNA, 22 bp, Homo sapiens
aagcaatagcaacaactttaca

SEQ ID NO: 7277859 - DNA, 22 bp, Homo sapiens
aagatgttaaatctgtagaatt

SEQ ID NO: 7277860 - DNA, 22 bp, Homo sapiens
acacatatatacatatttgtgc

SEQ ID NO: 7277861 - DNA, 22 bp, Homo sapiens
aagagcaggctgtcaatggggc

SEQ ID NO: 7277862 - DNA, 22 bp, Homo sapiens
aagagcaggacagaatcagaac

SEQ ID NO: 7277863 - DNA, 21 bp, Homo sapiens
acacattatgagcatagactc

SEQ ID NO: 7277864 - DNA, 22 bp, Homo sapiens
aagcaccctttgtctggacatg

SEQ ID NO: 7277865 - DNA, 22 bp, Homo sapiens
aagcaatatactgatatgatta

SEQ ID NO: 7277866 - DNA, 22 bp, Homo sapiens
aagcagaatagaggcccttccc

SEQ ID NO: 7277867 - DNA, 22 bp, Homo sapiens
aagcagagaatctgggagcgag

SEQ ID NO: 7277868 - DNA, 22 bp, Homo sapiens
aagcagagaccggctaatggag

SEQ ID NO: 7277869 - DNA, 22 bp, Homo sapiens
aagcagagcaagcgtatttatt

SEQ ID NO: 7277870 - DNA, 22 bp, Homo sapiens
aagcagaggaccgacggaggga

SEQ ID NO: 7277871 - DNA, 22 bp, Homo sapiens
acagcagagcaccagggccact

SEQ ID NO: 7277872 - DNA, 22 bp, Homo sapiens
aagcagagggtatggccaggtt

SEQ ID NO: 7277873 - DNA, 22 bp, Homo sapiens
aagcagagggtatggccaggtt

SEQ ID NO: 7277874 - DNA, 22 bp, Homo sapiens
aagcagaggccacagagtgggc

SEQ ID NO: 7277875 - DNA, 22 bp, Homo sapiens
aagcagcttttgaagagtgagg

SEQ ID NO: 7277876 - DNA, 22 bp, Homo sapiens
aagcagctggaagagtaagatg

SEQ ID NO: 7277877 - DNA, 22 bp, Homo sapiens
aagagcaagtgggtagtgaagc

SEQ ID NO: 7277878 - DNA, 21 bp, Homo sapiens
acacaaacctcctcagcctgg

SEQ ID NO: 7277879 - DNA, 20 bp, Homo sapiens
aattttatctccatcctttg

SEQ ID NO: 7277880 - DNA, 20 bp, Homo sapiens
aattttatctccatcctttg

SEQ ID NO: 7277881 - DNA, 22 bp, Homo sapiens
aattttacttccctcagtgtag

SEQ ID NO: 7277882 - DNA, 22 bp, Homo sapiens
aattttaatcagtggtgctgag

SEQ ID NO: 7277883 - DNA, 22 bp, Homo sapiens
aattttaagcatatgactggtt

SEQ ID NO: 7277884 - DNA, 22 bp, Homo sapiens
aatttgttttcaagtcactgga

SEQ ID NO: 7277885 - DNA, 22 bp, Homo sapiens
aatttccaaatttctgtcacac

SEQ ID NO: 7277886 - DNA, 22 bp, Homo sapiens
aatttccagaccccatccacag

SEQ ID NO: 7277887 - DNA, 22 bp, Homo sapiens
aatttccagaccccatccacag

SEQ ID NO: 7277888 - DNA, 22 bp, Homo sapiens
aatttccagatcagatgactca

SEQ ID NO: 7277889 - DNA, 22 bp, Homo sapiens
aatgggaaaagagtatgattta

SEQ ID NO: 7277890 - DNA, 17 bp, Homo sapiens
aactgctttttttagcc

SEQ ID NO: 7277891 - DNA, 22 bp, Homo sapiens
aactgcttgtaaataatgttga

SEQ ID NO: 7277892 - DNA, 22 bp, Homo sapiens
aactggaagagtgaatataact

SEQ ID NO: 7277893 - DNA, 22 bp, Homo sapiens
aactttcttggatgtctcaaca

SEQ ID NO: 7277894 - DNA, 22 bp, Homo sapiens
aagaaaatcagttctggtcagt

SEQ ID NO: 7277895 - DNA, 22 bp, Homo sapiens
aattctataggcaagctatttt

SEQ ID NO: 7277896 - DNA, 22 bp, Homo sapiens
aagaacagattcagcctgaact

SEQ ID NO: 7277897 - DNA, 22 bp, Homo sapiens
aagaaattaaggaatgcaacga

SEQ ID NO: 7277898 - DNA, 22 bp, Homo sapiens
aatgacataagtgcagatgcta

SEQ ID NO: 7277899 - DNA, 22 bp, Homo sapiens
aatgacatgctttttaattata

SEQ ID NO: 7277900 - DNA, 22 bp, Homo sapiens
aactataatggggttaggaaat

SEQ ID NO: 7277901 - DNA, 22 bp, Homo sapiens
aacctggccccagattccccat

SEQ ID NO: 7277902 - DNA, 22 bp, Homo sapiens
aacctggccctaatcccagtag

SEQ ID NO: 7277903 - DNA, 22 bp, Homo sapiens
aacctggagcaccctcatatct

SEQ ID NO: 7277904 - DNA, 22 bp, Homo sapiens
aacatctgatcgaacagtgcca

SEQ ID NO: 7277905 - DNA, 22 bp, Homo sapiens
aacatccccttcatgtcatgat

SEQ ID NO: 7277906 - DNA, 22 bp, Homo sapiens
aacatctactaagtgccaggca

SEQ ID NO: 7277907 - DNA, 22 bp, Homo sapiens
aacatcagaatatccatgttgg

SEQ ID NO: 7277908 - DNA, 22 bp, Homo sapiens
aagtgtatatatgacttataaa

SEQ ID NO: 7277909 - DNA, 22 bp, Homo sapiens
aagtgtcctcattcaacatgca

SEQ ID NO: 7277910 - DNA, 22 bp, Homo sapiens
aaattattctcatgtgtttctt

SEQ ID NO: 7277911 - DNA, 22 bp, Homo sapiens
aaggctgagagtcacagtccta

SEQ ID NO: 7277912 - DNA, 22 bp, Homo sapiens
aaggctgagccagggcccctat

SEQ ID NO: 7277913 - DNA, 22 bp, Homo sapiens
aaggctgggtttgggatgtgat

SEQ ID NO: 7277914 - DNA, 22 bp, Homo sapiens
aaggcagccagatcctttgggt

SEQ ID NO: 7277915 - DNA, 22 bp, Homo sapiens
aaggcagcatgaatccctgtac

SEQ ID NO: 7277916 - DNA, 22 bp, Homo sapiens
aaggcagcagtgcacgactgat

SEQ ID NO: 7277917 - DNA, 19 bp, Homo sapiens
aaggcagcagtagcatcca

SEQ ID NO: 7277918 - DNA, 22 bp, Homo sapiens
aaggcagccctggctcagcctg

SEQ ID NO: 7277919 - DNA, 22 bp, Homo sapiens
aaggcagccatagcaccatcca

SEQ ID NO: 7277920 - DNA, 22 bp, Homo sapiens
aaggcagccatgtgctttgggt

SEQ ID NO: 7277921 - DNA, 22 bp, Homo sapiens
aaggcagcaactaatggatctc

SEQ ID NO: 7277922 - DNA, 22 bp, Homo sapiens
aaggcagcaggatttggtgact

SEQ ID NO: 7277923 - DNA, 22 bp, Homo sapiens
aaggcagcagaggaaaggtgct

SEQ ID NO: 7277924 - DNA, 22 bp, Homo sapiens
aaggcagcaccgcctcctgaaa

SEQ ID NO: 7277925 - DNA, 22 bp, Homo sapiens
aaggcagcaagaattccaggtt

SEQ ID NO: 7277926 - DNA, 22 bp, Homo sapiens
aaggcagcacagcaactgctca

SEQ ID NO: 7277927 - DNA, 22 bp, Homo sapiens
aaggaagatgaggtgctgctta

SEQ ID NO: 7277928 - DNA, 22 bp, Homo sapiens
aacaatgcttgccaagtgtgat

SEQ ID NO: 7277929 - DNA, 22 bp, Homo sapiens
aaattttaaggctggaacttaa

SEQ ID NO: 7277930 - DNA, 22 bp, Homo sapiens
aaggctggtggattatgaggtc

SEQ ID NO: 7277931 - DNA, 22 bp, Homo sapiens
aaggctggtcagatgtggtgaa

SEQ ID NO: 7277932 - DNA, 22 bp, Homo sapiens
aaggctggtggattatgaggtc

SEQ ID NO: 7277933 - DNA, 22 bp, Homo sapiens
aaaatattttagggccaggaga

SEQ ID NO: 7277934 - DNA, 22 bp, Homo sapiens
aaaattatggagtatcccaaag

SEQ ID NO: 7277935 - DNA, 22 bp, Homo sapiens
aaaattatagatctagtgcctg

SEQ ID NO: 7277936 - DNA, 22 bp, Homo sapiens
aaaattattcatggcttttgga

SEQ ID NO: 7277937 - DNA, 22 bp, Homo sapiens
aaaactaaatacgctttgcctc

SEQ ID NO: 7277938 - DNA, 22 bp, Homo sapiens
aaaaatacttcacttctgggtg

SEQ ID NO: 7277939 - DNA, 20 bp, Homo sapiens
aaacattcatgtacaagtga

SEQ ID NO: 7277940 - DNA, 22 bp, Homo sapiens
aaacattagacaccatatgctc

SEQ ID NO: 7277941 - DNA, 22 bp, Homo sapiens
aaactgtaagtgcctcaaggtc

SEQ ID NO: 7277942 - DNA, 22 bp, Homo sapiens
aaactgtattccatcctcatca

SEQ ID NO: 7277943 - DNA, 22 bp, Homo sapiens
aaacagcagctgtttaatttgc

SEQ ID NO: 7277944 - DNA, 22 bp, Homo sapiens
aaagaaatagatggcatttaaa

SEQ ID NO: 7277945 - DNA, 22 bp, Homo sapiens
aaatataatttctgcctcaata

SEQ ID NO: 7277946 - DNA, 22 bp, Homo sapiens
aagattatggcagataacaatt

SEQ ID NO: 7277947 - DNA, 22 bp, Homo sapiens
aagattatttaagacaggaacc

SEQ ID NO: 7277948 - DNA, 22 bp, Homo sapiens
aagcaggcatcttggaggtcaa

SEQ ID NO: 7277949 - DNA, 22 bp, Homo sapiens
aagatccatgagggcagagatt

SEQ ID NO: 7277950 - DNA, 22 bp, Homo sapiens
aagatcagctcccgagtctgag

SEQ ID NO: 7277951 - DNA, 22 bp, Homo sapiens
aagatattcaaagatttattag

SEQ ID NO: 7277952 - DNA, 22 bp, Homo sapiens
aaatctctggtcacagaactta

SEQ ID NO: 7277953 - DNA, 22 bp, Homo sapiens
aaatctctggcagaaataaact

SEQ ID NO: 7277954 - DNA, 22 bp, Homo sapiens
aaatctctgcaggcaaatgtga

SEQ ID NO: 7277955 - DNA, 22 bp, Homo sapiens
aaatctctgaacttaataatgc

SEQ ID NO: 7277956 - DNA, 22 bp, Homo sapiens
aagcaggccctgggccagggga

SEQ ID NO: 7277957 - DNA, 22 bp, Homo sapiens
aagcaggcattccagagacaat

SEQ ID NO: 7277958 - DNA, 22 bp, Homo sapiens
aagcaggcatgggaggccatcc

SEQ ID NO: 7277959 - DNA, 22 bp, Homo sapiens
aagccgaggccacacagcagga

SEQ ID NO: 7277960 - DNA, 22 bp, Homo sapiens
aagcccttggcgcacaccgggc

SEQ ID NO: 7277961 - DNA, 22 bp, Homo sapiens
aagataaactcttgatttctga

SEQ ID NO: 7277962 - DNA, 17 bp, Homo sapiens
aagaggtaactgtacta

SEQ ID NO: 7277963 - DNA, 22 bp, Homo sapiens
aagaggtaaccatagcaaccac

SEQ ID NO: 7277964 - DNA, 22 bp, Homo sapiens
aagaggtaatgactgcttgagt

SEQ ID NO: 7277965 - DNA, 22 bp, Homo sapiens
aaatactagaattcagagttga

SEQ ID NO: 7277966 - DNA, 18 bp, Homo sapiens
aagaggaggagcaggttg

SEQ ID NO: 7277967 - DNA, 22 bp, Homo sapiens
aagagggcagcacaggtgggtc

SEQ ID NO: 7277968 - DNA, 22 bp, Homo sapiens
aagagggctgcaatcttattgc

SEQ ID NO: 7277969 - DNA, 22 bp, Homo sapiens
aagagggcagcacaggtgggtc

SEQ ID NO: 7277970 - DNA, 22 bp, Homo sapiens
aagactgatgtccagtcccatg

SEQ ID NO: 7277971 - DNA, 22 bp, Homo sapiens
aagacagagggaagcaatgatg

SEQ ID NO: 7277972 - DNA, 22 bp, Homo sapiens
aacccaggagacggagtttgtg

SEQ ID NO: 7277973 - DNA, 22 bp, Homo sapiens
aacccactctacctggctccat

SEQ ID NO: 7277974 - DNA, 22 bp, Homo sapiens
aaccccagtaccccaggatatg

SEQ ID NO: 7277975 - DNA, 22 bp, Homo sapiens
aagaacagttgggaggtgagcc

SEQ ID NO: 7277976 - DNA, 22 bp, Homo sapiens
aagaacagttgggaggtgagcc

SEQ ID NO: 7277977 - DNA, 22 bp, Homo sapiens
aactgtagaagggacacaaaag

SEQ ID NO: 7277978 - DNA, 22 bp, Homo sapiens
aactgtaatttttacatagtaa

SEQ ID NO: 7277979 - DNA, 22 bp, Homo sapiens
aactgtaatgaattgttcatga

SEQ ID NO: 7277980 - DNA, 22 bp, Homo sapiens
aactgtaagtggttggaagaag

SEQ ID NO: 7277981 - DNA, 22 bp, Homo sapiens
aactgtaaggcttagaacagca

SEQ ID NO: 7277982 - DNA, 22 bp, Homo sapiens
aactgtaaggcttagaacagca

SEQ ID NO: 7277983 - DNA, 22 bp, Homo sapiens
aactgtaagaaataaaattctg

SEQ ID NO: 7277984 - DNA, 22 bp, Homo sapiens
aaagcagattctgatgcagtag

SEQ ID NO: 7277985 - DNA, 22 bp, Homo sapiens
aaagcagaggttgcagtgagct

SEQ ID NO: 7277986 - DNA, 22 bp, Homo sapiens
aaagcagaggtgatatgactta

SEQ ID NO: 7277987 - DNA, 22 bp, Homo sapiens
aaagcagaggtgatatgactta

SEQ ID NO: 7277988 - DNA, 22 bp, Homo sapiens
aaagcagagatcatggcttgta

SEQ ID NO: 7277989 - DNA, 19 bp, Homo sapiens
aaagcagaggagcatctga

SEQ ID NO: 7277990 - DNA, 22 bp, Homo sapiens
aaagcagagcagggcacttatg

SEQ ID NO: 7277991 - DNA, 22 bp, Homo sapiens
aaagcagaactgagagagctgg

SEQ ID NO: 7277992 - DNA, 22 bp, Homo sapiens
aaagcagaactgagagagctgg

SEQ ID NO: 7277993 - DNA, 22 bp, Homo sapiens
aaagcagactgatttgcatcac

SEQ ID NO: 7277994 - DNA, 22 bp, Homo sapiens
aaagcacttcaggagcagtttg

SEQ ID NO: 7277995 - DNA, 22 bp, Homo sapiens
aacatacatatttcagtgtcca

SEQ ID NO: 7277996 - DNA, 22 bp, Homo sapiens
aaagccattacaaaatttcata

SEQ ID NO: 7277997 - DNA, 22 bp, Homo sapiens
aacatataaactcttaagttca

SEQ ID NO: 7277998 - DNA, 22 bp, Homo sapiens
aaagcccccctgatctgagatg

SEQ ID NO: 7277999 - DNA, 22 bp, Homo sapiens
aaagccattgaactgtacttta

SEQ ID NO: 7278000 - DNA, 22 bp, Homo sapiens
aaagattatggcattgaaatac

SEQ ID NO: 7278001 - DNA, 22 bp, Homo sapiens
gtggtcatcattagtattatta

SEQ ID NO: 7278002 - DNA, 22 bp, Homo sapiens
gtggtgtggctggcagagttta

SEQ ID NO: 7278003 - DNA, 21 bp, Homo sapiens
gtggttctagagaaacagaat

SEQ ID NO: 7278004 - DNA, 21 bp, Homo sapiens
gtggttctagagaaacagaat

SEQ ID NO: 7278005 - DNA, 22 bp, Homo sapiens
gtggtgtaggtcacagttagga

SEQ ID NO: 7278006 - DNA, 22 bp, Homo sapiens
gtggtcatggaaggtcctacct

SEQ ID NO: 7278007 - DNA, 22 bp, Homo sapiens
gtggtcatctgggtttgtggca

SEQ ID NO: 7278008 - DNA, 22 bp, Homo sapiens
gtggtcatctaactaaattttc

SEQ ID NO: 7278009 - DNA, 22 bp, Homo sapiens
gtggtcatgttaattatgatcc

SEQ ID NO: 7278010 - DNA, 22 bp, Homo sapiens
gtggtcatttgtctgagctcca

SEQ ID NO: 7278011 - DNA, 22 bp, Homo sapiens
gtggtccatcatgcagagctcc

SEQ ID NO: 7278012 - DNA, 22 bp, Homo sapiens
gtgtcacaggcccagctcttca

SEQ ID NO: 7278013 - DNA, 22 bp, Homo sapiens
gttgtatttgcctgaatgcagt

SEQ ID NO: 7278014 - DNA, 22 bp, Homo sapiens
gttctgagtcctcctttgaagg

SEQ ID NO: 7278015 - DNA, 22 bp, Homo sapiens
gttctgcctgtggcttctgtgg

SEQ ID NO: 7278016 - DNA, 22 bp, Homo sapiens
gttctatttcagtaagcaggca

SEQ ID NO: 7278017 - DNA, 22 bp, Homo sapiens
gttctgagtcctcctttgaagg

SEQ ID NO: 7278018 - DNA, 22 bp, Homo sapiens
gttctctctgcttccaagatgg

SEQ ID NO: 7278019 - DNA, 22 bp, Homo sapiens
gttattttatctctgagaggtt

SEQ ID NO: 7278020 - DNA, 21 bp, Homo sapiens
gttattttaagtgagctttgc

SEQ ID NO: 7278021 - DNA, 22 bp, Homo sapiens
gttattttcattggctcagact

SEQ ID NO: 7278022 - DNA, 22 bp, Homo sapiens
gttattttaacttctcagtaat

SEQ ID NO: 7278023 - DNA, 22 bp, Homo sapiens
gtgtgcaggggcttggtggagc

SEQ ID NO: 7278024 - DNA, 22 bp, Homo sapiens
gtgtggggtcttctcttggcct

SEQ ID NO: 7278025 - DNA, 22 bp, Homo sapiens
gtgtgggggcagctctgatatg

SEQ ID NO: 7278026 - DNA, 22 bp, Homo sapiens
gtgtggggagctgcagccacat

SEQ ID NO: 7278027 - DNA, 22 bp, Homo sapiens
gtgtctctatctatgcctgaag

SEQ ID NO: 7278028 - DNA, 22 bp, Homo sapiens
gtgtccttatttctgtctctca

SEQ ID NO: 7278029 - DNA, 22 bp, Homo sapiens
gtgtccttcattggaatctctc

SEQ ID NO: 7278030 - DNA, 22 bp, Homo sapiens
gtgtcccaggcctctggaatta

SEQ ID NO: 7278031 - DNA, 22 bp, Homo sapiens
taaagcaggccacatatgtgat

SEQ ID NO: 7278032 - DNA, 22 bp, Homo sapiens
taaaggattttgtataatataa

SEQ ID NO: 7278033 - DNA, 22 bp, Homo sapiens
gtttaaataattaggggcctgt

SEQ ID NO: 7278034 - DNA, 22 bp, Homo sapiens
taaatcactgttcattccacac

SEQ ID NO: 7278035 - DNA, 22 bp, Homo sapiens
taaatcactgtactttattcct

SEQ ID NO: 7278036 - DNA, 22 bp, Homo sapiens
taaatcactcttctctcaccac

SEQ ID NO: 7278037 - DNA, 22 bp, Homo sapiens
taaatcactcctaataatcagt

SEQ ID NO: 7278038 - DNA, 22 bp, Homo sapiens
taaatcacccatctcctaatct

SEQ ID NO: 7278039 - DNA, 22 bp, Homo sapiens
gtggcattgacatgtaaacagt

SEQ ID NO: 7278040 - DNA, 22 bp, Homo sapiens
gtggcaggggtattccagctga

SEQ ID NO: 7278041 - DNA, 22 bp, Homo sapiens
gtggcaggagagacacagccat

SEQ ID NO: 7278042 - DNA, 22 bp, Homo sapiens
gtggcaggagactggaagatgg

SEQ ID NO: 7278043 - DNA, 20 bp, Homo sapiens
gtggcaggcagtgaaggagc

SEQ ID NO: 7278044 - DNA, 22 bp, Homo sapiens
gtggccaccctcggcacacaca

SEQ ID NO: 7278045 - DNA, 22 bp, Homo sapiens
gtggctcttgcatggggtctct

SEQ ID NO: 7278046 - DNA, 22 bp, Homo sapiens
gtggctctggctttccaggcgg

SEQ ID NO: 7278047 - DNA, 22 bp, Homo sapiens
gtggctgctgtcctctctggtt

SEQ ID NO: 7278048 - DNA, 22 bp, Homo sapiens
gtggcagcaaatgcctggacta

SEQ ID NO: 7278049 - DNA, 22 bp, Homo sapiens
gtggcagcggtgtgcaaggagg

SEQ ID NO: 7278050 - DNA, 22 bp, Homo sapiens
gtggcagagtgcggttctgacc

SEQ ID NO: 7278051 - DNA, 22 bp, Homo sapiens
gtggcagagccaggctttgaac

SEQ ID NO: 7278052 - DNA, 22 bp, Homo sapiens
gtggcagagccgtgcaggtagg

SEQ ID NO: 7278053 - DNA, 22 bp, Homo sapiens
gtggatggagctggaagccatt

SEQ ID NO: 7278054 - DNA, 22 bp, Homo sapiens
gtggacaggcaggctgtcgggg

SEQ ID NO: 7278055 - DNA, 22 bp, Homo sapiens
gtggaagaggcaagatagctct

SEQ ID NO: 7278056 - DNA, 22 bp, Homo sapiens
gtggaatgtccttgatcataag

SEQ ID NO: 7278057 - DNA, 22 bp, Homo sapiens
gtggaatgaatagatttgcatt

SEQ ID NO: 7278058 - DNA, 22 bp, Homo sapiens
gtggaaggaattaacagactag

SEQ ID NO: 7278059 - DNA, 21 bp, Homo sapiens
ggtgtccagaggagtccccag

SEQ ID NO: 7278060 - DNA, 22 bp, Homo sapiens
ggtgtccatcaggctgtgcttc

SEQ ID NO: 7278061 - DNA, 22 bp, Homo sapiens
gtaaacattactgtgctgtata

SEQ ID NO: 7278062 - DNA, 22 bp, Homo sapiens
gtaaaatagaataacgtggcta

SEQ ID NO: 7278063 - DNA, 23 bp, Homo sapiens
gtaaaatacgcagtgcagtgtga

SEQ ID NO: 7278064 - DNA, 22 bp, Homo sapiens
gtaaataactggtaattggggt

SEQ ID NO: 7278065 - DNA, 22 bp, Homo sapiens
gtctgagggttgtgctggagga

SEQ ID NO: 7278066 - DNA, 22 bp, Homo sapiens
gtctgggattggggtaaagaag

SEQ ID NO: 7278067 - DNA, 22 bp, Homo sapiens
gtccatgactgtgactcacatg

SEQ ID NO: 7278068 - DNA, 22 bp, Homo sapiens
gtccatgattctgtgacaccct

SEQ ID NO: 7278069 - DNA, 22 bp, Homo sapiens
gtccatgattctgtgtagtaga

SEQ ID NO: 7278070 - DNA, 22 bp, Homo sapiens
gtcctggtagctggcttggtca

SEQ ID NO: 7278071 - DNA, 22 bp, Homo sapiens
gtcctggtagggctctgtgtct

SEQ ID NO: 7278072 - DNA, 22 bp, Homo sapiens
gtcccaggtgggctccacctct

SEQ ID NO: 7278073 - DNA, 22 bp, Homo sapiens
gtcccataagtagtgcaacttg

SEQ ID NO: 7278074 - DNA, 22 bp, Homo sapiens
gtcccataagtagtgcaacttg

SEQ ID NO: 7278075 - DNA, 22 bp, Homo sapiens
gtcagaggggcagctgccaggc

SEQ ID NO: 7278076 - DNA, 18 bp, Homo sapiens
gtcagaggatggggaaat

SEQ ID NO: 7278077 - DNA, 22 bp, Homo sapiens
gtcagaggaggctgagtaggaa

SEQ ID NO: 7278078 - DNA, 22 bp, Homo sapiens
gtatgtgctcagtaagtacatg

SEQ ID NO: 7278079 - DNA, 22 bp, Homo sapiens
gtatgtgcaattcactgtgaga

SEQ ID NO: 7278080 - DNA, 22 bp, Homo sapiens
ggagtggcctctcctgtgcagg

SEQ ID NO: 7278081 - DNA, 22 bp, Homo sapiens
ggagtgggaacaatgacatggt

SEQ ID NO: 7278082 - DNA, 22 bp, Homo sapiens
ggcacacatagatctgcactgg

SEQ ID NO: 7278083 - DNA, 22 bp, Homo sapiens
ggcaaggcctgcagctcagtgt

SEQ ID NO: 7278084 - DNA, 22 bp, Homo sapiens
ggcagacacctttatgtctaat

SEQ ID NO: 7278085 - DNA, 18 bp, Homo sapiens
ggcagacgcgaggggcgg

SEQ ID NO: 7278086 - DNA, 22 bp, Homo sapiens
ggcagactgtaataggagaatt

SEQ ID NO: 7278087 - DNA, 22 bp, Homo sapiens
ggcagagaatctggctgtttac

SEQ ID NO: 7278088 - DNA, 22 bp, Homo sapiens
ggcagagactgggttggcagag

SEQ ID NO: 7278089 - DNA, 23 bp, Homo sapiens
ggcagagagcatggctggggccc

SEQ ID NO: 7278090 - DNA, 23 bp, Homo sapiens
ggcagctctcatctgatgactga

SEQ ID NO: 7278091 - DNA, 22 bp, Homo sapiens
ggcagctgcacgttgtcccgtc

SEQ ID NO: 7278092 - DNA, 22 bp, Homo sapiens
ggcagctctgctccacatgagt

SEQ ID NO: 7278093 - DNA, 22 bp, Homo sapiens
ggcagctgtgaagtgcctcaca

SEQ ID NO: 7278094 - DNA, 22 bp, Homo sapiens
ggcagctgtctctgagttagca

SEQ ID NO: 7278095 - DNA, 22 bp, Homo sapiens
ggcagctgtctctgagttagca

SEQ ID NO: 7278096 - DNA, 22 bp, Homo sapiens
ggcagctgtaagatgagtgaat

SEQ ID NO: 7278097 - DNA, 22 bp, Homo sapiens
ggcagctgtaagatgagtgaat

SEQ ID NO: 7278098 - DNA, 22 bp, Homo sapiens
ggcagctggggcagtgccctgt

SEQ ID NO: 7278099 - DNA, 22 bp, Homo sapiens
ggcagctgggttggccagaaac

SEQ ID NO: 7278100 - DNA, 22 bp, Homo sapiens
ggcagctgggttggccagaaac

SEQ ID NO: 7278101 - DNA, 22 bp, Homo sapiens
ggcaggctcagcagccaaggag

SEQ ID NO: 7278102 - DNA, 22 bp, Homo sapiens
ggcaggcattgcaacatgtaca

SEQ ID NO: 7278103 - DNA, 22 bp, Homo sapiens
ggcaggctgcttgggtcatgtc

SEQ ID NO: 7278104 - DNA, 22 bp, Homo sapiens
ggcaggctgggtgtcatggagt

SEQ ID NO: 7278105 - DNA, 19 bp, Homo sapiens
ggcaggctggatagagagg

SEQ ID NO: 7278106 - DNA, 22 bp, Homo sapiens
ggcaggctgcttgggtcatgtc

SEQ ID NO: 7278107 - DNA, 20 bp, Homo sapiens
ggcaggtgctcgcttggtct

SEQ ID NO: 7278108 - DNA, 20 bp, Homo sapiens
ggagggtggaagaaagcaag

SEQ ID NO: 7278109 - DNA, 22 bp, Homo sapiens
ggaggggtctctagcgaggaga

SEQ ID NO: 7278110 - DNA, 22 bp, Homo sapiens
ggaggggaggtccagctgatct

SEQ ID NO: 7278111 - DNA, 22 bp, Homo sapiens
ggaggggagtctcccaaagccg

SEQ ID NO: 7278112 - DNA, 22 bp, Homo sapiens
ggaggggagatgtttgggctca

SEQ ID NO: 7278113 - DNA, 22 bp, Homo sapiens
ggaggggaggattaatgacaaa

SEQ ID NO: 7278114 - DNA, 22 bp, Homo sapiens
ggaggtggcagagggacattct

SEQ ID NO: 7278115 - DNA, 22 bp, Homo sapiens
ggaggtgggctaaggactctct

SEQ ID NO: 7278116 - DNA, 22 bp, Homo sapiens
ggaggtggtggcagtgacaatt

SEQ ID NO: 7278117 - DNA, 22 bp, Homo sapiens
ggagtaggagtagaactcatca

SEQ ID NO: 7278118 - DNA, 22 bp, Homo sapiens
ggaggtgggattaggacctaaa

SEQ ID NO: 7278119 - DNA, 22 bp, Homo sapiens
ggaggtggcagggaacataatt

SEQ ID NO: 7278120 - DNA, 21 bp, Homo sapiens
ggagggcagcccagactggct

SEQ ID NO: 7278121 - DNA, 22 bp, Homo sapiens
ggagggacccactctagaggtg

SEQ ID NO: 7278122 - DNA, 22 bp, Homo sapiens
ggagggaatgtctagcattctt

SEQ ID NO: 7278123 - DNA, 22 bp, Homo sapiens
ggaggggaactaatcccgtgac

SEQ ID NO: 7278124 - DNA, 22 bp, Homo sapiens
ggagggctgccaggtggagcgg

SEQ ID NO: 7278125 - DNA, 22 bp, Homo sapiens
ggagggctgagactggggtctg

SEQ ID NO: 7278126 - DNA, 22 bp, Homo sapiens
ggaggcggggaaggcatcccat

SEQ ID NO: 7278127 - DNA, 22 bp, Homo sapiens
ggaggctgaggcaggcggatca

SEQ ID NO: 7278128 - DNA, 22 bp, Homo sapiens
ggagctcaggcccagcaaggcc

SEQ ID NO: 7278129 - DNA, 22 bp, Homo sapiens
ggagctcataacaaggtagcca

SEQ ID NO: 7278130 - DNA, 22 bp, Homo sapiens
ggaggaagcacacggcttgtat

SEQ ID NO: 7278131 - DNA, 22 bp, Homo sapiens
ggaggacactggctctgccttc

SEQ ID NO: 7278132 - DNA, 22 bp, Homo sapiens
ggaggacaggggctgcagcaca

SEQ ID NO: 7278133 - DNA, 22 bp, Homo sapiens
ggaggcagaatagagtgtgggt

SEQ ID NO: 7278134 - DNA, 22 bp, Homo sapiens
ggaggaggcggcagaagttcct

SEQ ID NO: 7278135 - DNA, 22 bp, Homo sapiens
ggaggccacggtttagcaccga

SEQ ID NO: 7278136 - DNA, 22 bp, Homo sapiens
ggaggccaagtcactgacctgg

SEQ ID NO: 7278137 - DNA, 22 bp, Homo sapiens
ggaggccaccatggagtcactt

SEQ ID NO: 7278138 - DNA, 22 bp, Homo sapiens
ggaggccagggacccagtcagc

SEQ ID NO: 7278139 - DNA, 22 bp, Homo sapiens
ggaggccagcctgaggctgagg

SEQ ID NO: 7278140 - DNA, 22 bp, Homo sapiens
ggaggccagcctgaggctgagg

SEQ ID NO: 7278141 - DNA, 22 bp, Homo sapiens
ggagatgcttcttgtgtttatt

SEQ ID NO: 7278142 - DNA, 23 bp, Homo sapiens
ggagatgcttaagagtggttgag

SEQ ID NO: 7278143 - DNA, 22 bp, Homo sapiens
ggagatggaatagattctgact

SEQ ID NO: 7278144 - DNA, 22 bp, Homo sapiens
ggagatgccagaattgcaaatt

SEQ ID NO: 7278145 - DNA, 22 bp, Homo sapiens
ggagcggagggagggccactgt

SEQ ID NO: 7278146 - DNA, 22 bp, Homo sapiens
ggagaggggcaagtttatctag

SEQ ID NO: 7278147 - DNA, 23 bp, Homo sapiens
ggagaggggtgtgggcatcttta

SEQ ID NO: 7278148 - DNA, 22 bp, Homo sapiens
ggagagggtgtggaaagttatc

SEQ ID NO: 7278149 - DNA, 22 bp, Homo sapiens
ggagacagggttgaaccacgca

SEQ ID NO: 7278150 - DNA, 22 bp, Homo sapiens
ggagaaggaatattggagtagg

SEQ ID NO: 7278151 - DNA, 22 bp, Homo sapiens
ggaagtgtttgtgcagatggcc

SEQ ID NO: 7278152 - DNA, 22 bp, Homo sapiens
ggaaaactgaggctctcagcag

SEQ ID NO: 7278153 - DNA, 20 bp, Homo sapiens
ggaaaaatgcatgctcaaga

SEQ ID NO: 7278154 - DNA, 22 bp, Homo sapiens
ggaactttttaacaagctgctg

SEQ ID NO: 7278155 - DNA, 22 bp, Homo sapiens
ggaactttaggatcctggctca

SEQ ID NO: 7278156 - DNA, 21 bp, Homo sapiens
ggaactttcatgaatctagca

SEQ ID NO: 7278157 - DNA, 22 bp, Homo sapiens
gcttattgtttctaatagacga

SEQ ID NO: 7278158 - DNA, 22 bp, Homo sapiens
gcttagaagattgaccctggtt

SEQ ID NO: 7278159 - DNA, 22 bp, Homo sapiens
gcttcctgggacaggctatgtg

SEQ ID NO: 7278160 - DNA, 22 bp, Homo sapiens
gcttctgatgtcagacttctgg

SEQ ID NO: 7278161 - DNA, 22 bp, Homo sapiens
gcttccttctaccacatcatgc

SEQ ID NO: 7278162 - DNA, 22 bp, Homo sapiens
gcttccttattgttgccatagt

SEQ ID NO: 7278163 - DNA, 17 bp, Homo sapiens
gcttcctgtgctgggga

SEQ ID NO: 7278164 - DNA, 22 bp, Homo sapiens
ggggggtgctgatcagtggagc

SEQ ID NO: 7278165 - DNA, 22 bp, Homo sapiens
gggtgacattaggaagatagac

SEQ ID NO: 7278166 - DNA, 22 bp, Homo sapiens
gggctagcctcttccctgctcc

SEQ ID NO: 7278167 - DNA, 22 bp, Homo sapiens
gggctagcctcttccctgctcc

SEQ ID NO: 7278168 - DNA, 22 bp, Homo sapiens
gggctgagaattcagctttcct

SEQ ID NO: 7278169 - DNA, 22 bp, Homo sapiens
gggctgagacgatggggtcttc

SEQ ID NO: 7278170 - DNA, 22 bp, Homo sapiens
gggctgagaagttgatcccaag

SEQ ID NO: 7278171 - DNA, 22 bp, Homo sapiens
gggcggggtggctcatgcctgt

SEQ ID NO: 7278172 - DNA, 22 bp, Homo sapiens
gggccatgagaggttcatcaac

SEQ ID NO: 7278173 - DNA, 22 bp, Homo sapiens
gggccatgagaggttcatcaac

SEQ ID NO: 7278174 - DNA, 22 bp, Homo sapiens
gggcagaggttcaacttcaaca

SEQ ID NO: 7278175 - DNA, 18 bp, Homo sapiens
gggcagcacagcagcctc

SEQ ID NO: 7278176 - DNA, 22 bp, Homo sapiens
gggcagcactcatacctatatt

SEQ ID NO: 7278177 - DNA, 22 bp, Homo sapiens
gggcagcacgtttcaggaggat

SEQ ID NO: 7278178 - DNA, 22 bp, Homo sapiens
gggcagcagaattggacagaaa

SEQ ID NO: 7278179 - DNA, 22 bp, Homo sapiens
gggcagctagccctctagccca

SEQ ID NO: 7278180 - DNA, 22 bp, Homo sapiens
gggcagctcctgtggaatccac

SEQ ID NO: 7278181 - DNA, 20 bp, Homo sapiens
gggcagctcccctcattctg

SEQ ID NO: 7278182 - DNA, 22 bp, Homo sapiens
gggcagctcagccaccatgcag

SEQ ID NO: 7278183 - DNA, 22 bp, Homo sapiens
gggcagctctcacagcagccaa

SEQ ID NO: 7278184 - DNA, 22 bp, Homo sapiens
gggcagctcggaagtgggaaag

SEQ ID NO: 7278185 - DNA, 22 bp, Homo sapiens
gggcagctcctgtggaatccac

SEQ ID NO: 7278186 - DNA, 22 bp, Homo sapiens
gggacgggcagtccaaggggtc

SEQ ID NO: 7278187 - DNA, 22 bp, Homo sapiens
gggatggggagctggaaagggg

SEQ ID NO: 7278188 - DNA, 22 bp, Homo sapiens
gggcagaggggcgcttccctct

SEQ ID NO: 7278189 - DNA, 22 bp, Homo sapiens
gggatcgtcatggaaagtgcta

SEQ ID NO: 7278190 - DNA, 22 bp, Homo sapiens
ggcttccaaggtcctctccacc

SEQ ID NO: 7278191 - DNA, 22 bp, Homo sapiens
ggcttccagctgggccttggag

SEQ ID NO: 7278192 - DNA, 22 bp, Homo sapiens
gggaacagggcctgagctgggg

SEQ ID NO: 7278193 - DNA, 22 bp, Homo sapiens
ggctcctgttttaaaaggtgaa

SEQ ID NO: 7278194 - DNA, 23 bp, Homo sapiens
ggctcctggattcaaatcctgcc

SEQ ID NO: 7278195 - DNA, 22 bp, Homo sapiens
ggctgcagaggcccccagtggg

SEQ ID NO: 7278196 - DNA, 22 bp, Homo sapiens
ggctgcagaggcccccagtggg

SEQ ID NO: 7278197 - DNA, 22 bp, Homo sapiens
ggctgcagagctgggtgggcct

SEQ ID NO: 7278198 - DNA, 19 bp, Homo sapiens
ggctgcagagccccggcgc

SEQ ID NO: 7278199 - DNA, 22 bp, Homo sapiens
ggctgagttgagaggattactt

SEQ ID NO: 7278200 - DNA, 22 bp, Homo sapiens
ggctgatgagcttagctagaga

SEQ ID NO: 7278201 - DNA, 22 bp, Homo sapiens
ggctgatgagcttagctagaga

SEQ ID NO: 7278202 - DNA, 22 bp, Homo sapiens
ggctgatgggcatgagctgtca

SEQ ID NO: 7278203 - DNA, 22 bp, Homo sapiens
ggctgatgggcatgagctgtca

SEQ ID NO: 7278204 - DNA, 22 bp, Homo sapiens
ggctgcaggaacgacggagggg

SEQ ID NO: 7278205 - DNA, 22 bp, Homo sapiens
ggctgcaggcagaggctgtctg

SEQ ID NO: 7278206 - DNA, 22 bp, Homo sapiens
ggctgctgaacaagggaaccct

SEQ ID NO: 7278207 - DNA, 22 bp, Homo sapiens
ggcctgggcctttgtgttttga

SEQ ID NO: 7278208 - DNA, 22 bp, Homo sapiens
ggctccaccctgcttccagaag

SEQ ID NO: 7278209 - DNA, 22 bp, Homo sapiens
ggctcatgtttcagaaagtgga

SEQ ID NO: 7278210 - DNA, 22 bp, Homo sapiens
ggcccacactgacagctgagct

SEQ ID NO: 7278211 - DNA, 17 bp, Homo sapiens
ggccagaggcggggctg

SEQ ID NO: 7278212 - DNA, 22 bp, Homo sapiens
ggccagagctcaaacagtcgca

SEQ ID NO: 7278213 - DNA, 22 bp, Homo sapiens
ggcaggtgctgggagcatctca

SEQ ID NO: 7278214 - DNA, 22 bp, Homo sapiens
ggccacctgggatctcatcctg

SEQ ID NO: 7278215 - DNA, 20 bp, Homo sapiens
ggccacctgcttcagacccc

SEQ ID NO: 7278216 - DNA, 22 bp, Homo sapiens
gccgaggctctgcccagctgct

SEQ ID NO: 7278217 - DNA, 22 bp, Homo sapiens
gccggggctggggagagacatg

SEQ ID NO: 7278218 - DNA, 22 bp, Homo sapiens
gccgggttcaagccattctcct

SEQ ID NO: 7278219 - DNA, 22 bp, Homo sapiens
gccctctaccttggctatagaa

SEQ ID NO: 7278220 - DNA, 22 bp, Homo sapiens
gcccttccttagacagcaggat

SEQ ID NO: 7278221 - DNA, 22 bp, Homo sapiens
gcccttacagggtggtcagcca

SEQ ID NO: 7278222 - DNA, 22 bp, Homo sapiens
gcccaggagttggaggctgcag

SEQ ID NO: 7278223 - DNA, 22 bp, Homo sapiens
gcccaggaggcagaggttgtgg

SEQ ID NO: 7278224 - DNA, 22 bp, Homo sapiens
gcccaggaggtcaagtagctat

SEQ ID NO: 7278225 - DNA, 22 bp, Homo sapiens
gcccaggatggtgtgtagtggt

SEQ ID NO: 7278226 - DNA, 22 bp, Homo sapiens
gcccaggattctttcttcctta

SEQ ID NO: 7278227 - DNA, 22 bp, Homo sapiens
gcccaggatctgctcagatcat

SEQ ID NO: 7278228 - DNA, 22 bp, Homo sapiens
gcccaggatggctggaggtgct

SEQ ID NO: 7278229 - DNA, 22 bp, Homo sapiens
gcccaggatggagaatagtggt

SEQ ID NO: 7278230 - DNA, 22 bp, Homo sapiens
gcccaggagtttgcattttaac

SEQ ID NO: 7278231 - DNA, 22 bp, Homo sapiens
gcccaggagttggtggctgcag

SEQ ID NO: 7278232 - DNA, 22 bp, Homo sapiens
gcccaggataatgctgtccctg

SEQ ID NO: 7278233 - DNA, 20 bp, Homo sapiens
gcccaggatctctgaggcat

SEQ ID NO: 7278234 - DNA, 22 bp, Homo sapiens
gccagtgtttatagcagtgagg

SEQ ID NO: 7278235 - DNA, 19 bp, Homo sapiens
gccagtgtgtggtacagtg

SEQ ID NO: 7278236 - DNA, 18 bp, Homo sapiens
gcctgcctagagcttgcc

SEQ ID NO: 7278237 - DNA, 22 bp, Homo sapiens
gcctgcctcaaaatcccagttc

SEQ ID NO: 7278238 - DNA, 20 bp, Homo sapiens
gcctgcctcagctagctgag

SEQ ID NO: 7278239 - DNA, 22 bp, Homo sapiens
gcctgcctgctgtcatctgcct

SEQ ID NO: 7278240 - DNA, 19 bp, Homo sapiens
gcctgcctgggtttctgag

SEQ ID NO: 7278241 - DNA, 22 bp, Homo sapiens
gcctgcctgttggctgaggtgc

SEQ ID NO: 7278242 - DNA, 22 bp, Homo sapiens
gcctgcctttgtatgaccctga

SEQ ID NO: 7278243 - DNA, 22 bp, Homo sapiens
gcctgctcagacctagcaggcc

SEQ ID NO: 7278244 - DNA, 22 bp, Homo sapiens
gcctgctcccagttggcgcctc

SEQ ID NO: 7278245 - DNA, 22 bp, Homo sapiens
gcctgctctccggatccctgat

SEQ ID NO: 7278246 - DNA, 22 bp, Homo sapiens
gcctgctctgacatccatccca

SEQ ID NO: 7278247 - DNA, 22 bp, Homo sapiens
gcctgcttcacggacaggcctc

SEQ ID NO: 7278248 - DNA, 22 bp, Homo sapiens
gctggagagtgaggggagcaag

SEQ ID NO: 7278249 - DNA, 22 bp, Homo sapiens
gctggagatgctatgcagaggg

SEQ ID NO: 7278250 - DNA, 22 bp, Homo sapiens
gctggagccattggcttggcct

SEQ ID NO: 7278251 - DNA, 22 bp, Homo sapiens
gctggagccttctgctctgttg

SEQ ID NO: 7278252 - DNA, 22 bp, Homo sapiens
gctggagctgagttccctgggc

SEQ ID NO: 7278253 - DNA, 22 bp, Homo sapiens
gctggcctgcaaagcccggctg

SEQ ID NO: 7278254 - DNA, 22 bp, Homo sapiens
gctggcctgaccagccacaggc

SEQ ID NO: 7278255 - DNA, 22 bp, Homo sapiens
gctggcctctacaggccggcca

SEQ ID NO: 7278256 - DNA, 22 bp, Homo sapiens
gctggcctgggctcaagaccag

SEQ ID NO: 7278257 - DNA, 22 bp, Homo sapiens
gctggcctgggcagcctgtcgg

SEQ ID NO: 7278258 - DNA, 22 bp, Homo sapiens
gctggcctgctgggcaccaccg

SEQ ID NO: 7278259 - DNA, 22 bp, Homo sapiens
gctgggcagcccctacagagag

SEQ ID NO: 7278260 - DNA, 22 bp, Homo sapiens
gctgggcagcccctacagagag

SEQ ID NO: 7278261 - DNA, 22 bp, Homo sapiens
gctgggcagcctggccgctgcc

SEQ ID NO: 7278262 - DNA, 22 bp, Homo sapiens
gctgggcacctctcccagattg

SEQ ID NO: 7278263 - DNA, 22 bp, Homo sapiens
gctgagctagaaaaggaccaca

SEQ ID NO: 7278264 - DNA, 22 bp, Homo sapiens
gctgaggaggtgtggttaggtg

SEQ ID NO: 7278265 - DNA, 22 bp, Homo sapiens
gctgagcaggtgtaaggaaggc

SEQ ID NO: 7278266 - DNA, 22 bp, Homo sapiens
gctgagcaggtttgatgctttt

SEQ ID NO: 7278267 - DNA, 22 bp, Homo sapiens
gctgaggatatagcaggaacaa

SEQ ID NO: 7278268 - DNA, 22 bp, Homo sapiens
gctgaggattacttgaagtcag

SEQ ID NO: 7278269 - DNA, 20 bp, Homo sapiens
gctgaggattcctggcccct

SEQ ID NO: 7278270 - DNA, 22 bp, Homo sapiens
gctgcctgctcacccggcctgg

SEQ ID NO: 7278271 - DNA, 22 bp, Homo sapiens
gctgcctgctcggctcctggga

SEQ ID NO: 7278272 - DNA, 22 bp, Homo sapiens
gctgcctggaataacggctggc

SEQ ID NO: 7278273 - DNA, 22 bp, Homo sapiens
gctgcctggagctcagcctgcc

SEQ ID NO: 7278274 - DNA, 22 bp, Homo sapiens
gctgctctacccatgcatctgt

SEQ ID NO: 7278275 - DNA, 20 bp, Homo sapiens
gctgctcgctgcagtcactc

SEQ ID NO: 7278276 - DNA, 22 bp, Homo sapiens
gctgcctggtttctcagctgca

SEQ ID NO: 7278277 - DNA, 22 bp, Homo sapiens
gctgctctctccctaagttggg

SEQ ID NO: 7278278 - DNA, 22 bp, Homo sapiens
gctgctctgaaaatgactgttg

SEQ ID NO: 7278279 - DNA, 22 bp, Homo sapiens
gctgctctggctctgcagtgtc

SEQ ID NO: 7278280 - DNA, 19 bp, Homo sapiens
gctgctctgggtctcatct

SEQ ID NO: 7278281 - DNA, 19 bp, Homo sapiens
gctgctctgggtctcatct

SEQ ID NO: 7278282 - DNA, 20 bp, Homo sapiens
gctgctctccacggtctgca

SEQ ID NO: 7278283 - DNA, 22 bp, Homo sapiens
gctgctctccaagcctccttga

SEQ ID NO: 7278284 - DNA, 22 bp, Homo sapiens
gctgctgcctgtagccagggtg

SEQ ID NO: 7278285 - DNA, 21 bp, Homo sapiens
gctggagagccaggcaggggc

SEQ ID NO: 7278286 - DNA, 22 bp, Homo sapiens
gctgctcttttcagagatgaga

SEQ ID NO: 7278287 - DNA, 22 bp, Homo sapiens
gctgctctgtgacagcctccgg

SEQ ID NO: 7278288 - DNA, 22 bp, Homo sapiens
gctgctctgttaattgctgtaa

SEQ ID NO: 7278289 - DNA, 22 bp, Homo sapiens
gctgagattacgggcatgagcc

SEQ ID NO: 7278290 - DNA, 22 bp, Homo sapiens
gctgagcacacctagggtagag

SEQ ID NO: 7278291 - DNA, 22 bp, Homo sapiens
gctgagcagcctaagcaaattt

SEQ ID NO: 7278292 - DNA, 22 bp, Homo sapiens
gctgagagtgggtgcagtgctt

SEQ ID NO: 7278293 - DNA, 22 bp, Homo sapiens
gctcttgatttccaggagctag

SEQ ID NO: 7278294 - DNA, 22 bp, Homo sapiens
gctcttgaccttggagaactcg

SEQ ID NO: 7278295 - DNA, 22 bp, Homo sapiens
gctcttgatacatcaagaactt

SEQ ID NO: 7278296 - DNA, 22 bp, Homo sapiens
gctcttctcagattgtacactc

SEQ ID NO: 7278297 - DNA, 22 bp, Homo sapiens
gctcttgaaaatcaaaagggaa

SEQ ID NO: 7278298 - DNA, 22 bp, Homo sapiens
gctctctttttccagtggtggt

SEQ ID NO: 7278299 - DNA, 22 bp, Homo sapiens
gctctgagtgattaaggagctt

SEQ ID NO: 7278300 - DNA, 22 bp, Homo sapiens
gctctgccaaggacccattctc

SEQ ID NO: 7278301 - DNA, 22 bp, Homo sapiens
gctcctcttatttcatcagggc

SEQ ID NO: 7278302 - DNA, 22 bp, Homo sapiens
gctccaggaggatgaccttcct

SEQ ID NO: 7278303 - DNA, 22 bp, Homo sapiens
gctccaggagagggaagcagat

SEQ ID NO: 7278304 - DNA, 22 bp, Homo sapiens
gctccaggagctcacagctcgc

SEQ ID NO: 7278305 - DNA, 22 bp, Homo sapiens
gctcattcagccagggcccggt

SEQ ID NO: 7278306 - DNA, 22 bp, Homo sapiens
gctccaggaagggaaatctcca

SEQ ID NO: 7278307 - DNA, 22 bp, Homo sapiens
gatgtgtgctgcatagtatatt

SEQ ID NO: 7278308 - DNA, 18 bp, Homo sapiens
gatggaaagtgtatgagt

SEQ ID NO: 7278309 - DNA, 22 bp, Homo sapiens
gatgcttcagtaagaatgcatt

SEQ ID NO: 7278310 - DNA, 22 bp, Homo sapiens
gatgcttcaagcttccttataa

SEQ ID NO: 7278311 - DNA, 22 bp, Homo sapiens
gatgctccaaacagcaattctt

SEQ ID NO: 7278312 - DNA, 20 bp, Homo sapiens
gatgggaatcggagctggta

SEQ ID NO: 7278313 - DNA, 22 bp, Homo sapiens
gatggacagcctggaaggaaag

SEQ ID NO: 7278314 - DNA, 22 bp, Homo sapiens
gatggaatgaatggcagataca

SEQ ID NO: 7278315 - DNA, 22 bp, Homo sapiens
gatttatttttaatcagcaggg

SEQ ID NO: 7278316 - DNA, 22 bp, Homo sapiens
gatttattggtctttcattggt

SEQ ID NO: 7278317 - DNA, 21 bp, Homo sapiens
gatttgcagaaactagacagg

SEQ ID NO: 7278318 - DNA, 22 bp, Homo sapiens
gattttatatggcatactgtgg

SEQ ID NO: 7278319 - DNA, 22 bp, Homo sapiens
gattttatatggcatactgtgg

SEQ ID NO: 7278320 - DNA, 22 bp, Homo sapiens
gattttatagtcaggaaaaaga

SEQ ID NO: 7278321 - DNA, 22 bp, Homo sapiens
gattttcattatagctagtttc

SEQ ID NO: 7278322 - DNA, 22 bp, Homo sapiens
gattttcatttgcactctagaa

SEQ ID NO: 7278323 - DNA, 22 bp, Homo sapiens
gattttcatgataaacttgtga

SEQ ID NO: 7278324 - DNA, 22 bp, Homo sapiens
gattttcatgataaacttgtga

SEQ ID NO: 7278325 - DNA, 22 bp, Homo sapiens
gattttattagcccaaactttg

SEQ ID NO: 7278326 - DNA, 22 bp, Homo sapiens
gcagagcccctcaagccagcct

SEQ ID NO: 7278327 - DNA, 22 bp, Homo sapiens
gcacctgctggggctgatgaga

SEQ ID NO: 7278328 - DNA, 22 bp, Homo sapiens
gcacctgctggaatcagtctgt

SEQ ID NO: 7278329 - DNA, 22 bp, Homo sapiens
gcacctgcctgggactgaagat

SEQ ID NO: 7278330 - DNA, 22 bp, Homo sapiens
gcacaattatttatgcagtatg

SEQ ID NO: 7278331 - DNA, 22 bp, Homo sapiens
gcacccagggacttggctggcc

SEQ ID NO: 7278332 - DNA, 22 bp, Homo sapiens
gcagggcaaatgtggaaaggag

SEQ ID NO: 7278333 - DNA, 22 bp, Homo sapiens
gcagggcaaacccaggtgttca

SEQ ID NO: 7278334 - DNA, 22 bp, Homo sapiens
gcagggcagaaggtgctgagga

SEQ ID NO: 7278335 - DNA, 22 bp, Homo sapiens
gcagggcagagggagaatctct

SEQ ID NO: 7278336 - DNA, 22 bp, Homo sapiens
gcaggcagaggtggaggagaca

SEQ ID NO: 7278337 - DNA, 22 bp, Homo sapiens
gcaggctgccaccttctgagtt

SEQ ID NO: 7278338 - DNA, 22 bp, Homo sapiens
gcaggctgccctcttgtgttga

SEQ ID NO: 7278339 - DNA, 22 bp, Homo sapiens
gcaggctgctgagatccttagg

SEQ ID NO: 7278340 - DNA, 22 bp, Homo sapiens
gcaggctggaggctgttctggg

SEQ ID NO: 7278341 - DNA, 21 bp, Homo sapiens
gcaggctggtcaaacctcagt

SEQ ID NO: 7278342 - DNA, 22 bp, Homo sapiens
gcaggctggggtagccccactt

SEQ ID NO: 7278343 - DNA, 22 bp, Homo sapiens
gcagctaccacccaggaaggac

SEQ ID NO: 7278344 - DNA, 20 bp, Homo sapiens
gcagctactctgtctcgctc

SEQ ID NO: 7278345 - DNA, 18 bp, Homo sapiens
gcagctagccaggggggc

SEQ ID NO: 7278346 - DNA, 22 bp, Homo sapiens
gcagagcggtgatcaggcgcag

SEQ ID NO: 7278347 - DNA, 21 bp, Homo sapiens
gcagagccggggcgagaaggc

SEQ ID NO: 7278348 - DNA, 22 bp, Homo sapiens
gcagagcctgtgtctgagcaaa

SEQ ID NO: 7278349 - DNA, 22 bp, Homo sapiens
gcagctcctttaggctgcaaag

SEQ ID NO: 7278350 - DNA, 22 bp, Homo sapiens
gcagctcctcctgggctggaga

SEQ ID NO: 7278351 - DNA, 22 bp, Homo sapiens
gcagctcccagcttgaaaggtc

SEQ ID NO: 7278352 - DNA, 22 bp, Homo sapiens
gcagctattgtctcctgggccc

SEQ ID NO: 7278353 - DNA, 22 bp, Homo sapiens
gcagctattgtctcctgggccc

SEQ ID NO: 7278354 - DNA, 22 bp, Homo sapiens
gcagctattgtctcctgggccc

SEQ ID NO: 7278355 - DNA, 18 bp, Homo sapiens
gcagctgacactggagtt

SEQ ID NO: 7278356 - DNA, 22 bp, Homo sapiens
gcaggagccacttcagggatgc

SEQ ID NO: 7278357 - DNA, 22 bp, Homo sapiens
gcaggagactggctgtggtagt

SEQ ID NO: 7278358 - DNA, 22 bp, Homo sapiens
gcaggagacaactgtaaggaga

SEQ ID NO: 7278359 - DNA, 22 bp, Homo sapiens
gcaggagagccagcaggcttcc

SEQ ID NO: 7278360 - DNA, 22 bp, Homo sapiens
gcaggagaacaaagcaagctgc

SEQ ID NO: 7278361 - DNA, 22 bp, Homo sapiens
gcaggagaaatgaagattgggt

SEQ ID NO: 7278362 - DNA, 22 bp, Homo sapiens
gcagctgagagaagaacagggc

SEQ ID NO: 7278363 - DNA, 22 bp, Homo sapiens
gcagctgagcgtgaggaagagt

SEQ ID NO: 7278364 - DNA, 22 bp, Homo sapiens
gcatgtgttagagtgtgcatgc

SEQ ID NO: 7278365 - DNA, 22 bp, Homo sapiens
gcatgtgttattttatgtatga

SEQ ID NO: 7278366 - DNA, 22 bp, Homo sapiens
gcatgtgttggtttatgcatgt

SEQ ID NO: 7278367 - DNA, 22 bp, Homo sapiens
gcagtgttgctaggtgcggtga

SEQ ID NO: 7278368 - DNA, 22 bp, Homo sapiens
gcatgtgtggaggagatgtgct

SEQ ID NO: 7278369 - DNA, 22 bp, Homo sapiens
gcatgtgtggaggagatgtgct

SEQ ID NO: 7278370 - DNA, 22 bp, Homo sapiens
gccagatttacagatttgccct

SEQ ID NO: 7278371 - DNA, 20 bp, Homo sapiens
gccagaggccggcaggggct

SEQ ID NO: 7278372 - DNA, 22 bp, Homo sapiens
gccacagctcacgttccccatt

SEQ ID NO: 7278373 - DNA, 22 bp, Homo sapiens
gccagcagggaagccttgggct

SEQ ID NO: 7278374 - DNA, 22 bp, Homo sapiens
gccagcagccacagaagtcact

SEQ ID NO: 7278375 - DNA, 19 bp, Homo sapiens
gccagcagaatgatgaggc

SEQ ID NO: 7278376 - DNA, 22 bp, Homo sapiens
gcagtgttaggaataaaaatga

SEQ ID NO: 7278377 - DNA, 22 bp, Homo sapiens
gcagtgttatgttttctataat

SEQ ID NO: 7278378 - DNA, 22 bp, Homo sapiens
gcagtgttccttctactggggc

SEQ ID NO: 7278379 - DNA, 22 bp, Homo sapiens
gcagtgttcagtgaagcaggag

SEQ ID NO: 7278380 - DNA, 22 bp, Homo sapiens
gcagtgttctaaattgggtgtg

SEQ ID NO: 7278381 - DNA, 22 bp, Homo sapiens
gcagtgttcttgttgcttttat

SEQ ID NO: 7278382 - DNA, 22 bp, Homo sapiens
gcagtgttgactatggtatgag

SEQ ID NO: 7278383 - DNA, 22 bp, Homo sapiens
gcagtgttgagtggtggctgaa

SEQ ID NO: 7278384 - DNA, 22 bp, Homo sapiens
gcagtgttgagccagctggggg

SEQ ID NO: 7278385 - DNA, 18 bp, Homo sapiens
gcagtaggcgcgcaggac

SEQ ID NO: 7278386 - DNA, 22 bp, Homo sapiens
gcagtaggagggacaactacct

SEQ ID NO: 7278387 - DNA, 22 bp, Homo sapiens
gcagtaggagaagaggatgctt

SEQ ID NO: 7278388 - DNA, 22 bp, Homo sapiens
gcagtaagttaatagtgctggt

SEQ ID NO: 7278389 - DNA, 22 bp, Homo sapiens
gagtgtagttcattccgtccta

SEQ ID NO: 7278390 - DNA, 22 bp, Homo sapiens
gagtttattcaggaaatagcca

SEQ ID NO: 7278391 - DNA, 22 bp, Homo sapiens
gagtttattgtcttccaggctt

SEQ ID NO: 7278392 - DNA, 22 bp, Homo sapiens
gagttgctttcctgttaatatc

SEQ ID NO: 7278393 - DNA, 22 bp, Homo sapiens
gataaatggctgaagaaatagt

SEQ ID NO: 7278394 - DNA, 22 bp, Homo sapiens
gagtgctgtaggactgagccct

SEQ ID NO: 7278395 - DNA, 22 bp, Homo sapiens
gagtgcagttggggtgagggga

SEQ ID NO: 7278396 - DNA, 22 bp, Homo sapiens
gagtgcagttggggtgagggga

SEQ ID NO: 7278397 - DNA, 22 bp, Homo sapiens
gagtgcagtggcgtgatctctg

SEQ ID NO: 7278398 - DNA, 22 bp, Homo sapiens
gagtgcagtatgagaggctgct

SEQ ID NO: 7278399 - DNA, 23 bp, Homo sapiens
gagtgcagaatagacatgcagtg

SEQ ID NO: 7278400 - DNA, 23 bp, Homo sapiens
gagtgcagaatagacatgcagtg

SEQ ID NO: 7278401 - DNA, 22 bp, Homo sapiens
gagtgacaggaatatttatctg

SEQ ID NO: 7278402 - DNA, 22 bp, Homo sapiens
gagtctccaatccatgcctgtc

SEQ ID NO: 7278403 - DNA, 22 bp, Homo sapiens
gagtctcctactggctgtcctt

SEQ ID NO: 7278404 - DNA, 22 bp, Homo sapiens
gagtctcctactggctgtcctt

SEQ ID NO: 7278405 - DNA, 22 bp, Homo sapiens
gagtcctgcccttgtgtagtcc

SEQ ID NO: 7278406 - DNA, 22 bp, Homo sapiens
gatgacataaacttaacagtat

SEQ ID NO: 7278407 - DNA, 22 bp, Homo sapiens
gatgagcattgtttcatgtgtt

SEQ ID NO: 7278408 - DNA, 22 bp, Homo sapiens
gatgacatgatggacactcagt

SEQ ID NO: 7278409 - DNA, 22 bp, Homo sapiens
gatgacatctcaatttgttctt

SEQ ID NO: 7278410 - DNA, 20 bp, Homo sapiens
gatgacatactcacttaggg

SEQ ID NO: 7278411 - DNA, 22 bp, Homo sapiens
gatgacataacctaattacagt

SEQ ID NO: 7278412 - DNA, 22 bp, Homo sapiens
gatgacatggctagcactgtga

SEQ ID NO: 7278413 - DNA, 22 bp, Homo sapiens
gatgcacagtgaccctgccagt

SEQ ID NO: 7278414 - DNA, 22 bp, Homo sapiens
gatcttgaaatatcttttccta

SEQ ID NO: 7278415 - DNA, 22 bp, Homo sapiens
gatcttgagcaagttgcatccc

SEQ ID NO: 7278416 - DNA, 22 bp, Homo sapiens
gatcttgagcaagttgtgtaac

SEQ ID NO: 7278417 - DNA, 22 bp, Homo sapiens
gatcttctctttagtagaaaca

SEQ ID NO: 7278418 - DNA, 22 bp, Homo sapiens
gatcttctagcagaagtaattt

SEQ ID NO: 7278419 - DNA, 22 bp, Homo sapiens
gatcttctatgtaatgaagtgt

SEQ ID NO: 7278420 - DNA, 22 bp, Homo sapiens
gatagaaaggtgttgaaatcca

SEQ ID NO: 7278421 - DNA, 22 bp, Homo sapiens
gatagtcacctcccttaacttt

SEQ ID NO: 7278422 - DNA, 22 bp, Homo sapiens
gatcagaattcttgtgtgtttc

SEQ ID NO: 7278423 - DNA, 22 bp, Homo sapiens
gatcacaatttagactttttaa

SEQ ID NO: 7278424 - DNA, 22 bp, Homo sapiens
gatcaaggcagtagggccagct

SEQ ID NO: 7278425 - DNA, 22 bp, Homo sapiens
gagctgggacttggaatccaca

SEQ ID NO: 7278426 - DNA, 22 bp, Homo sapiens
gagatcctcagtggattggatg

SEQ ID NO: 7278427 - DNA, 20 bp, Homo sapiens
gagagtgcttttcattgctc

SEQ ID NO: 7278428 - DNA, 22 bp, Homo sapiens
gagagtgcgattcattcattta

SEQ ID NO: 7278429 - DNA, 22 bp, Homo sapiens
gagatactgcgttgtattaggt

SEQ ID NO: 7278430 - DNA, 22 bp, Homo sapiens
gagatactttacagtgattgcc

SEQ ID NO: 7278431 - DNA, 22 bp, Homo sapiens
gaggacagagccgcctggcaag

SEQ ID NO: 7278432 - DNA, 22 bp, Homo sapiens
gagctgggagttatagcatgtt

SEQ ID NO: 7278433 - DNA, 18 bp, Homo sapiens
gagctgggagaaggaagg

SEQ ID NO: 7278434 - DNA, 22 bp, Homo sapiens
gaggaagggctgcctgccgggc

SEQ ID NO: 7278435 - DNA, 22 bp, Homo sapiens
gaggaagggctgcctgccgggc

SEQ ID NO: 7278436 - DNA, 22 bp, Homo sapiens
gaggcagctgggctggtggttt

SEQ ID NO: 7278437 - DNA, 22 bp, Homo sapiens
gaggcagctgggatacaaggga

SEQ ID NO: 7278438 - DNA, 22 bp, Homo sapiens
gaggcagctgaaggagtgacag

SEQ ID NO: 7278439 - DNA, 22 bp, Homo sapiens
gaggcagctgaaggagtgacag

SEQ ID NO: 7278440 - DNA, 22 bp, Homo sapiens
gaggcagctgggtccggtcggg

SEQ ID NO: 7278441 - DNA, 22 bp, Homo sapiens
gaggcccagcattcagggcagg

SEQ ID NO: 7278442 - DNA, 22 bp, Homo sapiens
gaggcccagggtacaggccgct

SEQ ID NO: 7278443 - DNA, 22 bp, Homo sapiens
gaggcagcagggctggttcctt

SEQ ID NO: 7278444 - DNA, 18 bp, Homo sapiens
gaggcagctagcaatttt

SEQ ID NO: 7278445 - DNA, 22 bp, Homo sapiens
gaggcagcaggctgaggaggat

SEQ ID NO: 7278446 - DNA, 23 bp, Homo sapiens
gaggcagctcctgcagtgccctg

SEQ ID NO: 7278447 - DNA, 22 bp, Homo sapiens
gaggcagctcttctgaatgggg

SEQ ID NO: 7278448 - DNA, 22 bp, Homo sapiens
gaggcagctgaagcttcaaaga

SEQ ID NO: 7278449 - DNA, 22 bp, Homo sapiens
gaggcagcagaacatggaagag

SEQ ID NO: 7278450 - DNA, 22 bp, Homo sapiens
gaggcagcaataaaaagaattt

SEQ ID NO: 7278451 - DNA, 22 bp, Homo sapiens
gaggcagcaaaatatatcataa

SEQ ID NO: 7278452 - DNA, 22 bp, Homo sapiens
gaggcagagtgcaccccaggag

SEQ ID NO: 7278453 - DNA, 22 bp, Homo sapiens
gaggcagaggttgcagtgagct

SEQ ID NO: 7278454 - DNA, 22 bp, Homo sapiens
gaggcagaggttgcagtgagct

SEQ ID NO: 7278455 - DNA, 22 bp, Homo sapiens
gaggcagagtcacaaagagtct

SEQ ID NO: 7278456 - DNA, 22 bp, Homo sapiens
gaggcagaggttgttgcagtga

SEQ ID NO: 7278457 - DNA, 22 bp, Homo sapiens
gaggaggcttccgggaggcacg

SEQ ID NO: 7278458 - DNA, 22 bp, Homo sapiens
gaggtggtcgaggaggggtacc

SEQ ID NO: 7278459 - DNA, 22 bp, Homo sapiens
gaggtggtggtggaggcatagc

SEQ ID NO: 7278460 - DNA, 20 bp, Homo sapiens
gagtcacagaagaagctgaa

SEQ ID NO: 7278461 - DNA, 22 bp, Homo sapiens
gaggtcagtcagaccagggttt

SEQ ID NO: 7278462 - DNA, 22 bp, Homo sapiens
gaggtccactgaggcaacaggg

SEQ ID NO: 7278463 - DNA, 22 bp, Homo sapiens
gaggtccactgaggcaacaggg

SEQ ID NO: 7278464 - DNA, 22 bp, Homo sapiens
gaggtcaggcttgcagcagggt

SEQ ID NO: 7278465 - DNA, 22 bp, Homo sapiens
gaggtcaggggagaggctgatg

SEQ ID NO: 7278466 - DNA, 22 bp, Homo sapiens
gaggtcccccatggctgtgact

SEQ ID NO: 7278467 - DNA, 22 bp, Homo sapiens
gaggtccagggtggggcctgag

SEQ ID NO: 7278468 - DNA, 22 bp, Homo sapiens
gaggtccagagcaggttcagtg

SEQ ID NO: 7278469 - DNA, 19 bp, Homo sapiens
gaggtcagcaagaagtatt

SEQ ID NO: 7278470 - DNA, 22 bp, Homo sapiens
gaggctggcagaaaagcacagg

SEQ ID NO: 7278471 - DNA, 22 bp, Homo sapiens
gaggctggaggtcaaagatgaa

SEQ ID NO: 7278472 - DNA, 22 bp, Homo sapiens
gaggctggagatattccaatct

SEQ ID NO: 7278473 - DNA, 22 bp, Homo sapiens
gaggctgggaagtccaagacca

SEQ ID NO: 7278474 - DNA, 22 bp, Homo sapiens
gagggatggtagttgacactga

SEQ ID NO: 7278475 - DNA, 22 bp, Homo sapiens
gaggggaaagttctgcacaagg

SEQ ID NO: 7278476 - DNA, 22 bp, Homo sapiens
gagggcatagttaaataggagg

SEQ ID NO: 7278477 - DNA, 22 bp, Homo sapiens
gagggcagtagcctcgtaccct

SEQ ID NO: 7278478 - DNA, 22 bp, Homo sapiens
gagacagagtttcactcttgtt

SEQ ID NO: 7278479 - DNA, 22 bp, Homo sapiens
gagacagatctcggctccatgc

SEQ ID NO: 7278480 - DNA, 22 bp, Homo sapiens
gactttgtgccaaacgccagaa

SEQ ID NO: 7278481 - DNA, 22 bp, Homo sapiens
gacttaagtggtgtgataagtg

SEQ ID NO: 7278482 - DNA, 22 bp, Homo sapiens
gactttaaaagtttgtgcttgg

SEQ ID NO: 7278483 - DNA, 18 bp, Homo sapiens
gactttaaaacactgctc

SEQ ID NO: 7278484 - DNA, 22 bp, Homo sapiens
gactttaaaatgctagaacagg

SEQ ID NO: 7278485 - DNA, 21 bp, Homo sapiens
gactttaatttgagagcaaaa

SEQ ID NO: 7278486 - DNA, 22 bp, Homo sapiens
gactttaagtaagtcaaggagc

SEQ ID NO: 7278487 - DNA, 22 bp, Homo sapiens
gactttaagtcctatctgtgcg

SEQ ID NO: 7278488 - DNA, 22 bp, Homo sapiens
gactttaaagcctgacatttta

SEQ ID NO: 7278489 - DNA, 22 bp, Homo sapiens
gactttaaaggttctgctgctt

SEQ ID NO: 7278490 - DNA, 22 bp, Homo sapiens
gactggaaagcctgtcctcaga

SEQ ID NO: 7278491 - DNA, 22 bp, Homo sapiens
gacaggatattatgatagattc

SEQ ID NO: 7278492 - DNA, 22 bp, Homo sapiens
gacaggaggcagagctcaggtg

SEQ ID NO: 7278493 - DNA, 21 bp, Homo sapiens
gacaggcaaggagtcacttag

SEQ ID NO: 7278494 - DNA, 22 bp, Homo sapiens
gacaggcaattaccagcgccca

SEQ ID NO: 7278495 - DNA, 22 bp, Homo sapiens
gacaggcagacctgtgccctgg

SEQ ID NO: 7278496 - DNA, 22 bp, Homo sapiens
gacccaggagagagggttgcat

SEQ ID NO: 7278497 - DNA, 22 bp, Homo sapiens
gacccaggaagctacttctggt

SEQ ID NO: 7278498 - DNA, 22 bp, Homo sapiens
gacccaggctcgtgggacggct

SEQ ID NO: 7278499 - DNA, 22 bp, Homo sapiens
gacccaggcccaaggctgccag

SEQ ID NO: 7278500 - DNA, 22 bp, Homo sapiens
gacccaggagtgcagagagtgg

SEQ ID NO: 7278501 - DNA, 22 bp, Homo sapiens
gacccagggtggtcacctgaaa

SEQ ID NO: 7278502 - DNA, 22 bp, Homo sapiens
gacccagggtggtcacctgaaa

SEQ ID NO: 7278503 - DNA, 22 bp, Homo sapiens
gacccagggtatccagagctgc

SEQ ID NO: 7278504 - DNA, 22 bp, Homo sapiens
gacagctgtgcaggagaagggg

SEQ ID NO: 7278505 - DNA, 22 bp, Homo sapiens
gacagctgtggagaggcatgtg

SEQ ID NO: 7278506 - DNA, 22 bp, Homo sapiens
gacacagggacgtgctctgcct

SEQ ID NO: 7278507 - DNA, 22 bp, Homo sapiens
gaatttaaaggccagacctgag

SEQ ID NO: 7278508 - DNA, 23 bp, Homo sapiens
gaactgttgatgaatagaatata

SEQ ID NO: 7278509 - DNA, 22 bp, Homo sapiens
gaactgtttctggtgaaagagt

SEQ ID NO: 7278510 - DNA, 22 bp, Homo sapiens
gaaggaagtcattagtgcagac

SEQ ID NO: 7278511 - DNA, 22 bp, Homo sapiens
gaaggagaggattgtgaggctg

SEQ ID NO: 7278512 - DNA, 22 bp, Homo sapiens
gaagggaaggaaagaaccagca

SEQ ID NO: 7278513 - DNA, 22 bp, Homo sapiens
gaaggctgcatggaggctgtgg

SEQ ID NO: 7278514 - DNA, 22 bp, Homo sapiens
gaaggctgagtgggtacggagg

SEQ ID NO: 7278515 - DNA, 22 bp, Homo sapiens
gaaggctctgatttcttgcaaa

SEQ ID NO: 7278516 - DNA, 22 bp, Homo sapiens
ctttagatttctatgtatcact

SEQ ID NO: 7278517 - DNA, 22 bp, Homo sapiens
ctttagatgttgctttaactat

SEQ ID NO: 7278518 - DNA, 22 bp, Homo sapiens
ctttagacatacagaatttcca

SEQ ID NO: 7278519 - DNA, 19 bp, Homo sapiens
ctttagacacacctggaca

SEQ ID NO: 7278520 - DNA, 22 bp, Homo sapiens
cttgggaatgctaacagatgac

SEQ ID NO: 7278521 - DNA, 22 bp, Homo sapiens
cttgaagttgcaaaacattaat

SEQ ID NO: 7278522 - DNA, 22 bp, Homo sapiens
ctggctggtcctcggggacagc

SEQ ID NO: 7278523 - DNA, 22 bp, Homo sapiens
ctggctggtaatggaacgacag

SEQ ID NO: 7278524 - DNA, 22 bp, Homo sapiens
cttctcggggttcccgcgccct

SEQ ID NO: 7278525 - DNA, 22 bp, Homo sapiens
cttcttttcatggcttgggaag

SEQ ID NO: 7278526 - DNA, 22 bp, Homo sapiens
cttctttgttctgttgtctcac

SEQ ID NO: 7278527 - DNA, 22 bp, Homo sapiens
cttgaactcaatgtgaggaaga

SEQ ID NO: 7278528 - DNA, 22 bp, Homo sapiens
cttcttttgaagggcgttgtgt

SEQ ID NO: 7278529 - DNA, 22 bp, Homo sapiens
gaaatttattatctacatcatt

SEQ ID NO: 7278530 - DNA, 22 bp, Homo sapiens
gaaatttacaactttctcatgg

SEQ ID NO: 7278531 - DNA, 22 bp, Homo sapiens
gaaatacaaagccagccatttt

SEQ ID NO: 7278532 - DNA, 22 bp, Homo sapiens
gaaataatttagaaggtattcc

SEQ ID NO: 7278533 - DNA, 22 bp, Homo sapiens
gaaccttatggtaaatctagag

SEQ ID NO: 7278534 - DNA, 22 bp, Homo sapiens
gaacctttttccaagtaaacaa

SEQ ID NO: 7278535 - DNA, 22 bp, Homo sapiens
gaactaaatttgacagacaaca

SEQ ID NO: 7278536 - DNA, 22 bp, Homo sapiens
gaactctaggtaaatgagatat

SEQ ID NO: 7278537 - DNA, 22 bp, Homo sapiens
gaactcttgcagtgaaagctta

SEQ ID NO: 7278538 - DNA, 22 bp, Homo sapiens
gaactctctcatctgtcagttg

SEQ ID NO: 7278539 - DNA, 22 bp, Homo sapiens
gaactatatgtcttaaagcttt

SEQ ID NO: 7278540 - DNA, 22 bp, Homo sapiens
gaactgaagacttttactgtac

SEQ ID NO: 7278541 - DNA, 22 bp, Homo sapiens
gaacagagttgaaacaaggctg

SEQ ID NO: 7278542 - DNA, 22 bp, Homo sapiens
gaaaagagtcctgtgtgaggag

SEQ ID NO: 7278543 - DNA, 22 bp, Homo sapiens
gaaaagagacagggtgggtgat

SEQ ID NO: 7278544 - DNA, 22 bp, Homo sapiens
gaaaaggcctccccataggaat

SEQ ID NO: 7278545 - DNA, 22 bp, Homo sapiens
gaaaaggccactcctaggagct

SEQ ID NO: 7278546 - DNA, 22 bp, Homo sapiens
cttttaatgggagcagtatttg

SEQ ID NO: 7278547 - DNA, 22 bp, Homo sapiens
tgtggggatcttctagcttttc

SEQ ID NO: 7278548 - DNA, 22 bp, Homo sapiens
tgtgtggggaaggaaggagctg

SEQ ID NO: 7278549 - DNA, 22 bp, Homo sapiens
cctgggcaatatagtgaggccc

SEQ ID NO: 7278550 - DNA, 22 bp, Homo sapiens
cctgggcaatatagtgaggccc

SEQ ID NO: 7278551 - DNA, 22 bp, Homo sapiens
cctgggcatcaacaagcagaga

SEQ ID NO: 7278552 - DNA, 22 bp, Homo sapiens
cctgggcagcctgctcaaggac

SEQ ID NO: 7278553 - DNA, 23 bp, Homo sapiens
cctgggcattggctgcagcttct

SEQ ID NO: 7278554 - DNA, 22 bp, Homo sapiens
cctgggcatctcatgcacctgc

SEQ ID NO: 7278555 - DNA, 22 bp, Homo sapiens
cctgggcatctcatgcacctgc

SEQ ID NO: 7278556 - DNA, 22 bp, Homo sapiens
tgtgtgtcagagtctccatggt

SEQ ID NO: 7278557 - DNA, 22 bp, Homo sapiens
cctggggaatagagtcaagggg

SEQ ID NO: 7278558 - DNA, 22 bp, Homo sapiens
tgtgttctccaactgtagattt

SEQ ID NO: 7278559 - DNA, 22 bp, Homo sapiens
tgtgttcatttaactgttcttt

SEQ ID NO: 7278560 - DNA, 22 bp, Homo sapiens
tgtgaactggcaggtggacggg

SEQ ID NO: 7278561 - DNA, 21 bp, Homo sapiens
tgtctttggcctcattcccag

SEQ ID NO: 7278562 - DNA, 22 bp, Homo sapiens
tgtctggtgggttgacaggcag

SEQ ID NO: 7278563 - DNA, 22 bp, Homo sapiens
cctggctcttcgggagtttgtt

SEQ ID NO: 7278564 - DNA, 19 bp, Homo sapiens
cctggctctgagcccagcc

SEQ ID NO: 7278565 - DNA, 23 bp, Homo sapiens
cctggctgacctgaaggtgtagt

SEQ ID NO: 7278566 - DNA, 22 bp, Homo sapiens
cctggctgaacaaagtccctcc

SEQ ID NO: 7278567 - DNA, 22 bp, Homo sapiens
cctggctgagggacctcgggta

SEQ ID NO: 7278568 - DNA, 21 bp, Homo sapiens
cctggctgcacagttgctggt

SEQ ID NO: 7278569 - DNA, 22 bp, Homo sapiens
tgtgccagaaaatatgctgagg

SEQ ID NO: 7278570 - DNA, 22 bp, Homo sapiens
cctgggaagcccatagcagctt

SEQ ID NO: 7278571 - DNA, 22 bp, Homo sapiens
tgtgccagtcatccagatgtgt

SEQ ID NO: 7278572 - DNA, 22 bp, Homo sapiens
cctggctgtgtgaccttggcaa

SEQ ID NO: 7278573 - DNA, 22 bp, Homo sapiens
cctggctgcccatggaccctct

SEQ ID NO: 7278574 - DNA, 22 bp, Homo sapiens
cctggctgcattttgctggatg

SEQ ID NO: 7278575 - DNA, 22 bp, Homo sapiens
cctggctgccgagtgtgcagcg

SEQ ID NO: 7278576 - DNA, 22 bp, Homo sapiens
cctggctgctgtcactgaccat

SEQ ID NO: 7278577 - DNA, 22 bp, Homo sapiens
cctggctggttgtctgattcta

SEQ ID NO: 7278578 - DNA, 19 bp, Homo sapiens
cctggctgtgaagcctgca

SEQ ID NO: 7278579 - DNA, 23 bp, Homo sapiens
cctggctgtggatttgggcctgc

SEQ ID NO: 7278580 - DNA, 22 bp, Homo sapiens
cctggagcacatggcaggaggc

SEQ ID NO: 7278581 - DNA, 22 bp, Homo sapiens
cctggagcacagcccagtccca

SEQ ID NO: 7278582 - DNA, 22 bp, Homo sapiens
cctggagatttcttcaagcttt

SEQ ID NO: 7278583 - DNA, 22 bp, Homo sapiens
tgtaccactctactaagggttc

SEQ ID NO: 7278584 - DNA, 22 bp, Homo sapiens
tgtagggaggaagggttggaaa

SEQ ID NO: 7278585 - DNA, 22 bp, Homo sapiens
tgtaggtctcagtgtctgagct

SEQ ID NO: 7278586 - DNA, 22 bp, Homo sapiens
tgtattagagcatataatttga

SEQ ID NO: 7278587 - DNA, 22 bp, Homo sapiens
tgtattagatctgagaacttct

SEQ ID NO: 7278588 - DNA, 22 bp, Homo sapiens
tgtcatgggtctaaacattgat

SEQ ID NO: 7278589 - DNA, 22 bp, Homo sapiens
tgtcatgggcatttattgaggg

SEQ ID NO: 7278590 - DNA, 22 bp, Homo sapiens
cctctgtgctttgtccagcctc

SEQ ID NO: 7278591 - DNA, 21 bp, Homo sapiens
cctctgtgctaaagggctccc

SEQ ID NO: 7278592 - DNA, 22 bp, Homo sapiens
tggtcttagctggaaggaggga

SEQ ID NO: 7278593 - DNA, 17 bp, Homo sapiens
cctgcccagagacagat

SEQ ID NO: 7278594 - DNA, 17 bp, Homo sapiens
tggtggctggagtcagg

SEQ ID NO: 7278595 - DNA, 22 bp, Homo sapiens
cctggagagagaggccaactgc

SEQ ID NO: 7278596 - DNA, 22 bp, Homo sapiens
cctggagagagaggccaactgc

SEQ ID NO: 7278597 - DNA, 22 bp, Homo sapiens
cctggagaccagaggatacttc

SEQ ID NO: 7278598 - DNA, 22 bp, Homo sapiens
cctggactcaggctgtgggcac

SEQ ID NO: 7278599 - DNA, 22 bp, Homo sapiens
cctggcagcagcacatgccttc

SEQ ID NO: 7278600 - DNA, 23 bp, Homo sapiens
cctggcagcaaacgaggaggtta

SEQ ID NO: 7278601 - DNA, 22 bp, Homo sapiens
cctggcaggcaagaggaaggga

SEQ ID NO: 7278602 - DNA, 22 bp, Homo sapiens
tgtcctcatcctccagtctgtc

SEQ ID NO: 7278603 - DNA, 22 bp, Homo sapiens
tgtccatggggaaggggaagtg

SEQ ID NO: 7278604 - DNA, 22 bp, Homo sapiens
tgtccatggatagagctgctcg

SEQ ID NO: 7278605 - DNA, 22 bp, Homo sapiens
tgtctcatctcttaaccccact

SEQ ID NO: 7278606 - DNA, 22 bp, Homo sapiens
tgtctcatctcttaaccccact

SEQ ID NO: 7278607 - DNA, 22 bp, Homo sapiens
tgtctctgtgcatttgtgcttc

SEQ ID NO: 7278608 - DNA, 22 bp, Homo sapiens
tgtcctcttccagtgctccttc

SEQ ID NO: 7278609 - DNA, 22 bp, Homo sapiens
tgctccagtgcctgccccacag

SEQ ID NO: 7278610 - DNA, 22 bp, Homo sapiens
tgctccagggctgccagaccct

SEQ ID NO: 7278611 - DNA, 23 bp, Homo sapiens
tgctccaggtacagaactccagg

SEQ ID NO: 7278612 - DNA, 22 bp, Homo sapiens
tgctccaggtgtgcctctcatg

SEQ ID NO: 7278613 - DNA, 22 bp, Homo sapiens
tgctccagtgagctggccatcc

SEQ ID NO: 7278614 - DNA, 22 bp, Homo sapiens
cccaggctcctgctgtgttgac

SEQ ID NO: 7278615 - DNA, 22 bp, Homo sapiens
cccaggctcttatgtgacttgc

SEQ ID NO: 7278616 - DNA, 22 bp, Homo sapiens
tgcctgggctcaccgcctcttt

SEQ ID NO: 7278617 - DNA, 22 bp, Homo sapiens
tgcctgggccttcccacctctg

SEQ ID NO: 7278618 - DNA, 22 bp, Homo sapiens
tgcctgggatctgtgccctttg

SEQ ID NO: 7278619 - DNA, 20 bp, Homo sapiens
tgcctgggaaggcgtggagg

SEQ ID NO: 7278620 - DNA, 22 bp, Homo sapiens
tgcctgctcttgagacttacaa

SEQ ID NO: 7278621 - DNA, 22 bp, Homo sapiens
tgcctgggacatgctgtggact

SEQ ID NO: 7278622 - DNA, 22 bp, Homo sapiens
tgcctgggagtgaccaagactc

SEQ ID NO: 7278623 - DNA, 23 bp, Homo sapiens
tgctgaagtgttggccctgccca

SEQ ID NO: 7278624 - DNA, 22 bp, Homo sapiens
cccagggaggtagcaggagaaa

SEQ ID NO: 7278625 - DNA, 22 bp, Homo sapiens
cccagggatgtggcagatgtta

SEQ ID NO: 7278626 - DNA, 22 bp, Homo sapiens
cccagggactcgggattctagg

SEQ ID NO: 7278627 - DNA, 22 bp, Homo sapiens
ccccaggcctgttggatggcgc

SEQ ID NO: 7278628 - DNA, 22 bp, Homo sapiens
ccccagcccacaagcatattaa

SEQ ID NO: 7278629 - DNA, 22 bp, Homo sapiens
ccccagccttccatgggaattg

SEQ ID NO: 7278630 - DNA, 22 bp, Homo sapiens
ccccagcagactcagggcaggt

SEQ ID NO: 7278631 - DNA, 22 bp, Homo sapiens
ccccagccagcaggacctctga

SEQ ID NO: 7278632 - DNA, 22 bp, Homo sapiens
ccccagccagcttgtagtagaa

SEQ ID NO: 7278633 - DNA, 22 bp, Homo sapiens
ccccggaggcggaggttgcagt

SEQ ID NO: 7278634 - DNA, 22 bp, Homo sapiens
cccccagtctgaacagcagctg

SEQ ID NO: 7278635 - DNA, 22 bp, Homo sapiens
cccctccctgacctggttgggc

SEQ ID NO: 7278636 - DNA, 22 bp, Homo sapiens
cccctcctggccacactgtcag

SEQ ID NO: 7278637 - DNA, 22 bp, Homo sapiens
cccctctggtcaaccagtcaca

SEQ ID NO: 7278638 - DNA, 22 bp, Homo sapiens
cccagctgatttttgcagagat

SEQ ID NO: 7278639 - DNA, 22 bp, Homo sapiens
cccagctcttttagcggcatct

SEQ ID NO: 7278640 - DNA, 22 bp, Homo sapiens
cccaggaaagtggaggcggctg

SEQ ID NO: 7278641 - DNA, 22 bp, Homo sapiens
cccaggaaagagactgctgggt

SEQ ID NO: 7278642 - DNA, 22 bp, Homo sapiens
cccaggaaacccgaaggcgacc

SEQ ID NO: 7278643 - DNA, 22 bp, Homo sapiens
cccaggaaaagcagtgccagca

SEQ ID NO: 7278644 - DNA, 22 bp, Homo sapiens
cccagccttccaccctggacta

SEQ ID NO: 7278645 - DNA, 22 bp, Homo sapiens
cccagcctttgcttcctggttc

SEQ ID NO: 7278646 - DNA, 22 bp, Homo sapiens
cccagcctgtctttcccaatga

SEQ ID NO: 7278647 - DNA, 22 bp, Homo sapiens
cccagcctgtgacagccgtcct

SEQ ID NO: 7278648 - DNA, 22 bp, Homo sapiens
tctgtggcatgttgcacttgta

SEQ ID NO: 7278649 - DNA, 23 bp, Homo sapiens
tctgtggccccttcgccccactc

SEQ ID NO: 7278650 - DNA, 22 bp, Homo sapiens
tctgtggcccaagtgatggctg

SEQ ID NO: 7278651 - DNA, 22 bp, Homo sapiens
tctgtggcctgcctcctcattt

SEQ ID NO: 7278652 - DNA, 22 bp, Homo sapiens
tctgtggcctccttccacttac

SEQ ID NO: 7278653 - DNA, 19 bp, Homo sapiens
tctgtggccttccctgatg

SEQ ID NO: 7278654 - DNA, 22 bp, Homo sapiens
cccagcctggtgcactgtgggg

SEQ ID NO: 7278655 - DNA, 22 bp, Homo sapiens
cccagcctactctgccatagca

SEQ ID NO: 7278656 - DNA, 22 bp, Homo sapiens
tgccacacagctgtatgaggga

SEQ ID NO: 7278657 - DNA, 22 bp, Homo sapiens
tgccacactcccctgctgcagt

SEQ ID NO: 7278658 - DNA, 22 bp, Homo sapiens
cccaggaggtggaggctgcagt

SEQ ID NO: 7278659 - DNA, 22 bp, Homo sapiens
cccaggagggtggcctctgccc

SEQ ID NO: 7278660 - DNA, 22 bp, Homo sapiens
tgccacagagcaattctgctga

SEQ ID NO: 7278661 - DNA, 22 bp, Homo sapiens
cccaggaggtggaggttgcagt

SEQ ID NO: 7278662 - DNA, 22 bp, Homo sapiens
cccaggaggtggaggttgcagc

SEQ ID NO: 7278663 - DNA, 22 bp, Homo sapiens
cccaggaggttgaggctgcagt

SEQ ID NO: 7278664 - DNA, 22 bp, Homo sapiens
cccaggaggtggaggttgcggt

SEQ ID NO: 7278665 - DNA, 22 bp, Homo sapiens
cccaggaggtggagttcacagt

SEQ ID NO: 7278666 - DNA, 22 bp, Homo sapiens
cccaggaggtgtgcccaactcg

SEQ ID NO: 7278667 - DNA, 22 bp, Homo sapiens
cccaggaggtgtagctgcgtgg

SEQ ID NO: 7278668 - DNA, 21 bp, Homo sapiens
tgccaggcctgagctggggtc

SEQ ID NO: 7278669 - DNA, 15 bp, Homo sapiens
cccaggagttcgaga

SEQ ID NO: 7278670 - DNA, 22 bp, Homo sapiens
cccaggagttcgaggctgtagt

SEQ ID NO: 7278671 - DNA, 22 bp, Homo sapiens
cccaggcagaattagtgtttca

SEQ ID NO: 7278672 - DNA, 16 bp, Homo sapiens
tgcctgctctgatctc

SEQ ID NO: 7278673 - DNA, 22 bp, Homo sapiens
cccaggcagtgtgtgcatgcgt

SEQ ID NO: 7278674 - DNA, 22 bp, Homo sapiens
cccaggcagtgctgatccctca

SEQ ID NO: 7278675 - DNA, 22 bp, Homo sapiens
cccaggcagcggggtctccttg

SEQ ID NO: 7278676 - DNA, 22 bp, Homo sapiens
cccaggcagcctgcagggaagg

SEQ ID NO: 7278677 - DNA, 22 bp, Homo sapiens
ccctggctcaggcagctttgtt

SEQ ID NO: 7278678 - DNA, 22 bp, Homo sapiens
tggcagaggtaattcaaatccc

SEQ ID NO: 7278679 - DNA, 22 bp, Homo sapiens
tggcaaggctgtgggggcagag

SEQ ID NO: 7278680 - DNA, 22 bp, Homo sapiens
tggcaaggccacaggtgcagtt

SEQ ID NO: 7278681 - DNA, 23 bp, Homo sapiens
tggcaaggaatgggatggagact

SEQ ID NO: 7278682 - DNA, 22 bp, Homo sapiens
tggcagcaattagctagagctg

SEQ ID NO: 7278683 - DNA, 22 bp, Homo sapiens
tggcagcaaaaccagaatcaga

SEQ ID NO: 7278684 - DNA, 22 bp, Homo sapiens
tggcagcacattgacccgggct

SEQ ID NO: 7278685 - DNA, 22 bp, Homo sapiens
tggcagcacaaggtggcccatg

SEQ ID NO: 7278686 - DNA, 22 bp, Homo sapiens
tggcagcaatttgtgatgttga

SEQ ID NO: 7278687 - DNA, 22 bp, Homo sapiens
tggcagcactaggtactgagct

SEQ ID NO: 7278688 - DNA, 22 bp, Homo sapiens
tggcagctggctctgcgcaggc

SEQ ID NO: 7278689 - DNA, 22 bp, Homo sapiens
tggcagctggatcccaaggcag

SEQ ID NO: 7278690 - DNA, 22 bp, Homo sapiens
tggcagctggagggcaatggcc

SEQ ID NO: 7278691 - DNA, 15 bp, Homo sapiens
tggcagcttgttaag

SEQ ID NO: 7278692 - DNA, 22 bp, Homo sapiens
tggcagctttttgtttcaggct

SEQ ID NO: 7278693 - DNA, 22 bp, Homo sapiens
tggcagcttgaatgcagtcttt

SEQ ID NO: 7278694 - DNA, 22 bp, Homo sapiens
tggccaggcaggtagaacggcc

SEQ ID NO: 7278695 - DNA, 23 bp, Homo sapiens
tggcagctgtgtaagagaaagca

SEQ ID NO: 7278696 - DNA, 22 bp, Homo sapiens
tggcagctgtgcttcattcttt

SEQ ID NO: 7278697 - DNA, 22 bp, Homo sapiens
tggcagctggtacagtgggtct

SEQ ID NO: 7278698 - DNA, 22 bp, Homo sapiens
tggcagctgtctgtggggtctc

SEQ ID NO: 7278699 - DNA, 22 bp, Homo sapiens
tggcagctgtcagaatgcaaat

SEQ ID NO: 7278700 - DNA, 22 bp, Homo sapiens
tggcagcttcctgctcatagga

SEQ ID NO: 7278701 - DNA, 22 bp, Homo sapiens
tggcagcttgaatgcagtcttt

SEQ ID NO: 7278702 - DNA, 22 bp, Homo sapiens
tggcagctgttaatgttttgtt

SEQ ID NO: 7278703 - DNA, 22 bp, Homo sapiens
tggcagcttcctgctcatagga

SEQ ID NO: 7278704 - DNA, 22 bp, Homo sapiens
tggcagctgtgtccaggtagaa

SEQ ID NO: 7278705 - DNA, 22 bp, Homo sapiens
cctctgtgacaaacagtcctgg

SEQ ID NO: 7278706 - DNA, 22 bp, Homo sapiens
cctctgtccccagtgcaggcct

SEQ ID NO: 7278707 - DNA, 18 bp, Homo sapiens
cctctgggttttgttccc

SEQ ID NO: 7278708 - DNA, 22 bp, Homo sapiens
cctctgggtgacagactcttgg

SEQ ID NO: 7278709 - DNA, 22 bp, Homo sapiens
cctctctttcctacaccttgga

SEQ ID NO: 7278710 - DNA, 22 bp, Homo sapiens
cctctgggggcttccttaccct

SEQ ID NO: 7278711 - DNA, 21 bp, Homo sapiens
tggctgcctacatgctgcagg

SEQ ID NO: 7278712 - DNA, 22 bp, Homo sapiens
tggctcagtttcagtcctggtt

SEQ ID NO: 7278713 - DNA, 22 bp, Homo sapiens
cctatgtctcatgggataagac

SEQ ID NO: 7278714 - DNA, 20 bp, Homo sapiens
cctccactgtcactgacctg

SEQ ID NO: 7278715 - DNA, 22 bp, Homo sapiens
cctccactgcttcccagctttg

SEQ ID NO: 7278716 - DNA, 22 bp, Homo sapiens
cctccactctggcctctcaggt

SEQ ID NO: 7278717 - DNA, 22 bp, Homo sapiens
tggctgagggggcagttcagga

SEQ ID NO: 7278718 - DNA, 22 bp, Homo sapiens
tggctgagggggcagttcagga

SEQ ID NO: 7278719 - DNA, 22 bp, Homo sapiens
tggctgagggggctctgctcag

SEQ ID NO: 7278720 - DNA, 23 bp, Homo sapiens
tggctgaggtccaggtagtttca

SEQ ID NO: 7278721 - DNA, 22 bp, Homo sapiens
tggctgaggtaactatgaataa

SEQ ID NO: 7278722 - DNA, 22 bp, Homo sapiens
cctcggctgggccttggccact

SEQ ID NO: 7278723 - DNA, 22 bp, Homo sapiens
ctggcaagaaatatatatctta

SEQ ID NO: 7278724 - DNA, 22 bp, Homo sapiens
ctggccacccatgcctccctga

SEQ ID NO: 7278725 - DNA, 19 bp, Homo sapiens
ctggccacacctgctggtt

SEQ ID NO: 7278726 - DNA, 22 bp, Homo sapiens
ctggcctggcagggagggcatg

SEQ ID NO: 7278727 - DNA, 22 bp, Homo sapiens
ctggcctgcagatcccagggtc

SEQ ID NO: 7278728 - DNA, 22 bp, Homo sapiens
ctggcctgagcacagcggctgc

SEQ ID NO: 7278729 - DNA, 22 bp, Homo sapiens
ctggcctgaggccgccttcaga

SEQ ID NO: 7278730 - DNA, 22 bp, Homo sapiens
ctggcctggggcctcagctgct

SEQ ID NO: 7278731 - DNA, 22 bp, Homo sapiens
ctggctctgtgggacctggcct

SEQ ID NO: 7278732 - DNA, 22 bp, Homo sapiens
ctggctctgtggcttccttcat

SEQ ID NO: 7278733 - DNA, 22 bp, Homo sapiens
ctggctctgtcaccctttctcc

SEQ ID NO: 7278734 - DNA, 23 bp, Homo sapiens
ctggctctgtaggtggcatcctt

SEQ ID NO: 7278735 - DNA, 22 bp, Homo sapiens
ctggctctgagcccacctccag

SEQ ID NO: 7278736 - DNA, 22 bp, Homo sapiens
ctggctctgaccgcgctggcct

SEQ ID NO: 7278737 - DNA, 22 bp, Homo sapiens
ctggctctctgatttcacattc

SEQ ID NO: 7278738 - DNA, 22 bp, Homo sapiens
ctggctctattccctaaggatg

SEQ ID NO: 7278739 - DNA, 22 bp, Homo sapiens
ctggctctatctccaaggctgg

SEQ ID NO: 7278740 - DNA, 22 bp, Homo sapiens
ctggctctaagtgtcagctccc

SEQ ID NO: 7278741 - DNA, 22 bp, Homo sapiens
ctggctctaagtgtcagctccc

SEQ ID NO: 7278742 - DNA, 19 bp, Homo sapiens
ctggaatgtggctggtgca

SEQ ID NO: 7278743 - DNA, 22 bp, Homo sapiens
ctggacagaaaaggccactgga

SEQ ID NO: 7278744 - DNA, 22 bp, Homo sapiens
ctggacaggctggggactgcaa

SEQ ID NO: 7278745 - DNA, 22 bp, Homo sapiens
ctggacagaaaccagtcctggg

SEQ ID NO: 7278746 - DNA, 22 bp, Homo sapiens
ctgctttgtaaaatagacataa

SEQ ID NO: 7278747 - DNA, 22 bp, Homo sapiens
ctgcctgcgttgcctcgtgcct

SEQ ID NO: 7278748 - DNA, 22 bp, Homo sapiens
ctgcctggaccggcagccctcc

SEQ ID NO: 7278749 - DNA, 22 bp, Homo sapiens
ctgcctggcatggagaagagaa

SEQ ID NO: 7278750 - DNA, 22 bp, Homo sapiens
ctgcctggccacaacccagggt

SEQ ID NO: 7278751 - DNA, 22 bp, Homo sapiens
ctgcctggatgaatggcgcctt

SEQ ID NO: 7278752 - DNA, 22 bp, Homo sapiens
ctgcctggatgaatggcgcctt

SEQ ID NO: 7278753 - DNA, 22 bp, Homo sapiens
ctgcttctaagaacctgcagct

SEQ ID NO: 7278754 - DNA, 22 bp, Homo sapiens
ctgcctggcccagggatgggcc

SEQ ID NO: 7278755 - DNA, 22 bp, Homo sapiens
ctgcctggcccagggatgggcc

SEQ ID NO: 7278756 - DNA, 22 bp, Homo sapiens
ctgcttctaagaacctgcagct

SEQ ID NO: 7278757 - DNA, 22 bp, Homo sapiens
ctggagttagagtagacactga

SEQ ID NO: 7278758 - DNA, 22 bp, Homo sapiens
ctggagtgtaaagagcatagaa

SEQ ID NO: 7278759 - DNA, 22 bp, Homo sapiens
ctggagtctcttctgtagctac

SEQ ID NO: 7278760 - DNA, 22 bp, Homo sapiens
ctggagtcactcatgtagctgc

SEQ ID NO: 7278761 - DNA, 22 bp, Homo sapiens
ctggagtagccggacgggtctg

SEQ ID NO: 7278762 - DNA, 22 bp, Homo sapiens
tttgtgaataggttggcttcca

SEQ ID NO: 7278763 - DNA, 22 bp, Homo sapiens
tttgtctttcccctcctcattg

SEQ ID NO: 7278764 - DNA, 22 bp, Homo sapiens
ttttattcaaatagttcacact

SEQ ID NO: 7278765 - DNA, 23 bp, Homo sapiens
ttttattgatatgtagctgttgt

SEQ ID NO: 7278766 - DNA, 17 bp, Homo sapiens
ctctgggcagcctgggg

SEQ ID NO: 7278767 - DNA, 22 bp, Homo sapiens
ctctgggcaaagatgcctcatc

SEQ ID NO: 7278768 - DNA, 22 bp, Homo sapiens
ctctggtgtcctttagaattta

SEQ ID NO: 7278769 - DNA, 22 bp, Homo sapiens
ctctgggttcactgaggctctg

SEQ ID NO: 7278770 - DNA, 23 bp, Homo sapiens
ttttattgatatgtagctgttgt

SEQ ID NO: 7278771 - DNA, 22 bp, Homo sapiens
ctgaactctttatgacagcttg

SEQ ID NO: 7278772 - DNA, 22 bp, Homo sapiens
ctgaacttattgagtgcttgct

SEQ ID NO: 7278773 - DNA, 22 bp, Homo sapiens
ctgaagaaatatgattgcttaa

SEQ ID NO: 7278774 - DNA, 22 bp, Homo sapiens
ctgatcctcctttaagtagctg

SEQ ID NO: 7278775 - DNA, 22 bp, Homo sapiens
ctgagtccttgggcttagagtg

SEQ ID NO: 7278776 - DNA, 22 bp, Homo sapiens
ctgagtccagggacagaggcgt

SEQ ID NO: 7278777 - DNA, 22 bp, Homo sapiens
ctgcagaaatatggatgtgata

SEQ ID NO: 7278778 - DNA, 22 bp, Homo sapiens
ctgcagaaacctttcctgattt

SEQ ID NO: 7278779 - DNA, 22 bp, Homo sapiens
ctgattccctggtgcctccgtt

SEQ ID NO: 7278780 - DNA, 22 bp, Homo sapiens
ctgaggagttggtgaataagcc

SEQ ID NO: 7278781 - DNA, 22 bp, Homo sapiens
ctgaggagtgggtgggcagtga

SEQ ID NO: 7278782 - DNA, 22 bp, Homo sapiens
ctgaggcactgtcagctgaggc

SEQ ID NO: 7278783 - DNA, 22 bp, Homo sapiens
ctgagagaatcatgctgcaggt

SEQ ID NO: 7278784 - DNA, 22 bp, Homo sapiens
ctgaggagaaagatggtccaag

SEQ ID NO: 7278785 - DNA, 22 bp, Homo sapiens
ctgcctcctgccgtgcagcttc

SEQ ID NO: 7278786 - DNA, 22 bp, Homo sapiens
ctgcctcatgctgcctgcagcc

SEQ ID NO: 7278787 - DNA, 22 bp, Homo sapiens
ctgcctcatgctgcctgcagcc

SEQ ID NO: 7278788 - DNA, 22 bp, Homo sapiens
ctgcctagggtctggtaccaca

SEQ ID NO: 7278789 - DNA, 22 bp, Homo sapiens
ctgcctcacattggctgtgtga

SEQ ID NO: 7278790 - DNA, 22 bp, Homo sapiens
ctgcctcagccttctgggtgac

SEQ ID NO: 7278791 - DNA, 22 bp, Homo sapiens
ctgcctcagccttctgggtgac

SEQ ID NO: 7278792 - DNA, 22 bp, Homo sapiens
ctgcctcagcgttgtggcccta

SEQ ID NO: 7278793 - DNA, 22 bp, Homo sapiens
ctgcctcagcgttgtggcccta

SEQ ID NO: 7278794 - DNA, 22 bp, Homo sapiens
ctgccatctgagggtccagcct

SEQ ID NO: 7278795 - DNA, 22 bp, Homo sapiens
ctgccaggttggcgctcgctct

SEQ ID NO: 7278796 - DNA, 22 bp, Homo sapiens
ctgccatgcagttagtccctca

SEQ ID NO: 7278797 - DNA, 22 bp, Homo sapiens
ctgcctagaaaaccaggctcct

SEQ ID NO: 7278798 - DNA, 22 bp, Homo sapiens
ctgccgttgtgaagctcttaga

SEQ ID NO: 7278799 - DNA, 22 bp, Homo sapiens
ctgccaggggcctcacaggcca

SEQ ID NO: 7278800 - DNA, 22 bp, Homo sapiens
ctgccaggcgatggattggctg

SEQ ID NO: 7278801 - DNA, 22 bp, Homo sapiens
ctgccaggcctccgctgtcccc

SEQ ID NO: 7278802 - DNA, 22 bp, Homo sapiens
ctgccaggcctccgctgtcccc

SEQ ID NO: 7278803 - DNA, 22 bp, Homo sapiens
ctgcagatgtctcaattttatt

SEQ ID NO: 7278804 - DNA, 22 bp, Homo sapiens
ttggcattgaagtttcattggt

SEQ ID NO: 7278805 - DNA, 22 bp, Homo sapiens
ttggcattggagatgcaagaac

SEQ ID NO: 7278806 - DNA, 22 bp, Homo sapiens
ttgatacaggctctatttcatc

SEQ ID NO: 7278807 - DNA, 22 bp, Homo sapiens
ttgatacatttttaggataaac

SEQ ID NO: 7278808 - DNA, 22 bp, Homo sapiens
ctcagtttcctcaactgcaaaa

SEQ ID NO: 7278809 - DNA, 22 bp, Homo sapiens
ctcagtttcctcttctgttgaa

SEQ ID NO: 7278810 - DNA, 22 bp, Homo sapiens
ctcagtttccccggcctgggcg

SEQ ID NO: 7278811 - DNA, 22 bp, Homo sapiens
ctcagtttctgacattaaaatc

SEQ ID NO: 7278812 - DNA, 22 bp, Homo sapiens
ctcagtttgaggggtaggtgtt

SEQ ID NO: 7278813 - DNA, 22 bp, Homo sapiens
ctcagtttcttactctgtataa

SEQ ID NO: 7278814 - DNA, 22 bp, Homo sapiens
ctcagttttgctagctggagtt

SEQ ID NO: 7278815 - DNA, 22 bp, Homo sapiens
ctcagtttttgctgtctggttc

SEQ ID NO: 7278816 - DNA, 22 bp, Homo sapiens
ctcatcagaaatacctgacaaa

SEQ ID NO: 7278817 - DNA, 22 bp, Homo sapiens
ttggccagagaccagagcaggg

SEQ ID NO: 7278818 - DNA, 22 bp, Homo sapiens
ttgggcagcattgcagttccct

SEQ ID NO: 7278819 - DNA, 22 bp, Homo sapiens
ttgttaaaaatagatttccagg

SEQ ID NO: 7278820 - DNA, 22 bp, Homo sapiens
ctccaggtagctaagtcctggg

SEQ ID NO: 7278821 - DNA, 22 bp, Homo sapiens
ctccagggttccccgatccact

SEQ ID NO: 7278822 - DNA, 22 bp, Homo sapiens
tttaaaaaactagtctgagtct

SEQ ID NO: 7278823 - DNA, 22 bp, Homo sapiens
ctccagtctctttcggagacac

SEQ ID NO: 7278824 - DNA, 22 bp, Homo sapiens
ctccagtcatagcctcttgagt

SEQ ID NO: 7278825 - DNA, 22 bp, Homo sapiens
ctccagggggcatccacacagc

SEQ ID NO: 7278826 - DNA, 22 bp, Homo sapiens
ttgtatttgattgtcatatcgt

SEQ ID NO: 7278827 - DNA, 22 bp, Homo sapiens
ctccagggatgagacagagtag

SEQ ID NO: 7278828 - DNA, 22 bp, Homo sapiens
ctccagggaggtctgcaggact

SEQ ID NO: 7278829 - DNA, 22 bp, Homo sapiens
ctccagggaggagcacgggttc

SEQ ID NO: 7278830 - DNA, 20 bp, Homo sapiens
ctccaggggaagagccttcc

SEQ ID NO: 7278831 - DNA, 22 bp, Homo sapiens
ctccagggagctgtggaggttt

SEQ ID NO: 7278832 - DNA, 22 bp, Homo sapiens
tttaaatttagaagaaacactg

SEQ ID NO: 7278833 - DNA, 22 bp, Homo sapiens
tttacagttaagaaatgttacc

SEQ ID NO: 7278834 - DNA, 22 bp, Homo sapiens
tttacatggaatattgtcttgt

SEQ ID NO: 7278835 - DNA, 22 bp, Homo sapiens
tttacatgtaatgttatacaaa

SEQ ID NO: 7278836 - DNA, 22 bp, Homo sapiens
tttagacaagatccttctgaat

SEQ ID NO: 7278837 - DNA, 22 bp, Homo sapiens
tttagacacactttgtatattt

SEQ ID NO: 7278838 - DNA, 22 bp, Homo sapiens
tttagacatagctgaaatcatt

SEQ ID NO: 7278839 - DNA, 22 bp, Homo sapiens
tttagacatagctgaaatcatt

SEQ ID NO: 7278840 - DNA, 22 bp, Homo sapiens
tttagacatagctgaaatcatt

SEQ ID NO: 7278841 - DNA, 22 bp, Homo sapiens
tttagacatctataattgctaa

SEQ ID NO: 7278842 - DNA, 22 bp, Homo sapiens
tttagacaggggcaaaataagg

SEQ ID NO: 7278843 - DNA, 22 bp, Homo sapiens
tttagacagcggctctgaacca

SEQ ID NO: 7278844 - DNA, 22 bp, Homo sapiens
tttagacagatgtgaggtgggt

SEQ ID NO: 7278845 - DNA, 22 bp, Homo sapiens
tttagacactagggatgcagtg

SEQ ID NO: 7278846 - DNA, 22 bp, Homo sapiens
tttagacagcatctggtgactt

SEQ ID NO: 7278847 - DNA, 22 bp, Homo sapiens
ctcctcttctgagtaccaggga

SEQ ID NO: 7278848 - DNA, 22 bp, Homo sapiens
ctcctctttggggatttacaca

SEQ ID NO: 7278849 - DNA, 22 bp, Homo sapiens
ctcctctttagccccagctgga

SEQ ID NO: 7278850 - DNA, 22 bp, Homo sapiens
ctctccagaattattactatta

SEQ ID NO: 7278851 - DNA, 22 bp, Homo sapiens
ctctccagccacagaagctgct

SEQ ID NO: 7278852 - DNA, 22 bp, Homo sapiens
ctctcccccacagcagccttct

SEQ ID NO: 7278853 - DNA, 22 bp, Homo sapiens
ctctccctatgcctcccaggag

SEQ ID NO: 7278854 - DNA, 20 bp, Homo sapiens
tttcagttggttaatggcat

SEQ ID NO: 7278855 - DNA, 22 bp, Homo sapiens
tttcagttgtcctgttaatagc

SEQ ID NO: 7278856 - DNA, 22 bp, Homo sapiens
tttcagtgtgtaaattgaaata

SEQ ID NO: 7278857 - DNA, 22 bp, Homo sapiens
tttcagttactgctatatcatt

SEQ ID NO: 7278858 - DNA, 22 bp, Homo sapiens
tttcagttcagtttattatatc

SEQ ID NO: 7278859 - DNA, 20 bp, Homo sapiens
tttcagttatcttgaccttc

SEQ ID NO: 7278860 - DNA, 22 bp, Homo sapiens
ctctccaggagagcactttgag

SEQ ID NO: 7278861 - DNA, 22 bp, Homo sapiens
ttctgtcacagtgctggtatca

SEQ ID NO: 7278862 - DNA, 22 bp, Homo sapiens
ttctgtcatgctcatgtaattg

SEQ ID NO: 7278863 - DNA, 21 bp, Homo sapiens
ttcttcctaaatacagatctc

SEQ ID NO: 7278864 - DNA, 22 bp, Homo sapiens
ttctgtatcttcagtgcccagc

SEQ ID NO: 7278865 - DNA, 22 bp, Homo sapiens
ttctgtatgtatgccagagcat

SEQ ID NO: 7278866 - DNA, 22 bp, Homo sapiens
ctatttgtcacaactggtgttt

SEQ ID NO: 7278867 - DNA, 22 bp, Homo sapiens
ctatttcaaggcccagatatga

SEQ ID NO: 7278868 - DNA, 22 bp, Homo sapiens
ctagggagtggcagagctggga

SEQ ID NO: 7278869 - DNA, 22 bp, Homo sapiens
ctaggctgagctgggctgagct

SEQ ID NO: 7278870 - DNA, 22 bp, Homo sapiens
ctaggcagtcctgacggtacta

SEQ ID NO: 7278871 - DNA, 23 bp, Homo sapiens
ctaggcaggattgtaggcgggta

SEQ ID NO: 7278872 - DNA, 22 bp, Homo sapiens
ctaggctggagtgcattggcgt

SEQ ID NO: 7278873 - DNA, 22 bp, Homo sapiens
ttcctttgggaaatcactaagg

SEQ ID NO: 7278874 - DNA, 22 bp, Homo sapiens
ttccttttcttctaccacatgt

SEQ ID NO: 7278875 - DNA, 22 bp, Homo sapiens
ttccttttcttatgcatcatta

SEQ ID NO: 7278876 - DNA, 22 bp, Homo sapiens
ttccttttctcacggggatcca

SEQ ID NO: 7278877 - DNA, 22 bp, Homo sapiens
ttccttttcttaaacatatgtg

SEQ ID NO: 7278878 - DNA, 20 bp, Homo sapiens
ctagcctggccttgctctgg

SEQ ID NO: 7278879 - DNA, 22 bp, Homo sapiens
ctagcctgggatttgaacttat

SEQ ID NO: 7278880 - DNA, 20 bp, Homo sapiens
ctaggcagcgagtgactgag

SEQ ID NO: 7278881 - DNA, 22 bp, Homo sapiens
ctaggcagatggagaagtggct

SEQ ID NO: 7278882 - DNA, 20 bp, Homo sapiens
ttgagcttttagtacagaca

SEQ ID NO: 7278883 - DNA, 22 bp, Homo sapiens
ttgactttaaagctttgtctct

SEQ ID NO: 7278884 - DNA, 22 bp, Homo sapiens
ttgactgttaagacttggctct

SEQ ID NO: 7278885 - DNA, 22 bp, Homo sapiens
cggcagtgggcgccaggtctcc

SEQ ID NO: 7278886 - DNA, 22 bp, Homo sapiens
cggcagtgggcgccaggtctcc

SEQ ID NO: 7278887 - DNA, 22 bp, Homo sapiens
ttcacatggcaatagagaggga

SEQ ID NO: 7278888 - DNA, 22 bp, Homo sapiens
ttcacagacattgcagactgaa

SEQ ID NO: 7278889 - DNA, 22 bp, Homo sapiens
ttcacatgaaagtaggaaagga

SEQ ID NO: 7278890 - DNA, 22 bp, Homo sapiens
cggctgagcagtgctgatggaa

SEQ ID NO: 7278891 - DNA, 22 bp, Homo sapiens
cggctgaggatctccaggcctg

SEQ ID NO: 7278892 - DNA, 22 bp, Homo sapiens
cggctgagacggccatagacac

SEQ ID NO: 7278893 - DNA, 22 bp, Homo sapiens
ttcattcttatttgtgatctgg

SEQ ID NO: 7278894 - DNA, 22 bp, Homo sapiens
ttcattcttgggatcagagagt

SEQ ID NO: 7278895 - DNA, 22 bp, Homo sapiens
ttcattcttgtctttgtatagt

SEQ ID NO: 7278896 - DNA, 19 bp, Homo sapiens
ttcattctcttattgttgt

SEQ ID NO: 7278897 - DNA, 22 bp, Homo sapiens
ttcattctgcagttctcagctc

SEQ ID NO: 7278898 - DNA, 22 bp, Homo sapiens
ttcattctgggctctaaggaac

SEQ ID NO: 7278899 - DNA, 23 bp, Homo sapiens
ttcatgagttggacaagactggg

SEQ ID NO: 7278900 - DNA, 22 bp, Homo sapiens
ctaatacaccctattgcttgtt

SEQ ID NO: 7278901 - DNA, 22 bp, Homo sapiens
ctaatcatctttctcttaaagc

SEQ ID NO: 7278902 - DNA, 22 bp, Homo sapiens
ttccttctaatattctgcctgt

SEQ ID NO: 7278903 - DNA, 22 bp, Homo sapiens
ttccgagggctcggcggccgcc

SEQ ID NO: 7278904 - DNA, 22 bp, Homo sapiens
ttcccttaaattatggcatcta

SEQ ID NO: 7278905 - DNA, 22 bp, Homo sapiens
gtgggtgtggaactgtgagacc

SEQ ID NO: 7278906 - DNA, 22 bp, Homo sapiens
gtgggtgtgataagaccaaggg

SEQ ID NO: 7278907 - DNA, 22 bp, Homo sapiens
gtgtatgtgtttatagggaggt

SEQ ID NO: 7278908 - DNA, 22 bp, Homo sapiens
gtgtatgttctacttaatatta

SEQ ID NO: 7278909 - DNA, 19 bp, Homo sapiens
gtgtatgtaagttgtgagg

SEQ ID NO: 7278910 - DNA, 22 bp, Homo sapiens
gtgtatgtgccttacattttat

SEQ ID NO: 7278911 - DNA, 22 bp, Homo sapiens
gtgtgaaatggttctctttgtt

SEQ ID NO: 7278912 - DNA, 22 bp, Homo sapiens
gtgtgaaagtaattgcggtttt

SEQ ID NO: 7278913 - DNA, 17 bp, Homo sapiens
gtgtctttgctgttgtg

SEQ ID NO: 7278914 - DNA, 22 bp, Homo sapiens
gtgtctttattcctctatgttt

SEQ ID NO: 7278915 - DNA, 22 bp, Homo sapiens
gtgtgagagaagctgccatgga

SEQ ID NO: 7278916 - DNA, 22 bp, Homo sapiens
cagctggggcagccacgtgcgg

SEQ ID NO: 7278917 - DNA, 22 bp, Homo sapiens
cagctgtctggggagtgctcgc

SEQ ID NO: 7278918 - DNA, 22 bp, Homo sapiens
cagctggctggtcagtgcacaa

SEQ ID NO: 7278919 - DNA, 20 bp, Homo sapiens
cagctgcctggctctgggat

SEQ ID NO: 7278920 - DNA, 22 bp, Homo sapiens
cagctgccacttgctctcggct

SEQ ID NO: 7278921 - DNA, 22 bp, Homo sapiens
cagctgccacaggactttctga

SEQ ID NO: 7278922 - DNA, 22 bp, Homo sapiens
cagctgccacacctctttctct

SEQ ID NO: 7278923 - DNA, 22 bp, Homo sapiens
cagctgccaagaatcttttcta

SEQ ID NO: 7278924 - DNA, 22 bp, Homo sapiens
cagctggctgcatgatgccaaa

SEQ ID NO: 7278925 - DNA, 22 bp, Homo sapiens
cagctggccccacagtagaggc

SEQ ID NO: 7278926 - DNA, 22 bp, Homo sapiens
cagctggcgggcagagccgcca

SEQ ID NO: 7278927 - DNA, 22 bp, Homo sapiens
cagctggccaatcagggcgccc

SEQ ID NO: 7278928 - DNA, 22 bp, Homo sapiens
cagctgctgttcagttttgttt

SEQ ID NO: 7278929 - DNA, 22 bp, Homo sapiens
cagctgcttactagctgtgtga

SEQ ID NO: 7278930 - DNA, 22 bp, Homo sapiens
cagctgctgtaacagaatactt

SEQ ID NO: 7278931 - DNA, 22 bp, Homo sapiens
cagctgctgcccttggctgcag

SEQ ID NO: 7278932 - DNA, 22 bp, Homo sapiens
cagctgctctggtggtctctcc

SEQ ID NO: 7278933 - DNA, 22 bp, Homo sapiens
cagctgccttctgcgggaagtc

SEQ ID NO: 7278934 - DNA, 22 bp, Homo sapiens
cagctgcctgtctggaggcaat

SEQ ID NO: 7278935 - DNA, 22 bp, Homo sapiens
cagctgcctgtctggaggcaat

SEQ ID NO: 7278936 - DNA, 22 bp, Homo sapiens
cagctgagctgccagactactg

SEQ ID NO: 7278937 - DNA, 22 bp, Homo sapiens
cagctgagtttccaagtctgcc

SEQ ID NO: 7278938 - DNA, 22 bp, Homo sapiens
cagctgagttactctgaggtct

SEQ ID NO: 7278939 - DNA, 22 bp, Homo sapiens
cagctgagtggaccctagaggc

SEQ ID NO: 7278940 - DNA, 22 bp, Homo sapiens
gtggctttcatttcaggatgtg

SEQ ID NO: 7278941 - DNA, 22 bp, Homo sapiens
cagctctgtgcaggcctgggga

SEQ ID NO: 7278942 - DNA, 22 bp, Homo sapiens
gtggcagagcaggagacaggac

SEQ ID NO: 7278943 - DNA, 22 bp, Homo sapiens
gtggcagagatagaactggaat

SEQ ID NO: 7278944 - DNA, 22 bp, Homo sapiens
gtggcagagcaggagacaggac

SEQ ID NO: 7278945 - DNA, 22 bp, Homo sapiens
gtggcagagagcaagtgtctga

SEQ ID NO: 7278946 - DNA, 22 bp, Homo sapiens
gtggcagagaacaaggagaggt

SEQ ID NO: 7278947 - DNA, 22 bp, Homo sapiens
gtggcagaaactggcagaggag

SEQ ID NO: 7278948 - DNA, 22 bp, Homo sapiens
gtggcagaaatattcttgctct

SEQ ID NO: 7278949 - DNA, 22 bp, Homo sapiens
gtggcagaagagtaggatgggc

SEQ ID NO: 7278950 - DNA, 20 bp, Homo sapiens
gtgtgtgctccatgcatgct

SEQ ID NO: 7278951 - DNA, 22 bp, Homo sapiens
gttaaacagttacatgtgctgg

SEQ ID NO: 7278952 - DNA, 22 bp, Homo sapiens
gtgtgtctgaagttgagtagac

SEQ ID NO: 7278953 - DNA, 22 bp, Homo sapiens
cagcttccgaccgggggctgca

SEQ ID NO: 7278954 - DNA, 22 bp, Homo sapiens
cagcttccataagagatggaga

SEQ ID NO: 7278955 - DNA, 22 bp, Homo sapiens
cagcttccataagagatggaga

SEQ ID NO: 7278956 - DNA, 22 bp, Homo sapiens
cagcttccatctccactgccct

SEQ ID NO: 7278957 - DNA, 22 bp, Homo sapiens
cagctgtgctgattgctcagta

SEQ ID NO: 7278958 - DNA, 22 bp, Homo sapiens
cagctgtgtagatgcagggtca

SEQ ID NO: 7278959 - DNA, 22 bp, Homo sapiens
cagctgtggagggaggaaatgc

SEQ ID NO: 7278960 - DNA, 22 bp, Homo sapiens
gttcacagaaattgtgtacctc

SEQ ID NO: 7278961 - DNA, 22 bp, Homo sapiens
cagctttgaaacatggctctag

SEQ ID NO: 7278962 - DNA, 22 bp, Homo sapiens
caggaaaatggaatcacctgta

SEQ ID NO: 7278963 - DNA, 22 bp, Homo sapiens
caggaaaatgtcaatggaaagc

SEQ ID NO: 7278964 - DNA, 22 bp, Homo sapiens
cagcttctgctatcgaacatct

SEQ ID NO: 7278965 - DNA, 22 bp, Homo sapiens
caggaacacaatgagtctcaaa

SEQ ID NO: 7278966 - DNA, 22 bp, Homo sapiens
caggaacaatgtaagtctcatt

SEQ ID NO: 7278967 - DNA, 22 bp, Homo sapiens
gtttattatacaacaaaagcta

SEQ ID NO: 7278968 - DNA, 22 bp, Homo sapiens
gtttattgataaaagctggaca

SEQ ID NO: 7278969 - DNA, 22 bp, Homo sapiens
gtttattgggtattgtggagcc

SEQ ID NO: 7278970 - DNA, 22 bp, Homo sapiens
gtttgcctgccgacgctctcat

SEQ ID NO: 7278971 - DNA, 22 bp, Homo sapiens
gttcttcaggccatcctcccag

SEQ ID NO: 7278972 - DNA, 22 bp, Homo sapiens
gttcttcagcattagaagtcat

SEQ ID NO: 7278973 - DNA, 22 bp, Homo sapiens
gttcttcagattccatttcagt

SEQ ID NO: 7278974 - DNA, 22 bp, Homo sapiens
gttcttcagaggggaaagaacc

SEQ ID NO: 7278975 - DNA, 22 bp, Homo sapiens
gttctgtctgagcaccacagga

SEQ ID NO: 7278976 - DNA, 22 bp, Homo sapiens
gttcttcacatttcattgagga

SEQ ID NO: 7278977 - DNA, 22 bp, Homo sapiens
gttcttcaaagtgacaactaaa

SEQ ID NO: 7278978 - DNA, 22 bp, Homo sapiens
caggaaaggtgtgtcatgatgg

SEQ ID NO: 7278979 - DNA, 22 bp, Homo sapiens
caggaaagggatgggctgccac

SEQ ID NO: 7278980 - DNA, 22 bp, Homo sapiens
gttggccagagatgctgatata

SEQ ID NO: 7278981 - DNA, 22 bp, Homo sapiens
gttggccagcacagcttgcaag

SEQ ID NO: 7278982 - DNA, 22 bp, Homo sapiens
gttggccaggctggtctcaaac

SEQ ID NO: 7278983 - DNA, 22 bp, Homo sapiens
gttggccaggctggtctcaatc

SEQ ID NO: 7278984 - DNA, 22 bp, Homo sapiens
gttggccatcgctatgacaaga

SEQ ID NO: 7278985 - DNA, 22 bp, Homo sapiens
caggcagccaggggacctgtcc

SEQ ID NO: 7278986 - DNA, 22 bp, Homo sapiens
caggcagcatttactctgatga

SEQ ID NO: 7278987 - DNA, 22 bp, Homo sapiens
caggcagcatttactctgatga

SEQ ID NO: 7278988 - DNA, 22 bp, Homo sapiens
caggcagcatcagtctgctgta

SEQ ID NO: 7278989 - DNA, 22 bp, Homo sapiens
caggcagcaggagccctgctcg

SEQ ID NO: 7278990 - DNA, 22 bp, Homo sapiens
caggcagcaggagccctgctcg

SEQ ID NO: 7278991 - DNA, 22 bp, Homo sapiens
caggcagcagccactctggtat

SEQ ID NO: 7278992 - DNA, 22 bp, Homo sapiens
caggcagcagccactctggtat

SEQ ID NO: 7278993 - DNA, 22 bp, Homo sapiens
caggcagctctaatggaaagtg

SEQ ID NO: 7278994 - DNA, 22 bp, Homo sapiens
caggcagctcgatgccttgttg

SEQ ID NO: 7278995 - DNA, 22 bp, Homo sapiens
caggcagcctgagggatctggg

SEQ ID NO: 7278996 - DNA, 22 bp, Homo sapiens
caggcagcctgagggatctggg

SEQ ID NO: 7278997 - DNA, 22 bp, Homo sapiens
caggcagccctgcaccaagtgt

SEQ ID NO: 7278998 - DNA, 22 bp, Homo sapiens
caggcagccaggggacctgtcc

SEQ ID NO: 7278999 - DNA, 22 bp, Homo sapiens
caggcagctgactgtcagatat

SEQ ID NO: 7279000 - DNA, 22 bp, Homo sapiens
caggcagctctgcttttcctaa

SEQ ID NO: 7279001 - DNA, 22 bp, Homo sapiens
caggcagctgaggactttgcta

SEQ ID NO: 7279002 - DNA, 22 bp, Homo sapiens
caggcagctgcgacaagagagc

SEQ ID NO: 7279003 - DNA, 22 bp, Homo sapiens
caggcagctgcgacaagagagc

SEQ ID NO: 7279004 - DNA, 22 bp, Homo sapiens
caggcagctgctgggttcagcc

SEQ ID NO: 7279005 - DNA, 22 bp, Homo sapiens
caggcagctgctgggttcagcc

SEQ ID NO: 7279006 - DNA, 22 bp, Homo sapiens
caggcagctgggtcaccgtccc

SEQ ID NO: 7279007 - DNA, 23 bp, Homo sapiens
caggcaggatgaggactacactc

SEQ ID NO: 7279008 - DNA, 22 bp, Homo sapiens
caggcagggagccactgtataa

SEQ ID NO: 7279009 - DNA, 22 bp, Homo sapiens
caggcagagcaactggtccaga

SEQ ID NO: 7279010 - DNA, 22 bp, Homo sapiens
caggcagactttgagaatgatg

SEQ ID NO: 7279011 - DNA, 22 bp, Homo sapiens
caggcagagacgtcagtgtagg

SEQ ID NO: 7279012 - DNA, 22 bp, Homo sapiens
caggcagagaggagcatttaat

SEQ ID NO: 7279013 - DNA, 17 bp, Homo sapiens
caggcagacatgtaagc

SEQ ID NO: 7279014 - DNA, 22 bp, Homo sapiens
caggcagaaggaagtaccaggc

SEQ ID NO: 7279015 - DNA, 22 bp, Homo sapiens
caggcagaagaagtggaaggac

SEQ ID NO: 7279016 - DNA, 22 bp, Homo sapiens
caggcagggagctggaaaggat

SEQ ID NO: 7279017 - DNA, 22 bp, Homo sapiens
tacatcataataatacttagaa

SEQ ID NO: 7279018 - DNA, 22 bp, Homo sapiens
caggccctgggcaggatcagcc

SEQ ID NO: 7279019 - DNA, 22 bp, Homo sapiens
caggccctggcagggctgagtc

SEQ ID NO: 7279020 - DNA, 22 bp, Homo sapiens
caggccctgggcaggcacagag

SEQ ID NO: 7279021 - DNA, 22 bp, Homo sapiens
taacattaggtagacataagcc

SEQ ID NO: 7279022 - DNA, 22 bp, Homo sapiens
taacactttggattaaaattct

SEQ ID NO: 7279023 - DNA, 22 bp, Homo sapiens
taactttaggaataggtaatct

SEQ ID NO: 7279024 - DNA, 22 bp, Homo sapiens
taactttatgacatgtcttgct

SEQ ID NO: 7279025 - DNA, 22 bp, Homo sapiens
taactttagtgtatgaggtaag

SEQ ID NO: 7279026 - DNA, 22 bp, Homo sapiens
caggatggtcttcatttggctc

SEQ ID NO: 7279027 - DNA, 22 bp, Homo sapiens
caggatgaggtagaggcagata

SEQ ID NO: 7279028 - DNA, 22 bp, Homo sapiens
caggatgaccatatgttccagt

SEQ ID NO: 7279029 - DNA, 22 bp, Homo sapiens
caggatgagaagggctcttacg

SEQ ID NO: 7279030 - DNA, 22 bp, Homo sapiens
caggagagatatgagtccccac

SEQ ID NO: 7279031 - DNA, 19 bp, Homo sapiens
caggagagcatgcactttg

SEQ ID NO: 7279032 - DNA, 22 bp, Homo sapiens
caggagagcccgggtccgggct

SEQ ID NO: 7279033 - DNA, 22 bp, Homo sapiens
caggagaggaggctacttctta

SEQ ID NO: 7279034 - DNA, 15 bp, Homo sapiens
caggagaggaaggtt

SEQ ID NO: 7279035 - DNA, 22 bp, Homo sapiens
caggagatcttaggaattctta

SEQ ID NO: 7279036 - DNA, 22 bp, Homo sapiens
caggagaggctgtacgtttctc

SEQ ID NO: 7279037 - DNA, 22 bp, Homo sapiens
caggagatgtaagacttctgtt

SEQ ID NO: 7279038 - DNA, 22 bp, Homo sapiens
taaatcacatcgaaatctgggt

SEQ ID NO: 7279039 - DNA, 22 bp, Homo sapiens
taaatcacaaattttctcattt

SEQ ID NO: 7279040 - DNA, 22 bp, Homo sapiens
taaatcacattttctttgtgtt

SEQ ID NO: 7279041 - DNA, 22 bp, Homo sapiens
taaatcacattcgtctgctcct

SEQ ID NO: 7279042 - DNA, 22 bp, Homo sapiens
caggaggcatcatggagcggac

SEQ ID NO: 7279043 - DNA, 22 bp, Homo sapiens
caggaggcccaaagggcgcaga

SEQ ID NO: 7279044 - DNA, 22 bp, Homo sapiens
caggaggccaactgtgggactt

SEQ ID NO: 7279045 - DNA, 22 bp, Homo sapiens
caggagggcccgagactcttcc

SEQ ID NO: 7279046 - DNA, 20 bp, Homo sapiens
caggagggacatttcagcat

SEQ ID NO: 7279047 - DNA, 22 bp, Homo sapiens
caggagggggtggagtttcgcc

SEQ ID NO: 7279048 - DNA, 22 bp, Homo sapiens
caggaggcgtcttcagtttgtt

SEQ ID NO: 7279049 - DNA, 22 bp, Homo sapiens
taacaaagtaccatagattggg

SEQ ID NO: 7279050 - DNA, 19 bp, Homo sapiens
taacaaagtctgaagtcag

SEQ ID NO: 7279051 - DNA, 22 bp, Homo sapiens
taacaaagtaccatagactgga

SEQ ID NO: 7279052 - DNA, 22 bp, Homo sapiens
caggagcttctgcccatggcca

SEQ ID NO: 7279053 - DNA, 22 bp, Homo sapiens
caggagctggatctccttgcgg

SEQ ID NO: 7279054 - DNA, 22 bp, Homo sapiens
caggaggcagtttcagaagtca

SEQ ID NO: 7279055 - DNA, 22 bp, Homo sapiens
caggaggcaggtgcattttgag

SEQ ID NO: 7279056 - DNA, 22 bp, Homo sapiens
caggaggcagaggttgcagcga

SEQ ID NO: 7279057 - DNA, 22 bp, Homo sapiens
caggaggcagaggttgcagtga

SEQ ID NO: 7279058 - DNA, 22 bp, Homo sapiens
caggaggaagaactctgcaaca

SEQ ID NO: 7279059 - DNA, 22 bp, Homo sapiens
caggacatcgtcatcatgggga

SEQ ID NO: 7279060 - DNA, 23 bp, Homo sapiens
caggacatgggaggaagtatggc

SEQ ID NO: 7279061 - DNA, 22 bp, Homo sapiens
taaaatgatctctcatgttctt

SEQ ID NO: 7279062 - DNA, 22 bp, Homo sapiens
taaacatttgttattcttgttt

SEQ ID NO: 7279063 - DNA, 22 bp, Homo sapiens
taaaatagcatgtgcagtgaaa

SEQ ID NO: 7279064 - DNA, 22 bp, Homo sapiens
taaaatagcatgtgcagtgaaa

SEQ ID NO: 7279065 - DNA, 22 bp, Homo sapiens
gttttctgattagcaaatctga

SEQ ID NO: 7279066 - DNA, 22 bp, Homo sapiens
caggaatgtttgtgctccttta

SEQ ID NO: 7279067 - DNA, 22 bp, Homo sapiens
caggaatgtgagggttccctgc

SEQ ID NO: 7279068 - DNA, 22 bp, Homo sapiens
caggaatgtccttgtcatttca

SEQ ID NO: 7279069 - DNA, 22 bp, Homo sapiens
caggaatgtcccatccccttca

SEQ ID NO: 7279070 - DNA, 22 bp, Homo sapiens
caggaatgttgcatgtgatctt

SEQ ID NO: 7279071 - DNA, 22 bp, Homo sapiens
caggaatgagttctggtgctct

SEQ ID NO: 7279072 - DNA, 22 bp, Homo sapiens
caggaatgatattcgaggagat

SEQ ID NO: 7279073 - DNA, 22 bp, Homo sapiens
caggaatggaggcatttatgaa

SEQ ID NO: 7279074 - DNA, 22 bp, Homo sapiens
caggaatgccttcttcagccat

SEQ ID NO: 7279075 - DNA, 22 bp, Homo sapiens
caggaatggttaatctaaagtg

SEQ ID NO: 7279076 - DNA, 22 bp, Homo sapiens
caggacagctcaacacctcctc

SEQ ID NO: 7279077 - DNA, 22 bp, Homo sapiens
gttttccatggaggtctgacct

SEQ ID NO: 7279078 - DNA, 22 bp, Homo sapiens
gttttccactggattgtttgga

SEQ ID NO: 7279079 - DNA, 22 bp, Homo sapiens
caggaatgacccaacagtttca

SEQ ID NO: 7279080 - DNA, 22 bp, Homo sapiens
catatcatttgcttataaatct

SEQ ID NO: 7279081 - DNA, 22 bp, Homo sapiens
catatcataggtcttggataat

SEQ ID NO: 7279082 - DNA, 22 bp, Homo sapiens
catatccaatatgactagtgtt

SEQ ID NO: 7279083 - DNA, 22 bp, Homo sapiens
catatcttctgacatgatcagg

SEQ ID NO: 7279084 - DNA, 22 bp, Homo sapiens
tcagctctgttttgagtggaac

SEQ ID NO: 7279085 - DNA, 22 bp, Homo sapiens
catgcaaaggtcaagatcagga

SEQ ID NO: 7279086 - DNA, 22 bp, Homo sapiens
catgcaaacacgtaaacattca

SEQ ID NO: 7279087 - DNA, 23 bp, Homo sapiens
catggctgatttcaagctaccac

SEQ ID NO: 7279088 - DNA, 19 bp, Homo sapiens
catggctgctgcttgggag

SEQ ID NO: 7279089 - DNA, 22 bp, Homo sapiens
catgtcttaggaaagcagagga

SEQ ID NO: 7279090 - DNA, 22 bp, Homo sapiens
tcagttctgctagaaaaacagt

SEQ ID NO: 7279091 - DNA, 20 bp, Homo sapiens
tcagtttaaatcctggcttt

SEQ ID NO: 7279092 - DNA, 22 bp, Homo sapiens
tcagttctttatttcacagtga

SEQ ID NO: 7279093 - DNA, 22 bp, Homo sapiens
tcatttcaatgatactactaag

SEQ ID NO: 7279094 - DNA, 22 bp, Homo sapiens
catgatctggtcctactgtggg

SEQ ID NO: 7279095 - DNA, 19 bp, Homo sapiens
tatggcaggccgaggcact

SEQ ID NO: 7279096 - DNA, 22 bp, Homo sapiens
tatctctaggctgccacttaaa

SEQ ID NO: 7279097 - DNA, 22 bp, Homo sapiens
tatctccatctggagagcaaaa

SEQ ID NO: 7279098 - DNA, 22 bp, Homo sapiens
tatctccagtttctgagcctca

SEQ ID NO: 7279099 - DNA, 22 bp, Homo sapiens
tatggctggaatactgaaaggc

SEQ ID NO: 7279100 - DNA, 22 bp, Homo sapiens
caggtctgggttgatggcctgg

SEQ ID NO: 7279101 - DNA, 22 bp, Homo sapiens
tattggaaggaagcaagagagg

SEQ ID NO: 7279102 - DNA, 22 bp, Homo sapiens
tattggaagattcaggattgca

SEQ ID NO: 7279103 - DNA, 22 bp, Homo sapiens
tacatgtgttctgtttcaagtt

SEQ ID NO: 7279104 - DNA, 22 bp, Homo sapiens
tataatatgaggcaggagtgat

SEQ ID NO: 7279105 - DNA, 22 bp, Homo sapiens
caggggcaagaatgctgtcagc

SEQ ID NO: 7279106 - DNA, 22 bp, Homo sapiens
caggggcaggtgtgagatcatc

SEQ ID NO: 7279107 - DNA, 22 bp, Homo sapiens
cagggtggcactcagcgcatct

SEQ ID NO: 7279108 - DNA, 22 bp, Homo sapiens
caggtctcgggttcagcagtga

SEQ ID NO: 7279109 - DNA, 22 bp, Homo sapiens
caggtccagaaaccaaaggatt

SEQ ID NO: 7279110 - DNA, 22 bp, Homo sapiens
cagtgattcagactcatcattt

SEQ ID NO: 7279111 - DNA, 22 bp, Homo sapiens
tattggaatagttaaggaagat

SEQ ID NO: 7279112 - DNA, 22 bp, Homo sapiens
tattggaatgcactgggagaga

SEQ ID NO: 7279113 - DNA, 22 bp, Homo sapiens
tattggattgagacattttaga

SEQ ID NO: 7279114 - DNA, 22 bp, Homo sapiens
cagtcctctctgtgtctgcacc

SEQ ID NO: 7279115 - DNA, 22 bp, Homo sapiens
cagtcctctcactcaggccttt

SEQ ID NO: 7279116 - DNA, 22 bp, Homo sapiens
cagtcctgttcctggagtagtt

SEQ ID NO: 7279117 - DNA, 22 bp, Homo sapiens
cagtgctgtgctggaagctgtt

SEQ ID NO: 7279118 - DNA, 23 bp, Homo sapiens
cagtgctggttctgcctgtgggg

SEQ ID NO: 7279119 - DNA, 22 bp, Homo sapiens
cagtgctgtgctggaagctgtt

SEQ ID NO: 7279120 - DNA, 22 bp, Homo sapiens
cagtgctgttgggcccagagag

SEQ ID NO: 7279121 - DNA, 22 bp, Homo sapiens
cagtgctgagagcctggccagg

SEQ ID NO: 7279122 - DNA, 22 bp, Homo sapiens
cagtgctgcaggcgcctgcggt

SEQ ID NO: 7279123 - DNA, 22 bp, Homo sapiens
cagtgctgggcagaggagagcg

SEQ ID NO: 7279124 - DNA, 22 bp, Homo sapiens
cagtgctggctgttaggacagt

SEQ ID NO: 7279125 - DNA, 22 bp, Homo sapiens
tcactcaatatcccagtggggc

SEQ ID NO: 7279126 - DNA, 22 bp, Homo sapiens
tcactcaagcatctacagggat

SEQ ID NO: 7279127 - DNA, 22 bp, Homo sapiens
tcactcaatggtatcaggaggt

SEQ ID NO: 7279128 - DNA, 22 bp, Homo sapiens
tcacttcccagacggggtggca

SEQ ID NO: 7279129 - DNA, 22 bp, Homo sapiens
tctgtcttcatcagcatgtgat

SEQ ID NO: 7279130 - DNA, 22 bp, Homo sapiens
tctgtcttcatcagcatgtgat

SEQ ID NO: 7279131 - DNA, 17 bp, Homo sapiens
tctgtctgtggtccact

SEQ ID NO: 7279132 - DNA, 23 bp, Homo sapiens
tctgtcttgtttaggccactgtt

SEQ ID NO: 7279133 - DNA, 22 bp, Homo sapiens
tctgtggcacgattgcactgca

SEQ ID NO: 7279134 - DNA, 22 bp, Homo sapiens
tctgtcacccctgtttctggct

SEQ ID NO: 7279135 - DNA, 21 bp, Homo sapiens
ccaggaaggactgagctccct

SEQ ID NO: 7279136 - DNA, 22 bp, Homo sapiens
ccaggaagctgtctgatatgaa

SEQ ID NO: 7279137 - DNA, 22 bp, Homo sapiens
ccaggaaaataccaagctttaa

SEQ ID NO: 7279138 - DNA, 22 bp, Homo sapiens
ccaggaaatagtgctgtgatct

SEQ ID NO: 7279139 - DNA, 22 bp, Homo sapiens
ccaggaaatggcttgcttcttt

SEQ ID NO: 7279140 - DNA, 22 bp, Homo sapiens
tctgcgccctgtcgcctgctcc

SEQ ID NO: 7279141 - DNA, 22 bp, Homo sapiens
tctgcctgaaccactcttggag

SEQ ID NO: 7279142 - DNA, 19 bp, Homo sapiens
tctgcctctggtcaggctc

SEQ ID NO: 7279143 - DNA, 22 bp, Homo sapiens
tctgcctctttcaggcctggca

SEQ ID NO: 7279144 - DNA, 22 bp, Homo sapiens
tctgcctctttcaggcctggca

SEQ ID NO: 7279145 - DNA, 22 bp, Homo sapiens
tctgcctgaaccactcttggag

SEQ ID NO: 7279146 - DNA, 22 bp, Homo sapiens
tctgcctgagaagtggggtgcc

SEQ ID NO: 7279147 - DNA, 22 bp, Homo sapiens
tctgcctgagaagtggggtgcc

SEQ ID NO: 7279148 - DNA, 22 bp, Homo sapiens
ccagctctaaacggctctgtgg

SEQ ID NO: 7279149 - DNA, 22 bp, Homo sapiens
ccagctccttctgtctgtggag

SEQ ID NO: 7279150 - DNA, 22 bp, Homo sapiens
ccagctcctgggtcttagtcag

SEQ ID NO: 7279151 - DNA, 21 bp, Homo sapiens
ccagctccaggaccttggatc

SEQ ID NO: 7279152 - DNA, 22 bp, Homo sapiens
ccagctcctcttgtctctagca

SEQ ID NO: 7279153 - DNA, 19 bp, Homo sapiens
tctgcctctggtcaggctc

SEQ ID NO: 7279154 - DNA, 22 bp, Homo sapiens
tctgcctcgctaacagcagcca

SEQ ID NO: 7279155 - DNA, 22 bp, Homo sapiens
tctgcctcctgcttgtcccgac

SEQ ID NO: 7279156 - DNA, 22 bp, Homo sapiens
tctgcctcctgcttgtcccgac

SEQ ID NO: 7279157 - DNA, 22 bp, Homo sapiens
tctgcctcgctaacagcagcca

SEQ ID NO: 7279158 - DNA, 23 bp, Homo sapiens
ccagcgctcactcagagcatgtt

SEQ ID NO: 7279159 - DNA, 22 bp, Homo sapiens
ccagcctttgcatcccccatct

SEQ ID NO: 7279160 - DNA, 22 bp, Homo sapiens
ccagccttgcaccgagccagcc

SEQ ID NO: 7279161 - DNA, 22 bp, Homo sapiens
ccagccttctgggactctcatc

SEQ ID NO: 7279162 - DNA, 22 bp, Homo sapiens
ccagccttgactgccccagcac

SEQ ID NO: 7279163 - DNA, 22 bp, Homo sapiens
ccagctccagcatagccaccat

SEQ ID NO: 7279164 - DNA, 22 bp, Homo sapiens
ccagctccaagtttgggcatca

SEQ ID NO: 7279165 - DNA, 22 bp, Homo sapiens
ccagccactgggccactgccag

SEQ ID NO: 7279166 - DNA, 22 bp, Homo sapiens
tctctcttcaacccttaactag

SEQ ID NO: 7279167 - DNA, 22 bp, Homo sapiens
tctctcttctttgttaagaatg

SEQ ID NO: 7279168 - DNA, 22 bp, Homo sapiens
tctctcttgaagtattagctag

SEQ ID NO: 7279169 - DNA, 22 bp, Homo sapiens
tctctcttgtcaccccatctgc

SEQ ID NO: 7279170 - DNA, 22 bp, Homo sapiens
tctgaggacagtgctgtgcctg

SEQ ID NO: 7279171 - DNA, 22 bp, Homo sapiens
ccagccctacagtatcacctgt

SEQ ID NO: 7279172 - DNA, 22 bp, Homo sapiens
tctgaggagtgaccctcttgca

SEQ ID NO: 7279173 - DNA, 22 bp, Homo sapiens
tctgaggttttcatgttttctg

SEQ ID NO: 7279174 - DNA, 22 bp, Homo sapiens
tctgaggttgaactttgcaaag

SEQ ID NO: 7279175 - DNA, 22 bp, Homo sapiens
tctgaggttctgttttcaactg

SEQ ID NO: 7279176 - DNA, 22 bp, Homo sapiens
ccagccatgcacaaaccatgag

SEQ ID NO: 7279177 - DNA, 21 bp, Homo sapiens
ccagcccagcctccttctctt

SEQ ID NO: 7279178 - DNA, 22 bp, Homo sapiens
ccagccccgggaacctggccgt

SEQ ID NO: 7279179 - DNA, 22 bp, Homo sapiens
ccagccccgggaacctggccgt

SEQ ID NO: 7279180 - DNA, 19 bp, Homo sapiens
ccagcccatagtccatcac

SEQ ID NO: 7279181 - DNA, 21 bp, Homo sapiens
tcccagggccaggtgccatca

SEQ ID NO: 7279182 - DNA, 22 bp, Homo sapiens
tcccagggctctagagtgctgg

SEQ ID NO: 7279183 - DNA, 22 bp, Homo sapiens
tcccagggcttttctcatgctt

SEQ ID NO: 7279184 - DNA, 22 bp, Homo sapiens
catttgatcctcacaacaatct

SEQ ID NO: 7279185 - DNA, 22 bp, Homo sapiens
ccaaagtcagtgctcagtcgtc

SEQ ID NO: 7279186 - DNA, 22 bp, Homo sapiens
ccaaaagcagctgtctgtgaat

SEQ ID NO: 7279187 - DNA, 23 bp, Homo sapiens
ccaaagtcgaagtctagtccaga

SEQ ID NO: 7279188 - DNA, 22 bp, Homo sapiens
tccctgctgcactcacacctac

SEQ ID NO: 7279189 - DNA, 22 bp, Homo sapiens
tcctgcagtgtgtctcctgcac

SEQ ID NO: 7279190 - DNA, 22 bp, Homo sapiens
ccaaataatatttcagaaccat

SEQ ID NO: 7279191 - DNA, 22 bp, Homo sapiens
ccaaataatatttcagaaccat

SEQ ID NO: 7279192 - DNA, 22 bp, Homo sapiens
ccaaatgtgcctgtttcaacaa

SEQ ID NO: 7279193 - DNA, 22 bp, Homo sapiens
ccacagctagggcaatctgatt

SEQ ID NO: 7279194 - DNA, 22 bp, Homo sapiens
ccacagctgaaagcagaggctc

SEQ ID NO: 7279195 - DNA, 22 bp, Homo sapiens
ccacagaggacaactgcctggc

SEQ ID NO: 7279196 - DNA, 20 bp, Homo sapiens
tcctgcagttcctaggaggg

SEQ ID NO: 7279197 - DNA, 22 bp, Homo sapiens
ccacagtctagctagaaggcat

SEQ ID NO: 7279198 - DNA, 22 bp, Homo sapiens
ccacagtccgggctggcaggac

SEQ ID NO: 7279199 - DNA, 22 bp, Homo sapiens
ccacagtgagttctgtactctg

SEQ ID NO: 7279200 - DNA, 22 bp, Homo sapiens
tcctggtgaatgactttttatt

SEQ ID NO: 7279201 - DNA, 23 bp, Homo sapiens
tcctggtgacatgcctgagcatc

SEQ ID NO: 7279202 - DNA, 22 bp, Homo sapiens
tcctggtgctgacacccatagc

SEQ ID NO: 7279203 - DNA, 19 bp, Homo sapiens
tcctggtgcttgacactga

SEQ ID NO: 7279204 - DNA, 22 bp, Homo sapiens
tcctggtgcctggagctctcca

SEQ ID NO: 7279205 - DNA, 22 bp, Homo sapiens
tcctggtgatcaaaattcattt

SEQ ID NO: 7279206 - DNA, 22 bp, Homo sapiens
tcctggtgaggactccaagata

SEQ ID NO: 7279207 - DNA, 19 bp, Homo sapiens
tcctggtgaccctgaaatt

SEQ ID NO: 7279208 - DNA, 22 bp, Homo sapiens
tcctggtgaggctagaagtgtc

SEQ ID NO: 7279209 - DNA, 22 bp, Homo sapiens
tcctggtggatagaagccaagg

SEQ ID NO: 7279210 - DNA, 20 bp, Homo sapiens
tcctggtggatactgcttaa

SEQ ID NO: 7279211 - DNA, 22 bp, Homo sapiens
tcctggtgcttgtatttgaagt

SEQ ID NO: 7279212 - DNA, 18 bp, Homo sapiens
tcctggtggagaagtggt

SEQ ID NO: 7279213 - DNA, 22 bp, Homo sapiens
ccactgaggcaggcagtatcta

SEQ ID NO: 7279214 - DNA, 22 bp, Homo sapiens
tctccagtctcaagacattgag

SEQ ID NO: 7279215 - DNA, 18 bp, Homo sapiens
ccagagctggctcctcgc

SEQ ID NO: 7279216 - DNA, 22 bp, Homo sapiens
ccagagctgatgggcccagggt

SEQ ID NO: 7279217 - DNA, 22 bp, Homo sapiens
ccagagctgattcctgggactt

SEQ ID NO: 7279218 - DNA, 22 bp, Homo sapiens
ccagagctgcatccagcaggtt

SEQ ID NO: 7279219 - DNA, 20 bp, Homo sapiens
ccagagctgatggctgcccg

SEQ ID NO: 7279220 - DNA, 19 bp, Homo sapiens
tctctctgtacattagata

SEQ ID NO: 7279221 - DNA, 22 bp, Homo sapiens
ccagatgagaccacactgctgg

SEQ ID NO: 7279222 - DNA, 22 bp, Homo sapiens
ccagatatcactgccgtgttgt

SEQ ID NO: 7279223 - DNA, 22 bp, Homo sapiens
ccagaggagatgcctcctctgt

SEQ ID NO: 7279224 - DNA, 22 bp, Homo sapiens
tgtggggaagagtatgacttgg

SEQ ID NO: 7279225 - DNA, 22 bp, Homo sapiens
tgtgtacatatctatcctagat

SEQ ID NO: 7279226 - DNA, 22 bp, Homo sapiens
tgtgggcaggagcacaagtcag

SEQ ID NO: 7279227 - DNA, 22 bp, Homo sapiens
tgtgggatggttttgccagaat

SEQ ID NO: 7279228 - DNA, 23 bp, Homo sapiens
tgtgggcgcattgtaagggtagc

SEQ ID NO: 7279229 - DNA, 22 bp, Homo sapiens
tgtggctgactcctggtcccca

SEQ ID NO: 7279230 - DNA, 22 bp, Homo sapiens
tgtggctcggccagctgctgaa

SEQ ID NO: 7279231 - DNA, 22 bp, Homo sapiens
tgtggctctcctcctgctgccc

SEQ ID NO: 7279232 - DNA, 22 bp, Homo sapiens
tgtgtgttatcttagttcatct

SEQ ID NO: 7279233 - DNA, 22 bp, Homo sapiens
tgtgtgtgtcctcatttgcaga

SEQ ID NO: 7279234 - DNA, 22 bp, Homo sapiens
tgtgtggattcatctcaaagag

SEQ ID NO: 7279235 - DNA, 22 bp, Homo sapiens
tgtgtgtgagtcctggctttcc

SEQ ID NO: 7279236 - DNA, 22 bp, Homo sapiens
tgtgtgtgcacatgcatataca

SEQ ID NO: 7279237 - DNA, 22 bp, Homo sapiens
tgtgtgctaatgtatgctctaa

SEQ ID NO: 7279238 - DNA, 22 bp, Homo sapiens
tgtttattacagttcttggaat

SEQ ID NO: 7279239 - DNA, 22 bp, Homo sapiens
tgtttattcatggctaatgaaa

SEQ ID NO: 7279240 - DNA, 18 bp, Homo sapiens
tgtttattctcctgacag

SEQ ID NO: 7279241 - DNA, 22 bp, Homo sapiens
tgtttattgagtgcctactata

SEQ ID NO: 7279242 - DNA, 22 bp, Homo sapiens
tgtttattgctgcaattgtgcc

SEQ ID NO: 7279243 - DNA, 22 bp, Homo sapiens
tgtttattttcaggatggattg

SEQ ID NO: 7279244 - DNA, 22 bp, Homo sapiens
tgtttattgcagtgctgggctg

SEQ ID NO: 7279245 - DNA, 22 bp, Homo sapiens
tgttggggtcaggagctagcct

SEQ ID NO: 7279246 - DNA, 22 bp, Homo sapiens
tgttgagtatatacctacaagt

SEQ ID NO: 7279247 - DNA, 22 bp, Homo sapiens
tgttcttagcaggagcatctat

SEQ ID NO: 7279248 - DNA, 22 bp, Homo sapiens
tgttctttggcttcacagctct

SEQ ID NO: 7279249 - DNA, 22 bp, Homo sapiens
tgttcttctagattgcctttta

SEQ ID NO: 7279250 - DNA, 18 bp, Homo sapiens
tgtttatttttctcttac

SEQ ID NO: 7279251 - DNA, 18 bp, Homo sapiens
tgtttatttttctcttac

SEQ ID NO: 7279252 - DNA, 22 bp, Homo sapiens
tgtttgctctgactatcttgcg

SEQ ID NO: 7279253 - DNA, 20 bp, Homo sapiens
tgtttgtgtggggccttggc

SEQ ID NO: 7279254 - DNA, 22 bp, Homo sapiens
tgttttaagagcgcactttata

SEQ ID NO: 7279255 - DNA, 22 bp, Homo sapiens
tgttttaaagccattgcctttc

SEQ ID NO: 7279256 - DNA, 22 bp, Homo sapiens
ttaaaaatatgtagggcccgat

SEQ ID NO: 7279257 - DNA, 22 bp, Homo sapiens
ttaaacacctgtctagtgtagc

SEQ ID NO: 7279258 - DNA, 22 bp, Homo sapiens
ttaaaatttccccaccatgtat

SEQ ID NO: 7279259 - DNA, 22 bp, Homo sapiens
tgtcttcattctgtatgtccag

SEQ ID NO: 7279260 - DNA, 20 bp, Homo sapiens
tgtcttcattatggtgccct

SEQ ID NO: 7279261 - DNA, 22 bp, Homo sapiens
tgtctttaagcaaacagtgttt

SEQ ID NO: 7279262 - DNA, 22 bp, Homo sapiens
tgtcttgattagaatgatgggc

SEQ ID NO: 7279263 - DNA, 22 bp, Homo sapiens
tgtcttcttcataaggagagtg

SEQ ID NO: 7279264 - DNA, 22 bp, Homo sapiens
tgtcttcagcagtcatctgggg

SEQ ID NO: 7279265 - DNA, 22 bp, Homo sapiens
tgtcttcagataggcattcttc

SEQ ID NO: 7279266 - DNA, 22 bp, Homo sapiens
tgtcttcagcaaatgcctttct

SEQ ID NO: 7279267 - DNA, 22 bp, Homo sapiens
tgtcttcagcaaatgcctttct

SEQ ID NO: 7279268 - DNA, 22 bp, Homo sapiens
tgtcttcactcaagtctcttgg

SEQ ID NO: 7279269 - DNA, 22 bp, Homo sapiens
tgtcttcaaatattgaaatcct

SEQ ID NO: 7279270 - DNA, 22 bp, Homo sapiens
tgtctgctacttggttctacca

SEQ ID NO: 7279271 - DNA, 22 bp, Homo sapiens
tgtctgcctgcgggccggcaca

SEQ ID NO: 7279272 - DNA, 22 bp, Homo sapiens
tgtctctgaggtgagggtcagc

SEQ ID NO: 7279273 - DNA, 22 bp, Homo sapiens
tgtctctgaactgggttttctt

SEQ ID NO: 7279274 - DNA, 22 bp, Homo sapiens
tgtgctctgactttctcctggt

SEQ ID NO: 7279275 - DNA, 22 bp, Homo sapiens
tgtgctgacaagatcagaaggt

SEQ ID NO: 7279276 - DNA, 22 bp, Homo sapiens
tgtgctctggagttgccttcac

SEQ ID NO: 7279277 - DNA, 22 bp, Homo sapiens
tgtgcctggtccctgagtcgag

SEQ ID NO: 7279278 - DNA, 22 bp, Homo sapiens
tgtgcctgagttggctgagtac

SEQ ID NO: 7279279 - DNA, 17 bp, Homo sapiens
tgtgcatagaataatga

SEQ ID NO: 7279280 - DNA, 20 bp, Homo sapiens
tgtgcaggagagtgaggctg

SEQ ID NO: 7279281 - DNA, 22 bp, Homo sapiens
tgtgcaggtgcaggaagggggc

SEQ ID NO: 7279282 - DNA, 22 bp, Homo sapiens
tgtgcacatatactcatattcc

SEQ ID NO: 7279283 - DNA, 22 bp, Homo sapiens
tgtgcacaggaagctattctct

SEQ ID NO: 7279284 - DNA, 22 bp, Homo sapiens
tgtgactggttgtcccgctttc

SEQ ID NO: 7279285 - DNA, 22 bp, Homo sapiens
tgtgactgtggacttttgtggg

SEQ ID NO: 7279286 - DNA, 22 bp, Homo sapiens
tgtgattatttgattaacatgt

SEQ ID NO: 7279287 - DNA, 22 bp, Homo sapiens
tgtgatgctggagtgcgaatat

SEQ ID NO: 7279288 - DNA, 22 bp, Homo sapiens
tgtgatatttgagtattgtcaa

SEQ ID NO: 7279289 - DNA, 22 bp, Homo sapiens
tgtgacagatctctatacatga

SEQ ID NO: 7279290 - DNA, 22 bp, Homo sapiens
tgtgaatatccatttgtttcag

SEQ ID NO: 7279291 - DNA, 22 bp, Homo sapiens
tgtgaatatttccttctttgga

SEQ ID NO: 7279292 - DNA, 22 bp, Homo sapiens
tgtgaaagtcaaattaattgaa

SEQ ID NO: 7279293 - DNA, 22 bp, Homo sapiens
ttcaggaaggtcctatagcaga

SEQ ID NO: 7279294 - DNA, 22 bp, Homo sapiens
ttcaccctggaccagaaattgg

SEQ ID NO: 7279295 - DNA, 19 bp, Homo sapiens
ttcattctttctacttacc

SEQ ID NO: 7279296 - DNA, 19 bp, Homo sapiens
ttcattctttctacttacc

SEQ ID NO: 7279297 - DNA, 22 bp, Homo sapiens
ttcattctttgaatctgaggta

SEQ ID NO: 7279298 - DNA, 22 bp, Homo sapiens
ttcattcttgtctttgtatagt

SEQ ID NO: 7279299 - DNA, 22 bp, Homo sapiens
ttcattgaaccactttattctt

SEQ ID NO: 7279300 - DNA, 22 bp, Homo sapiens
ttccagctaactcacatccctt

SEQ ID NO: 7279301 - DNA, 22 bp, Homo sapiens
ttccagctaactcacatccctt

SEQ ID NO: 7279302 - DNA, 17 bp, Homo sapiens
ttccagcatgttactaa

SEQ ID NO: 7279303 - DNA, 22 bp, Homo sapiens
ttccagcagggtacttgtaatt

SEQ ID NO: 7279304 - DNA, 22 bp, Homo sapiens
ttccagatgtttaagttctgct

SEQ ID NO: 7279305 - DNA, 22 bp, Homo sapiens
ttccagatttctacacaagacc

SEQ ID NO: 7279306 - DNA, 23 bp, Homo sapiens
ttccagagtccacatctgccacc

SEQ ID NO: 7279307 - DNA, 22 bp, Homo sapiens
ttagggttacaccagcctcctg

SEQ ID NO: 7279308 - DNA, 22 bp, Homo sapiens
ttagcagcttttaaatggttct

SEQ ID NO: 7279309 - DNA, 22 bp, Homo sapiens
ttagcagctaagtcatgctgca

SEQ ID NO: 7279310 - DNA, 22 bp, Homo sapiens
ttattattccccaagtcattat

SEQ ID NO: 7279311 - DNA, 22 bp, Homo sapiens
ttatgatttgccacagattggt

SEQ ID NO: 7279312 - DNA, 22 bp, Homo sapiens
ttatgatttgccacagattggt

SEQ ID NO: 7279313 - DNA, 22 bp, Homo sapiens
ttattcatcagtgcattaattt

SEQ ID NO: 7279314 - DNA, 22 bp, Homo sapiens
ttattattgattcgctctcaaa

SEQ ID NO: 7279315 - DNA, 22 bp, Homo sapiens
ttattattggtgagttaaggaa

SEQ ID NO: 7279316 - DNA, 22 bp, Homo sapiens
ttattcatcagtgcattaattt

SEQ ID NO: 7279317 - DNA, 22 bp, Homo sapiens
ttaataaagtatgaattggaaa

SEQ ID NO: 7279318 - DNA, 22 bp, Homo sapiens
ttaatgtatggggttgagatga

SEQ ID NO: 7279319 - DNA, 18 bp, Homo sapiens
ttaatgtggcttactatg

SEQ ID NO: 7279320 - DNA, 22 bp, Homo sapiens
ttaataacattgtgtatcaccc

SEQ ID NO: 7279321 - DNA, 22 bp, Homo sapiens
tggggccagagatggggcgcag

SEQ ID NO: 7279322 - DNA, 22 bp, Homo sapiens
tgggtccatggaacagaggtgc

SEQ ID NO: 7279323 - DNA, 22 bp, Homo sapiens
tgggtccacggaagacttaggg

SEQ ID NO: 7279324 - DNA, 22 bp, Homo sapiens
tgggtccacttctgcactgtgg

SEQ ID NO: 7279325 - DNA, 22 bp, Homo sapiens
tgggtccagtgcagctgcgcgt

SEQ ID NO: 7279326 - DNA, 22 bp, Homo sapiens
tgggtactcctattagttcagt

SEQ ID NO: 7279327 - DNA, 22 bp, Homo sapiens
tgggggtgccctatgaggaagc

SEQ ID NO: 7279328 - DNA, 22 bp, Homo sapiens
tggtattacttctagacacaag

SEQ ID NO: 7279329 - DNA, 22 bp, Homo sapiens
tggtcaaaccagttatctgtaa

SEQ ID NO: 7279330 - DNA, 22 bp, Homo sapiens
tgggtgaggagaggctgtctaa

SEQ ID NO: 7279331 - DNA, 22 bp, Homo sapiens
tgggtgaggatgatgaggcagc

SEQ ID NO: 7279332 - DNA, 22 bp, Homo sapiens
tgggcagcaaagactgtgtgct

SEQ ID NO: 7279333 - DNA, 20 bp, Homo sapiens
tgggcagcactgctggctgg

SEQ ID NO: 7279334 - DNA, 22 bp, Homo sapiens
tgggcagggagctggaaccaca

SEQ ID NO: 7279335 - DNA, 22 bp, Homo sapiens
tgggcagtggcgcaatctctgg

SEQ ID NO: 7279336 - DNA, 22 bp, Homo sapiens
tgggcagtggctgggcctctct

SEQ ID NO: 7279337 - DNA, 19 bp, Homo sapiens
tgggcagtgccagggctta

SEQ ID NO: 7279338 - DNA, 22 bp, Homo sapiens
tgggcatcatggacagcagagg

SEQ ID NO: 7279339 - DNA, 22 bp, Homo sapiens
tgggcagttgctcctcagaccc

SEQ ID NO: 7279340 - DNA, 22 bp, Homo sapiens
tgggcagttttctatgctgcaa

SEQ ID NO: 7279341 - DNA, 22 bp, Homo sapiens
tgggcagtgtgtaatgcataga

SEQ ID NO: 7279342 - DNA, 18 bp, Homo sapiens
tgggatggagagtaactg

SEQ ID NO: 7279343 - DNA, 22 bp, Homo sapiens
tgggatgccggcaggaggcaat

SEQ ID NO: 7279344 - DNA, 22 bp, Homo sapiens
tgggcagaggctctgaagtcca

SEQ ID NO: 7279345 - DNA, 22 bp, Homo sapiens
tgggcactcaggctgaggccgt

SEQ ID NO: 7279346 - DNA, 21 bp, Homo sapiens
tgggctctttaacccaggcac

SEQ ID NO: 7279347 - DNA, 22 bp, Homo sapiens
tgggctctgaagggtcccggat

SEQ ID NO: 7279348 - DNA, 22 bp, Homo sapiens
tgggctctctttacctcataac

SEQ ID NO: 7279349 - DNA, 22 bp, Homo sapiens
tgggctctcaaagtgcggcttg

SEQ ID NO: 7279350 - DNA, 20 bp, Homo sapiens
tgggctctgcttcctggagt

SEQ ID NO: 7279351 - DNA, 22 bp, Homo sapiens
tgggctctgcatcagtgcccat

SEQ ID NO: 7279352 - DNA, 22 bp, Homo sapiens
tgggctctggggaaactgtgat

SEQ ID NO: 7279353 - DNA, 22 bp, Homo sapiens
tgggctctggtttcctggctgg

SEQ ID NO: 7279354 - DNA, 22 bp, Homo sapiens
tgggctctggagggcctaggat

SEQ ID NO: 7279355 - DNA, 22 bp, Homo sapiens
tgggccaggtctgtgtcagctg

SEQ ID NO: 7279356 - DNA, 22 bp, Homo sapiens
tgtatacattctcttgggtttg

SEQ ID NO: 7279357 - DNA, 22 bp, Homo sapiens
tgtagctctccagccagcaagg

SEQ ID NO: 7279358 - DNA, 22 bp, Homo sapiens
tgtagcagtgtctaccacatta

SEQ ID NO: 7279359 - DNA, 22 bp, Homo sapiens
tgtagatacacacatatagtgg

SEQ ID NO: 7279360 - DNA, 22 bp, Homo sapiens
tgtagaaagaatatgtttcata

SEQ ID NO: 7279361 - DNA, 22 bp, Homo sapiens
tgtagaagtttatgaacacatt

SEQ ID NO: 7279362 - DNA, 22 bp, Homo sapiens
tgtagaagtaggagtcatctca

SEQ ID NO: 7279363 - DNA, 22 bp, Homo sapiens
tgtagaagctagcctggagcca

SEQ ID NO: 7279364 - DNA, 22 bp, Homo sapiens
tgtcacatgtttaatgtggact

SEQ ID NO: 7279365 - DNA, 22 bp, Homo sapiens
tgtcaccaagttgatgaatgca

SEQ ID NO: 7279366 - DNA, 22 bp, Homo sapiens
tgtcaccatgccagcttctgcc

SEQ ID NO: 7279367 - DNA, 22 bp, Homo sapiens
tgtcaccatgcgaggctaattt

SEQ ID NO: 7279368 - DNA, 22 bp, Homo sapiens
tgtcaaacaccaacatttctcc

SEQ ID NO: 7279369 - DNA, 22 bp, Homo sapiens
tgtcaaagacagaaggaaatgg

SEQ ID NO: 7279370 - DNA, 22 bp, Homo sapiens
tgtcaatgtgtacaggagctca

SEQ ID NO: 7279371 - DNA, 22 bp, Homo sapiens
tgtattttctgaagataatcaa

SEQ ID NO: 7279372 - DNA, 22 bp, Homo sapiens
tgtatttaagctttacctaaaa

SEQ ID NO: 7279373 - DNA, 22 bp, Homo sapiens
tgtattgtaagtggttatatgc

SEQ ID NO: 7279374 - DNA, 22 bp, Homo sapiens
tgtcatttatcttatagtaatc

SEQ ID NO: 7279375 - DNA, 22 bp, Homo sapiens
tgtcattgttctgtttgttcct

SEQ ID NO: 7279376 - DNA, 22 bp, Homo sapiens
tgtccacatcactcacttgtca

SEQ ID NO: 7279377 - DNA, 22 bp, Homo sapiens
tgtcattttaatcacctttcca

SEQ ID NO: 7279378 - DNA, 18 bp, Homo sapiens
tgtccctgcaaataacat

SEQ ID NO: 7279379 - DNA, 22 bp, Homo sapiens
tgtccctctgaggcttccctgg

SEQ ID NO: 7279380 - DNA, 20 bp, Homo sapiens
tgtccccaccaaaatttcat

SEQ ID NO: 7279381 - DNA, 22 bp, Homo sapiens
tgtccccagagcctgttcctgc

SEQ ID NO: 7279382 - DNA, 22 bp, Homo sapiens
tgtccccaggtcctctgccgtc

SEQ ID NO: 7279383 - DNA, 22 bp, Homo sapiens
tgtccccacccaaatctcatct

SEQ ID NO: 7279384 - DNA, 22 bp, Homo sapiens
tgtcccaggctgaagtacagtg

SEQ ID NO: 7279385 - DNA, 22 bp, Homo sapiens
tgtcctgtgtctaggggtcttc

SEQ ID NO: 7279386 - DNA, 22 bp, Homo sapiens
tgtcctcagatatgtctactct

SEQ ID NO: 7279387 - DNA, 22 bp, Homo sapiens
tgtcctagagacatcagatgtt

SEQ ID NO: 7279388 - DNA, 23 bp, Homo sapiens
tggtggcagaagtagcagatgac

SEQ ID NO: 7279389 - DNA, 22 bp, Homo sapiens
tggtggcaattcaaagacagca

SEQ ID NO: 7279390 - DNA, 21 bp, Homo sapiens
tggtggagtgtgctgagcatg

SEQ ID NO: 7279391 - DNA, 19 bp, Homo sapiens
tggtggaggtgcacctgac

SEQ ID NO: 7279392 - DNA, 22 bp, Homo sapiens
tggtggagctgtggccacgacc

SEQ ID NO: 7279393 - DNA, 22 bp, Homo sapiens
tggtgcagtccaaagggagcag

SEQ ID NO: 7279394 - DNA, 22 bp, Homo sapiens
tggtcgaccagttggaaagtaa

SEQ ID NO: 7279395 - DNA, 22 bp, Homo sapiens
tggtgcagagagggatctaggg

SEQ ID NO: 7279396 - DNA, 22 bp, Homo sapiens
tggtcataacatgattagtagg

SEQ ID NO: 7279397 - DNA, 22 bp, Homo sapiens
tggtcattgctattgtttctca

SEQ ID NO: 7279398 - DNA, 17 bp, Homo sapiens
tggtcattttaatttta

SEQ ID NO: 7279399 - DNA, 22 bp, Homo sapiens
tggtccacagggagtccgtgct

SEQ ID NO: 7279400 - DNA, 23 bp, Homo sapiens
tggtggggtcttggagacagcac

SEQ ID NO: 7279401 - DNA, 23 bp, Homo sapiens
tggtggttgatctggggcacagc

SEQ ID NO: 7279402 - DNA, 20 bp, Homo sapiens
tggtgttatcctgaagaatt

SEQ ID NO: 7279403 - DNA, 22 bp, Homo sapiens
tggtgtggggataagcactctg

SEQ ID NO: 7279404 - DNA, 20 bp, Homo sapiens
tggtgttagaccagagagtg

SEQ ID NO: 7279405 - DNA, 21 bp, Homo sapiens
tggtgttgacatcaagttata

SEQ ID NO: 7279406 - DNA, 22 bp, Homo sapiens
tggtgttgaacctcagcagggg

SEQ ID NO: 7279407 - DNA, 22 bp, Homo sapiens
tggtgttgcaaataaagtccaa

SEQ ID NO: 7279408 - DNA, 22 bp, Homo sapiens
tggtgttggagatggttgcatt

SEQ ID NO: 7279409 - DNA, 22 bp, Homo sapiens
tggtttgacaatgaggactggt

SEQ ID NO: 7279410 - DNA, 22 bp, Homo sapiens
tgtacaatgtggccagtgttaa

SEQ ID NO: 7279411 - DNA, 22 bp, Homo sapiens
tgtacaatctgatgatgtatgg

SEQ ID NO: 7279412 - DNA, 22 bp, Homo sapiens
tgtacaatcttggtccctttat

SEQ ID NO: 7279413 - DNA, 22 bp, Homo sapiens
tgtaacctgactgctttgctct

SEQ ID NO: 7279414 - DNA, 21 bp, Homo sapiens
tggattgaggtgacagtgtgc

SEQ ID NO: 7279415 - DNA, 22 bp, Homo sapiens
tggattgataagagacaagtga

SEQ ID NO: 7279416 - DNA, 22 bp, Homo sapiens
tggatgtgagagcatcatgttc

SEQ ID NO: 7279417 - DNA, 22 bp, Homo sapiens
tggcaaagtttatcaggaatat

SEQ ID NO: 7279418 - DNA, 22 bp, Homo sapiens
tggcaaagtatctgtcccagct

SEQ ID NO: 7279419 - DNA, 22 bp, Homo sapiens
tggcaaagtgactccttggggc

SEQ ID NO: 7279420 - DNA, 22 bp, Homo sapiens
tggcaaagatggttctcaccat

SEQ ID NO: 7279421 - DNA, 22 bp, Homo sapiens
tggcaaagatgaagcatttcgt

SEQ ID NO: 7279422 - DNA, 22 bp, Homo sapiens
tggcaaagacgctagctaagat

SEQ ID NO: 7279423 - DNA, 22 bp, Homo sapiens
tggcaaagactgcaaggacttt

SEQ ID NO: 7279424 - DNA, 22 bp, Homo sapiens
tggcaaagactgcaaggacttt

SEQ ID NO: 7279425 - DNA, 22 bp, Homo sapiens
tggcaaagaccgcaattacttt

SEQ ID NO: 7279426 - DNA, 22 bp, Homo sapiens
tggcaaagctagacattccctc

SEQ ID NO: 7279427 - DNA, 22 bp, Homo sapiens
tggcaaaggaaatgatttaaga

SEQ ID NO: 7279428 - DNA, 22 bp, Homo sapiens
tggcaaagattaccacatctac

SEQ ID NO: 7279429 - DNA, 23 bp, Homo sapiens
tggcaaagcattcttataacagt

SEQ ID NO: 7279430 - DNA, 22 bp, Homo sapiens
tggcaaaggggaccatgttgaa

SEQ ID NO: 7279431 - DNA, 22 bp, Homo sapiens
tggcaaagtaattgggtttctc

SEQ ID NO: 7279432 - DNA, 22 bp, Homo sapiens
tggcaaaggcgctcacatgcct

SEQ ID NO: 7279433 - DNA, 22 bp, Homo sapiens
tggcaaaggaacctattttaaa

SEQ ID NO: 7279434 - DNA, 22 bp, Homo sapiens
tggcaatgttagcaaagcattt

SEQ ID NO: 7279435 - DNA, 22 bp, Homo sapiens
tggcagagagagtgcagtcgac

SEQ ID NO: 7279436 - DNA, 22 bp, Homo sapiens
tggcagagagactctccttgat

SEQ ID NO: 7279437 - DNA, 22 bp, Homo sapiens
tggcagagagactctccttgat

SEQ ID NO: 7279438 - DNA, 23 bp, Homo sapiens
tggcagagacccagaatctacat

SEQ ID NO: 7279439 - DNA, 22 bp, Homo sapiens
tggcagagactcctcctgggag

SEQ ID NO: 7279440 - DNA, 22 bp, Homo sapiens
tggcagagacaaggccgggcct

SEQ ID NO: 7279441 - DNA, 22 bp, Homo sapiens
tggcagagaataaatcttgact

SEQ ID NO: 7279442 - DNA, 22 bp, Homo sapiens
tggcagagaacacggctgatct

SEQ ID NO: 7279443 - DNA, 22 bp, Homo sapiens
tggcagagaacctgggctttgt

SEQ ID NO: 7279444 - DNA, 22 bp, Homo sapiens
tggcagagcaaaaagatagaat

SEQ ID NO: 7279445 - DNA, 22 bp, Homo sapiens
tggcagagcaaaaagatagaat

SEQ ID NO: 7279446 - DNA, 22 bp, Homo sapiens
tggcagagatgaagagttgttt

SEQ ID NO: 7279447 - DNA, 22 bp, Homo sapiens
tggcagagcccagaactgagca

SEQ ID NO: 7279448 - DNA, 22 bp, Homo sapiens
tggcagagcccagactccagtc

SEQ ID NO: 7279449 - DNA, 22 bp, Homo sapiens
tggcagagccttgccaaactcc

SEQ ID NO: 7279450 - DNA, 22 bp, Homo sapiens
tggcagagctggctgcggatga

SEQ ID NO: 7279451 - DNA, 16 bp, Homo sapiens
tggcagaggttcagcc

SEQ ID NO: 7279452 - DNA, 22 bp, Homo sapiens
tggcagaggtatattgggagga

SEQ ID NO: 7279453 - DNA, 22 bp, Homo sapiens
tggcagcagggcccctggagga

SEQ ID NO: 7279454 - DNA, 22 bp, Homo sapiens
tggcagcagggaggccagtgtt

SEQ ID NO: 7279455 - DNA, 22 bp, Homo sapiens
tggcagcagctaacttaggcag

SEQ ID NO: 7279456 - DNA, 18 bp, Homo sapiens
tggcagcaggaagccatt

SEQ ID NO: 7279457 - DNA, 18 bp, Homo sapiens
tggcagcaggaagccatt

SEQ ID NO: 7279458 - DNA, 22 bp, Homo sapiens
tggcagcagccatggaaggccc

SEQ ID NO: 7279459 - DNA, 22 bp, Homo sapiens
tggcagcagccatggaaggccc

SEQ ID NO: 7279460 - DNA, 22 bp, Homo sapiens
tggcagcagcaaatggcatatc

SEQ ID NO: 7279461 - DNA, 22 bp, Homo sapiens
tggcagcagacaaaaggccatt

SEQ ID NO: 7279462 - DNA, 22 bp, Homo sapiens
tggcagcagacatctgaggtct

SEQ ID NO: 7279463 - DNA, 22 bp, Homo sapiens
tggcagctctgttcaacatgag

SEQ ID NO: 7279464 - DNA, 22 bp, Homo sapiens
tggcagctcctggggccagcac

SEQ ID NO: 7279465 - DNA, 22 bp, Homo sapiens
tggcagctccgggtaggggctg

SEQ ID NO: 7279466 - DNA, 22 bp, Homo sapiens
tggcagctcccagagcttccaa

SEQ ID NO: 7279467 - DNA, 22 bp, Homo sapiens
tggcagctcatttggaaatgga

SEQ ID NO: 7279468 - DNA, 22 bp, Homo sapiens
tggcagctattacaaggaagtc

SEQ ID NO: 7279469 - DNA, 22 bp, Homo sapiens
tggcagctatggtctaagggcc

SEQ ID NO: 7279470 - DNA, 18 bp, Homo sapiens
tggcagctaggtaaagaa

SEQ ID NO: 7279471 - DNA, 22 bp, Homo sapiens
tggcagctatctttaatgagat

SEQ ID NO: 7279472 - DNA, 22 bp, Homo sapiens
tggcagctagctgttttcatgc

SEQ ID NO: 7279473 - DNA, 22 bp, Homo sapiens
tggcagctagatagtgtgttta

SEQ ID NO: 7279474 - DNA, 22 bp, Homo sapiens
tggcagctacagacagaggtga

SEQ ID NO: 7279475 - DNA, 22 bp, Homo sapiens
tggcagcattttttccagaaca

SEQ ID NO: 7279476 - DNA, 22 bp, Homo sapiens
tggcagcattaattattcaggt

SEQ ID NO: 7279477 - DNA, 19 bp, Homo sapiens
tggcagcattggtaccttg

SEQ ID NO: 7279478 - DNA, 21 bp, Homo sapiens
tggcagagttgagtagttatg

SEQ ID NO: 7279479 - DNA, 22 bp, Homo sapiens
tggcagagttggaggtggaaga

SEQ ID NO: 7279480 - DNA, 22 bp, Homo sapiens
tggcagcagacaaaaggccatt

SEQ ID NO: 7279481 - DNA, 22 bp, Homo sapiens
tggcagcacttgaacttgagcc

SEQ ID NO: 7279482 - DNA, 20 bp, Homo sapiens
tggcagagttgtcccaccca

SEQ ID NO: 7279483 - DNA, 20 bp, Homo sapiens
tggcagagttgtcccaccca

SEQ ID NO: 7279484 - DNA, 22 bp, Homo sapiens
tggcagagtggaccatactcaa

SEQ ID NO: 7279485 - DNA, 18 bp, Homo sapiens
tggcagagtgtctgttct

SEQ ID NO: 7279486 - DNA, 18 bp, Homo sapiens
tggcagagtgtctgttct

SEQ ID NO: 7279487 - DNA, 18 bp, Homo sapiens
tggcagagtgtctgttct

SEQ ID NO: 7279488 - DNA, 22 bp, Homo sapiens
tggcagagttatgggtatttat

SEQ ID NO: 7279489 - DNA, 22 bp, Homo sapiens
tggcagagttcgctcctattca

SEQ ID NO: 7279490 - DNA, 22 bp, Homo sapiens
tggcagagttcgctgtgccttt

SEQ ID NO: 7279491 - DNA, 22 bp, Homo sapiens
tggcagagttcgctgtgccttt

SEQ ID NO: 7279492 - DNA, 22 bp, Homo sapiens
tggcagagttcgctgtgccttt

SEQ ID NO: 7279493 - DNA, 22 bp, Homo sapiens
tggcagagtctgggcttgggca

SEQ ID NO: 7279494 - DNA, 22 bp, Homo sapiens
tggcagagtgcagaagaggcat

SEQ ID NO: 7279495 - DNA, 22 bp, Homo sapiens
tggcagagtgcagaagaggcat

SEQ ID NO: 7279496 - DNA, 21 bp, Homo sapiens
tggcagagtgcagtctataca

SEQ ID NO: 7279497 - DNA, 22 bp, Homo sapiens
tggcagagtgcggcatcccctg

SEQ ID NO: 7279498 - DNA, 22 bp, Homo sapiens
tggcagagtaggatggccctgt

SEQ ID NO: 7279499 - DNA, 22 bp, Homo sapiens
tggcagagtcatcacatctgga

SEQ ID NO: 7279500 - DNA, 22 bp, Homo sapiens
tggcagagtctctcctttccag

SEQ ID NO: 7279501 - DNA, 22 bp, Homo sapiens
tggcagagtctctcctttccag

SEQ ID NO: 7279502 - DNA, 22 bp, Homo sapiens
tggcagctgcgttgtgtttctg

SEQ ID NO: 7279503 - DNA, 22 bp, Homo sapiens
tggcagctgccatgtccacgtg

SEQ ID NO: 7279504 - DNA, 22 bp, Homo sapiens
tggcagctgcaggcctcctgag

SEQ ID NO: 7279505 - DNA, 22 bp, Homo sapiens
tggcagctgagtgcaccccctc

SEQ ID NO: 7279506 - DNA, 22 bp, Homo sapiens
tggcagctgattagatggtgcc

SEQ ID NO: 7279507 - DNA, 22 bp, Homo sapiens
tggcagctgaatggctggatgg

SEQ ID NO: 7279508 - DNA, 17 bp, Homo sapiens
tggcagctgaaagctct

SEQ ID NO: 7279509 - DNA, 22 bp, Homo sapiens
tggcagctgaggggaggctttg

SEQ ID NO: 7279510 - DNA, 22 bp, Homo sapiens
tggcaggaaccaggaggctctc

SEQ ID NO: 7279511 - DNA, 18 bp, Homo sapiens
tggcaggaaatgcacttt

SEQ ID NO: 7279512 - DNA, 22 bp, Homo sapiens
tggcaggagagcgtcagatcag

SEQ ID NO: 7279513 - DNA, 22 bp, Homo sapiens
tggcaggaggttttctccagga

SEQ ID NO: 7279514 - DNA, 22 bp, Homo sapiens
tggcaggaggttttctccagga

SEQ ID NO: 7279515 - DNA, 22 bp, Homo sapiens
tggcaggcagtgtgggagctgg

SEQ ID NO: 7279516 - DNA, 21 bp, Homo sapiens
tggcaggcagctggaagcttg

SEQ ID NO: 7279517 - DNA, 18 bp, Homo sapiens
tggcaggggcagtacgcc

SEQ ID NO: 7279518 - DNA, 22 bp, Homo sapiens
tggcatgaagtcagcagctggg

SEQ ID NO: 7279519 - DNA, 17 bp, Homo sapiens
tggcatgagggtgtggg

SEQ ID NO: 7279520 - DNA, 22 bp, Homo sapiens
tggcatgagtataggcttctca

SEQ ID NO: 7279521 - DNA, 22 bp, Homo sapiens
tggcagtgtttctaaggggctc

SEQ ID NO: 7279522 - DNA, 22 bp, Homo sapiens
tggcagtggataggggagcggt

SEQ ID NO: 7279523 - DNA, 22 bp, Homo sapiens
tggcagtgctgcagtgccctta

SEQ ID NO: 7279524 - DNA, 22 bp, Homo sapiens
tggcagtgccccttgaccagtg

SEQ ID NO: 7279525 - DNA, 22 bp, Homo sapiens
tggcagtggcgggactcagggc

SEQ ID NO: 7279526 - DNA, 22 bp, Homo sapiens
tggcagtggataggggagcggt

SEQ ID NO: 7279527 - DNA, 22 bp, Homo sapiens
tggcagtggcactgcccccata

SEQ ID NO: 7279528 - DNA, 22 bp, Homo sapiens
tggcagtggcatcaccccaata

SEQ ID NO: 7279529 - DNA, 22 bp, Homo sapiens
tggcagtgtttctaaggggctc

SEQ ID NO: 7279530 - DNA, 22 bp, Homo sapiens
tggcagtgttgtgccacattcc

SEQ ID NO: 7279531 - DNA, 19 bp, Homo sapiens
tggcagtgtggggtatgaa

SEQ ID NO: 7279532 - DNA, 22 bp, Homo sapiens
tggcagtgtgtgagctgttatt

SEQ ID NO: 7279533 - DNA, 22 bp, Homo sapiens
tggcagtgtgtgagctgttatt

SEQ ID NO: 7279534 - DNA, 22 bp, Homo sapiens
tggcagtggctcagagtgcaga

SEQ ID NO: 7279535 - DNA, 22 bp, Homo sapiens
tggcaggtggagacagcagagc

SEQ ID NO: 7279536 - DNA, 22 bp, Homo sapiens
tggcaggtggctctggcattct

SEQ ID NO: 7279537 - DNA, 22 bp, Homo sapiens
tggcaggttaacttacaactgt

SEQ ID NO: 7279538 - DNA, 22 bp, Homo sapiens
tggcagtgaaagacaattgggc

SEQ ID NO: 7279539 - DNA, 22 bp, Homo sapiens
tggcagtgaaccaaggctccaa

SEQ ID NO: 7279540 - DNA, 18 bp, Homo sapiens
tggcagtgaggtaggcat

SEQ ID NO: 7279541 - DNA, 18 bp, Homo sapiens
tggcagtgaggtaggcat

SEQ ID NO: 7279542 - DNA, 22 bp, Homo sapiens
tggcagtgaaccaaggctccaa

SEQ ID NO: 7279543 - DNA, 22 bp, Homo sapiens
tggcagtgaagctgtctttagg

SEQ ID NO: 7279544 - DNA, 22 bp, Homo sapiens
tggcagtgatgcggcaggacat

SEQ ID NO: 7279545 - DNA, 23 bp, Homo sapiens
tggcagtgatcaaaagcttacat

SEQ ID NO: 7279546 - DNA, 23 bp, Homo sapiens
tggcagtgcccagggagatgatc

SEQ ID NO: 7279547 - DNA, 22 bp, Homo sapiens
tggcagtgatgcggcaggacat

SEQ ID NO: 7279548 - DNA, 22 bp, Homo sapiens
tggcagtgatgcttatggtttg

SEQ ID NO: 7279549 - DNA, 18 bp, Homo sapiens
tggcagtgccaccttctc

SEQ ID NO: 7279550 - DNA, 22 bp, Homo sapiens
tggcatttagttgcgtattgca

SEQ ID NO: 7279551 - DNA, 22 bp, Homo sapiens
tggccacagcctctgccagttc

SEQ ID NO: 7279552 - DNA, 22 bp, Homo sapiens
tggccaggtgtgggttctcaga

SEQ ID NO: 7279553 - DNA, 18 bp, Homo sapiens
tggcctggagacaactct

SEQ ID NO: 7279554 - DNA, 22 bp, Homo sapiens
tggctcagtctgggttgactga

SEQ ID NO: 7279555 - DNA, 22 bp, Homo sapiens
tggctcaggggtctggctctgt

SEQ ID NO: 7279556 - DNA, 22 bp, Homo sapiens
tggctcagccagccctaggaac

SEQ ID NO: 7279557 - DNA, 22 bp, Homo sapiens
tggcctgggtgctgctgacatc

SEQ ID NO: 7279558 - DNA, 22 bp, Homo sapiens
tggcctggttgttgctgccgtt

SEQ ID NO: 7279559 - DNA, 22 bp, Homo sapiens
tggctcagaactacttctagtt

SEQ ID NO: 7279560 - DNA, 22 bp, Homo sapiens
tggctcagagcagggactctgg

SEQ ID NO: 7279561 - DNA, 22 bp, Homo sapiens
tggctcagaaggctgccttcac

SEQ ID NO: 7279562 - DNA, 22 bp, Homo sapiens
tggctcagaaggctgccttcac

SEQ ID NO: 7279563 - DNA, 21 bp, Homo sapiens
tggctgagccaggtgtgtgga

SEQ ID NO: 7279564 - DNA, 21 bp, Homo sapiens
tggctgagccaggtgtgtgga

SEQ ID NO: 7279565 - DNA, 22 bp, Homo sapiens
tggctgagccacttgttcagat

SEQ ID NO: 7279566 - DNA, 22 bp, Homo sapiens
tggctgagccacttgttcagat

SEQ ID NO: 7279567 - DNA, 23 bp, Homo sapiens
tggctgagcccactatcttggcc

SEQ ID NO: 7279568 - DNA, 22 bp, Homo sapiens
tggctgagagtcatcctgtgtg

SEQ ID NO: 7279569 - DNA, 22 bp, Homo sapiens
tggctgagaagttctggtggga

SEQ ID NO: 7279570 - DNA, 22 bp, Homo sapiens
tggctgagagcaattgactctg

SEQ ID NO: 7279571 - DNA, 23 bp, Homo sapiens
tggctgagatcctactgtttgct

SEQ ID NO: 7279572 - DNA, 22 bp, Homo sapiens
tggctgagaaaaaagagctata

SEQ ID NO: 7279573 - DNA, 22 bp, Homo sapiens
tggctgagaaaatggttttagg

SEQ ID NO: 7279574 - DNA, 19 bp, Homo sapiens
tggctgagctggactgagg

SEQ ID NO: 7279575 - DNA, 22 bp, Homo sapiens
tggctgaggagagggcggaagt

SEQ ID NO: 7279576 - DNA, 22 bp, Homo sapiens
tggctgaggagggtcttctggt

SEQ ID NO: 7279577 - DNA, 22 bp, Homo sapiens
tggctgaggcacagctgccgcc

SEQ ID NO: 7279578 - DNA, 22 bp, Homo sapiens
tggctgagctgcagcgtggctt

SEQ ID NO: 7279579 - DNA, 22 bp, Homo sapiens
tggctgagcctttggggctttc

SEQ ID NO: 7279580 - DNA, 22 bp, Homo sapiens
tggctgagctccctgtgtgttg

SEQ ID NO: 7279581 - DNA, 22 bp, Homo sapiens
tggctgaggctggagtgcagtg

SEQ ID NO: 7279582 - DNA, 22 bp, Homo sapiens
tggctgaggcttttcttaaaga

SEQ ID NO: 7279583 - DNA, 22 bp, Homo sapiens
tggctgagtaagttgtgatatg

SEQ ID NO: 7279584 - DNA, 22 bp, Homo sapiens
tggctgaggttatgctggttgt

SEQ ID NO: 7279585 - DNA, 22 bp, Homo sapiens
tggctgaggtctggggcttctg

SEQ ID NO: 7279586 - DNA, 22 bp, Homo sapiens
tggctgagggcactatgaagcc

SEQ ID NO: 7279587 - DNA, 21 bp, Homo sapiens
tggctgagtggatgcatgaat

SEQ ID NO: 7279588 - DNA, 22 bp, Homo sapiens
tggctgagtgttccaaggagca

SEQ ID NO: 7279589 - DNA, 22 bp, Homo sapiens
tggctgagtgatatttgcaaag

SEQ ID NO: 7279590 - DNA, 22 bp, Homo sapiens
tggctgagtgaacatgtccatt

SEQ ID NO: 7279591 - DNA, 22 bp, Homo sapiens
tggctgagttcctggcacacgg

SEQ ID NO: 7279592 - DNA, 22 bp, Homo sapiens
tggctgagttacgaacagagca

SEQ ID NO: 7279593 - DNA, 22 bp, Homo sapiens
tggctgcagatcaagggcaggc

SEQ ID NO: 7279594 - DNA, 22 bp, Homo sapiens
tggctgcagacacctatggcag

SEQ ID NO: 7279595 - DNA, 21 bp, Homo sapiens
tggctgcactgtggctttcat

SEQ ID NO: 7279596 - DNA, 22 bp, Homo sapiens
tggctgagtttcatgcatcatg

SEQ ID NO: 7279597 - DNA, 22 bp, Homo sapiens
tggctgagttctccaggagtag

SEQ ID NO: 7279598 - DNA, 22 bp, Homo sapiens
tggctgcagttgggccctcaga

SEQ ID NO: 7279599 - DNA, 22 bp, Homo sapiens
tggctgctgcagacagacagga

SEQ ID NO: 7279600 - DNA, 18 bp, Homo sapiens
tggctctgcagccagatg

SEQ ID NO: 7279601 - DNA, 22 bp, Homo sapiens
tggctctgatcagatgtccagt

SEQ ID NO: 7279602 - DNA, 22 bp, Homo sapiens
tggctctgcacctcagtgtacc

SEQ ID NO: 7279603 - DNA, 22 bp, Homo sapiens
tggctctgccacctttccctaa

SEQ ID NO: 7279604 - DNA, 18 bp, Homo sapiens
tggctctgccactcaccg

SEQ ID NO: 7279605 - DNA, 22 bp, Homo sapiens
tggctctggagctcctgggccc

SEQ ID NO: 7279606 - DNA, 18 bp, Homo sapiens
tggctctggacttgctcc

SEQ ID NO: 7279607 - DNA, 21 bp, Homo sapiens
tggctctgctcagagcagtcc

SEQ ID NO: 7279608 - DNA, 22 bp, Homo sapiens
tggctctgctgaacctagtgca

SEQ ID NO: 7279609 - DNA, 22 bp, Homo sapiens
tggctctactcaaatatctggc

SEQ ID NO: 7279610 - DNA, 17 bp, Homo sapiens
tggctctgaggctgaat

SEQ ID NO: 7279611 - DNA, 23 bp, Homo sapiens
tggctctgagaggttcagatgct

SEQ ID NO: 7279612 - DNA, 22 bp, Homo sapiens
tggctctgagctgcaaagctgc

SEQ ID NO: 7279613 - DNA, 21 bp, Homo sapiens
tggctctgagcctcatggctg

SEQ ID NO: 7279614 - DNA, 22 bp, Homo sapiens
tggctctggagctggcggctga

SEQ ID NO: 7279615 - DNA, 22 bp, Homo sapiens
tggctctgggcaccgtgtccac

SEQ ID NO: 7279616 - DNA, 22 bp, Homo sapiens
tggctctggggacagtaagtcc

SEQ ID NO: 7279617 - DNA, 22 bp, Homo sapiens
tggctctgggaatgggaagatg

SEQ ID NO: 7279618 - DNA, 23 bp, Homo sapiens
tggctctgtggatccctcaggag

SEQ ID NO: 7279619 - DNA, 22 bp, Homo sapiens
tggctctgtgcttctagtatct

SEQ ID NO: 7279620 - DNA, 19 bp, Homo sapiens
tggctctgtttctctggag

SEQ ID NO: 7279621 - DNA, 19 bp, Homo sapiens
tggctctgtttctctggag

SEQ ID NO: 7279622 - DNA, 22 bp, Homo sapiens
tggctctgttcgccatcaggag

SEQ ID NO: 7279623 - DNA, 22 bp, Homo sapiens
tggctctgttgtgctgagccag

SEQ ID NO: 7279624 - DNA, 22 bp, Homo sapiens
tgggacaggttggagagaagca

SEQ ID NO: 7279625 - DNA, 22 bp, Homo sapiens
tgggacagtgaccccagaggtc

SEQ ID NO: 7279626 - DNA, 21 bp, Homo sapiens
tgggacagtgatggctcctcc

SEQ ID NO: 7279627 - DNA, 22 bp, Homo sapiens
tgggactcactcttttggccag

SEQ ID NO: 7279628 - DNA, 22 bp, Homo sapiens
tggcttcaagtctaggttctac

SEQ ID NO: 7279629 - DNA, 22 bp, Homo sapiens
tggctggattattggctagtac

SEQ ID NO: 7279630 - DNA, 22 bp, Homo sapiens
tggctggagtctggtgctagcc

SEQ ID NO: 7279631 - DNA, 22 bp, Homo sapiens
tggctggaatggagctgagcct

SEQ ID NO: 7279632 - DNA, 22 bp, Homo sapiens
tggctttatacttaagcacaat

SEQ ID NO: 7279633 - DNA, 20 bp, Homo sapiens
tggctttagtgagggaacat

SEQ ID NO: 7279634 - DNA, 22 bp, Homo sapiens
tggctttataaaaggaaagagg

SEQ ID NO: 7279635 - DNA, 22 bp, Homo sapiens
tgggaactggggcattgtttct

SEQ ID NO: 7279636 - DNA, 22 bp, Homo sapiens
tggcttcctgcacagtgtctgc

SEQ ID NO: 7279637 - DNA, 20 bp, Homo sapiens
tggagctccagcgtccatgt

SEQ ID NO: 7279638 - DNA, 22 bp, Homo sapiens
tggagaggtttaaacaaaagtt

SEQ ID NO: 7279639 - DNA, 22 bp, Homo sapiens
tggagaggttgaataacttgtc

SEQ ID NO: 7279640 - DNA, 22 bp, Homo sapiens
tggagaggagcaccatggccat

SEQ ID NO: 7279641 - DNA, 22 bp, Homo sapiens
tggagaggagcaccatggccat

SEQ ID NO: 7279642 - DNA, 19 bp, Homo sapiens
tggagaggaaatgctgctc

SEQ ID NO: 7279643 - DNA, 22 bp, Homo sapiens
tggagaggaaagtgcagttttg

SEQ ID NO: 7279644 - DNA, 22 bp, Homo sapiens
tggagtgcaatagtaataaggt

SEQ ID NO: 7279645 - DNA, 20 bp, Homo sapiens
tggaggcacctgtggagatc

SEQ ID NO: 7279646 - DNA, 22 bp, Homo sapiens
tggaggcctaggttgatgtgtg

SEQ ID NO: 7279647 - DNA, 22 bp, Homo sapiens
tggaggccgcgtagtctgagca

SEQ ID NO: 7279648 - DNA, 22 bp, Homo sapiens
tggaggaaaaaaccaggcagag

SEQ ID NO: 7279649 - DNA, 22 bp, Homo sapiens
tggaaatggatctgatgagtct

SEQ ID NO: 7279650 - DNA, 22 bp, Homo sapiens
tggaaatacaagaagtatgtca

SEQ ID NO: 7279651 - DNA, 22 bp, Homo sapiens
tggaaagtctcttttgactgta

SEQ ID NO: 7279652 - DNA, 23 bp, Homo sapiens
tggaaagcggacctggggcagag

SEQ ID NO: 7279653 - DNA, 22 bp, Homo sapiens
tggaaagcgaggagttggcatt

SEQ ID NO: 7279654 - DNA, 22 bp, Homo sapiens
tggaaaggaggcttgtggaata

SEQ ID NO: 7279655 - DNA, 22 bp, Homo sapiens
tggaaatgtatttgggcatgcc

SEQ ID NO: 7279656 - DNA, 22 bp, Homo sapiens
tggaacttcatgagattatgga

SEQ ID NO: 7279657 - DNA, 19 bp, Homo sapiens
tggaacctgtgccagggct

SEQ ID NO: 7279658 - DNA, 19 bp, Homo sapiens
tggaaaatggattgaatca

SEQ ID NO: 7279659 - DNA, 21 bp, Homo sapiens
tggaaaacatttaaatagcaa

SEQ ID NO: 7279660 - DNA, 17 bp, Homo sapiens
tgctttcttcctgccct

SEQ ID NO: 7279661 - DNA, 22 bp, Homo sapiens
tgctttctgtttttcatataat

SEQ ID NO: 7279662 - DNA, 22 bp, Homo sapiens
tgctttctgctctggaaacagg

SEQ ID NO: 7279663 - DNA, 18 bp, Homo sapiens
tgctttctagcttcagat

SEQ ID NO: 7279664 - DNA, 22 bp, Homo sapiens
tgctttctcctgtctgaaagat

SEQ ID NO: 7279665 - DNA, 22 bp, Homo sapiens
tgctttattaagagagaaattt

SEQ ID NO: 7279666 - DNA, 22 bp, Homo sapiens
tgctttattcagggtttacccc

SEQ ID NO: 7279667 - DNA, 22 bp, Homo sapiens
tgctttataacttagtttatgg

SEQ ID NO: 7279668 - DNA, 22 bp, Homo sapiens
tgctttatcaaagctatagtga

SEQ ID NO: 7279669 - DNA, 21 bp, Homo sapiens
tgctttatgggaaaaatgtca

SEQ ID NO: 7279670 - DNA, 22 bp, Homo sapiens
tgctttatgtggctgatactca

SEQ ID NO: 7279671 - DNA, 18 bp, Homo sapiens
tgctttatgcttatataa

SEQ ID NO: 7279672 - DNA, 20 bp, Homo sapiens
tgctttatgctatactttgt

SEQ ID NO: 7279673 - DNA, 22 bp, Homo sapiens
tgcttgcaagagatgcaatgac

SEQ ID NO: 7279674 - DNA, 22 bp, Homo sapiens
tgctttaaaccatggatgtgag

SEQ ID NO: 7279675 - DNA, 22 bp, Homo sapiens
tgctttataaccatttctgtgg

SEQ ID NO: 7279676 - DNA, 22 bp, Homo sapiens
tgcttctgtttcattgatctta

SEQ ID NO: 7279677 - DNA, 22 bp, Homo sapiens
tgcttctgtttgtttctgtcat

SEQ ID NO: 7279678 - DNA, 22 bp, Homo sapiens
tgcttctgtattttgggcttga

SEQ ID NO: 7279679 - DNA, 17 bp, Homo sapiens
tgcttctgtattgctgg

SEQ ID NO: 7279680 - DNA, 19 bp, Homo sapiens
tgcttctggggcttctcca

SEQ ID NO: 7279681 - DNA, 22 bp, Homo sapiens
tgcttctgggcctggtgttccc

SEQ ID NO: 7279682 - DNA, 19 bp, Homo sapiens
tgcttctggaaccatgatc

SEQ ID NO: 7279683 - DNA, 22 bp, Homo sapiens
tgcttctgctttacttggttca

SEQ ID NO: 7279684 - DNA, 22 bp, Homo sapiens
tgcttctggagtaacagggtga

SEQ ID NO: 7279685 - DNA, 22 bp, Homo sapiens
tggaatttagttaattccattt

SEQ ID NO: 7279686 - DNA, 22 bp, Homo sapiens
tggaatgttttcctaaatcaga

SEQ ID NO: 7279687 - DNA, 23 bp, Homo sapiens
tggaatgtttcttgtactgaatg

SEQ ID NO: 7279688 - DNA, 22 bp, Homo sapiens
tggaatgtttccccagcctgca

SEQ ID NO: 7279689 - DNA, 22 bp, Homo sapiens
tggaatgttgataaacataggc

SEQ ID NO: 7279690 - DNA, 22 bp, Homo sapiens
tggaatgatctgatgtatttta

SEQ ID NO: 7279691 - DNA, 22 bp, Homo sapiens
tggaatgaaaagtacttcagaa

SEQ ID NO: 7279692 - DNA, 22 bp, Homo sapiens
tggaatgaagacatgttgtttg

SEQ ID NO: 7279693 - DNA, 22 bp, Homo sapiens
tggaatgagctggctaataacc

SEQ ID NO: 7279694 - DNA, 22 bp, Homo sapiens
tggaatgaatttggcttcctcc

SEQ ID NO: 7279695 - DNA, 23 bp, Homo sapiens
tggacagcagcagcagtgtcacc

SEQ ID NO: 7279696 - DNA, 22 bp, Homo sapiens
tggacagcgaaagtgcctggga

SEQ ID NO: 7279697 - DNA, 22 bp, Homo sapiens
tggacaggatagtgcagtacgc

SEQ ID NO: 7279698 - DNA, 22 bp, Homo sapiens
tggacaggtgagtgactcaggg

SEQ ID NO: 7279699 - DNA, 22 bp, Homo sapiens
tggactggaatgctgatcctct

SEQ ID NO: 7279700 - DNA, 22 bp, Homo sapiens
tggaagggggaagacagctctg

SEQ ID NO: 7279701 - DNA, 22 bp, Homo sapiens
tggaaggagactgggaagtgtg

SEQ ID NO: 7279702 - DNA, 20 bp, Homo sapiens
tggaagaggagatgcctctg

SEQ ID NO: 7279703 - DNA, 22 bp, Homo sapiens
tggaagatcaaccaggattgac

SEQ ID NO: 7279704 - DNA, 22 bp, Homo sapiens
tggaaggaaaggtagcagagaa

SEQ ID NO: 7279705 - DNA, 22 bp, Homo sapiens
tggaaggaagccaaggaaggtt

SEQ ID NO: 7279706 - DNA, 22 bp, Homo sapiens
tgctgggctgttcctgtccatg

SEQ ID NO: 7279707 - DNA, 22 bp, Homo sapiens
tgcttaaagtgttaaccctgtt

SEQ ID NO: 7279708 - DNA, 22 bp, Homo sapiens
tgcttagacgtcaagtacagcc

SEQ ID NO: 7279709 - DNA, 22 bp, Homo sapiens
tgcttcagcactttgagagcct

SEQ ID NO: 7279710 - DNA, 22 bp, Homo sapiens
tgcttcaaggacactgactttt

SEQ ID NO: 7279711 - DNA, 22 bp, Homo sapiens
tgcttcagtgctctgagcctgt

SEQ ID NO: 7279712 - DNA, 22 bp, Homo sapiens
tgcttctgcaggagctcctgat

SEQ ID NO: 7279713 - DNA, 22 bp, Homo sapiens
tgcttctgattcatggttattg

SEQ ID NO: 7279714 - DNA, 22 bp, Homo sapiens
tgcttctgaagtggatgggtgc

SEQ ID NO: 7279715 - DNA, 22 bp, Homo sapiens
tgctgctgtatccttagtgtca

SEQ ID NO: 7279716 - DNA, 19 bp, Homo sapiens
tgctgctgtccttgcaggg

SEQ ID NO: 7279717 - DNA, 22 bp, Homo sapiens
tgctgctgggtttgacagtcac

SEQ ID NO: 7279718 - DNA, 22 bp, Homo sapiens
tgctgctgtatcatgccttcat

SEQ ID NO: 7279719 - DNA, 22 bp, Homo sapiens
tgctgctggatcttactcatct

SEQ ID NO: 7279720 - DNA, 22 bp, Homo sapiens
tgctgctgcttctgtacagcct

SEQ ID NO: 7279721 - DNA, 20 bp, Homo sapiens
tgctgctgcttcacccccat

SEQ ID NO: 7279722 - DNA, 22 bp, Homo sapiens
tgctgctgatggcacctaggca

SEQ ID NO: 7279723 - DNA, 20 bp, Homo sapiens
tgctgctgcctccgcctctg

SEQ ID NO: 7279724 - DNA, 20 bp, Homo sapiens
tgctgctttgccactagttg

SEQ ID NO: 7279725 - DNA, 22 bp, Homo sapiens
tgctgctttgatgtgtaaatca

SEQ ID NO: 7279726 - DNA, 20 bp, Homo sapiens
tgctgctgtgagcgtccctg

SEQ ID NO: 7279727 - DNA, 22 bp, Homo sapiens
tgctgctgttgacggctgtcca

SEQ ID NO: 7279728 - DNA, 22 bp, Homo sapiens
tgctgctgttgacggctgtcca

SEQ ID NO: 7279729 - DNA, 22 bp, Homo sapiens
tgctggaataatttcatgttaa

SEQ ID NO: 7279730 - DNA, 22 bp, Homo sapiens
tgctggagaactgctctgtgtt

SEQ ID NO: 7279731 - DNA, 22 bp, Homo sapiens
tgctggagaagctcctgggact

SEQ ID NO: 7279732 - DNA, 22 bp, Homo sapiens
tgctgcatagcagctcctgaaa

SEQ ID NO: 7279733 - DNA, 22 bp, Homo sapiens
tgctgctgacatttggggcttg

SEQ ID NO: 7279734 - DNA, 22 bp, Homo sapiens
tgctgctgacatttggggcttg

SEQ ID NO: 7279735 - DNA, 22 bp, Homo sapiens
tgctgctgatcatttatagtct

SEQ ID NO: 7279736 - DNA, 21 bp, Homo sapiens
tgctgctgatcggggttggct

SEQ ID NO: 7279737 - DNA, 22 bp, Homo sapiens
tgctgctgatgcatagtctgct

SEQ ID NO: 7279738 - DNA, 22 bp, Homo sapiens
tgctgctgatgcatagtctgct

SEQ ID NO: 7279739 - DNA, 22 bp, Homo sapiens
tgctgctcgccacggcccaggg

SEQ ID NO: 7279740 - DNA, 22 bp, Homo sapiens
tgctgcctccttcctgccagga

SEQ ID NO: 7279741 - DNA, 19 bp, Homo sapiens
tgctggaggttgacagggt

SEQ ID NO: 7279742 - DNA, 22 bp, Homo sapiens
tgctggcacgtgactgggaagt

SEQ ID NO: 7279743 - DNA, 23 bp, Homo sapiens
tgctggctgaaacagccaaagga

SEQ ID NO: 7279744 - DNA, 21 bp, Homo sapiens
tgctggctgaaaggcacagag

SEQ ID NO: 7279745 - DNA, 23 bp, Homo sapiens
tgctggctgtgttattgccaaca

SEQ ID NO: 7279746 - DNA, 22 bp, Homo sapiens
tgctggctgcagtgctgtcaaa

SEQ ID NO: 7279747 - DNA, 22 bp, Homo sapiens
tgctatgtaaagctctgggttt

SEQ ID NO: 7279748 - DNA, 22 bp, Homo sapiens
tgctcagtagcagtgtgctgct

SEQ ID NO: 7279749 - DNA, 22 bp, Homo sapiens
tgctcagtcctcctgcagtgcc

SEQ ID NO: 7279750 - DNA, 22 bp, Homo sapiens
tgctcatcaacatgatgatcat

SEQ ID NO: 7279751 - DNA, 22 bp, Homo sapiens
tgcctgtcttggagtcctggcc

SEQ ID NO: 7279752 - DNA, 22 bp, Homo sapiens
tgcctgggttgactcttagctg

SEQ ID NO: 7279753 - DNA, 22 bp, Homo sapiens
tgcctgggtgctggctggtcac

SEQ ID NO: 7279754 - DNA, 22 bp, Homo sapiens
tgcctggccctgacagccctgg

SEQ ID NO: 7279755 - DNA, 22 bp, Homo sapiens
tgcctgtgtcacagtgatgttt

SEQ ID NO: 7279756 - DNA, 22 bp, Homo sapiens
tgccttgcacataatatacatt

SEQ ID NO: 7279757 - DNA, 22 bp, Homo sapiens
tgctgaggaggtggctgtgctt

SEQ ID NO: 7279758 - DNA, 19 bp, Homo sapiens
tgctgaggatgcaagatcc

SEQ ID NO: 7279759 - DNA, 22 bp, Homo sapiens
tgctgaggactaaaggagatga

SEQ ID NO: 7279760 - DNA, 22 bp, Homo sapiens
tgctgaggagggcacccggggg

SEQ ID NO: 7279761 - DNA, 22 bp, Homo sapiens
tgctgaggaaaaatgtgactct

SEQ ID NO: 7279762 - DNA, 22 bp, Homo sapiens
tgctgaggaaagaggataaaag

SEQ ID NO: 7279763 - DNA, 22 bp, Homo sapiens
tgctgaggaataattgttcctg

SEQ ID NO: 7279764 - DNA, 22 bp, Homo sapiens
tgctgaggaatttggtttatgt

SEQ ID NO: 7279765 - DNA, 22 bp, Homo sapiens
tgctgaggacacctagccttct

SEQ ID NO: 7279766 - DNA, 22 bp, Homo sapiens
tgctcttcggggccactgcttg

SEQ ID NO: 7279767 - DNA, 22 bp, Homo sapiens
tgctctgtcaagaaaagatgcc

SEQ ID NO: 7279768 - DNA, 22 bp, Homo sapiens
tgctgcaggcagcccctctact

SEQ ID NO: 7279769 - DNA, 22 bp, Homo sapiens
tgctgaggttgtggagtgcatt

SEQ ID NO: 7279770 - DNA, 22 bp, Homo sapiens
tgctgaggtttcgtctgcttgc

SEQ ID NO: 7279771 - DNA, 22 bp, Homo sapiens
tgctgaggtttctgactatgga

SEQ ID NO: 7279772 - DNA, 22 bp, Homo sapiens
tgctgaggtcaccttgctgcta

SEQ ID NO: 7279773 - DNA, 22 bp, Homo sapiens
tgctgaggtcacggcggccaga

SEQ ID NO: 7279774 - DNA, 22 bp, Homo sapiens
tgctgaggtcatttccaagtga

SEQ ID NO: 7279775 - DNA, 20 bp, Homo sapiens
tgctgaggttgacatgccca

SEQ ID NO: 7279776 - DNA, 22 bp, Homo sapiens
tgctgaggctagacctggaagt

SEQ ID NO: 7279777 - DNA, 22 bp, Homo sapiens
tgctgagggagcatcaaagaaa

SEQ ID NO: 7279778 - DNA, 22 bp, Homo sapiens
tgctgagggaggggttttccag

SEQ ID NO: 7279779 - DNA, 22 bp, Homo sapiens
tgctgagggcagatgaattaga

SEQ ID NO: 7279780 - DNA, 22 bp, Homo sapiens
tgctgagggctgttaaggaagc

SEQ ID NO: 7279781 - DNA, 22 bp, Homo sapiens
tgctgaggtaaccatatcctgc

SEQ ID NO: 7279782 - DNA, 22 bp, Homo sapiens
tgctgaggcagatgtctgtgac

SEQ ID NO: 7279783 - DNA, 22 bp, Homo sapiens
tgctgaggcagtcctaacagga

SEQ ID NO: 7279784 - DNA, 22 bp, Homo sapiens
tgctgaggcatttggacagagt

SEQ ID NO: 7279785 - DNA, 20 bp, Homo sapiens
tgctgaggcctgaggcctgg

SEQ ID NO: 7279786 - DNA, 22 bp, Homo sapiens
tgctgaggcccaggagcacttt

SEQ ID NO: 7279787 - DNA, 22 bp, Homo sapiens
tgctccagcgctgccaccagtt

SEQ ID NO: 7279788 - DNA, 22 bp, Homo sapiens
tgctccagcaccaagagctcca

SEQ ID NO: 7279789 - DNA, 22 bp, Homo sapiens
tgctccagcatgaccctcaatg

SEQ ID NO: 7279790 - DNA, 22 bp, Homo sapiens
tgctccagcctatgctctccgg

SEQ ID NO: 7279791 - DNA, 22 bp, Homo sapiens
tgctccaggagcactttccatt

SEQ ID NO: 7279792 - DNA, 19 bp, Homo sapiens
tgctccaggccttgccgca

SEQ ID NO: 7279793 - DNA, 21 bp, Homo sapiens
tgctccagggcagcttccagc

SEQ ID NO: 7279794 - DNA, 22 bp, Homo sapiens
tgctcctttcatccaattctca

SEQ ID NO: 7279795 - DNA, 17 bp, Homo sapiens
tgctcctgggacaagga

SEQ ID NO: 7279796 - DNA, 22 bp, Homo sapiens
tgctctgggctcaatggcagct

SEQ ID NO: 7279797 - DNA, 22 bp, Homo sapiens
tgagggagagggcgaaaatgaa

SEQ ID NO: 7279798 - DNA, 22 bp, Homo sapiens
tgagggagcacacactgaagtg

SEQ ID NO: 7279799 - DNA, 22 bp, Homo sapiens
tgaggggagctagcatgccttg

SEQ ID NO: 7279800 - DNA, 22 bp, Homo sapiens
tgaggggagcccgccctggacg

SEQ ID NO: 7279801 - DNA, 19 bp, Homo sapiens
tgaggggaggagaggcctg

SEQ ID NO: 7279802 - DNA, 22 bp, Homo sapiens
tgaggggaggttggggcacatc

SEQ ID NO: 7279803 - DNA, 22 bp, Homo sapiens
tgaggggatacggtacacattg

SEQ ID NO: 7279804 - DNA, 22 bp, Homo sapiens
tgaggggaaggcatgataaata

SEQ ID NO: 7279805 - DNA, 22 bp, Homo sapiens
tgaggggagaagcagcagcctg

SEQ ID NO: 7279806 - DNA, 22 bp, Homo sapiens
tgaggggagacagagtggactc

SEQ ID NO: 7279807 - DNA, 22 bp, Homo sapiens
tgagggagttgggtgtatagga

SEQ ID NO: 7279808 - DNA, 22 bp, Homo sapiens
tgagggagtcatgattaaggaa

SEQ ID NO: 7279809 - DNA, 22 bp, Homo sapiens
tgaggctcacgaacagaagact

SEQ ID NO: 7279810 - DNA, 22 bp, Homo sapiens
tgaggctcagagaacagtgact

SEQ ID NO: 7279811 - DNA, 22 bp, Homo sapiens
tgaggctcagagaagtgctgtt

SEQ ID NO: 7279812 - DNA, 22 bp, Homo sapiens
tgaggctcagagcacctgctcc

SEQ ID NO: 7279813 - DNA, 20 bp, Homo sapiens
tgaggctcagagaggttgag

SEQ ID NO: 7279814 - DNA, 22 bp, Homo sapiens
tgaggctccttgtagagagtgg

SEQ ID NO: 7279815 - DNA, 22 bp, Homo sapiens
tgaggctccttgtagagagtgg

SEQ ID NO: 7279816 - DNA, 22 bp, Homo sapiens
tgaggctcattctgcatgccaa

SEQ ID NO: 7279817 - DNA, 22 bp, Homo sapiens
tgaggctcaagaaagatttgtt

SEQ ID NO: 7279818 - DNA, 21 bp, Homo sapiens
tgaggcctgccagtctcagaa

SEQ ID NO: 7279819 - DNA, 22 bp, Homo sapiens
tgaggctgttctaccagggcca

SEQ ID NO: 7279820 - DNA, 21 bp, Homo sapiens
tgaggctctgttgtgcctgca

SEQ ID NO: 7279821 - DNA, 17 bp, Homo sapiens
tgaggctcggtgaggag

SEQ ID NO: 7279822 - DNA, 22 bp, Homo sapiens
tgaggctctatgtggtagatta

SEQ ID NO: 7279823 - DNA, 22 bp, Homo sapiens
tgaggctctccaagcagatgag

SEQ ID NO: 7279824 - DNA, 22 bp, Homo sapiens
tgagtatttctaatattccagt

SEQ ID NO: 7279825 - DNA, 22 bp, Homo sapiens
tgagtattttaagttctcaatc

SEQ ID NO: 7279826 - DNA, 22 bp, Homo sapiens
tgagtattttccctatcaatgt

SEQ ID NO: 7279827 - DNA, 22 bp, Homo sapiens
tgagtattgaagcgatttcaat

SEQ ID NO: 7279828 - DNA, 22 bp, Homo sapiens
tgagtattgaccagaaaattta

SEQ ID NO: 7279829 - DNA, 22 bp, Homo sapiens
tgagtattctgaatttcaaact

SEQ ID NO: 7279830 - DNA, 22 bp, Homo sapiens
tgagtattccttatctgaaatg

SEQ ID NO: 7279831 - DNA, 22 bp, Homo sapiens
tgaggtctgcagggctgtgcat

SEQ ID NO: 7279832 - DNA, 22 bp, Homo sapiens
tgaggatggtcccgaggacact

SEQ ID NO: 7279833 - DNA, 22 bp, Homo sapiens
tgaggcaggaatggggaaaagt

SEQ ID NO: 7279834 - DNA, 22 bp, Homo sapiens
tgaggcaggacatggacaactg

SEQ ID NO: 7279835 - DNA, 22 bp, Homo sapiens
tgaggcaggaagttatataatg

SEQ ID NO: 7279836 - DNA, 22 bp, Homo sapiens
tgaggcagctttttctgtgtgt

SEQ ID NO: 7279837 - DNA, 22 bp, Homo sapiens
tgaggcagctttttctgtgtgt

SEQ ID NO: 7279838 - DNA, 22 bp, Homo sapiens
tgaggcagaaaatagcagttca

SEQ ID NO: 7279839 - DNA, 22 bp, Homo sapiens
tgaggcaggactgagcgggatg

SEQ ID NO: 7279840 - DNA, 22 bp, Homo sapiens
tgaggcaggacttgcataaagt

SEQ ID NO: 7279841 - DNA, 22 bp, Homo sapiens
tgaggcaggagaatcacatgaa

SEQ ID NO: 7279842 - DNA, 22 bp, Homo sapiens
tgaggcaggagaatcaccggaa

SEQ ID NO: 7279843 - DNA, 20 bp, Homo sapiens
tgaggcaggagaatggcatg

SEQ ID NO: 7279844 - DNA, 22 bp, Homo sapiens
tgaggcaggagaatcaccggaa

SEQ ID NO: 7279845 - DNA, 22 bp, Homo sapiens
tgaggcaggagaatcacatgaa

SEQ ID NO: 7279846 - DNA, 22 bp, Homo sapiens
tgaggatggttaaagaacattg

SEQ ID NO: 7279847 - DNA, 22 bp, Homo sapiens
tgaggcaggagttcaggctgcg

SEQ ID NO: 7279848 - DNA, 23 bp, Homo sapiens
tgaggcaggcggatcacgaggtc

SEQ ID NO: 7279849 - DNA, 22 bp, Homo sapiens
tgaggcaggatgcttgcacagg

SEQ ID NO: 7279850 - DNA, 22 bp, Homo sapiens
tgaggcaggaggttgagaactg

SEQ ID NO: 7279851 - DNA, 22 bp, Homo sapiens
tgaggcaggagttaatgtgctc

SEQ ID NO: 7279852 - DNA, 22 bp, Homo sapiens
tgaggcaggaggttgagaactg

SEQ ID NO: 7279853 - DNA, 22 bp, Homo sapiens
tgaggcaggaggattgcaggat

SEQ ID NO: 7279854 - DNA, 22 bp, Homo sapiens
tgaggcaggagaatggcgggaa

SEQ ID NO: 7279855 - DNA, 20 bp, Homo sapiens
tgaggcaggagaatggcatg

SEQ ID NO: 7279856 - DNA, 22 bp, Homo sapiens
tgaggcagggagtttaattgtc

SEQ ID NO: 7279857 - DNA, 23 bp, Homo sapiens
tgaggcaggcggatcacgaggtc

SEQ ID NO: 7279858 - DNA, 22 bp, Homo sapiens
tgaggcagggagagtggatatg

SEQ ID NO: 7279859 - DNA, 21 bp, Homo sapiens
tgaggcaggggtgcttttgtc

SEQ ID NO: 7279860 - DNA, 22 bp, Homo sapiens
tgaggcagttcttacttgtatt

SEQ ID NO: 7279861 - DNA, 22 bp, Homo sapiens
tgaggcagttgagcttcctgag

SEQ ID NO: 7279862 - DNA, 22 bp, Homo sapiens
tgaggcagttgagcttcctgag

SEQ ID NO: 7279863 - DNA, 17 bp, Homo sapiens
tgaggcctgcatcagtg

SEQ ID NO: 7279864 - DNA, 22 bp, Homo sapiens
tgaggcctctgaggcctaggct

SEQ ID NO: 7279865 - DNA, 22 bp, Homo sapiens
tgaggccctctgggctggtcct

SEQ ID NO: 7279866 - DNA, 22 bp, Homo sapiens
tgaggccctagggcatgggaga

SEQ ID NO: 7279867 - DNA, 18 bp, Homo sapiens
tgaggcccgcagaggtgg

SEQ ID NO: 7279868 - DNA, 22 bp, Homo sapiens
tgaggccccgaagctgaggttt

SEQ ID NO: 7279869 - DNA, 22 bp, Homo sapiens
tgaggcccgggtggaggaatgc

SEQ ID NO: 7279870 - DNA, 22 bp, Homo sapiens
tgagcagatggaggcttctgca

SEQ ID NO: 7279871 - DNA, 22 bp, Homo sapiens
tgagcagagtcgctccagagtg

SEQ ID NO: 7279872 - DNA, 22 bp, Homo sapiens
tgagcagagcagtaacaggagc

SEQ ID NO: 7279873 - DNA, 22 bp, Homo sapiens
tgagcaaggagcagtctttctt

SEQ ID NO: 7279874 - DNA, 22 bp, Homo sapiens
tgagcaggcgcagcaggaggtc

SEQ ID NO: 7279875 - DNA, 22 bp, Homo sapiens
tgagcaggactcactgcagcct

SEQ ID NO: 7279876 - DNA, 22 bp, Homo sapiens
tgagcagggactttggagtctg

SEQ ID NO: 7279877 - DNA, 22 bp, Homo sapiens
tgagcagggagctgggctgagc

SEQ ID NO: 7279878 - DNA, 22 bp, Homo sapiens
tgagcagtggctcctgctggac

SEQ ID NO: 7279879 - DNA, 22 bp, Homo sapiens
tgagcagtcatccatttctcct

SEQ ID NO: 7279880 - DNA, 19 bp, Homo sapiens
tgagccagggaggccatgc

SEQ ID NO: 7279881 - DNA, 22 bp, Homo sapiens
tgagctgcattacagcctctgt

SEQ ID NO: 7279882 - DNA, 22 bp, Homo sapiens
tgagctgcagtgagctgagatg

SEQ ID NO: 7279883 - DNA, 22 bp, Homo sapiens
tgagctgtaaggctgtcactga

SEQ ID NO: 7279884 - DNA, 22 bp, Homo sapiens
tgaggaaacttacaaggcagaa

SEQ ID NO: 7279885 - DNA, 17 bp, Homo sapiens
tgagcttcaatcaggtg

SEQ ID NO: 7279886 - DNA, 22 bp, Homo sapiens
tgagctgtgattaactctgaga

SEQ ID NO: 7279887 - DNA, 22 bp, Homo sapiens
tgagctgtgagggtacagatat

SEQ ID NO: 7279888 - DNA, 22 bp, Homo sapiens
tgagctgtcaaggtacagtgaa

SEQ ID NO: 7279889 - DNA, 22 bp, Homo sapiens
tgagctgtagcagatgctgttg

SEQ ID NO: 7279890 - DNA, 22 bp, Homo sapiens
tgagccctccaaacccaggatt

SEQ ID NO: 7279891 - DNA, 22 bp, Homo sapiens
tgagatgctaaagggctgctca

SEQ ID NO: 7279892 - DNA, 22 bp, Homo sapiens
tgagatttcgccgacagtattt

SEQ ID NO: 7279893 - DNA, 22 bp, Homo sapiens
tgagatttggaaaatttgatat

SEQ ID NO: 7279894 - DNA, 22 bp, Homo sapiens
tgagatttgagggttaatctga

SEQ ID NO: 7279895 - DNA, 22 bp, Homo sapiens
tgagattctgttcagaaaaatg

SEQ ID NO: 7279896 - DNA, 22 bp, Homo sapiens
tgagattttcctaaatataatg

SEQ ID NO: 7279897 - DNA, 20 bp, Homo sapiens
tgagatttgtattataagtc

SEQ ID NO: 7279898 - DNA, 22 bp, Homo sapiens
tgagatgtaaggtatgcttact

SEQ ID NO: 7279899 - DNA, 22 bp, Homo sapiens
tgagatggttgaccagagagca

SEQ ID NO: 7279900 - DNA, 18 bp, Homo sapiens
tgagaggctattttttgc

SEQ ID NO: 7279901 - DNA, 19 bp, Homo sapiens
tgagaacttttacttatgc

SEQ ID NO: 7279902 - DNA, 22 bp, Homo sapiens
tgagaactgcctgtatttatct

SEQ ID NO: 7279903 - DNA, 18 bp, Homo sapiens
tgagaactaggcattgca

SEQ ID NO: 7279904 - DNA, 22 bp, Homo sapiens
tgagaactgaggatttgaattc

SEQ ID NO: 7279905 - DNA, 22 bp, Homo sapiens
tgagaacatacaaacagagaaa

SEQ ID NO: 7279906 - DNA, 22 bp, Homo sapiens
tgagaagcccacactctttcct

SEQ ID NO: 7279907 - DNA, 23 bp, Homo sapiens
tgagaagccaggggagcgtgagg

SEQ ID NO: 7279908 - DNA, 23 bp, Homo sapiens
tgagaaattttgattcagtagga

SEQ ID NO: 7279909 - DNA, 22 bp, Homo sapiens
tgagaaacatatgagagatttg

SEQ ID NO: 7279910 - DNA, 19 bp, Homo sapiens
tgagacagaagatgagcct

SEQ ID NO: 7279911 - DNA, 22 bp, Homo sapiens
tgagacagtatcgccccaaggc

SEQ ID NO: 7279912 - DNA, 17 bp, Homo sapiens
tgagacagggcaggccc

SEQ ID NO: 7279913 - DNA, 22 bp, Homo sapiens
tgagacagggtcttgctctgtt

SEQ ID NO: 7279914 - DNA, 22 bp, Homo sapiens
tgagacagggtcttgctctgtt

SEQ ID NO: 7279915 - DNA, 22 bp, Homo sapiens
tgagacagcctctgcactcatg

SEQ ID NO: 7279916 - DNA, 18 bp, Homo sapiens
tgagacagctaccacttg

SEQ ID NO: 7279917 - DNA, 22 bp, Homo sapiens
tgagacaggagaggcccctcct

SEQ ID NO: 7279918 - DNA, 22 bp, Homo sapiens
tgagacaggcttccttcttggg

SEQ ID NO: 7279919 - DNA, 22 bp, Homo sapiens
tgaaagagtgcaagtcaaggag

SEQ ID NO: 7279920 - DNA, 22 bp, Homo sapiens
tgaaagcacaagttctaacagg

SEQ ID NO: 7279921 - DNA, 22 bp, Homo sapiens
tgaactctctcaagtgacagaa

SEQ ID NO: 7279922 - DNA, 22 bp, Homo sapiens
tgaactcgggaggaggctgcag

SEQ ID NO: 7279923 - DNA, 22 bp, Homo sapiens
tgaactcctgacctcatgatcc

SEQ ID NO: 7279924 - DNA, 22 bp, Homo sapiens
tgaactccaaatactgctgatt

SEQ ID NO: 7279925 - DNA, 22 bp, Homo sapiens
tgaactttgtagtaatggagat

SEQ ID NO: 7279926 - DNA, 17 bp, Homo sapiens
tgaactttaggtggagc

SEQ ID NO: 7279927 - DNA, 22 bp, Homo sapiens
tgaactttcacaagaatatgct

SEQ ID NO: 7279928 - DNA, 18 bp, Homo sapiens
tgaactttggtgtctctc

SEQ ID NO: 7279929 - DNA, 22 bp, Homo sapiens
tgaacttttatttgatgacagg

SEQ ID NO: 7279930 - DNA, 18 bp, Homo sapiens
tgaacttttcctgctgct

SEQ ID NO: 7279931 - DNA, 22 bp, Homo sapiens
tgaacttttgcacagaggattt

SEQ ID NO: 7279932 - DNA, 22 bp, Homo sapiens
tgaactttttctctacgggcca

SEQ ID NO: 7279933 - DNA, 22 bp, Homo sapiens
tgaaacatttgatgatctttgg

SEQ ID NO: 7279934 - DNA, 22 bp, Homo sapiens
tgaaagaaacaggtatattggg

SEQ ID NO: 7279935 - DNA, 22 bp, Homo sapiens
tgaaacttgctaattgcacgta

SEQ ID NO: 7279936 - DNA, 22 bp, Homo sapiens
tgaaaccactgatggtaccaag

SEQ ID NO: 7279937 - DNA, 22 bp, Homo sapiens
tgaaaagactgcaagagagcat

SEQ ID NO: 7279938 - DNA, 22 bp, Homo sapiens
tctttgcacacagcgattcttc

SEQ ID NO: 7279939 - DNA, 22 bp, Homo sapiens
tctttgcatgtgcttcttggcc

SEQ ID NO: 7279940 - DNA, 22 bp, Homo sapiens
tctttgctccacactctagaga

SEQ ID NO: 7279941 - DNA, 22 bp, Homo sapiens
tcttttagctctgcaaggaaag

SEQ ID NO: 7279942 - DNA, 22 bp, Homo sapiens
tcttttcctcctcttgttggcc

SEQ ID NO: 7279943 - DNA, 22 bp, Homo sapiens
tgacatgtatgttgttggcatg

SEQ ID NO: 7279944 - DNA, 22 bp, Homo sapiens
tgacatgtcctgagaagatggc

SEQ ID NO: 7279945 - DNA, 22 bp, Homo sapiens
tgacatgtccaggtggtcctgt

SEQ ID NO: 7279946 - DNA, 22 bp, Homo sapiens
tgacatgtggctttgacccagg

SEQ ID NO: 7279947 - DNA, 22 bp, Homo sapiens
tgacatgtgctcatcttggcta

SEQ ID NO: 7279948 - DNA, 22 bp, Homo sapiens
tgacatgtgtctccttccgtct

SEQ ID NO: 7279949 - DNA, 22 bp, Homo sapiens
tgacatgtgtaatcagctccgt

SEQ ID NO: 7279950 - DNA, 22 bp, Homo sapiens
tgacatgttagggaaatgtgat

SEQ ID NO: 7279951 - DNA, 21 bp, Homo sapiens
tgacatttggattcatagtaa

SEQ ID NO: 7279952 - DNA, 22 bp, Homo sapiens
tgacccttagtgaacattagaa

SEQ ID NO: 7279953 - DNA, 21 bp, Homo sapiens
tgacccttctagcagaacaca

SEQ ID NO: 7279954 - DNA, 22 bp, Homo sapiens
tgacctattagatttccttgcc

SEQ ID NO: 7279955 - DNA, 22 bp, Homo sapiens
tgactctggggttgaccagatg

SEQ ID NO: 7279956 - DNA, 22 bp, Homo sapiens
tgactctgattgccttagcttg

SEQ ID NO: 7279957 - DNA, 22 bp, Homo sapiens
tgacctttctttgagattcctg

SEQ ID NO: 7279958 - DNA, 23 bp, Homo sapiens
tgacctcatgatccgcccacctc

SEQ ID NO: 7279959 - DNA, 22 bp, Homo sapiens
tgacctcttgtcggagctccag

SEQ ID NO: 7279960 - DNA, 22 bp, Homo sapiens
tgacttgtcaaagaaatgtgtg

SEQ ID NO: 7279961 - DNA, 22 bp, Homo sapiens
tgacttgtctctttgggagaca

SEQ ID NO: 7279962 - DNA, 22 bp, Homo sapiens
tgacttgtctctttgggagaca

SEQ ID NO: 7279963 - DNA, 22 bp, Homo sapiens
tgactggattgtcattacgacg

SEQ ID NO: 7279964 - DNA, 22 bp, Homo sapiens
tgacaggcttgctaagacatag

SEQ ID NO: 7279965 - DNA, 21 bp, Homo sapiens
tgacaggtatttatctggaaa

SEQ ID NO: 7279966 - DNA, 22 bp, Homo sapiens
tgacaggtgaaatgtccttatt

SEQ ID NO: 7279967 - DNA, 22 bp, Homo sapiens
tgacaggtcatataagcttgca

SEQ ID NO: 7279968 - DNA, 19 bp, Homo sapiens
tgacaggttttatgtgttt

SEQ ID NO: 7279969 - DNA, 21 bp, Homo sapiens
tgacaggtttaggattaaaat

SEQ ID NO: 7279970 - DNA, 22 bp, Homo sapiens
tgacaggttgtgtaggtggcca

SEQ ID NO: 7279971 - DNA, 22 bp, Homo sapiens
tgacaggtgattgtgaactaag

SEQ ID NO: 7279972 - DNA, 22 bp, Homo sapiens
tgacaggtgctgggggcagtgt

SEQ ID NO: 7279973 - DNA, 22 bp, Homo sapiens
tgacaggttcgttagtcatgtt

SEQ ID NO: 7279974 - DNA, 22 bp, Homo sapiens
tgacatgtaagatggaaaagcg

SEQ ID NO: 7279975 - DNA, 22 bp, Homo sapiens
tgacatgtatgtatttgtttat

SEQ ID NO: 7279976 - DNA, 22 bp, Homo sapiens
tgacatgtatatcttacgctat

SEQ ID NO: 7279977 - DNA, 22 bp, Homo sapiens
tgacagaaagaatatgtcaatc

SEQ ID NO: 7279978 - DNA, 22 bp, Homo sapiens
tgacagacagcttctcatttta

SEQ ID NO: 7279979 - DNA, 22 bp, Homo sapiens
tgacagaatgtgactctcagat

SEQ ID NO: 7279980 - DNA, 22 bp, Homo sapiens
tgaaggtaatggaatctcctga

SEQ ID NO: 7279981 - DNA, 22 bp, Homo sapiens
tgaaggcttgactgaggcagga

SEQ ID NO: 7279982 - DNA, 22 bp, Homo sapiens
tgaaggctgggctcagccagct

SEQ ID NO: 7279983 - DNA, 19 bp, Homo sapiens
tgaaggagggggatggcca

SEQ ID NO: 7279984 - DNA, 22 bp, Homo sapiens
tgaaggagggaagaaggctctg

SEQ ID NO: 7279985 - DNA, 22 bp, Homo sapiens
tgaaggagctgatgtaaggggt

SEQ ID NO: 7279986 - DNA, 22 bp, Homo sapiens
tgaaggagatttttagggaggc

SEQ ID NO: 7279987 - DNA, 22 bp, Homo sapiens
tgaatctggatctatgatcaat

SEQ ID NO: 7279988 - DNA, 22 bp, Homo sapiens
tgaatctgatttccctggaggc

SEQ ID NO: 7279989 - DNA, 22 bp, Homo sapiens
tgaatctgatttccctggaggc

SEQ ID NO: 7279990 - DNA, 22 bp, Homo sapiens
tgaatgcttggagtcataaaat

SEQ ID NO: 7279991 - DNA, 22 bp, Homo sapiens
tgaatcatggataaatagctta

SEQ ID NO: 7279992 - DNA, 22 bp, Homo sapiens
tgacaaaccctgcaaatagctc

SEQ ID NO: 7279993 - DNA, 22 bp, Homo sapiens
tgcctaggctggagtgtagtgg

SEQ ID NO: 7279994 - DNA, 22 bp, Homo sapiens
tgcctaggctggagtgtagtgg

SEQ ID NO: 7279995 - DNA, 22 bp, Homo sapiens
tgccctgggaacacagatgcca

SEQ ID NO: 7279996 - DNA, 22 bp, Homo sapiens
tgccctgggaacacagatgcca

SEQ ID NO: 7279997 - DNA, 22 bp, Homo sapiens
tgccctggctggagtgcagtgg

SEQ ID NO: 7279998 - DNA, 22 bp, Homo sapiens
tgccgcagtgcggggagggccc

SEQ ID NO: 7279999 - DNA, 22 bp, Homo sapiens
tgccctggaaccatctacagtc

SEQ ID NO: 7280000 - DNA, 22 bp, Homo sapiens
tgccctggaaatgagaggtgtg

SEQ ID NO: 7280001 - DNA, 22 bp, Homo sapiens
tgccctggctcctcccacgctg

SEQ ID NO: 7280002 - DNA, 22 bp, Homo sapiens
tgccctggctctccactagttt

SEQ ID NO: 7280003 - DNA, 22 bp, Homo sapiens
tgccctggcgctgtctctatgg

SEQ ID NO: 7280004 - DNA, 22 bp, Homo sapiens
tgccctggcattgggttggata

SEQ ID NO: 7280005 - DNA, 22 bp, Homo sapiens
tgccctggcacacacacagctg

SEQ ID NO: 7280006 - DNA, 22 bp, Homo sapiens
tgccctgcagaccctgcagtgt

SEQ ID NO: 7280007 - DNA, 22 bp, Homo sapiens
tgccctgccaagactgagtggt

SEQ ID NO: 7280008 - DNA, 22 bp, Homo sapiens
tgcctggattcggttgttgtca

SEQ ID NO: 7280009 - DNA, 22 bp, Homo sapiens
tgcctggcaccccagtctgcac

SEQ ID NO: 7280010 - DNA, 19 bp, Homo sapiens
tgcctggacaaatgtgggg

SEQ ID NO: 7280011 - DNA, 22 bp, Homo sapiens
tgcctggaaggcccatgggaag

SEQ ID NO: 7280012 - DNA, 22 bp, Homo sapiens
tgcctgctgattggagttgaat

SEQ ID NO: 7280013 - DNA, 22 bp, Homo sapiens
tgcctgctgctaagctctttgt

SEQ ID NO: 7280014 - DNA, 22 bp, Homo sapiens
tgcctgccaggcaacctgggag

SEQ ID NO: 7280015 - DNA, 20 bp, Homo sapiens
tgcctgcccaggtcctgcac

SEQ ID NO: 7280016 - DNA, 22 bp, Homo sapiens
tgcctcagctgaggccgctcca

SEQ ID NO: 7280017 - DNA, 22 bp, Homo sapiens
tgcctccattcctgggtcattg

SEQ ID NO: 7280018 - DNA, 22 bp, Homo sapiens
tgcctcagtcagcttccctggg

SEQ ID NO: 7280019 - DNA, 22 bp, Homo sapiens
tgcctgagtgatgtggcagcca

SEQ ID NO: 7280020 - DNA, 22 bp, Homo sapiens
tgcctctgggtgaccaaggagc

SEQ ID NO: 7280021 - DNA, 22 bp, Homo sapiens
tgcccaggctggaatgcagtgg

SEQ ID NO: 7280022 - DNA, 22 bp, Homo sapiens
tgcccaggctggaatgcagtgg

SEQ ID NO: 7280023 - DNA, 22 bp, Homo sapiens
tgcccaggctggagtacagtgg

SEQ ID NO: 7280024 - DNA, 22 bp, Homo sapiens
tgcccaggctggagtgcagagg

SEQ ID NO: 7280025 - DNA, 22 bp, Homo sapiens
tgcccaggattgtgaggtcagg

SEQ ID NO: 7280026 - DNA, 19 bp, Homo sapiens
tgcccaggccaggttgggc

SEQ ID NO: 7280027 - DNA, 22 bp, Homo sapiens
tgcccaggctggagtgcagtgg

SEQ ID NO: 7280028 - DNA, 22 bp, Homo sapiens
tgcccagggataagcctagaga

SEQ ID NO: 7280029 - DNA, 22 bp, Homo sapiens
tgcccagggtggagtgcagtgg

SEQ ID NO: 7280030 - DNA, 22 bp, Homo sapiens
tgcccagggtttctaagagcag

SEQ ID NO: 7280031 - DNA, 20 bp, Homo sapiens
tgccccaggcctgcacctgc

SEQ ID NO: 7280032 - DNA, 22 bp, Homo sapiens
tgccccagacctactgaatggg

SEQ ID NO: 7280033 - DNA, 22 bp, Homo sapiens
tgcccacatggtgccatggcca

SEQ ID NO: 7280034 - DNA, 22 bp, Homo sapiens
tgccatttctttcaatattctt

SEQ ID NO: 7280035 - DNA, 22 bp, Homo sapiens
tgccatggcctagacctgtgat

SEQ ID NO: 7280036 - DNA, 22 bp, Homo sapiens
tgccatggaatcacctccagct

SEQ ID NO: 7280037 - DNA, 22 bp, Homo sapiens
tgccaggccctgtgctggatgc

SEQ ID NO: 7280038 - DNA, 22 bp, Homo sapiens
tgccaggcccagctccagagct

SEQ ID NO: 7280039 - DNA, 20 bp, Homo sapiens
tgccaggcacggagtgcatg

SEQ ID NO: 7280040 - DNA, 22 bp, Homo sapiens
tgccagctcccttttctcctcc

SEQ ID NO: 7280041 - DNA, 22 bp, Homo sapiens
tgccatccaacagttccatctt

SEQ ID NO: 7280042 - DNA, 22 bp, Homo sapiens
tgcattcctttgtctgttaaag

SEQ ID NO: 7280043 - DNA, 22 bp, Homo sapiens
tgccacagttgtttgtgctcta

SEQ ID NO: 7280044 - DNA, 22 bp, Homo sapiens
tgccacaggcaatccctgcacg

SEQ ID NO: 7280045 - DNA, 22 bp, Homo sapiens
tgcagtgtttttcagggcatat

SEQ ID NO: 7280046 - DNA, 22 bp, Homo sapiens
tgcatacacaagcatacatgta

SEQ ID NO: 7280047 - DNA, 22 bp, Homo sapiens
tgcatacataaagtgctatcat

SEQ ID NO: 7280048 - DNA, 22 bp, Homo sapiens
tgcatcatgcggaactggcttt

SEQ ID NO: 7280049 - DNA, 22 bp, Homo sapiens
tgcatgaacggagggtaagctg

SEQ ID NO: 7280050 - DNA, 22 bp, Homo sapiens
tgcatgaaatattttctgtagg

SEQ ID NO: 7280051 - DNA, 22 bp, Homo sapiens
tgcatgaacacatgtgcatgta

SEQ ID NO: 7280052 - DNA, 22 bp, Homo sapiens
tgcatgcatgtgagcatgcata

SEQ ID NO: 7280053 - DNA, 22 bp, Homo sapiens
tgcatggactcatcagacaaga

SEQ ID NO: 7280054 - DNA, 22 bp, Homo sapiens
tgcatgtggacccctggtgcct

SEQ ID NO: 7280055 - DNA, 22 bp, Homo sapiens
tgcatgtggacccctggtgcct

SEQ ID NO: 7280056 - DNA, 23 bp, Homo sapiens
tgcatgtgaattcatacttgttt

SEQ ID NO: 7280057 - DNA, 22 bp, Homo sapiens
tgcatggaggaagatgaatgca

SEQ ID NO: 7280058 - DNA, 22 bp, Homo sapiens
tgcatgttaagaaaatattgag

SEQ ID NO: 7280059 - DNA, 22 bp, Homo sapiens
tgcatgtgtcgggcctgtgcta

SEQ ID NO: 7280060 - DNA, 22 bp, Homo sapiens
tgcatgtgtcgggcctgtgcta

SEQ ID NO: 7280061 - DNA, 22 bp, Homo sapiens
tgcatgtgtttgccacagtgag

SEQ ID NO: 7280062 - DNA, 22 bp, Homo sapiens
tgcaggctggggaggcagactt

SEQ ID NO: 7280063 - DNA, 22 bp, Homo sapiens
tgcaggctgctggcagtagctt

SEQ ID NO: 7280064 - DNA, 22 bp, Homo sapiens
tgcaggctgccttcacagagcc

SEQ ID NO: 7280065 - DNA, 22 bp, Homo sapiens
tgcaggctccatgaggacaggc

SEQ ID NO: 7280066 - DNA, 22 bp, Homo sapiens
tgcaggctctctgctgccagat

SEQ ID NO: 7280067 - DNA, 22 bp, Homo sapiens
tgcaggtctccattggcagact

SEQ ID NO: 7280068 - DNA, 20 bp, Homo sapiens
tgcagtgtggaagactgaga

SEQ ID NO: 7280069 - DNA, 22 bp, Homo sapiens
tgcagagaaaactcctgggtac

SEQ ID NO: 7280070 - DNA, 22 bp, Homo sapiens
tgcagagatcctggactgagcg

SEQ ID NO: 7280071 - DNA, 22 bp, Homo sapiens
tgcagagatctgggcgtcggct

SEQ ID NO: 7280072 - DNA, 22 bp, Homo sapiens
tgcagagattgaacaagaagga

SEQ ID NO: 7280073 - DNA, 22 bp, Homo sapiens
tgcagaggaccattgtcctgga

SEQ ID NO: 7280074 - DNA, 22 bp, Homo sapiens
tgcagaggagtcagcctgggca

SEQ ID NO: 7280075 - DNA, 22 bp, Homo sapiens
tgcagaggagctggaaggctgg

SEQ ID NO: 7280076 - DNA, 22 bp, Homo sapiens
tgcagaggcgccgtgggtgggg

SEQ ID NO: 7280077 - DNA, 22 bp, Homo sapiens
tgcagaggctggctcgccgggt

SEQ ID NO: 7280078 - DNA, 23 bp, Homo sapiens
tgcagaggcatgatcactgctca

SEQ ID NO: 7280079 - DNA, 22 bp, Homo sapiens
tgcagaggcatttattgatgta

SEQ ID NO: 7280080 - DNA, 22 bp, Homo sapiens
tgcagaggcccagcggttcttc

SEQ ID NO: 7280081 - DNA, 21 bp, Homo sapiens
tgcagaggcacaaacaagccc

SEQ ID NO: 7280082 - DNA, 22 bp, Homo sapiens
tgcagattcaaatgaaatgcaa

SEQ ID NO: 7280083 - DNA, 20 bp, Homo sapiens
tgcagcagaagcccatgctc

SEQ ID NO: 7280084 - DNA, 21 bp, Homo sapiens
tgcagcagaagtctctgtgtc

SEQ ID NO: 7280085 - DNA, 22 bp, Homo sapiens
tgcagcagaatatggctgcagg

SEQ ID NO: 7280086 - DNA, 22 bp, Homo sapiens
tgcagcagaagtgttcttctct

SEQ ID NO: 7280087 - DNA, 19 bp, Homo sapiens
tgcagagggtaggaaggcc

SEQ ID NO: 7280088 - DNA, 23 bp, Homo sapiens
tgcagagggactgaagccagctt

SEQ ID NO: 7280089 - DNA, 22 bp, Homo sapiens
tgcagagggagtgacggttcac

SEQ ID NO: 7280090 - DNA, 22 bp, Homo sapiens
tgcagagggacagccacagctc

SEQ ID NO: 7280091 - DNA, 22 bp, Homo sapiens
tgcagagggaaaaggtgctcct

SEQ ID NO: 7280092 - DNA, 22 bp, Homo sapiens
tgcaccctcatcagtcaaatgg

SEQ ID NO: 7280093 - DNA, 21 bp, Homo sapiens
tgcacctgttcactgcagttc

SEQ ID NO: 7280094 - DNA, 22 bp, Homo sapiens
tgcacgtgtgagcattcacatg

SEQ ID NO: 7280095 - DNA, 22 bp, Homo sapiens
tgcagaagaatgtaggcataag

SEQ ID NO: 7280096 - DNA, 22 bp, Homo sapiens
tgcagaagacacaaggtaacgt

SEQ ID NO: 7280097 - DNA, 22 bp, Homo sapiens
tgcagaagaaaacagctgtgtg

SEQ ID NO: 7280098 - DNA, 22 bp, Homo sapiens
tgcagaaggaggaggaaatcca

SEQ ID NO: 7280099 - DNA, 22 bp, Homo sapiens
tgcagaagatggtctgagcacc

SEQ ID NO: 7280100 - DNA, 22 bp, Homo sapiens
tgcagctctgtatgctgattat

SEQ ID NO: 7280101 - DNA, 22 bp, Homo sapiens
tgcagctcctctggctgcctga

SEQ ID NO: 7280102 - DNA, 22 bp, Homo sapiens
tgcagcagacataatgtggatt

SEQ ID NO: 7280103 - DNA, 22 bp, Homo sapiens
tgcagcagactgagtatgagaa

SEQ ID NO: 7280104 - DNA, 21 bp, Homo sapiens
tgcagcagatttgggggaaga

SEQ ID NO: 7280105 - DNA, 21 bp, Homo sapiens
tgcagcagagtaagcagggga

SEQ ID NO: 7280106 - DNA, 22 bp, Homo sapiens
tgcagcagagtgggcctgggtg

SEQ ID NO: 7280107 - DNA, 22 bp, Homo sapiens
tgcagcagggcccaggcacaga

SEQ ID NO: 7280108 - DNA, 22 bp, Homo sapiens
tgcagcagggacctctatgtga

SEQ ID NO: 7280109 - DNA, 22 bp, Homo sapiens
tgcagcaggagccaggcctggt

SEQ ID NO: 7280110 - DNA, 22 bp, Homo sapiens
tgcagcaggcacaggacggaag

SEQ ID NO: 7280111 - DNA, 22 bp, Homo sapiens
tgcagcagccaaggttctgtgc

SEQ ID NO: 7280112 - DNA, 22 bp, Homo sapiens
tgcagcagcagggaggaggctc

SEQ ID NO: 7280113 - DNA, 22 bp, Homo sapiens
tgcagcagcctcatctggtttc

SEQ ID NO: 7280114 - DNA, 22 bp, Homo sapiens
tgcagcagctccaggttaccct

SEQ ID NO: 7280115 - DNA, 19 bp, Homo sapiens
tgcagccacgtgagagact

SEQ ID NO: 7280116 - DNA, 23 bp, Homo sapiens
tgcagcagggtggtctacttctc

SEQ ID NO: 7280117 - DNA, 22 bp, Homo sapiens
tgcaggaactgggagggatagt

SEQ ID NO: 7280118 - DNA, 22 bp, Homo sapiens
tgcaggaaattccagggtggcc

SEQ ID NO: 7280119 - DNA, 22 bp, Homo sapiens
tgcaggaaattccagggtggcc

SEQ ID NO: 7280120 - DNA, 22 bp, Homo sapiens
tgatatggaaggaagatgtaca

SEQ ID NO: 7280121 - DNA, 22 bp, Homo sapiens
tgatatggctaaagaaagtttc

SEQ ID NO: 7280122 - DNA, 17 bp, Homo sapiens
tgatagttcattttaag

SEQ ID NO: 7280123 - DNA, 22 bp, Homo sapiens
tgatcccaatctttcctgctcc

SEQ ID NO: 7280124 - DNA, 23 bp, Homo sapiens
tgagtgtgttccctgtgagattt

SEQ ID NO: 7280125 - DNA, 22 bp, Homo sapiens
tgagtgggttatcaggaaaggt

SEQ ID NO: 7280126 - DNA, 22 bp, Homo sapiens
tgagtgaggtgcttagggcaca

SEQ ID NO: 7280127 - DNA, 22 bp, Homo sapiens
tgagtgctctgtatgtgccaga

SEQ ID NO: 7280128 - DNA, 20 bp, Homo sapiens
tgagtgctccattctgccca

SEQ ID NO: 7280129 - DNA, 22 bp, Homo sapiens
tgatggttttattaataggacc

SEQ ID NO: 7280130 - DNA, 22 bp, Homo sapiens
tgattccactctgaggatcgta

SEQ ID NO: 7280131 - DNA, 22 bp, Homo sapiens
tgattcatcagaataggagttt

SEQ ID NO: 7280132 - DNA, 21 bp, Homo sapiens
tgattctgcatttctaacagg

SEQ ID NO: 7280133 - DNA, 21 bp, Homo sapiens
tgattctgttttatcatcagc

SEQ ID NO: 7280134 - DNA, 22 bp, Homo sapiens
tgattctgtaaacatgtcttta

SEQ ID NO: 7280135 - DNA, 22 bp, Homo sapiens
tgatttaaaagaaacattgtct

SEQ ID NO: 7280136 - DNA, 22 bp, Homo sapiens
tgatgcccccaaatctggctca

SEQ ID NO: 7280137 - DNA, 22 bp, Homo sapiens
tgatggtcaggatgcatggaga

SEQ ID NO: 7280138 - DNA, 22 bp, Homo sapiens
tgcaagaaggcaataaactctt

SEQ ID NO: 7280139 - DNA, 17 bp, Homo sapiens
tgcaagaagattaggaa

SEQ ID NO: 7280140 - DNA, 22 bp, Homo sapiens
tgcaagaaatgtgaagctacaa

SEQ ID NO: 7280141 - DNA, 22 bp, Homo sapiens
tgcaagaaaggtggggccaggc

SEQ ID NO: 7280142 - DNA, 22 bp, Homo sapiens
tgcaagaaacatattccacaag

SEQ ID NO: 7280143 - DNA, 22 bp, Homo sapiens
tgcaagaagtcctctctgggtg

SEQ ID NO: 7280144 - DNA, 21 bp, Homo sapiens
tgcaagaatcaggaagctgcc

SEQ ID NO: 7280145 - DNA, 22 bp, Homo sapiens
tgcaagaatgacccatctaccc

SEQ ID NO: 7280146 - DNA, 22 bp, Homo sapiens
tgcaagaattgtataccctcat

SEQ ID NO: 7280147 - DNA, 22 bp, Homo sapiens
tgcaagagacatgggttgtgtg

SEQ ID NO: 7280148 - DNA, 22 bp, Homo sapiens
tgcaagagcccagggccaggaa

SEQ ID NO: 7280149 - DNA, 22 bp, Homo sapiens
tgcaaggctattcacatgtatt

SEQ ID NO: 7280150 - DNA, 20 bp, Homo sapiens
tgcaatgtccatgttccagg

SEQ ID NO: 7280151 - DNA, 22 bp, Homo sapiens
tgatttcctaggtctggagaag

SEQ ID NO: 7280152 - DNA, 22 bp, Homo sapiens
tgcaaagatgaaatattaaagg

SEQ ID NO: 7280153 - DNA, 22 bp, Homo sapiens
tgcaaagatatgagaagctgta

SEQ ID NO: 7280154 - DNA, 20 bp, Homo sapiens
tgcaaacacagagtgtatga

SEQ ID NO: 7280155 - DNA, 22 bp, Homo sapiens
tgcaaacacttcaacgtgcatc

SEQ ID NO: 7280156 - DNA, 22 bp, Homo sapiens
tgcaaacatccgactgaaagcc

SEQ ID NO: 7280157 - DNA, 22 bp, Homo sapiens
tctaattttaggcatttgttca

SEQ ID NO: 7280158 - DNA, 22 bp, Homo sapiens
tctaacctttgaaactgctttc

SEQ ID NO: 7280159 - DNA, 22 bp, Homo sapiens
tctacccagagctatgacctga

SEQ ID NO: 7280160 - DNA, 22 bp, Homo sapiens
tctagaaacaggtttctagaaa

SEQ ID NO: 7280161 - DNA, 22 bp, Homo sapiens
tctagctctgcttatcatggct

SEQ ID NO: 7280162 - DNA, 22 bp, Homo sapiens
tctatgcttgagacagatgggg

SEQ ID NO: 7280163 - DNA, 22 bp, Homo sapiens
tctatgtgccctttgtgtgatg

SEQ ID NO: 7280164 - DNA, 19 bp, Homo sapiens
tctatgtggcagtgatggc

SEQ ID NO: 7280165 - DNA, 22 bp, Homo sapiens
tctagttctagatccctgagga

SEQ ID NO: 7280166 - DNA, 22 bp, Homo sapiens
tctagggttgaggccacaggga

SEQ ID NO: 7280167 - DNA, 22 bp, Homo sapiens
tctagggaggcaatagcaatgt

SEQ ID NO: 7280168 - DNA, 22 bp, Homo sapiens
tctcaaatggcaaatgtgggtc

SEQ ID NO: 7280169 - DNA, 22 bp, Homo sapiens
tctcaaatggacaatattgtgg

SEQ ID NO: 7280170 - DNA, 23 bp, Homo sapiens
tctcaaatctttgcgttgtatct

SEQ ID NO: 7280171 - DNA, 22 bp, Homo sapiens
tctcaaatcaaactttgagctt

SEQ ID NO: 7280172 - DNA, 22 bp, Homo sapiens
tctcacagctctgctgcatgct

SEQ ID NO: 7280173 - DNA, 19 bp, Homo sapiens
tctcacagctctactatgt

SEQ ID NO: 7280174 - DNA, 22 bp, Homo sapiens
tctcacagggctaggccctgcc

SEQ ID NO: 7280175 - DNA, 22 bp, Homo sapiens
tctcacagccatttctccctct

SEQ ID NO: 7280176 - DNA, 22 bp, Homo sapiens
tctatttctgggtttgtgtggt

SEQ ID NO: 7280177 - DNA, 22 bp, Homo sapiens
tctcaaactaacaatgattata

SEQ ID NO: 7280178 - DNA, 22 bp, Homo sapiens
tctcaaatatttggagagagga

SEQ ID NO: 7280179 - DNA, 23 bp, Homo sapiens
tctcaaatatgatctgggtcatc

SEQ ID NO: 7280180 - DNA, 22 bp, Homo sapiens
tctcaaataggccttggtcctg

SEQ ID NO: 7280181 - DNA, 22 bp, Homo sapiens
tccttagacaaagagtgggctt

SEQ ID NO: 7280182 - DNA, 22 bp, Homo sapiens
tccttagacaaagagtgggctt

SEQ ID NO: 7280183 - DNA, 22 bp, Homo sapiens
tccttaggtatttagcatgaat

SEQ ID NO: 7280184 - DNA, 22 bp, Homo sapiens
tccttcaagtgcagtacctgag

SEQ ID NO: 7280185 - DNA, 22 bp, Homo sapiens
tccttcaactttttacttgccc

SEQ ID NO: 7280186 - DNA, 22 bp, Homo sapiens
tccttcaaagctcctagtgagc

SEQ ID NO: 7280187 - DNA, 22 bp, Homo sapiens
tccttcaaaagttgagagagcc

SEQ ID NO: 7280188 - DNA, 22 bp, Homo sapiens
tccttcaggcctcattctcata

SEQ ID NO: 7280189 - DNA, 22 bp, Homo sapiens
tccttcagctactcagtttcca

SEQ ID NO: 7280190 - DNA, 22 bp, Homo sapiens
tccttggaggtgttcatctgcc

SEQ ID NO: 7280191 - DNA, 21 bp, Homo sapiens
tccttgctattttcctcagct

SEQ ID NO: 7280192 - DNA, 21 bp, Homo sapiens
tccttgctattttcctcagct

SEQ ID NO: 7280193 - DNA, 22 bp, Homo sapiens
tccttctttgacaagtggcaga

SEQ ID NO: 7280194 - DNA, 22 bp, Homo sapiens
tccttctttgacaagtggcaga

SEQ ID NO: 7280195 - DNA, 22 bp, Homo sapiens
tccttctttccccctagtcatt

SEQ ID NO: 7280196 - DNA, 22 bp, Homo sapiens
tccttctttccccctagtcatt

SEQ ID NO: 7280197 - DNA, 22 bp, Homo sapiens
tccttctctacaaatccaggca

SEQ ID NO: 7280198 - DNA, 22 bp, Homo sapiens
tcgtgatctgtccacctcggcc

SEQ ID NO: 7280199 - DNA, 22 bp, Homo sapiens
tcgcccaggctggaagtgcagt

SEQ ID NO: 7280200 - DNA, 22 bp, Homo sapiens
tctaaagaagagggttctgcgg

SEQ ID NO: 7280201 - DNA, 22 bp, Homo sapiens
tctaaacactaagtcttgatgc

SEQ ID NO: 7280202 - DNA, 22 bp, Homo sapiens
tctaaacagtttcactcttaat

SEQ ID NO: 7280203 - DNA, 22 bp, Homo sapiens
tcgaactcatagtcgtagctgt

SEQ ID NO: 7280204 - DNA, 22 bp, Homo sapiens
tcgagctctggagccaaggatg

SEQ ID NO: 7280205 - DNA, 22 bp, Homo sapiens
tcgagctctggagccaaggatg

SEQ ID NO: 7280206 - DNA, 22 bp, Homo sapiens
tcgatagaaaagagctgcaggg

SEQ ID NO: 7280207 - DNA, 22 bp, Homo sapiens
tcgatagaatatactagctgtg

SEQ ID NO: 7280208 - DNA, 22 bp, Homo sapiens
tcctggctcctggagacctgct

SEQ ID NO: 7280209 - DNA, 22 bp, Homo sapiens
tcctggctctaagtcctgagtg

SEQ ID NO: 7280210 - DNA, 22 bp, Homo sapiens
tcctggctctgctgcctcctag

SEQ ID NO: 7280211 - DNA, 17 bp, Homo sapiens
tcctggctctgccactg

SEQ ID NO: 7280212 - DNA, 22 bp, Homo sapiens
taagaattatctcatggataat

SEQ ID NO: 7280213 - DNA, 22 bp, Homo sapiens
taagaattgtgttgaatagagt

SEQ ID NO: 7280214 - DNA, 22 bp, Homo sapiens
tcctgcttccttgtctttagac

SEQ ID NO: 7280215 - DNA, 22 bp, Homo sapiens
taagaacttcggacatgttatc

SEQ ID NO: 7280216 - DNA, 22 bp, Homo sapiens
taagaacagtagaacagtaggt

SEQ ID NO: 7280217 - DNA, 22 bp, Homo sapiens
taagaacagtgacagccaacat

SEQ ID NO: 7280218 - DNA, 22 bp, Homo sapiens
taagaacagtgtctgtctcaca

SEQ ID NO: 7280219 - DNA, 22 bp, Homo sapiens
taagaacagtgtttcatctcta

SEQ ID NO: 7280220 - DNA, 22 bp, Homo sapiens
tcctggtgggacagaaaacctc

SEQ ID NO: 7280221 - DNA, 22 bp, Homo sapiens
tcctggtggtctgtgcttcttc

SEQ ID NO: 7280222 - DNA, 22 bp, Homo sapiens
tcctggtggtgccagctgcagg

SEQ ID NO: 7280223 - DNA, 22 bp, Homo sapiens
tcctggtggtgccggtgcccgg

SEQ ID NO: 7280224 - DNA, 22 bp, Homo sapiens
tcctggtggtttgaaaactgaa

SEQ ID NO: 7280225 - DNA, 22 bp, Homo sapiens
tcctggtgtaatggtaagcatg

SEQ ID NO: 7280226 - DNA, 22 bp, Homo sapiens
tcctggtgtttatgtcacatag

SEQ ID NO: 7280227 - DNA, 22 bp, Homo sapiens
tcctggtgttactaaattgaaa

SEQ ID NO: 7280228 - DNA, 22 bp, Homo sapiens
tcctggtgtcgcctggtcagtt

SEQ ID NO: 7280229 - DNA, 22 bp, Homo sapiens
tcctggtgtcctggtctgctag

SEQ ID NO: 7280230 - DNA, 22 bp, Homo sapiens
tcctggtggcagattttaggtc

SEQ ID NO: 7280231 - DNA, 22 bp, Homo sapiens
tcctggtggctctttgggaagg

SEQ ID NO: 7280232 - DNA, 22 bp, Homo sapiens
tcctggtggctttccctgcctt

SEQ ID NO: 7280233 - DNA, 22 bp, Homo sapiens
tcctggcttcctgctcttgtca

SEQ ID NO: 7280234 - DNA, 22 bp, Homo sapiens
tcctggcttctgtctccttatt

SEQ ID NO: 7280235 - DNA, 22 bp, Homo sapiens
tcctggcttccactcctctgtt

SEQ ID NO: 7280236 - DNA, 22 bp, Homo sapiens
tcctggcttaggtttccagaac

SEQ ID NO: 7280237 - DNA, 22 bp, Homo sapiens
tcctggctgccgtcgtcctgcg

SEQ ID NO: 7280238 - DNA, 22 bp, Homo sapiens
tcctggctgagttcccaagtcg

SEQ ID NO: 7280239 - DNA, 21 bp, Homo sapiens
tcctggctttatgctacctct

SEQ ID NO: 7280240 - DNA, 22 bp, Homo sapiens
tctctggaagcgcagatctgtt

SEQ ID NO: 7280241 - DNA, 22 bp, Homo sapiens
tctctgcttggtgtatgtgagt

SEQ ID NO: 7280242 - DNA, 21 bp, Homo sapiens
tctctggaattagaccatgtt

SEQ ID NO: 7280243 - DNA, 22 bp, Homo sapiens
tctctgctcaggcaccagccct

SEQ ID NO: 7280244 - DNA, 22 bp, Homo sapiens
tctctgctctgtgcctcagttt

SEQ ID NO: 7280245 - DNA, 20 bp, Homo sapiens
tctctgctgtccacatttgc

SEQ ID NO: 7280246 - DNA, 16 bp, Homo sapiens
tctctgcttcataggt

SEQ ID NO: 7280247 - DNA, 22 bp, Homo sapiens
tctctgggggtagaactcaggc

SEQ ID NO: 7280248 - DNA, 22 bp, Homo sapiens
tctctgggtattcactgccttc

SEQ ID NO: 7280249 - DNA, 22 bp, Homo sapiens
tctctctgccaactcacagcca

SEQ ID NO: 7280250 - DNA, 22 bp, Homo sapiens
tctctctttttaatcatgtaat

SEQ ID NO: 7280251 - DNA, 22 bp, Homo sapiens
tctctcagggggaaggctgaag

SEQ ID NO: 7280252 - DNA, 22 bp, Homo sapiens
tctctcatagagaaaaatatat

SEQ ID NO: 7280253 - DNA, 22 bp, Homo sapiens
tctctccaacatggtggtgctg

SEQ ID NO: 7280254 - DNA, 18 bp, Homo sapiens
tctctccatctatttgtt

SEQ ID NO: 7280255 - DNA, 22 bp, Homo sapiens
tctctcagatggggcactagta

SEQ ID NO: 7280256 - DNA, 22 bp, Homo sapiens
tctctcaggctggagtgcagtg

SEQ ID NO: 7280257 - DNA, 22 bp, Homo sapiens
tctctcagaggaagaggcagtg

SEQ ID NO: 7280258 - DNA, 19 bp, Homo sapiens
tctctcaattgcttcaatt

SEQ ID NO: 7280259 - DNA, 22 bp, Homo sapiens
tctctctaggcatctattttca

SEQ ID NO: 7280260 - DNA, 22 bp, Homo sapiens
tctgaaatgcaaatttgactga

SEQ ID NO: 7280261 - DNA, 22 bp, Homo sapiens
tctgaactccagccctgctctc

SEQ ID NO: 7280262 - DNA, 22 bp, Homo sapiens
tctgaagagaatgctgctgaac

SEQ ID NO: 7280263 - DNA, 22 bp, Homo sapiens
tctgaaagaagggcagtctttt

SEQ ID NO: 7280264 - DNA, 22 bp, Homo sapiens
tctctttaagtataatcttata

SEQ ID NO: 7280265 - DNA, 23 bp, Homo sapiens
tctctttcaagagcttaatgtgc

SEQ ID NO: 7280266 - DNA, 22 bp, Homo sapiens
tctctttactttcaccaatttg

SEQ ID NO: 7280267 - DNA, 22 bp, Homo sapiens
tctcttctttggggtgggctca

SEQ ID NO: 7280268 - DNA, 22 bp, Homo sapiens
tctctttctttgtatgtctatt

SEQ ID NO: 7280269 - DNA, 17 bp, Homo sapiens
tctctttccctttctgc

SEQ ID NO: 7280270 - DNA, 17 bp, Homo sapiens
tctctttccctttctgc

SEQ ID NO: 7280271 - DNA, 22 bp, Homo sapiens
tctctttctatatgtgagtctt

SEQ ID NO: 7280272 - DNA, 22 bp, Homo sapiens
tctcttccttgacctattgtaa

SEQ ID NO: 7280273 - DNA, 22 bp, Homo sapiens
tctcttccagtggctttgattt

SEQ ID NO: 7280274 - DNA, 19 bp, Homo sapiens
tctcttctccctggtttta

SEQ ID NO: 7280275 - DNA, 22 bp, Homo sapiens
tctcttctaattagggtccatg

SEQ ID NO: 7280276 - DNA, 22 bp, Homo sapiens
tctcttctagcttcttgtggtt

SEQ ID NO: 7280277 - DNA, 18 bp, Homo sapiens
tctcttcttggcagtcaa

SEQ ID NO: 7280278 - DNA, 22 bp, Homo sapiens
tctctgtcacacaatctacaca

SEQ ID NO: 7280279 - DNA, 22 bp, Homo sapiens
tctctgtccctaggagccttgc

SEQ ID NO: 7280280 - DNA, 22 bp, Homo sapiens
tctctgtccctaggagccttgc

SEQ ID NO: 7280281 - DNA, 22 bp, Homo sapiens
tctctgtctcccgtgtgtccgg

SEQ ID NO: 7280282 - DNA, 22 bp, Homo sapiens
tctctgtctgcacccaatcaat

SEQ ID NO: 7280283 - DNA, 22 bp, Homo sapiens
tctctgtctttgttgtcttcac

SEQ ID NO: 7280284 - DNA, 22 bp, Homo sapiens
tctctgtctgagcctggcagac

SEQ ID NO: 7280285 - DNA, 22 bp, Homo sapiens
tctctgtggcaagcatgctgct

SEQ ID NO: 7280286 - DNA, 19 bp, Homo sapiens
tctccaggtgccccaaaca

SEQ ID NO: 7280287 - DNA, 22 bp, Homo sapiens
tctccaggtggggtcacctttt

SEQ ID NO: 7280288 - DNA, 22 bp, Homo sapiens
tctccaggtaaatggcatcctg

SEQ ID NO: 7280289 - DNA, 22 bp, Homo sapiens
tctccaggcctttcccatctta

SEQ ID NO: 7280290 - DNA, 22 bp, Homo sapiens
tctccttgctacccagtatgtc

SEQ ID NO: 7280291 - DNA, 22 bp, Homo sapiens
tctcgatctcctgaccttgtga

SEQ ID NO: 7280292 - DNA, 22 bp, Homo sapiens
tctcgctctgtcgcccaggctg

SEQ ID NO: 7280293 - DNA, 22 bp, Homo sapiens
tctcgctctgtcgcccaggctg

SEQ ID NO: 7280294 - DNA, 22 bp, Homo sapiens
tctcgctctgtcgcccaggctg

SEQ ID NO: 7280295 - DNA, 19 bp, Homo sapiens
tctccaaaaccaatcacta

SEQ ID NO: 7280296 - DNA, 22 bp, Homo sapiens
tctccaggagcaagtcacccag

SEQ ID NO: 7280297 - DNA, 23 bp, Homo sapiens
tctcagggtggctgggcccatcc

SEQ ID NO: 7280298 - DNA, 22 bp, Homo sapiens
tctcaggtggcccccatgagtg

SEQ ID NO: 7280299 - DNA, 22 bp, Homo sapiens
tctcaggtctcatgccaggcct

SEQ ID NO: 7280300 - DNA, 22 bp, Homo sapiens
tctcagggcgcagtgaggcagt

SEQ ID NO: 7280301 - DNA, 22 bp, Homo sapiens
tctcagagttcctctggagtcc

SEQ ID NO: 7280302 - DNA, 22 bp, Homo sapiens
tctcagagggaaacatgagtga

SEQ ID NO: 7280303 - DNA, 22 bp, Homo sapiens
tctcagctgactgctttcctcg

SEQ ID NO: 7280304 - DNA, 22 bp, Homo sapiens
tctcacagttgtcccttgtgag

SEQ ID NO: 7280305 - DNA, 22 bp, Homo sapiens
tctcagagaggggccgggcctt

SEQ ID NO: 7280306 - DNA, 19 bp, Homo sapiens
tctcagagccctagaggcc

SEQ ID NO: 7280307 - DNA, 23 bp, Homo sapiens
tctcagaggattcctgggccttg

SEQ ID NO: 7280308 - DNA, 18 bp, Homo sapiens
tcttccaacactgacacc

SEQ ID NO: 7280309 - DNA, 22 bp, Homo sapiens
tcttccaaggttgcacactatc

SEQ ID NO: 7280310 - DNA, 22 bp, Homo sapiens
tcttcagctctgaggctctggc

SEQ ID NO: 7280311 - DNA, 22 bp, Homo sapiens
tcttcatgccaaatgagttttg

SEQ ID NO: 7280312 - DNA, 23 bp, Homo sapiens
tcttcatgcccaggccttggtgc

SEQ ID NO: 7280313 - DNA, 22 bp, Homo sapiens
tcttcatggtctggttctccag

SEQ ID NO: 7280314 - DNA, 22 bp, Homo sapiens
tcttcatgttgcttattctggg

SEQ ID NO: 7280315 - DNA, 22 bp, Homo sapiens
tcttcaattagatttaccaatt

SEQ ID NO: 7280316 - DNA, 22 bp, Homo sapiens
tcttcacaaagctgttgttaaa

SEQ ID NO: 7280317 - DNA, 22 bp, Homo sapiens
tcttcaagttccaaagtgcagg

SEQ ID NO: 7280318 - DNA, 22 bp, Homo sapiens
tcttcacatcatgttttttaat

SEQ ID NO: 7280319 - DNA, 22 bp, Homo sapiens
tcttcacaggagcctgcctgcc

SEQ ID NO: 7280320 - DNA, 22 bp, Homo sapiens
tcttcagatggccagttgtccc

SEQ ID NO: 7280321 - DNA, 22 bp, Homo sapiens
tcttcacatggaacatgaagct

SEQ ID NO: 7280322 - DNA, 22 bp, Homo sapiens
tcttcacatgaccttcatgtct

SEQ ID NO: 7280323 - DNA, 22 bp, Homo sapiens
tcttattgtgatgatgaagaac

SEQ ID NO: 7280324 - DNA, 20 bp, Homo sapiens
tcttattgtcttgaggagtt

SEQ ID NO: 7280325 - DNA, 22 bp, Homo sapiens
tcttattggtaatgatggcatt

SEQ ID NO: 7280326 - DNA, 22 bp, Homo sapiens
tcttattggataaaaggaaacc

SEQ ID NO: 7280327 - DNA, 23 bp, Homo sapiens
tcttcctgaactatcaggcacat

SEQ ID NO: 7280328 - DNA, 23 bp, Homo sapiens
tcttcctgaactatcaggcacat

SEQ ID NO: 7280329 - DNA, 22 bp, Homo sapiens
tcttctgttttagattgcatac

SEQ ID NO: 7280330 - DNA, 22 bp, Homo sapiens
tcttcttcctcatttatacata

SEQ ID NO: 7280331 - DNA, 22 bp, Homo sapiens
tcttcttcccatccctcaaatg

SEQ ID NO: 7280332 - DNA, 22 bp, Homo sapiens
tcttctccagtgcttctgcaca

SEQ ID NO: 7280333 - DNA, 22 bp, Homo sapiens
tcttctccagttcatcctacca

SEQ ID NO: 7280334 - DNA, 20 bp, Homo sapiens
tctttagatttatcttatgt

SEQ ID NO: 7280335 - DNA, 22 bp, Homo sapiens
tctttagatgtttagaggaaga

SEQ ID NO: 7280336 - DNA, 22 bp, Homo sapiens
tctttagagttaacaataatga

SEQ ID NO: 7280337 - DNA, 22 bp, Homo sapiens
tctttagagctcagaaatacag

SEQ ID NO: 7280338 - DNA, 22 bp, Homo sapiens
tctttagagcctttcctcccga

SEQ ID NO: 7280339 - DNA, 22 bp, Homo sapiens
tctttagagcacgggaaaaaca

SEQ ID NO: 7280340 - DNA, 22 bp, Homo sapiens
tctttagacatccagtttctct

SEQ ID NO: 7280341 - DNA, 22 bp, Homo sapiens
tctttccatggccacacagtct

SEQ ID NO: 7280342 - DNA, 22 bp, Homo sapiens
tctttccatggccacacagtct

SEQ ID NO: 7280343 - DNA, 22 bp, Homo sapiens
tctttccaaggactctgtagca

SEQ ID NO: 7280344 - DNA, 22 bp, Homo sapiens
tctttatttaagtctgttgtaa

SEQ ID NO: 7280345 - DNA, 22 bp, Homo sapiens
tctttcatgtatatgcaaccta

SEQ ID NO: 7280346 - DNA, 22 bp, Homo sapiens
tctttcctactttattgtgaac

SEQ ID NO: 7280347 - DNA, 22 bp, Homo sapiens
tctttcctaggtgatatgcaat

SEQ ID NO: 7280348 - DNA, 22 bp, Homo sapiens
tctttcctaggtgatatgcaat

SEQ ID NO: 7280349 - DNA, 23 bp, Homo sapiens
tctttagaagaacatcagaaatg

SEQ ID NO: 7280350 - DNA, 22 bp, Homo sapiens
tctttagaaacttttcttcatg

SEQ ID NO: 7280351 - DNA, 23 bp, Homo sapiens
tctttacatactgatgagttctc

SEQ ID NO: 7280352 - DNA, 22 bp, Homo sapiens
tctttacaatctaagcatagtt

SEQ ID NO: 7280353 - DNA, 22 bp, Homo sapiens
tctttaattgtggaagagcagc

SEQ ID NO: 7280354 - DNA, 22 bp, Homo sapiens
tctttaattcagcatgatgcgg

SEQ ID NO: 7280355 - DNA, 22 bp, Homo sapiens
tctttaatgtactttctttcac

SEQ ID NO: 7280356 - DNA, 22 bp, Homo sapiens
tctttaatcataaccaagatgg

SEQ ID NO: 7280357 - DNA, 22 bp, Homo sapiens
tctttaatgtgattgtaattat

SEQ ID NO: 7280358 - DNA, 22 bp, Homo sapiens
tcttggcttctgtatttcctgt

SEQ ID NO: 7280359 - DNA, 22 bp, Homo sapiens
tcttggctgtctttgaagttag

SEQ ID NO: 7280360 - DNA, 22 bp, Homo sapiens
tcttggctgtaccattgactag

SEQ ID NO: 7280361 - DNA, 22 bp, Homo sapiens
tcttggctgctgccaatttact

SEQ ID NO: 7280362 - DNA, 22 bp, Homo sapiens
tcttggcttttcccctatggtc

SEQ ID NO: 7280363 - DNA, 19 bp, Homo sapiens
tcttggctttgtctactgt

SEQ ID NO: 7280364 - DNA, 22 bp, Homo sapiens
tcttgaaggggggcagtgttga

SEQ ID NO: 7280365 - DNA, 19 bp, Homo sapiens
tcttgatgaggtttctcca

SEQ ID NO: 7280366 - DNA, 22 bp, Homo sapiens
tcttggctactttcctgtctgc

SEQ ID NO: 7280367 - DNA, 22 bp, Homo sapiens
tcttggctagtaccttcctgcc

SEQ ID NO: 7280368 - DNA, 22 bp, Homo sapiens
tcttggctatccaagttatcca

SEQ ID NO: 7280369 - DNA, 22 bp, Homo sapiens
tcttggaacttattattgtaga

SEQ ID NO: 7280370 - DNA, 22 bp, Homo sapiens
tcttggaatctccatagagtga

SEQ ID NO: 7280371 - DNA, 22 bp, Homo sapiens
tctgtccagaacgtacatcttg

SEQ ID NO: 7280372 - DNA, 22 bp, Homo sapiens
tctgtccaggcttactatatat

SEQ ID NO: 7280373 - DNA, 22 bp, Homo sapiens
tctgtccctgagagctcaggag

SEQ ID NO: 7280374 - DNA, 23 bp, Homo sapiens
tctgtctgaataatttactcttt

SEQ ID NO: 7280375 - DNA, 22 bp, Homo sapiens
tctgtacttgttagtcttcatg

SEQ ID NO: 7280376 - DNA, 20 bp, Homo sapiens
tctgtacactcatcttctgc

SEQ ID NO: 7280377 - DNA, 22 bp, Homo sapiens
tctgtaaagactccaaaagcca

SEQ ID NO: 7280378 - DNA, 22 bp, Homo sapiens
tctgtaaacaccatgttagagt

SEQ ID NO: 7280379 - DNA, 20 bp, Homo sapiens
tctgtaaagactccagaagc

SEQ ID NO: 7280380 - DNA, 22 bp, Homo sapiens
tctgggtgccctttgctctgtt

SEQ ID NO: 7280381 - DNA, 22 bp, Homo sapiens
tctgggtgccactgtctgtaca

SEQ ID NO: 7280382 - DNA, 22 bp, Homo sapiens
tctgggtgatgaaatgcactgt

SEQ ID NO: 7280383 - DNA, 22 bp, Homo sapiens
tctgggtggctgccaatctgcc

SEQ ID NO: 7280384 - DNA, 22 bp, Homo sapiens
tctgggtgctacaaacagtatt

SEQ ID NO: 7280385 - DNA, 22 bp, Homo sapiens
tctgggtggcttcagaggccac

SEQ ID NO: 7280386 - DNA, 22 bp, Homo sapiens
tctgggtgtagggcctggcaac

SEQ ID NO: 7280387 - DNA, 22 bp, Homo sapiens
tctgggtgtcactcctgcctgc

SEQ ID NO: 7280388 - DNA, 22 bp, Homo sapiens
tctgtgaacatcacattgacag

SEQ ID NO: 7280389 - DNA, 22 bp, Homo sapiens
tctgtctttgtcaggaccagag

SEQ ID NO: 7280390 - DNA, 22 bp, Homo sapiens
tctgtctgcttcacttgcattt

SEQ ID NO: 7280391 - DNA, 22 bp, Homo sapiens
tctgtggctttcttatgttgta

SEQ ID NO: 7280392 - DNA, 22 bp, Homo sapiens
tctgtggcttgggcctgcctgt

SEQ ID NO: 7280393 - DNA, 22 bp, Homo sapiens
tctgtggattttagtgttcatg

SEQ ID NO: 7280394 - DNA, 22 bp, Homo sapiens
tctgtggctgtgctgggccaga

SEQ ID NO: 7280395 - DNA, 22 bp, Homo sapiens
tctgtggcttcctatttcttgg

SEQ ID NO: 7280396 - DNA, 22 bp, Homo sapiens
tctgtggctgttatctttatat

SEQ ID NO: 7280397 - DNA, 22 bp, Homo sapiens
tctgtgctagaggagttggcca

SEQ ID NO: 7280398 - DNA, 22 bp, Homo sapiens
tctgtgctcattcagtcattca

SEQ ID NO: 7280399 - DNA, 22 bp, Homo sapiens
tctgtgctggactgatttcata

SEQ ID NO: 7280400 - DNA, 19 bp, Homo sapiens
tctgtgctgggaggcagca

SEQ ID NO: 7280401 - DNA, 22 bp, Homo sapiens
tctgttcttggtgcagctggga

SEQ ID NO: 7280402 - DNA, 22 bp, Homo sapiens
tctgttgactcctagcagccat

SEQ ID NO: 7280403 - DNA, 22 bp, Homo sapiens
tctgtgtgtgcctgttaatatt

SEQ ID NO: 7280404 - DNA, 22 bp, Homo sapiens
tctgtgtggtagtttcagtgaa

SEQ ID NO: 7280405 - DNA, 22 bp, Homo sapiens
tctgtgtggtagtttcagtgaa

SEQ ID NO: 7280406 - DNA, 22 bp, Homo sapiens
tctgtgtgggatagtttgagga

SEQ ID NO: 7280407 - DNA, 22 bp, Homo sapiens
tcttagcacagctatataagtt

SEQ ID NO: 7280408 - DNA, 22 bp, Homo sapiens
tcttaagcagagaagaagttga

SEQ ID NO: 7280409 - DNA, 22 bp, Homo sapiens
tctgttttcatttgtcttgaga

SEQ ID NO: 7280410 - DNA, 22 bp, Homo sapiens
tcttaaagagcgcaatttgagg

SEQ ID NO: 7280411 - DNA, 22 bp, Homo sapiens
tctgccctcattgctgcctgga

SEQ ID NO: 7280412 - DNA, 22 bp, Homo sapiens
tctgcccttggctctcttgttg

SEQ ID NO: 7280413 - DNA, 22 bp, Homo sapiens
tctgcctgagcagagggaggcc

SEQ ID NO: 7280414 - DNA, 21 bp, Homo sapiens
tctgcctgagactttgctggt

SEQ ID NO: 7280415 - DNA, 21 bp, Homo sapiens
tctgcctgagactttgctggt

SEQ ID NO: 7280416 - DNA, 22 bp, Homo sapiens
tctgcctgagggagctgaggaa

SEQ ID NO: 7280417 - DNA, 22 bp, Homo sapiens
tctgcctgagggagctgaggaa

SEQ ID NO: 7280418 - DNA, 22 bp, Homo sapiens
tctgcctgccagtctggtcctc

SEQ ID NO: 7280419 - DNA, 22 bp, Homo sapiens
tctgcctgcgctcacggggccg

SEQ ID NO: 7280420 - DNA, 22 bp, Homo sapiens
tctgcctgccagtctggtcctc

SEQ ID NO: 7280421 - DNA, 22 bp, Homo sapiens
tctgcctgcagtgtggcagggc

SEQ ID NO: 7280422 - DNA, 22 bp, Homo sapiens
tctgcctgcggctgcaggtggc

SEQ ID NO: 7280423 - DNA, 22 bp, Homo sapiens
tctgcctgctaactcctgcacc

SEQ ID NO: 7280424 - DNA, 22 bp, Homo sapiens
tctgcctgctaactcctgcacc

SEQ ID NO: 7280425 - DNA, 22 bp, Homo sapiens
tctgcctgctaactcctgcacc

SEQ ID NO: 7280426 - DNA, 19 bp, Homo sapiens
tctgcctgcttgtaggggc

SEQ ID NO: 7280427 - DNA, 22 bp, Homo sapiens
tctgcctgcttcttcatagtct

SEQ ID NO: 7280428 - DNA, 22 bp, Homo sapiens
tctgcctgctgcctgggggctc

SEQ ID NO: 7280429 - DNA, 22 bp, Homo sapiens
tctgcctggagagttcttctct

SEQ ID NO: 7280430 - DNA, 22 bp, Homo sapiens
tctgcctggaccctggtgagct

SEQ ID NO: 7280431 - DNA, 22 bp, Homo sapiens
tctgcctgtaatatttggagaa

SEQ ID NO: 7280432 - DNA, 22 bp, Homo sapiens
tctgcctgtacctcttttttgc

SEQ ID NO: 7280433 - DNA, 22 bp, Homo sapiens
tctgcctggctcatggcagtga

SEQ ID NO: 7280434 - DNA, 22 bp, Homo sapiens
tctgcctggctcatggcagtga

SEQ ID NO: 7280435 - DNA, 22 bp, Homo sapiens
tctgcctggattccattctcca

SEQ ID NO: 7280436 - DNA, 22 bp, Homo sapiens
tctgcctggatgatggcagggc

SEQ ID NO: 7280437 - DNA, 22 bp, Homo sapiens
tctgcctggattccattctcca

SEQ ID NO: 7280438 - DNA, 22 bp, Homo sapiens
tctgctcactattacatggaca

SEQ ID NO: 7280439 - DNA, 22 bp, Homo sapiens
tctgctcaggttacctagctag

SEQ ID NO: 7280440 - DNA, 22 bp, Homo sapiens
tctgcctgttgagcctaaggcc

SEQ ID NO: 7280441 - DNA, 22 bp, Homo sapiens
tctgcctgttgctagaatgtca

SEQ ID NO: 7280442 - DNA, 22 bp, Homo sapiens
tctgcctgtgctgtgttttcat

SEQ ID NO: 7280443 - DNA, 22 bp, Homo sapiens
tctgcctgttcaagtcttctag

SEQ ID NO: 7280444 - DNA, 22 bp, Homo sapiens
tctgcaggctctagatgaggtt

SEQ ID NO: 7280445 - DNA, 22 bp, Homo sapiens
tctgcaggaggctggctgcagg

SEQ ID NO: 7280446 - DNA, 22 bp, Homo sapiens
tctgcaggtgttggaagggtca

SEQ ID NO: 7280447 - DNA, 22 bp, Homo sapiens
tctgcatggagaggagatgcta

SEQ ID NO: 7280448 - DNA, 22 bp, Homo sapiens
tctgcatgatgaacaaatgagc

SEQ ID NO: 7280449 - DNA, 22 bp, Homo sapiens
tctgcaggcttggagtggcagc

SEQ ID NO: 7280450 - DNA, 22 bp, Homo sapiens
tctgcagggatgtgaggggtga

SEQ ID NO: 7280451 - DNA, 22 bp, Homo sapiens
tctgcaggcttataggatgggt

SEQ ID NO: 7280452 - DNA, 22 bp, Homo sapiens
tctgcaggctgtacaggaagca

SEQ ID NO: 7280453 - DNA, 21 bp, Homo sapiens
tctgcccacactggccactgc

SEQ ID NO: 7280454 - DNA, 22 bp, Homo sapiens
tctgccaggttgttatgctact

SEQ ID NO: 7280455 - DNA, 22 bp, Homo sapiens
tctgaccacagacaacctgcta

SEQ ID NO: 7280456 - DNA, 22 bp, Homo sapiens
tctgaccaggctggctcagggc

SEQ ID NO: 7280457 - DNA, 23 bp, Homo sapiens
tctgaccatttgacaacatcctg

SEQ ID NO: 7280458 - DNA, 22 bp, Homo sapiens
tctgacttccttttctgatcca

SEQ ID NO: 7280459 - DNA, 22 bp, Homo sapiens
tctgagaacataaattgacttc

SEQ ID NO: 7280460 - DNA, 22 bp, Homo sapiens
tctgagaacatgctttgatcat

SEQ ID NO: 7280461 - DNA, 22 bp, Homo sapiens
tctgagaataaaaattgcattt

SEQ ID NO: 7280462 - DNA, 21 bp, Homo sapiens
tctgatggtagatgagatgtg

SEQ ID NO: 7280463 - DNA, 22 bp, Homo sapiens
tctgaggtgtcacaaggccagg

SEQ ID NO: 7280464 - DNA, 22 bp, Homo sapiens
tctgaggttaatcctgctgcat

SEQ ID NO: 7280465 - DNA, 22 bp, Homo sapiens
tctgaggttactgctttgtaga

SEQ ID NO: 7280466 - DNA, 22 bp, Homo sapiens
tctgaggttccctcaactacct

SEQ ID NO: 7280467 - DNA, 22 bp, Homo sapiens
tctgaggttattgtctgccatt

SEQ ID NO: 7280468 - DNA, 19 bp, Homo sapiens
tctgaggtggaactggggg

SEQ ID NO: 7280469 - DNA, 18 bp, Homo sapiens
tctgaggtggacgaggag

SEQ ID NO: 7280470 - DNA, 17 bp, Homo sapiens
tctgaggtgaggatgca

SEQ ID NO: 7280471 - DNA, 22 bp, Homo sapiens
tctgaggtggggctggagcatt

SEQ ID NO: 7280472 - DNA, 22 bp, Homo sapiens
tctgaggtgtagctgggcttca

SEQ ID NO: 7280473 - DNA, 23 bp, Homo sapiens
tctgaggtggctcttgctttgaa

SEQ ID NO: 7280474 - DNA, 22 bp, Homo sapiens
tctgaggtggacgatggagcct

SEQ ID NO: 7280475 - DNA, 22 bp, Homo sapiens
tctgaggtcagtgctgcagtta

SEQ ID NO: 7280476 - DNA, 22 bp, Homo sapiens
tctgaggtcattccaaggacat

SEQ ID NO: 7280477 - DNA, 22 bp, Homo sapiens
tctgaggtcataaagcaacttt

SEQ ID NO: 7280478 - DNA, 23 bp, Homo sapiens
tctgaggtccaccagtttgcaga

SEQ ID NO: 7280479 - DNA, 22 bp, Homo sapiens
tctgaggtcctactataagtgg

SEQ ID NO: 7280480 - DNA, 22 bp, Homo sapiens
tctgaggtctcatgacttgcat

SEQ ID NO: 7280481 - DNA, 22 bp, Homo sapiens
tctgaggtctatgactttgctt

SEQ ID NO: 7280482 - DNA, 22 bp, Homo sapiens
tctgaggtcctgtgatttctct

SEQ ID NO: 7280483 - DNA, 22 bp, Homo sapiens
tctgcaacagtgccctgtaaat

SEQ ID NO: 7280484 - DNA, 22 bp, Homo sapiens
tctgaggtaccagctggtttat

SEQ ID NO: 7280485 - DNA, 20 bp, Homo sapiens
tctgaggtatgatagggtct

SEQ ID NO: 7280486 - DNA, 22 bp, Homo sapiens
tctgaggtcacagatttcaaga

SEQ ID NO: 7280487 - DNA, 22 bp, Homo sapiens
tctggctgaagcttttgcagct

SEQ ID NO: 7280488 - DNA, 22 bp, Homo sapiens
tctggctgacatcctgtatgag

SEQ ID NO: 7280489 - DNA, 22 bp, Homo sapiens
tctgggaagctggtcctgttct

SEQ ID NO: 7280490 - DNA, 22 bp, Homo sapiens
tctgggaagctgcgtgcctgtt

SEQ ID NO: 7280491 - DNA, 22 bp, Homo sapiens
tctgggaaggctctgcagatat

SEQ ID NO: 7280492 - DNA, 22 bp, Homo sapiens
tctgggaaccagtgcggctggg

SEQ ID NO: 7280493 - DNA, 22 bp, Homo sapiens
tctgggaactgagctcccctag

SEQ ID NO: 7280494 - DNA, 22 bp, Homo sapiens
tctgggaactctgtcatttccc

SEQ ID NO: 7280495 - DNA, 22 bp, Homo sapiens
tctgggaaatgctgttccttgt

SEQ ID NO: 7280496 - DNA, 22 bp, Homo sapiens
tctgggaacagcctggctgtgt

SEQ ID NO: 7280497 - DNA, 22 bp, Homo sapiens
tctgggaacacacgtcacttca

SEQ ID NO: 7280498 - DNA, 22 bp, Homo sapiens
tctgggaagtcctctgtcatgc

SEQ ID NO: 7280499 - DNA, 22 bp, Homo sapiens
tctgggaatgaataagacctgt

SEQ ID NO: 7280500 - DNA, 22 bp, Homo sapiens
tctgggaatttattggcacttt

SEQ ID NO: 7280501 - DNA, 22 bp, Homo sapiens
tctgggatttttgacactgaag

SEQ ID NO: 7280502 - DNA, 22 bp, Homo sapiens
tctgggattttatagacatgct

SEQ ID NO: 7280503 - DNA, 22 bp, Homo sapiens
tctgggatgcaaacagaatctg

SEQ ID NO: 7280504 - DNA, 22 bp, Homo sapiens
tctgggcactgctgagcctgta

SEQ ID NO: 7280505 - DNA, 23 bp, Homo sapiens
tctgggcatatctagtcacatcg

SEQ ID NO: 7280506 - DNA, 22 bp, Homo sapiens
tctgggcagttcggatcctctg

SEQ ID NO: 7280507 - DNA, 21 bp, Homo sapiens
tctgggcagcccagtcctgag

SEQ ID NO: 7280508 - DNA, 22 bp, Homo sapiens
tctgggcagccatgtgcctggc

SEQ ID NO: 7280509 - DNA, 22 bp, Homo sapiens
tctgggcagcagcagctagtag

SEQ ID NO: 7280510 - DNA, 22 bp, Homo sapiens
tctggaccctgggctgtgattt

SEQ ID NO: 7280511 - DNA, 22 bp, Homo sapiens
tctggaaggcttcaaggtctaa

SEQ ID NO: 7280512 - DNA, 22 bp, Homo sapiens
tctggaaggaagagctgagtcc

SEQ ID NO: 7280513 - DNA, 22 bp, Homo sapiens
tctggaagtcccttgatgccag

SEQ ID NO: 7280514 - DNA, 22 bp, Homo sapiens
tctggaaggttggctcccagtt

SEQ ID NO: 7280515 - DNA, 22 bp, Homo sapiens
tctggaaggggatctgtggtca

SEQ ID NO: 7280516 - DNA, 22 bp, Homo sapiens
tctggaagacagtgagcccgct

SEQ ID NO: 7280517 - DNA, 22 bp, Homo sapiens
tctggaaggaacccttagagga

SEQ ID NO: 7280518 - DNA, 22 bp, Homo sapiens
tctggagaagcagtgagagtca

SEQ ID NO: 7280519 - DNA, 22 bp, Homo sapiens
tctggagataagacagacagat

SEQ ID NO: 7280520 - DNA, 22 bp, Homo sapiens
tctggagagtcacagtgccaga

SEQ ID NO: 7280521 - DNA, 22 bp, Homo sapiens
tctgctgaatcagatagctaag

SEQ ID NO: 7280522 - DNA, 22 bp, Homo sapiens
tctgctctagttgcttcctgcc

SEQ ID NO: 7280523 - DNA, 22 bp, Homo sapiens
tctgctctagttgcttcctgcc

SEQ ID NO: 7280524 - DNA, 22 bp, Homo sapiens
tctgctctagttgcttcctgcc

SEQ ID NO: 7280525 - DNA, 22 bp, Homo sapiens
tctgctctccatacttccgcac

SEQ ID NO: 7280526 - DNA, 22 bp, Homo sapiens
tctgctctccatacttccgcac

SEQ ID NO: 7280527 - DNA, 22 bp, Homo sapiens
tctgctctccatacttccgcac

SEQ ID NO: 7280528 - DNA, 17 bp, Homo sapiens
tctgctctgccaatcca

SEQ ID NO: 7280529 - DNA, 22 bp, Homo sapiens
tctgctctgtggcttcagctaa

SEQ ID NO: 7280530 - DNA, 22 bp, Homo sapiens
tctgctgtgatttgctacctgt

SEQ ID NO: 7280531 - DNA, 22 bp, Homo sapiens
ttccaggaaaacagttggaagt

SEQ ID NO: 7280532 - DNA, 22 bp, Homo sapiens
aagccgggcctgagaaatgaca

SEQ ID NO: 7280533 - DNA, 22 bp, Homo sapiens
aaggaagagtctagaacaggca

SEQ ID NO: 7280534 - DNA, 22 bp, Homo sapiens
aaggaggaatttcagggtgaat

SEQ ID NO: 7280535 - DNA, 22 bp, Homo sapiens
aaggaggacacccaggactggg

SEQ ID NO: 7280536 - DNA, 20 bp, Homo sapiens
agccctgtttcctggagaga

SEQ ID NO: 7280537 - DNA, 22 bp, Homo sapiens
acctggacacctgctgtcatct

SEQ ID NO: 7280538 - DNA, 22 bp, Homo sapiens
actgattgcattcatagggttt

SEQ ID NO: 7280539 - DNA, 22 bp, Homo sapiens
atgtccagaggtgagtcagagc

SEQ ID NO: 7280540 - DNA, 22 bp, Homo sapiens
atgtccagggcacacagcagtg

SEQ ID NO: 7280541 - DNA, 22 bp, Homo sapiens
aggaaagctcccagtagggctc

SEQ ID NO: 7280542 - DNA, 22 bp, Homo sapiens
aggaggaagggaagacaagtaa

SEQ ID NO: 7280543 - DNA, 22 bp, Homo sapiens
aggaggataagttagttgggta

SEQ ID NO: 7280544 - DNA, 17 bp, Homo sapiens
aggaggatcagagagta

SEQ ID NO: 7280545 - DNA, 22 bp, Homo sapiens
aggaggaattgacacagaagcc

SEQ ID NO: 7280546 - DNA, 21 bp, Homo sapiens
aggaggagagcttggcctacc

SEQ ID NO: 7280547 - DNA, 22 bp, Homo sapiens
aggaagctgctggagtagtgtg

SEQ ID NO: 7280548 - DNA, 22 bp, Homo sapiens
agggaagaatcactgggatgtt

SEQ ID NO: 7280549 - DNA, 22 bp, Homo sapiens
agtggtgcaaactggggcagct

SEQ ID NO: 7280550 - DNA, 22 bp, Homo sapiens
gagaggaactcccagtgcctgg

SEQ ID NO: 7280551 - DNA, 23 bp, Homo sapiens
atggtccagccagctgcacagga

SEQ ID NO: 7280552 - DNA, 20 bp, Homo sapiens
catttagaaattggcatgga

SEQ ID NO: 7280553 - DNA, 22 bp, Homo sapiens
catttagtctgatatggatgaa

SEQ ID NO: 7280554 - DNA, 22 bp, Homo sapiens
catttatataaaatgtccagaa

SEQ ID NO: 7280555 - DNA, 22 bp, Homo sapiens
caggaagctgtgaaggagacgg

SEQ ID NO: 7280556 - DNA, 22 bp, Homo sapiens
caggaagctgccggtgagcgag

SEQ ID NO: 7280557 - DNA, 23 bp, Homo sapiens
caggaagcagatggggtagaaga

SEQ ID NO: 7280558 - DNA, 22 bp, Homo sapiens
caggaagcacagtgaggagacc

SEQ ID NO: 7280559 - DNA, 22 bp, Homo sapiens
ttccctttgttaaattggaaga

SEQ ID NO: 7280560 - DNA, 22 bp, Homo sapiens
ctggatgcttcctctctgctag

SEQ ID NO: 7280561 - DNA, 22 bp, Homo sapiens
cctggcctggcactccctctgc

SEQ ID NO: 7280562 - DNA, 22 bp, Homo sapiens
cctggcctcctggccttctcat

SEQ ID NO: 7280563 - DNA, 22 bp, Homo sapiens
tgtcccagacataagtggacat

SEQ ID NO: 7280564 - DNA, 22 bp, Homo sapiens
cctggacttgatattctctttc

SEQ ID NO: 7280565 - DNA, 22 bp, Homo sapiens
gaggggagtgtcctccgggccc

SEQ ID NO: 7280566 - DNA, 22 bp, Homo sapiens
gctctgtgttccctccaggctc

SEQ ID NO: 7280567 - DNA, 22 bp, Homo sapiens
ggagaggggaacttgttgcttg

SEQ ID NO: 7280568 - DNA, 22 bp, Homo sapiens
ggaggacggcatgctgggacgt

SEQ ID NO: 7280569 - DNA, 22 bp, Homo sapiens
ggaggaagaggttgttctctca

SEQ ID NO: 7280570 - DNA, 22 bp, Homo sapiens
ggaggaagccctcggtgcccca

SEQ ID NO: 7280571 - DNA, 22 bp, Homo sapiens
ggaggggagatgtttgggctca

SEQ ID NO: 7280572 - DNA, 22 bp, Homo sapiens
ggaggggagtctcccaaagccg

SEQ ID NO: 7280573 - DNA, 22 bp, Homo sapiens
gtgacagagtgagaccttgtct

SEQ ID NO: 7280574 - DNA, 22 bp, Homo sapiens
gtggaggacaaaagaagccttt

SEQ ID NO: 7280575 - DNA, 22 bp, Homo sapiens
gtggaggaaaagaagttgggtg

SEQ ID NO: 7280576 - DNA, 22 bp, Homo sapiens
tcctggcctccgttctctgcat

SEQ ID NO: 7280577 - DNA, 22 bp, Homo sapiens
tcctggcccactcctagcttct

SEQ ID NO: 7280578 - DNA, 22 bp, Homo sapiens
tcctggccaagttactctctgc

SEQ ID NO: 7280579 - DNA, 22 bp, Homo sapiens
tgcacttttatatcactctggc

SEQ ID NO: 7280580 - DNA, 22 bp, Homo sapiens
tgccagggaccctgtcggccct

SEQ ID NO: 7280581 - DNA, 22 bp, Homo sapiens
tgaagccaccgaaccagaagag

SEQ ID NO: 7280582 - DNA, 22 bp, Homo sapiens
tgaagccaatctgccaggcaga

SEQ ID NO: 7280583 - DNA, 21 bp, Homo sapiens
tgactgaggcttcttcacaca

SEQ ID NO: 7280584 - DNA, 22 bp, Homo sapiens
tgaggaagccaaacagctacac

SEQ ID NO: 7280585 - DNA, 22 bp, Homo sapiens
tgaggaagttgatctcatcagt

SEQ ID NO: 7280586 - DNA, 22 bp, Homo sapiens
tgaggaagtggttgtatggttt

SEQ ID NO: 7280587 - DNA, 22 bp, Homo sapiens
tgaggggagaagcagcagcctg

SEQ ID NO: 7280588 - DNA, 22 bp, Homo sapiens
tgaggggaaggcatgataaata

SEQ ID NO: 7280589 - DNA, 22 bp, Homo sapiens
tgaggggagctagcatgccttg

SEQ ID NO: 7280590 - DNA, 22 bp, Homo sapiens
tgctcagtgagtctgtgacagg

SEQ ID NO: 7280591 - DNA, 22 bp, Homo sapiens
tgggaggatctcttgaggccag

SEQ ID NO: 7280592 - DNA, 22 bp, Homo sapiens
tgggaggaatgtcactgagcca

SEQ ID NO: 7280593 - DNA, 22 bp, Homo sapiens
tggtgccattagccctgctgtt

SEQ ID NO: 7280594 - DNA, 22 bp, Homo sapiens
tgtcccagtttatctgggactg

SEQ ID NO: 7280595 - DNA, 22 bp, Homo sapiens
tgtccaggtcagcagcagggac

SEQ ID NO: 7280596 - DNA, 21 bp, Homo sapiens
tgtgacagaggcggtgcctac

SEQ ID NO: 7280597 - DNA, 22 bp, Homo sapiens
tgtctagggagctgctcaggct

SEQ ID NO: 7280598 - DNA, 22 bp, Homo sapiens
tgttgattagtgtttagactta

SEQ ID NO: 7280599 - DNA, 22 bp, Homo sapiens
aagaggaagtctccatggagag

SEQ ID NO: 7280600 - DNA, 22 bp, Homo sapiens
aggaggggttctcgggtgctga

SEQ ID NO: 7280601 - DNA, 22 bp, Homo sapiens
ccaggctgcttagccttatctt

SEQ ID NO: 7280602 - DNA, 22 bp, Homo sapiens
ccatttagtaaggaagaacagc

SEQ ID NO: 7280603 - DNA, 22 bp, Homo sapiens
aggggatggagctggaaggcag

SEQ ID NO: 7280604 - DNA, 20 bp, Homo sapiens
aggatagcatgcaagtgaga

SEQ ID NO: 7280605 - DNA, 22 bp, Homo sapiens
agtgattctttaaagtggtatt

SEQ ID NO: 7280606 - DNA, 21 bp, Homo sapiens
gaaaaccatttgcatcatgag

SEQ ID NO: 7280607 - DNA, 22 bp, Homo sapiens
gacagggaggaaagagactgct

SEQ ID NO: 7280608 - DNA, 22 bp, Homo sapiens
gaggaagccccattgaagccag

SEQ ID NO: 7280609 - DNA, 22 bp, Homo sapiens
ggaggggatttagtagatgcta

SEQ ID NO: 7280610 - DNA, 22 bp, Homo sapiens
ggcgccgcactcggtgcagccg

SEQ ID NO: 7280611 - DNA, 22 bp, Homo sapiens
gtgcaggagcaggagccatgtc

SEQ ID NO: 7280612 - DNA, 22 bp, Homo sapiens
ccaccctggacaggcctctgag

SEQ ID NO: 7280613 - DNA, 22 bp, Homo sapiens
catttcctgtctggaggtcaaa

SEQ ID NO: 7280614 - DNA, 22 bp, Homo sapiens
cagggacagcgggactctgaca

SEQ ID NO: 7280615 - DNA, 22 bp, Homo sapiens
tgctgcctgatgctttctggac

SEQ ID NO: 7280616 - DNA, 22 bp, Homo sapiens
tgctcagggacaatggagaggg

SEQ ID NO: 7280617 - DNA, 22 bp, Homo sapiens
tgctcaggccagccggacagag

SEQ ID NO: 7280618 - DNA, 19 bp, Homo sapiens
tgctcaggccaaggagccc

SEQ ID NO: 7280619 - DNA, 22 bp, Homo sapiens
tgctcaggaggaggctgtgagg

SEQ ID NO: 7280620 - DNA, 22 bp, Homo sapiens
tgctcaggagcttagagcacag

SEQ ID NO: 7280621 - DNA, 22 bp, Homo sapiens
cctgcctgcaccttctctgggg

SEQ ID NO: 7280622 - DNA, 22 bp, Homo sapiens
cgggaggaaaggcgaggctctg

SEQ ID NO: 7280623 - DNA, 22 bp, Homo sapiens
ctctgctggtgaccactgggcc

SEQ ID NO: 7280624 - DNA, 22 bp, Homo sapiens
ctggtgccctgtgtggcaggag

SEQ ID NO: 7280625 - DNA, 22 bp, Homo sapiens
gagacgtggcctttgcctgagc

SEQ ID NO: 7280626 - DNA, 18 bp, Homo sapiens
gaagggagctggaatgca

SEQ ID NO: 7280627 - DNA, 23 bp, Homo sapiens
gaggaaagaatatagatgcaatc

SEQ ID NO: 7280628 - DNA, 20 bp, Homo sapiens
gctgtgccatgaccctcgag

SEQ ID NO: 7280629 - DNA, 22 bp, Homo sapiens
gctgtgcccagctccagctctg

SEQ ID NO: 7280630 - DNA, 22 bp, Homo sapiens
gcggaggaaactgaggcaagag

SEQ ID NO: 7280631 - DNA, 22 bp, Homo sapiens
ggatgctgggagacagcaggca

SEQ ID NO: 7280632 - DNA, 22 bp, Homo sapiens
gtgatgtcacagaataagtgat

SEQ ID NO: 7280633 - DNA, 22 bp, Homo sapiens
gtgattcattcgattagtattt

SEQ ID NO: 7280634 - DNA, 22 bp, Homo sapiens
gttcatttttactttgatctac

SEQ ID NO: 7280635 - DNA, 22 bp, Homo sapiens
tcaggcaggttggctgcaggtc

SEQ ID NO: 7280636 - DNA, 22 bp, Homo sapiens
tcaggcaggaagggaggacttg

SEQ ID NO: 7280637 - DNA, 22 bp, Homo sapiens
ttcctttagggaaatcgtctca

SEQ ID NO: 7280638 - DNA, 22 bp, Homo sapiens
ttccatttattcttgtccagat

SEQ ID NO: 7280639 - DNA, 22 bp, Homo sapiens
ttgccatttcaagtggccactg

SEQ ID NO: 7280640 - DNA, 20 bp, Homo sapiens
aatccattggtctatatgtc

SEQ ID NO: 7280641 - DNA, 22 bp, Homo sapiens
aatccattgctgtgctgccagg

SEQ ID NO: 7280642 - DNA, 22 bp, Homo sapiens
aacagggacaaggatagagaaa

SEQ ID NO: 7280643 - DNA, 22 bp, Homo sapiens
aagaggaactgggggctgagtc

SEQ ID NO: 7280644 - DNA, 22 bp, Homo sapiens
actctgtgtttagtgctgccat

SEQ ID NO: 7280645 - DNA, 22 bp, Homo sapiens
actctgtgccaggcactttggg

SEQ ID NO: 7280646 - DNA, 22 bp, Homo sapiens
actctgtgggtgagcctggaca

SEQ ID NO: 7280647 - DNA, 22 bp, Homo sapiens
actctgtgtgagtagagcctgt

SEQ ID NO: 7280648 - DNA, 22 bp, Homo sapiens
atacagggacatccagtttttc

SEQ ID NO: 7280649 - DNA, 22 bp, Homo sapiens
agggagacacatgaggaagtca

SEQ ID NO: 7280650 - DNA, 22 bp, Homo sapiens
agggagaacagttgcagcagac

SEQ ID NO: 7280651 - DNA, 22 bp, Homo sapiens
agggagaaaattggatgcacaa

SEQ ID NO: 7280652 - DNA, 22 bp, Homo sapiens
agggaaattaatgtgagcaatg

SEQ ID NO: 7280653 - DNA, 22 bp, Homo sapiens
cctggactaaaatcttttctta

SEQ ID NO: 7280654 - DNA, 22 bp, Homo sapiens
gccctgtgagtcatgcggcaga

SEQ ID NO: 7280655 - DNA, 22 bp, Homo sapiens
cttctcctctgagtcctgggag

SEQ ID NO: 7280656 - DNA, 22 bp, Homo sapiens
atgccactgcacttcagcttgg

SEQ ID NO: 7280657 - DNA, 22 bp, Homo sapiens
ggggaggaagctctcagttcca

SEQ ID NO: 7280658 - DNA, 22 bp, Homo sapiens
ccagggaaactttggagtggag

SEQ ID NO: 7280659 - DNA, 22 bp, Homo sapiens
ccagggaagattagaagccact

SEQ ID NO: 7280660 - DNA, 22 bp, Homo sapiens
cccgtgtgtgcgaggctcccgc

SEQ ID NO: 7280661 - DNA, 22 bp, Homo sapiens
caggggagttttatgcaacaga

SEQ ID NO: 7280662 - DNA, 23 bp, Homo sapiens
taggaggagaccgcagtgttacc

SEQ ID NO: 7280663 - DNA, 22 bp, Homo sapiens
taggaggagggcatttgaagta

SEQ ID NO: 7280664 - DNA, 18 bp, Homo sapiens
taggaggatactgagatg

SEQ ID NO: 7280665 - DNA, 22 bp, Homo sapiens
tagaggaactgcctttcttctg

SEQ ID NO: 7280666 - DNA, 22 bp, Homo sapiens
ctctgtgcgggccatggtcagg

SEQ ID NO: 7280667 - DNA, 22 bp, Homo sapiens
ctctgtgccctactgctcagct

SEQ ID NO: 7280668 - DNA, 22 bp, Homo sapiens
ctctgtgccagtctgcactcgg

SEQ ID NO: 7280669 - DNA, 22 bp, Homo sapiens
ctgagcagtctagccaggtgtt

SEQ ID NO: 7280670 - DNA, 22 bp, Homo sapiens
cggggagggcagaggctccctc

SEQ ID NO: 7280671 - DNA, 22 bp, Homo sapiens
gaggatggaggtgtgagctatg

SEQ ID NO: 7280672 - DNA, 22 bp, Homo sapiens
gagctcagcccaaagagcagtg

SEQ ID NO: 7280673 - DNA, 22 bp, Homo sapiens
gagggtggagctccagaatctg

SEQ ID NO: 7280674 - DNA, 22 bp, Homo sapiens
gaccttcttgctgtgtcctaac

SEQ ID NO: 7280675 - DNA, 22 bp, Homo sapiens
ctggtgcctcctctcccaggtc

SEQ ID NO: 7280676 - DNA, 22 bp, Homo sapiens
gctctgtgtccacagctggaaa

SEQ ID NO: 7280677 - DNA, 22 bp, Homo sapiens
gctctgtgggggaaatcctggg

SEQ ID NO: 7280678 - DNA, 18 bp, Homo sapiens
gctctgtgaccttgagca

SEQ ID NO: 7280679 - DNA, 21 bp, Homo sapiens
gctctgtgaaatttcaccagg

SEQ ID NO: 7280680 - DNA, 22 bp, Homo sapiens
gctctgtgcagttcagggacac

SEQ ID NO: 7280681 - DNA, 22 bp, Homo sapiens
gctctgtgccagggctgggcca

SEQ ID NO: 7280682 - DNA, 22 bp, Homo sapiens
gctctgtgcccctgccgtggac

SEQ ID NO: 7280683 - DNA, 22 bp, Homo sapiens
gctctgtggcattcatgggcag

SEQ ID NO: 7280684 - DNA, 22 bp, Homo sapiens
ggaggatgagctacgaggagct

SEQ ID NO: 7280685 - DNA, 23 bp, Homo sapiens
gggagatgggaaatgaaggctct

SEQ ID NO: 7280686 - DNA, 22 bp, Homo sapiens
gtccagaaggaggtcaagttgg

SEQ ID NO: 7280687 - DNA, 22 bp, Homo sapiens
gtgccaggtgctaagctgtgct

SEQ ID NO: 7280688 - DNA, 22 bp, Homo sapiens
gggtggtggcggaggctccagg

SEQ ID NO: 7280689 - DNA, 22 bp, Homo sapiens
ggggaggaagctggaacacggg

SEQ ID NO: 7280690 - DNA, 18 bp, Homo sapiens
gggtggtgtgctcttcgc

SEQ ID NO: 7280691 - DNA, 22 bp, Homo sapiens
ggtggatgctgactgttctgct

SEQ ID NO: 7280692 - DNA, 22 bp, Homo sapiens
gtgttgatgacattttagaaac

SEQ ID NO: 7280693 - DNA, 22 bp, Homo sapiens
taggggaggccaggaagtttta

SEQ ID NO: 7280694 - DNA, 22 bp, Homo sapiens
taggggaggggatcatgtgctg

SEQ ID NO: 7280695 - DNA, 22 bp, Homo sapiens
tcccaggctggcaggcagcagt

SEQ ID NO: 7280696 - DNA, 22 bp, Homo sapiens
tccatttagctggcaaacaatg

SEQ ID NO: 7280697 - DNA, 22 bp, Homo sapiens
tccatttaactgtccccagcac

SEQ ID NO: 7280698 - DNA, 22 bp, Homo sapiens
ttccttgggaaatgctcgttta

SEQ ID NO: 7280699 - DNA, 20 bp, Homo sapiens
ttccttggattgtgtcttga

SEQ ID NO: 7280700 - DNA, 22 bp, Homo sapiens
ttccttggaaattctgacttca

SEQ ID NO: 7280701 - DNA, 22 bp, Homo sapiens
ttcctgggggcagcagtcttga

SEQ ID NO: 7280702 - DNA, 21 bp, Homo sapiens
agcaggtgtaaaggaggaaat

SEQ ID NO: 7280703 - DNA, 18 bp, Homo sapiens
agaggatgcatctaagag

SEQ ID NO: 7280704 - DNA, 22 bp, Homo sapiens
agaggaagtaatcaggacctgc

SEQ ID NO: 7280705 - DNA, 22 bp, Homo sapiens
agaggaaggatgcatatccaaa

SEQ ID NO: 7280706 - DNA, 18 bp, Homo sapiens
aagcagggtccattgtgc

SEQ ID NO: 7280707 - DNA, 22 bp, Homo sapiens
aagcagggtcttcctcagttgg

SEQ ID NO: 7280708 - DNA, 22 bp, Homo sapiens
agaggaaaatgagttccagaat

SEQ ID NO: 7280709 - DNA, 22 bp, Homo sapiens
agaggaagccattgcttactga

SEQ ID NO: 7280710 - DNA, 22 bp, Homo sapiens
cagccagtgtgaccgaggagga

SEQ ID NO: 7280711 - DNA, 22 bp, Homo sapiens
agcgagggaggtctgaggacag

SEQ ID NO: 7280712 - DNA, 22 bp, Homo sapiens
agcaggtggccacgaggaggag

SEQ ID NO: 7280713 - DNA, 22 bp, Homo sapiens
agggctcagccagcctgtgtgc

SEQ ID NO: 7280714 - DNA, 22 bp, Homo sapiens
aggggaggagcttttcttgcct

SEQ ID NO: 7280715 - DNA, 22 bp, Homo sapiens
aggggaaggccagcctgtagag

SEQ ID NO: 7280716 - DNA, 22 bp, Homo sapiens
ctggcccattgccttctctctc

SEQ ID NO: 7280717 - DNA, 22 bp, Homo sapiens
atgatccaaagccacaggggca

SEQ ID NO: 7280718 - DNA, 22 bp, Homo sapiens
cagaggattccctagtgacctg

SEQ ID NO: 7280719 - DNA, 22 bp, Homo sapiens
tccttcctgctctaacattcag

SEQ ID NO: 7280720 - DNA, 22 bp, Homo sapiens
tccatttaggttccactagtta

SEQ ID NO: 7280721 - DNA, 22 bp, Homo sapiens
ccattgtaaattctgtggaagt

SEQ ID NO: 7280722 - DNA, 22 bp, Homo sapiens
tctcagaagtgatcaggatgtt

SEQ ID NO: 7280723 - DNA, 22 bp, Homo sapiens
ctcatttatgtaatgattaagg

SEQ ID NO: 7280724 - DNA, 21 bp, Homo sapiens
ctcatttatttttgtgtccaa

SEQ ID NO: 7280725 - DNA, 22 bp, Homo sapiens
ctcatttatccaaaagccagtt

SEQ ID NO: 7280726 - DNA, 22 bp, Homo sapiens
ctcatttactcatctgcaaaac

SEQ ID NO: 7280727 - DNA, 22 bp, Homo sapiens
ttctctggagagtatcttctta

SEQ ID NO: 7280728 - DNA, 22 bp, Homo sapiens
ttctctggactatttgcactcc

SEQ ID NO: 7280729 - DNA, 22 bp, Homo sapiens
ttcctggcttcatactttgtac

SEQ ID NO: 7280730 - DNA, 22 bp, Homo sapiens
cttcctggctcggtgcctcacc

SEQ ID NO: 7280731 - DNA, 22 bp, Homo sapiens
cttcctgggcaatgttctgctt

SEQ ID NO: 7280732 - DNA, 22 bp, Homo sapiens
ctgggtgagttgatgaaggaga

SEQ ID NO: 7280733 - DNA, 22 bp, Homo sapiens
ctgtgccactgccccaggcctc

SEQ ID NO: 7280734 - DNA, 22 bp, Homo sapiens
gacagggaaacattgaagtgtc

SEQ ID NO: 7280735 - DNA, 22 bp, Homo sapiens
gacagggacacagccagtgagg

SEQ ID NO: 7280736 - DNA, 22 bp, Homo sapiens
gaacagggttgggtgagagagg

SEQ ID NO: 7280737 - DNA, 22 bp, Homo sapiens
gagaaggaggcgaagcgtgtgc

SEQ ID NO: 7280738 - DNA, 22 bp, Homo sapiens
gaggaggaggaagtggaaccca

SEQ ID NO: 7280739 - DNA, 19 bp, Homo sapiens
gaggaggaaaactagtgta

SEQ ID NO: 7280740 - DNA, 22 bp, Homo sapiens
gaggaggaaaccctgttcctct

SEQ ID NO: 7280741 - DNA, 22 bp, Homo sapiens
gaggaggaagttctctgtaggc

SEQ ID NO: 7280742 - DNA, 22 bp, Homo sapiens
gaggcagaggttgcagtgagct

SEQ ID NO: 7280743 - DNA, 22 bp, Homo sapiens
gaggcagaagttgcagtgagca

SEQ ID NO: 7280744 - DNA, 22 bp, Homo sapiens
gtccagaagcagtgcacatcac

SEQ ID NO: 7280745 - DNA, 22 bp, Homo sapiens
gtgagacatcttgggaagtgat

SEQ ID NO: 7280746 - DNA, 22 bp, Homo sapiens
gccctgtggacccaggaactct

SEQ ID NO: 7280747 - DNA, 22 bp, Homo sapiens
gccctgtgctcatgggaacatc

SEQ ID NO: 7280748 - DNA, 22 bp, Homo sapiens
gcaggggagtggatgatggatt

SEQ ID NO: 7280749 - DNA, 19 bp, Homo sapiens
gctcagcagacccagtgct

SEQ ID NO: 7280750 - DNA, 19 bp, Homo sapiens
gctgtgcctctctcctgct

SEQ ID NO: 7280751 - DNA, 22 bp, Homo sapiens
tcaggaaggcttcacacgagtg

SEQ ID NO: 7280752 - DNA, 22 bp, Homo sapiens
tcagggaaattcaagggagatt

SEQ ID NO: 7280753 - DNA, 22 bp, Homo sapiens
tagacagagtgaagacaagtgg

SEQ ID NO: 7280754 - DNA, 22 bp, Homo sapiens
ttcctgtggccttacatctgtg

SEQ ID NO: 7280755 - DNA, 22 bp, Homo sapiens
ttcaattttgcagaggaatgca

SEQ ID NO: 7280756 - DNA, 22 bp, Homo sapiens
tttcattttggttatgccataa

SEQ ID NO: 7280757 - DNA, 22 bp, Homo sapiens
tttcctggaccaactgagattg

SEQ ID NO: 7280758 - DNA, 22 bp, Homo sapiens
tttcctggaagttattcctcat

SEQ ID NO: 7280759 - DNA, 22 bp, Homo sapiens
gggccagagcacagaggatgtt

SEQ ID NO: 7280760 - DNA, 22 bp, Homo sapiens
gggccagacctcttctcaggga

SEQ ID NO: 7280761 - DNA, 20 bp, Homo sapiens
cagacctgcacccacttcga

SEQ ID NO: 7280762 - DNA, 22 bp, Homo sapiens
ggtgagaaagggattcctgttc

SEQ ID NO: 7280763 - DNA, 21 bp, Homo sapiens
cagaggggctagcctggctgc

SEQ ID NO: 7280764 - DNA, 22 bp, Homo sapiens
cagaggcacagcttcttttaat

SEQ ID NO: 7280765 - DNA, 22 bp, Homo sapiens
cacagaggaaatgactttctta

SEQ ID NO: 7280766 - DNA, 20 bp, Homo sapiens
cacaggctatatgagagcca

SEQ ID NO: 7280767 - DNA, 22 bp, Homo sapiens
gctgttctttgcatctctggtg

SEQ ID NO: 7280768 - DNA, 22 bp, Homo sapiens
ggccaagaatgataggctcagt

SEQ ID NO: 7280769 - DNA, 22 bp, Homo sapiens
ggcctgtgagccttagtttata

SEQ ID NO: 7280770 - DNA, 22 bp, Homo sapiens
ggctgccctcgtctactgccca

SEQ ID NO: 7280771 - DNA, 22 bp, Homo sapiens
cagaaaaggaagagctatgtaa

SEQ ID NO: 7280772 - DNA, 23 bp, Homo sapiens
cagaaataaactggtttgtagat

SEQ ID NO: 7280773 - DNA, 22 bp, Homo sapiens
ctttcaaagaccttggcatggg

SEQ ID NO: 7280774 - DNA, 22 bp, Homo sapiens
cttctttactttctagaaataa

SEQ ID NO: 7280775 - DNA, 22 bp, Homo sapiens
atgcacagtaatgagctggttg

SEQ ID NO: 7280776 - DNA, 22 bp, Homo sapiens
atgcacaggacagcctctactc

SEQ ID NO: 7280777 - DNA, 22 bp, Homo sapiens
atgcacaggaagtgtccccatt

SEQ ID NO: 7280778 - DNA, 22 bp, Homo sapiens
atgcacagctgaacactctaaa

SEQ ID NO: 7280779 - DNA, 22 bp, Homo sapiens
atgcacagcagtgagttcagtg

SEQ ID NO: 7280780 - DNA, 22 bp, Homo sapiens
atgcacagatcctggcacttag

SEQ ID NO: 7280781 - DNA, 22 bp, Homo sapiens
atgcacagaacaattttaagag

SEQ ID NO: 7280782 - DNA, 22 bp, Homo sapiens
gacactccagcttttggctcaa

SEQ ID NO: 7280783 - DNA, 22 bp, Homo sapiens
gactggctcactccactcctat

SEQ ID NO: 7280784 - DNA, 22 bp, Homo sapiens
gactggctctatctccttggcg

SEQ ID NO: 7280785 - DNA, 22 bp, Homo sapiens
gactggcttatttcacttagca

SEQ ID NO: 7280786 - DNA, 22 bp, Homo sapiens
atgtgaatgcagttatctataa

SEQ ID NO: 7280787 - DNA, 20 bp, Homo sapiens
atgttgtttactcatagcat

SEQ ID NO: 7280788 - DNA, 22 bp, Homo sapiens
gagagaggcctccatgtactga

SEQ ID NO: 7280789 - DNA, 19 bp, Homo sapiens
atgggaagcggccagcgga

SEQ ID NO: 7280790 - DNA, 22 bp, Homo sapiens
attcatctatgactctaatgtg

SEQ ID NO: 7280791 - DNA, 22 bp, Homo sapiens
attcacaatagcagcttgcatg

SEQ ID NO: 7280792 - DNA, 22 bp, Homo sapiens
gcaccttgggaagcgccagttg

SEQ ID NO: 7280793 - DNA, 22 bp, Homo sapiens
attaggtcatggggaggcccta

SEQ ID NO: 7280794 - DNA, 22 bp, Homo sapiens
attcaaattaagttaattcagc

SEQ ID NO: 7280795 - DNA, 22 bp, Homo sapiens
atttccaggagttgaggtctga

SEQ ID NO: 7280796 - DNA, 22 bp, Homo sapiens
atttcccaatacgctaagtgga

SEQ ID NO: 7280797 - DNA, 22 bp, Homo sapiens
atttctcagtgtgatcaggcct

SEQ ID NO: 7280798 - DNA, 20 bp, Homo sapiens
gcctagggtcacttcagtga

SEQ ID NO: 7280799 - DNA, 22 bp, Homo sapiens
gctgacccctacaggttgtgtt

SEQ ID NO: 7280800 - DNA, 22 bp, Homo sapiens
gctcttgtcaaaaattagttga

SEQ ID NO: 7280801 - DNA, 18 bp, Homo sapiens
gctctttctgtctccagc

SEQ ID NO: 7280802 - DNA, 22 bp, Homo sapiens
atactaaagtatagaacttagt

SEQ ID NO: 7280803 - DNA, 22 bp, Homo sapiens
ctggctcccgttgtccttgaag

SEQ ID NO: 7280804 - DNA, 20 bp, Homo sapiens
ctgcatctgtgacttgcaaa

SEQ ID NO: 7280805 - DNA, 22 bp, Homo sapiens
ctgtggctcaaaatcccatgat

SEQ ID NO: 7280806 - DNA, 22 bp, Homo sapiens
ctgtggctcaattgcctactga

SEQ ID NO: 7280807 - DNA, 22 bp, Homo sapiens
ctgtggctatggtgtacatact

SEQ ID NO: 7280808 - DNA, 22 bp, Homo sapiens
ctgtggctaggattattcctga

SEQ ID NO: 7280809 - DNA, 22 bp, Homo sapiens
ctgtggctcagcacggggtcag

SEQ ID NO: 7280810 - DNA, 22 bp, Homo sapiens
ctgtggctcaggcctgtaagcc

SEQ ID NO: 7280811 - DNA, 22 bp, Homo sapiens
ctgtggctttggggcggaggac

SEQ ID NO: 7280812 - DNA, 22 bp, Homo sapiens
ctgtggctttgtgtctattgta

SEQ ID NO: 7280813 - DNA, 22 bp, Homo sapiens
ctgtggcttttccggggagcct

SEQ ID NO: 7280814 - DNA, 15 bp, Homo sapiens
ctgtggctaacctaa

SEQ ID NO: 7280815 - DNA, 22 bp, Homo sapiens
ctgtggctaataattagtattt

SEQ ID NO: 7280816 - DNA, 22 bp, Homo sapiens
ctgtggctaggaagctgtggga

SEQ ID NO: 7280817 - DNA, 22 bp, Homo sapiens
ctgtgtgctcggatggactcgt

SEQ ID NO: 7280818 - DNA, 22 bp, Homo sapiens
ctgtgtgcatagttgtgctcaa

SEQ ID NO: 7280819 - DNA, 22 bp, Homo sapiens
cttcccacagaattcaatcagt

SEQ ID NO: 7280820 - DNA, 17 bp, Homo sapiens
cttcccaccatctcctg

SEQ ID NO: 7280821 - DNA, 22 bp, Homo sapiens
cttcccactagtatcacagagc

SEQ ID NO: 7280822 - DNA, 22 bp, Homo sapiens
ctgggctcacctgtggctggca

SEQ ID NO: 7280823 - DNA, 22 bp, Homo sapiens
ctccctcaggccttagccctgc

SEQ ID NO: 7280824 - DNA, 22 bp, Homo sapiens
ctccctcagaggagcacctgtt

SEQ ID NO: 7280825 - DNA, 22 bp, Homo sapiens
agtccctgtactttccactgcc

SEQ ID NO: 7280826 - DNA, 22 bp, Homo sapiens
agtcccttgagggagtactgtt

SEQ ID NO: 7280827 - DNA, 22 bp, Homo sapiens
ctccagggaaaggggcgtccgc

SEQ ID NO: 7280828 - DNA, 22 bp, Homo sapiens
agtcttctgaataagaatcact

SEQ ID NO: 7280829 - DNA, 22 bp, Homo sapiens
agtcttagaactacagtgccta

SEQ ID NO: 7280830 - DNA, 22 bp, Homo sapiens
ctctgggcttcaagtcagattt

SEQ ID NO: 7280831 - DNA, 22 bp, Homo sapiens
ctctgggaccacgtgactctgc

SEQ ID NO: 7280832 - DNA, 22 bp, Homo sapiens
ctctgggaccatggcaagtgcg

SEQ ID NO: 7280833 - DNA, 18 bp, Homo sapiens
ctctgggagaggcataca

SEQ ID NO: 7280834 - DNA, 22 bp, Homo sapiens
ctctgggaagggctgagcactg

SEQ ID NO: 7280835 - DNA, 22 bp, Homo sapiens
ctctgggaaagattgtgcaggc

SEQ ID NO: 7280836 - DNA, 22 bp, Homo sapiens
ctctgggaattctgagcaagca

SEQ ID NO: 7280837 - DNA, 22 bp, Homo sapiens
agttagagttaatttcctaaca

SEQ ID NO: 7280838 - DNA, 22 bp, Homo sapiens
agttagagacacatgcacatgc

SEQ ID NO: 7280839 - DNA, 22 bp, Homo sapiens
agttagaatataattatgttaa

SEQ ID NO: 7280840 - DNA, 20 bp, Homo sapiens
agttaggaatttaagtgtta

SEQ ID NO: 7280841 - DNA, 22 bp, Homo sapiens
agttagaaagtaaatcatttga

SEQ ID NO: 7280842 - DNA, 22 bp, Homo sapiens
agttagaagtgtgtcatctgtg

SEQ ID NO: 7280843 - DNA, 19 bp, Homo sapiens
agtccatgaatggaggatg

SEQ ID NO: 7280844 - DNA, 19 bp, Homo sapiens
aggtccctccctcgaggct

SEQ ID NO: 7280845 - DNA, 22 bp, Homo sapiens
cctgggctttgagggcaggatg

SEQ ID NO: 7280846 - DNA, 22 bp, Homo sapiens
cctgtgagtcaacccctccttg

SEQ ID NO: 7280847 - DNA, 22 bp, Homo sapiens
cctccttctctttttgcagagc

SEQ ID NO: 7280848 - DNA, 22 bp, Homo sapiens
cccctgccagctatccctgaac

SEQ ID NO: 7280849 - DNA, 22 bp, Homo sapiens
cccctgccatagtcaaatctaa

SEQ ID NO: 7280850 - DNA, 22 bp, Homo sapiens
cccctgggtccaggcttctctg

SEQ ID NO: 7280851 - DNA, 22 bp, Homo sapiens
cccctgttatagaaccacctca

SEQ ID NO: 7280852 - DNA, 19 bp, Homo sapiens
ccagaggtttgctgggcct

SEQ ID NO: 7280853 - DNA, 22 bp, Homo sapiens
ccagaggttccaggctagggag

SEQ ID NO: 7280854 - DNA, 22 bp, Homo sapiens
ccagaggttactttgccttgga

SEQ ID NO: 7280855 - DNA, 22 bp, Homo sapiens
ccagaggtggtggtgtctagaa

SEQ ID NO: 7280856 - DNA, 22 bp, Homo sapiens
ccagaggtggtgggtgctacag

SEQ ID NO: 7280857 - DNA, 22 bp, Homo sapiens
ccagaggtgggagtgatctggt

SEQ ID NO: 7280858 - DNA, 22 bp, Homo sapiens
ccagggcacttaggcccagccc

SEQ ID NO: 7280859 - DNA, 22 bp, Homo sapiens
cccacgtcgaacttgctccaga

SEQ ID NO: 7280860 - DNA, 22 bp, Homo sapiens
cccacactcagttccccttggg

SEQ ID NO: 7280861 - DNA, 20 bp, Homo sapiens
cccagaggttgcggcaggag

SEQ ID NO: 7280862 - DNA, 22 bp, Homo sapiens
aggcaatcccctgaggatactt

SEQ ID NO: 7280863 - DNA, 22 bp, Homo sapiens
ccacgacgagtcatcagggcga

SEQ ID NO: 7280864 - DNA, 22 bp, Homo sapiens
cagtaaatgcagatatagatac

SEQ ID NO: 7280865 - DNA, 22 bp, Homo sapiens
aggaagtgctaagagaacatca

SEQ ID NO: 7280866 - DNA, 22 bp, Homo sapiens
caggacctgaagacaggcaggt

SEQ ID NO: 7280867 - DNA, 22 bp, Homo sapiens
accctttcttactcacacgctc

SEQ ID NO: 7280868 - DNA, 18 bp, Homo sapiens
accctttccaaactgcag

SEQ ID NO: 7280869 - DNA, 22 bp, Homo sapiens
aggggtggagagtgttgccagt

SEQ ID NO: 7280870 - DNA, 23 bp, Homo sapiens
aggggtggtcagtacccgcagtg

SEQ ID NO: 7280871 - DNA, 22 bp, Homo sapiens
acatgtatgctttatgaagtag

SEQ ID NO: 7280872 - DNA, 21 bp, Homo sapiens
aggctgctggctcagggtcct

SEQ ID NO: 7280873 - DNA, 22 bp, Homo sapiens
aggctgctgaggccaccacgct

SEQ ID NO: 7280874 - DNA, 22 bp, Homo sapiens
acagtgaaaagaatattagaat

SEQ ID NO: 7280875 - DNA, 22 bp, Homo sapiens
aggacacaggtaagccagtgga

SEQ ID NO: 7280876 - DNA, 21 bp, Homo sapiens
acaggcaatttcatatggttc

SEQ ID NO: 7280877 - DNA, 22 bp, Homo sapiens
acaggacaactcagcagccagc

SEQ ID NO: 7280878 - DNA, 22 bp, Homo sapiens
agttctttgtgagtaatacaga

SEQ ID NO: 7280879 - DNA, 22 bp, Homo sapiens
agttcagaaatgtctttgcaaa

SEQ ID NO: 7280880 - DNA, 22 bp, Homo sapiens
atcaagagaaggggaagatgaa

SEQ ID NO: 7280881 - DNA, 20 bp, Homo sapiens
agaaatattgagttcagagg

SEQ ID NO: 7280882 - DNA, 22 bp, Homo sapiens
agaaatgtaggcatataaggaa

SEQ ID NO: 7280883 - DNA, 22 bp, Homo sapiens
agaaatgtaattgcaactgtct

SEQ ID NO: 7280884 - DNA, 22 bp, Homo sapiens
agaaatgtcaggaaagaagtcc

SEQ ID NO: 7280885 - DNA, 22 bp, Homo sapiens
agaaatgtgaatttcatttcct

SEQ ID NO: 7280886 - DNA, 22 bp, Homo sapiens
agggtgcagaaggagcctagga

SEQ ID NO: 7280887 - DNA, 22 bp, Homo sapiens
cactgcacttcagcctgggtga

SEQ ID NO: 7280888 - DNA, 22 bp, Homo sapiens
caattcaagttgagtacagctt

SEQ ID NO: 7280889 - DNA, 22 bp, Homo sapiens
cagcctcctgggacactcaccg

SEQ ID NO: 7280890 - DNA, 22 bp, Homo sapiens
cagctgcccaggccacctggag

SEQ ID NO: 7280891 - DNA, 22 bp, Homo sapiens
cagctgccagcttctctccatc

SEQ ID NO: 7280892 - DNA, 18 bp, Homo sapiens
cagcctctgattggttgc

SEQ ID NO: 7280893 - DNA, 22 bp, Homo sapiens
cagagccaggtctaggagtctc

SEQ ID NO: 7280894 - DNA, 22 bp, Homo sapiens
agcctgagtgcttaggactgtt

SEQ ID NO: 7280895 - DNA, 23 bp, Homo sapiens
attgagaaggatacattgttctc

SEQ ID NO: 7280896 - DNA, 22 bp, Homo sapiens
atgtatatgtgaaagatgttta

SEQ ID NO: 7280897 - DNA, 20 bp, Homo sapiens
atgtatattactggctgtga

SEQ ID NO: 7280898 - DNA, 22 bp, Homo sapiens
atgtatatgaagctagtatttt

SEQ ID NO: 7280899 - DNA, 22 bp, Homo sapiens
atgtatatacttacatgtgtgg

SEQ ID NO: 7280900 - DNA, 22 bp, Homo sapiens
atgtcttgttaatctgaagcaa

SEQ ID NO: 7280901 - DNA, 22 bp, Homo sapiens
agagccagcatttgacactggc

SEQ ID NO: 7280902 - DNA, 22 bp, Homo sapiens
atgactgttatgggactggaac

SEQ ID NO: 7280903 - DNA, 22 bp, Homo sapiens
atctgggagcggaggttgcagt

SEQ ID NO: 7280904 - DNA, 22 bp, Homo sapiens
atgattctcattttataaactt

SEQ ID NO: 7280905 - DNA, 22 bp, Homo sapiens
atgattctggcaaatttattat

SEQ ID NO: 7280906 - DNA, 22 bp, Homo sapiens
atgattctctgctactctaaat

SEQ ID NO: 7280907 - DNA, 22 bp, Homo sapiens
aagcagggctccctggggactc

SEQ ID NO: 7280908 - DNA, 22 bp, Homo sapiens
acagcagggggagctgttggac

SEQ ID NO: 7280909 - DNA, 22 bp, Homo sapiens
aagatacacgttgtattgaata

SEQ ID NO: 7280910 - DNA, 22 bp, Homo sapiens
acaaaagtgtaggaattcctta

SEQ ID NO: 7280911 - DNA, 22 bp, Homo sapiens
aagtgcttaggtcaaaggacat

SEQ ID NO: 7280912 - DNA, 22 bp, Homo sapiens
aatatttctgtagctatgttct

SEQ ID NO: 7280913 - DNA, 22 bp, Homo sapiens
aatatttctggtgcttctcact

SEQ ID NO: 7280914 - DNA, 22 bp, Homo sapiens
aatatttctgcagaatggtttt

SEQ ID NO: 7280915 - DNA, 21 bp, Homo sapiens
aatacagtgaagaatttcttt

SEQ ID NO: 7280916 - DNA, 22 bp, Homo sapiens
aacttcattcctttttatgact

SEQ ID NO: 7280917 - DNA, 22 bp, Homo sapiens
aatgcttcctcctcacctcagg

SEQ ID NO: 7280918 - DNA, 22 bp, Homo sapiens
aaagttctctatggtgtaaaaa

SEQ ID NO: 7280919 - DNA, 22 bp, Homo sapiens
aaagttctggagaaaataatga

SEQ ID NO: 7280920 - DNA, 22 bp, Homo sapiens
aaagttctgatgctgatcaaag

SEQ ID NO: 7280921 - DNA, 22 bp, Homo sapiens
aaagttctttctcttatttggt

SEQ ID NO: 7280922 - DNA, 22 bp, Homo sapiens
aaagttcttagattaatcactg

SEQ ID NO: 7280923 - DNA, 20 bp, Homo sapiens
aaagtcccttagtgggagca

SEQ ID NO: 7280924 - DNA, 22 bp, Homo sapiens
aaagggaactctaattatcttc

SEQ ID NO: 7280925 - DNA, 18 bp, Homo sapiens
aaaggctgaatatagaag

SEQ ID NO: 7280926 - DNA, 22 bp, Homo sapiens
aacatgaagttttctatagtga

SEQ ID NO: 7280927 - DNA, 22 bp, Homo sapiens
aaagcatagaattagagttagg

SEQ ID NO: 7280928 - DNA, 22 bp, Homo sapiens
aaagttctttttctataaatcc

SEQ ID NO: 7280929 - DNA, 22 bp, Homo sapiens
aaatatgagatgttctctttcg

SEQ ID NO: 7280930 - DNA, 22 bp, Homo sapiens
aaatgaggttaatacagtgctt

SEQ ID NO: 7280931 - DNA, 21 bp, Homo sapiens
aaatacagatgcaaatctgtt

SEQ ID NO: 7280932 - DNA, 22 bp, Homo sapiens
aaatacagagttatggacctca

SEQ ID NO: 7280933 - DNA, 22 bp, Homo sapiens
aaagttctaaaactctttgtga

SEQ ID NO: 7280934 - DNA, 23 bp, Homo sapiens
aaagttctagaatgacttcctgt

SEQ ID NO: 7280935 - DNA, 22 bp, Homo sapiens
aaagttctagagttgcaagaga

SEQ ID NO: 7280936 - DNA, 22 bp, Homo sapiens
aaaatgatatcctgacttttat

SEQ ID NO: 7280937 - DNA, 22 bp, Homo sapiens
aaaatacacatactaggggaaa

SEQ ID NO: 7280938 - DNA, 22 bp, Homo sapiens
aaaacagacagccagtgtagag

SEQ ID NO: 7280939 - DNA, 22 bp, Homo sapiens
aatgtataatatttaatgcttt

SEQ ID NO: 7280940 - DNA, 21 bp, Homo sapiens
aatgtgtgctatttatctttt

SEQ ID NO: 7280941 - DNA, 22 bp, Homo sapiens
agagaagggggaaagatctcac

SEQ ID NO: 7280942 - DNA, 22 bp, Homo sapiens
aatttcttcagctctaaaatgg

SEQ ID NO: 7280943 - DNA, 22 bp, Homo sapiens
agagttaaggccactgtcagta

SEQ ID NO: 7280944 - DNA, 22 bp, Homo sapiens
agagttaagaggaatgtgaatt

SEQ ID NO: 7280945 - DNA, 22 bp, Homo sapiens
agagtgtggaacttgaggagct

SEQ ID NO: 7280946 - DNA, 22 bp, Homo sapiens
acaaagtgaaaagcatcgaatt

SEQ ID NO: 7280947 - DNA, 22 bp, Homo sapiens
agcacagaaagcacatttgaaa

SEQ ID NO: 7280948 - DNA, 22 bp, Homo sapiens
agcaggtgtatcggtcacctac

SEQ ID NO: 7280949 - DNA, 22 bp, Homo sapiens
acacatatgtggcaactgtaga

SEQ ID NO: 7280950 - DNA, 22 bp, Homo sapiens
acacagttcatgcatgaggtct

SEQ ID NO: 7280951 - DNA, 22 bp, Homo sapiens
acagaggtaggacatgagatat

SEQ ID NO: 7280952 - DNA, 22 bp, Homo sapiens
acagaatagtagcttaaagtca

SEQ ID NO: 7280953 - DNA, 22 bp, Homo sapiens
acagcaggttttaactttgaag

SEQ ID NO: 7280954 - DNA, 22 bp, Homo sapiens
acatgactataattacttaaat

SEQ ID NO: 7280955 - DNA, 22 bp, Homo sapiens
acccagggctcaagcgtaggca

SEQ ID NO: 7280956 - DNA, 22 bp, Homo sapiens
acctgcccttaacactgtgtgc

SEQ ID NO: 7280957 - DNA, 20 bp, Homo sapiens
accagaggaaagagcagtga

SEQ ID NO: 7280958 - DNA, 22 bp, Homo sapiens
accagagggagacttcctcttc

SEQ ID NO: 7280959 - DNA, 22 bp, Homo sapiens
acatttcagatgtaatgtgatg

SEQ ID NO: 7280960 - DNA, 22 bp, Homo sapiens
acatttcagtaagtgttaattt

SEQ ID NO: 7280961 - DNA, 22 bp, Homo sapiens
aatgaactggagaacaatgacc

SEQ ID NO: 7280962 - DNA, 22 bp, Homo sapiens
agaacacactgggggaaacaag

SEQ ID NO: 7280963 - DNA, 18 bp, Homo sapiens
actctttctgcccacagg

SEQ ID NO: 7280964 - DNA, 22 bp, Homo sapiens
actgaaaatgaattagaaacag

SEQ ID NO: 7280965 - DNA, 22 bp, Homo sapiens
aagtgtttggggatcattttaa

SEQ ID NO: 7280966 - DNA, 22 bp, Homo sapiens
tagaattttctgctttgatagt

SEQ ID NO: 7280967 - DNA, 23 bp, Homo sapiens
tagaatgtcattcaatgatatgg

SEQ ID NO: 7280968 - DNA, 22 bp, Homo sapiens
tagaatgtgcctggaatacagt

SEQ ID NO: 7280969 - DNA, 21 bp, Homo sapiens
tagcccttctccacctcgccc

SEQ ID NO: 7280970 - DNA, 22 bp, Homo sapiens
tagcccctgcctttgaacctgg

SEQ ID NO: 7280971 - DNA, 22 bp, Homo sapiens
taggatatggtagaaatcattc

SEQ ID NO: 7280972 - DNA, 22 bp, Homo sapiens
tatttctaagctgtaagtctga

SEQ ID NO: 7280973 - DNA, 22 bp, Homo sapiens
tatttaatttgctcattgtgat

SEQ ID NO: 7280974 - DNA, 22 bp, Homo sapiens
tatctactcctctttcagatgc

SEQ ID NO: 7280975 - DNA, 21 bp, Homo sapiens
tatctactggtgtctttcaga

SEQ ID NO: 7280976 - DNA, 23 bp, Homo sapiens
tatctactttgcaattcagtacc

SEQ ID NO: 7280977 - DNA, 22 bp, Homo sapiens
tatccaattcaccattgatggg

SEQ ID NO: 7280978 - DNA, 22 bp, Homo sapiens
tacagaaacagcgtggttagaa

SEQ ID NO: 7280979 - DNA, 22 bp, Homo sapiens
tacagcaatgctacaagatgac

SEQ ID NO: 7280980 - DNA, 23 bp, Homo sapiens
tacagcaaggacaacataggtgg

SEQ ID NO: 7280981 - DNA, 22 bp, Homo sapiens
tacagcaatgcctgaaatagta

SEQ ID NO: 7280982 - DNA, 21 bp, Homo sapiens
tacagcaccgagtaggccctc

SEQ ID NO: 7280983 - DNA, 22 bp, Homo sapiens
taagtgaatccttgagaagaaa

SEQ ID NO: 7280984 - DNA, 22 bp, Homo sapiens
taagtgaatactaaggatggag

SEQ ID NO: 7280985 - DNA, 22 bp, Homo sapiens
taaagtagcgcctaactaatgt

SEQ ID NO: 7280986 - DNA, 22 bp, Homo sapiens
gttgagtgggttaggatgctga

SEQ ID NO: 7280987 - DNA, 22 bp, Homo sapiens
gtgtggctagaagtgtcttgtt

SEQ ID NO: 7280988 - DNA, 22 bp, Homo sapiens
gttaagaatcaagacttatctt

SEQ ID NO: 7280989 - DNA, 22 bp, Homo sapiens
gttaagaacttgttgaaggtct

SEQ ID NO: 7280990 - DNA, 22 bp, Homo sapiens
gttaagaatgcattatgcatat

SEQ ID NO: 7280991 - DNA, 22 bp, Homo sapiens
gtgtgcatgtggaagcatgtat

SEQ ID NO: 7280992 - DNA, 22 bp, Homo sapiens
tcacaaaggatgatgaattctg

SEQ ID NO: 7280993 - DNA, 22 bp, Homo sapiens
tcactttcctcatcacgactag

SEQ ID NO: 7280994 - DNA, 22 bp, Homo sapiens
tcagagaggttggtgataagaa

SEQ ID NO: 7280995 - DNA, 22 bp, Homo sapiens
tcagagaggcaatactgtttaa

SEQ ID NO: 7280996 - DNA, 23 bp, Homo sapiens
tcagagaggccccctgcagagat

SEQ ID NO: 7280997 - DNA, 22 bp, Homo sapiens
tccagagatcacactgggcagg

SEQ ID NO: 7280998 - DNA, 22 bp, Homo sapiens
tccagaggcagctgcggtcagg

SEQ ID NO: 7280999 - DNA, 22 bp, Homo sapiens
gctgtggctttctgtttctgtt

SEQ ID NO: 7281000 - DNA, 22 bp, Homo sapiens
ggaagcaggaggctggggtaaa

SEQ ID NO: 7281001 - DNA, 17 bp, Homo sapiens
ggacacagctcatggct

SEQ ID NO: 7281002 - DNA, 21 bp, Homo sapiens
gctcagcaaaggtgaggtgca

SEQ ID NO: 7281003 - DNA, 21 bp, Homo sapiens
gctccctgctcagctcctggg

SEQ ID NO: 7281004 - DNA, 22 bp, Homo sapiens
gctccctggaatgttggctgcc

SEQ ID NO: 7281005 - DNA, 22 bp, Homo sapiens
gctgcctccaatctgtgccccg

SEQ ID NO: 7281006 - DNA, 22 bp, Homo sapiens
gctgcctcaggcacctcctggc

SEQ ID NO: 7281007 - DNA, 22 bp, Homo sapiens
gctccctgttctcagccatgat

SEQ ID NO: 7281008 - DNA, 22 bp, Homo sapiens
gccaggcagctgggagggtgcc

SEQ ID NO: 7281009 - DNA, 22 bp, Homo sapiens
gccaggcagcagcgaggatggt

SEQ ID NO: 7281010 - DNA, 22 bp, Homo sapiens
gccctggccttcatctcagaca

SEQ ID NO: 7281011 - DNA, 18 bp, Homo sapiens
gcccatggtaaatgctgt

SEQ ID NO: 7281012 - DNA, 22 bp, Homo sapiens
gccagggtgtgcagggacagga

SEQ ID NO: 7281013 - DNA, 22 bp, Homo sapiens
gcagggaaggggcatgctggag

SEQ ID NO: 7281014 - DNA, 22 bp, Homo sapiens
gcagaggtctagcaccaagaat

SEQ ID NO: 7281015 - DNA, 22 bp, Homo sapiens
gcagaggtgaccagcagcaggg

SEQ ID NO: 7281016 - DNA, 22 bp, Homo sapiens
gcagaggtcctagccaggagtc

SEQ ID NO: 7281017 - DNA, 22 bp, Homo sapiens
gcagagggtcctgtgccagcag

SEQ ID NO: 7281018 - DNA, 22 bp, Homo sapiens
gcaaagcattctgtggagtcta

SEQ ID NO: 7281019 - DNA, 22 bp, Homo sapiens
gtgactgtgatcttatttgcaa

SEQ ID NO: 7281020 - DNA, 22 bp, Homo sapiens
gtgagaagataagtattgcaaa

SEQ ID NO: 7281021 - DNA, 22 bp, Homo sapiens
gtgcacatcgtgcaggtttgtt

SEQ ID NO: 7281022 - DNA, 23 bp, Homo sapiens
gtgcacagtcaagcccagcttag

SEQ ID NO: 7281023 - DNA, 22 bp, Homo sapiens
gtgcatatgtgtgtatacaaac

SEQ ID NO: 7281024 - DNA, 18 bp, Homo sapiens
gtccacagccctcacagc

SEQ ID NO: 7281025 - DNA, 22 bp, Homo sapiens
gtccctgcatcaccacgggact

SEQ ID NO: 7281026 - DNA, 22 bp, Homo sapiens
gtccctgcatctgcaggccatg

SEQ ID NO: 7281027 - DNA, 22 bp, Homo sapiens
gtccctgccctcctgggactca

SEQ ID NO: 7281028 - DNA, 22 bp, Homo sapiens
ggtcgcacccgggcgctgctgg

SEQ ID NO: 7281029 - DNA, 22 bp, Homo sapiens
ggtctctgagtgaggacctggg

SEQ ID NO: 7281030 - DNA, 22 bp, Homo sapiens
ggccatgccaggctgcctggga

SEQ ID NO: 7281031 - DNA, 22 bp, Homo sapiens
ggccatgcaggtctggtaggtc

SEQ ID NO: 7281032 - DNA, 22 bp, Homo sapiens
ggccatgcaggtcagaggtggg

SEQ ID NO: 7281033 - DNA, 22 bp, Homo sapiens
ggccaaggctcttgagggctga

SEQ ID NO: 7281034 - DNA, 22 bp, Homo sapiens
ggcatgtgcctgaggtcacaca

SEQ ID NO: 7281035 - DNA, 22 bp, Homo sapiens
ggccacagaacagctacaggac

SEQ ID NO: 7281036 - DNA, 22 bp, Homo sapiens
ggccttgggatgtggctgcagc

SEQ ID NO: 7281037 - DNA, 18 bp, Homo sapiens
ggcctgcagtgaagcaag

SEQ ID NO: 7281038 - DNA, 22 bp, Homo sapiens
ggccttggtgccatggccagtt

SEQ ID NO: 7281039 - DNA, 22 bp, Homo sapiens
ggctccaggagatgctgggcag

SEQ ID NO: 7281040 - DNA, 22 bp, Homo sapiens
ggctccagctaatggtttctat

SEQ ID NO: 7281041 - DNA, 22 bp, Homo sapiens
ggctccagccctggctcttcac

SEQ ID NO: 7281042 - DNA, 22 bp, Homo sapiens
ggctccagatgtctcctggcaa

SEQ ID NO: 7281043 - DNA, 22 bp, Homo sapiens
ggctcttctggttgtcacattt

SEQ ID NO: 7281044 - DNA, 22 bp, Homo sapiens
ggctcttctgtttcacaggcca

SEQ ID NO: 7281045 - DNA, 19 bp, Homo sapiens
gggagctttccatctgtcc

SEQ ID NO: 7281046 - DNA, 22 bp, Homo sapiens
gggagcttaagacagttccaat

SEQ ID NO: 7281047 - DNA, 22 bp, Homo sapiens
gagcctggattgaagtgggtgg

SEQ ID NO: 7281048 - DNA, 22 bp, Homo sapiens
gagcctggagctggaacgaagc

SEQ ID NO: 7281049 - DNA, 22 bp, Homo sapiens
gagaattagggcgtaattcaga

SEQ ID NO: 7281050 - DNA, 22 bp, Homo sapiens
gagatcggtaaagagcatgcac

SEQ ID NO: 7281051 - DNA, 22 bp, Homo sapiens
gagatggagtctttttctgtca

SEQ ID NO: 7281052 - DNA, 20 bp, Homo sapiens
gaaatgtacacattaccaca

SEQ ID NO: 7281053 - DNA, 22 bp, Homo sapiens
ctttcacagctactcacctctg

SEQ ID NO: 7281054 - DNA, 22 bp, Homo sapiens
ctttcacataattgaccttgaa

SEQ ID NO: 7281055 - DNA, 22 bp, Homo sapiens
ctttcacagctactcacctctg

SEQ ID NO: 7281056 - DNA, 22 bp, Homo sapiens
ctttcacagcacaagcctgcct

SEQ ID NO: 7281057 - DNA, 22 bp, Homo sapiens
gaagataattcctacttataac

SEQ ID NO: 7281058 - DNA, 22 bp, Homo sapiens
gaccctggtgtccaggtcctgc

SEQ ID NO: 7281059 - DNA, 22 bp, Homo sapiens
gaaggaaaaatactctgtaagg

SEQ ID NO: 7281060 - DNA, 22 bp, Homo sapiens
ctgtggctcatatctgtaatct

SEQ ID NO: 7281061 - DNA, 22 bp, Homo sapiens
ctgtggccccaccctcttggcc

SEQ ID NO: 7281062 - DNA, 22 bp, Homo sapiens
ctgtggcttcagcattcagagc

SEQ ID NO: 7281063 - DNA, 22 bp, Homo sapiens
ctgtggctgtctctttcccatg

SEQ ID NO: 7281064 - DNA, 22 bp, Homo sapiens
ctgtggctgtgaaacttctcag

SEQ ID NO: 7281065 - DNA, 22 bp, Homo sapiens
ctgtggctgtatttggccagag

SEQ ID NO: 7281066 - DNA, 22 bp, Homo sapiens
ctgtggctggctcatcataggt

SEQ ID NO: 7281067 - DNA, 22 bp, Homo sapiens
ctgtggctggcctgtctgacat

SEQ ID NO: 7281068 - DNA, 22 bp, Homo sapiens
ctgtggctggaataataaatgt

SEQ ID NO: 7281069 - DNA, 22 bp, Homo sapiens
ctgtggctggccttattgctgc

SEQ ID NO: 7281070 - DNA, 23 bp, Homo sapiens
ctgtggctgagtcctgttggagt

SEQ ID NO: 7281071 - DNA, 22 bp, Homo sapiens
ctgtggctgagttccttatgtt

SEQ ID NO: 7281072 - DNA, 19 bp, Homo sapiens
ctgtggctgacctctggcc

SEQ ID NO: 7281073 - DNA, 22 bp, Homo sapiens
ctgtggctgaactctgaagagg

SEQ ID NO: 7281074 - DNA, 22 bp, Homo sapiens
ctgtggctctttagttgagcac

SEQ ID NO: 7281075 - DNA, 22 bp, Homo sapiens
ctgtggctctgcagtcccaaca

SEQ ID NO: 7281076 - DNA, 22 bp, Homo sapiens
ctgtggctgcctcacctacagg

SEQ ID NO: 7281077 - DNA, 22 bp, Homo sapiens
ctgtggctgcagaccttaaaca

SEQ ID NO: 7281078 - DNA, 22 bp, Homo sapiens
ctgtggctgcagccttggtcct

SEQ ID NO: 7281079 - DNA, 22 bp, Homo sapiens
ctgtggctgcgtaggtctggca

SEQ ID NO: 7281080 - DNA, 22 bp, Homo sapiens
ctgtggctgcgccatcgaaaac

SEQ ID NO: 7281081 - DNA, 22 bp, Homo sapiens
ctgtggctgcgccctgggggag

SEQ ID NO: 7281082 - DNA, 22 bp, Homo sapiens
ctgtggctcattcttggtggca

SEQ ID NO: 7281083 - DNA, 22 bp, Homo sapiens
ctgtggctccagtgaaccaatg

SEQ ID NO: 7281084 - DNA, 16 bp, Homo sapiens
ctgtggctcccaggtt

SEQ ID NO: 7281085 - DNA, 22 bp, Homo sapiens
ctgtggctccatagaagttgca

SEQ ID NO: 7281086 - DNA, 20 bp, Homo sapiens
ctgtggctcatgcatctgcc

SEQ ID NO: 7281087 - DNA, 22 bp, Homo sapiens
ctgtggctctctgcagggtccc

SEQ ID NO: 7281088 - DNA, 22 bp, Homo sapiens
ctgtggctctccaatggaggga

SEQ ID NO: 7281089 - DNA, 22 bp, Homo sapiens
ctgtggctctcagaggctgctg

SEQ ID NO: 7281090 - DNA, 17 bp, Homo sapiens
ctgttccccactactca

SEQ ID NO: 7281091 - DNA, 22 bp, Homo sapiens
cttgtccagatgtttgttaggt

SEQ ID NO: 7281092 - DNA, 22 bp, Homo sapiens
cttgtcagccaattgtggattt

SEQ ID NO: 7281093 - DNA, 22 bp, Homo sapiens
cttcagcccagcctccgcctcc

SEQ ID NO: 7281094 - DNA, 22 bp, Homo sapiens
cttcagccctgagtgccagcag

SEQ ID NO: 7281095 - DNA, 22 bp, Homo sapiens
cttcagcctcaactactatggt

SEQ ID NO: 7281096 - DNA, 22 bp, Homo sapiens
cttcagcctcatctcagcccgt

SEQ ID NO: 7281097 - DNA, 22 bp, Homo sapiens
cttcagcctcgttactcctgcg

SEQ ID NO: 7281098 - DNA, 22 bp, Homo sapiens
ctggctcttcagtgcttggttc

SEQ ID NO: 7281099 - DNA, 22 bp, Homo sapiens
ctggctccaaattctgatgttc

SEQ ID NO: 7281100 - DNA, 22 bp, Homo sapiens
ctgggccagatccagcctcaca

SEQ ID NO: 7281101 - DNA, 22 bp, Homo sapiens
ctgggccacagactcaaggcag

SEQ ID NO: 7281102 - DNA, 22 bp, Homo sapiens
ctgggccacttcctcaggggaa

SEQ ID NO: 7281103 - DNA, 22 bp, Homo sapiens
ctgggaggcagaggttgcagtg

SEQ ID NO: 7281104 - DNA, 22 bp, Homo sapiens
ctgggaggcactattcaggagg

SEQ ID NO: 7281105 - DNA, 22 bp, Homo sapiens
ctgggaggcccacgttgggaag

SEQ ID NO: 7281106 - DNA, 22 bp, Homo sapiens
ctgggaagaaattgtgggaggc

SEQ ID NO: 7281107 - DNA, 18 bp, Homo sapiens
cctttcctcccctcagct

SEQ ID NO: 7281108 - DNA, 22 bp, Homo sapiens
cctttctctatcgacccatcgc

SEQ ID NO: 7281109 - DNA, 22 bp, Homo sapiens
cctttctctttgctgatcatgt

SEQ ID NO: 7281110 - DNA, 22 bp, Homo sapiens
cctttctcttggataccgattg

SEQ ID NO: 7281111 - DNA, 22 bp, Homo sapiens
cctgtgtggtagccagcggtgc

SEQ ID NO: 7281112 - DNA, 20 bp, Homo sapiens
cctgtgtggccagctgaggc

SEQ ID NO: 7281113 - DNA, 22 bp, Homo sapiens
cctgtgtgattggaagctgaga

SEQ ID NO: 7281114 - DNA, 22 bp, Homo sapiens
cctgtgtgaaggttaggcaggt

SEQ ID NO: 7281115 - DNA, 22 bp, Homo sapiens
ccttccccagtgattctctcag

SEQ ID NO: 7281116 - DNA, 22 bp, Homo sapiens
ccttctcagccccagctcccgc

SEQ ID NO: 7281117 - DNA, 22 bp, Homo sapiens
cctgggcaaattatgttactca

SEQ ID NO: 7281118 - DNA, 22 bp, Homo sapiens
cctgggcttacgacctctgact

SEQ ID NO: 7281119 - DNA, 22 bp, Homo sapiens
cctgggcttccacgagcagagg

SEQ ID NO: 7281120 - DNA, 22 bp, Homo sapiens
cctggtgtctgtttacagcagc

SEQ ID NO: 7281121 - DNA, 22 bp, Homo sapiens
ctcatctgtatatagtgaatga

SEQ ID NO: 7281122 - DNA, 19 bp, Homo sapiens
ctccaagttaagagggagg

SEQ ID NO: 7281123 - DNA, 22 bp, Homo sapiens
ctcccactcctggctcaccaca

SEQ ID NO: 7281124 - DNA, 21 bp, Homo sapiens
ttgtgaaagtccaggaacaac

SEQ ID NO: 7281125 - DNA, 22 bp, Homo sapiens
ctcccctttggaagaagggtct

SEQ ID NO: 7281126 - DNA, 22 bp, Homo sapiens
ctcccctgagcatagactctgt

SEQ ID NO: 7281127 - DNA, 22 bp, Homo sapiens
ctctctcttgtgttgctgcaga

SEQ ID NO: 7281128 - DNA, 22 bp, Homo sapiens
ctgactcctatgccccatgggc

SEQ ID NO: 7281129 - DNA, 22 bp, Homo sapiens
ctctttctgattcgctgggacc

SEQ ID NO: 7281130 - DNA, 22 bp, Homo sapiens
ctctttctcgccgcccgcagtc

SEQ ID NO: 7281131 - DNA, 22 bp, Homo sapiens
ctgcaggggaccaaagtctgac

SEQ ID NO: 7281132 - DNA, 19 bp, Homo sapiens
ctgcagggatgtgcagagt

SEQ ID NO: 7281133 - DNA, 18 bp, Homo sapiens
ctgaggcccagagagggc

SEQ ID NO: 7281134 - DNA, 22 bp, Homo sapiens
ccagagagagaggtcaatggca

SEQ ID NO: 7281135 - DNA, 22 bp, Homo sapiens
ccagagagaaatggatttgagt

SEQ ID NO: 7281136 - DNA, 22 bp, Homo sapiens
ccagagagaaaatggagggcca

SEQ ID NO: 7281137 - DNA, 22 bp, Homo sapiens
tctggcctcttgggatgctccc

SEQ ID NO: 7281138 - DNA, 22 bp, Homo sapiens
ccaggagaataatggcagatta

SEQ ID NO: 7281139 - DNA, 22 bp, Homo sapiens
tgatttctcatattgttcaaaa

SEQ ID NO: 7281140 - DNA, 22 bp, Homo sapiens
tgcacagacaactctttctaga

SEQ ID NO: 7281141 - DNA, 22 bp, Homo sapiens
tgcacagaatcattttcagctg

SEQ ID NO: 7281142 - DNA, 22 bp, Homo sapiens
cccactttggttgcactctgcc

SEQ ID NO: 7281143 - DNA, 22 bp, Homo sapiens
ccatgcagtgctggagctgatt

SEQ ID NO: 7281144 - DNA, 22 bp, Homo sapiens
ccaggggttggaggttgcagtg

SEQ ID NO: 7281145 - DNA, 22 bp, Homo sapiens
tgcacagatagtgatagatagc

SEQ ID NO: 7281146 - DNA, 22 bp, Homo sapiens
tgcacagacatacacatatatg

SEQ ID NO: 7281147 - DNA, 22 bp, Homo sapiens
tgcacagatctggtggcaagga

SEQ ID NO: 7281148 - DNA, 22 bp, Homo sapiens
cccagggacagatgggcagcta

SEQ ID NO: 7281149 - DNA, 22 bp, Homo sapiens
ccccttctctgcaagcctgctc

SEQ ID NO: 7281150 - DNA, 22 bp, Homo sapiens
cccctttctcccgcgactggcc

SEQ ID NO: 7281151 - DNA, 22 bp, Homo sapiens
cccctttctcccgcgtctggcc

SEQ ID NO: 7281152 - DNA, 22 bp, Homo sapiens
ccccttctgtgtcctgtcagcc

SEQ ID NO: 7281153 - DNA, 22 bp, Homo sapiens
tgggctctagactttagtgtgg

SEQ ID NO: 7281154 - DNA, 22 bp, Homo sapiens
tgggctgctgtctgcacatgct

SEQ ID NO: 7281155 - DNA, 19 bp, Homo sapiens
cctgagattcctccttttc

SEQ ID NO: 7281156 - DNA, 22 bp, Homo sapiens
cctcttcctcaccatctacaac

SEQ ID NO: 7281157 - DNA, 22 bp, Homo sapiens
tgggaagctgcattttaacaag

SEQ ID NO: 7281158 - DNA, 22 bp, Homo sapiens
tgggaaggacgtgtcagtggca

SEQ ID NO: 7281159 - DNA, 22 bp, Homo sapiens
tggcctgggcatgaagcatcgt

SEQ ID NO: 7281160 - DNA, 22 bp, Homo sapiens
cccttcctcccaggcttctgtg

SEQ ID NO: 7281161 - DNA, 22 bp, Homo sapiens
cccttctctttcactcactatt

SEQ ID NO: 7281162 - DNA, 23 bp, Homo sapiens
ccctgcagtcagggtgagatggt

SEQ ID NO: 7281163 - DNA, 22 bp, Homo sapiens
ccctgcaggggacctgcagcct

SEQ ID NO: 7281164 - DNA, 22 bp, Homo sapiens
ccctgcagggaggattctgaag

SEQ ID NO: 7281165 - DNA, 21 bp, Homo sapiens
ccctgcaggccagggctgagc

SEQ ID NO: 7281166 - DNA, 22 bp, Homo sapiens
cattacatctttgatgcagtat

SEQ ID NO: 7281167 - DNA, 22 bp, Homo sapiens
cattacatttcaaaatgtttcc

SEQ ID NO: 7281168 - DNA, 22 bp, Homo sapiens
cattcttatatttactcattca

SEQ ID NO: 7281169 - DNA, 22 bp, Homo sapiens
tccctcctgcatgaggctcggc

SEQ ID NO: 7281170 - DNA, 22 bp, Homo sapiens
tccctcctggtgatgatgcaaa

SEQ ID NO: 7281171 - DNA, 18 bp, Homo sapiens
tccctcctgcctgcttcc

SEQ ID NO: 7281172 - DNA, 22 bp, Homo sapiens
tccctcctggccgtcaccgctg

SEQ ID NO: 7281173 - DNA, 22 bp, Homo sapiens
tctaatcctatggtggggaggg

SEQ ID NO: 7281174 - DNA, 22 bp, Homo sapiens
tctaatccttgctacctgggtg

SEQ ID NO: 7281175 - DNA, 22 bp, Homo sapiens
ccactgtcttttccaggctgaa

SEQ ID NO: 7281176 - DNA, 22 bp, Homo sapiens
ccaagagtaaattcatgatgcc

SEQ ID NO: 7281177 - DNA, 22 bp, Homo sapiens
tcagagagttagtgtcttagct

SEQ ID NO: 7281178 - DNA, 22 bp, Homo sapiens
tcagagagttttcactagggtg

SEQ ID NO: 7281179 - DNA, 22 bp, Homo sapiens
tcagggagggacctgaggctgg

SEQ ID NO: 7281180 - DNA, 22 bp, Homo sapiens
catctgctgttccttggactca

SEQ ID NO: 7281181 - DNA, 22 bp, Homo sapiens
taatatgtgttactgacttttt

SEQ ID NO: 7281182 - DNA, 22 bp, Homo sapiens
caggcctgaccctgagcttcac

SEQ ID NO: 7281183 - DNA, 22 bp, Homo sapiens
tagattcagatatttaggacaa

SEQ ID NO: 7281184 - DNA, 21 bp, Homo sapiens
tttctcataaaatactcatta

SEQ ID NO: 7281185 - DNA, 22 bp, Homo sapiens
tttcagtgcacgtagtttattt

SEQ ID NO: 7281186 - DNA, 19 bp, Homo sapiens
tttctctgtgcaccttttc

SEQ ID NO: 7281187 - DNA, 21 bp, Homo sapiens
tttcttcactttgccccatgt

SEQ ID NO: 7281188 - DNA, 22 bp, Homo sapiens
tttcttcattcaccttcacccc

SEQ ID NO: 7281189 - DNA, 22 bp, Homo sapiens
tttcttcccaagcagtttcaga

SEQ ID NO: 7281190 - DNA, 22 bp, Homo sapiens
tttcttctctaatctcaatgat

SEQ ID NO: 7281191 - DNA, 22 bp, Homo sapiens
tttaaaatttagacctctccac

SEQ ID NO: 7281192 - DNA, 22 bp, Homo sapiens
ttgttataaagactaaatatgt

SEQ ID NO: 7281193 - DNA, 22 bp, Homo sapiens
ttcaatttcataatatctagct

SEQ ID NO: 7281194 - DNA, 22 bp, Homo sapiens
ttcacaataggagcatgcaaat

SEQ ID NO: 7281195 - DNA, 22 bp, Homo sapiens
ttcacaaagctggagcatttcc

SEQ ID NO: 7281196 - DNA, 22 bp, Homo sapiens
ttagaggtgtcaggagcacagg

SEQ ID NO: 7281197 - DNA, 22 bp, Homo sapiens
ttcatgtgtatggaacattttt

SEQ ID NO: 7281198 - DNA, 22 bp, Homo sapiens
ttcatgtatttatcatgtaaat

SEQ ID NO: 7281199 - DNA, 20 bp, Homo sapiens
ttcatgtacaggaaaggaga

SEQ ID NO: 7281200 - DNA, 22 bp, Homo sapiens
ttcacattcagaaaaagcccgt

SEQ ID NO: 7281201 - DNA, 22 bp, Homo sapiens
ttcacattgaaggtgctttctt

SEQ ID NO: 7281202 - DNA, 22 bp, Homo sapiens
ttcacattagtggttctatata

SEQ ID NO: 7281203 - DNA, 22 bp, Homo sapiens
ttccttagatccttcaatcacg

SEQ ID NO: 7281204 - DNA, 22 bp, Homo sapiens
ttctacaaatatttactgttcc

SEQ ID NO: 7281205 - DNA, 22 bp, Homo sapiens
ttctactttctctgtcattaaa

SEQ ID NO: 7281206 - DNA, 22 bp, Homo sapiens
ttcctccacgtgacaggagcca

SEQ ID NO: 7281207 - DNA, 22 bp, Homo sapiens
ttcctccagcctggagcacttc

SEQ ID NO: 7281208 - DNA, 22 bp, Homo sapiens
ttccagagaaaaggtttatttc

SEQ ID NO: 7281209 - DNA, 19 bp, Homo sapiens
ttccacacagctctcgggc

SEQ ID NO: 7281210 - DNA, 23 bp, Homo sapiens
ttgattctccagtatgggctgag

SEQ ID NO: 7281211 - DNA, 22 bp, Homo sapiens
ttgattctgatcctgtctggag

SEQ ID NO: 7281212 - DNA, 22 bp, Homo sapiens
ttgattctggtgactgatggaa

SEQ ID NO: 7281213 - DNA, 22 bp, Homo sapiens
ttcttacatattttcatatggt

SEQ ID NO: 7281214 - DNA, 22 bp, Homo sapiens
ttcttgaaggggatataaatag

SEQ ID NO: 7281215 - DNA, 22 bp, Homo sapiens
ttctgcttttagctaaactata

SEQ ID NO: 7281216 - DNA, 20 bp, Homo sapiens
ttctgagagttcacagcccc

SEQ ID NO: 7281217 - DNA, 22 bp, Homo sapiens
ttacaaagaaaattaggcattt

SEQ ID NO: 7281218 - DNA, 21 bp, Homo sapiens
ttagaagctaatgcagctggt

SEQ ID NO: 7281219 - DNA, 22 bp, Homo sapiens
ttagagaattccaaatgactac

SEQ ID NO: 7281220 - DNA, 22 bp, Homo sapiens
ttactttgttctcaagatatgt

SEQ ID NO: 7281221 - DNA, 22 bp, Homo sapiens
ttaagttttaaagctagagtct

SEQ ID NO: 7281222 - DNA, 22 bp, Homo sapiens
ttaagaaggctgtttgctagac

SEQ ID NO: 7281223 - DNA, 22 bp, Homo sapiens
ttaacattgtccttagcagatt

SEQ ID NO: 7281224 - DNA, 22 bp, Homo sapiens
tgtgtttatagtgtatcttcca

SEQ ID NO: 7281225 - DNA, 22 bp, Homo sapiens
tgtgtttacttctatgcagttt

SEQ ID NO: 7281226 - DNA, 22 bp, Homo sapiens
tgtgttaatttattgcctcaga

SEQ ID NO: 7281227 - DNA, 22 bp, Homo sapiens
tgtgtgaagcacatgttcaagg

SEQ ID NO: 7281228 - DNA, 22 bp, Homo sapiens
tgtgtgaactctctgatgtaca

SEQ ID NO: 7281229 - DNA, 22 bp, Homo sapiens
tgtgtgaacatgttttcatttc

SEQ ID NO: 7281230 - DNA, 22 bp, Homo sapiens
tgtgtgaagtgattttaagtct

SEQ ID NO: 7281231 - DNA, 22 bp, Homo sapiens
tgtgtgaatctattgaatatat

SEQ ID NO: 7281232 - DNA, 22 bp, Homo sapiens
tgtgtgaatggattattctatt

SEQ ID NO: 7281233 - DNA, 22 bp, Homo sapiens
tgtgtgattgcaggagatgtgg

SEQ ID NO: 7281234 - DNA, 22 bp, Homo sapiens
tgtgtcatctgtgttacataat

SEQ ID NO: 7281235 - DNA, 22 bp, Homo sapiens
tcccctgcagatgagggcagtg

SEQ ID NO: 7281236 - DNA, 22 bp, Homo sapiens
tcccctcctctcctgatatggg

SEQ ID NO: 7281237 - DNA, 22 bp, Homo sapiens
ggggccttggatctgtgccccg

SEQ ID NO: 7281238 - DNA, 22 bp, Homo sapiens
ggtagtcggccttgccctgggc

SEQ ID NO: 7281239 - DNA, 22 bp, Homo sapiens
gggtccctggaattacttgaca

SEQ ID NO: 7281240 - DNA, 22 bp, Homo sapiens
cagaatttagaaaacaacataa

SEQ ID NO: 7281241 - DNA, 22 bp, Homo sapiens
cagaatttttcactcaatcttc

SEQ ID NO: 7281242 - DNA, 22 bp, Homo sapiens
cagaatttttcgaatgtactgt

SEQ ID NO: 7281243 - DNA, 20 bp, Homo sapiens
cagccctccagtggaggcag

SEQ ID NO: 7281244 - DNA, 22 bp, Homo sapiens
gtccagagatggacgagcagat

SEQ ID NO: 7281245 - DNA, 22 bp, Homo sapiens
gtccagagaggcaggaggctac

SEQ ID NO: 7281246 - DNA, 22 bp, Homo sapiens
gtccagagagtaaagggggtaa

SEQ ID NO: 7281247 - DNA, 20 bp, Homo sapiens
cagcaaaatgaaaatggatt

SEQ ID NO: 7281248 - DNA, 22 bp, Homo sapiens
gtacttctcaaactagaaacta

SEQ ID NO: 7281249 - DNA, 22 bp, Homo sapiens
caatttcagtgctgtggagagg

SEQ ID NO: 7281250 - DNA, 22 bp, Homo sapiens
caatatataatgagtactttcc

SEQ ID NO: 7281251 - DNA, 22 bp, Homo sapiens
caaagtgagttataaacatctt

SEQ ID NO: 7281252 - DNA, 22 bp, Homo sapiens
cactgcactccagcctgggtga

SEQ ID NO: 7281253 - DNA, 22 bp, Homo sapiens
cactgcactccagcctgggtca

SEQ ID NO: 7281254 - DNA, 22 bp, Homo sapiens
cactgcactccagcttgggtga

SEQ ID NO: 7281255 - DNA, 21 bp, Homo sapiens
cactccacttagaacagggtt

SEQ ID NO: 7281256 - DNA, 22 bp, Homo sapiens
cactgcactccagcctgggaga

SEQ ID NO: 7281257 - DNA, 22 bp, Homo sapiens
cacaggcctgtctctttctaac

SEQ ID NO: 7281258 - DNA, 22 bp, Homo sapiens
atgatgtaatggaaagaacaga

SEQ ID NO: 7281259 - DNA, 22 bp, Homo sapiens
atctttgactgccattcttgac

SEQ ID NO: 7281260 - DNA, 23 bp, Homo sapiens
ctttgccacccagagcctgacag

SEQ ID NO: 7281261 - DNA, 22 bp, Homo sapiens
ctttttcattggctttaggaca

SEQ ID NO: 7281262 - DNA, 22 bp, Homo sapiens
atgtatcaacaaattgtacagt

SEQ ID NO: 7281263 - DNA, 22 bp, Homo sapiens
gaggttgggatgagggatacag

SEQ ID NO: 7281264 - DNA, 22 bp, Homo sapiens
atgtggctagtcctctgcggca

SEQ ID NO: 7281265 - DNA, 22 bp, Homo sapiens
atgtggctcagcaggctcccgt

SEQ ID NO: 7281266 - DNA, 22 bp, Homo sapiens
atgtggctgccacctgcctgaa

SEQ ID NO: 7281267 - DNA, 22 bp, Homo sapiens
atgggcagagtggggacaggaa

SEQ ID NO: 7281268 - DNA, 22 bp, Homo sapiens
atttctgtttgctactataagt

SEQ ID NO: 7281269 - DNA, 17 bp, Homo sapiens
gccctgcctgctgccct

SEQ ID NO: 7281270 - DNA, 22 bp, Homo sapiens
atttcccactcaggccgcggcg

SEQ ID NO: 7281271 - DNA, 22 bp, Homo sapiens
atttcccagataaacagctgga

SEQ ID NO: 7281272 - DNA, 22 bp, Homo sapiens
atttcccagctttgatcagttt

SEQ ID NO: 7281273 - DNA, 22 bp, Homo sapiens
atttcccagggcctgggatttg

SEQ ID NO: 7281274 - DNA, 22 bp, Homo sapiens
atttcccagggccctcatagtt

SEQ ID NO: 7281275 - DNA, 22 bp, Homo sapiens
gccatgcatccttggacttggc

SEQ ID NO: 7281276 - DNA, 22 bp, Homo sapiens
atttatgacaaccaaagagtga

SEQ ID NO: 7281277 - DNA, 19 bp, Homo sapiens
gctcagagacacctgttgc

SEQ ID NO: 7281278 - DNA, 22 bp, Homo sapiens
attgcactccggcctgggtgac

SEQ ID NO: 7281279 - DNA, 22 bp, Homo sapiens
attgcactccagcctgggggac

SEQ ID NO: 7281280 - DNA, 22 bp, Homo sapiens
attgcactccagcctgggtgac

SEQ ID NO: 7281281 - DNA, 22 bp, Homo sapiens
attctttccagacactgattgc

SEQ ID NO: 7281282 - DNA, 22 bp, Homo sapiens
attcacaagttgatggatattt

SEQ ID NO: 7281283 - DNA, 22 bp, Homo sapiens
attctgaagttgcaggagaagc

SEQ ID NO: 7281284 - DNA, 22 bp, Homo sapiens
gatggcagtcaaccaggtgagg

SEQ ID NO: 7281285 - DNA, 22 bp, Homo sapiens
cctgggcagggctggactctca

SEQ ID NO: 7281286 - DNA, 22 bp, Homo sapiens
cctttaggagtgaggaccgagc

SEQ ID NO: 7281287 - DNA, 22 bp, Homo sapiens
cctttagaattctgcccctcct

SEQ ID NO: 7281288 - DNA, 22 bp, Homo sapiens
cctttagaatacagactttcta

SEQ ID NO: 7281289 - DNA, 22 bp, Homo sapiens
aggttatcatcagttgagcact

SEQ ID NO: 7281290 - DNA, 19 bp, Homo sapiens
agtcatctcactgtgccca

SEQ ID NO: 7281291 - DNA, 22 bp, Homo sapiens
agtcattaattagtaggaaggt

SEQ ID NO: 7281292 - DNA, 22 bp, Homo sapiens
agtcattaaatgctgtcatggc

SEQ ID NO: 7281293 - DNA, 22 bp, Homo sapiens
ctcctcccacggtctcaggaag

SEQ ID NO: 7281294 - DNA, 22 bp, Homo sapiens
ctccagttggccccagttggtt

SEQ ID NO: 7281295 - DNA, 22 bp, Homo sapiens
ctccagggagctgcgggagcca

SEQ ID NO: 7281296 - DNA, 21 bp, Homo sapiens
agtgtgttcttggcattacct

SEQ ID NO: 7281297 - DNA, 22 bp, Homo sapiens
ctgagtgatagcgatggggaac

SEQ ID NO: 7281298 - DNA, 18 bp, Homo sapiens
ctgagtgatgatggggtg

SEQ ID NO: 7281299 - DNA, 23 bp, Homo sapiens
agtgttcagcatgtagtaaatac

SEQ ID NO: 7281300 - DNA, 22 bp, Homo sapiens
ataataactcctgttgaagaac

SEQ ID NO: 7281301 - DNA, 22 bp, Homo sapiens
ataataacacctgaataggaaa

SEQ ID NO: 7281302 - DNA, 22 bp, Homo sapiens
ataggtccaaggagaggtcttt

SEQ ID NO: 7281303 - DNA, 22 bp, Homo sapiens
atagaaaacagatgtccttaaa

SEQ ID NO: 7281304 - DNA, 21 bp, Homo sapiens
atacagaacattgatccaaga

SEQ ID NO: 7281305 - DNA, 22 bp, Homo sapiens
atacagaactctcagttgtata

SEQ ID NO: 7281306 - DNA, 22 bp, Homo sapiens
atacagaaaatgatgcagagtt

SEQ ID NO: 7281307 - DNA, 22 bp, Homo sapiens
atacagaaaagtggatagccag

SEQ ID NO: 7281308 - DNA, 21 bp, Homo sapiens
atacagaaggtggcaaagtac

SEQ ID NO: 7281309 - DNA, 22 bp, Homo sapiens
atacatgactcacacattctgc

SEQ ID NO: 7281310 - DNA, 22 bp, Homo sapiens
cttcatgttctgcctgtggaag

SEQ ID NO: 7281311 - DNA, 22 bp, Homo sapiens
ctgtttcaagtgaagtcagaca

SEQ ID NO: 7281312 - DNA, 22 bp, Homo sapiens
atatcacaggtgtttacctgat

SEQ ID NO: 7281313 - DNA, 23 bp, Homo sapiens
atatcacacccagtacagtctcc

SEQ ID NO: 7281314 - DNA, 22 bp, Homo sapiens
atatattttgcggtcacgtggc

SEQ ID NO: 7281315 - DNA, 22 bp, Homo sapiens
atatattttttgagacagagtc

SEQ ID NO: 7281316 - DNA, 22 bp, Homo sapiens
ctgtatttgaaagaaaagattt

SEQ ID NO: 7281317 - DNA, 22 bp, Homo sapiens
ctgtcattgtacatgttataca

SEQ ID NO: 7281318 - DNA, 22 bp, Homo sapiens
ctgtcatttttttagaacacct

SEQ ID NO: 7281319 - DNA, 22 bp, Homo sapiens
ctgtcattttcttccaatataa

SEQ ID NO: 7281320 - DNA, 22 bp, Homo sapiens
ctgtcatttctttagcaatggg

SEQ ID NO: 7281321 - DNA, 22 bp, Homo sapiens
ctgtcatttctattatagagga

SEQ ID NO: 7281322 - DNA, 22 bp, Homo sapiens
ctgtatatgtgcatacacacac

SEQ ID NO: 7281323 - DNA, 22 bp, Homo sapiens
ccctccccacaaagcttcacac

SEQ ID NO: 7281324 - DNA, 22 bp, Homo sapiens
ccctttcttccgtgacttctgc

SEQ ID NO: 7281325 - DNA, 22 bp, Homo sapiens
ccctttctgggacccctgtctc

SEQ ID NO: 7281326 - DNA, 22 bp, Homo sapiens
ccctttctccagaactgtctga

SEQ ID NO: 7281327 - DNA, 22 bp, Homo sapiens
agggctccaaggaagtgtagct

SEQ ID NO: 7281328 - DNA, 22 bp, Homo sapiens
agggctcccgtgaggtgactgc

SEQ ID NO: 7281329 - DNA, 22 bp, Homo sapiens
agggctccaggggaccatcagt

SEQ ID NO: 7281330 - DNA, 22 bp, Homo sapiens
agggctcctccccggcctccac

SEQ ID NO: 7281331 - DNA, 23 bp, Homo sapiens
agggctccttgttgattagcatt

SEQ ID NO: 7281332 - DNA, 22 bp, Homo sapiens
agggctcctgaggcccttctgg

SEQ ID NO: 7281333 - DNA, 22 bp, Homo sapiens
aggggaccaaaatgtcctgcct

SEQ ID NO: 7281334 - DNA, 18 bp, Homo sapiens
cctctgccatagccagca

SEQ ID NO: 7281335 - DNA, 22 bp, Homo sapiens
ccagagaggggaagggcttgcc

SEQ ID NO: 7281336 - DNA, 22 bp, Homo sapiens
ccagagagtatcatggagagta

SEQ ID NO: 7281337 - DNA, 22 bp, Homo sapiens
ccagagagtcgatgggggacac

SEQ ID NO: 7281338 - DNA, 22 bp, Homo sapiens
ccaggagagcaggcgtgcagct

SEQ ID NO: 7281339 - DNA, 22 bp, Homo sapiens
ccaggagagcagaagcccaggc

SEQ ID NO: 7281340 - DNA, 22 bp, Homo sapiens
ccaggagagcgccctcccggcc

SEQ ID NO: 7281341 - DNA, 22 bp, Homo sapiens
ccaggagatgggagcatctaaa

SEQ ID NO: 7281342 - DNA, 22 bp, Homo sapiens
aggccagatgtcgggctagaag

SEQ ID NO: 7281343 - DNA, 22 bp, Homo sapiens
aggccagatattgtgctaccca

SEQ ID NO: 7281344 - DNA, 22 bp, Homo sapiens
aggctcagttctgtggtgagcc

SEQ ID NO: 7281345 - DNA, 22 bp, Homo sapiens
ccagggagcctggtgtgtcagc

SEQ ID NO: 7281346 - DNA, 18 bp, Homo sapiens
ccagggagcttattagga

SEQ ID NO: 7281347 - DNA, 22 bp, Homo sapiens
cagggtgactgccctggccact

SEQ ID NO: 7281348 - DNA, 22 bp, Homo sapiens
cattaaaatatctcatggtgtt

SEQ ID NO: 7281349 - DNA, 22 bp, Homo sapiens
catacattacctaacttaatgc

SEQ ID NO: 7281350 - DNA, 22 bp, Homo sapiens
cagtgcccgccgccgttcctgg

SEQ ID NO: 7281351 - DNA, 22 bp, Homo sapiens
aggacccaagcacagttcctgg

SEQ ID NO: 7281352 - DNA, 22 bp, Homo sapiens
agggagacaaaagcagctgcca

SEQ ID NO: 7281353 - DNA, 22 bp, Homo sapiens
agggcagcaatgcagctgctgc

SEQ ID NO: 7281354 - DNA, 22 bp, Homo sapiens
agggctgctgaggaagccttgc

SEQ ID NO: 7281355 - DNA, 22 bp, Homo sapiens
acatgttagggacagagtatgt

SEQ ID NO: 7281356 - DNA, 22 bp, Homo sapiens
acagtaaaaagccttagaattt

SEQ ID NO: 7281357 - DNA, 22 bp, Homo sapiens
acagtaaatcaacagaatatct

SEQ ID NO: 7281358 - DNA, 22 bp, Homo sapiens
aggacacagctgctctgcagag

SEQ ID NO: 7281359 - DNA, 21 bp, Homo sapiens
acatacattatctttttaaaa

SEQ ID NO: 7281360 - DNA, 22 bp, Homo sapiens
acaggggaatttactgtcatta

SEQ ID NO: 7281361 - DNA, 22 bp, Homo sapiens
aggacacacccagctcacgggg

SEQ ID NO: 7281362 - DNA, 22 bp, Homo sapiens
aggacacaccaggtccagctgt

SEQ ID NO: 7281363 - DNA, 22 bp, Homo sapiens
aggacacactgttctcacgtaa

SEQ ID NO: 7281364 - DNA, 22 bp, Homo sapiens
acttcttcttcagctgggggat

SEQ ID NO: 7281365 - DNA, 22 bp, Homo sapiens
acttcttcttcagctgggggat

SEQ ID NO: 7281366 - DNA, 22 bp, Homo sapiens
atactgatacggaagaaaaaag

SEQ ID NO: 7281367 - DNA, 22 bp, Homo sapiens
atactgatgatgtgaagaaaca

SEQ ID NO: 7281368 - DNA, 22 bp, Homo sapiens
actgtcaaaagagattatatta

SEQ ID NO: 7281369 - DNA, 22 bp, Homo sapiens
actgtcaaatttatggaaagag

SEQ ID NO: 7281370 - DNA, 22 bp, Homo sapiens
actgtcaaggaaacaaaattac

SEQ ID NO: 7281371 - DNA, 22 bp, Homo sapiens
actttcatttgtaataaacttc

SEQ ID NO: 7281372 - DNA, 22 bp, Homo sapiens
actttcatggtagttgtattct

SEQ ID NO: 7281373 - DNA, 20 bp, Homo sapiens
actttctcggtttctcacct

SEQ ID NO: 7281374 - DNA, 22 bp, Homo sapiens
actgcacttcagcctgggtgtc

SEQ ID NO: 7281375 - DNA, 22 bp, Homo sapiens
actgcacttcagcctgggtgtc

SEQ ID NO: 7281376 - DNA, 22 bp, Homo sapiens
acctgcagctgagaaaatgact

SEQ ID NO: 7281377 - DNA, 22 bp, Homo sapiens
acctgcaggcacaggtgtgcgc

SEQ ID NO: 7281378 - DNA, 22 bp, Homo sapiens
acctgcagccacttctctcctt

SEQ ID NO: 7281379 - DNA, 22 bp, Homo sapiens
acctgcagctaaagatgtaggg

SEQ ID NO: 7281380 - DNA, 22 bp, Homo sapiens
acctgcagtggccactcctaat

SEQ ID NO: 7281381 - DNA, 19 bp, Homo sapiens
acctgcagtaataattcct

SEQ ID NO: 7281382 - DNA, 22 bp, Homo sapiens
acctgcaggtgtttccacactt

SEQ ID NO: 7281383 - DNA, 22 bp, Homo sapiens
acctgcaggggtgctctctggg

SEQ ID NO: 7281384 - DNA, 22 bp, Homo sapiens
acctgaggctgttagtctaggt

SEQ ID NO: 7281385 - DNA, 22 bp, Homo sapiens
agaagtgaaactgcaaaagtgt

SEQ ID NO: 7281386 - DNA, 22 bp, Homo sapiens
agaagtgagactcagttgatga

SEQ ID NO: 7281387 - DNA, 22 bp, Homo sapiens
agaagtgagtgtgactcagcag

SEQ ID NO: 7281388 - DNA, 22 bp, Homo sapiens
agaagttaccacatacttctct

SEQ ID NO: 7281389 - DNA, 22 bp, Homo sapiens
agagacccgcagcctcggagct

SEQ ID NO: 7281390 - DNA, 22 bp, Homo sapiens
atgtgtatatttattgtagttt

SEQ ID NO: 7281391 - DNA, 22 bp, Homo sapiens
atgtttatggagcaggtattag

SEQ ID NO: 7281392 - DNA, 22 bp, Homo sapiens
attattatatagggaaagtccc

SEQ ID NO: 7281393 - DNA, 22 bp, Homo sapiens
agatactggaggttcctacaac

SEQ ID NO: 7281394 - DNA, 22 bp, Homo sapiens
atttgtgggactataatgcagg

SEQ ID NO: 7281395 - DNA, 22 bp, Homo sapiens
atttcacatctatctcagattt

SEQ ID NO: 7281396 - DNA, 22 bp, Homo sapiens
atttcacatctatctcagattt

SEQ ID NO: 7281397 - DNA, 22 bp, Homo sapiens
atttcacagctgtcagtgttac

SEQ ID NO: 7281398 - DNA, 22 bp, Homo sapiens
atttcacagctgctgttcaggt

SEQ ID NO: 7281399 - DNA, 18 bp, Homo sapiens
agcctctggcagagagaa

SEQ ID NO: 7281400 - DNA, 22 bp, Homo sapiens
cagcagctcctctgcggctatg

SEQ ID NO: 7281401 - DNA, 22 bp, Homo sapiens
cagaaatatcagttgaaagtgc

SEQ ID NO: 7281402 - DNA, 22 bp, Homo sapiens
caactttagaccccaagtagct

SEQ ID NO: 7281403 - DNA, 22 bp, Homo sapiens
caaatagtgtcacattgtgagg

SEQ ID NO: 7281404 - DNA, 22 bp, Homo sapiens
aagagaggacatggtgaacctg

SEQ ID NO: 7281405 - DNA, 17 bp, Homo sapiens
aagagaggctgagctgg

SEQ ID NO: 7281406 - DNA, 22 bp, Homo sapiens
aagagagggacttattaaagtc

SEQ ID NO: 7281407 - DNA, 22 bp, Homo sapiens
aagagaggggttgcatggaaat

SEQ ID NO: 7281408 - DNA, 22 bp, Homo sapiens
acagaggttaggatgggttgta

SEQ ID NO: 7281409 - DNA, 23 bp, Homo sapiens
acagacaacactgatgagagaaa

SEQ ID NO: 7281410 - DNA, 18 bp, Homo sapiens
acagacaaaatggaaatg

SEQ ID NO: 7281411 - DNA, 22 bp, Homo sapiens
aacatgtaaatatcattgtact

SEQ ID NO: 7281412 - DNA, 22 bp, Homo sapiens
aataacttcatgtaacatttaa

SEQ ID NO: 7281413 - DNA, 22 bp, Homo sapiens
aactgctgtggcctagtactta

SEQ ID NO: 7281414 - DNA, 22 bp, Homo sapiens
aactgctgcatcttagaatgca

SEQ ID NO: 7281415 - DNA, 22 bp, Homo sapiens
aactgttttttactagaggact

SEQ ID NO: 7281416 - DNA, 22 bp, Homo sapiens
aactgtttttcacgtgtctcat

SEQ ID NO: 7281417 - DNA, 22 bp, Homo sapiens
aactgtttcagaaatattgttg

SEQ ID NO: 7281418 - DNA, 22 bp, Homo sapiens
aactgtttggaactcttccaca

SEQ ID NO: 7281419 - DNA, 22 bp, Homo sapiens
aactgtttatgtaagtatgcag

SEQ ID NO: 7281420 - DNA, 22 bp, Homo sapiens
aactgtttaccatacacagtga

SEQ ID NO: 7281421 - DNA, 22 bp, Homo sapiens
aatcatgacaggaatagaaggg

SEQ ID NO: 7281422 - DNA, 22 bp, Homo sapiens
aaggtcacactcccagagctga

SEQ ID NO: 7281423 - DNA, 22 bp, Homo sapiens
aaagataatgtttccttattct

SEQ ID NO: 7281424 - DNA, 22 bp, Homo sapiens
aactaaatctggcatttagagc

SEQ ID NO: 7281425 - DNA, 22 bp, Homo sapiens
aaataagttaaactagaatgat

SEQ ID NO: 7281426 - DNA, 22 bp, Homo sapiens
aaataagaaattcttctttgca

SEQ ID NO: 7281427 - DNA, 22 bp, Homo sapiens
aaatgtagtatgttgcatgtat

SEQ ID NO: 7281428 - DNA, 22 bp, Homo sapiens
aaacaagtttagaataatgaat

SEQ ID NO: 7281429 - DNA, 22 bp, Homo sapiens
aaacaagtgtaaactagtctgt

SEQ ID NO: 7281430 - DNA, 22 bp, Homo sapiens
aaaagagaatcctgtacagaga

SEQ ID NO: 7281431 - DNA, 22 bp, Homo sapiens
aaaatcttgtgacttaggaagg

SEQ ID NO: 7281432 - DNA, 23 bp, Homo sapiens
aaaatcttctgcctatgaagaaa

SEQ ID NO: 7281433 - DNA, 22 bp, Homo sapiens
aaacagaagggtaggtaaacat

SEQ ID NO: 7281434 - DNA, 22 bp, Homo sapiens
aaagaataccctgggtcataaa

SEQ ID NO: 7281435 - DNA, 22 bp, Homo sapiens
aaaggtaaagtatctgcccaag

SEQ ID NO: 7281436 - DNA, 20 bp, Homo sapiens
aatcccttctctggactctt

SEQ ID NO: 7281437 - DNA, 19 bp, Homo sapiens
aatgactgagtacattgtc

SEQ ID NO: 7281438 - DNA, 22 bp, Homo sapiens
aatgactgtagtcatattaagg

SEQ ID NO: 7281439 - DNA, 22 bp, Homo sapiens
agaaaactctacatctgtatgt

SEQ ID NO: 7281440 - DNA, 22 bp, Homo sapiens
aataagataagatttctgctct

SEQ ID NO: 7281441 - DNA, 22 bp, Homo sapiens
aataattttagctcagagttgt

SEQ ID NO: 7281442 - DNA, 22 bp, Homo sapiens
actccagttaccttggctgagg

SEQ ID NO: 7281443 - DNA, 22 bp, Homo sapiens
aagttagagattccatcatgct

SEQ ID NO: 7281444 - DNA, 22 bp, Homo sapiens
aagtggaaagagtgttgcaagg

SEQ ID NO: 7281445 - DNA, 22 bp, Homo sapiens
aagtgctttacaaatgtctgtt

SEQ ID NO: 7281446 - DNA, 23 bp, Homo sapiens
aagctgccagtctgaagcctggg

SEQ ID NO: 7281447 - DNA, 18 bp, Homo sapiens
aagctgccctcaggcagg

SEQ ID NO: 7281448 - DNA, 22 bp, Homo sapiens
aagctgccagctgagctgaggc

SEQ ID NO: 7281449 - DNA, 22 bp, Homo sapiens
accatgttggccaagctggtct

SEQ ID NO: 7281450 - DNA, 22 bp, Homo sapiens
aaggtgaactggtaatgacaga

SEQ ID NO: 7281451 - DNA, 21 bp, Homo sapiens
agcctgcctgaactctgtggc

SEQ ID NO: 7281452 - DNA, 22 bp, Homo sapiens
agcccctgtaccctgagtgctt

SEQ ID NO: 7281453 - DNA, 22 bp, Homo sapiens
acagaggtggacctcagcaggc

SEQ ID NO: 7281454 - DNA, 17 bp, Homo sapiens
agcccctcagcgtcacc

SEQ ID NO: 7281455 - DNA, 22 bp, Homo sapiens
acacatatgtatgcatcatgtg

SEQ ID NO: 7281456 - DNA, 22 bp, Homo sapiens
acacatatatttgcatatacac

SEQ ID NO: 7281457 - DNA, 22 bp, Homo sapiens
acagaaagatgatttgaaatgg

SEQ ID NO: 7281458 - DNA, 22 bp, Homo sapiens
aatgttatttctgcatagtagt

SEQ ID NO: 7281459 - DNA, 22 bp, Homo sapiens
tcccagagccaagctatggatg

SEQ ID NO: 7281460 - DNA, 22 bp, Homo sapiens
tcccagagcagtactccaggag

SEQ ID NO: 7281461 - DNA, 22 bp, Homo sapiens
tcccctttgtcttcctgtgggt

SEQ ID NO: 7281462 - DNA, 22 bp, Homo sapiens
tcccctttgtaagatggaaacg

SEQ ID NO: 7281463 - DNA, 22 bp, Homo sapiens
tcccagggactctctgccttcc

SEQ ID NO: 7281464 - DNA, 22 bp, Homo sapiens
tccctccccacttctgagcttt

SEQ ID NO: 7281465 - DNA, 22 bp, Homo sapiens
tccctggcagctgtcctttcag

SEQ ID NO: 7281466 - DNA, 22 bp, Homo sapiens
tcctgatggaggggtcatcttt

SEQ ID NO: 7281467 - DNA, 22 bp, Homo sapiens
tcctgatggcctctggctccag

SEQ ID NO: 7281468 - DNA, 22 bp, Homo sapiens
tcctgcagacctcagtcaggtc

SEQ ID NO: 7281469 - DNA, 22 bp, Homo sapiens
tcctgcagagacagaggcctca

SEQ ID NO: 7281470 - DNA, 19 bp, Homo sapiens
tcctgcagaccagacctgt

SEQ ID NO: 7281471 - DNA, 22 bp, Homo sapiens
tcctgcagccattagaggtcaa

SEQ ID NO: 7281472 - DNA, 22 bp, Homo sapiens
tcctgcagatcaaagcctttga

SEQ ID NO: 7281473 - DNA, 23 bp, Homo sapiens
tcctgcagataagctggttgaca

SEQ ID NO: 7281474 - DNA, 22 bp, Homo sapiens
tcctgcagagtcccactgattt

SEQ ID NO: 7281475 - DNA, 22 bp, Homo sapiens
tcctgcagagccgccctcaggt

SEQ ID NO: 7281476 - DNA, 20 bp, Homo sapiens
tcctgcagtcgctagcgccc

SEQ ID NO: 7281477 - DNA, 22 bp, Homo sapiens
tcctgcaggtggatgattctct

SEQ ID NO: 7281478 - DNA, 22 bp, Homo sapiens
tcctgcaggcctgttcccagta

SEQ ID NO: 7281479 - DNA, 22 bp, Homo sapiens
tcctgcaggcttgagtcctcag

SEQ ID NO: 7281480 - DNA, 18 bp, Homo sapiens
tcctgcagcttctatgta

SEQ ID NO: 7281481 - DNA, 22 bp, Homo sapiens
tcctgcagctctgagaagcatc

SEQ ID NO: 7281482 - DNA, 22 bp, Homo sapiens
tcctgcagctgaagctcatgtg

SEQ ID NO: 7281483 - DNA, 22 bp, Homo sapiens
tcctgcagctgcagacctgggg

SEQ ID NO: 7281484 - DNA, 22 bp, Homo sapiens
tcatacatcttgtatatctatc

SEQ ID NO: 7281485 - DNA, 22 bp, Homo sapiens
tcaggagacttatgtcacagtg

SEQ ID NO: 7281486 - DNA, 21 bp, Homo sapiens
tcaggagagcccatctacaaa

SEQ ID NO: 7281487 - DNA, 22 bp, Homo sapiens
tcagtagtcttgggccgacttg

SEQ ID NO: 7281488 - DNA, 22 bp, Homo sapiens
tcatttcagtggcacagaagat

SEQ ID NO: 7281489 - DNA, 22 bp, Homo sapiens
tcattgccatggcatttgcaga

SEQ ID NO: 7281490 - DNA, 22 bp, Homo sapiens
tcatttacacttcacaaatgga

SEQ ID NO: 7281491 - DNA, 22 bp, Homo sapiens
tcatttacatagaaacaatata

SEQ ID NO: 7281492 - DNA, 22 bp, Homo sapiens
tcatttactgtaggagtgaacc

SEQ ID NO: 7281493 - DNA, 22 bp, Homo sapiens
tcaactttgaaaccatagtgaa

SEQ ID NO: 7281494 - DNA, 20 bp, Homo sapiens
tcagccagctaacatgggga

SEQ ID NO: 7281495 - DNA, 22 bp, Homo sapiens
tcagccagaggtggatgagtca

SEQ ID NO: 7281496 - DNA, 18 bp, Homo sapiens
tcaggagacacagacgca

SEQ ID NO: 7281497 - DNA, 22 bp, Homo sapiens
tagtgccctcccctttgggata

SEQ ID NO: 7281498 - DNA, 22 bp, Homo sapiens
tagaagaacatgtcaaactata

SEQ ID NO: 7281499 - DNA, 22 bp, Homo sapiens
tatttaaaaagaggccagctgg

SEQ ID NO: 7281500 - DNA, 22 bp, Homo sapiens
tatttaaaatagtgctccagca

SEQ ID NO: 7281501 - DNA, 22 bp, Homo sapiens
tataaaatggcatcagctccaa

SEQ ID NO: 7281502 - DNA, 22 bp, Homo sapiens
tatcagaagacttacagtatcg

SEQ ID NO: 7281503 - DNA, 22 bp, Homo sapiens
taagagaactggatagatagga

SEQ ID NO: 7281504 - DNA, 22 bp, Homo sapiens
taagagcagacacaacctgaga

SEQ ID NO: 7281505 - DNA, 19 bp, Homo sapiens
taaagagaataccggtggc

SEQ ID NO: 7281506 - DNA, 22 bp, Homo sapiens
taaaagagaatggataacagag

SEQ ID NO: 7281507 - DNA, 22 bp, Homo sapiens
taagcctgcatgaaccatgaga

SEQ ID NO: 7281508 - DNA, 22 bp, Homo sapiens
tacagttaaaaagttcaatggt

SEQ ID NO: 7281509 - DNA, 22 bp, Homo sapiens
tacatgtatgtgttaatatctg

SEQ ID NO: 7281510 - DNA, 22 bp, Homo sapiens
tactgtgtggtgagctgtctcc

SEQ ID NO: 7281511 - DNA, 22 bp, Homo sapiens
tactgtgtgattccatttacgt

SEQ ID NO: 7281512 - DNA, 22 bp, Homo sapiens
tactgaaactcttgtaaatatc

SEQ ID NO: 7281513 - DNA, 22 bp, Homo sapiens
tactgttttttagactcatggt

SEQ ID NO: 7281514 - DNA, 22 bp, Homo sapiens
tactgtttttgcctctttagaa

SEQ ID NO: 7281515 - DNA, 22 bp, Homo sapiens
tactgtttttaaaattgcatcc

SEQ ID NO: 7281516 - DNA, 22 bp, Homo sapiens
tactgttttctttatagtacag

SEQ ID NO: 7281517 - DNA, 22 bp, Homo sapiens
tactgttttctttacaccatgt

SEQ ID NO: 7281518 - DNA, 22 bp, Homo sapiens
tactgttttaaaaggtacttgt

SEQ ID NO: 7281519 - DNA, 22 bp, Homo sapiens
tactgttttctataatggctgt

SEQ ID NO: 7281520 - DNA, 22 bp, Homo sapiens
tactgtttctactacttaggga

SEQ ID NO: 7281521 - DNA, 22 bp, Homo sapiens
tactgtttgaaattggcttgtt

SEQ ID NO: 7281522 - DNA, 22 bp, Homo sapiens
tactgtttgcagtttgcagtat

SEQ ID NO: 7281523 - DNA, 22 bp, Homo sapiens
tactgtttcaagccctcacaga

SEQ ID NO: 7281524 - DNA, 22 bp, Homo sapiens
tactgtttcctgaagcagatgc

SEQ ID NO: 7281525 - DNA, 18 bp, Homo sapiens
tactgtttaattgattac

SEQ ID NO: 7281526 - DNA, 22 bp, Homo sapiens
ggtggggattcctgatcactgt

SEQ ID NO: 7281527 - DNA, 22 bp, Homo sapiens
gggttggggcccagcagtctgc

SEQ ID NO: 7281528 - DNA, 19 bp, Homo sapiens
ggggtggctggggctccag

SEQ ID NO: 7281529 - DNA, 22 bp, Homo sapiens
gtgctgacaggagcctggcggt

SEQ ID NO: 7281530 - DNA, 22 bp, Homo sapiens
gtgaggagctctttgactcacg

SEQ ID NO: 7281531 - DNA, 22 bp, Homo sapiens
gtctttctatgcatagagcaga

SEQ ID NO: 7281532 - DNA, 22 bp, Homo sapiens
gtgaaaaatgatttgttaactg

SEQ ID NO: 7281533 - DNA, 22 bp, Homo sapiens
gtgaaaaatcatcatgacttga

SEQ ID NO: 7281534 - DNA, 22 bp, Homo sapiens
gtctacttttgtcatcattgca

SEQ ID NO: 7281535 - DNA, 22 bp, Homo sapiens
gtccagagaagggaggggactc

SEQ ID NO: 7281536 - DNA, 21 bp, Homo sapiens
gtccagagagccggctcctga

SEQ ID NO: 7281537 - DNA, 22 bp, Homo sapiens
gtcactgtatccaggttccagc

SEQ ID NO: 7281538 - DNA, 22 bp, Homo sapiens
gtagtcccagctaccccggagg

SEQ ID NO: 7281539 - DNA, 22 bp, Homo sapiens
gtagtcccagctaccccggagg

SEQ ID NO: 7281540 - DNA, 22 bp, Homo sapiens
gtaggtcagacataagaggaca

SEQ ID NO: 7281541 - DNA, 22 bp, Homo sapiens
gggaagatagtgttgagggccc

SEQ ID NO: 7281542 - DNA, 22 bp, Homo sapiens
gggaaggcatacctgagggaga

SEQ ID NO: 7281543 - DNA, 22 bp, Homo sapiens
gggaagagggagctggaatgat

SEQ ID NO: 7281544 - DNA, 22 bp, Homo sapiens
gggcaggtgccagctccctgtc

SEQ ID NO: 7281545 - DNA, 22 bp, Homo sapiens
gggagctcgtgcgcccaggtgc

SEQ ID NO: 7281546 - DNA, 21 bp, Homo sapiens
ggccacagttagggctcagga

SEQ ID NO: 7281547 - DNA, 22 bp, Homo sapiens
ggccacagagggcgggatgctg

SEQ ID NO: 7281548 - DNA, 17 bp, Homo sapiens
ggccacagagcttgggg

SEQ ID NO: 7281549 - DNA, 22 bp, Homo sapiens
ggccacagcagatgcttcagat

SEQ ID NO: 7281550 - DNA, 22 bp, Homo sapiens
ggctctgcccaggtggacagca

SEQ ID NO: 7281551 - DNA, 22 bp, Homo sapiens
gctgcctcccagagccctgcag

SEQ ID NO: 7281552 - DNA, 22 bp, Homo sapiens
gctgcagggagctggaaggctc

SEQ ID NO: 7281553 - DNA, 22 bp, Homo sapiens
ggaaaaatagagtatactttaa

SEQ ID NO: 7281554 - DNA, 22 bp, Homo sapiens
ggaaaaacagtctttattattt

SEQ ID NO: 7281555 - DNA, 22 bp, Homo sapiens
ggaaggctctgttccttgactt

SEQ ID NO: 7281556 - DNA, 22 bp, Homo sapiens
ggaaggcttgagttcccaggtc

SEQ ID NO: 7281557 - DNA, 22 bp, Homo sapiens
gctgtgtgctaggatatgtttt

SEQ ID NO: 7281558 - DNA, 19 bp, Homo sapiens
gcctcatttccacctcccc

SEQ ID NO: 7281559 - DNA, 22 bp, Homo sapiens
gcccctcccagtcaggagcact

SEQ ID NO: 7281560 - DNA, 22 bp, Homo sapiens
gcctgcagtgagtgcagaaggt

SEQ ID NO: 7281561 - DNA, 21 bp, Homo sapiens
gcctgcagttttgaagccctt

SEQ ID NO: 7281562 - DNA, 22 bp, Homo sapiens
gcctgcagggcctgggcctacc

SEQ ID NO: 7281563 - DNA, 21 bp, Homo sapiens
gcctgcagaccccaccaggct

SEQ ID NO: 7281564 - DNA, 21 bp, Homo sapiens
gccacctcgtctcggagcagc

SEQ ID NO: 7281565 - DNA, 22 bp, Homo sapiens
gcagtttgaggttttctgatgt

SEQ ID NO: 7281566 - DNA, 22 bp, Homo sapiens
gcccaagatcagtggggcagat

SEQ ID NO: 7281567 - DNA, 18 bp, Homo sapiens
gcaggcctagaacttggt

SEQ ID NO: 7281568 - DNA, 22 bp, Homo sapiens
gcacagagacagtcctgagatc

SEQ ID NO: 7281569 - DNA, 22 bp, Homo sapiens
gcacagaaccctatctttcgga

SEQ ID NO: 7281570 - DNA, 22 bp, Homo sapiens
gcacagaacttctcttagtagg

SEQ ID NO: 7281571 - DNA, 22 bp, Homo sapiens
gcacagagtcactagctaagca

SEQ ID NO: 7281572 - DNA, 22 bp, Homo sapiens
gcacagcagctgggggccctgg

SEQ ID NO: 7281573 - DNA, 22 bp, Homo sapiens
gcagaggtgtgggaggggccac

SEQ ID NO: 7281574 - DNA, 22 bp, Homo sapiens
gcagaggtgtcaccttccagga

SEQ ID NO: 7281575 - DNA, 22 bp, Homo sapiens
gcagaggtgtagccccctccat

SEQ ID NO: 7281576 - DNA, 22 bp, Homo sapiens
gcagaggtgtagccccctccat

SEQ ID NO: 7281577 - DNA, 22 bp, Homo sapiens
gcagaggtgctcagtggcagaa

SEQ ID NO: 7281578 - DNA, 22 bp, Homo sapiens
gcagaggtgagtttctcagctg

SEQ ID NO: 7281579 - DNA, 22 bp, Homo sapiens
gcagaggttggattggtgactt

SEQ ID NO: 7281580 - DNA, 22 bp, Homo sapiens
gcagaggttggattggtgactt

SEQ ID NO: 7281581 - DNA, 22 bp, Homo sapiens
ctgggtgtagatggaagtttgg

SEQ ID NO: 7281582 - DNA, 22 bp, Homo sapiens
ctgggtgttgggtactgaccgt

SEQ ID NO: 7281583 - DNA, 22 bp, Homo sapiens
ctgggtgtagcccagtatgagg

SEQ ID NO: 7281584 - DNA, 22 bp, Homo sapiens
ctgggtgtcaggagacatgatg

SEQ ID NO: 7281585 - DNA, 22 bp, Homo sapiens
ctgggccaggaccagggttgaa

SEQ ID NO: 7281586 - DNA, 22 bp, Homo sapiens
ctgggaggcggaggttgcagtg

SEQ ID NO: 7281587 - DNA, 22 bp, Homo sapiens
ctgggctcagtggctcatggct

SEQ ID NO: 7281588 - DNA, 22 bp, Homo sapiens
ctgggctcagtgtctcactcct

SEQ ID NO: 7281589 - DNA, 22 bp, Homo sapiens
ctgggctcaaatcctggccctg

SEQ ID NO: 7281590 - DNA, 22 bp, Homo sapiens
ctgtgtttgacaggcggtctcc

SEQ ID NO: 7281591 - DNA, 22 bp, Homo sapiens
ctgtgtttggacaacttttcag

SEQ ID NO: 7281592 - DNA, 22 bp, Homo sapiens
ctgtgttttgagatattattaa

SEQ ID NO: 7281593 - DNA, 22 bp, Homo sapiens
ctgtgtttttggtctgatctat

SEQ ID NO: 7281594 - DNA, 22 bp, Homo sapiens
ctgtgtttctgagaagtgggga

SEQ ID NO: 7281595 - DNA, 22 bp, Homo sapiens
ctgtggcttctaggtccccgat

SEQ ID NO: 7281596 - DNA, 22 bp, Homo sapiens
ctgtggcttctgcttgggcctc

SEQ ID NO: 7281597 - DNA, 22 bp, Homo sapiens
ctgtggcttctgggtcagttca

SEQ ID NO: 7281598 - DNA, 22 bp, Homo sapiens
ctgtggctttctctgcctcctt

SEQ ID NO: 7281599 - DNA, 22 bp, Homo sapiens
ctgtggctttgcagggcttgtt

SEQ ID NO: 7281600 - DNA, 22 bp, Homo sapiens
ctgtcccagatgttctcagcac

SEQ ID NO: 7281601 - DNA, 22 bp, Homo sapiens
ctgtcccatccttactctaccc

SEQ ID NO: 7281602 - DNA, 22 bp, Homo sapiens
ctgtcattgagcctgtcagggc

SEQ ID NO: 7281603 - DNA, 22 bp, Homo sapiens
ctgtcattcttacataatgtga

SEQ ID NO: 7281604 - DNA, 22 bp, Homo sapiens
ctgtcattggcagggagtgtgt

SEQ ID NO: 7281605 - DNA, 22 bp, Homo sapiens
ctttcctccactccctaggctt

SEQ ID NO: 7281606 - DNA, 22 bp, Homo sapiens
ctttcctagttggtcccagcac

SEQ ID NO: 7281607 - DNA, 22 bp, Homo sapiens
ctttctcagtgttaattacttt

SEQ ID NO: 7281608 - DNA, 22 bp, Homo sapiens
gaagaacacttcatgattcatt

SEQ ID NO: 7281609 - DNA, 22 bp, Homo sapiens
gaaagaatgctatagtgacttc

SEQ ID NO: 7281610 - DNA, 22 bp, Homo sapiens
gaaaaatgctccaaatctgtgg

SEQ ID NO: 7281611 - DNA, 22 bp, Homo sapiens
gacatcaggcctgcagtctggg

SEQ ID NO: 7281612 - DNA, 22 bp, Homo sapiens
gaagaattgaggatgtttacct

SEQ ID NO: 7281613 - DNA, 22 bp, Homo sapiens
gacagcagccacagggagaggg

SEQ ID NO: 7281614 - DNA, 22 bp, Homo sapiens
gagaagccgagtcagctgagcc

SEQ ID NO: 7281615 - DNA, 22 bp, Homo sapiens
gagctcattcattcattgcctg

SEQ ID NO: 7281616 - DNA, 21 bp, Homo sapiens
cgtgactgggtccgtctggct

SEQ ID NO: 7281617 - DNA, 22 bp, Homo sapiens
ccttttgctctcccatccagaa

SEQ ID NO: 7281618 - DNA, 22 bp, Homo sapiens
ttacataacggtatgaaaaatg

SEQ ID NO: 7281619 - DNA, 22 bp, Homo sapiens
ccttcagccttcatccttcctt

SEQ ID NO: 7281620 - DNA, 18 bp, Homo sapiens
ccttcagctctgccagta

SEQ ID NO: 7281621 - DNA, 22 bp, Homo sapiens
ttatatttctggtagccttcag

SEQ ID NO: 7281622 - DNA, 21 bp, Homo sapiens
cctgtgtgtgtccctttaaga

SEQ ID NO: 7281623 - DNA, 21 bp, Homo sapiens
ttacagaatccatgggaagtc

SEQ ID NO: 7281624 - DNA, 22 bp, Homo sapiens
ttctttctctccacaaggcttg

SEQ ID NO: 7281625 - DNA, 22 bp, Homo sapiens
ttctttctgaatacagttgagt

SEQ ID NO: 7281626 - DNA, 22 bp, Homo sapiens
ttctgaaggctcctcaggaaag

SEQ ID NO: 7281627 - DNA, 22 bp, Homo sapiens
ctagaggtagaggcagtgggaa

SEQ ID NO: 7281628 - DNA, 22 bp, Homo sapiens
ctccagaggatgcaggtgaggg

SEQ ID NO: 7281629 - DNA, 22 bp, Homo sapiens
ctccagagtcacactgcctggg

SEQ ID NO: 7281630 - DNA, 21 bp, Homo sapiens
ctgcaggatgctgaagccagg

SEQ ID NO: 7281631 - DNA, 22 bp, Homo sapiens
ctgccccatggtccctggtggg

SEQ ID NO: 7281632 - DNA, 22 bp, Homo sapiens
ctgcccctgccaggcagctgtc

SEQ ID NO: 7281633 - DNA, 22 bp, Homo sapiens
ctgccccacaggcttggtaggg

SEQ ID NO: 7281634 - DNA, 22 bp, Homo sapiens
ctgctgtcccagcctcctcaca

SEQ ID NO: 7281635 - DNA, 22 bp, Homo sapiens
ctgctgtcaaaaatcactccat

SEQ ID NO: 7281636 - DNA, 22 bp, Homo sapiens
ctggagagtaatctctgtgtta

SEQ ID NO: 7281637 - DNA, 19 bp, Homo sapiens
ctctgggctgcatcttggt

SEQ ID NO: 7281638 - DNA, 22 bp, Homo sapiens
tttgaaaattagacacaggcta

SEQ ID NO: 7281639 - DNA, 22 bp, Homo sapiens
tttccaatgtagatgtctctgg

SEQ ID NO: 7281640 - DNA, 22 bp, Homo sapiens
tttccaattcaagcttttacgt

SEQ ID NO: 7281641 - DNA, 22 bp, Homo sapiens
tttcacatatcaactctatcct

SEQ ID NO: 7281642 - DNA, 22 bp, Homo sapiens
tagagttatatgatgtgctagt

SEQ ID NO: 7281643 - DNA, 22 bp, Homo sapiens
tactatttggaattttaaattg

SEQ ID NO: 7281644 - DNA, 20 bp, Homo sapiens
cagccctgtgacctggccct

SEQ ID NO: 7281645 - DNA, 22 bp, Homo sapiens
tagctcaaaggttaagtgtgga

SEQ ID NO: 7281646 - DNA, 19 bp, Homo sapiens
tagtctttattcttaattt

SEQ ID NO: 7281647 - DNA, 22 bp, Homo sapiens
tagtgaaacctgacagatcatg

SEQ ID NO: 7281648 - DNA, 22 bp, Homo sapiens
tagtgaaatttatgcacagcta

SEQ ID NO: 7281649 - DNA, 22 bp, Homo sapiens
tagtgaaatatgtgctgatagc

SEQ ID NO: 7281650 - DNA, 22 bp, Homo sapiens
tagtgaaatgagaatgtatgac

SEQ ID NO: 7281651 - DNA, 22 bp, Homo sapiens
tagtgaaagtcaaagacagcta

SEQ ID NO: 7281652 - DNA, 22 bp, Homo sapiens
tatcataagttaattaaacagt

SEQ ID NO: 7281653 - DNA, 22 bp, Homo sapiens
tatcagtttattctataaatag

SEQ ID NO: 7281654 - DNA, 22 bp, Homo sapiens
tcacagttcaactagttcagat

SEQ ID NO: 7281655 - DNA, 22 bp, Homo sapiens
tcacagttgattgaaacacagc

SEQ ID NO: 7281656 - DNA, 22 bp, Homo sapiens
tcacagtttccataggtcagca

SEQ ID NO: 7281657 - DNA, 22 bp, Homo sapiens
tcacagttactccttcagatga

SEQ ID NO: 7281658 - DNA, 22 bp, Homo sapiens
cagttacatgctcatgtcatca

SEQ ID NO: 7281659 - DNA, 20 bp, Homo sapiens
tcatgcaagattcataaagg

SEQ ID NO: 7281660 - DNA, 22 bp, Homo sapiens
tccagagaggcatatttacaag

SEQ ID NO: 7281661 - DNA, 22 bp, Homo sapiens
tccagagagccacggacagggg

SEQ ID NO: 7281662 - DNA, 22 bp, Homo sapiens
tccagagaattctacgcagtgc

SEQ ID NO: 7281663 - DNA, 22 bp, Homo sapiens
catgtgttaatctttctgcaaa

SEQ ID NO: 7281664 - DNA, 22 bp, Homo sapiens
catgtgtttcgagactgttgag

SEQ ID NO: 7281665 - DNA, 22 bp, Homo sapiens
tccctaggagaattgccgcagc

SEQ ID NO: 7281666 - DNA, 22 bp, Homo sapiens
cattgacttacctagtatcacc

SEQ ID NO: 7281667 - DNA, 22 bp, Homo sapiens
tccctaggtcctagtcacagta

SEQ ID NO: 7281668 - DNA, 22 bp, Homo sapiens
tccctcacctagtctttgactc

SEQ ID NO: 7281669 - DNA, 22 bp, Homo sapiens
tctcctggctcaccaggctgga

SEQ ID NO: 7281670 - DNA, 22 bp, Homo sapiens
tctcctggctcaccaggctgga

SEQ ID NO: 7281671 - DNA, 22 bp, Homo sapiens
ccagcccttcccaactggccag

SEQ ID NO: 7281672 - DNA, 22 bp, Homo sapiens
ccagagaggccaaggtcgtggt

SEQ ID NO: 7281673 - DNA, 22 bp, Homo sapiens
ccagagagagtactgggctctg

SEQ ID NO: 7281674 - DNA, 19 bp, Homo sapiens
ccagagagctaggtacaga

SEQ ID NO: 7281675 - DNA, 22 bp, Homo sapiens
tctccaggaagccctccctgac

SEQ ID NO: 7281676 - DNA, 21 bp, Homo sapiens
ccagagagagggaagtgggtt

SEQ ID NO: 7281677 - DNA, 22 bp, Homo sapiens
ccacctcctaggcctggagaag

SEQ ID NO: 7281678 - DNA, 22 bp, Homo sapiens
tcgcttgaacccaggaagtgga

SEQ ID NO: 7281679 - DNA, 22 bp, Homo sapiens
ccacctccacctattgccagcc

SEQ ID NO: 7281680 - DNA, 22 bp, Homo sapiens
ccctactctgccactttttctg

SEQ ID NO: 7281681 - DNA, 20 bp, Homo sapiens
tggaaggcatctgcattatt

SEQ ID NO: 7281682 - DNA, 22 bp, Homo sapiens
tggaaggcaggacctgccttgg

SEQ ID NO: 7281683 - DNA, 22 bp, Homo sapiens
tggaaggcagtgatattgttga

SEQ ID NO: 7281684 - DNA, 22 bp, Homo sapiens
tggaaggctgtgattactgtgc

SEQ ID NO: 7281685 - DNA, 22 bp, Homo sapiens
tggaaggcctgttgtgtcctag

SEQ ID NO: 7281686 - DNA, 22 bp, Homo sapiens
tggaaggcttggaatacttcca

SEQ ID NO: 7281687 - DNA, 22 bp, Homo sapiens
tggaaggctttgctgtccttgc

SEQ ID NO: 7281688 - DNA, 19 bp, Homo sapiens
tgcctgctcctggcttcca

SEQ ID NO: 7281689 - DNA, 22 bp, Homo sapiens
tgctttcatattgcctatgact

SEQ ID NO: 7281690 - DNA, 22 bp, Homo sapiens
tgctttcaaaggctttctagat

SEQ ID NO: 7281691 - DNA, 22 bp, Homo sapiens
ccctgcctacagggttttcttt

SEQ ID NO: 7281692 - DNA, 22 bp, Homo sapiens
ccctgcagagccagccctgacc

SEQ ID NO: 7281693 - DNA, 22 bp, Homo sapiens
ccctgcagatctagggtccttc

SEQ ID NO: 7281694 - DNA, 22 bp, Homo sapiens
ccctgcagatcagtgagaactt

SEQ ID NO: 7281695 - DNA, 22 bp, Homo sapiens
ccctgcagcattctctaactgg

SEQ ID NO: 7281696 - DNA, 22 bp, Homo sapiens
ccctgcagagaccactgacctt

SEQ ID NO: 7281697 - DNA, 22 bp, Homo sapiens
ccctgcagagagtgcttttgtg

SEQ ID NO: 7281698 - DNA, 22 bp, Homo sapiens
ccctgccttgtctgggctaggt

SEQ ID NO: 7281699 - DNA, 22 bp, Homo sapiens
ccctgccttcttggcctttaaa

SEQ ID NO: 7281700 - DNA, 23 bp, Homo sapiens
cctccccttcccacagctgggtg

SEQ ID NO: 7281701 - DNA, 19 bp, Homo sapiens
cctccccttggaccagcaa

SEQ ID NO: 7281702 - DNA, 18 bp, Homo sapiens
cctccctcattttcccag

SEQ ID NO: 7281703 - DNA, 22 bp, Homo sapiens
cctccctccctgcagaagccac

SEQ ID NO: 7281704 - DNA, 22 bp, Homo sapiens
cctccctctgttagagctgtct

SEQ ID NO: 7281705 - DNA, 22 bp, Homo sapiens
cctcccctcagacagagactgg

SEQ ID NO: 7281706 - DNA, 22 bp, Homo sapiens
cctcccctgctcagaactctgg

SEQ ID NO: 7281707 - DNA, 22 bp, Homo sapiens
cctcactcttgtcctggcaggt

SEQ ID NO: 7281708 - DNA, 22 bp, Homo sapiens
cctcagccttggccccaggcag

SEQ ID NO: 7281709 - DNA, 18 bp, Homo sapiens
ccgggctttggtgacaca

SEQ ID NO: 7281710 - DNA, 22 bp, Homo sapiens
ccggctactcgggaggctgacg

SEQ ID NO: 7281711 - DNA, 22 bp, Homo sapiens
ccctttccatggctctcctagg

SEQ ID NO: 7281712 - DNA, 22 bp, Homo sapiens
cctgactcctgggcaaaaccaa

SEQ ID NO: 7281713 - DNA, 22 bp, Homo sapiens
cctgacaggagaagcgcagcat

SEQ ID NO: 7281714 - DNA, 23 bp, Homo sapiens
cctgaccctgtctccctcacatg

SEQ ID NO: 7281715 - DNA, 22 bp, Homo sapiens
cctgcaagagcggagaagccag

SEQ ID NO: 7281716 - DNA, 23 bp, Homo sapiens
tggctctctcagtgctgcagagg

SEQ ID NO: 7281717 - DNA, 22 bp, Homo sapiens
tgggagcagttcaggtgtggct

SEQ ID NO: 7281718 - DNA, 22 bp, Homo sapiens
cctgcttccttcaagtttatct

SEQ ID NO: 7281719 - DNA, 22 bp, Homo sapiens
cctgctgttttcttcacttcag

SEQ ID NO: 7281720 - DNA, 21 bp, Homo sapiens
tgtaagtttcatctgaattgg

SEQ ID NO: 7281721 - DNA, 19 bp, Homo sapiens
tgagctggctgagcctctc

SEQ ID NO: 7281722 - DNA, 22 bp, Homo sapiens
tgcagtctggatgtcctcagat

SEQ ID NO: 7281723 - DNA, 22 bp, Homo sapiens
tgccctccctgtactgtcagga

SEQ ID NO: 7281724 - DNA, 21 bp, Homo sapiens
tgcatatataagtgcatacac

SEQ ID NO: 7281725 - DNA, 22 bp, Homo sapiens
cccagagagcatttggacaaag

SEQ ID NO: 7281726 - DNA, 22 bp, Homo sapiens
cccagagaattccacatagagg

SEQ ID NO: 7281727 - DNA, 22 bp, Homo sapiens
ttccttctggaagcttcagggg

SEQ ID NO: 7281728 - DNA, 22 bp, Homo sapiens
ttctgtgtgccagagttgtgct

SEQ ID NO: 7281729 - DNA, 22 bp, Homo sapiens
ttctgtgtgcttactggtgttc

SEQ ID NO: 7281730 - DNA, 22 bp, Homo sapiens
ttctgtgtcttcttgttctgtg

SEQ ID NO: 7281731 - DNA, 22 bp, Homo sapiens
ttattgtgtcttggtttatctt

SEQ ID NO: 7281732 - DNA, 20 bp, Homo sapiens
tcctgctgccacctcttctt

SEQ ID NO: 7281733 - DNA, 22 bp, Homo sapiens
tcctgctggaaacttcctcttg

SEQ ID NO: 7281734 - DNA, 22 bp, Homo sapiens
ttaggaaagggttttctaacag

SEQ ID NO: 7281735 - DNA, 22 bp, Homo sapiens
ttatactaaaacgcattgaatt

SEQ ID NO: 7281736 - DNA, 22 bp, Homo sapiens
ttatataaagataacttttctt

SEQ ID NO: 7281737 - DNA, 22 bp, Homo sapiens
ttcatttttaccgcgtgtcaaa

SEQ ID NO: 7281738 - DNA, 22 bp, Homo sapiens
ttcattgtactttaagagatgc

SEQ ID NO: 7281739 - DNA, 22 bp, Homo sapiens
ttcattgtgaacacattctgcc

SEQ ID NO: 7281740 - DNA, 22 bp, Homo sapiens
tttcacacgcatctgtctgccc

SEQ ID NO: 7281741 - DNA, 22 bp, Homo sapiens
tttcacacccactaggactgtt

SEQ ID NO: 7281742 - DNA, 22 bp, Homo sapiens
tttcacactgcagcatcagaga

SEQ ID NO: 7281743 - DNA, 23 bp, Homo sapiens
tttcacaatgagcattacagaat

SEQ ID NO: 7281744 - DNA, 22 bp, Homo sapiens
tttcatcttccttggcataggt

SEQ ID NO: 7281745 - DNA, 22 bp, Homo sapiens
tttcattgatgggtgatagaaa

SEQ ID NO: 7281746 - DNA, 22 bp, Homo sapiens
tttaatgtagcgtgaaatgatt

SEQ ID NO: 7281747 - DNA, 22 bp, Homo sapiens
ttgctctgaacccagggcacca

SEQ ID NO: 7281748 - DNA, 22 bp, Homo sapiens
ttgcttcagaagttctgcttgt

SEQ ID NO: 7281749 - DNA, 22 bp, Homo sapiens
ttgggaggtaatggagccaagt

SEQ ID NO: 7281750 - DNA, 22 bp, Homo sapiens
ttgggacagaaaaggagaagat

SEQ ID NO: 7281751 - DNA, 22 bp, Homo sapiens
ttgtggctcatcttcagctccc

SEQ ID NO: 7281752 - DNA, 22 bp, Homo sapiens
ttgtggctgtgcaccgctgcct

SEQ ID NO: 7281753 - DNA, 22 bp, Homo sapiens
tttgtaaagtctgttctgagtt

SEQ ID NO: 7281754 - DNA, 22 bp, Homo sapiens
ttttcattagaatgactgagaa

SEQ ID NO: 7281755 - DNA, 22 bp, Homo sapiens
ttttcattgttactatgagcta

SEQ ID NO: 7281756 - DNA, 22 bp, Homo sapiens
ttttcatttttgtagatgcaag

SEQ ID NO: 7281757 - DNA, 22 bp, Homo sapiens
tttcctcctagcctccagccgc

SEQ ID NO: 7281758 - DNA, 22 bp, Homo sapiens
gtctttcttcagagcttggact

SEQ ID NO: 7281759 - DNA, 22 bp, Homo sapiens
gtgaagtgattgaagggtaggg

SEQ ID NO: 7281760 - DNA, 22 bp, Homo sapiens
gtgaagtggagtggtatggttt

SEQ ID NO: 7281761 - DNA, 22 bp, Homo sapiens
gtctttctgctgcacggactgc

SEQ ID NO: 7281762 - DNA, 22 bp, Homo sapiens
gtctttctctggaacagtaaaa

SEQ ID NO: 7281763 - DNA, 22 bp, Homo sapiens
gtctttcttaaacaacagaaca

SEQ ID NO: 7281764 - DNA, 22 bp, Homo sapiens
cagcaggtgcaggtgcggccgc

SEQ ID NO: 7281765 - DNA, 22 bp, Homo sapiens
cagcaggttaacagaggctggt

SEQ ID NO: 7281766 - DNA, 22 bp, Homo sapiens
cagcagagctgggctttgaatt

SEQ ID NO: 7281767 - DNA, 22 bp, Homo sapiens
cagcaggtcccactgagggccc

SEQ ID NO: 7281768 - DNA, 22 bp, Homo sapiens
gtgcctggtatgtaggtagcgg

SEQ ID NO: 7281769 - DNA, 20 bp, Homo sapiens
cagcctccactcactcagct

SEQ ID NO: 7281770 - DNA, 22 bp, Homo sapiens
gtgcctggggttgagctatgaa

SEQ ID NO: 7281771 - DNA, 22 bp, Homo sapiens
gtgcctgggcatgagcttgttg

SEQ ID NO: 7281772 - DNA, 22 bp, Homo sapiens
gtaagaaaaccttctttctaat

SEQ ID NO: 7281773 - DNA, 22 bp, Homo sapiens
cagagagagtctgtccctgaag

SEQ ID NO: 7281774 - DNA, 22 bp, Homo sapiens
cagagagaggggctgcctggcc

SEQ ID NO: 7281775 - DNA, 20 bp, Homo sapiens
cagagacctgtcttcacaga

SEQ ID NO: 7281776 - DNA, 22 bp, Homo sapiens
cagagagaatcttggcagctga

SEQ ID NO: 7281777 - DNA, 22 bp, Homo sapiens
gggctcaggtcagggcatcagc

SEQ ID NO: 7281778 - DNA, 19 bp, Homo sapiens
cagaggcactttctcttag

SEQ ID NO: 7281779 - DNA, 22 bp, Homo sapiens
ggatacagcggcttctgcgcga

SEQ ID NO: 7281780 - DNA, 22 bp, Homo sapiens
ggctcctgggggtgctcctgcc

SEQ ID NO: 7281781 - DNA, 22 bp, Homo sapiens
ggcgctcagtgttgccccagag

SEQ ID NO: 7281782 - DNA, 22 bp, Homo sapiens
cacagccttgagcgaggacaag

SEQ ID NO: 7281783 - DNA, 22 bp, Homo sapiens
cacagcctgctgcactcaagaa

SEQ ID NO: 7281784 - DNA, 22 bp, Homo sapiens
cacagcctccttcagagagcat

SEQ ID NO: 7281785 - DNA, 22 bp, Homo sapiens
cacagcagggatgaatggagtg

SEQ ID NO: 7281786 - DNA, 22 bp, Homo sapiens
cacagcctcctctggctcacgg

SEQ ID NO: 7281787 - DNA, 22 bp, Homo sapiens
ggacacagataatcacacagat

SEQ ID NO: 7281788 - DNA, 22 bp, Homo sapiens
ggagagtctgagcctgctggag

SEQ ID NO: 7281789 - DNA, 22 bp, Homo sapiens
ggagagtctgagcctgctggag

SEQ ID NO: 7281790 - DNA, 22 bp, Homo sapiens
caaattcctcagaatcagaaaa

SEQ ID NO: 7281791 - DNA, 22 bp, Homo sapiens
atgtcacagcaggagtattctt

SEQ ID NO: 7281792 - DNA, 22 bp, Homo sapiens
atgtacaaaatgttttgaaatg

SEQ ID NO: 7281793 - DNA, 22 bp, Homo sapiens
atgtttcagggtgatagaaggt

SEQ ID NO: 7281794 - DNA, 22 bp, Homo sapiens
atgtttcaaatatatagagttg

SEQ ID NO: 7281795 - DNA, 22 bp, Homo sapiens
gccctcctgcaggggcttctgg

SEQ ID NO: 7281796 - DNA, 22 bp, Homo sapiens
gccctgccctctcggcactcgc

SEQ ID NO: 7281797 - DNA, 22 bp, Homo sapiens
gcccctccatccatcaccgggg

SEQ ID NO: 7281798 - DNA, 18 bp, Homo sapiens
gccagaggtactactgat

SEQ ID NO: 7281799 - DNA, 22 bp, Homo sapiens
gccagaggggctcgaaggcgcg

SEQ ID NO: 7281800 - DNA, 18 bp, Homo sapiens
gccagagggcccaaggtc

SEQ ID NO: 7281801 - DNA, 22 bp, Homo sapiens
gccagaggttcaacaactgtct

SEQ ID NO: 7281802 - DNA, 18 bp, Homo sapiens
gccagagggaagcaggtg

SEQ ID NO: 7281803 - DNA, 22 bp, Homo sapiens
gcctgcccacggggctggcata

SEQ ID NO: 7281804 - DNA, 21 bp, Homo sapiens
gcctgccctctgtgatggcca

SEQ ID NO: 7281805 - DNA, 22 bp, Homo sapiens
atttgcaagcatgcacaaaagc

SEQ ID NO: 7281806 - DNA, 22 bp, Homo sapiens
gcaaaagtacagccggatttct

SEQ ID NO: 7281807 - DNA, 18 bp, Homo sapiens
gcacagagcaagtttcat

SEQ ID NO: 7281808 - DNA, 22 bp, Homo sapiens
gcacagagcttgtttacatttg

SEQ ID NO: 7281809 - DNA, 22 bp, Homo sapiens
gcacagaggatgaggcagctct

SEQ ID NO: 7281810 - DNA, 22 bp, Homo sapiens
gcagaggctgtagggaaggttg

SEQ ID NO: 7281811 - DNA, 22 bp, Homo sapiens
gcagtgctgagaggtgatcgga

SEQ ID NO: 7281812 - DNA, 22 bp, Homo sapiens
agtgccctgggccttccaggac

SEQ ID NO: 7281813 - DNA, 22 bp, Homo sapiens
agtgcctggcacatggaaggtg

SEQ ID NO: 7281814 - DNA, 22 bp, Homo sapiens
agtgcctggaccccatgacata

SEQ ID NO: 7281815 - DNA, 22 bp, Homo sapiens
agtgatggtgagtgagaagctc

SEQ ID NO: 7281816 - DNA, 22 bp, Homo sapiens
agtgaaaacctaatcatgcagt

SEQ ID NO: 7281817 - DNA, 22 bp, Homo sapiens
agtcttctgctctgtcactaac

SEQ ID NO: 7281818 - DNA, 22 bp, Homo sapiens
agtgtttcaagtgatgctttgg

SEQ ID NO: 7281819 - DNA, 22 bp, Homo sapiens
agtgtttggggtgattgtaacc

SEQ ID NO: 7281820 - DNA, 21 bp, Homo sapiens
agttaaacctttagagaacta

SEQ ID NO: 7281821 - DNA, 22 bp, Homo sapiens
ctgagccagcgggctcactttt

SEQ ID NO: 7281822 - DNA, 22 bp, Homo sapiens
agtgggtgtagtcttcctcctg

SEQ ID NO: 7281823 - DNA, 22 bp, Homo sapiens
cctgggaggtggaggttgcagt

SEQ ID NO: 7281824 - DNA, 22 bp, Homo sapiens
cctgggaggtggaggttgcagc

SEQ ID NO: 7281825 - DNA, 21 bp, Homo sapiens
cctgtgccagtctatgtgttc

SEQ ID NO: 7281826 - DNA, 22 bp, Homo sapiens
cctgggtccaattctggcttgt

SEQ ID NO: 7281827 - DNA, 22 bp, Homo sapiens
ctatctcagataacctgcacca

SEQ ID NO: 7281828 - DNA, 22 bp, Homo sapiens
ataaaaaggacagatgtggtct

SEQ ID NO: 7281829 - DNA, 20 bp, Homo sapiens
ataaaactctaatctggcct

SEQ ID NO: 7281830 - DNA, 22 bp, Homo sapiens
ataaaagaagttttggtacttg

SEQ ID NO: 7281831 - DNA, 22 bp, Homo sapiens
ctgcagggaccacaagcaggtt

SEQ ID NO: 7281832 - DNA, 22 bp, Homo sapiens
atacacatgtgtatgtgcatgc

SEQ ID NO: 7281833 - DNA, 22 bp, Homo sapiens
ctggctctttcagccgctggag

SEQ ID NO: 7281834 - DNA, 22 bp, Homo sapiens
ctggccttttgtttctggagaa

SEQ ID NO: 7281835 - DNA, 21 bp, Homo sapiens
atctcgggcttctcgcccagc

SEQ ID NO: 7281836 - DNA, 22 bp, Homo sapiens
cttcttaatgacagattaaaat

SEQ ID NO: 7281837 - DNA, 22 bp, Homo sapiens
atcatacagcctttgttagtgt

SEQ ID NO: 7281838 - DNA, 22 bp, Homo sapiens
ctgtaaatatgaagaatatatg

SEQ ID NO: 7281839 - DNA, 22 bp, Homo sapiens
ctgtaatcccagctactcggga

SEQ ID NO: 7281840 - DNA, 19 bp, Homo sapiens
ctgggaggtgttcagagaa

SEQ ID NO: 7281841 - DNA, 22 bp, Homo sapiens
ctgggaggattcattgaggtga

SEQ ID NO: 7281842 - DNA, 22 bp, Homo sapiens
ctgggaggtggaggttgcattg

SEQ ID NO: 7281843 - DNA, 20 bp, Homo sapiens
aggcagagcgcacttttaga

SEQ ID NO: 7281844 - DNA, 22 bp, Homo sapiens
agctttcacgatttggaacagg

SEQ ID NO: 7281845 - DNA, 22 bp, Homo sapiens
caggtcctggcagctgactcag

SEQ ID NO: 7281846 - DNA, 17 bp, Homo sapiens
caggaaaatatgagtga

SEQ ID NO: 7281847 - DNA, 22 bp, Homo sapiens
agctgccctgggctggagatgg

SEQ ID NO: 7281848 - DNA, 22 bp, Homo sapiens
agctgccctgggtcttgctgct

SEQ ID NO: 7281849 - DNA, 20 bp, Homo sapiens
agctgcccttttcacatgtt

SEQ ID NO: 7281850 - DNA, 22 bp, Homo sapiens
agctgccctgtggggagggttg

SEQ ID NO: 7281851 - DNA, 22 bp, Homo sapiens
cctgagagtgagtgccacctta

SEQ ID NO: 7281852 - DNA, 22 bp, Homo sapiens
ccctgccctgggcagaagtggg

SEQ ID NO: 7281853 - DNA, 22 bp, Homo sapiens
ccctgcccaccacatgctggga

SEQ ID NO: 7281854 - DNA, 22 bp, Homo sapiens
ccctgcccatcggggcggcctg

SEQ ID NO: 7281855 - DNA, 21 bp, Homo sapiens
ccctgccctcaaggacagtgc

SEQ ID NO: 7281856 - DNA, 22 bp, Homo sapiens
aggctgctttcatggccgcccc

SEQ ID NO: 7281857 - DNA, 18 bp, Homo sapiens
aggcctgggaagctgagg

SEQ ID NO: 7281858 - DNA, 22 bp, Homo sapiens
ccagcaggagatgcctgtgtct

SEQ ID NO: 7281859 - DNA, 22 bp, Homo sapiens
acatacatcaagtatcacaaga

SEQ ID NO: 7281860 - DNA, 22 bp, Homo sapiens
aggcacacagaccccagcaagt

SEQ ID NO: 7281861 - DNA, 23 bp, Homo sapiens
aggagacagggaagtgcctggct

SEQ ID NO: 7281862 - DNA, 22 bp, Homo sapiens
agcttcataattccttgactca

SEQ ID NO: 7281863 - DNA, 22 bp, Homo sapiens
aggaaaaacctgttaatggtag

SEQ ID NO: 7281864 - DNA, 22 bp, Homo sapiens
aggaaaaaagtctgtgattata

SEQ ID NO: 7281865 - DNA, 22 bp, Homo sapiens
acccacgaagatgagcggcatg

SEQ ID NO: 7281866 - DNA, 22 bp, Homo sapiens
acatacatgggattaaaaaatt

SEQ ID NO: 7281867 - DNA, 22 bp, Homo sapiens
acatacatggtgctttcttggt

SEQ ID NO: 7281868 - DNA, 19 bp, Homo sapiens
agaaaaactggtactgctg

SEQ ID NO: 7281869 - DNA, 22 bp, Homo sapiens
agaaaaactaagagtgggtggt

SEQ ID NO: 7281870 - DNA, 22 bp, Homo sapiens
atccatttgtttactgatggac

SEQ ID NO: 7281871 - DNA, 22 bp, Homo sapiens
atccattttccttggcagcagg

SEQ ID NO: 7281872 - DNA, 22 bp, Homo sapiens
atccattttttcagaatgctct

SEQ ID NO: 7281873 - DNA, 22 bp, Homo sapiens
ataaaaactgacccatcctttg

SEQ ID NO: 7281874 - DNA, 22 bp, Homo sapiens
actgggctccaaggacctggag

SEQ ID NO: 7281875 - DNA, 22 bp, Homo sapiens
actgggctagagtggaagctgg

SEQ ID NO: 7281876 - DNA, 18 bp, Homo sapiens
acttctcatttctctgca

SEQ ID NO: 7281877 - DNA, 22 bp, Homo sapiens
actgtttatagttttgagctga

SEQ ID NO: 7281878 - DNA, 22 bp, Homo sapiens
actgtttatgatgatagagggg

SEQ ID NO: 7281879 - DNA, 22 bp, Homo sapiens
atagagtgatgtaaggtatgtg

SEQ ID NO: 7281880 - DNA, 22 bp, Homo sapiens
actgcactccagcctgggtgat

SEQ ID NO: 7281881 - DNA, 22 bp, Homo sapiens
actgcactccagcctgggtgat

SEQ ID NO: 7281882 - DNA, 22 bp, Homo sapiens
actgcacttcaccctgggtgac

SEQ ID NO: 7281883 - DNA, 22 bp, Homo sapiens
actgcactcctgcctgggtaac

SEQ ID NO: 7281884 - DNA, 22 bp, Homo sapiens
actgcactcctgcctgggtaac

SEQ ID NO: 7281885 - DNA, 22 bp, Homo sapiens
agtgaatgagaggtgagtattg

SEQ ID NO: 7281886 - DNA, 22 bp, Homo sapiens
actgcacttcaccctgggtgac

SEQ ID NO: 7281887 - DNA, 22 bp, Homo sapiens
actgcacttcagcctgggtgac

SEQ ID NO: 7281888 - DNA, 22 bp, Homo sapiens
actgcacttcagcctgggtgac

SEQ ID NO: 7281889 - DNA, 22 bp, Homo sapiens
agtgctcatgcacatttatagt

SEQ ID NO: 7281890 - DNA, 22 bp, Homo sapiens
agtgctcataaaaatgtgaaac

SEQ ID NO: 7281891 - DNA, 22 bp, Homo sapiens
actactttgggccatttgttta

SEQ ID NO: 7281892 - DNA, 22 bp, Homo sapiens
aggtccagctgttgcagcctcc

SEQ ID NO: 7281893 - DNA, 22 bp, Homo sapiens
aggtccaggttccgtttctgcg

SEQ ID NO: 7281894 - DNA, 22 bp, Homo sapiens
aggtccagtgctcttggtggtt

SEQ ID NO: 7281895 - DNA, 22 bp, Homo sapiens
aggtcacacaactgtcagaggc

SEQ ID NO: 7281896 - DNA, 22 bp, Homo sapiens
agtacccttttcactgtcacaa

SEQ ID NO: 7281897 - DNA, 23 bp, Homo sapiens
agtacatttgacccaaataagct

SEQ ID NO: 7281898 - DNA, 22 bp, Homo sapiens
agtacttcagaggctgcccagg

SEQ ID NO: 7281899 - DNA, 23 bp, Homo sapiens
agaggctgcagggtattgagaat

SEQ ID NO: 7281900 - DNA, 22 bp, Homo sapiens
agaggggctcaagcagtggtct

SEQ ID NO: 7281901 - DNA, 23 bp, Homo sapiens
caaagatgattggaacatggctt

SEQ ID NO: 7281902 - DNA, 22 bp, Homo sapiens
agatcatatgcagtaatgaact

SEQ ID NO: 7281903 - DNA, 22 bp, Homo sapiens
agatcatatgaaaaatttcaag

SEQ ID NO: 7281904 - DNA, 21 bp, Homo sapiens
agagaattgccttagatgttc

SEQ ID NO: 7281905 - DNA, 21 bp, Homo sapiens
agagagggagatgaaacatcc

SEQ ID NO: 7281906 - DNA, 22 bp, Homo sapiens
agagagggcatagaaaaaggga

SEQ ID NO: 7281907 - DNA, 22 bp, Homo sapiens
agactgttgcctgaacttagcc

SEQ ID NO: 7281908 - DNA, 22 bp, Homo sapiens
agactgttgtgtgaagtagggt

SEQ ID NO: 7281909 - DNA, 22 bp, Homo sapiens
agactgtttgggttccaaatct

SEQ ID NO: 7281910 - DNA, 22 bp, Homo sapiens
agactgttaatttcaattaaaa

SEQ ID NO: 7281911 - DNA, 22 bp, Homo sapiens
agactgttcctagtggctgttc

SEQ ID NO: 7281912 - DNA, 22 bp, Homo sapiens
agactgttgatggctgaattca

SEQ ID NO: 7281913 - DNA, 21 bp, Homo sapiens
cacagagatattggtgagcct

SEQ ID NO: 7281914 - DNA, 22 bp, Homo sapiens
agcacctgtcaagtccaggctg

SEQ ID NO: 7281915 - DNA, 22 bp, Homo sapiens
agcacctggagggctgggacct

SEQ ID NO: 7281916 - DNA, 22 bp, Homo sapiens
agcagaggaggatttagttagg

SEQ ID NO: 7281917 - DNA, 22 bp, Homo sapiens
agcagagctttttggactcaga

SEQ ID NO: 7281918 - DNA, 22 bp, Homo sapiens
agcagagctgcagtggcctgct

SEQ ID NO: 7281919 - DNA, 18 bp, Homo sapiens
agcatgagagaggctgtg

SEQ ID NO: 7281920 - DNA, 22 bp, Homo sapiens
agcatggggcaatgcatgtgct

SEQ ID NO: 7281921 - DNA, 22 bp, Homo sapiens
cactgttttacatgttatttaa

SEQ ID NO: 7281922 - DNA, 22 bp, Homo sapiens
cactgttttattccaacatagg

SEQ ID NO: 7281923 - DNA, 22 bp, Homo sapiens
cactgtttggctcctgtactta

SEQ ID NO: 7281924 - DNA, 22 bp, Homo sapiens
cactgtttttatgtaatcagtg

SEQ ID NO: 7281925 - DNA, 22 bp, Homo sapiens
cactgttttcagtcagttctat

SEQ ID NO: 7281926 - DNA, 22 bp, Homo sapiens
cactgtttgaggccctagttga

SEQ ID NO: 7281927 - DNA, 22 bp, Homo sapiens
cactgtttaataatattgttaa

SEQ ID NO: 7281928 - DNA, 22 bp, Homo sapiens
cactgtgggcctgtcgtgggtg

SEQ ID NO: 7281929 - DNA, 22 bp, Homo sapiens
cacagcagaaatatgaaggcag

SEQ ID NO: 7281930 - DNA, 22 bp, Homo sapiens
cagagaccctaggcaggtgaca

SEQ ID NO: 7281931 - DNA, 22 bp, Homo sapiens
agctccaggataagacaggtgc

SEQ ID NO: 7281932 - DNA, 22 bp, Homo sapiens
agctccaggatctgaaagttcg

SEQ ID NO: 7281933 - DNA, 22 bp, Homo sapiens
agctccagccctagtacagctg

SEQ ID NO: 7281934 - DNA, 22 bp, Homo sapiens
agctccagaggcagtgatgaag

SEQ ID NO: 7281935 - DNA, 22 bp, Homo sapiens
agctccagaagcctgcaaggta

SEQ ID NO: 7281936 - DNA, 22 bp, Homo sapiens
agctcctggctttcctctcacc

SEQ ID NO: 7281937 - DNA, 22 bp, Homo sapiens
agcctgggcaacagagcaaaac

SEQ ID NO: 7281938 - DNA, 21 bp, Homo sapiens
agcctgggaggcggaggttgc

SEQ ID NO: 7281939 - DNA, 22 bp, Homo sapiens
agcctgggaatttagagttcgg

SEQ ID NO: 7281940 - DNA, 22 bp, Homo sapiens
aagaggttgtctgtgatgagtt

SEQ ID NO: 7281941 - DNA, 22 bp, Homo sapiens
aatgtattctgggaaaatgtta

SEQ ID NO: 7281942 - DNA, 22 bp, Homo sapiens
aatgtgaaaccgcacagaataa

SEQ ID NO: 7281943 - DNA, 22 bp, Homo sapiens
aatgttatgtggttcaacttaa

SEQ ID NO: 7281944 - DNA, 22 bp, Homo sapiens
aagaattttccagcatgtcagt

SEQ ID NO: 7281945 - DNA, 22 bp, Homo sapiens
aagaattattgcaatactagat

SEQ ID NO: 7281946 - DNA, 22 bp, Homo sapiens
aattcaaagactagaattttgc

SEQ ID NO: 7281947 - DNA, 22 bp, Homo sapiens
acaactgatgggtcatgtggga

SEQ ID NO: 7281948 - DNA, 22 bp, Homo sapiens
aagttcttgataagtccactgt

SEQ ID NO: 7281949 - DNA, 22 bp, Homo sapiens
aataaaatggtcagttttctca

SEQ ID NO: 7281950 - DNA, 22 bp, Homo sapiens
aatatttgaacagtcactgagt

SEQ ID NO: 7281951 - DNA, 22 bp, Homo sapiens
aaatttaagaagtgtgtgcgtg

SEQ ID NO: 7281952 - DNA, 22 bp, Homo sapiens
aaattattataggcagagctga

SEQ ID NO: 7281953 - DNA, 22 bp, Homo sapiens
aaaagtgatgggatggcacttc

SEQ ID NO: 7281954 - DNA, 22 bp, Homo sapiens
aaaaagatgtcctgaagtttag

SEQ ID NO: 7281955 - DNA, 22 bp, Homo sapiens
aaaaatgaattcttcagtggca

SEQ ID NO: 7281956 - DNA, 22 bp, Homo sapiens
aaagaagatggagacctgacta

SEQ ID NO: 7281957 - DNA, 19 bp, Homo sapiens
aaagatctgggattgagac

SEQ ID NO: 7281958 - DNA, 22 bp, Homo sapiens
aaatatgtaaccaaggtgaagt

SEQ ID NO: 7281959 - DNA, 22 bp, Homo sapiens
aaatatgtgatcagtgaataaa

SEQ ID NO: 7281960 - DNA, 22 bp, Homo sapiens
aaatactgttgaatgaagtaag

SEQ ID NO: 7281961 - DNA, 23 bp, Homo sapiens
aaagatgtgagtattcatatggc

SEQ ID NO: 7281962 - DNA, 20 bp, Homo sapiens
aagagaggaagttatactag

SEQ ID NO: 7281963 - DNA, 22 bp, Homo sapiens
aagaagttggaaatgattgaga

SEQ ID NO: 7281964 - DNA, 22 bp, Homo sapiens
aagcactgggaggaggctgaga

SEQ ID NO: 7281965 - DNA, 22 bp, Homo sapiens
aagcactgagcacagtggctga

SEQ ID NO: 7281966 - DNA, 22 bp, Homo sapiens
aaatatcatttataacttttaa

SEQ ID NO: 7281967 - DNA, 22 bp, Homo sapiens
aacaagaacacctacagttcta

SEQ ID NO: 7281968 - DNA, 22 bp, Homo sapiens
aacagcagctgaggagctgggc

SEQ ID NO: 7281969 - DNA, 22 bp, Homo sapiens
aactcactttgtggcttctgaa

SEQ ID NO: 7281970 - DNA, 22 bp, Homo sapiens
aacatgcaatgtctgaaaatcc

SEQ ID NO: 7281971 - DNA, 22 bp, Homo sapiens
actgacatttttccctaagcat

SEQ ID NO: 7281972 - DNA, 22 bp, Homo sapiens
aagtgaatgatgtgaagtgtaa

SEQ ID NO: 7281973 - DNA, 22 bp, Homo sapiens
aagtgatacctaggaaatcaag

SEQ ID NO: 7281974 - DNA, 22 bp, Homo sapiens
aatatgaattattgttacaagt

SEQ ID NO: 7281975 - DNA, 22 bp, Homo sapiens
actgtggcactaggcaccttac

SEQ ID NO: 7281976 - DNA, 22 bp, Homo sapiens
actgtggccaaagcctctggga

SEQ ID NO: 7281977 - DNA, 22 bp, Homo sapiens
actgtggctaattcatttggtc

SEQ ID NO: 7281978 - DNA, 22 bp, Homo sapiens
actgtggccttgtgggttcagg

SEQ ID NO: 7281979 - DNA, 22 bp, Homo sapiens
actgtggccggaacagtgggac

SEQ ID NO: 7281980 - DNA, 22 bp, Homo sapiens
actgtggcctgctgtatgggct

SEQ ID NO: 7281981 - DNA, 22 bp, Homo sapiens
acattatagttgctacagagta

SEQ ID NO: 7281982 - DNA, 22 bp, Homo sapiens
aagtaaaagcaggtgtgctggg

SEQ ID NO: 7281983 - DNA, 22 bp, Homo sapiens
acaggaaattggcatatcagtt

SEQ ID NO: 7281984 - DNA, 22 bp, Homo sapiens
acaggaaagagctaggcatagg

SEQ ID NO: 7281985 - DNA, 22 bp, Homo sapiens
aatgtataaagtgttaataact

SEQ ID NO: 7281986 - DNA, 22 bp, Homo sapiens
agaagttttgggaaatactgat

SEQ ID NO: 7281987 - DNA, 22 bp, Homo sapiens
agagcaggcataaagctttgaa

SEQ ID NO: 7281988 - DNA, 22 bp, Homo sapiens
agagcaggtggcaactctggga

SEQ ID NO: 7281989 - DNA, 22 bp, Homo sapiens
agagtactgcctcagttatgaa

SEQ ID NO: 7281990 - DNA, 22 bp, Homo sapiens
agaggtggccatgggcgctgga

SEQ ID NO: 7281991 - DNA, 22 bp, Homo sapiens
agccaggacagggcagctcgct

SEQ ID NO: 7281992 - DNA, 22 bp, Homo sapiens
agcctgtgactctgtgaaacca

SEQ ID NO: 7281993 - DNA, 22 bp, Homo sapiens
agcaggtgacagggctgtggtg

SEQ ID NO: 7281994 - DNA, 22 bp, Homo sapiens
tcaggagagtgttcagtggagg

SEQ ID NO: 7281995 - DNA, 22 bp, Homo sapiens
tcagcctctctgagtccagacc

SEQ ID NO: 7281996 - DNA, 22 bp, Homo sapiens
tcagccagggcagagcaggtga

SEQ ID NO: 7281997 - DNA, 22 bp, Homo sapiens
tcagccaggtaatgtggagatg

SEQ ID NO: 7281998 - DNA, 22 bp, Homo sapiens
tcaggtctgggcacatggtaca

SEQ ID NO: 7281999 - DNA, 22 bp, Homo sapiens
tcaggtcttttgtctcctagaa

SEQ ID NO: 7282000 - DNA, 23 bp, Homo sapiens
tcagagagctgttgagagctgcc

SEQ ID NO: 7282001 - DNA, 18 bp, Homo sapiens
tcagagagcagctttatt

SEQ ID NO: 7282002 - DNA, 22 bp, Homo sapiens
tcagagagcctcaggcactgcc

SEQ ID NO: 7282003 - DNA, 22 bp, Homo sapiens
tcagagagctggtgggcagagg

SEQ ID NO: 7282004 - DNA, 22 bp, Homo sapiens
tcaaaatcaaagatacttgaaa

SEQ ID NO: 7282005 - DNA, 21 bp, Homo sapiens
tccaggccatggtggggaggc

SEQ ID NO: 7282006 - DNA, 22 bp, Homo sapiens
tccaggcccagacggggtgagg

SEQ ID NO: 7282007 - DNA, 22 bp, Homo sapiens
tccaggccctgggatgggagca

SEQ ID NO: 7282008 - DNA, 20 bp, Homo sapiens
tcccactgggcctcagtttc

SEQ ID NO: 7282009 - DNA, 22 bp, Homo sapiens
tcccactgctttgctctgctca

SEQ ID NO: 7282010 - DNA, 21 bp, Homo sapiens
tcccactgccacagcttcagg

SEQ ID NO: 7282011 - DNA, 22 bp, Homo sapiens
tcatgtgtctgccagtgtttat

SEQ ID NO: 7282012 - DNA, 22 bp, Homo sapiens
tcatggctggaagctcagttag

SEQ ID NO: 7282013 - DNA, 22 bp, Homo sapiens
tcatgtgtcctagttcatataa

SEQ ID NO: 7282014 - DNA, 22 bp, Homo sapiens
tccgggagctgaacgtcttgcg

SEQ ID NO: 7282015 - DNA, 22 bp, Homo sapiens
tccggactcacctgacaatggc

SEQ ID NO: 7282016 - DNA, 22 bp, Homo sapiens
tccgaggccaaagctgtgaata

SEQ ID NO: 7282017 - DNA, 22 bp, Homo sapiens
tccctttcacttaactagccca

SEQ ID NO: 7282018 - DNA, 22 bp, Homo sapiens
tcctccctgcactcagtgaagt

SEQ ID NO: 7282019 - DNA, 23 bp, Homo sapiens
tccctgagatgctgctctgtccc

SEQ ID NO: 7282020 - DNA, 23 bp, Homo sapiens
tccctgagctggagagactgcac

SEQ ID NO: 7282021 - DNA, 18 bp, Homo sapiens
tcccttctcccttgcctc

SEQ ID NO: 7282022 - DNA, 22 bp, Homo sapiens
tccctttcactactgtgttggt

SEQ ID NO: 7282023 - DNA, 22 bp, Homo sapiens
gttaggaagtggtaaggttctg

SEQ ID NO: 7282024 - DNA, 22 bp, Homo sapiens
gttagaaatgcagaaacttgac

SEQ ID NO: 7282025 - DNA, 22 bp, Homo sapiens
taacttctgcacagaaaatttg

SEQ ID NO: 7282026 - DNA, 22 bp, Homo sapiens
taacttctggaaatgcatctgc

SEQ ID NO: 7282027 - DNA, 22 bp, Homo sapiens
taaatacagtcatttgagccat

SEQ ID NO: 7282028 - DNA, 22 bp, Homo sapiens
tacctgcagcgggaatccatta

SEQ ID NO: 7282029 - DNA, 22 bp, Homo sapiens
tacctgcacagccagccatgtg

SEQ ID NO: 7282030 - DNA, 22 bp, Homo sapiens
tacttccagcagcctgcttgct

SEQ ID NO: 7282031 - DNA, 22 bp, Homo sapiens
tacttctctgcgatcacttgat

SEQ ID NO: 7282032 - DNA, 22 bp, Homo sapiens
tacttctctccgcctcgtgctt

SEQ ID NO: 7282033 - DNA, 22 bp, Homo sapiens
tacattatttcatcagtcatct

SEQ ID NO: 7282034 - DNA, 22 bp, Homo sapiens
tacagttacgctgagaaacgaa

SEQ ID NO: 7282035 - DNA, 22 bp, Homo sapiens
tagtcccggaactccttcaggt

SEQ ID NO: 7282036 - DNA, 22 bp, Homo sapiens
tactttcatgtctatacatatt

SEQ ID NO: 7282037 - DNA, 22 bp, Homo sapiens
tatattaaagtgctttgcagtg

SEQ ID NO: 7282038 - DNA, 22 bp, Homo sapiens
tatattaaaccctctctgtagg

SEQ ID NO: 7282039 - DNA, 22 bp, Homo sapiens
tatattaacacccacttgcctc

SEQ ID NO: 7282040 - DNA, 22 bp, Homo sapiens
tattcagtgacagggtattatg

SEQ ID NO: 7282041 - DNA, 22 bp, Homo sapiens
tattttcattctgtgtgactgt

SEQ ID NO: 7282042 - DNA, 22 bp, Homo sapiens
tatttctaagagatatctgtac

SEQ ID NO: 7282043 - DNA, 21 bp, Homo sapiens
tattgattcaatttcttgagt

SEQ ID NO: 7282044 - DNA, 22 bp, Homo sapiens
gtgcacagaaattggtaagact

SEQ ID NO: 7282045 - DNA, 22 bp, Homo sapiens
gtcttctttgtcatcttaggtt

SEQ ID NO: 7282046 - DNA, 22 bp, Homo sapiens
gtcagtgtgagataatcttgga

SEQ ID NO: 7282047 - DNA, 22 bp, Homo sapiens
gtagatgagctcacatgacctt

SEQ ID NO: 7282048 - DNA, 22 bp, Homo sapiens
gtagatgagctcacatgacctt

SEQ ID NO: 7282049 - DNA, 22 bp, Homo sapiens
gtagatgtttggttattactct

SEQ ID NO: 7282050 - DNA, 22 bp, Homo sapiens
gtagctctgtttaaagttcttt

SEQ ID NO: 7282051 - DNA, 22 bp, Homo sapiens
gtaaatgtgaatgtcatttagc

SEQ ID NO: 7282052 - DNA, 22 bp, Homo sapiens
gtaaattatttcaagatcatct

SEQ ID NO: 7282053 - DNA, 22 bp, Homo sapiens
gggctccatcacaggctccatc

SEQ ID NO: 7282054 - DNA, 23 bp, Homo sapiens
gggctccagtctctgctcagttg

SEQ ID NO: 7282055 - DNA, 19 bp, Homo sapiens
gggctccttgggcctctct

SEQ ID NO: 7282056 - DNA, 22 bp, Homo sapiens
gggtccagatggtgagagttaa

SEQ ID NO: 7282057 - DNA, 22 bp, Homo sapiens
ggcagcagcaaggttggagctg

SEQ ID NO: 7282058 - DNA, 22 bp, Homo sapiens
ggccaggaacttttgggatggg

SEQ ID NO: 7282059 - DNA, 21 bp, Homo sapiens
ggccctggttacgcctcctct

SEQ ID NO: 7282060 - DNA, 22 bp, Homo sapiens
ggcctgctgctatgacttcctg

SEQ ID NO: 7282061 - DNA, 22 bp, Homo sapiens
ggcctgctgtgtactgatgtca

SEQ ID NO: 7282062 - DNA, 22 bp, Homo sapiens
gggaggtgatggcaagcagcgg

SEQ ID NO: 7282063 - DNA, 22 bp, Homo sapiens
gggaggttgaggctgcagtgag

SEQ ID NO: 7282064 - DNA, 22 bp, Homo sapiens
gggaaggctgcctgagggatgg

SEQ ID NO: 7282065 - DNA, 23 bp, Homo sapiens
gggaagtgaggagcccctcagcc

SEQ ID NO: 7282066 - DNA, 22 bp, Homo sapiens
ggctccaggctcctatttcact

SEQ ID NO: 7282067 - DNA, 22 bp, Homo sapiens
gcgctgaggctggaggcgcacg

SEQ ID NO: 7282068 - DNA, 22 bp, Homo sapiens
gctccttcaggtggtagctgtt

SEQ ID NO: 7282069 - DNA, 22 bp, Homo sapiens
gctctcaagtccttttgctcag

SEQ ID NO: 7282070 - DNA, 22 bp, Homo sapiens
gctgccagccagggtgggatcc

SEQ ID NO: 7282071 - DNA, 22 bp, Homo sapiens
gctgccagggaggtggtggagg

SEQ ID NO: 7282072 - DNA, 22 bp, Homo sapiens
gctgccagccctcggggtctga

SEQ ID NO: 7282073 - DNA, 22 bp, Homo sapiens
gctgccagctcactctcctgag

SEQ ID NO: 7282074 - DNA, 22 bp, Homo sapiens
gctggctctgccccacctgttc

SEQ ID NO: 7282075 - DNA, 22 bp, Homo sapiens
ggaccctgggcttgctcctggg

SEQ ID NO: 7282076 - DNA, 22 bp, Homo sapiens
ggactctcaggctgtcggcttc

SEQ ID NO: 7282077 - DNA, 22 bp, Homo sapiens
ggactctcaggctgtcggcttc

SEQ ID NO: 7282078 - DNA, 22 bp, Homo sapiens
gcactgcaggtgggtggagagg

SEQ ID NO: 7282079 - DNA, 22 bp, Homo sapiens
gcagcatggagttgtggaatga

SEQ ID NO: 7282080 - DNA, 22 bp, Homo sapiens
gcagcatggagaagtagctaga

SEQ ID NO: 7282081 - DNA, 22 bp, Homo sapiens
gcagcatgtgccttaaatcatt

SEQ ID NO: 7282082 - DNA, 20 bp, Homo sapiens
gccagaggccggcaggggct

SEQ ID NO: 7282083 - DNA, 22 bp, Homo sapiens
gccagaggaacgctgcgcgccc

SEQ ID NO: 7282084 - DNA, 22 bp, Homo sapiens
gccagcagtcctgctgtgtgcc

SEQ ID NO: 7282085 - DNA, 22 bp, Homo sapiens
gccagcattccttggctcctgg

SEQ ID NO: 7282086 - DNA, 22 bp, Homo sapiens
gcatgactggttttcttacaaa

SEQ ID NO: 7282087 - DNA, 22 bp, Homo sapiens
gcccatggacacccaagtgcca

SEQ ID NO: 7282088 - DNA, 22 bp, Homo sapiens
gccctgagcctatgagcctctc

SEQ ID NO: 7282089 - DNA, 22 bp, Homo sapiens
gcccactgagtgactccctcag

SEQ ID NO: 7282090 - DNA, 22 bp, Homo sapiens
gagaggggcgcgcagctcgcga

SEQ ID NO: 7282091 - DNA, 22 bp, Homo sapiens
gaaggcagtaaatggctgtttt

SEQ ID NO: 7282092 - DNA, 22 bp, Homo sapiens
gagacctcttggtatcgctagg

SEQ ID NO: 7282093 - DNA, 22 bp, Homo sapiens
gactcccctgggccccatccag

SEQ ID NO: 7282094 - DNA, 20 bp, Homo sapiens
ctgctgtgtgtgcctcagcc

SEQ ID NO: 7282095 - DNA, 22 bp, Homo sapiens
ctgggaagatggtgacagaatt

SEQ ID NO: 7282096 - DNA, 22 bp, Homo sapiens
cttaatgtggacctggtttcta

SEQ ID NO: 7282097 - DNA, 22 bp, Homo sapiens
cttacaaatacacttaggagag

SEQ ID NO: 7282098 - DNA, 22 bp, Homo sapiens
gaaaatttctgccacatgtgtg

SEQ ID NO: 7282099 - DNA, 22 bp, Homo sapiens
ctcctgggcttcgaaggctccc

SEQ ID NO: 7282100 - DNA, 22 bp, Homo sapiens
ctcgggtaccatgctaggcact

SEQ ID NO: 7282101 - DNA, 22 bp, Homo sapiens
ctccctggaggtgagctggcac

SEQ ID NO: 7282102 - DNA, 22 bp, Homo sapiens
ctccctgccctgtgagttggcc

SEQ ID NO: 7282103 - DNA, 22 bp, Homo sapiens
ctccctggcagccgcactcctg

SEQ ID NO: 7282104 - DNA, 22 bp, Homo sapiens
ctccctggggctcctcctattt

SEQ ID NO: 7282105 - DNA, 22 bp, Homo sapiens
ctccctgggcagatgtggctct

SEQ ID NO: 7282106 - DNA, 22 bp, Homo sapiens
ctccctggtgtcccctccagga

SEQ ID NO: 7282107 - DNA, 22 bp, Homo sapiens
ctgaaaaatatgttttggagaa

SEQ ID NO: 7282108 - DNA, 22 bp, Homo sapiens
ctgctggaaggtacacatcttg

SEQ ID NO: 7282109 - DNA, 22 bp, Homo sapiens
ctgctctctgttcccctggatc

SEQ ID NO: 7282110 - DNA, 18 bp, Homo sapiens
ctgccccttctctgagat

SEQ ID NO: 7282111 - DNA, 22 bp, Homo sapiens
ctgcccctggctggtgaagcag

SEQ ID NO: 7282112 - DNA, 22 bp, Homo sapiens
ttgcactccagcccgagcaaca

SEQ ID NO: 7282113 - DNA, 23 bp, Homo sapiens
ttcttacaaggctggcccacttg

SEQ ID NO: 7282114 - DNA, 22 bp, Homo sapiens
ttacctaaaatagctcaattta

SEQ ID NO: 7282115 - DNA, 22 bp, Homo sapiens
ttacccactgagcttcagccct

SEQ ID NO: 7282116 - DNA, 22 bp, Homo sapiens
ttacccacctttctcatgccaa

SEQ ID NO: 7282117 - DNA, 22 bp, Homo sapiens
ttacagaagtattgagagatcc

SEQ ID NO: 7282118 - DNA, 22 bp, Homo sapiens
ttacagaactgccctagttggc

SEQ ID NO: 7282119 - DNA, 22 bp, Homo sapiens
ttacagaaaggttgtgggatag

SEQ ID NO: 7282120 - DNA, 20 bp, Homo sapiens
ttacagaaatgatgttattt

SEQ ID NO: 7282121 - DNA, 20 bp, Homo sapiens
ttacagaaatgatgttattt

SEQ ID NO: 7282122 - DNA, 22 bp, Homo sapiens
cgcaccactgaattccagcctg

SEQ ID NO: 7282123 - DNA, 22 bp, Homo sapiens
cctgtggctgccacttgggtga

SEQ ID NO: 7282124 - DNA, 23 bp, Homo sapiens
ttacaagttctgaaatttccttc

SEQ ID NO: 7282125 - DNA, 22 bp, Homo sapiens
cctgtgctttaggcctcaaact

SEQ ID NO: 7282126 - DNA, 22 bp, Homo sapiens
ttaaaagtctgatgatttacat

SEQ ID NO: 7282127 - DNA, 22 bp, Homo sapiens
tgttgcccaggttctctcctgc

SEQ ID NO: 7282128 - DNA, 22 bp, Homo sapiens
cctgccctgtcactggctaggg

SEQ ID NO: 7282129 - DNA, 22 bp, Homo sapiens
cctgcaggtaaggctaactgcc

SEQ ID NO: 7282130 - DNA, 22 bp, Homo sapiens
cctgcagggtgctgccacagat

SEQ ID NO: 7282131 - DNA, 22 bp, Homo sapiens
cctgcaggggagagacttctag

SEQ ID NO: 7282132 - DNA, 19 bp, Homo sapiens
cctgcagggatgagaggtt

SEQ ID NO: 7282133 - DNA, 22 bp, Homo sapiens
cctgcaggttgcagaggcggaa

SEQ ID NO: 7282134 - DNA, 22 bp, Homo sapiens
cctgcaggtccccggatgcgca

SEQ ID NO: 7282135 - DNA, 22 bp, Homo sapiens
cctgcaggtttcccccggacgg

SEQ ID NO: 7282136 - DNA, 22 bp, Homo sapiens
cctgcagggaatcgaggcagaa

SEQ ID NO: 7282137 - DNA, 22 bp, Homo sapiens
cctgcaggctgcaggccagttc

SEQ ID NO: 7282138 - DNA, 22 bp, Homo sapiens
cctgcagctttgcctcctgaac

SEQ ID NO: 7282139 - DNA, 22 bp, Homo sapiens
cctccatctccagcttctgcct

SEQ ID NO: 7282140 - DNA, 23 bp, Homo sapiens
cctcccacctatttcactttctt

SEQ ID NO: 7282141 - DNA, 21 bp, Homo sapiens
cctccaggtgattccgtgctc

SEQ ID NO: 7282142 - DNA, 22 bp, Homo sapiens
tgggacaggatgaccagaaggt

SEQ ID NO: 7282143 - DNA, 22 bp, Homo sapiens
tgcaggtgcctcttgagcttgt

SEQ ID NO: 7282144 - DNA, 22 bp, Homo sapiens
tgcaggtgcctcttgagcttgt

SEQ ID NO: 7282145 - DNA, 21 bp, Homo sapiens
tgcttccctgggccacactga

SEQ ID NO: 7282146 - DNA, 22 bp, Homo sapiens
ccctccctttgcagcagtgcat

SEQ ID NO: 7282147 - DNA, 22 bp, Homo sapiens
ccctcctcaactctggcttcca

SEQ ID NO: 7282148 - DNA, 22 bp, Homo sapiens
ccctttcaacattctgccttgt

SEQ ID NO: 7282149 - DNA, 22 bp, Homo sapiens
ccctttagcccctgcagagact

SEQ ID NO: 7282150 - DNA, 22 bp, Homo sapiens
cccagaggggtcgtctgagggg

SEQ ID NO: 7282151 - DNA, 22 bp, Homo sapiens
cccagaggaggatctcggcccg

SEQ ID NO: 7282152 - DNA, 22 bp, Homo sapiens
cccagaggaggcaaagctctgt

SEQ ID NO: 7282153 - DNA, 22 bp, Homo sapiens
cccagagggtggaggttgcagt

SEQ ID NO: 7282154 - DNA, 19 bp, Homo sapiens
cccagaggaatgcctggaa

SEQ ID NO: 7282155 - DNA, 22 bp, Homo sapiens
tgcactgatgttttgccaagga

SEQ ID NO: 7282156 - DNA, 21 bp, Homo sapiens
tgcaatccagcctgggcgaca

SEQ ID NO: 7282157 - DNA, 22 bp, Homo sapiens
tgcactccaggctgggtgacag

SEQ ID NO: 7282158 - DNA, 22 bp, Homo sapiens
tgcacagatgctaggaggtgaa

SEQ ID NO: 7282159 - DNA, 22 bp, Homo sapiens
ccagtgcccagctgcccaggca

SEQ ID NO: 7282160 - DNA, 22 bp, Homo sapiens
ccaggcacttgtttgccaggca

SEQ ID NO: 7282161 - DNA, 22 bp, Homo sapiens
ccaggagagcaaaggtcactct

SEQ ID NO: 7282162 - DNA, 22 bp, Homo sapiens
tagaaagaacttcatgtaaaac

SEQ ID NO: 7282163 - DNA, 22 bp, Homo sapiens
caggcctgtgacaccgtgtctg

SEQ ID NO: 7282164 - DNA, 17 bp, Homo sapiens
tacagttagaatctgga

SEQ ID NO: 7282165 - DNA, 22 bp, Homo sapiens
tacagttatatgtgataagtaa

SEQ ID NO: 7282166 - DNA, 22 bp, Homo sapiens
tcacattctcagcatctataca

SEQ ID NO: 7282167 - DNA, 22 bp, Homo sapiens
tatgattaatattcttaaaatt

SEQ ID NO: 7282168 - DNA, 22 bp, Homo sapiens
catttccactctgggagtcaga

SEQ ID NO: 7282169 - DNA, 22 bp, Homo sapiens
catttcacagtatattcaaaat

SEQ ID NO: 7282170 - DNA, 22 bp, Homo sapiens
catttcaccttagagaattatt

SEQ ID NO: 7282171 - DNA, 22 bp, Homo sapiens
tcctgactctggtgtcctctac

SEQ ID NO: 7282172 - DNA, 22 bp, Homo sapiens
tcctgaggtggattgagcagag

SEQ ID NO: 7282173 - DNA, 22 bp, Homo sapiens
ccaagaggggaagggccgcagc

SEQ ID NO: 7282174 - DNA, 22 bp, Homo sapiens
tctcagtggtggcattccagac

SEQ ID NO: 7282175 - DNA, 22 bp, Homo sapiens
tctcagtggtgttttgagtcca

SEQ ID NO: 7282176 - DNA, 22 bp, Homo sapiens
tctcagtgttatctatctgcct

SEQ ID NO: 7282177 - DNA, 18 bp, Homo sapiens
ccagagggtgcgtcagct

SEQ ID NO: 7282178 - DNA, 22 bp, Homo sapiens
ccagaggtcctgctcactggtg

SEQ ID NO: 7282179 - DNA, 22 bp, Homo sapiens
ccagaggtcctgtgatgctgca

SEQ ID NO: 7282180 - DNA, 22 bp, Homo sapiens
ccagaggtgagggggattcttg

SEQ ID NO: 7282181 - DNA, 22 bp, Homo sapiens
ccagaggtgaacaggaggctgt

SEQ ID NO: 7282182 - DNA, 22 bp, Homo sapiens
tcactgttgacctggaagtggg

SEQ ID NO: 7282183 - DNA, 22 bp, Homo sapiens
tcactgtttgcagtgaagagaa

SEQ ID NO: 7282184 - DNA, 22 bp, Homo sapiens
tccaggtcccagactgggcagc

SEQ ID NO: 7282185 - DNA, 22 bp, Homo sapiens
catgtacagtttttctgtcctg

SEQ ID NO: 7282186 - DNA, 18 bp, Homo sapiens
tccagagagggagaagtg

SEQ ID NO: 7282187 - DNA, 22 bp, Homo sapiens
ttgtattaattgaaatgaatgc

SEQ ID NO: 7282188 - DNA, 17 bp, Homo sapiens
tttcatctgggaccacc

SEQ ID NO: 7282189 - DNA, 22 bp, Homo sapiens
tttcatctgtgctgccaagact

SEQ ID NO: 7282190 - DNA, 22 bp, Homo sapiens
tttcatctctctaaaagacagt

SEQ ID NO: 7282191 - DNA, 18 bp, Homo sapiens
tttcacaacctccagagg

SEQ ID NO: 7282192 - DNA, 22 bp, Homo sapiens
tttcacattggcttctatttct

SEQ ID NO: 7282193 - DNA, 22 bp, Homo sapiens
tttagctcagttctagccccat

SEQ ID NO: 7282194 - DNA, 22 bp, Homo sapiens
tttagctcatactgctcttcca

SEQ ID NO: 7282195 - DNA, 22 bp, Homo sapiens
ttcccctttttgtgtgcagctg

SEQ ID NO: 7282196 - DNA, 22 bp, Homo sapiens
ttccccttataagtctggcttc

SEQ ID NO: 7282197 - DNA, 22 bp, Homo sapiens
ttatgtgtgtacatgcatatgt

SEQ ID NO: 7282198 - DNA, 20 bp, Homo sapiens
ttatgtgtacctgtgctccc

SEQ ID NO: 7282199 - DNA, 22 bp, Homo sapiens
ttctaaaaccaattctgcttct

SEQ ID NO: 7282200 - DNA, 22 bp, Homo sapiens
ttctaaaataagtttatctggt

SEQ ID NO: 7282201 - DNA, 22 bp, Homo sapiens
ttctcttgactaccagttagga

SEQ ID NO: 7282202 - DNA, 22 bp, Homo sapiens
ttctctttgacattattcaggt

SEQ ID NO: 7282203 - DNA, 22 bp, Homo sapiens
ttcttcttgaaactttaggttg

SEQ ID NO: 7282204 - DNA, 21 bp, Homo sapiens
ttcttcttggactgttttggc

SEQ ID NO: 7282205 - DNA, 22 bp, Homo sapiens
ttctttctctactagcagagct

SEQ ID NO: 7282206 - DNA, 22 bp, Homo sapiens
ttgagaaggtggtcatttgcaa

SEQ ID NO: 7282207 - DNA, 22 bp, Homo sapiens
ttgagaatgtgttttgctaagt

SEQ ID NO: 7282208 - DNA, 22 bp, Homo sapiens
ttgagaaataagcatgtctaga

SEQ ID NO: 7282209 - DNA, 22 bp, Homo sapiens
ttgagaaaggggtcaatatctc

SEQ ID NO: 7282210 - DNA, 22 bp, Homo sapiens
ttgaaaaaattggtagaggatg

SEQ ID NO: 7282211 - DNA, 22 bp, Homo sapiens
ttttcaaagactggaggctgat

SEQ ID NO: 7282212 - DNA, 22 bp, Homo sapiens
atgggttcaagtgattctcctg

SEQ ID NO: 7282213 - DNA, 22 bp, Homo sapiens
atgtctttattaatatcatgcc

SEQ ID NO: 7282214 - DNA, 22 bp, Homo sapiens
atgtctttgccatagttcatat

SEQ ID NO: 7282215 - DNA, 22 bp, Homo sapiens
atgtgtgtgcatttctctccct

SEQ ID NO: 7282216 - DNA, 22 bp, Homo sapiens
atgtgtgtatatatagtcattt

SEQ ID NO: 7282217 - DNA, 22 bp, Homo sapiens
atgtgtatgagtgtgcttcttt

SEQ ID NO: 7282218 - DNA, 22 bp, Homo sapiens
gagaacacttatggattattct

SEQ ID NO: 7282219 - DNA, 22 bp, Homo sapiens
atgcattaggctctggaaataa

SEQ ID NO: 7282220 - DNA, 22 bp, Homo sapiens
atgaagataagaccaggctgga

SEQ ID NO: 7282221 - DNA, 22 bp, Homo sapiens
atgaggtggtcttcagtaggtc

SEQ ID NO: 7282222 - DNA, 22 bp, Homo sapiens
atctactttacaaatcatctcc

SEQ ID NO: 7282223 - DNA, 22 bp, Homo sapiens
atttctcaggactccatgggcg

SEQ ID NO: 7282224 - DNA, 22 bp, Homo sapiens
atttctcacagtggaatctctg

SEQ ID NO: 7282225 - DNA, 22 bp, Homo sapiens
gcctgggagatgcgttgtggcc

SEQ ID NO: 7282226 - DNA, 21 bp, Homo sapiens
gcctgctgcctgtggccggtc

SEQ ID NO: 7282227 - DNA, 22 bp, Homo sapiens
gcctgctggacattggccggcc

SEQ ID NO: 7282228 - DNA, 22 bp, Homo sapiens
gcctgctgagggaagttgggca

SEQ ID NO: 7282229 - DNA, 22 bp, Homo sapiens
gcctgggagtgcacagtgaggt

SEQ ID NO: 7282230 - DNA, 22 bp, Homo sapiens
gccaggagtgtgtggctatgtt

SEQ ID NO: 7282231 - DNA, 22 bp, Homo sapiens
atttaattaatcatggtgaatt

SEQ ID NO: 7282232 - DNA, 22 bp, Homo sapiens
atttaattttctcaacagtgct

SEQ ID NO: 7282233 - DNA, 22 bp, Homo sapiens
attgcttttgagctagaatttt

SEQ ID NO: 7282234 - DNA, 22 bp, Homo sapiens
attgcttttagtgaaattatat

SEQ ID NO: 7282235 - DNA, 22 bp, Homo sapiens
atttcacaaaccatcctgattt

SEQ ID NO: 7282236 - DNA, 22 bp, Homo sapiens
atttctcaaaggaatagagtga

SEQ ID NO: 7282237 - DNA, 22 bp, Homo sapiens
atttctcaaaggaatagagtga

SEQ ID NO: 7282238 - DNA, 22 bp, Homo sapiens
attaaaagagataatgtgtgtt

SEQ ID NO: 7282239 - DNA, 22 bp, Homo sapiens
atgtgtgtgtttaatcctcaaa

SEQ ID NO: 7282240 - DNA, 22 bp, Homo sapiens
atgtgttttggtaatttctgct

SEQ ID NO: 7282241 - DNA, 22 bp, Homo sapiens
atgtgttttggtggatcattca

SEQ ID NO: 7282242 - DNA, 22 bp, Homo sapiens
atgtgtttgtacctttaaatat

SEQ ID NO: 7282243 - DNA, 22 bp, Homo sapiens
atgtgtttataattactcaatc

SEQ ID NO: 7282244 - DNA, 22 bp, Homo sapiens
atgttttattaccaacttgtac

SEQ ID NO: 7282245 - DNA, 22 bp, Homo sapiens
attagaagatagtgatttctgc

SEQ ID NO: 7282246 - DNA, 22 bp, Homo sapiens
attaagatgtgggaaaatttaa

SEQ ID NO: 7282247 - DNA, 22 bp, Homo sapiens
attacaagatgcatccatattt

SEQ ID NO: 7282248 - DNA, 22 bp, Homo sapiens
attgcacttcagcctgggtgac

SEQ ID NO: 7282249 - DNA, 22 bp, Homo sapiens
attcttacaaagcagagtctgt

SEQ ID NO: 7282250 - DNA, 22 bp, Homo sapiens
attcagttccttgagggtatag

SEQ ID NO: 7282251 - DNA, 22 bp, Homo sapiens
cactgcactccatcctgggaaa

SEQ ID NO: 7282252 - DNA, 22 bp, Homo sapiens
ggcagtttatattatgtgtgtg

SEQ ID NO: 7282253 - DNA, 22 bp, Homo sapiens
ggcagtttggcaggatggaggg

SEQ ID NO: 7282254 - DNA, 22 bp, Homo sapiens
ggcagttttaacagaggtagta

SEQ ID NO: 7282255 - DNA, 22 bp, Homo sapiens
ggcagttttctcagtggggtac

SEQ ID NO: 7282256 - DNA, 22 bp, Homo sapiens
ggcatagatttctttaggttta

SEQ ID NO: 7282257 - DNA, 22 bp, Homo sapiens
caccctcaagcagtggcacgtg

SEQ ID NO: 7282258 - DNA, 22 bp, Homo sapiens
caccccttccgccactgccttc

SEQ ID NO: 7282259 - DNA, 18 bp, Homo sapiens
caccctccgcggctgccc

SEQ ID NO: 7282260 - DNA, 22 bp, Homo sapiens
cacagggcaccagttggccatc

SEQ ID NO: 7282261 - DNA, 22 bp, Homo sapiens
ggcagcagtggctgctattgtc

SEQ ID NO: 7282262 - DNA, 22 bp, Homo sapiens
caaagtaactgcctttccaatt

SEQ ID NO: 7282263 - DNA, 17 bp, Homo sapiens
gcttgggctgcctgttg

SEQ ID NO: 7282264 - DNA, 20 bp, Homo sapiens
gctgtggcaaagctttgtgt

SEQ ID NO: 7282265 - DNA, 22 bp, Homo sapiens
cagccactggtgccaggctgtt

SEQ ID NO: 7282266 - DNA, 22 bp, Homo sapiens
cagccactctcagacagtccca

SEQ ID NO: 7282267 - DNA, 22 bp, Homo sapiens
cagcagagtttggcttctaatg

SEQ ID NO: 7282268 - DNA, 22 bp, Homo sapiens
gtatattttgatcaccctctat

SEQ ID NO: 7282269 - DNA, 22 bp, Homo sapiens
ggttccagagtgggctgggaaa

SEQ ID NO: 7282270 - DNA, 22 bp, Homo sapiens
ggttccccaggcggcccttgga

SEQ ID NO: 7282271 - DNA, 20 bp, Homo sapiens
gtaaaatatggtctttgggt

SEQ ID NO: 7282272 - DNA, 22 bp, Homo sapiens
cagaagtgaatgtgataaacca

SEQ ID NO: 7282273 - DNA, 20 bp, Homo sapiens
cagaaggtctaagctttaga

SEQ ID NO: 7282274 - DNA, 22 bp, Homo sapiens
cagaagtgcaatttaaattagg

SEQ ID NO: 7282275 - DNA, 22 bp, Homo sapiens
cagagctggtgttacaagtcca

SEQ ID NO: 7282276 - DNA, 22 bp, Homo sapiens
ctcttagtaatgccatgaagca

SEQ ID NO: 7282277 - DNA, 22 bp, Homo sapiens
ctcttgagtggcatgctctaac

SEQ ID NO: 7282278 - DNA, 22 bp, Homo sapiens
ctccttctgaggctctgggttc

SEQ ID NO: 7282279 - DNA, 22 bp, Homo sapiens
ctccttctgggcctggcagtgg

SEQ ID NO: 7282280 - DNA, 22 bp, Homo sapiens
ctcgcctgcctgtgtctctccc

SEQ ID NO: 7282281 - DNA, 18 bp, Homo sapiens
ctcctttccctacacctc

SEQ ID NO: 7282282 - DNA, 22 bp, Homo sapiens
ctccagagagtccagctctggg

SEQ ID NO: 7282283 - DNA, 22 bp, Homo sapiens
agtgctgggattacaggcataa

SEQ ID NO: 7282284 - DNA, 22 bp, Homo sapiens
agtgctgggattgcaggcatga

SEQ ID NO: 7282285 - DNA, 22 bp, Homo sapiens
ctcagcctgtgaagagcagagg

SEQ ID NO: 7282286 - DNA, 22 bp, Homo sapiens
ctcagggacgttagaggacagg

SEQ ID NO: 7282287 - DNA, 22 bp, Homo sapiens
agtctccttggcctcaatgcct

SEQ ID NO: 7282288 - DNA, 22 bp, Homo sapiens
ctcaaagacaaaaatctgaggt

SEQ ID NO: 7282289 - DNA, 22 bp, Homo sapiens
cctgcccctcaaggcctggtgc

SEQ ID NO: 7282290 - DNA, 22 bp, Homo sapiens
aggtgctgttaacatatgaggt

SEQ ID NO: 7282291 - DNA, 22 bp, Homo sapiens
ctgccaggattctgtgaacccc

SEQ ID NO: 7282292 - DNA, 22 bp, Homo sapiens
ctgcagagcaagttctctgttg

SEQ ID NO: 7282293 - DNA, 22 bp, Homo sapiens
atacagaattcactacagtttc

SEQ ID NO: 7282294 - DNA, 22 bp, Homo sapiens
ctgggtcagtctgtccctaggg

SEQ ID NO: 7282295 - DNA, 22 bp, Homo sapiens
ctgggaagggagtcaagatact

SEQ ID NO: 7282296 - DNA, 22 bp, Homo sapiens
ctgggaagccatgtttctagga

SEQ ID NO: 7282297 - DNA, 22 bp, Homo sapiens
ctgggaagcttcgagcaggaaa

SEQ ID NO: 7282298 - DNA, 22 bp, Homo sapiens
ctgggaaggggaaggtcctctc

SEQ ID NO: 7282299 - DNA, 22 bp, Homo sapiens
ctgggaagccacagggtgtggg

SEQ ID NO: 7282300 - DNA, 22 bp, Homo sapiens
ctgggaagcatggtgatggtat

SEQ ID NO: 7282301 - DNA, 22 bp, Homo sapiens
ctgggagagacacttctgatta

SEQ ID NO: 7282302 - DNA, 22 bp, Homo sapiens
atatatatgctgatggctgcca

SEQ ID NO: 7282303 - DNA, 22 bp, Homo sapiens
atatgtgtgtatttcttactag

SEQ ID NO: 7282304 - DNA, 22 bp, Homo sapiens
atatgtgtatggatttctatct

SEQ ID NO: 7282305 - DNA, 22 bp, Homo sapiens
atatgagtttcccacttctgga

SEQ ID NO: 7282306 - DNA, 22 bp, Homo sapiens
agggaagaatcactgggatgtt

SEQ ID NO: 7282307 - DNA, 22 bp, Homo sapiens
ccctgggcagtctgcacttcag

SEQ ID NO: 7282308 - DNA, 22 bp, Homo sapiens
agggccaggaacacctgaaggg

SEQ ID NO: 7282309 - DNA, 22 bp, Homo sapiens
agggcagctggaaggtggcttc

SEQ ID NO: 7282310 - DNA, 22 bp, Homo sapiens
agggcagcccttctgggagggc

SEQ ID NO: 7282311 - DNA, 22 bp, Homo sapiens
ccactggcttttcctaggtctc

SEQ ID NO: 7282312 - DNA, 22 bp, Homo sapiens
agctgtttccataaatgagaca

SEQ ID NO: 7282313 - DNA, 22 bp, Homo sapiens
caggcctgggcttcggggctga

SEQ ID NO: 7282314 - DNA, 22 bp, Homo sapiens
caggaggttgagggtgcagtga

SEQ ID NO: 7282315 - DNA, 22 bp, Homo sapiens
caggaggttggtagcagtagat

SEQ ID NO: 7282316 - DNA, 22 bp, Homo sapiens
caggaggttgtaagagcaggcc

SEQ ID NO: 7282317 - DNA, 18 bp, Homo sapiens
atgtctgtgcactggata

SEQ ID NO: 7282318 - DNA, 22 bp, Homo sapiens
atcttggggaatcctctgtgta

SEQ ID NO: 7282319 - DNA, 22 bp, Homo sapiens
agaattctcttccattgaaaca

SEQ ID NO: 7282320 - DNA, 22 bp, Homo sapiens
attcaaagcccagtaaacattg

SEQ ID NO: 7282321 - DNA, 22 bp, Homo sapiens
atgtgtatccatctgtctattt

SEQ ID NO: 7282322 - DNA, 22 bp, Homo sapiens
attaaagttgaaattgaactga

SEQ ID NO: 7282323 - DNA, 22 bp, Homo sapiens
agccaggatggtctcgatcggc

SEQ ID NO: 7282324 - DNA, 22 bp, Homo sapiens
agccctagagctggaggtcagt

SEQ ID NO: 7282325 - DNA, 22 bp, Homo sapiens
cagccctggcctcttcgctttc

SEQ ID NO: 7282326 - DNA, 22 bp, Homo sapiens
cagccctggctagggcgagggc

SEQ ID NO: 7282327 - DNA, 22 bp, Homo sapiens
agcaggagaacactgtggctct

SEQ ID NO: 7282328 - DNA, 22 bp, Homo sapiens
agcaggtgatgtgagtctggaa

SEQ ID NO: 7282329 - DNA, 22 bp, Homo sapiens
agcaggtgatcgcgtgtgctcc

SEQ ID NO: 7282330 - DNA, 23 bp, Homo sapiens
agcacagactagaaaggtctttc

SEQ ID NO: 7282331 - DNA, 22 bp, Homo sapiens
agcacagatgtactttgagggg

SEQ ID NO: 7282332 - DNA, 22 bp, Homo sapiens
agcacagagctcggggaatgga

SEQ ID NO: 7282333 - DNA, 19 bp, Homo sapiens
agcacagagagtctatagc

SEQ ID NO: 7282334 - DNA, 22 bp, Homo sapiens
agcacagagattatttacaaga

SEQ ID NO: 7282335 - DNA, 23 bp, Homo sapiens
actgattcttgaagttgacaagt

SEQ ID NO: 7282336 - DNA, 22 bp, Homo sapiens
acctgcccacatatatatgtat

SEQ ID NO: 7282337 - DNA, 22 bp, Homo sapiens
acctgctcaactggcttctcgc

SEQ ID NO: 7282338 - DNA, 22 bp, Homo sapiens
acctcccctgactcgaaaccca

SEQ ID NO: 7282339 - DNA, 22 bp, Homo sapiens
acctccccattaggtcacccac

SEQ ID NO: 7282340 - DNA, 22 bp, Homo sapiens
acctccccgggagcagcctcct

SEQ ID NO: 7282341 - DNA, 19 bp, Homo sapiens
actcagggaaaggagaatt

SEQ ID NO: 7282342 - DNA, 22 bp, Homo sapiens
actgtgactgagcattcacatg

SEQ ID NO: 7282343 - DNA, 22 bp, Homo sapiens
agtttagacaaagtcttgcatt

SEQ ID NO: 7282344 - DNA, 22 bp, Homo sapiens
actgtgtgactgttattactgt

SEQ ID NO: 7282345 - DNA, 22 bp, Homo sapiens
actgtgtgaaacatcaatgtgt

SEQ ID NO: 7282346 - DNA, 22 bp, Homo sapiens
agaaacatttagattatatgtc

SEQ ID NO: 7282347 - DNA, 22 bp, Homo sapiens
agaaacatattcagtgagtaat

SEQ ID NO: 7282348 - DNA, 22 bp, Homo sapiens
atcacatttatagtggcacgca

SEQ ID NO: 7282349 - DNA, 22 bp, Homo sapiens
acatttaacctttgaggaactg

SEQ ID NO: 7282350 - DNA, 22 bp, Homo sapiens
acatgattttagtatcataata

SEQ ID NO: 7282351 - DNA, 20 bp, Homo sapiens
accaggccccgggccctgca

SEQ ID NO: 7282352 - DNA, 22 bp, Homo sapiens
agggaagaggaccagagtctct

SEQ ID NO: 7282353 - DNA, 22 bp, Homo sapiens
accctcaacaaattcactctat

SEQ ID NO: 7282354 - DNA, 22 bp, Homo sapiens
acccgggaggcaggagtcatag

SEQ ID NO: 7282355 - DNA, 21 bp, Homo sapiens
agctgcccagagtagggaagg

SEQ ID NO: 7282356 - DNA, 22 bp, Homo sapiens
agctgcccaatcctgcagggcg

SEQ ID NO: 7282357 - DNA, 22 bp, Homo sapiens
acataaatagattattgggagg

SEQ ID NO: 7282358 - DNA, 22 bp, Homo sapiens
acagttacatcacttactgaca

SEQ ID NO: 7282359 - DNA, 22 bp, Homo sapiens
acagagccactttggtgcctac

SEQ ID NO: 7282360 - DNA, 22 bp, Homo sapiens
acagagccaaaaggacatagta

SEQ ID NO: 7282361 - DNA, 22 bp, Homo sapiens
acagagcctccaggagtgctgg

SEQ ID NO: 7282362 - DNA, 22 bp, Homo sapiens
acagagagaggcccgaggctgc

SEQ ID NO: 7282363 - DNA, 19 bp, Homo sapiens
agcagagcagggccgtggg

SEQ ID NO: 7282364 - DNA, 22 bp, Homo sapiens
acacagagtccttactgaggta

SEQ ID NO: 7282365 - DNA, 22 bp, Homo sapiens
acacagagtttgacacatggga

SEQ ID NO: 7282366 - DNA, 22 bp, Homo sapiens
acacattaaaacgtctacaatg

SEQ ID NO: 7282367 - DNA, 22 bp, Homo sapiens
acaaagtagtcaaagtagatga

SEQ ID NO: 7282368 - DNA, 22 bp, Homo sapiens
agagccaggctcccatggggca

SEQ ID NO: 7282369 - DNA, 22 bp, Homo sapiens
aattctgatgaataaatcatcc

SEQ ID NO: 7282370 - DNA, 22 bp, Homo sapiens
agaccctggtaaacactccagg

SEQ ID NO: 7282371 - DNA, 21 bp, Homo sapiens
agaccctgcatatgttcagta

SEQ ID NO: 7282372 - DNA, 22 bp, Homo sapiens
agaccctgcattttccagggtt

SEQ ID NO: 7282373 - DNA, 22 bp, Homo sapiens
agaccctctcctcatggacatg

SEQ ID NO: 7282374 - DNA, 22 bp, Homo sapiens
acatatgcgatcataggatgca

SEQ ID NO: 7282375 - DNA, 22 bp, Homo sapiens
aagctgccttccatgtgaggaa

SEQ ID NO: 7282376 - DNA, 22 bp, Homo sapiens
accctgccaaggatggccccga

SEQ ID NO: 7282377 - DNA, 22 bp, Homo sapiens
accctgccgtgggctgcttgtg

SEQ ID NO: 7282378 - DNA, 22 bp, Homo sapiens
acatttcatttgcagtatggat

SEQ ID NO: 7282379 - DNA, 22 bp, Homo sapiens
actttcttaggctgtataaatg

SEQ ID NO: 7282380 - DNA, 22 bp, Homo sapiens
actgggctgcttgagtgccttc

SEQ ID NO: 7282381 - DNA, 22 bp, Homo sapiens
actgggctgtaaagagaggcaa

SEQ ID NO: 7282382 - DNA, 22 bp, Homo sapiens
actgggcttatgctgtggagta

SEQ ID NO: 7282383 - DNA, 20 bp, Homo sapiens
agaacaagtactaaaggaga

SEQ ID NO: 7282384 - DNA, 22 bp, Homo sapiens
actgcactccagcctcggggtc

SEQ ID NO: 7282385 - DNA, 22 bp, Homo sapiens
actgcactccagcctgggtaac

SEQ ID NO: 7282386 - DNA, 22 bp, Homo sapiens
actgcactccagcctgggtaac

SEQ ID NO: 7282387 - DNA, 22 bp, Homo sapiens
actgcactccaacctgggtgac

SEQ ID NO: 7282388 - DNA, 22 bp, Homo sapiens
actgcactccaacctgggtgac

SEQ ID NO: 7282389 - DNA, 22 bp, Homo sapiens
actgcactccagcctgggtgac

SEQ ID NO: 7282390 - DNA, 22 bp, Homo sapiens
actgcactccagcctgggtgac

SEQ ID NO: 7282391 - DNA, 22 bp, Homo sapiens
actggccaggcagcagtagctt

SEQ ID NO: 7282392 - DNA, 22 bp, Homo sapiens
acctacccttagatcacaaggg

SEQ ID NO: 7282393 - DNA, 22 bp, Homo sapiens
aaatgtcagaagctttacttct

SEQ ID NO: 7282394 - DNA, 22 bp, Homo sapiens
aagtgtcaatatttttgtaggt

SEQ ID NO: 7282395 - DNA, 22 bp, Homo sapiens
aacatgtaaccagcattcatct

SEQ ID NO: 7282396 - DNA, 22 bp, Homo sapiens
aacccgggaggcggaggttgtg

SEQ ID NO: 7282397 - DNA, 22 bp, Homo sapiens
aattctgagaacaaaaggtact

SEQ ID NO: 7282398 - DNA, 20 bp, Homo sapiens
aattttatctccatcctttg

SEQ ID NO: 7282399 - DNA, 22 bp, Homo sapiens
aagacttgaccaggttgaaggc

SEQ ID NO: 7282400 - DNA, 20 bp, Homo sapiens
aagagaagaagtctttgaaa

SEQ ID NO: 7282401 - DNA, 22 bp, Homo sapiens
aagagaaggattctgagcctgg

SEQ ID NO: 7282402 - DNA, 21 bp, Homo sapiens
acacattatgagcatagactc

SEQ ID NO: 7282403 - DNA, 22 bp, Homo sapiens
aaatctgaaatagtgtgaagta

SEQ ID NO: 7282404 - DNA, 19 bp, Homo sapiens
aaagtgaatgctgttttct

SEQ ID NO: 7282405 - DNA, 22 bp, Homo sapiens
aaagcacttcaggagcagtttg

SEQ ID NO: 7282406 - DNA, 22 bp, Homo sapiens
aactgcaacttcgtaaagtgag

SEQ ID NO: 7282407 - DNA, 22 bp, Homo sapiens
aagaacataacagaagctgtgt

SEQ ID NO: 7282408 - DNA, 22 bp, Homo sapiens
aaagtaagggttaatctacttt

SEQ ID NO: 7282409 - DNA, 22 bp, Homo sapiens
aacccgggaggcagaggttgtg

SEQ ID NO: 7282410 - DNA, 22 bp, Homo sapiens
aaagaaatagatggcatttaaa

SEQ ID NO: 7282411 - DNA, 22 bp, Homo sapiens
aaagaacaaatgatatatggtt

SEQ ID NO: 7282412 - DNA, 22 bp, Homo sapiens
aaacagcaatggagaagccagg

SEQ ID NO: 7282413 - DNA, 22 bp, Homo sapiens
aaacagcaggaacatcttgcca

SEQ ID NO: 7282414 - DNA, 22 bp, Homo sapiens
aaaatatgtataactcttctgc

SEQ ID NO: 7282415 - DNA, 22 bp, Homo sapiens
aaaatatgaagttgtcagtatg

SEQ ID NO: 7282416 - DNA, 20 bp, Homo sapiens
aaaatatgtataactcttct

SEQ ID NO: 7282417 - DNA, 22 bp, Homo sapiens
aaaatatggggtgagcccagag

SEQ ID NO: 7282418 - DNA, 22 bp, Homo sapiens
aaaatatgactgtgctccttaa

SEQ ID NO: 7282419 - DNA, 22 bp, Homo sapiens
gtgcctgccccactcctcagca

SEQ ID NO: 7282420 - DNA, 22 bp, Homo sapiens
gtgcctggagctaatgtgtata

SEQ ID NO: 7282421 - DNA, 22 bp, Homo sapiens
gtggctgctgtcctctctggtt

SEQ ID NO: 7282422 - DNA, 22 bp, Homo sapiens
gtggctgcagagggcacagcat

SEQ ID NO: 7282423 - DNA, 22 bp, Homo sapiens
gtggctctggctttccaggcgg

SEQ ID NO: 7282424 - DNA, 22 bp, Homo sapiens
gtggctcttgcatggggtctct

SEQ ID NO: 7282425 - DNA, 22 bp, Homo sapiens
gtcctgttgtgagctgccttcc

SEQ ID NO: 7282426 - DNA, 20 bp, Homo sapiens
gtctgaggagcagtgggaaa

SEQ ID NO: 7282427 - DNA, 22 bp, Homo sapiens
gtctgagggagaaggatctggg

SEQ ID NO: 7282428 - DNA, 22 bp, Homo sapiens
gtaaagcaaaatgtagagattg

SEQ ID NO: 7282429 - DNA, 20 bp, Homo sapiens
gtaaagcattcttggcatac

SEQ ID NO: 7282430 - DNA, 22 bp, Homo sapiens
gtacatttactgatgaaaagta

SEQ ID NO: 7282431 - DNA, 22 bp, Homo sapiens
gtacagttttcagtgttcactg

SEQ ID NO: 7282432 - DNA, 22 bp, Homo sapiens
taaaactagaccgtgagtctaa

SEQ ID NO: 7282433 - DNA, 22 bp, Homo sapiens
gttcaagaccagcctggccaac

SEQ ID NO: 7282434 - DNA, 22 bp, Homo sapiens
gttcaaggttttacagagtgta

SEQ ID NO: 7282435 - DNA, 22 bp, Homo sapiens
gtgggcagaggagagaacatta

SEQ ID NO: 7282436 - DNA, 22 bp, Homo sapiens
gtgggcagtgtgtcagtatctt

SEQ ID NO: 7282437 - DNA, 22 bp, Homo sapiens
gtgggccacatcccagggctct

SEQ ID NO: 7282438 - DNA, 22 bp, Homo sapiens
ggaggctgagaagtccaagatc

SEQ ID NO: 7282439 - DNA, 22 bp, Homo sapiens
ggcagaggaagctggaagtggg

SEQ ID NO: 7282440 - DNA, 22 bp, Homo sapiens
ggcagaggaagctggaagtggg

SEQ ID NO: 7282441 - DNA, 21 bp, Homo sapiens
ggcagagaagctggaagttgg

SEQ ID NO: 7282442 - DNA, 22 bp, Homo sapiens
ggcacagagttggcagagctgc

SEQ ID NO: 7282443 - DNA, 23 bp, Homo sapiens
ggcacagatgctgagcatgtgca

SEQ ID NO: 7282444 - DNA, 22 bp, Homo sapiens
ggcacagatagatcaagtgtct

SEQ ID NO: 7282445 - DNA, 22 bp, Homo sapiens
ggcacagagctccagccttggc

SEQ ID NO: 7282446 - DNA, 22 bp, Homo sapiens
ggcacagacctgctgcgatatc

SEQ ID NO: 7282447 - DNA, 22 bp, Homo sapiens
ggaggaccatcctggtttcacc

SEQ ID NO: 7282448 - DNA, 22 bp, Homo sapiens
gctgggctccaccctcaactgt

SEQ ID NO: 7282449 - DNA, 22 bp, Homo sapiens
gctgggctcgttcccacacgcg

SEQ ID NO: 7282450 - DNA, 22 bp, Homo sapiens
gctgggctctgtcatgccttcc

SEQ ID NO: 7282451 - DNA, 22 bp, Homo sapiens
gctgggctgagctagacttggc

SEQ ID NO: 7282452 - DNA, 22 bp, Homo sapiens
gctgggctcttatcacctgtac

SEQ ID NO: 7282453 - DNA, 22 bp, Homo sapiens
ggaaaacaagagaatgatgttt

SEQ ID NO: 7282454 - DNA, 22 bp, Homo sapiens
ggccagaggacctctcatagcc

SEQ ID NO: 7282455 - DNA, 18 bp, Homo sapiens
ggccagagggagggtccc

SEQ ID NO: 7282456 - DNA, 22 bp, Homo sapiens
ggccagaggtggtacatagctt

SEQ ID NO: 7282457 - DNA, 22 bp, Homo sapiens
ggccagaggtgtcctcagttct

SEQ ID NO: 7282458 - DNA, 22 bp, Homo sapiens
ggctccaccctgcttccagaag

SEQ ID NO: 7282459 - DNA, 22 bp, Homo sapiens
ggccttgggaggagggtcagaa

SEQ ID NO: 7282460 - DNA, 23 bp, Homo sapiens
ggcctgtgttttgtctgaagtac

SEQ ID NO: 7282461 - DNA, 22 bp, Homo sapiens
ggctgctcggcagctcctgagc

SEQ ID NO: 7282462 - DNA, 19 bp, Homo sapiens
ggctcctggggctcagccc

SEQ ID NO: 7282463 - DNA, 22 bp, Homo sapiens
gggaacagggcctgagctgggg

SEQ ID NO: 7282464 - DNA, 22 bp, Homo sapiens
gggaacagcatatctgaagggt

SEQ ID NO: 7282465 - DNA, 22 bp, Homo sapiens
gggaccaggtcagggctctgac

SEQ ID NO: 7282466 - DNA, 22 bp, Homo sapiens
gggccaggtcggtgaatggtca

SEQ ID NO: 7282467 - DNA, 19 bp, Homo sapiens
gggcccagcatggagggtt

SEQ ID NO: 7282468 - DNA, 23 bp, Homo sapiens
ggggacagttcccactggggtct

SEQ ID NO: 7282469 - DNA, 22 bp, Homo sapiens
gggctggcaggacctgggctga

SEQ ID NO: 7282470 - DNA, 22 bp, Homo sapiens
gggtctggcatgctgagatgga

SEQ ID NO: 7282471 - DNA, 22 bp, Homo sapiens
ggggtactggctggagccccac

SEQ ID NO: 7282472 - DNA, 22 bp, Homo sapiens
gctctgaggctgggagcactct

SEQ ID NO: 7282473 - DNA, 22 bp, Homo sapiens
gctctgagtaaatgaaagcatt

SEQ ID NO: 7282474 - DNA, 22 bp, Homo sapiens
gctctgagcccccagaagcaga

SEQ ID NO: 7282475 - DNA, 22 bp, Homo sapiens
gctcagagcccgaggcttgcat

SEQ ID NO: 7282476 - DNA, 22 bp, Homo sapiens
gctgctctccaagcctccttga

SEQ ID NO: 7282477 - DNA, 22 bp, Homo sapiens
gctgctctcagagctcatgctg

SEQ ID NO: 7282478 - DNA, 22 bp, Homo sapiens
gcctggcccagggctccgcagg

SEQ ID NO: 7282479 - DNA, 22 bp, Homo sapiens
gccctgttctggacaggcacaa

SEQ ID NO: 7282480 - DNA, 22 bp, Homo sapiens
gccctttcttcttctggactgg

SEQ ID NO: 7282481 - DNA, 16 bp, Homo sapiens
gccctttccttggctg

SEQ ID NO: 7282482 - DNA, 22 bp, Homo sapiens
gccctcctttgcttctcctagt

SEQ ID NO: 7282483 - DNA, 19 bp, Homo sapiens
gccagcagaatgatgaggc

SEQ ID NO: 7282484 - DNA, 22 bp, Homo sapiens
gccagaggctcaggttgccatg

SEQ ID NO: 7282485 - DNA, 21 bp, Homo sapiens
gcaggcactctagaggagctg

SEQ ID NO: 7282486 - DNA, 22 bp, Homo sapiens
gattagtatccttattaagaga

SEQ ID NO: 7282487 - DNA, 22 bp, Homo sapiens
gatgaatgatggcttgtttctg

SEQ ID NO: 7282488 - DNA, 19 bp, Homo sapiens
gagtcctgtgctccttgtt

SEQ ID NO: 7282489 - DNA, 22 bp, Homo sapiens
gagtcctgtaactttcttccta

SEQ ID NO: 7282490 - DNA, 22 bp, Homo sapiens
gagtctggccctgatgcatcat

SEQ ID NO: 7282491 - DNA, 20 bp, Homo sapiens
gagtgctttggcttgctctc

SEQ ID NO: 7282492 - DNA, 18 bp, Homo sapiens
gagtgtggcactgggccc

SEQ ID NO: 7282493 - DNA, 22 bp, Homo sapiens
gagtgtggtatgctctgaggct

SEQ ID NO: 7282494 - DNA, 22 bp, Homo sapiens
gaaaacatccagagatagacct

SEQ ID NO: 7282495 - DNA, 22 bp, Homo sapiens
gaaaatacttcagtgttctggc

SEQ ID NO: 7282496 - DNA, 22 bp, Homo sapiens
gaaatacagaaagggctgaatg

SEQ ID NO: 7282497 - DNA, 18 bp, Homo sapiens
ctttagctgtcatctttg

SEQ ID NO: 7282498 - DNA, 22 bp, Homo sapiens
gaagtgaaggttactctagatt

SEQ ID NO: 7282499 - DNA, 18 bp, Homo sapiens
gaagtgaagtgactcaat

SEQ ID NO: 7282500 - DNA, 23 bp, Homo sapiens
gaagtgtctgagctgtatttttc

SEQ ID NO: 7282501 - DNA, 22 bp, Homo sapiens
gaaggagaggattgtgaggctg

SEQ ID NO: 7282502 - DNA, 22 bp, Homo sapiens
gaagttctcaaggatcacagaa

SEQ ID NO: 7282503 - DNA, 22 bp, Homo sapiens
gacacagggacgtgctctgcct

SEQ ID NO: 7282504 - DNA, 22 bp, Homo sapiens
gacacaggattcctggctctgc

SEQ ID NO: 7282505 - DNA, 22 bp, Homo sapiens
gactgtttaatactgtgagttc

SEQ ID NO: 7282506 - DNA, 22 bp, Homo sapiens
gacttttctgagacaatgcttt

SEQ ID NO: 7282507 - DNA, 21 bp, Homo sapiens
cctctgtgctaaagggctccc

SEQ ID NO: 7282508 - DNA, 22 bp, Homo sapiens
tgtcattatgaggattacaata

SEQ ID NO: 7282509 - DNA, 22 bp, Homo sapiens
tgtcattatggagcttccactg

SEQ ID NO: 7282510 - DNA, 22 bp, Homo sapiens
tgtcattatttgaggatagact

SEQ ID NO: 7282511 - DNA, 22 bp, Homo sapiens
tgtctatttgaattatcctaat

SEQ ID NO: 7282512 - DNA, 22 bp, Homo sapiens
tgtctattttacagcatacatt

SEQ ID NO: 7282513 - DNA, 22 bp, Homo sapiens
tgtctattaacacaagaaagga

SEQ ID NO: 7282514 - DNA, 22 bp, Homo sapiens
tgtctcttctgcctccagctgt

SEQ ID NO: 7282515 - DNA, 22 bp, Homo sapiens
tgtctcttggctctatcactta

SEQ ID NO: 7282516 - DNA, 22 bp, Homo sapiens
cctgggtcttcagtctgctggt

SEQ ID NO: 7282517 - DNA, 22 bp, Homo sapiens
cctgggtgacagagtgagacct

SEQ ID NO: 7282518 - DNA, 22 bp, Homo sapiens
cctggggaatcttgcaggggaa

SEQ ID NO: 7282519 - DNA, 22 bp, Homo sapiens
cctgggaggcggaggttgcagt

SEQ ID NO: 7282520 - DNA, 22 bp, Homo sapiens
cctgggaggcggaggttgcagg

SEQ ID NO: 7282521 - DNA, 22 bp, Homo sapiens
cctgggaggcagaggttgcagt

SEQ ID NO: 7282522 - DNA, 22 bp, Homo sapiens
tgtggctgtctgttctcctagg

SEQ ID NO: 7282523 - DNA, 22 bp, Homo sapiens
tgtggctgtgccgtcacacgtg

SEQ ID NO: 7282524 - DNA, 22 bp, Homo sapiens
tggcccagccctgctctagggc

SEQ ID NO: 7282525 - DNA, 23 bp, Homo sapiens
tggccaggcataaaggtgggtgg

SEQ ID NO: 7282526 - DNA, 22 bp, Homo sapiens
tggcacaggaatttagatgcag

SEQ ID NO: 7282527 - DNA, 22 bp, Homo sapiens
tggcacagtatgggattaaaga

SEQ ID NO: 7282528 - DNA, 19 bp, Homo sapiens
tctgtggccttccctgatg

SEQ ID NO: 7282529 - DNA, 22 bp, Homo sapiens
tctgtggcctccttccacttac

SEQ ID NO: 7282530 - DNA, 22 bp, Homo sapiens
tctgtggcctgcctcctcattt

SEQ ID NO: 7282531 - DNA, 22 bp, Homo sapiens
tctgtggcccaagtgatggctg

SEQ ID NO: 7282532 - DNA, 23 bp, Homo sapiens
tctgtggccccttcgccccactc

SEQ ID NO: 7282533 - DNA, 22 bp, Homo sapiens
tctgtggcatgttgcacttgta

SEQ ID NO: 7282534 - DNA, 22 bp, Homo sapiens
cccagcctttgcttcctggttc

SEQ ID NO: 7282535 - DNA, 22 bp, Homo sapiens
cccagcgagtttgccggtgaac

SEQ ID NO: 7282536 - DNA, 22 bp, Homo sapiens
cccctcctgcagcacctttctt

SEQ ID NO: 7282537 - DNA, 22 bp, Homo sapiens
cccctccctgacctggttgggc

SEQ ID NO: 7282538 - DNA, 22 bp, Homo sapiens
cccctcctggccacactgtcag

SEQ ID NO: 7282539 - DNA, 22 bp, Homo sapiens
tgcctgggagtgaccaagactc

SEQ ID NO: 7282540 - DNA, 22 bp, Homo sapiens
ctggcaagaaatatatatctta

SEQ ID NO: 7282541 - DNA, 22 bp, Homo sapiens
ctggctctaagtgtcagctccc

SEQ ID NO: 7282542 - DNA, 22 bp, Homo sapiens
ctggctccaggtcatgcactca

SEQ ID NO: 7282543 - DNA, 22 bp, Homo sapiens
ctggctccactccctgcctgac

SEQ ID NO: 7282544 - DNA, 22 bp, Homo sapiens
ctggctccctctccctgagtca

SEQ ID NO: 7282545 - DNA, 22 bp, Homo sapiens
ctgcctggaccggcagccctcc

SEQ ID NO: 7282546 - DNA, 22 bp, Homo sapiens
ctgcctggaatgccagcttctc

SEQ ID NO: 7282547 - DNA, 22 bp, Homo sapiens
ctgaagaggacgcagcagcaag

SEQ ID NO: 7282548 - DNA, 22 bp, Homo sapiens
ctctgggcaaagatgcctcatc

SEQ ID NO: 7282549 - DNA, 22 bp, Homo sapiens
ctctgggagtggccacttctca

SEQ ID NO: 7282550 - DNA, 17 bp, Homo sapiens
ctctgggcagcctgggg

SEQ ID NO: 7282551 - DNA, 22 bp, Homo sapiens
ctctcctctgaagtggtgaccc

SEQ ID NO: 7282552 - DNA, 22 bp, Homo sapiens
ttcagaaaaaacttcaataagt

SEQ ID NO: 7282553 - DNA, 22 bp, Homo sapiens
ttcagaaaaaacttcaataagt

SEQ ID NO: 7282554 - DNA, 22 bp, Homo sapiens
ttgactgtgaatctaagttact

SEQ ID NO: 7282555 - DNA, 22 bp, Homo sapiens
ttgactgttgctgccattctgg

SEQ ID NO: 7282556 - DNA, 22 bp, Homo sapiens
ttgactgtacaaccttttgtag

SEQ ID NO: 7282557 - DNA, 22 bp, Homo sapiens
tttcagtgtgtaaattgaaata

SEQ ID NO: 7282558 - DNA, 22 bp, Homo sapiens
ctctccctatgcctcccaggag

SEQ ID NO: 7282559 - DNA, 22 bp, Homo sapiens
ctcctgggctgtcggcgctctg

SEQ ID NO: 7282560 - DNA, 22 bp, Homo sapiens
ctcctgggctatgtctgcttgg

SEQ ID NO: 7282561 - DNA, 17 bp, Homo sapiens
ctcctctctgggttact

SEQ ID NO: 7282562 - DNA, 22 bp, Homo sapiens
ctccagggttccccgatccact

SEQ ID NO: 7282563 - DNA, 22 bp, Homo sapiens
ctcatctgctcttattatctta

SEQ ID NO: 7282564 - DNA, 22 bp, Homo sapiens
cagcttcagaagaagccgtgag

SEQ ID NO: 7282565 - DNA, 22 bp, Homo sapiens
gtgggcaggagtgagcaacagg

SEQ ID NO: 7282566 - DNA, 22 bp, Homo sapiens
cagctgccttctgcgggaagtc

SEQ ID NO: 7282567 - DNA, 20 bp, Homo sapiens
cagctgcctggctctgggat

SEQ ID NO: 7282568 - DNA, 22 bp, Homo sapiens
cagctgcctatgacctagcctc

SEQ ID NO: 7282569 - DNA, 22 bp, Homo sapiens
cagctgccctgccttgccctta

SEQ ID NO: 7282570 - DNA, 22 bp, Homo sapiens
gtgtgagagaagctgccatgga

SEQ ID NO: 7282571 - DNA, 22 bp, Homo sapiens
gtgtgaaagtaattgcggtttt

SEQ ID NO: 7282572 - DNA, 22 bp, Homo sapiens
gtgtgaaatggttctctttgtt

SEQ ID NO: 7282573 - DNA, 22 bp, Homo sapiens
caggacacagaataaggcagtt

SEQ ID NO: 7282574 - DNA, 22 bp, Homo sapiens
taaaatgatctctcatgttctt

SEQ ID NO: 7282575 - DNA, 22 bp, Homo sapiens
taaatatgcatgtatccttatc

SEQ ID NO: 7282576 - DNA, 19 bp, Homo sapiens
caggagagcatgcactttg

SEQ ID NO: 7282577 - DNA, 22 bp, Homo sapiens
taacagaaaggggacagaaata

SEQ ID NO: 7282578 - DNA, 22 bp, Homo sapiens
taacagaaacagataagtgtaa

SEQ ID NO: 7282579 - DNA, 22 bp, Homo sapiens
taacagaaatagaaatgagagt

SEQ ID NO: 7282580 - DNA, 22 bp, Homo sapiens
taacagaaatagtaggtgaggg

SEQ ID NO: 7282581 - DNA, 22 bp, Homo sapiens
taatgttataaattcttggttt

SEQ ID NO: 7282582 - DNA, 22 bp, Homo sapiens
taatttaattccatggattcta

SEQ ID NO: 7282583 - DNA, 22 bp, Homo sapiens
tcccagggcttttctcatgctt

SEQ ID NO: 7282584 - DNA, 22 bp, Homo sapiens
tcccagggcactcaccctccct

SEQ ID NO: 7282585 - DNA, 22 bp, Homo sapiens
tccctgctgagagtgctctccc

SEQ ID NO: 7282586 - DNA, 20 bp, Homo sapiens
tcctgcagttcctaggaggg

SEQ ID NO: 7282587 - DNA, 22 bp, Homo sapiens
tcctccccaaagcccagcctgg

SEQ ID NO: 7282588 - DNA, 22 bp, Homo sapiens
tcctgcagtgtgtctcctgcac

SEQ ID NO: 7282589 - DNA, 22 bp, Homo sapiens
ccagatcactcaaccagagctc

SEQ ID NO: 7282590 - DNA, 22 bp, Homo sapiens
ccagaggtgctctttggaagtg

SEQ ID NO: 7282591 - DNA, 22 bp, Homo sapiens
ccagaggtgctgggagaggtct

SEQ ID NO: 7282592 - DNA, 22 bp, Homo sapiens
ccactgccgatgttccatcttg

SEQ ID NO: 7282593 - DNA, 22 bp, Homo sapiens
ccactgacacagacaaggcctg

SEQ ID NO: 7282594 - DNA, 17 bp, Homo sapiens
ccactgactctgacttc

SEQ ID NO: 7282595 - DNA, 23 bp, Homo sapiens
tctctcttagctatgcttatggc

SEQ ID NO: 7282596 - DNA, 22 bp, Homo sapiens
tctctcttcaacccttaactag

SEQ ID NO: 7282597 - DNA, 22 bp, Homo sapiens
tctgtggcacgattgcactgca

SEQ ID NO: 7282598 - DNA, 22 bp, Homo sapiens
cagtgatttcagaatggattat

SEQ ID NO: 7282599 - DNA, 22 bp, Homo sapiens
caggtgaacccagtctaatcat

SEQ ID NO: 7282600 - DNA, 22 bp, Homo sapiens
catacatttatacacatctatg

SEQ ID NO: 7282601 - DNA, 22 bp, Homo sapiens
catactgtaagtgcaaaagtgt

SEQ ID NO: 7282602 - DNA, 22 bp, Homo sapiens
catatcatttgcttataaatct

SEQ ID NO: 7282603 - DNA, 18 bp, Homo sapiens
tgtttattctcctgacag

SEQ ID NO: 7282604 - DNA, 22 bp, Homo sapiens
tgttagaatattgtaatattcg

SEQ ID NO: 7282605 - DNA, 22 bp, Homo sapiens
tgttagaagttaatcactaatt

SEQ ID NO: 7282606 - DNA, 22 bp, Homo sapiens
tgttaagagagtttctaatatt

SEQ ID NO: 7282607 - DNA, 22 bp, Homo sapiens
ttaaaagagacttcctttgttt

SEQ ID NO: 7282608 - DNA, 22 bp, Homo sapiens
ttaaaagacctgttgaggttag

SEQ ID NO: 7282609 - DNA, 22 bp, Homo sapiens
ttaaaagaatcctgttatcctc

SEQ ID NO: 7282610 - DNA, 22 bp, Homo sapiens
tgtgtgctaatgtatgctctaa

SEQ ID NO: 7282611 - DNA, 22 bp, Homo sapiens
tgtgtgtgagtcctggctttcc

SEQ ID NO: 7282612 - DNA, 22 bp, Homo sapiens
tgtgtgtgtcctcatttgcaga

SEQ ID NO: 7282613 - DNA, 22 bp, Homo sapiens
tgtgtgttatcttagttcatct

SEQ ID NO: 7282614 - DNA, 22 bp, Homo sapiens
tgtggctctcctcctgctgccc

SEQ ID NO: 7282615 - DNA, 22 bp, Homo sapiens
tgtggctcggccagctgctgaa

SEQ ID NO: 7282616 - DNA, 22 bp, Homo sapiens
tgtggctgactcctggtcccca

SEQ ID NO: 7282617 - DNA, 22 bp, Homo sapiens
tgtgggatggttttgccagaat

SEQ ID NO: 7282618 - DNA, 22 bp, Homo sapiens
tgtctcttttcaagctaccctt

SEQ ID NO: 7282619 - DNA, 22 bp, Homo sapiens
tgtctttaagcaaacagtgttt

SEQ ID NO: 7282620 - DNA, 22 bp, Homo sapiens
tgtgaatatttccttctttgga

SEQ ID NO: 7282621 - DNA, 22 bp, Homo sapiens
tgtgaatatccatttgtttcag

SEQ ID NO: 7282622 - DNA, 22 bp, Homo sapiens
tgtgaaagtcaaattaattgaa

SEQ ID NO: 7282623 - DNA, 22 bp, Homo sapiens
tgtgattactgaatagaaaata

SEQ ID NO: 7282624 - DNA, 22 bp, Homo sapiens
tgtgctcttgggcaatagctgc

SEQ ID NO: 7282625 - DNA, 22 bp, Homo sapiens
ttaataacattgtgtatcaccc

SEQ ID NO: 7282626 - DNA, 22 bp, Homo sapiens
ttagatgtgcaggacttttatc

SEQ ID NO: 7282627 - DNA, 22 bp, Homo sapiens
ttagatgtgtatatacatgtca

SEQ ID NO: 7282628 - DNA, 22 bp, Homo sapiens
ttagtaagcactcacacattcc

SEQ ID NO: 7282629 - DNA, 22 bp, Homo sapiens
ttcagcctgtctgcagacccct

SEQ ID NO: 7282630 - DNA, 22 bp, Homo sapiens
tgtcccatggacacaacttctt

SEQ ID NO: 7282631 - DNA, 18 bp, Homo sapiens
tgtccctgcaaataacat

SEQ ID NO: 7282632 - DNA, 18 bp, Homo sapiens
tgtccctgcaaataacat

SEQ ID NO: 7282633 - DNA, 22 bp, Homo sapiens
tgtcatttatcttatagtaatc

SEQ ID NO: 7282634 - DNA, 20 bp, Homo sapiens
tgtcatttatttatcaaatg

SEQ ID NO: 7282635 - DNA, 22 bp, Homo sapiens
tgtcacaaaaatcagtaattgc

SEQ ID NO: 7282636 - DNA, 22 bp, Homo sapiens
tgtagaaagaatatgtttcata

SEQ ID NO: 7282637 - DNA, 22 bp, Homo sapiens
tgtatgaatatgtattttcata

SEQ ID NO: 7282638 - DNA, 22 bp, Homo sapiens
tgtatattctgcctaaaagctt

SEQ ID NO: 7282639 - DNA, 22 bp, Homo sapiens
tgtaattttctcaagtttctac

SEQ ID NO: 7282640 - DNA, 22 bp, Homo sapiens
tgtacaaattcattgaactgta

SEQ ID NO: 7282641 - DNA, 22 bp, Homo sapiens
tggtgtcaagcagaactgtgaa

SEQ ID NO: 7282642 - DNA, 22 bp, Homo sapiens
tgggctctggagggcctaggat

SEQ ID NO: 7282643 - DNA, 22 bp, Homo sapiens
tgggctctggtttcctggctgg

SEQ ID NO: 7282644 - DNA, 22 bp, Homo sapiens
tgggctctggggaaactgtgat

SEQ ID NO: 7282645 - DNA, 22 bp, Homo sapiens
tgggctctgcatcagtgcccat

SEQ ID NO: 7282646 - DNA, 20 bp, Homo sapiens
tgggctctgcttcctggagt

SEQ ID NO: 7282647 - DNA, 22 bp, Homo sapiens
tgggctctcaaagtgcggcttg

SEQ ID NO: 7282648 - DNA, 22 bp, Homo sapiens
tgggctctctttacctcataac

SEQ ID NO: 7282649 - DNA, 22 bp, Homo sapiens
tgggctctgaagggtcccggat

SEQ ID NO: 7282650 - DNA, 21 bp, Homo sapiens
tgggctctttaacccaggcac

SEQ ID NO: 7282651 - DNA, 22 bp, Homo sapiens
tgggctgccggcaggctctgcc

SEQ ID NO: 7282652 - DNA, 22 bp, Homo sapiens
tgggcgaggagaatgctgtgaa

SEQ ID NO: 7282653 - DNA, 22 bp, Homo sapiens
tgggaggcaggtaggtgatgat

SEQ ID NO: 7282654 - DNA, 22 bp, Homo sapiens
tgggtgaggagaggctgtctaa

SEQ ID NO: 7282655 - DNA, 22 bp, Homo sapiens
tggtagtcggcctcggtggctc

SEQ ID NO: 7282656 - DNA, 22 bp, Homo sapiens
tgggggtgaaagtctggacagt

SEQ ID NO: 7282657 - DNA, 21 bp, Homo sapiens
tgggggtgaggcctaggaatc

SEQ ID NO: 7282658 - DNA, 22 bp, Homo sapiens
tggggccagggaggaccagaca

SEQ ID NO: 7282659 - DNA, 22 bp, Homo sapiens
tggggccaggtggctgcaggtc

SEQ ID NO: 7282660 - DNA, 22 bp, Homo sapiens
tgggggctccaggctccaggga

SEQ ID NO: 7282661 - DNA, 22 bp, Homo sapiens
tgggaggcagaagttgactgga

SEQ ID NO: 7282662 - DNA, 22 bp, Homo sapiens
tgggagcaaatgactgggagat

SEQ ID NO: 7282663 - DNA, 22 bp, Homo sapiens
tgggacagtgaccccagaggtc

SEQ ID NO: 7282664 - DNA, 22 bp, Homo sapiens
tgggacaggttggagagaagca

SEQ ID NO: 7282665 - DNA, 22 bp, Homo sapiens
tgggaagttaggatgccaggga

SEQ ID NO: 7282666 - DNA, 22 bp, Homo sapiens
tgggaagggtcaacagctggaa

SEQ ID NO: 7282667 - DNA, 22 bp, Homo sapiens
tgggaagactcctcaggaggcg

SEQ ID NO: 7282668 - DNA, 22 bp, Homo sapiens
tgggaacagtagctgctgagct

SEQ ID NO: 7282669 - DNA, 19 bp, Homo sapiens
tggctctgtttctctggag

SEQ ID NO: 7282670 - DNA, 22 bp, Homo sapiens
tggctccttcattctcctgcca

SEQ ID NO: 7282671 - DNA, 22 bp, Homo sapiens
tggctgctgagaaggcagctgt

SEQ ID NO: 7282672 - DNA, 22 bp, Homo sapiens
tggcctggctcacagtgagatt

SEQ ID NO: 7282673 - DNA, 22 bp, Homo sapiens
tggctcctaatcggcttctttc

SEQ ID NO: 7282674 - DNA, 22 bp, Homo sapiens
tggctcctgcagaccatctgga

SEQ ID NO: 7282675 - DNA, 18 bp, Homo sapiens
tggctcctgcctcctgca

SEQ ID NO: 7282676 - DNA, 22 bp, Homo sapiens
tggcctggccacatccagcagg

SEQ ID NO: 7282677 - DNA, 22 bp, Homo sapiens
tggcctggccctgaggccctgt

SEQ ID NO: 7282678 - DNA, 22 bp, Homo sapiens
tggcctgcctgggagcagcagg

SEQ ID NO: 7282679 - DNA, 22 bp, Homo sapiens
tggcctgccccgagatcctggc

SEQ ID NO: 7282680 - DNA, 22 bp, Homo sapiens
tggcctgcccagagcagctctg

SEQ ID NO: 7282681 - DNA, 22 bp, Homo sapiens
tggcccagggcacagcagggag

SEQ ID NO: 7282682 - DNA, 22 bp, Homo sapiens
tggcccaggtctctctgagccc

SEQ ID NO: 7282683 - DNA, 22 bp, Homo sapiens
tggcccaggaggccagagggca

SEQ ID NO: 7282684 - DNA, 22 bp, Homo sapiens
tggcccagtcagcaggagaggg

SEQ ID NO: 7282685 - DNA, 23 bp, Homo sapiens
tggccaggtagaggaggtagtga

SEQ ID NO: 7282686 - DNA, 22 bp, Homo sapiens
tggccaggcctcttggtgccca

SEQ ID NO: 7282687 - DNA, 22 bp, Homo sapiens
tggcagctgcaggcctcctgag

SEQ ID NO: 7282688 - DNA, 22 bp, Homo sapiens
tggcagctacagacagaggtga

SEQ ID NO: 7282689 - DNA, 22 bp, Homo sapiens
tggcagctccgggtaggggctg

SEQ ID NO: 7282690 - DNA, 22 bp, Homo sapiens
tggcacagacagcacagcaatg

SEQ ID NO: 7282691 - DNA, 22 bp, Homo sapiens
tggcacagttaaagttgtagaa

SEQ ID NO: 7282692 - DNA, 22 bp, Homo sapiens
tggattcacaccattctcctgc

SEQ ID NO: 7282693 - DNA, 20 bp, Homo sapiens
tgctatattgaagtgcagtt

SEQ ID NO: 7282694 - DNA, 22 bp, Homo sapiens
tgcggaaggcagcgcagggtgg

SEQ ID NO: 7282695 - DNA, 22 bp, Homo sapiens
tgctcgccccacatgccctcat

SEQ ID NO: 7282696 - DNA, 22 bp, Homo sapiens
tgctgaggcatttggacagagt

SEQ ID NO: 7282697 - DNA, 22 bp, Homo sapiens
tgctgagggagcatcaaagaaa

SEQ ID NO: 7282698 - DNA, 22 bp, Homo sapiens
tgctgaggtcacggcggccaga

SEQ ID NO: 7282699 - DNA, 22 bp, Homo sapiens
tgctgaggttgtggagtgcatt

SEQ ID NO: 7282700 - DNA, 22 bp, Homo sapiens
tgctgaggactaaaggagatga

SEQ ID NO: 7282701 - DNA, 22 bp, Homo sapiens
tgcttcattaaaacaatatttt

SEQ ID NO: 7282702 - DNA, 22 bp, Homo sapiens
tgctgtgacagagtctcatgga

SEQ ID NO: 7282703 - DNA, 22 bp, Homo sapiens
tggaaggtgtggcaggtctagt

SEQ ID NO: 7282704 - DNA, 22 bp, Homo sapiens
tggaagtgctcttctgaccaac

SEQ ID NO: 7282705 - DNA, 22 bp, Homo sapiens
tggaagtgctcttctgaccaac

SEQ ID NO: 7282706 - DNA, 22 bp, Homo sapiens
tggaagtgccttgctggctgtg

SEQ ID NO: 7282707 - DNA, 23 bp, Homo sapiens
tggaagtggcagggagacaaagc

SEQ ID NO: 7282708 - DNA, 22 bp, Homo sapiens
tggaatgcagtgggagcttacc

SEQ ID NO: 7282709 - DNA, 22 bp, Homo sapiens
tggaatgttgtgtataggtcag

SEQ ID NO: 7282710 - DNA, 22 bp, Homo sapiens
tgctttctctctaccccacttt

SEQ ID NO: 7282711 - DNA, 17 bp, Homo sapiens
tgctttcttcctgccct

SEQ ID NO: 7282712 - DNA, 22 bp, Homo sapiens
tggaaaaactgagacttagaca

SEQ ID NO: 7282713 - DNA, 22 bp, Homo sapiens
tgaggcctggactctgcatgga

SEQ ID NO: 7282714 - DNA, 22 bp, Homo sapiens
tgaggtggctagggaggcactc

SEQ ID NO: 7282715 - DNA, 22 bp, Homo sapiens
tgagacagggtcttgctctgtt

SEQ ID NO: 7282716 - DNA, 22 bp, Homo sapiens
tgagacagttctgcagctgggt

SEQ ID NO: 7282717 - DNA, 23 bp, Homo sapiens
tgagaagccgccgggcagcctgg

SEQ ID NO: 7282718 - DNA, 22 bp, Homo sapiens
tgagaaattcgacatatattta

SEQ ID NO: 7282719 - DNA, 22 bp, Homo sapiens
tgagaaatggcagcattactgg

SEQ ID NO: 7282720 - DNA, 22 bp, Homo sapiens
tgagaagcagtttcagtaagaa

SEQ ID NO: 7282721 - DNA, 22 bp, Homo sapiens
tgagaagcccacactctttcct

SEQ ID NO: 7282722 - DNA, 22 bp, Homo sapiens
tgagacagttctgcagctgggt

SEQ ID NO: 7282723 - DNA, 20 bp, Homo sapiens
tgagccagtcaagctacatt

SEQ ID NO: 7282724 - DNA, 22 bp, Homo sapiens
tgagctgcattacagcctctgt

SEQ ID NO: 7282725 - DNA, 22 bp, Homo sapiens
tgagccagccttgcagctgtgc

SEQ ID NO: 7282726 - DNA, 22 bp, Homo sapiens
tgagccagcctcagaagtcacg

SEQ ID NO: 7282727 - DNA, 22 bp, Homo sapiens
tgagccagcaggcctccagtgg

SEQ ID NO: 7282728 - DNA, 22 bp, Homo sapiens
tgacttgtctctttgggagaca

SEQ ID NO: 7282729 - DNA, 22 bp, Homo sapiens
tgactctcccaagtttgaggga

SEQ ID NO: 7282730 - DNA, 22 bp, Homo sapiens
tgaatttaagcactgatgttaa

SEQ ID NO: 7282731 - DNA, 22 bp, Homo sapiens
tctttgcatgtgcttcttggcc

SEQ ID NO: 7282732 - DNA, 22 bp, Homo sapiens
tctttgcacacagcgattcttc

SEQ ID NO: 7282733 - DNA, 22 bp, Homo sapiens
tgaaaccactgatggtaccaag

SEQ ID NO: 7282734 - DNA, 22 bp, Homo sapiens
tgaaagaaacaggtatattggg

SEQ ID NO: 7282735 - DNA, 22 bp, Homo sapiens
tgaaacaaaattaagattctcg

SEQ ID NO: 7282736 - DNA, 22 bp, Homo sapiens
tgaagactcagaagctaagata

SEQ ID NO: 7282737 - DNA, 22 bp, Homo sapiens
tgaaatatcattttcatctccc

SEQ ID NO: 7282738 - DNA, 22 bp, Homo sapiens
tgcctgctgctaagctctttgt

SEQ ID NO: 7282739 - DNA, 22 bp, Homo sapiens
tgcctgcttgtgtacctggtga

SEQ ID NO: 7282740 - DNA, 22 bp, Homo sapiens
tgcctgctttctgggctgccat

SEQ ID NO: 7282741 - DNA, 22 bp, Homo sapiens
tgcctgctttctcctcaactca

SEQ ID NO: 7282742 - DNA, 21 bp, Homo sapiens
tgcccctttatgggctcccta

SEQ ID NO: 7282743 - DNA, 22 bp, Homo sapiens
tgccctggaaccatctacagtc

SEQ ID NO: 7282744 - DNA, 22 bp, Homo sapiens
tgccctgggaacacagatgcca

SEQ ID NO: 7282745 - DNA, 22 bp, Homo sapiens
tgcatgctagcctcgtgaataa

SEQ ID NO: 7282746 - DNA, 22 bp, Homo sapiens
tgcagttttatcacatatatag

SEQ ID NO: 7282747 - DNA, 22 bp, Homo sapiens
tgcagttttggccattgaaggc

SEQ ID NO: 7282748 - DNA, 22 bp, Homo sapiens
tgccacagggtcctcaggccag

SEQ ID NO: 7282749 - DNA, 22 bp, Homo sapiens
tgcatttcacagactgagaaat

SEQ ID NO: 7282750 - DNA, 22 bp, Homo sapiens
tgcactactgtgatacacagcc

SEQ ID NO: 7282751 - DNA, 23 bp, Homo sapiens
tgcagaggcatgatcactgctca

SEQ ID NO: 7282752 - DNA, 21 bp, Homo sapiens
tgcagaggcacaaacaagccc

SEQ ID NO: 7282753 - DNA, 22 bp, Homo sapiens
tgcagaggagctggaaggctgg

SEQ ID NO: 7282754 - DNA, 22 bp, Homo sapiens
tgcaggctcaccctggagctga

SEQ ID NO: 7282755 - DNA, 21 bp, Homo sapiens
tgcaggagtctgtgagtcagg

SEQ ID NO: 7282756 - DNA, 23 bp, Homo sapiens
tgcaaaatttgcagagttcgatg

SEQ ID NO: 7282757 - DNA, 22 bp, Homo sapiens
tgcaaagatgaaatattaaagg

SEQ ID NO: 7282758 - DNA, 22 bp, Homo sapiens
tgcaaaataatgaacgattttt

SEQ ID NO: 7282759 - DNA, 22 bp, Homo sapiens
tgatttatgaccaagttagaat

SEQ ID NO: 7282760 - DNA, 22 bp, Homo sapiens
tgatttacttctggataaatcc

SEQ ID NO: 7282761 - DNA, 22 bp, Homo sapiens
tgatttacaattgtaaaagttt

SEQ ID NO: 7282762 - DNA, 22 bp, Homo sapiens
tgcaagggtgtttgagctgccc

SEQ ID NO: 7282763 - DNA, 22 bp, Homo sapiens
tgattgcctactatgtgccatg

SEQ ID NO: 7282764 - DNA, 22 bp, Homo sapiens
tgatgtctctctatactctaac

SEQ ID NO: 7282765 - DNA, 22 bp, Homo sapiens
tgagtgttgtaaccatatgatt

SEQ ID NO: 7282766 - DNA, 22 bp, Homo sapiens
tgatattttatgagctttcata

SEQ ID NO: 7282767 - DNA, 22 bp, Homo sapiens
tgatatttaagcaaaaatatgg

SEQ ID NO: 7282768 - DNA, 22 bp, Homo sapiens
tcctggctctgctgcctcctag

SEQ ID NO: 7282769 - DNA, 22 bp, Homo sapiens
taagaacagtgtctgtctcaca

SEQ ID NO: 7282770 - DNA, 22 bp, Homo sapiens
tcctgggaggcggaggttgcag

SEQ ID NO: 7282771 - DNA, 23 bp, Homo sapiens
tcctgggtttgaattctagtctt

SEQ ID NO: 7282772 - DNA, 22 bp, Homo sapiens
tcctgggtaaacactgaccttt

SEQ ID NO: 7282773 - DNA, 22 bp, Homo sapiens
tcgcaccattgcactccagcca

SEQ ID NO: 7282774 - DNA, 22 bp, Homo sapiens
tcctttctgggcctcagtgact

SEQ ID NO: 7282775 - DNA, 22 bp, Homo sapiens
tcctttctatcttgggtatcta

SEQ ID NO: 7282776 - DNA, 22 bp, Homo sapiens
tcctttctcccaggttagttgt

SEQ ID NO: 7282777 - DNA, 18 bp, Homo sapiens
tcctttctccctcatctt

SEQ ID NO: 7282778 - DNA, 22 bp, Homo sapiens
tctaaagaaacattgagacctg

SEQ ID NO: 7282779 - DNA, 23 bp, Homo sapiens
tcgttgaatagcaatagcacaac

SEQ ID NO: 7282780 - DNA, 19 bp, Homo sapiens
tccttctccggccaccccg

SEQ ID NO: 7282781 - DNA, 22 bp, Homo sapiens
tccttaggtatttagcatgaat

SEQ ID NO: 7282782 - DNA, 22 bp, Homo sapiens
tccttaggcaatttgggagagt

SEQ ID NO: 7282783 - DNA, 23 bp, Homo sapiens
tctagcctgtcatcagcctctcc

SEQ ID NO: 7282784 - DNA, 22 bp, Homo sapiens
tctagaaaaccaatattacatg

SEQ ID NO: 7282785 - DNA, 22 bp, Homo sapiens
tctagaaaaacaaagtatctga

SEQ ID NO: 7282786 - DNA, 22 bp, Homo sapiens
tctactttcactcatacttatt

SEQ ID NO: 7282787 - DNA, 22 bp, Homo sapiens
tctacttttccctatacagttt

SEQ ID NO: 7282788 - DNA, 22 bp, Homo sapiens
tctactttataagtatataagt

SEQ ID NO: 7282789 - DNA, 17 bp, Homo sapiens
tctcagtgactgatagc

SEQ ID NO: 7282790 - DNA, 22 bp, Homo sapiens
tctcagtgagcttttctatgtt

SEQ ID NO: 7282791 - DNA, 23 bp, Homo sapiens
tctccaggccttactccaggcct

SEQ ID NO: 7282792 - DNA, 22 bp, Homo sapiens
tctccaggactgagctccagcc

SEQ ID NO: 7282793 - DNA, 22 bp, Homo sapiens
tctcattggaaaagagtttaat

SEQ ID NO: 7282794 - DNA, 22 bp, Homo sapiens
tctcctggatggaccttctctt

SEQ ID NO: 7282795 - DNA, 22 bp, Homo sapiens
tctcctggagcccagatgctgg

SEQ ID NO: 7282796 - DNA, 22 bp, Homo sapiens
tctccaggcttaatctcagctt

SEQ ID NO: 7282797 - DNA, 22 bp, Homo sapiens
tctccagggaggtagcccagtg

SEQ ID NO: 7282798 - DNA, 22 bp, Homo sapiens
tctccagggtgagctaggccag

SEQ ID NO: 7282799 - DNA, 19 bp, Homo sapiens
tctccaggtgccccaaaca

SEQ ID NO: 7282800 - DNA, 22 bp, Homo sapiens
tctcccctactctaaatctgca

SEQ ID NO: 7282801 - DNA, 22 bp, Homo sapiens
tctcccctagtgcattaaagtg

SEQ ID NO: 7282802 - DNA, 22 bp, Homo sapiens
tctgaagagaacaccagtagtt

SEQ ID NO: 7282803 - DNA, 22 bp, Homo sapiens
tctgaagagtcttgcaagaaag

SEQ ID NO: 7282804 - DNA, 22 bp, Homo sapiens
tctgaagattaccagctaaatg

SEQ ID NO: 7282805 - DNA, 22 bp, Homo sapiens
tctgaagaagggtgccaggctg

SEQ ID NO: 7282806 - DNA, 22 bp, Homo sapiens
tctgaaattgttagtaaaaatg

SEQ ID NO: 7282807 - DNA, 22 bp, Homo sapiens
tctgaaattttagttatagaaa

SEQ ID NO: 7282808 - DNA, 22 bp, Homo sapiens
tctctgggtattcactgccttc

SEQ ID NO: 7282809 - DNA, 22 bp, Homo sapiens
tctctgggcctccctttccaag

SEQ ID NO: 7282810 - DNA, 22 bp, Homo sapiens
tctgggcagccatgtgcctggc

SEQ ID NO: 7282811 - DNA, 22 bp, Homo sapiens
tctgggcagcctcaggccaggg

SEQ ID NO: 7282812 - DNA, 22 bp, Homo sapiens
tctgaggtggggctggagcatt

SEQ ID NO: 7282813 - DNA, 22 bp, Homo sapiens
tctgagccctcttttgcagccc

SEQ ID NO: 7282814 - DNA, 22 bp, Homo sapiens
tctgagccataagagtacagga

SEQ ID NO: 7282815 - DNA, 22 bp, Homo sapiens
tctgagccagacaagacagcca

SEQ ID NO: 7282816 - DNA, 22 bp, Homo sapiens
tctgcccttggctctcttgttg

SEQ ID NO: 7282817 - DNA, 22 bp, Homo sapiens
tctgccctgcagggagcagtaa

SEQ ID NO: 7282818 - DNA, 21 bp, Homo sapiens
tctgccctccaggagctcata

SEQ ID NO: 7282819 - DNA, 22 bp, Homo sapiens
tctgccctcagggtaatgatca

SEQ ID NO: 7282820 - DNA, 22 bp, Homo sapiens
tctgttttcatttgtcttgaga

SEQ ID NO: 7282821 - DNA, 22 bp, Homo sapiens
tctgtttattcaatttctatat

SEQ ID NO: 7282822 - DNA, 22 bp, Homo sapiens
tctgtgtgggatagtttgagga

SEQ ID NO: 7282823 - DNA, 22 bp, Homo sapiens
tctgtgtggtagtttcagtgaa

SEQ ID NO: 7282824 - DNA, 22 bp, Homo sapiens
tctgtgtgtgcctgttaatatt

SEQ ID NO: 7282825 - DNA, 22 bp, Homo sapiens
tctgtttatatgtttttcagac

SEQ ID NO: 7282826 - DNA, 22 bp, Homo sapiens
tctgtttatgtgtctaaataaa

SEQ ID NO: 7282827 - DNA, 22 bp, Homo sapiens
tctgtggctgttatctttatat

SEQ ID NO: 7282828 - DNA, 22 bp, Homo sapiens
tctgtggcttcctatttcttgg

SEQ ID NO: 7282829 - DNA, 22 bp, Homo sapiens
tctgtggctgtgctgggccaga

SEQ ID NO: 7282830 - DNA, 22 bp, Homo sapiens
tctgtggcttgggcctgcctgt

SEQ ID NO: 7282831 - DNA, 22 bp, Homo sapiens
tctgtggctttcttatgttgta

SEQ ID NO: 7282832 - DNA, 22 bp, Homo sapiens
tctgtccaggcttactatatat

SEQ ID NO: 7282833 - DNA, 22 bp, Homo sapiens
tctttacaatctaagcatagtt

SEQ ID NO: 7282834 - DNA, 23 bp, Homo sapiens
tctttacatactgatgagttctc

SEQ ID NO: 7282835 - DNA, 22 bp, Homo sapiens
tctttcccagtagctctcccag

SEQ ID NO: 7282836 - DNA, 22 bp, Homo sapiens
tcttctgtcctaagtcaaagca

SEQ ID NO: 7282837 - DNA, 22 bp, Homo sapiens
tcttctgtggctctcaccaccc

SEQ ID NO: 7282838 - DNA, 22 bp, Homo sapiens
tcttctttggatgaaagaatat

SEQ ID NO: 7282839 - DNA, 22 bp, Homo sapiens
aaaatatgactgtgctccttaa

SEQ ID NO: 7282840 - DNA, 20 bp, Homo sapiens
aaaatatgtataactcttct

SEQ ID NO: 7282841 - DNA, 22 bp, Homo sapiens
aaaatatgtataactcttctgc

SEQ ID NO: 7282842 - DNA, 22 bp, Homo sapiens
aaacaccaagagctagctatta

SEQ ID NO: 7282843 - DNA, 22 bp, Homo sapiens
aaaattctcttgatcttgacag

SEQ ID NO: 7282844 - DNA, 22 bp, Homo sapiens
aaaattggacgtagctactcca

SEQ ID NO: 7282845 - DNA, 22 bp, Homo sapiens
aaaattggttcctttctgaggc

SEQ ID NO: 7282846 - DNA, 22 bp, Homo sapiens
aaaaatacttcacttctgggtg

SEQ ID NO: 7282847 - DNA, 22 bp, Homo sapiens
aaaactaaatacgctttgcctc

SEQ ID NO: 7282848 - DNA, 22 bp, Homo sapiens
aaaattcatagaactgtacgct

SEQ ID NO: 7282849 - DNA, 22 bp, Homo sapiens
aaaattcatggcttgggaaaag

SEQ ID NO: 7282850 - DNA, 22 bp, Homo sapiens
aaaattatagatctagtgcctg

SEQ ID NO: 7282851 - DNA, 22 bp, Homo sapiens
aaagccaggcagccaagccagt

SEQ ID NO: 7282852 - DNA, 22 bp, Homo sapiens
aaacatgcattcaagaaaatct

SEQ ID NO: 7282853 - DNA, 21 bp, Homo sapiens
aaagaaatctcccattggtag

SEQ ID NO: 7282854 - DNA, 22 bp, Homo sapiens
aaagaaatagatggcatttaaa

SEQ ID NO: 7282855 - DNA, 22 bp, Homo sapiens
aaagaaatacctttctcagctt

SEQ ID NO: 7282856 - DNA, 22 bp, Homo sapiens
aaacttcattttcaactgcaaa

SEQ ID NO: 7282857 - DNA, 22 bp, Homo sapiens
aaagaacaatgtggaatctcct

SEQ ID NO: 7282858 - DNA, 22 bp, Homo sapiens
aaagagaacttttacccaagaa

SEQ ID NO: 7282859 - DNA, 20 bp, Homo sapiens
aaagagaagcctcaccttgt

SEQ ID NO: 7282860 - DNA, 22 bp, Homo sapiens
aaaggcaggactgcagcatagg

SEQ ID NO: 7282861 - DNA, 18 bp, Homo sapiens
aaaggcagattactggga

SEQ ID NO: 7282862 - DNA, 22 bp, Homo sapiens
aaaggcagagttgttggaggca

SEQ ID NO: 7282863 - DNA, 22 bp, Homo sapiens
aaaggcaggctttcacatctca

SEQ ID NO: 7282864 - DNA, 23 bp, Homo sapiens
aaaggcaggcctaggacatattg

SEQ ID NO: 7282865 - DNA, 23 bp, Homo sapiens
aaaggcaggcctaggacatattg

SEQ ID NO: 7282866 - DNA, 22 bp, Homo sapiens
aaaggcagtgggtatgtggatc

SEQ ID NO: 7282867 - DNA, 19 bp, Homo sapiens
aaaggcagtgggtggcgtg

SEQ ID NO: 7282868 - DNA, 22 bp, Homo sapiens
aaaggcagtgtgatactgtggt

SEQ ID NO: 7282869 - DNA, 22 bp, Homo sapiens
aacccagagctggaggagagta

SEQ ID NO: 7282870 - DNA, 22 bp, Homo sapiens
aaagcctcccaggttatgagta

SEQ ID NO: 7282871 - DNA, 22 bp, Homo sapiens
aagaacataaacagaaggacag

SEQ ID NO: 7282872 - DNA, 22 bp, Homo sapiens
aagaacatgaacacaatgttta

SEQ ID NO: 7282873 - DNA, 22 bp, Homo sapiens
aagaacatgaacctcttctaac

SEQ ID NO: 7282874 - DNA, 22 bp, Homo sapiens
aagaacatgaagtcacaaatgc

SEQ ID NO: 7282875 - DNA, 22 bp, Homo sapiens
aaagcactcggcttcatccagg

SEQ ID NO: 7282876 - DNA, 22 bp, Homo sapiens
aaagcagactgatttgcatcac

SEQ ID NO: 7282877 - DNA, 22 bp, Homo sapiens
aaagcagagcagggcacttatg

SEQ ID NO: 7282878 - DNA, 22 bp, Homo sapiens
aaagcagagatcatggcttgta

SEQ ID NO: 7282879 - DNA, 22 bp, Homo sapiens
aaagcagaggtgatatgactta

SEQ ID NO: 7282880 - DNA, 22 bp, Homo sapiens
aaagcagaggttgcagtgagct

SEQ ID NO: 7282881 - DNA, 22 bp, Homo sapiens
aaagcagattctgatgcagtag

SEQ ID NO: 7282882 - DNA, 22 bp, Homo sapiens
aaagcagcaaatacttttgcac

SEQ ID NO: 7282883 - DNA, 22 bp, Homo sapiens
aaagcctcccaggttatgagta

SEQ ID NO: 7282884 - DNA, 22 bp, Homo sapiens
aacatacttgtactatgcatat

SEQ ID NO: 7282885 - DNA, 22 bp, Homo sapiens
aacatacttatactaaataatg

SEQ ID NO: 7282886 - DNA, 22 bp, Homo sapiens
aaagcaaacagaaccccaagct

SEQ ID NO: 7282887 - DNA, 22 bp, Homo sapiens
aaagcaagtctctacaaagtac

SEQ ID NO: 7282888 - DNA, 22 bp, Homo sapiens
aagaacatggtaggataacaaa

SEQ ID NO: 7282889 - DNA, 22 bp, Homo sapiens
aaagttttagctgtccagttcc

SEQ ID NO: 7282890 - DNA, 22 bp, Homo sapiens
aaatactggcaagtgctaattc

SEQ ID NO: 7282891 - DNA, 22 bp, Homo sapiens
aaatactgctgctattcctttt

SEQ ID NO: 7282892 - DNA, 22 bp, Homo sapiens
aagcaggcattccagagacaat

SEQ ID NO: 7282893 - DNA, 22 bp, Homo sapiens
aagcaggccctgggccagggga

SEQ ID NO: 7282894 - DNA, 22 bp, Homo sapiens
aagcaggcgagggcctggagca

SEQ ID NO: 7282895 - DNA, 22 bp, Homo sapiens
aagatcaccttgacatgaaaag

SEQ ID NO: 7282896 - DNA, 22 bp, Homo sapiens
aagcaggcatcttggaggtcaa

SEQ ID NO: 7282897 - DNA, 22 bp, Homo sapiens
aagcaggcagggtggagagttt

SEQ ID NO: 7282898 - DNA, 22 bp, Homo sapiens
aagcaggcaaggttgtggggca

SEQ ID NO: 7282899 - DNA, 22 bp, Homo sapiens
acacatttattacatgcatgtg

SEQ ID NO: 7282900 - DNA, 22 bp, Homo sapiens
aagagcaggctgctgtggagta

SEQ ID NO: 7282901 - DNA, 22 bp, Homo sapiens
acacatgaaagacattaaggtg

SEQ ID NO: 7282902 - DNA, 22 bp, Homo sapiens
acacatgaaataatattatgca

SEQ ID NO: 7282903 - DNA, 22 bp, Homo sapiens
acacatgaatcactggtggaag

SEQ ID NO: 7282904 - DNA, 22 bp, Homo sapiens
acacatgataagaaagtttaaa

SEQ ID NO: 7282905 - DNA, 22 bp, Homo sapiens
acacatgagttctcatcttgtg

SEQ ID NO: 7282906 - DNA, 22 bp, Homo sapiens
acacatgaggatgaggggatca

SEQ ID NO: 7282907 - DNA, 19 bp, Homo sapiens
acacatgaggagggacccc

SEQ ID NO: 7282908 - DNA, 22 bp, Homo sapiens
acacatgaggaaggcctcaccc

SEQ ID NO: 7282909 - DNA, 22 bp, Homo sapiens
acacatgagaaacatcagttgt

SEQ ID NO: 7282910 - DNA, 22 bp, Homo sapiens
acacatgacctccgcagcagca

SEQ ID NO: 7282911 - DNA, 22 bp, Homo sapiens
acacatgattaatgccaagcat

SEQ ID NO: 7282912 - DNA, 22 bp, Homo sapiens
aagcagagggtatggccaggtt

SEQ ID NO: 7282913 - DNA, 22 bp, Homo sapiens
aagcagaggccacagagtgggc

SEQ ID NO: 7282914 - DNA, 22 bp, Homo sapiens
acagcaaaagacaagaacttaa

SEQ ID NO: 7282915 - DNA, 22 bp, Homo sapiens
aagcacaatgaacatcttagat

SEQ ID NO: 7282916 - DNA, 22 bp, Homo sapiens
aagagaagaaagtgtctacaca

SEQ ID NO: 7282917 - DNA, 22 bp, Homo sapiens
aattttacttccctcagtgtag

SEQ ID NO: 7282918 - DNA, 22 bp, Homo sapiens
aattttactaatctgagtgtga

SEQ ID NO: 7282919 - DNA, 22 bp, Homo sapiens
aattttacataggggatatggg

SEQ ID NO: 7282920 - DNA, 20 bp, Homo sapiens
aattttactgtcctatagag

SEQ ID NO: 7282921 - DNA, 22 bp, Homo sapiens
aattttacaagaaggcctcgta

SEQ ID NO: 7282922 - DNA, 22 bp, Homo sapiens
aattttacaaaatacctccgat

SEQ ID NO: 7282923 - DNA, 22 bp, Homo sapiens
acacaaagttggatgacaaaat

SEQ ID NO: 7282924 - DNA, 22 bp, Homo sapiens
aagagcagattcctagtggagc

SEQ ID NO: 7282925 - DNA, 22 bp, Homo sapiens
aattctctccagggtaacatca

SEQ ID NO: 7282926 - DNA, 22 bp, Homo sapiens
aagaacaactgctttaaaagca

SEQ ID NO: 7282927 - DNA, 22 bp, Homo sapiens
aagaaatgtgaatattgaatag

SEQ ID NO: 7282928 - DNA, 22 bp, Homo sapiens
aagaaatgtagagcctagtaaa

SEQ ID NO: 7282929 - DNA, 22 bp, Homo sapiens
aatttacacttcatttggaggg

SEQ ID NO: 7282930 - DNA, 22 bp, Homo sapiens
aagaaaatcagttctggtcagt

SEQ ID NO: 7282931 - DNA, 22 bp, Homo sapiens
aagaaaaggtaaccgcttatct

SEQ ID NO: 7282932 - DNA, 22 bp, Homo sapiens
aagaaaagatgtttggttttca

SEQ ID NO: 7282933 - DNA, 22 bp, Homo sapiens
aactgggcccagtctgagttgg

SEQ ID NO: 7282934 - DNA, 22 bp, Homo sapiens
aatgaattgcagtactgacttg

SEQ ID NO: 7282935 - DNA, 22 bp, Homo sapiens
aacatcagcacacaatagcaag

SEQ ID NO: 7282936 - DNA, 22 bp, Homo sapiens
aacatcaggatcttgttacagt

SEQ ID NO: 7282937 - DNA, 22 bp, Homo sapiens
aacatccccttcatgtcatgat

SEQ ID NO: 7282938 - DNA, 22 bp, Homo sapiens
aaggcagcaagaattccaggtt

SEQ ID NO: 7282939 - DNA, 22 bp, Homo sapiens
aaggcagccctggctcagcctg

SEQ ID NO: 7282940 - DNA, 22 bp, Homo sapiens
aaggcagccagatcctttgggt

SEQ ID NO: 7282941 - DNA, 19 bp, Homo sapiens
aaggctggtaccataggtt

SEQ ID NO: 7282942 - DNA, 22 bp, Homo sapiens
aaggctgggtttgggatgtgat

SEQ ID NO: 7282943 - DNA, 22 bp, Homo sapiens
aaggctgggtaacctgtccact

SEQ ID NO: 7282944 - DNA, 22 bp, Homo sapiens
aaattcaattaactttcatgct

SEQ ID NO: 7282945 - DNA, 22 bp, Homo sapiens
aaattcaatgatcactggctca

SEQ ID NO: 7282946 - DNA, 22 bp, Homo sapiens
aaggctggttccatccctggtg

SEQ ID NO: 7282947 - DNA, 22 bp, Homo sapiens
aaggctggtggattatgaggtc

SEQ ID NO: 7282948 - DNA, 22 bp, Homo sapiens
aaggctggtcagatgtggtgaa

SEQ ID NO: 7282949 - DNA, 22 bp, Homo sapiens
aacacagggactcccaggagaa

SEQ ID NO: 7282950 - DNA, 22 bp, Homo sapiens
aacacaggggcgtggctcttac

SEQ ID NO: 7282951 - DNA, 22 bp, Homo sapiens
aacacaggttcattctgtgagg

SEQ ID NO: 7282952 - DNA, 22 bp, Homo sapiens
aacagagatcttaattcctgta

SEQ ID NO: 7282953 - DNA, 22 bp, Homo sapiens
acgtgcaggatctggttggcga

SEQ ID NO: 7282954 - DNA, 22 bp, Homo sapiens
aagtctctggtgatgcaggaaa

SEQ ID NO: 7282955 - DNA, 22 bp, Homo sapiens
aagtctctggttgcttgcatgg

SEQ ID NO: 7282956 - DNA, 22 bp, Homo sapiens
aagtctcttagtaatatccaac

SEQ ID NO: 7282957 - DNA, 22 bp, Homo sapiens
aagtctcttcctctgccaaaga

SEQ ID NO: 7282958 - DNA, 22 bp, Homo sapiens
aagtctctttgggtactttatt

SEQ ID NO: 7282959 - DNA, 22 bp, Homo sapiens
aagtctctttacctctccaggc

SEQ ID NO: 7282960 - DNA, 22 bp, Homo sapiens
aagtctctaagactgtgccatc

SEQ ID NO: 7282961 - DNA, 22 bp, Homo sapiens
aagtctctcacatatctggtcc

SEQ ID NO: 7282962 - DNA, 22 bp, Homo sapiens
aagtctctcatggctgacagca

SEQ ID NO: 7282963 - DNA, 22 bp, Homo sapiens
aagtctctctgtgtgggataag

SEQ ID NO: 7282964 - DNA, 22 bp, Homo sapiens
aagtctctgatgtgtgttaggt

SEQ ID NO: 7282965 - DNA, 22 bp, Homo sapiens
aagtctctggcaaatgatcttg

SEQ ID NO: 7282966 - DNA, 18 bp, Homo sapiens
aagtctctgaaagctttt

SEQ ID NO: 7282967 - DNA, 22 bp, Homo sapiens
aagtctctgactcacacaatgt

SEQ ID NO: 7282968 - DNA, 22 bp, Homo sapiens
actctccctgagagggaggcat

SEQ ID NO: 7282969 - DNA, 22 bp, Homo sapiens
actccctccaaatctgcacagt

SEQ ID NO: 7282970 - DNA, 22 bp, Homo sapiens
actgctagtgagaaaataacca

SEQ ID NO: 7282971 - DNA, 22 bp, Homo sapiens
actgagagaacgggctgctccc

SEQ ID NO: 7282972 - DNA, 22 bp, Homo sapiens
actctgctggctgcagggcagc

SEQ ID NO: 7282973 - DNA, 22 bp, Homo sapiens
actctgctgtctgatggcagga

SEQ ID NO: 7282974 - DNA, 22 bp, Homo sapiens
actctgcttaattaaaaccagg

SEQ ID NO: 7282975 - DNA, 22 bp, Homo sapiens
actctgctctttggacaatgcc

SEQ ID NO: 7282976 - DNA, 17 bp, Homo sapiens
actctgctgaagtagaa

SEQ ID NO: 7282977 - DNA, 22 bp, Homo sapiens
actctgctcttatagtgttata

SEQ ID NO: 7282978 - DNA, 22 bp, Homo sapiens
actctgcttgcccaatggaaac

SEQ ID NO: 7282979 - DNA, 22 bp, Homo sapiens
agaaatgacacacatgagacat

SEQ ID NO: 7282980 - DNA, 22 bp, Homo sapiens
agaaatgacacacatgagacat

SEQ ID NO: 7282981 - DNA, 22 bp, Homo sapiens
aatcaggcaaatttctttttct

SEQ ID NO: 7282982 - DNA, 22 bp, Homo sapiens
agaaatgaaaccaaagcctaga

SEQ ID NO: 7282983 - DNA, 22 bp, Homo sapiens
agaaatgaagagagtcaaggtt

SEQ ID NO: 7282984 - DNA, 22 bp, Homo sapiens
agaaatgaagagagtcaaggtt

SEQ ID NO: 7282985 - DNA, 22 bp, Homo sapiens
agaaatgaagcaggagttatta

SEQ ID NO: 7282986 - DNA, 22 bp, Homo sapiens
agaaatgaatatgtagtggtta

SEQ ID NO: 7282987 - DNA, 22 bp, Homo sapiens
agaaatgacaagactgatcagg

SEQ ID NO: 7282988 - DNA, 22 bp, Homo sapiens
actgggcttatgctgtggagta

SEQ ID NO: 7282989 - DNA, 23 bp, Homo sapiens
actgggcttatgaggaggcttgt

SEQ ID NO: 7282990 - DNA, 22 bp, Homo sapiens
actgggctgtaaagagaggcaa

SEQ ID NO: 7282991 - DNA, 22 bp, Homo sapiens
aatactctagggcagtgcttct

SEQ ID NO: 7282992 - DNA, 22 bp, Homo sapiens
aatactgaaagtattttcaaat

SEQ ID NO: 7282993 - DNA, 22 bp, Homo sapiens
aatatagatttactcaagagaa

SEQ ID NO: 7282994 - DNA, 22 bp, Homo sapiens
actttcttaggctgtataaatg

SEQ ID NO: 7282995 - DNA, 22 bp, Homo sapiens
actttcttatccatgatctcac

SEQ ID NO: 7282996 - DNA, 22 bp, Homo sapiens
actttgaaatgtgtaagagaga

SEQ ID NO: 7282997 - DNA, 22 bp, Homo sapiens
actttaaaactgatcatcagag

SEQ ID NO: 7282998 - DNA, 22 bp, Homo sapiens
aaggctgggaaacatgcaggcc

SEQ ID NO: 7282999 - DNA, 22 bp, Homo sapiens
aaggctggcaatatatttgtta

SEQ ID NO: 7283000 - DNA, 22 bp, Homo sapiens
aaggctggacctggatgaatct

SEQ ID NO: 7283001 - DNA, 22 bp, Homo sapiens
aaggctggagatggttggaatg

SEQ ID NO: 7283002 - DNA, 21 bp, Homo sapiens
aaggctggagatgcaggtctg

SEQ ID NO: 7283003 - DNA, 19 bp, Homo sapiens
aaggctggagaaggcctct

SEQ ID NO: 7283004 - DNA, 20 bp, Homo sapiens
aaggcagagtgggttggagc

SEQ ID NO: 7283005 - DNA, 22 bp, Homo sapiens
aaggcagataagaattcagcaa

SEQ ID NO: 7283006 - DNA, 22 bp, Homo sapiens
accctgccgtgggctgcttgtg

SEQ ID NO: 7283007 - DNA, 22 bp, Homo sapiens
accctgccctctccagctcagg

SEQ ID NO: 7283008 - DNA, 22 bp, Homo sapiens
accctgcctctgcttcctgtag

SEQ ID NO: 7283009 - DNA, 20 bp, Homo sapiens
accctgccaggcatgtgaat

SEQ ID NO: 7283010 - DNA, 22 bp, Homo sapiens
accctgccaaggatggccccga

SEQ ID NO: 7283011 - DNA, 22 bp, Homo sapiens
accccttctcctggctgttcca

SEQ ID NO: 7283012 - DNA, 22 bp, Homo sapiens
acattttaatatgcttagtgtg

SEQ ID NO: 7283013 - DNA, 22 bp, Homo sapiens
acattttacagttgtctggcta

SEQ ID NO: 7283014 - DNA, 22 bp, Homo sapiens
acattttacaccaagacttctt

SEQ ID NO: 7283015 - DNA, 22 bp, Homo sapiens
aagggcttaggattttgctgtg

SEQ ID NO: 7283016 - DNA, 19 bp, Homo sapiens
acagggcagcaataggata

SEQ ID NO: 7283017 - DNA, 22 bp, Homo sapiens
acagggcagagggcagttggta

SEQ ID NO: 7283018 - DNA, 22 bp, Homo sapiens
acagggcagagaggcaggcttg

SEQ ID NO: 7283019 - DNA, 22 bp, Homo sapiens
acagggcagaaatgttgcatct

SEQ ID NO: 7283020 - DNA, 22 bp, Homo sapiens
acagcctggcctgagttaaggc

SEQ ID NO: 7283021 - DNA, 22 bp, Homo sapiens
aagcgccatggttcctgcgcag

SEQ ID NO: 7283022 - DNA, 22 bp, Homo sapiens
aagcgcagacacagagagtgga

SEQ ID NO: 7283023 - DNA, 22 bp, Homo sapiens
aagccaagtgctggccatgggc

SEQ ID NO: 7283024 - DNA, 22 bp, Homo sapiens
aagccaaggttttggtcacagc

SEQ ID NO: 7283025 - DNA, 22 bp, Homo sapiens
aaggcagagattagcagaatga

SEQ ID NO: 7283026 - DNA, 22 bp, Homo sapiens
aaggcagaggaaggtctagttt

SEQ ID NO: 7283027 - DNA, 22 bp, Homo sapiens
aaggcagagggctggatcagag

SEQ ID NO: 7283028 - DNA, 22 bp, Homo sapiens
aaggcagagtctatcttggaag

SEQ ID NO: 7283029 - DNA, 22 bp, Homo sapiens
acagtctttaatttctttgtgg

SEQ ID NO: 7283030 - DNA, 22 bp, Homo sapiens
aattaaaaaaggagagcttgct

SEQ ID NO: 7283031 - DNA, 22 bp, Homo sapiens
agagacaggaatggcattaaga

SEQ ID NO: 7283032 - DNA, 22 bp, Homo sapiens
aattaaaagataacccatgagt

SEQ ID NO: 7283033 - DNA, 22 bp, Homo sapiens
aatgggctttcttggacaggag

SEQ ID NO: 7283034 - DNA, 22 bp, Homo sapiens
aatgtggatccttacagatacc

SEQ ID NO: 7283035 - DNA, 22 bp, Homo sapiens
aatgtgcagatgaataaacaaa

SEQ ID NO: 7283036 - DNA, 22 bp, Homo sapiens
acaaagtaggtcatcaaagctc

SEQ ID NO: 7283037 - DNA, 22 bp, Homo sapiens
agaggctgttacactcccagat

SEQ ID NO: 7283038 - DNA, 22 bp, Homo sapiens
agaggctgttacactcccagat

SEQ ID NO: 7283039 - DNA, 22 bp, Homo sapiens
agaggctgtgcccaccaggcaa

SEQ ID NO: 7283040 - DNA, 22 bp, Homo sapiens
agaggctgtgcccaccaggcaa

SEQ ID NO: 7283041 - DNA, 22 bp, Homo sapiens
acaatgaaaggtattctgaact

SEQ ID NO: 7283042 - DNA, 22 bp, Homo sapiens
acaagattttgtctggtagggt

SEQ ID NO: 7283043 - DNA, 22 bp, Homo sapiens
acaagattttatgactcttttt

SEQ ID NO: 7283044 - DNA, 22 bp, Homo sapiens
acaagatttggctgaaactcca

SEQ ID NO: 7283045 - DNA, 22 bp, Homo sapiens
acaagatttagcttaaagggct

SEQ ID NO: 7283046 - DNA, 22 bp, Homo sapiens
acaagatttaatgcaacccaag

SEQ ID NO: 7283047 - DNA, 22 bp, Homo sapiens
acaagattgataagtctgccct

SEQ ID NO: 7283048 - DNA, 22 bp, Homo sapiens
acaagattcaatgaattgattg

SEQ ID NO: 7283049 - DNA, 22 bp, Homo sapiens
acaagactgtgctctaagagtg

SEQ ID NO: 7283050 - DNA, 22 bp, Homo sapiens
acaactagcaggtattaatttt

SEQ ID NO: 7283051 - DNA, 17 bp, Homo sapiens
acacagggagagggagc

SEQ ID NO: 7283052 - DNA, 22 bp, Homo sapiens
acacagggatatttcaggtggt

SEQ ID NO: 7283053 - DNA, 19 bp, Homo sapiens
acacagggatcagagggtt

SEQ ID NO: 7283054 - DNA, 22 bp, Homo sapiens
acacagggcggaaagcatgaga

SEQ ID NO: 7283055 - DNA, 22 bp, Homo sapiens
acacagggcagagagctggctc

SEQ ID NO: 7283056 - DNA, 22 bp, Homo sapiens
acactgacgcttgacagtcacc

SEQ ID NO: 7283057 - DNA, 22 bp, Homo sapiens
acactagtggaaattgatttgt

SEQ ID NO: 7283058 - DNA, 22 bp, Homo sapiens
acacagagggcagaagatacat

SEQ ID NO: 7283059 - DNA, 22 bp, Homo sapiens
acacagaggctccagagataga

SEQ ID NO: 7283060 - DNA, 19 bp, Homo sapiens
agcagagcaaagtggctga

SEQ ID NO: 7283061 - DNA, 22 bp, Homo sapiens
agcagatgtgtctctgcactgt

SEQ ID NO: 7283062 - DNA, 22 bp, Homo sapiens
agcagatgttccctggtccctt

SEQ ID NO: 7283063 - DNA, 22 bp, Homo sapiens
agcagagcccttccatggcctt

SEQ ID NO: 7283064 - DNA, 22 bp, Homo sapiens
acagagactaagcttttcatca

SEQ ID NO: 7283065 - DNA, 22 bp, Homo sapiens
acactttgtcctttttcattgt

SEQ ID NO: 7283066 - DNA, 22 bp, Homo sapiens
acactttgttgtggcatatacg

SEQ ID NO: 7283067 - DNA, 22 bp, Homo sapiens
acactttgctacatttcatatt

SEQ ID NO: 7283068 - DNA, 22 bp, Homo sapiens
acagaaagaccttgtaacactt

SEQ ID NO: 7283069 - DNA, 22 bp, Homo sapiens
agcctctctttattcccagcta

SEQ ID NO: 7283070 - DNA, 22 bp, Homo sapiens
agcctctcactgtcaccctccc

SEQ ID NO: 7283071 - DNA, 22 bp, Homo sapiens
agcctctccagagcctggcaga

SEQ ID NO: 7283072 - DNA, 22 bp, Homo sapiens
agcctctcatgttctcccccag

SEQ ID NO: 7283073 - DNA, 22 bp, Homo sapiens
agcctctcttatcccttcaaag

SEQ ID NO: 7283074 - DNA, 22 bp, Homo sapiens
agcctctctgttagtcactggg

SEQ ID NO: 7283075 - DNA, 22 bp, Homo sapiens
acagtgcacatcctgagtgatt

SEQ ID NO: 7283076 - DNA, 22 bp, Homo sapiens
acagtgcaaataggactgtctt

SEQ ID NO: 7283077 - DNA, 22 bp, Homo sapiens
acagtgcaaacttttgtctcct

SEQ ID NO: 7283078 - DNA, 22 bp, Homo sapiens
acagtgcaaaccctcgggaaag

SEQ ID NO: 7283079 - DNA, 22 bp, Homo sapiens
aggcaggcaaccacctgggaag

SEQ ID NO: 7283080 - DNA, 19 bp, Homo sapiens
aggcagcacccagtccttg

SEQ ID NO: 7283081 - DNA, 22 bp, Homo sapiens
aggcagcatgggcccagagtcc

SEQ ID NO: 7283082 - DNA, 22 bp, Homo sapiens
aggcagcatgctctgcttctac

SEQ ID NO: 7283083 - DNA, 22 bp, Homo sapiens
aggagtctgttgaaatgtctat

SEQ ID NO: 7283084 - DNA, 22 bp, Homo sapiens
acaggtggcttattggctgatt

SEQ ID NO: 7283085 - DNA, 22 bp, Homo sapiens
acagggcacctgaggtaggaag

SEQ ID NO: 7283086 - DNA, 22 bp, Homo sapiens
acagggcaacctctgggagact

SEQ ID NO: 7283087 - DNA, 22 bp, Homo sapiens
acaggctctggggcaggatggc

SEQ ID NO: 7283088 - DNA, 14 bp, Homo sapiens
aggaatgtcctagg

SEQ ID NO: 7283089 - DNA, 22 bp, Homo sapiens
aggaatgtcatagaataatcat

SEQ ID NO: 7283090 - DNA, 22 bp, Homo sapiens
aggaatgtcaagtagatgtgcg

SEQ ID NO: 7283091 - DNA, 22 bp, Homo sapiens
aggaatgtattgacctgttgca

SEQ ID NO: 7283092 - DNA, 22 bp, Homo sapiens
aggaatgtattattccttctgg

SEQ ID NO: 7283093 - DNA, 22 bp, Homo sapiens
aggaatgtagtttgagtagaaa

SEQ ID NO: 7283094 - DNA, 22 bp, Homo sapiens
aggaatgtaatagtgtggctca

SEQ ID NO: 7283095 - DNA, 22 bp, Homo sapiens
aggaatgtaacaggagtaaaaa

SEQ ID NO: 7283096 - DNA, 22 bp, Homo sapiens
aggaatgtaaatctagatttta

SEQ ID NO: 7283097 - DNA, 22 bp, Homo sapiens
accccttttatagaagaacaga

SEQ ID NO: 7283098 - DNA, 22 bp, Homo sapiens
agggcctggttctgtgtaggga

SEQ ID NO: 7283099 - DNA, 22 bp, Homo sapiens
agggcctggggtagcttactgc

SEQ ID NO: 7283100 - DNA, 22 bp, Homo sapiens
agggcctggtgacctgggtcct

SEQ ID NO: 7283101 - DNA, 22 bp, Homo sapiens
agggcctgggccagcacccttt

SEQ ID NO: 7283102 - DNA, 22 bp, Homo sapiens
agggcctgggatgtcctcctag

SEQ ID NO: 7283103 - DNA, 23 bp, Homo sapiens
aggctttatggtagaaagtttgc

SEQ ID NO: 7283104 - DNA, 22 bp, Homo sapiens
aggctggcatacatttgttctt

SEQ ID NO: 7283105 - DNA, 22 bp, Homo sapiens
aggctggcagccacctcagcag

SEQ ID NO: 7283106 - DNA, 22 bp, Homo sapiens
aggctggcaaggcagatgtgtg

SEQ ID NO: 7283107 - DNA, 22 bp, Homo sapiens
aggctggcaaggcagatgtgtg

SEQ ID NO: 7283108 - DNA, 20 bp, Homo sapiens
aggctggcactcctggccag

SEQ ID NO: 7283109 - DNA, 22 bp, Homo sapiens
acatgatcccacctgcctataa

SEQ ID NO: 7283110 - DNA, 22 bp, Homo sapiens
acatgatctgacttgcttttta

SEQ ID NO: 7283111 - DNA, 22 bp, Homo sapiens
aggcaggcagctgtcaccactc

SEQ ID NO: 7283112 - DNA, 22 bp, Homo sapiens
aggcagggaccagttgttttct

SEQ ID NO: 7283113 - DNA, 23 bp, Homo sapiens
aggcaggcagttcagctgttgtt

SEQ ID NO: 7283114 - DNA, 22 bp, Homo sapiens
aggcagggctgggattagactc

SEQ ID NO: 7283115 - DNA, 22 bp, Homo sapiens
aggcagggctcatttcttaggc

SEQ ID NO: 7283116 - DNA, 22 bp, Homo sapiens
acatggaagcaaagttctattt

SEQ ID NO: 7283117 - DNA, 22 bp, Homo sapiens
aggctaggaatcaagcctttct

SEQ ID NO: 7283118 - DNA, 22 bp, Homo sapiens
aggctaggcatgtgctaccaca

SEQ ID NO: 7283119 - DNA, 22 bp, Homo sapiens
aggctagggccatggctggtga

SEQ ID NO: 7283120 - DNA, 22 bp, Homo sapiens
aggctaggctgatgcctcttcc

SEQ ID NO: 7283121 - DNA, 22 bp, Homo sapiens
aggcgcacagggtgttgatgtg

SEQ ID NO: 7283122 - DNA, 22 bp, Homo sapiens
aggctagctgattgccttagaa

SEQ ID NO: 7283123 - DNA, 22 bp, Homo sapiens
aggcctgtttcttgtccagctc

SEQ ID NO: 7283124 - DNA, 22 bp, Homo sapiens
aggcctgttccaggcccctttt

SEQ ID NO: 7283125 - DNA, 22 bp, Homo sapiens
aggcctgcctggatcacacaga

SEQ ID NO: 7283126 - DNA, 22 bp, Homo sapiens
aggcctgttccttcctgggcac

SEQ ID NO: 7283127 - DNA, 22 bp, Homo sapiens
aggcctgttggcgtgggctcta

SEQ ID NO: 7283128 - DNA, 22 bp, Homo sapiens
atatgaaaagaagtcaccattg

SEQ ID NO: 7283129 - DNA, 22 bp, Homo sapiens
agaaaatttaaagagacacaca

SEQ ID NO: 7283130 - DNA, 22 bp, Homo sapiens
agaaacaacttgtttctcttgc

SEQ ID NO: 7283131 - DNA, 22 bp, Homo sapiens
actttggtgaatcagttttgtt

SEQ ID NO: 7283132 - DNA, 22 bp, Homo sapiens
acttcagtgtggtataaaacgt

SEQ ID NO: 7283133 - DNA, 22 bp, Homo sapiens
acttgcctaaggtcatgcaact

SEQ ID NO: 7283134 - DNA, 20 bp, Homo sapiens
acttgcctctatgctacgtt

SEQ ID NO: 7283135 - DNA, 22 bp, Homo sapiens
acttgcctgttacatttctagt

SEQ ID NO: 7283136 - DNA, 22 bp, Homo sapiens
acttgcctccatattttattgc

SEQ ID NO: 7283137 - DNA, 22 bp, Homo sapiens
agtttacatatttgtcggagtc

SEQ ID NO: 7283138 - DNA, 22 bp, Homo sapiens
agtttacataaaaaggcagagg

SEQ ID NO: 7283139 - DNA, 22 bp, Homo sapiens
actgtaaaactgctttggaaac

SEQ ID NO: 7283140 - DNA, 22 bp, Homo sapiens
agtttacagatgctacaggagc

SEQ ID NO: 7283141 - DNA, 22 bp, Homo sapiens
actatttactcaaatgaggttg

SEQ ID NO: 7283142 - DNA, 19 bp, Homo sapiens
actaaaaatgatgtttgag

SEQ ID NO: 7283143 - DNA, 19 bp, Homo sapiens
actaaaaatgatgtttgag

SEQ ID NO: 7283144 - DNA, 22 bp, Homo sapiens
actaaaaactactgccaatagc

SEQ ID NO: 7283145 - DNA, 19 bp, Homo sapiens
accttcagagtggcacaaa

SEQ ID NO: 7283146 - DNA, 21 bp, Homo sapiens
accttcagtgttctcagctgc

SEQ ID NO: 7283147 - DNA, 22 bp, Homo sapiens
acctgccttctcaaggacatga

SEQ ID NO: 7283148 - DNA, 22 bp, Homo sapiens
acctgtgcacagtcagccctgg

SEQ ID NO: 7283149 - DNA, 22 bp, Homo sapiens
acctgtgcaaagactggtcagg

SEQ ID NO: 7283150 - DNA, 22 bp, Homo sapiens
actgaagtagtcattgtcatta

SEQ ID NO: 7283151 - DNA, 22 bp, Homo sapiens
actgcaacctccgcctgccagg

SEQ ID NO: 7283152 - DNA, 22 bp, Homo sapiens
actgcaaagccagatattatca

SEQ ID NO: 7283153 - DNA, 22 bp, Homo sapiens
actgctggggctcattcatctc

SEQ ID NO: 7283154 - DNA, 22 bp, Homo sapiens
actgctggaaacccagaatggt

SEQ ID NO: 7283155 - DNA, 22 bp, Homo sapiens
actgctggcatgcatatacaaa

SEQ ID NO: 7283156 - DNA, 22 bp, Homo sapiens
agtctctcttgggtgtggtttg

SEQ ID NO: 7283157 - DNA, 22 bp, Homo sapiens
agtctggctttttgatgagctt

SEQ ID NO: 7283158 - DNA, 22 bp, Homo sapiens
agtctcttattccctattgctg

SEQ ID NO: 7283159 - DNA, 22 bp, Homo sapiens
agcacaaaaacattcccagagt

SEQ ID NO: 7283160 - DNA, 22 bp, Homo sapiens
agcagcagggtgtaattgggca

SEQ ID NO: 7283161 - DNA, 22 bp, Homo sapiens
agcagcaggtgacctcgatgcc

SEQ ID NO: 7283162 - DNA, 22 bp, Homo sapiens
caaggcaggtctgaggaggttg

SEQ ID NO: 7283163 - DNA, 22 bp, Homo sapiens
caaggcaggccagtttcaaggc

SEQ ID NO: 7283164 - DNA, 22 bp, Homo sapiens
caaggcagttccccagagggct

SEQ ID NO: 7283165 - DNA, 22 bp, Homo sapiens
caaggcagtccctactccctgc

SEQ ID NO: 7283166 - DNA, 22 bp, Homo sapiens
caaggcagtgggctaggaacct

SEQ ID NO: 7283167 - DNA, 22 bp, Homo sapiens
caaggcaggcagttcacttgag

SEQ ID NO: 7283168 - DNA, 16 bp, Homo sapiens
agcagggcgggaagga

SEQ ID NO: 7283169 - DNA, 22 bp, Homo sapiens
agcagggctccatttcactgcc

SEQ ID NO: 7283170 - DNA, 22 bp, Homo sapiens
agcagggctctgccatgggccc

SEQ ID NO: 7283171 - DNA, 22 bp, Homo sapiens
agcagggctcctgaaagccgcg

SEQ ID NO: 7283172 - DNA, 22 bp, Homo sapiens
agcagggcagtgcttcagctct

SEQ ID NO: 7283173 - DNA, 21 bp, Homo sapiens
agcaggtgctgttggaggaaa

SEQ ID NO: 7283174 - DNA, 22 bp, Homo sapiens
agcataagttggtacagccact

SEQ ID NO: 7283175 - DNA, 22 bp, Homo sapiens
cacaggaggaggtgcccgggcc

SEQ ID NO: 7283176 - DNA, 22 bp, Homo sapiens
cacagggctaaatgaagggttg

SEQ ID NO: 7283177 - DNA, 22 bp, Homo sapiens
cacagggcttctcatggggtgc

SEQ ID NO: 7283178 - DNA, 22 bp, Homo sapiens
cacaggaggaggccagagcgta

SEQ ID NO: 7283179 - DNA, 22 bp, Homo sapiens
cagccctgggagttggggccga

SEQ ID NO: 7283180 - DNA, 22 bp, Homo sapiens
cagcaggagcagtcagactcct

SEQ ID NO: 7283181 - DNA, 22 bp, Homo sapiens
agctaggataagcagagactgg

SEQ ID NO: 7283182 - DNA, 18 bp, Homo sapiens
agcctgtcccttctcctg

SEQ ID NO: 7283183 - DNA, 19 bp, Homo sapiens
agcccccagacagcaggcc

SEQ ID NO: 7283184 - DNA, 22 bp, Homo sapiens
cagagagggcggccctggcttc

SEQ ID NO: 7283185 - DNA, 22 bp, Homo sapiens
cagacagacctgcaagggcaca

SEQ ID NO: 7283186 - DNA, 17 bp, Homo sapiens
cagaaggaagcatggca

SEQ ID NO: 7283187 - DNA, 22 bp, Homo sapiens
cagaagcctaaatagtgcacca

SEQ ID NO: 7283188 - DNA, 22 bp, Homo sapiens
cactgaaaattagctttcctga

SEQ ID NO: 7283189 - DNA, 22 bp, Homo sapiens
cactgaaatattaatatcttat

SEQ ID NO: 7283190 - DNA, 22 bp, Homo sapiens
atgttaaataatcccttaaagc

SEQ ID NO: 7283191 - DNA, 22 bp, Homo sapiens
atgttaaagatggtgggaaatt

SEQ ID NO: 7283192 - DNA, 22 bp, Homo sapiens
atgttacaaatcctacaggtag

SEQ ID NO: 7283193 - DNA, 22 bp, Homo sapiens
atgttacaatccaacaaaatta

SEQ ID NO: 7283194 - DNA, 22 bp, Homo sapiens
atgttacaaccctgaggagccg

SEQ ID NO: 7283195 - DNA, 20 bp, Homo sapiens
atgttaaatagcatttagag

SEQ ID NO: 7283196 - DNA, 22 bp, Homo sapiens
atgttaaatagccatttgtttg

SEQ ID NO: 7283197 - DNA, 22 bp, Homo sapiens
atgttaaatggtttattattaa

SEQ ID NO: 7283198 - DNA, 22 bp, Homo sapiens
attatacattttgtgtagagat

SEQ ID NO: 7283199 - DNA, 22 bp, Homo sapiens
agagggtgggcacgtgatggat

SEQ ID NO: 7283200 - DNA, 22 bp, Homo sapiens
attctggggctggttattttga

SEQ ID NO: 7283201 - DNA, 22 bp, Homo sapiens
agcaaaataaggtaatttattg

SEQ ID NO: 7283202 - DNA, 22 bp, Homo sapiens
agatttccatctttttcatgtg

SEQ ID NO: 7283203 - DNA, 20 bp, Homo sapiens
agcaaaatgcaagattttca

SEQ ID NO: 7283204 - DNA, 22 bp, Homo sapiens
agatgaagcctgtacttagtct

SEQ ID NO: 7283205 - DNA, 22 bp, Homo sapiens
atttaacaagacagagaactgg

SEQ ID NO: 7283206 - DNA, 22 bp, Homo sapiens
attcttcatgttgaagctgtca

SEQ ID NO: 7283207 - DNA, 23 bp, Homo sapiens
attcttcattatcttctagaaaa

SEQ ID NO: 7283208 - DNA, 22 bp, Homo sapiens
atttaggaatgttctgcacaaa

SEQ ID NO: 7283209 - DNA, 22 bp, Homo sapiens
agagtggggacagggcctgtcc

SEQ ID NO: 7283210 - DNA, 22 bp, Homo sapiens
atttagcaagagtacaaaataa

SEQ ID NO: 7283211 - DNA, 22 bp, Homo sapiens
agagtgggcaggagcctcgact

SEQ ID NO: 7283212 - DNA, 22 bp, Homo sapiens
agagtgggacacgggcgctgtc

SEQ ID NO: 7283213 - DNA, 22 bp, Homo sapiens
agagtggggaaggtgttgagaa

SEQ ID NO: 7283214 - DNA, 22 bp, Homo sapiens
agacaatatgtatattaagaat

SEQ ID NO: 7283215 - DNA, 22 bp, Homo sapiens
agacacagaacacaaaagcata

SEQ ID NO: 7283216 - DNA, 22 bp, Homo sapiens
atctttacagtgtaagtgcaga

SEQ ID NO: 7283217 - DNA, 22 bp, Homo sapiens
agaagaatacttgatgttcatg

SEQ ID NO: 7283218 - DNA, 22 bp, Homo sapiens
agaatacagtatgcaaaaagat

SEQ ID NO: 7283219 - DNA, 22 bp, Homo sapiens
agaatacagtatgcaaaaagat

SEQ ID NO: 7283220 - DNA, 22 bp, Homo sapiens
agaatagagaaaaaggttattt

SEQ ID NO: 7283221 - DNA, 19 bp, Homo sapiens
atctttgggtcctgaaggg

SEQ ID NO: 7283222 - DNA, 21 bp, Homo sapiens
atggctggtggctcagcctcc

SEQ ID NO: 7283223 - DNA, 22 bp, Homo sapiens
atggaaagtgcatggaagtcat

SEQ ID NO: 7283224 - DNA, 22 bp, Homo sapiens
atggaaagggaagcaaggaaca

SEQ ID NO: 7283225 - DNA, 22 bp, Homo sapiens
atggaaaggctgtggaaactta

SEQ ID NO: 7283226 - DNA, 22 bp, Homo sapiens
atggaaagctaagccatttacc

SEQ ID NO: 7283227 - DNA, 22 bp, Homo sapiens
agactacaggagaaactcactc

SEQ ID NO: 7283228 - DNA, 22 bp, Homo sapiens
caggaggttgtaagagcaggcc

SEQ ID NO: 7283229 - DNA, 22 bp, Homo sapiens
agctggccagcacctccaggtc

SEQ ID NO: 7283230 - DNA, 22 bp, Homo sapiens
agctggcattctccttgttatt

SEQ ID NO: 7283231 - DNA, 22 bp, Homo sapiens
agctggcttcacaggcagtgtg

SEQ ID NO: 7283232 - DNA, 22 bp, Homo sapiens
agctggctttgagctgggaggt

SEQ ID NO: 7283233 - DNA, 22 bp, Homo sapiens
caggaaaaatgccaggagtcag

SEQ ID NO: 7283234 - DNA, 22 bp, Homo sapiens
agctggcagtcggccttgatgc

SEQ ID NO: 7283235 - DNA, 22 bp, Homo sapiens
caggacagacagaatgcctaac

SEQ ID NO: 7283236 - DNA, 22 bp, Homo sapiens
agctgaggccacgagtgaaggg

SEQ ID NO: 7283237 - DNA, 22 bp, Homo sapiens
agctgaggcatggacaggctgc

SEQ ID NO: 7283238 - DNA, 23 bp, Homo sapiens
agctgaggctgtgggtgtcagag

SEQ ID NO: 7283239 - DNA, 21 bp, Homo sapiens
agctgcaggcctcccagggat

SEQ ID NO: 7283240 - DNA, 22 bp, Homo sapiens
caggcctggttgagccctgaga

SEQ ID NO: 7283241 - DNA, 22 bp, Homo sapiens
agctgggaagactggaagacag

SEQ ID NO: 7283242 - DNA, 22 bp, Homo sapiens
agctggcttttgtgaaggtttt

SEQ ID NO: 7283243 - DNA, 23 bp, Homo sapiens
agctgggaattttctgaagcttt

SEQ ID NO: 7283244 - DNA, 22 bp, Homo sapiens
cagggccagagagggctggctg

SEQ ID NO: 7283245 - DNA, 18 bp, Homo sapiens
aggaaagacgaagagggc

SEQ ID NO: 7283246 - DNA, 22 bp, Homo sapiens
aggaaagactggggccccagaa

SEQ ID NO: 7283247 - DNA, 22 bp, Homo sapiens
aggaagctccatgaaggcagag

SEQ ID NO: 7283248 - DNA, 22 bp, Homo sapiens
aggaacccggtctgtcactgtg

SEQ ID NO: 7283249 - DNA, 22 bp, Homo sapiens
aggaaccctgcgccatactttg

SEQ ID NO: 7283250 - DNA, 22 bp, Homo sapiens
aggaacctaagagcctgcagtc

SEQ ID NO: 7283251 - DNA, 22 bp, Homo sapiens
aggaacacttgtggaaacattc

SEQ ID NO: 7283252 - DNA, 22 bp, Homo sapiens
aggaacacttaattcgatacta

SEQ ID NO: 7283253 - DNA, 22 bp, Homo sapiens
aggaacacccccttcctaccag

SEQ ID NO: 7283254 - DNA, 22 bp, Homo sapiens
aggaacacaagctatgatccac

SEQ ID NO: 7283255 - DNA, 22 bp, Homo sapiens
aggaaatgcaggcaaatactct

SEQ ID NO: 7283256 - DNA, 22 bp, Homo sapiens
aggagaagccaagttgtgagca

SEQ ID NO: 7283257 - DNA, 21 bp, Homo sapiens
aggaggagagcttggcctacc

SEQ ID NO: 7283258 - DNA, 22 bp, Homo sapiens
aggaggagcagctttttgtctc

SEQ ID NO: 7283259 - DNA, 17 bp, Homo sapiens
aggaggatcagagagta

SEQ ID NO: 7283260 - DNA, 22 bp, Homo sapiens
aggaggaggtgggacacagtga

SEQ ID NO: 7283261 - DNA, 22 bp, Homo sapiens
aggaggaggtaagaaaagcata

SEQ ID NO: 7283262 - DNA, 22 bp, Homo sapiens
aggagagaatgttccaggcttg

SEQ ID NO: 7283263 - DNA, 22 bp, Homo sapiens
aggagcctggctggcccacagg

SEQ ID NO: 7283264 - DNA, 18 bp, Homo sapiens
aggagcctttgcactgga

SEQ ID NO: 7283265 - DNA, 19 bp, Homo sapiens
aggagccttgagcagtgag

SEQ ID NO: 7283266 - DNA, 21 bp, Homo sapiens
catttacatgacagattggtt

SEQ ID NO: 7283267 - DNA, 22 bp, Homo sapiens
aggcagcagaggttgaggaaag

SEQ ID NO: 7283268 - DNA, 18 bp, Homo sapiens
aggcagcagcatcttctc

SEQ ID NO: 7283269 - DNA, 22 bp, Homo sapiens
aggcagcagccacaaggcctga

SEQ ID NO: 7283270 - DNA, 19 bp, Homo sapiens
aggcagcattctggggctt

SEQ ID NO: 7283271 - DNA, 22 bp, Homo sapiens
aggcagcatttgaatccaggtc

SEQ ID NO: 7283272 - DNA, 22 bp, Homo sapiens
aggcagccagttcaggtttctt

SEQ ID NO: 7283273 - DNA, 22 bp, Homo sapiens
aggcagcagaaaacaaatggtt

SEQ ID NO: 7283274 - DNA, 22 bp, Homo sapiens
cattcccttggggagttcatgc

SEQ ID NO: 7283275 - DNA, 22 bp, Homo sapiens
cattccctgtctcttcaatcct

SEQ ID NO: 7283276 - DNA, 22 bp, Homo sapiens
cattatgttcagtagcttaaaa

SEQ ID NO: 7283277 - DNA, 22 bp, Homo sapiens
cattatgttcagaggtccataa

SEQ ID NO: 7283278 - DNA, 22 bp, Homo sapiens
catgcctgtatttctgatctat

SEQ ID NO: 7283279 - DNA, 22 bp, Homo sapiens
aggaggtgttgatagaaggttt

SEQ ID NO: 7283280 - DNA, 22 bp, Homo sapiens
aggaggtggctgaacttgaggg

SEQ ID NO: 7283281 - DNA, 22 bp, Homo sapiens
aggaggtggcctgagcgtgccc

SEQ ID NO: 7283282 - DNA, 22 bp, Homo sapiens
aggaggtggcctgagcgtgccc

SEQ ID NO: 7283283 - DNA, 22 bp, Homo sapiens
aggaggtggctgaacttgaggg

SEQ ID NO: 7283284 - DNA, 22 bp, Homo sapiens
aggaggtgttgatagaaggttt

SEQ ID NO: 7283285 - DNA, 22 bp, Homo sapiens
aggaggtgtagatttcctgtca

SEQ ID NO: 7283286 - DNA, 22 bp, Homo sapiens
aggaggtgctagagaagatgtt

SEQ ID NO: 7283287 - DNA, 22 bp, Homo sapiens
aggaggtgctgtttgtcctgga

SEQ ID NO: 7283288 - DNA, 22 bp, Homo sapiens
aggaggtggcaactgtcgacag

SEQ ID NO: 7283289 - DNA, 22 bp, Homo sapiens
aggcatggcatggggcagatgt

SEQ ID NO: 7283290 - DNA, 22 bp, Homo sapiens
aggcatgactttggctgaagaa

SEQ ID NO: 7283291 - DNA, 21 bp, Homo sapiens
aggcatgagccctgcatggac

SEQ ID NO: 7283292 - DNA, 22 bp, Homo sapiens
aggcatgatgtgcagtggcaaa

SEQ ID NO: 7283293 - DNA, 23 bp, Homo sapiens
aggcagtgggggccactttgctt

SEQ ID NO: 7283294 - DNA, 22 bp, Homo sapiens
aggcagtccccaggggtgttgc

SEQ ID NO: 7283295 - DNA, 22 bp, Homo sapiens
aggcagtctatctctggagcct

SEQ ID NO: 7283296 - DNA, 22 bp, Homo sapiens
aggcagtcagccctgctagggt

SEQ ID NO: 7283297 - DNA, 23 bp, Homo sapiens
aggcaggtttgggctcttcttgt

SEQ ID NO: 7283298 - DNA, 22 bp, Homo sapiens
aggcagcccacaggacacagga

SEQ ID NO: 7283299 - DNA, 22 bp, Homo sapiens
aggcagccatctgcaggaagga

SEQ ID NO: 7283300 - DNA, 22 bp, Homo sapiens
aggcagtggctgagaccagggg

SEQ ID NO: 7283301 - DNA, 22 bp, Homo sapiens
aggcagtggatgtcaggaatgg

SEQ ID NO: 7283302 - DNA, 22 bp, Homo sapiens
aggccaagtagctagcattgaa

SEQ ID NO: 7283303 - DNA, 20 bp, Homo sapiens
aggccaggaaatgtagttct

SEQ ID NO: 7283304 - DNA, 22 bp, Homo sapiens
aggccaggaatccttgtcccag

SEQ ID NO: 7283305 - DNA, 22 bp, Homo sapiens
aggccaggaccattagcccaga

SEQ ID NO: 7283306 - DNA, 22 bp, Homo sapiens
aggctgagcggggtcccagagc

SEQ ID NO: 7283307 - DNA, 22 bp, Homo sapiens
ccaggcagtggaagctaaaatt

SEQ ID NO: 7283308 - DNA, 22 bp, Homo sapiens
ccaggcacttcatcattagggt

SEQ ID NO: 7283309 - DNA, 22 bp, Homo sapiens
ccaggcccttgcaagtcccacc

SEQ ID NO: 7283310 - DNA, 22 bp, Homo sapiens
agggcagctggaaggtggcttc

SEQ ID NO: 7283311 - DNA, 22 bp, Homo sapiens
agggcagctgtgagccactgtg

SEQ ID NO: 7283312 - DNA, 22 bp, Homo sapiens
agggcagcctgagtgctggccc

SEQ ID NO: 7283313 - DNA, 22 bp, Homo sapiens
agggcagctctcacctctggcc

SEQ ID NO: 7283314 - DNA, 22 bp, Homo sapiens
agggccagctgatgagaatgag

SEQ ID NO: 7283315 - DNA, 22 bp, Homo sapiens
ccctgggcagtctgcacttcag

SEQ ID NO: 7283316 - DNA, 22 bp, Homo sapiens
ccctgggctcagagcaggtagc

SEQ ID NO: 7283317 - DNA, 22 bp, Homo sapiens
cctctcggcagcccatcttgtc

SEQ ID NO: 7283318 - DNA, 22 bp, Homo sapiens
cctctctccaattttcacctca

SEQ ID NO: 7283319 - DNA, 22 bp, Homo sapiens
cctccaggataagtcagggcct

SEQ ID NO: 7283320 - DNA, 22 bp, Homo sapiens
cctccaggctggttatcagctg

SEQ ID NO: 7283321 - DNA, 22 bp, Homo sapiens
agggaaggaaaagctgtcgctt

SEQ ID NO: 7283322 - DNA, 22 bp, Homo sapiens
aggcttcaaggacctgagggaa

SEQ ID NO: 7283323 - DNA, 22 bp, Homo sapiens
agggaaggcttttgacatttcc

SEQ ID NO: 7283324 - DNA, 19 bp, Homo sapiens
agggaaggattctgtcatt

SEQ ID NO: 7283325 - DNA, 19 bp, Homo sapiens
agggaatccggctgaggga

SEQ ID NO: 7283326 - DNA, 22 bp, Homo sapiens
agggaagggcagggtctatgca

SEQ ID NO: 7283327 - DNA, 22 bp, Homo sapiens
agggagaggttgaaacctcagt

SEQ ID NO: 7283328 - DNA, 22 bp, Homo sapiens
agggagagtagatatcaggtgt

SEQ ID NO: 7283329 - DNA, 21 bp, Homo sapiens
ccccatggagtacagttgggc

SEQ ID NO: 7283330 - DNA, 22 bp, Homo sapiens
agggagccagagttgggagctc

SEQ ID NO: 7283331 - DNA, 22 bp, Homo sapiens
ccataatcatgtaagtaaattc

SEQ ID NO: 7283332 - DNA, 23 bp, Homo sapiens
ccataatcagggttgtggggtcc

SEQ ID NO: 7283333 - DNA, 22 bp, Homo sapiens
ccataatctggctttgagagag

SEQ ID NO: 7283334 - DNA, 22 bp, Homo sapiens
ccataatcgtgtgttaaataat

SEQ ID NO: 7283335 - DNA, 22 bp, Homo sapiens
ccatctccactgtccctgtcaa

SEQ ID NO: 7283336 - DNA, 21 bp, Homo sapiens
ccataatcttaggatcaaaat

SEQ ID NO: 7283337 - DNA, 22 bp, Homo sapiens
ccatgacattttaattttcact

SEQ ID NO: 7283338 - DNA, 22 bp, Homo sapiens
ccatctgtatctgacaaattct

SEQ ID NO: 7283339 - DNA, 22 bp, Homo sapiens
ccatcttctcttgaacctcctt

SEQ ID NO: 7283340 - DNA, 22 bp, Homo sapiens
ccatcttacttggagagccatt

SEQ ID NO: 7283341 - DNA, 18 bp, Homo sapiens
cccagcctctcctttcta

SEQ ID NO: 7283342 - DNA, 22 bp, Homo sapiens
cccagcagtacccaagcccttg

SEQ ID NO: 7283343 - DNA, 22 bp, Homo sapiens
cccagcagtggttctcaaactt

SEQ ID NO: 7283344 - DNA, 22 bp, Homo sapiens
cccagcctctgtttgctcctct

SEQ ID NO: 7283345 - DNA, 22 bp, Homo sapiens
cccagcctctgggttctgccgg

SEQ ID NO: 7283346 - DNA, 22 bp, Homo sapiens
cccagcctctggattctgccct

SEQ ID NO: 7283347 - DNA, 22 bp, Homo sapiens
atatgggggggcgtgcagagga

SEQ ID NO: 7283348 - DNA, 22 bp, Homo sapiens
ctgggagtactgggggatgtca

SEQ ID NO: 7283349 - DNA, 22 bp, Homo sapiens
ctgggcacagcgttgggctctt

SEQ ID NO: 7283350 - DNA, 22 bp, Homo sapiens
ctgggcacactctgctccagct

SEQ ID NO: 7283351 - DNA, 22 bp, Homo sapiens
ctgggactttaccctgtggccc

SEQ ID NO: 7283352 - DNA, 22 bp, Homo sapiens
ctgggaagccacagggtgtggg

SEQ ID NO: 7283353 - DNA, 22 bp, Homo sapiens
ctgggaaggggaaggtcctctc

SEQ ID NO: 7283354 - DNA, 22 bp, Homo sapiens
ctgggaagtggtgagggcctga

SEQ ID NO: 7283355 - DNA, 22 bp, Homo sapiens
atcacaggtggtaggaaaagaa

SEQ ID NO: 7283356 - DNA, 22 bp, Homo sapiens
ctgtcctcaccttggcaggggg

SEQ ID NO: 7283357 - DNA, 22 bp, Homo sapiens
ctgtggagtgcttggctcagtg

SEQ ID NO: 7283358 - DNA, 22 bp, Homo sapiens
atccaaaatttactgtagcatt

SEQ ID NO: 7283359 - DNA, 22 bp, Homo sapiens
atccaaaaccagtgcattttcc

SEQ ID NO: 7283360 - DNA, 18 bp, Homo sapiens
atccaaaaagatggaagt

SEQ ID NO: 7283361 - DNA, 22 bp, Homo sapiens
atccctctctgcatgactgtgt

SEQ ID NO: 7283362 - DNA, 22 bp, Homo sapiens
atccccttcacaccctctgcat

SEQ ID NO: 7283363 - DNA, 22 bp, Homo sapiens
atacagagacacttgagactgg

SEQ ID NO: 7283364 - DNA, 22 bp, Homo sapiens
ctgcccagaagccagatgggca

SEQ ID NO: 7283365 - DNA, 22 bp, Homo sapiens
ctgcccacttggccaccttcta

SEQ ID NO: 7283366 - DNA, 22 bp, Homo sapiens
ctgcccagaatcactcactcga

SEQ ID NO: 7283367 - DNA, 20 bp, Homo sapiens
ctgctctgctttgcaggtgg

SEQ ID NO: 7283368 - DNA, 22 bp, Homo sapiens
ctgcagctcctctctgtgcccc

SEQ ID NO: 7283369 - DNA, 20 bp, Homo sapiens
ataaaataactgccacaaga

SEQ ID NO: 7283370 - DNA, 22 bp, Homo sapiens
ctgaggctgggcttgccttctt

SEQ ID NO: 7283371 - DNA, 22 bp, Homo sapiens
ctgaggtattgggaagtggact

SEQ ID NO: 7283372 - DNA, 22 bp, Homo sapiens
ctgaggctttgtgtgcatgcct

SEQ ID NO: 7283373 - DNA, 22 bp, Homo sapiens
ctgagggtcaacttgattgtat

SEQ ID NO: 7283374 - DNA, 21 bp, Homo sapiens
ctctttgggatctttggaaag

SEQ ID NO: 7283375 - DNA, 22 bp, Homo sapiens
cctgggacttggtctggggttt

SEQ ID NO: 7283376 - DNA, 22 bp, Homo sapiens
cctgggacctcgcgggaagcgg

SEQ ID NO: 7283377 - DNA, 22 bp, Homo sapiens
cctgggaatcggtgcgttgagg

SEQ ID NO: 7283378 - DNA, 22 bp, Homo sapiens
aggtgcaggagctgtgcaggga

SEQ ID NO: 7283379 - DNA, 22 bp, Homo sapiens
ccttggctgaggagggagctga

SEQ ID NO: 7283380 - DNA, 22 bp, Homo sapiens
ccttggctaggcagcggctgtc

SEQ ID NO: 7283381 - DNA, 22 bp, Homo sapiens
ccttggcaagacagtggagggt

SEQ ID NO: 7283382 - DNA, 22 bp, Homo sapiens
ccttggcaaaccagggcagctg

SEQ ID NO: 7283383 - DNA, 22 bp, Homo sapiens
ccttgccttggtccttcgcagg

SEQ ID NO: 7283384 - DNA, 22 bp, Homo sapiens
aggtgggcaatgaggcctgagt

SEQ ID NO: 7283385 - DNA, 21 bp, Homo sapiens
aggtgggagaccatgtaggtc

SEQ ID NO: 7283386 - DNA, 22 bp, Homo sapiens
aggtgggaacccagcagggccc

SEQ ID NO: 7283387 - DNA, 22 bp, Homo sapiens
aggtggctgagctgtgcccctg

SEQ ID NO: 7283388 - DNA, 22 bp, Homo sapiens
cggccctgctgagcttgtctgg

SEQ ID NO: 7283389 - DNA, 22 bp, Homo sapiens
cgaggaggaaacgcggagaact

SEQ ID NO: 7283390 - DNA, 22 bp, Homo sapiens
aggtgggggctgtgtccttgac

SEQ ID NO: 7283391 - DNA, 22 bp, Homo sapiens
cctgccctatgaccagcttcac

SEQ ID NO: 7283392 - DNA, 19 bp, Homo sapiens
cctctgccagcccgcctct

SEQ ID NO: 7283393 - DNA, 22 bp, Homo sapiens
cctctgcatcccatataattct

SEQ ID NO: 7283394 - DNA, 19 bp, Homo sapiens
cctctgcatggaaacagct

SEQ ID NO: 7283395 - DNA, 22 bp, Homo sapiens
cctctgccacctcccacgaggc

SEQ ID NO: 7283396 - DNA, 22 bp, Homo sapiens
cctctctccttcctttgccaaa

SEQ ID NO: 7283397 - DNA, 22 bp, Homo sapiens
agggtctctggagagctgagga

SEQ ID NO: 7283398 - DNA, 22 bp, Homo sapiens
agggtctctgggagtagggcac

SEQ ID NO: 7283399 - DNA, 22 bp, Homo sapiens
cctgccctgctcactgtcggta

SEQ ID NO: 7283400 - DNA, 20 bp, Homo sapiens
agggtcagagagcgtgagtg

SEQ ID NO: 7283401 - DNA, 22 bp, Homo sapiens
agggtctatctctctgcctttg

SEQ ID NO: 7283402 - DNA, 20 bp, Homo sapiens
cctgctgagccagtgtgagg

SEQ ID NO: 7283403 - DNA, 22 bp, Homo sapiens
cctgctctgccaagtcctcttt

SEQ ID NO: 7283404 - DNA, 22 bp, Homo sapiens
cctgctctgccaagtcctcttt

SEQ ID NO: 7283405 - DNA, 22 bp, Homo sapiens
cctggcagcgccgaagctggcc

SEQ ID NO: 7283406 - DNA, 22 bp, Homo sapiens
cctggcagcccagagcgccgct

SEQ ID NO: 7283407 - DNA, 22 bp, Homo sapiens
cctggcagcgccgaagctggcc

SEQ ID NO: 7283408 - DNA, 22 bp, Homo sapiens
cctggcagcgtgccgagctgcg

SEQ ID NO: 7283409 - DNA, 22 bp, Homo sapiens
cctggaagtcattcctcgttcc

SEQ ID NO: 7283410 - DNA, 22 bp, Homo sapiens
cctggctggatggagcccctgg

SEQ ID NO: 7283411 - DNA, 23 bp, Homo sapiens
cctggctggattctctgcattca

SEQ ID NO: 7283412 - DNA, 19 bp, Homo sapiens
cctggctgctgtgggatgc

SEQ ID NO: 7283413 - DNA, 22 bp, Homo sapiens
cctggctggggtagaagtgagg

SEQ ID NO: 7283414 - DNA, 17 bp, Homo sapiens
cctggctgggaatctga

SEQ ID NO: 7283415 - DNA, 22 bp, Homo sapiens
cctggctggtggcagcgacaag

SEQ ID NO: 7283416 - DNA, 22 bp, Homo sapiens
cctggccaatctagggctgtta

SEQ ID NO: 7283417 - DNA, 22 bp, Homo sapiens
cctggcagctccgtggccttcc

SEQ ID NO: 7283418 - DNA, 22 bp, Homo sapiens
cctggcagctccgtggccttcc

SEQ ID NO: 7283419 - DNA, 22 bp, Homo sapiens
cctggcagctaagtgctttgag

SEQ ID NO: 7283420 - DNA, 22 bp, Homo sapiens
cctggcagctcctccccggcgg

SEQ ID NO: 7283421 - DNA, 22 bp, Homo sapiens
cctggcagctcctccccggcgg

SEQ ID NO: 7283422 - DNA, 22 bp, Homo sapiens
ctcaaatacctctccatgtgac

SEQ ID NO: 7283423 - DNA, 22 bp, Homo sapiens
ctcaaatataagctaaatgtgg

SEQ ID NO: 7283424 - DNA, 23 bp, Homo sapiens
ctcaaccctagtaagggagtagg

SEQ ID NO: 7283425 - DNA, 22 bp, Homo sapiens
ctcaggccaataagctccagcc

SEQ ID NO: 7283426 - DNA, 22 bp, Homo sapiens
agtgaatttaaaacactgagga

SEQ ID NO: 7283427 - DNA, 22 bp, Homo sapiens
agtgctgggattgcaggcatga

SEQ ID NO: 7283428 - DNA, 22 bp, Homo sapiens
agtgctgggattacaggcataa

SEQ ID NO: 7283429 - DNA, 22 bp, Homo sapiens
agtgctggcccatagctgctgg

SEQ ID NO: 7283430 - DNA, 19 bp, Homo sapiens
ctctccacctaacaggtat

SEQ ID NO: 7283431 - DNA, 23 bp, Homo sapiens
ctctccaccttcccacccaggga

SEQ ID NO: 7283432 - DNA, 22 bp, Homo sapiens
ctctccactcagcgtcatgtcc

SEQ ID NO: 7283433 - DNA, 22 bp, Homo sapiens
ctctccattccctacagttttc

SEQ ID NO: 7283434 - DNA, 22 bp, Homo sapiens
ctctctagaggcccaccttgag

SEQ ID NO: 7283435 - DNA, 20 bp, Homo sapiens
ctctcccagcacagcttcct

SEQ ID NO: 7283436 - DNA, 22 bp, Homo sapiens
ctctcccagtcaggctcaggat

SEQ ID NO: 7283437 - DNA, 22 bp, Homo sapiens
ctctccccacaccctctgcatg

SEQ ID NO: 7283438 - DNA, 22 bp, Homo sapiens
ctcttgggagtgctctggagaa

SEQ ID NO: 7283439 - DNA, 22 bp, Homo sapiens
ctcttggccagacacagaggca

SEQ ID NO: 7283440 - DNA, 22 bp, Homo sapiens
ctctttggcgttggcagagcca

SEQ ID NO: 7283441 - DNA, 22 bp, Homo sapiens
ctcttggtaagacattagaggt

SEQ ID NO: 7283442 - DNA, 22 bp, Homo sapiens
cagaggtgttggtgaatggaga

SEQ ID NO: 7283443 - DNA, 22 bp, Homo sapiens
gggtgccctgggtaggtcagtt

SEQ ID NO: 7283444 - DNA, 22 bp, Homo sapiens
gggcagagaaatggacagttgg

SEQ ID NO: 7283445 - DNA, 22 bp, Homo sapiens
gggccttcagccttggactgag

SEQ ID NO: 7283446 - DNA, 22 bp, Homo sapiens
gggccttgccatggagcctgag

SEQ ID NO: 7283447 - DNA, 22 bp, Homo sapiens
cagagctgctcatggtggccag

SEQ ID NO: 7283448 - DNA, 22 bp, Homo sapiens
cagagctgacccaaggattgaa

SEQ ID NO: 7283449 - DNA, 22 bp, Homo sapiens
gggaggtgaaaggtcatgtgtg

SEQ ID NO: 7283450 - DNA, 22 bp, Homo sapiens
gggaggtgaaaggttgctgcag

SEQ ID NO: 7283451 - DNA, 22 bp, Homo sapiens
gggcaaggcagaagagttggag

SEQ ID NO: 7283452 - DNA, 22 bp, Homo sapiens
cagacagggacctcgctccaga

SEQ ID NO: 7283453 - DNA, 22 bp, Homo sapiens
gggaaaggatcagtgggaggct

SEQ ID NO: 7283454 - DNA, 20 bp, Homo sapiens
gtaaaatatggtctttgggt

SEQ ID NO: 7283455 - DNA, 20 bp, Homo sapiens
gggtgggagagtctgagggt

SEQ ID NO: 7283456 - DNA, 22 bp, Homo sapiens
ggtggggctgcaagcagttcgg

SEQ ID NO: 7283457 - DNA, 22 bp, Homo sapiens
ggtggggctcagcaatctgtgt

SEQ ID NO: 7283458 - DNA, 22 bp, Homo sapiens
ggtgggtaaaactgctggcact

SEQ ID NO: 7283459 - DNA, 22 bp, Homo sapiens
ggtgggtgaaatctaggtgtgt

SEQ ID NO: 7283460 - DNA, 22 bp, Homo sapiens
cagcagagtatggcactcaact

SEQ ID NO: 7283461 - DNA, 22 bp, Homo sapiens
cagcagagtaattctcacctct

SEQ ID NO: 7283462 - DNA, 22 bp, Homo sapiens
cagcaggcaggtgggccaagtc

SEQ ID NO: 7283463 - DNA, 22 bp, Homo sapiens
cagcaggcggcccgcgggcccg

SEQ ID NO: 7283464 - DNA, 19 bp, Homo sapiens
gctgtctgatgctgaggtc

SEQ ID NO: 7283465 - DNA, 22 bp, Homo sapiens
caaggcagcgttcctttctgga

SEQ ID NO: 7283466 - DNA, 22 bp, Homo sapiens
caaggcagcccgctgaaccaca

SEQ ID NO: 7283467 - DNA, 20 bp, Homo sapiens
caaggcagaccagagtgagt

SEQ ID NO: 7283468 - DNA, 22 bp, Homo sapiens
caaggcagaattcagactcagg

SEQ ID NO: 7283469 - DNA, 22 bp, Homo sapiens
caaggcagctattgtctccata

SEQ ID NO: 7283470 - DNA, 22 bp, Homo sapiens
caaggcagctgtagggatttgg

SEQ ID NO: 7283471 - DNA, 22 bp, Homo sapiens
gcttgggaaactggggaaacca

SEQ ID NO: 7283472 - DNA, 22 bp, Homo sapiens
gcttctccagaccttcatcccc

SEQ ID NO: 7283473 - DNA, 22 bp, Homo sapiens
gcttctcctcccgctcccaggc

SEQ ID NO: 7283474 - DNA, 22 bp, Homo sapiens
cacaagtctgtggtctccaaca

SEQ ID NO: 7283475 - DNA, 19 bp, Homo sapiens
cacacccatgcttgccaag

SEQ ID NO: 7283476 - DNA, 22 bp, Homo sapiens
gctcctgcagagatgttccatg

SEQ ID NO: 7283477 - DNA, 22 bp, Homo sapiens
gctcctgccctcttgcaattcc

SEQ ID NO: 7283478 - DNA, 22 bp, Homo sapiens
gctcctggagagattgagaaag

SEQ ID NO: 7283479 - DNA, 22 bp, Homo sapiens
caacatcagtcctcatgagaca

SEQ ID NO: 7283480 - DNA, 22 bp, Homo sapiens
caacatttgagtaaagaaatgg

SEQ ID NO: 7283481 - DNA, 22 bp, Homo sapiens
gctgctggcatctagggggtgg

SEQ ID NO: 7283482 - DNA, 22 bp, Homo sapiens
gctgctggccccacatgctcca

SEQ ID NO: 7283483 - DNA, 22 bp, Homo sapiens
gctgctggcactggagtgagcc

SEQ ID NO: 7283484 - DNA, 22 bp, Homo sapiens
gctgctggatgcgcttgatggt

SEQ ID NO: 7283485 - DNA, 22 bp, Homo sapiens
gctgctggagagcgagactgtt

SEQ ID NO: 7283486 - DNA, 22 bp, Homo sapiens
gctgctggagctttgcagaagg

SEQ ID NO: 7283487 - DNA, 22 bp, Homo sapiens
caagatcttcctcaatagacct

SEQ ID NO: 7283488 - DNA, 22 bp, Homo sapiens
ggcagatggaatgagctgtcta

SEQ ID NO: 7283489 - DNA, 22 bp, Homo sapiens
ggcagcatatattcagtgggca

SEQ ID NO: 7283490 - DNA, 22 bp, Homo sapiens
ggcagccaccctgggaggcaga

SEQ ID NO: 7283491 - DNA, 22 bp, Homo sapiens
ggcactgggcaccggctgaggg

SEQ ID NO: 7283492 - DNA, 22 bp, Homo sapiens
ggcacagggaggccctggtgtg

SEQ ID NO: 7283493 - DNA, 22 bp, Homo sapiens
cacagggcagagacctgggtgc

SEQ ID NO: 7283494 - DNA, 22 bp, Homo sapiens
ggaggcggaggctgcagtgagc

SEQ ID NO: 7283495 - DNA, 22 bp, Homo sapiens
ggaggcggaagttgcagtgagc

SEQ ID NO: 7283496 - DNA, 22 bp, Homo sapiens
ggaggcggagcttgcagtgagc

SEQ ID NO: 7283497 - DNA, 22 bp, Homo sapiens
ggaggcggacacaggtagtgtt

SEQ ID NO: 7283498 - DNA, 22 bp, Homo sapiens
cacactgtcaggtaaataacac

SEQ ID NO: 7283499 - DNA, 22 bp, Homo sapiens
caccccttgtctttggggtcgt

SEQ ID NO: 7283500 - DNA, 22 bp, Homo sapiens
cacccctgtggagcatggtggc

SEQ ID NO: 7283501 - DNA, 22 bp, Homo sapiens
ggcagctgattagcatcaagga

SEQ ID NO: 7283502 - DNA, 22 bp, Homo sapiens
ggcctctcatgtcctgggcttc

SEQ ID NO: 7283503 - DNA, 22 bp, Homo sapiens
ggcctctcattctccctggtcc

SEQ ID NO: 7283504 - DNA, 22 bp, Homo sapiens
ggcctctctagcatccagcctg

SEQ ID NO: 7283505 - DNA, 22 bp, Homo sapiens
ggcctctcatgcccagagccaa

SEQ ID NO: 7283506 - DNA, 22 bp, Homo sapiens
ggcctctcagggcagagaccct

SEQ ID NO: 7283507 - DNA, 17 bp, Homo sapiens
cactgagaggtttgaga

SEQ ID NO: 7283508 - DNA, 22 bp, Homo sapiens
cactggaattcaagatactgag

SEQ ID NO: 7283509 - DNA, 22 bp, Homo sapiens
ggctaggggaataatctgtggt

SEQ ID NO: 7283510 - DNA, 22 bp, Homo sapiens
ggctagggagacagagggcatg

SEQ ID NO: 7283511 - DNA, 22 bp, Homo sapiens
ggctagggagacagagggcatg

SEQ ID NO: 7283512 - DNA, 22 bp, Homo sapiens
gcagcaggcttttcataccttg

SEQ ID NO: 7283513 - DNA, 22 bp, Homo sapiens
gcagcaggcatggccgccctgg

SEQ ID NO: 7283514 - DNA, 16 bp, Homo sapiens
gcagaggaaaggggag

SEQ ID NO: 7283515 - DNA, 22 bp, Homo sapiens
attctacatttggagtgatgtc

SEQ ID NO: 7283516 - DNA, 22 bp, Homo sapiens
attctacatgatagaagggaga

SEQ ID NO: 7283517 - DNA, 22 bp, Homo sapiens
gcagcagggtgccagctttgca

SEQ ID NO: 7283518 - DNA, 22 bp, Homo sapiens
gcagcagggagcaggggtgtca

SEQ ID NO: 7283519 - DNA, 22 bp, Homo sapiens
attctacacaaagcaagaagac

SEQ ID NO: 7283520 - DNA, 22 bp, Homo sapiens
gcagcaggtccgcatcatcatc

SEQ ID NO: 7283521 - DNA, 22 bp, Homo sapiens
attcttcaccatggataatttg

SEQ ID NO: 7283522 - DNA, 22 bp, Homo sapiens
attcttcacataagtgctgtac

SEQ ID NO: 7283523 - DNA, 22 bp, Homo sapiens
attcttcaaagagtgtcaaagt

SEQ ID NO: 7283524 - DNA, 22 bp, Homo sapiens
attcttcacaaatatatagaag

SEQ ID NO: 7283525 - DNA, 22 bp, Homo sapiens
attgaaaaatgactattgctta

SEQ ID NO: 7283526 - DNA, 22 bp, Homo sapiens
attcttcactgtttcagaatga

SEQ ID NO: 7283527 - DNA, 22 bp, Homo sapiens
atgttaaaaaccagtacagttg

SEQ ID NO: 7283528 - DNA, 19 bp, Homo sapiens
gccaggcctggacctgcag

SEQ ID NO: 7283529 - DNA, 22 bp, Homo sapiens
gccaggcctgcaagtgctggtg

SEQ ID NO: 7283530 - DNA, 22 bp, Homo sapiens
attggaatggctttgcatgtcc

SEQ ID NO: 7283531 - DNA, 22 bp, Homo sapiens
attggagaaatggggctttagg

SEQ ID NO: 7283532 - DNA, 22 bp, Homo sapiens
attggagtggtggttacatgag

SEQ ID NO: 7283533 - DNA, 22 bp, Homo sapiens
atttacagaagcatgtaatagc

SEQ ID NO: 7283534 - DNA, 22 bp, Homo sapiens
atttacagaaacttaatcatag

SEQ ID NO: 7283535 - DNA, 22 bp, Homo sapiens
gcctgtgactcgtcttgggcca

SEQ ID NO: 7283536 - DNA, 22 bp, Homo sapiens
gcctgtgatgcccccataagta

SEQ ID NO: 7283537 - DNA, 22 bp, Homo sapiens
gcctgtgacccctccatctgct

SEQ ID NO: 7283538 - DNA, 22 bp, Homo sapiens
gcctgtgcctcagcctgcagcc

SEQ ID NO: 7283539 - DNA, 23 bp, Homo sapiens
gcctgtgcctatgcccagctctg

SEQ ID NO: 7283540 - DNA, 22 bp, Homo sapiens
gcctgtctacactttctctgca

SEQ ID NO: 7283541 - DNA, 22 bp, Homo sapiens
caaaaccaagaacattcatttc

SEQ ID NO: 7283542 - DNA, 22 bp, Homo sapiens
caaacttttcctggaaaagatt

SEQ ID NO: 7283543 - DNA, 22 bp, Homo sapiens
gctcaggcaggagtgcagtggc

SEQ ID NO: 7283544 - DNA, 22 bp, Homo sapiens
gcctgctgagggaagttgggca

SEQ ID NO: 7283545 - DNA, 22 bp, Homo sapiens
gcctgctgaagccagagtgtgt

SEQ ID NO: 7283546 - DNA, 22 bp, Homo sapiens
gcctgctctggaatccatgtaa

SEQ ID NO: 7283547 - DNA, 22 bp, Homo sapiens
gcctgctgaacctcatgcagtc

SEQ ID NO: 7283548 - DNA, 18 bp, Homo sapiens
gcctgcctagagcttgcc

SEQ ID NO: 7283549 - DNA, 18 bp, Homo sapiens
gcctgcctagagcttgcc

SEQ ID NO: 7283550 - DNA, 22 bp, Homo sapiens
gcctgctggacattggccggcc

SEQ ID NO: 7283551 - DNA, 21 bp, Homo sapiens
gcctgctgcctgtggccggtc

SEQ ID NO: 7283552 - DNA, 22 bp, Homo sapiens
gcctgctgcatccaggctattg

SEQ ID NO: 7283553 - DNA, 22 bp, Homo sapiens
gcctgctgccaccctggctccg

SEQ ID NO: 7283554 - DNA, 22 bp, Homo sapiens
gcctgctggatgtggccaggcc

SEQ ID NO: 7283555 - DNA, 22 bp, Homo sapiens
gcctgctggctgtccattgcag

SEQ ID NO: 7283556 - DNA, 22 bp, Homo sapiens
gcctccacttttgctggcttct

SEQ ID NO: 7283557 - DNA, 21 bp, Homo sapiens
gcctctccaaatcctgccttc

SEQ ID NO: 7283558 - DNA, 23 bp, Homo sapiens
cttgcctggcctctctgcccaga

SEQ ID NO: 7283559 - DNA, 19 bp, Homo sapiens
cttgcctgttcctacagct

SEQ ID NO: 7283560 - DNA, 19 bp, Homo sapiens
cttgcctgttcctacagct

SEQ ID NO: 7283561 - DNA, 22 bp, Homo sapiens
cttgcctgctggagcagggctc

SEQ ID NO: 7283562 - DNA, 23 bp, Homo sapiens
cttgcctggcctctctgcccaga

SEQ ID NO: 7283563 - DNA, 22 bp, Homo sapiens
cttgcctttgtcttcaaaggct

SEQ ID NO: 7283564 - DNA, 22 bp, Homo sapiens
cttgtaaatgcagattctgatt

SEQ ID NO: 7283565 - DNA, 22 bp, Homo sapiens
cttggcctcttctcagggtggg

SEQ ID NO: 7283566 - DNA, 22 bp, Homo sapiens
cttggcatgcagcaggcactca

SEQ ID NO: 7283567 - DNA, 19 bp, Homo sapiens
cttggcatctgtgaagtga

SEQ ID NO: 7283568 - DNA, 22 bp, Homo sapiens
cttggccagacagggagctcca

SEQ ID NO: 7283569 - DNA, 22 bp, Homo sapiens
cttggctgaactccaggatgca

SEQ ID NO: 7283570 - DNA, 22 bp, Homo sapiens
cttttcaaacgctgatgtcagt

SEQ ID NO: 7283571 - DNA, 19 bp, Homo sapiens
cttttcaagccatcagttt

SEQ ID NO: 7283572 - DNA, 22 bp, Homo sapiens
atcttgatcaaggctatcatga

SEQ ID NO: 7283573 - DNA, 22 bp, Homo sapiens
atctttgggcaatgatgaggga

SEQ ID NO: 7283574 - DNA, 22 bp, Homo sapiens
atcttttttgtcttggtcactg

SEQ ID NO: 7283575 - DNA, 22 bp, Homo sapiens
atcttttttgtcttggtcactg

SEQ ID NO: 7283576 - DNA, 22 bp, Homo sapiens
atctttttatctgtttggaaca

SEQ ID NO: 7283577 - DNA, 22 bp, Homo sapiens
atctttttgacatggtgatggt

SEQ ID NO: 7283578 - DNA, 22 bp, Homo sapiens
atctttttgacatggtgatggt

SEQ ID NO: 7283579 - DNA, 22 bp, Homo sapiens
atctttttactaacactgctta

SEQ ID NO: 7283580 - DNA, 22 bp, Homo sapiens
atctttttactaacactgctta

SEQ ID NO: 7283581 - DNA, 22 bp, Homo sapiens
atctttttatctgtttggaaca

SEQ ID NO: 7283582 - DNA, 22 bp, Homo sapiens
cttgtggcccatggcttcctgc

SEQ ID NO: 7283583 - DNA, 22 bp, Homo sapiens
atgaaaagcataaacgctgaag

SEQ ID NO: 7283584 - DNA, 22 bp, Homo sapiens
cttgtttatctctgtagccctg

SEQ ID NO: 7283585 - DNA, 22 bp, Homo sapiens
atgaggtggtcttcagtaggtc

SEQ ID NO: 7283586 - DNA, 22 bp, Homo sapiens
atgcaaaaactgcacttacgct

SEQ ID NO: 7283587 - DNA, 22 bp, Homo sapiens
atgcaaaagactatttgttgct

SEQ ID NO: 7283588 - DNA, 22 bp, Homo sapiens
atgcaaaagtaactgtgatttt

SEQ ID NO: 7283589 - DNA, 22 bp, Homo sapiens
atgcaaaagtaattgcaatttt

SEQ ID NO: 7283590 - DNA, 22 bp, Homo sapiens
atgattttttctaacacagtcg

SEQ ID NO: 7283591 - DNA, 22 bp, Homo sapiens
gaaagcaatttgtgtaatctgt

SEQ ID NO: 7283592 - DNA, 22 bp, Homo sapiens
atgcaaaagtagttgcagtttt

SEQ ID NO: 7283593 - DNA, 22 bp, Homo sapiens
atgcaaaataaggcagaaacat

SEQ ID NO: 7283594 - DNA, 22 bp, Homo sapiens
atgcaaaattaccattctgttc

SEQ ID NO: 7283595 - DNA, 22 bp, Homo sapiens
atgcaaagcacacacagaatcc

SEQ ID NO: 7283596 - DNA, 22 bp, Homo sapiens
atgcagatgttcctactgtgtt

SEQ ID NO: 7283597 - DNA, 22 bp, Homo sapiens
atgcagatggtggatggagaaa

SEQ ID NO: 7283598 - DNA, 22 bp, Homo sapiens
gagccaggaagaaggccttact

SEQ ID NO: 7283599 - DNA, 22 bp, Homo sapiens
gagccaggcccgtacttgctgt

SEQ ID NO: 7283600 - DNA, 22 bp, Homo sapiens
atggaacaggctcagagatgct

SEQ ID NO: 7283601 - DNA, 22 bp, Homo sapiens
atggaatgtgaacatgatggca

SEQ ID NO: 7283602 - DNA, 22 bp, Homo sapiens
atggaagcagacaggtaattcc

SEQ ID NO: 7283603 - DNA, 20 bp, Homo sapiens
atggaggaagggcaagagaa

SEQ ID NO: 7283604 - DNA, 22 bp, Homo sapiens
gagaaatgcatgcatgtcatca

SEQ ID NO: 7283605 - DNA, 22 bp, Homo sapiens
gagaaatgctagcttaggaatc

SEQ ID NO: 7283606 - DNA, 22 bp, Homo sapiens
gaggcctggagccgcctaggcg

SEQ ID NO: 7283607 - DNA, 22 bp, Homo sapiens
tcaggaagttttgaatcaactg

SEQ ID NO: 7283608 - DNA, 20 bp, Homo sapiens
tcagggcatgggacagcccc

SEQ ID NO: 7283609 - DNA, 21 bp, Homo sapiens
catgatctcattcaactaggg

SEQ ID NO: 7283610 - DNA, 22 bp, Homo sapiens
catgatggttcttacaaaggtg

SEQ ID NO: 7283611 - DNA, 17 bp, Homo sapiens
tatctcttcaagtttca

SEQ ID NO: 7283612 - DNA, 22 bp, Homo sapiens
tatctctttcattttagagtca

SEQ ID NO: 7283613 - DNA, 22 bp, Homo sapiens
tatctcttgtctgttttgcaaa

SEQ ID NO: 7283614 - DNA, 22 bp, Homo sapiens
tatctctttattgacaataaaa

SEQ ID NO: 7283615 - DNA, 22 bp, Homo sapiens
tattcctcctttctgctcagcc

SEQ ID NO: 7283616 - DNA, 22 bp, Homo sapiens
tatctatgtgctctgacctctc

SEQ ID NO: 7283617 - DNA, 22 bp, Homo sapiens
caggggcctggctgtctaggaa

SEQ ID NO: 7283618 - DNA, 17 bp, Homo sapiens
tacatgtgtatctgatt

SEQ ID NO: 7283619 - DNA, 22 bp, Homo sapiens
cagtgcagaacacatggaaaat

SEQ ID NO: 7283620 - DNA, 22 bp, Homo sapiens
cagtgcagacgtggagggggca

SEQ ID NO: 7283621 - DNA, 17 bp, Homo sapiens
cagtgcagagccctttc

SEQ ID NO: 7283622 - DNA, 22 bp, Homo sapiens
cagtgcagaggccagggaggat

SEQ ID NO: 7283623 - DNA, 22 bp, Homo sapiens
tcactcagaaatagaatgaacc

SEQ ID NO: 7283624 - DNA, 22 bp, Homo sapiens
tcagaaatactatcagcttttg

SEQ ID NO: 7283625 - DNA, 22 bp, Homo sapiens
tcagaaatcttgtcaaggcatc

SEQ ID NO: 7283626 - DNA, 22 bp, Homo sapiens
tcagaaatttaggctggacttg

SEQ ID NO: 7283627 - DNA, 22 bp, Homo sapiens
cagtgcagaggccagggaggat

SEQ ID NO: 7283628 - DNA, 22 bp, Homo sapiens
tcacattctttatttgccatcc

SEQ ID NO: 7283629 - DNA, 22 bp, Homo sapiens
ccaggaagcctcagatgctgag

SEQ ID NO: 7283630 - DNA, 21 bp, Homo sapiens
ccaggaaggactgagctccct

SEQ ID NO: 7283631 - DNA, 22 bp, Homo sapiens
tctgcctctttcaggcctggca

SEQ ID NO: 7283632 - DNA, 22 bp, Homo sapiens
tctgcctgaaccactcttggag

SEQ ID NO: 7283633 - DNA, 22 bp, Homo sapiens
ccagctggtctgtgctcatgtt

SEQ ID NO: 7283634 - DNA, 22 bp, Homo sapiens
ccagctggtgacatccccaacc

SEQ ID NO: 7283635 - DNA, 22 bp, Homo sapiens
ccagctggtgggtctttctctg

SEQ ID NO: 7283636 - DNA, 22 bp, Homo sapiens
ccagctggtaagtgatggagcc

SEQ ID NO: 7283637 - DNA, 22 bp, Homo sapiens
ccagctggggaagtggggcata

SEQ ID NO: 7283638 - DNA, 22 bp, Homo sapiens
ccagctggtttatattccccac

SEQ ID NO: 7283639 - DNA, 22 bp, Homo sapiens
ccagctgtcagtgtgaaaataa

SEQ ID NO: 7283640 - DNA, 22 bp, Homo sapiens
tctctcttgtcaccccatctgc

SEQ ID NO: 7283641 - DNA, 22 bp, Homo sapiens
tctcttgggaggaaagagagaa

SEQ ID NO: 7283642 - DNA, 22 bp, Homo sapiens
tctcttgaagattgaagacaaa

SEQ ID NO: 7283643 - DNA, 22 bp, Homo sapiens
tctcttgactgctaaaattaga

SEQ ID NO: 7283644 - DNA, 22 bp, Homo sapiens
tctcttgatatattacatagag

SEQ ID NO: 7283645 - DNA, 22 bp, Homo sapiens
tctcttggtgacttaaaatgtt

SEQ ID NO: 7283646 - DNA, 22 bp, Homo sapiens
tctcttggtgatagtctttctt

SEQ ID NO: 7283647 - DNA, 21 bp, Homo sapiens
tctgaggagaaactcttggtg

SEQ ID NO: 7283648 - DNA, 22 bp, Homo sapiens
tctgaggagtgaccctcttgca

SEQ ID NO: 7283649 - DNA, 22 bp, Homo sapiens
tctgagagtctttcttcaagtg

SEQ ID NO: 7283650 - DNA, 20 bp, Homo sapiens
tctgagagtctgagtgatga

SEQ ID NO: 7283651 - DNA, 22 bp, Homo sapiens
tctgaggacagtgctgtgcctg

SEQ ID NO: 7283652 - DNA, 22 bp, Homo sapiens
tctgatactgcaaaaatgtagg

SEQ ID NO: 7283653 - DNA, 22 bp, Homo sapiens
ccagcctggggaggcagcttct

SEQ ID NO: 7283654 - DNA, 19 bp, Homo sapiens
tctgcctctggtcaggctc

SEQ ID NO: 7283655 - DNA, 22 bp, Homo sapiens
tctgcctcctgcttgtcccgac

SEQ ID NO: 7283656 - DNA, 20 bp, Homo sapiens
tctgccactgcactctgccc

SEQ ID NO: 7283657 - DNA, 23 bp, Homo sapiens
ccactctcccaccatatctgtat

SEQ ID NO: 7283658 - DNA, 22 bp, Homo sapiens
tcctggtgctgacacccatagc

SEQ ID NO: 7283659 - DNA, 22 bp, Homo sapiens
ccactgccgtgggccttgggga

SEQ ID NO: 7283660 - DNA, 22 bp, Homo sapiens
ccactgccagctttgtcctccc

SEQ ID NO: 7283661 - DNA, 22 bp, Homo sapiens
ccactgccagctttgtcctccc

SEQ ID NO: 7283662 - DNA, 22 bp, Homo sapiens
ccactgccatgggctaggcatg

SEQ ID NO: 7283663 - DNA, 22 bp, Homo sapiens
ccactgccatgggctaggcatg

SEQ ID NO: 7283664 - DNA, 22 bp, Homo sapiens
ccactgcctatttgcagggccc

SEQ ID NO: 7283665 - DNA, 22 bp, Homo sapiens
ccactgcctctccagggccatc

SEQ ID NO: 7283666 - DNA, 22 bp, Homo sapiens
ccagaaaagcatctggttcttt

SEQ ID NO: 7283667 - DNA, 22 bp, Homo sapiens
ccagaaaaggagctgcaggatg

SEQ ID NO: 7283668 - DNA, 22 bp, Homo sapiens
ccagatatcactgccgtgttgt

SEQ ID NO: 7283669 - DNA, 22 bp, Homo sapiens
ccagatattcacttttacatgc

SEQ ID NO: 7283670 - DNA, 22 bp, Homo sapiens
tctctaagataggaatacagtt

SEQ ID NO: 7283671 - DNA, 22 bp, Homo sapiens
tcctccccaaagcccagcctgg

SEQ ID NO: 7283672 - DNA, 22 bp, Homo sapiens
tcctgccatttgctttttctcc

SEQ ID NO: 7283673 - DNA, 22 bp, Homo sapiens
catttgcaagagataaatgttt

SEQ ID NO: 7283674 - DNA, 22 bp, Homo sapiens
catttgcagagggtgacactct

SEQ ID NO: 7283675 - DNA, 22 bp, Homo sapiens
catttgcatatgaagaagtaag

SEQ ID NO: 7283676 - DNA, 22 bp, Homo sapiens
tccctgcctgacagcacccacc

SEQ ID NO: 7283677 - DNA, 22 bp, Homo sapiens
tccctgcctgacagcacccacc

SEQ ID NO: 7283678 - DNA, 20 bp, Homo sapiens
tccctgccttttactgctgg

SEQ ID NO: 7283679 - DNA, 22 bp, Homo sapiens
tcccagggtcagtggtgaggcc

SEQ ID NO: 7283680 - DNA, 22 bp, Homo sapiens
caggcagagccaatcgtggggt

SEQ ID NO: 7283681 - DNA, 22 bp, Homo sapiens
caggcagagcaactggtccaga

SEQ ID NO: 7283682 - DNA, 22 bp, Homo sapiens
caggcagaaggaagtaccaggc

SEQ ID NO: 7283683 - DNA, 22 bp, Homo sapiens
caggcagaagaagtggaaggac

SEQ ID NO: 7283684 - DNA, 22 bp, Homo sapiens
caggcagaatgagattacttca

SEQ ID NO: 7283685 - DNA, 17 bp, Homo sapiens
caggcagacatgtaagc

SEQ ID NO: 7283686 - DNA, 22 bp, Homo sapiens
caggcagaatgaccgacctcgc

SEQ ID NO: 7283687 - DNA, 22 bp, Homo sapiens
caggcagagaggagcatttaat

SEQ ID NO: 7283688 - DNA, 22 bp, Homo sapiens
caggcagagacgtcagtgtagg

SEQ ID NO: 7283689 - DNA, 22 bp, Homo sapiens
caggcagagaccctctcctaaa

SEQ ID NO: 7283690 - DNA, 22 bp, Homo sapiens
caggcagagaactcatccgtga

SEQ ID NO: 7283691 - DNA, 22 bp, Homo sapiens
caggcagactttgagaatgatg

SEQ ID NO: 7283692 - DNA, 22 bp, Homo sapiens
caggcagacatttttgacatag

SEQ ID NO: 7283693 - DNA, 22 bp, Homo sapiens
caggcaggagaggaggatttct

SEQ ID NO: 7283694 - DNA, 22 bp, Homo sapiens
caggcagctgggtcaccgtccc

SEQ ID NO: 7283695 - DNA, 22 bp, Homo sapiens
caggcagctgactgtcagatat

SEQ ID NO: 7283696 - DNA, 22 bp, Homo sapiens
caggccctggcagggctgagtc

SEQ ID NO: 7283697 - DNA, 22 bp, Homo sapiens
caggccctgctgctgagacctt

SEQ ID NO: 7283698 - DNA, 20 bp, Homo sapiens
tacaaattttccatgtttcc

SEQ ID NO: 7283699 - DNA, 22 bp, Homo sapiens
tacaaattaatgggcatgttta

SEQ ID NO: 7283700 - DNA, 22 bp, Homo sapiens
taacatttaaatttttcacata

SEQ ID NO: 7283701 - DNA, 22 bp, Homo sapiens
taacattcttaacttagaaaca

SEQ ID NO: 7283702 - DNA, 22 bp, Homo sapiens
caggcacatgggagctcatcat

SEQ ID NO: 7283703 - DNA, 22 bp, Homo sapiens
taaggcagaaatatgagcaggg

SEQ ID NO: 7283704 - DNA, 22 bp, Homo sapiens
taaggcagccgctcagagaggt

SEQ ID NO: 7283705 - DNA, 22 bp, Homo sapiens
taaggcagcataattaggccac

SEQ ID NO: 7283706 - DNA, 19 bp, Homo sapiens
taaggcagcagtgacaggc

SEQ ID NO: 7283707 - DNA, 22 bp, Homo sapiens
taaggcagaggtaccactaggc

SEQ ID NO: 7283708 - DNA, 22 bp, Homo sapiens
taaggcagatgtggaatcaatt

SEQ ID NO: 7283709 - DNA, 22 bp, Homo sapiens
caggcagaaattttgtttcatt

SEQ ID NO: 7283710 - DNA, 22 bp, Homo sapiens
caggcagaaagtattctgtgta

SEQ ID NO: 7283711 - DNA, 22 bp, Homo sapiens
taaggcagcctcagggtagggt

SEQ ID NO: 7283712 - DNA, 22 bp, Homo sapiens
caggagagatatgagtccccac

SEQ ID NO: 7283713 - DNA, 22 bp, Homo sapiens
caggagagcccgggtccgggct

SEQ ID NO: 7283714 - DNA, 22 bp, Homo sapiens
caggagccctggtgggtggaca

SEQ ID NO: 7283715 - DNA, 22 bp, Homo sapiens
taaatcacccatctcctaatct

SEQ ID NO: 7283716 - DNA, 22 bp, Homo sapiens
taaatcacatcgaaatctgggt

SEQ ID NO: 7283717 - DNA, 22 bp, Homo sapiens
taaagtcatctttacatctttg

SEQ ID NO: 7283718 - DNA, 22 bp, Homo sapiens
taaagtcatctttaaacatgcc

SEQ ID NO: 7283719 - DNA, 22 bp, Homo sapiens
taaagtcataagagtggatccg

SEQ ID NO: 7283720 - DNA, 22 bp, Homo sapiens
taaagtcagggagattgaggct

SEQ ID NO: 7283721 - DNA, 22 bp, Homo sapiens
taaagtcagatatctgggttga

SEQ ID NO: 7283722 - DNA, 22 bp, Homo sapiens
taaagccacgctggaaatcagg

SEQ ID NO: 7283723 - DNA, 20 bp, Homo sapiens
caggaggcaaggtcaaggtc

SEQ ID NO: 7283724 - DNA, 22 bp, Homo sapiens
caggaggcagaggttgcagtga

SEQ ID NO: 7283725 - DNA, 22 bp, Homo sapiens
caggaggcagaggttgcagcga

SEQ ID NO: 7283726 - DNA, 22 bp, Homo sapiens
caggaggcagaggatgcccagt

SEQ ID NO: 7283727 - DNA, 22 bp, Homo sapiens
caggaggcagcgctctcaggac

SEQ ID NO: 7283728 - DNA, 19 bp, Homo sapiens
taacaaagtctgaagtcag

SEQ ID NO: 7283729 - DNA, 22 bp, Homo sapiens
caggaggcgtcttcagtttgtt

SEQ ID NO: 7283730 - DNA, 22 bp, Homo sapiens
caggaggcccaaagggcgcaga

SEQ ID NO: 7283731 - DNA, 22 bp, Homo sapiens
caggaggcccggccacagccca

SEQ ID NO: 7283732 - DNA, 22 bp, Homo sapiens
caggaggcccacaggcccctgc

SEQ ID NO: 7283733 - DNA, 22 bp, Homo sapiens
caggaggccaactgtgggactt

SEQ ID NO: 7283734 - DNA, 22 bp, Homo sapiens
taaaatgatctctcatgttctt

SEQ ID NO: 7283735 - DNA, 22 bp, Homo sapiens
gttttcctgagcccagagatgc

SEQ ID NO: 7283736 - DNA, 22 bp, Homo sapiens
taaaatgacttcctccaacatc

SEQ ID NO: 7283737 - DNA, 22 bp, Homo sapiens
gtttggaatagcagtaaacatt

SEQ ID NO: 7283738 - DNA, 22 bp, Homo sapiens
cagctgggtgatcttgggcagg

SEQ ID NO: 7283739 - DNA, 22 bp, Homo sapiens
gtggggcggcagatgctccctg

SEQ ID NO: 7283740 - DNA, 22 bp, Homo sapiens
gtggggctcccatctcctggct

SEQ ID NO: 7283741 - DNA, 22 bp, Homo sapiens
gtggggctaaaaactgtgcagt

SEQ ID NO: 7283742 - DNA, 22 bp, Homo sapiens
gtggggctgagtggagccagaa

SEQ ID NO: 7283743 - DNA, 22 bp, Homo sapiens
cagctggctccacctctgggct

SEQ ID NO: 7283744 - DNA, 22 bp, Homo sapiens
cagctggctccacctctgggct

SEQ ID NO: 7283745 - DNA, 22 bp, Homo sapiens
cagctggcgcctggggaccaga

SEQ ID NO: 7283746 - DNA, 22 bp, Homo sapiens
cagctggcgcctggggaccaga

SEQ ID NO: 7283747 - DNA, 22 bp, Homo sapiens
cagctggctgcggtgaggggac

SEQ ID NO: 7283748 - DNA, 22 bp, Homo sapiens
gtggcctttatcttaggtatcc

SEQ ID NO: 7283749 - DNA, 22 bp, Homo sapiens
gtggcagagaacaaggagaggt

SEQ ID NO: 7283750 - DNA, 21 bp, Homo sapiens
cagcccagcttcttccccagt

SEQ ID NO: 7283751 - DNA, 22 bp, Homo sapiens
gtggcagaaactggcagaggag

SEQ ID NO: 7283752 - DNA, 22 bp, Homo sapiens
gtggccagtgggaatgggctca

SEQ ID NO: 7283753 - DNA, 22 bp, Homo sapiens
gtggcagtctttggcaatgaca

SEQ ID NO: 7283754 - DNA, 22 bp, Homo sapiens
gtggcagtgaggcaggagcagt

SEQ ID NO: 7283755 - DNA, 22 bp, Homo sapiens
gtggcagtcggaagtcaggaga

SEQ ID NO: 7283756 - DNA, 22 bp, Homo sapiens
gtggcagtcatcaaggacagat

SEQ ID NO: 7283757 - DNA, 22 bp, Homo sapiens
gtggcagtcatcaaggacagat

SEQ ID NO: 7283758 - DNA, 22 bp, Homo sapiens
cagctgtgggcctgacgtggca

SEQ ID NO: 7283759 - DNA, 22 bp, Homo sapiens
gttaaataacctcatgtccgtt

SEQ ID NO: 7283760 - DNA, 20 bp, Homo sapiens
gttaaaagagtaatttgagg

SEQ ID NO: 7283761 - DNA, 22 bp, Homo sapiens
caggaagattagaccaagagct

SEQ ID NO: 7283762 - DNA, 22 bp, Homo sapiens
gtttacatgcagaaaatcaatg

SEQ ID NO: 7283763 - DNA, 22 bp, Homo sapiens
gtttacatgtactcattatact

SEQ ID NO: 7283764 - DNA, 22 bp, Homo sapiens
gttcctgggaggcatgggctgg

SEQ ID NO: 7283765 - DNA, 22 bp, Homo sapiens
ttgggatctacatagctatgta

SEQ ID NO: 7283766 - DNA, 21 bp, Homo sapiens
ttgggatctgagaagtgaaaa

SEQ ID NO: 7283767 - DNA, 22 bp, Homo sapiens
ttgggatctcaaatccagctat

SEQ ID NO: 7283768 - DNA, 22 bp, Homo sapiens
ttggcatttttcctcagctgga

SEQ ID NO: 7283769 - DNA, 22 bp, Homo sapiens
ttggcattgaagtttcattggt

SEQ ID NO: 7283770 - DNA, 22 bp, Homo sapiens
ttggcatttatctttaatcaaa

SEQ ID NO: 7283771 - DNA, 22 bp, Homo sapiens
ttgctttgtggtggttcttcca

SEQ ID NO: 7283772 - DNA, 22 bp, Homo sapiens
tttaaaaaactagtctgagtct

SEQ ID NO: 7283773 - DNA, 22 bp, Homo sapiens
ctcctctggcttcctggaggca

SEQ ID NO: 7283774 - DNA, 22 bp, Homo sapiens
tttacatgtaatgttatacaaa

SEQ ID NO: 7283775 - DNA, 22 bp, Homo sapiens
tttacatttccctctgtcagtt

SEQ ID NO: 7283776 - DNA, 17 bp, Homo sapiens
tttacattgctcgcagt

SEQ ID NO: 7283777 - DNA, 22 bp, Homo sapiens
tttacattgcattaggtattat

SEQ ID NO: 7283778 - DNA, 22 bp, Homo sapiens
tttacagttccatgtgataggc

SEQ ID NO: 7283779 - DNA, 22 bp, Homo sapiens
tttacagttaagaaatgttacc

SEQ ID NO: 7283780 - DNA, 22 bp, Homo sapiens
tttaaatttagaagaaacactg

SEQ ID NO: 7283781 - DNA, 22 bp, Homo sapiens
ctcctgggctatgtctgcttgg

SEQ ID NO: 7283782 - DNA, 21 bp, Homo sapiens
ctcctgggctaagatatagtg

SEQ ID NO: 7283783 - DNA, 18 bp, Homo sapiens
ctcctgggctgcagatgc

SEQ ID NO: 7283784 - DNA, 22 bp, Homo sapiens
ctcctgggagcagggatggatg

SEQ ID NO: 7283785 - DNA, 22 bp, Homo sapiens
ctcctgggagctgtggcagagc

SEQ ID NO: 7283786 - DNA, 22 bp, Homo sapiens
ctcctgggagtcttcctggatg

SEQ ID NO: 7283787 - DNA, 22 bp, Homo sapiens
ctctccactgtcctttgctggt

SEQ ID NO: 7283788 - DNA, 22 bp, Homo sapiens
ctctcagaagtagcacgtgggc

SEQ ID NO: 7283789 - DNA, 19 bp, Homo sapiens
ctctcactcgccacatcct

SEQ ID NO: 7283790 - DNA, 19 bp, Homo sapiens
ctctcactcgccacatcct

SEQ ID NO: 7283791 - DNA, 19 bp, Homo sapiens
ctctccagctccagtagct

SEQ ID NO: 7283792 - DNA, 22 bp, Homo sapiens
ctctccctatgcctcccaggag

SEQ ID NO: 7283793 - DNA, 22 bp, Homo sapiens
ctctccaggagagcactttgag

SEQ ID NO: 7283794 - DNA, 22 bp, Homo sapiens
ctctccaggactttggcccaat

SEQ ID NO: 7283795 - DNA, 22 bp, Homo sapiens
ttgacccagctttccccacaat

SEQ ID NO: 7283796 - DNA, 22 bp, Homo sapiens
ttcttgtttattaagatataaa

SEQ ID NO: 7283797 - DNA, 20 bp, Homo sapiens
ctagcctggccttgctctgg

SEQ ID NO: 7283798 - DNA, 22 bp, Homo sapiens
ctagggaatgagagactggatc

SEQ ID NO: 7283799 - DNA, 22 bp, Homo sapiens
ctaggcagggtgctgtgccatg

SEQ ID NO: 7283800 - DNA, 22 bp, Homo sapiens
ttcagaaaaaacttcaataagt

SEQ ID NO: 7283801 - DNA, 22 bp, Homo sapiens
ttcacattacaaggccatattt

SEQ ID NO: 7283802 - DNA, 22 bp, Homo sapiens
ttcacattaagcctcctcctac

SEQ ID NO: 7283803 - DNA, 22 bp, Homo sapiens
cgctgggcgccgacctgctggc

SEQ ID NO: 7283804 - DNA, 21 bp, Homo sapiens
ttcccttctggttttgagaga

SEQ ID NO: 7283805 - DNA, 22 bp, Homo sapiens
ctaaggcaccgaggcaggagcg

SEQ ID NO: 7283806 - DNA, 22 bp, Homo sapiens
ttcccttcctcactctacttgt

SEQ ID NO: 7283807 - DNA, 22 bp, Homo sapiens
ctaaggcaggtccattccagga

SEQ ID NO: 7283808 - DNA, 22 bp, Homo sapiens
tttgtctttcccctcctcattg

SEQ ID NO: 7283809 - DNA, 22 bp, Homo sapiens
tttgtcttgtaagttaaattca

SEQ ID NO: 7283810 - DNA, 22 bp, Homo sapiens
tttgtgaattcttggaagattg

SEQ ID NO: 7283811 - DNA, 22 bp, Homo sapiens
ctctgggccaccgctggtgtat

SEQ ID NO: 7283812 - DNA, 22 bp, Homo sapiens
ctctttttcacctctgtcagcg

SEQ ID NO: 7283813 - DNA, 22 bp, Homo sapiens
ctctttttcagccttaccaaag

SEQ ID NO: 7283814 - DNA, 22 bp, Homo sapiens
ctgccctgggttttatgggagt

SEQ ID NO: 7283815 - DNA, 22 bp, Homo sapiens
ctgccatgcagttagtccctca

SEQ ID NO: 7283816 - DNA, 22 bp, Homo sapiens
ctgccctggggggcctccttgc

SEQ ID NO: 7283817 - DNA, 22 bp, Homo sapiens
ctgccctgggtgctggggatcc

SEQ ID NO: 7283818 - DNA, 22 bp, Homo sapiens
ctgccatcctcaccagagcagc

SEQ ID NO: 7283819 - DNA, 22 bp, Homo sapiens
ctgcctccaggctcaccttgac

SEQ ID NO: 7283820 - DNA, 22 bp, Homo sapiens
ctgcctctataggagtccacca

SEQ ID NO: 7283821 - DNA, 22 bp, Homo sapiens
ctgaggagaaagatggtccaag

SEQ ID NO: 7283822 - DNA, 22 bp, Homo sapiens
ctgcaaaagtaattgcaggttt

SEQ ID NO: 7283823 - DNA, 22 bp, Homo sapiens
ctgcaaaagtcattgtggtttt

SEQ ID NO: 7283824 - DNA, 22 bp, Homo sapiens
ctgcaaaagtaattggggcttt

SEQ ID NO: 7283825 - DNA, 22 bp, Homo sapiens
ctgattaattagctataaaact

SEQ ID NO: 7283826 - DNA, 22 bp, Homo sapiens
ctgcctgctcaccagggctctg

SEQ ID NO: 7283827 - DNA, 22 bp, Homo sapiens
ctgcctggatgaatggcgcctt

SEQ ID NO: 7283828 - DNA, 17 bp, Homo sapiens
ctgcctggagtcccatc

SEQ ID NO: 7283829 - DNA, 22 bp, Homo sapiens
ctgcctggcccagggatgggcc

SEQ ID NO: 7283830 - DNA, 18 bp, Homo sapiens
ctggagtcacagtgggga

SEQ ID NO: 7283831 - DNA, 21 bp, Homo sapiens
ctggagtcattttctgagtag

SEQ ID NO: 7283832 - DNA, 22 bp, Homo sapiens
ctggacagtgggcagaggagac

SEQ ID NO: 7283833 - DNA, 22 bp, Homo sapiens
ctggctctgtgggacctggcct

SEQ ID NO: 7283834 - DNA, 22 bp, Homo sapiens
ctggcccttctcttgcttcctg

SEQ ID NO: 7283835 - DNA, 22 bp, Homo sapiens
ctggcctggcaggggacctcta

SEQ ID NO: 7283836 - DNA, 22 bp, Homo sapiens
ctggccagttactgctattggc

SEQ ID NO: 7283837 - DNA, 22 bp, Homo sapiens
ctggcagagttgggtctcaaat

SEQ ID NO: 7283838 - DNA, 22 bp, Homo sapiens
ctggcagagtctgctgtctgca

SEQ ID NO: 7283839 - DNA, 22 bp, Homo sapiens
ctggcagaggatggggacccag

SEQ ID NO: 7283840 - DNA, 22 bp, Homo sapiens
ctggcagatagccacgcctgtc

SEQ ID NO: 7283841 - DNA, 22 bp, Homo sapiens
ctggccaggctctcacgtggtc

SEQ ID NO: 7283842 - DNA, 22 bp, Homo sapiens
ctggcatgccttgggtgcctct

SEQ ID NO: 7283843 - DNA, 20 bp, Homo sapiens
tgcctgggaaggcgtggagg

SEQ ID NO: 7283844 - DNA, 22 bp, Homo sapiens
tgctgagagccagggctggcat

SEQ ID NO: 7283845 - DNA, 22 bp, Homo sapiens
cccccaccgtgttcctgctcgg

SEQ ID NO: 7283846 - DNA, 22 bp, Homo sapiens
ccccagccttccatgggaattg

SEQ ID NO: 7283847 - DNA, 22 bp, Homo sapiens
cccagcctttgcttcctggttc

SEQ ID NO: 7283848 - DNA, 22 bp, Homo sapiens
tgcattattcttttttggtagg

SEQ ID NO: 7283849 - DNA, 22 bp, Homo sapiens
tggcagcacggcatccactctc

SEQ ID NO: 7283850 - DNA, 22 bp, Homo sapiens
tggcagatttaacattggaact

SEQ ID NO: 7283851 - DNA, 22 bp, Homo sapiens
tggcagattttctctggaggag

SEQ ID NO: 7283852 - DNA, 22 bp, Homo sapiens
tggcagatgtatatcacagctt

SEQ ID NO: 7283853 - DNA, 22 bp, Homo sapiens
tggcagatggcctggaaccaaa

SEQ ID NO: 7283854 - DNA, 22 bp, Homo sapiens
tggcagatgagccgcgctccaa

SEQ ID NO: 7283855 - DNA, 22 bp, Homo sapiens
tggcagcttgaatgcagtcttt

SEQ ID NO: 7283856 - DNA, 22 bp, Homo sapiens
tggcagctgtctgtggggtctc

SEQ ID NO: 7283857 - DNA, 22 bp, Homo sapiens
ccctggctctgcctcagagccc

SEQ ID NO: 7283858 - DNA, 17 bp, Homo sapiens
ccctggctctaggtgga

SEQ ID NO: 7283859 - DNA, 22 bp, Homo sapiens
ccctccagggagccatgctggg

SEQ ID NO: 7283860 - DNA, 22 bp, Homo sapiens
tggcccagtgcttatgctctga

SEQ ID NO: 7283861 - DNA, 22 bp, Homo sapiens
tggccctgctggacacgcctgc

SEQ ID NO: 7283862 - DNA, 22 bp, Homo sapiens
tggccctgctatgatcctgcaa

SEQ ID NO: 7283863 - DNA, 22 bp, Homo sapiens
tggccccccagagctggaggac

SEQ ID NO: 7283864 - DNA, 22 bp, Homo sapiens
tggctcagtttctgcccagctg

SEQ ID NO: 7283865 - DNA, 22 bp, Homo sapiens
tggctcagtttcagtcctggtt

SEQ ID NO: 7283866 - DNA, 22 bp, Homo sapiens
tggccctgctgggtcagagctg

SEQ ID NO: 7283867 - DNA, 22 bp, Homo sapiens
tggccctgcttatgtctctctt

SEQ ID NO: 7283868 - DNA, 22 bp, Homo sapiens
tggccctgctgtatcatctgct

SEQ ID NO: 7283869 - DNA, 22 bp, Homo sapiens
tggctcagtttagcagctcagt

SEQ ID NO: 7283870 - DNA, 22 bp, Homo sapiens
tggctcagctgtcacagcctgg

SEQ ID NO: 7283871 - DNA, 22 bp, Homo sapiens
cctcctctggtgctgccaaccc

SEQ ID NO: 7283872 - DNA, 23 bp, Homo sapiens
cctctccagacactgggccttgt

SEQ ID NO: 7283873 - DNA, 22 bp, Homo sapiens
cctctccagcggcctcagggcc

SEQ ID NO: 7283874 - DNA, 22 bp, Homo sapiens
cctctcagcgattcctcttgga

SEQ ID NO: 7283875 - DNA, 22 bp, Homo sapiens
cctctcagtattgaactttata

SEQ ID NO: 7283876 - DNA, 22 bp, Homo sapiens
cctctcagccggactgtcaggc

SEQ ID NO: 7283877 - DNA, 22 bp, Homo sapiens
cctctacttaccactcagccag

SEQ ID NO: 7283878 - DNA, 20 bp, Homo sapiens
cctctctgcatgctccctga

SEQ ID NO: 7283879 - DNA, 22 bp, Homo sapiens
cctctctgtcacaccagtggcc

SEQ ID NO: 7283880 - DNA, 20 bp, Homo sapiens
cctctctgccctgcaaggcc

SEQ ID NO: 7283881 - DNA, 22 bp, Homo sapiens
cctctgagcctgtgtgcggcac

SEQ ID NO: 7283882 - DNA, 22 bp, Homo sapiens
cctctgggtatctgtggaagta

SEQ ID NO: 7283883 - DNA, 22 bp, Homo sapiens
cctctgggggtcctcagagtct

SEQ ID NO: 7283884 - DNA, 22 bp, Homo sapiens
cctgggagctgtggaaaggctg

SEQ ID NO: 7283885 - DNA, 22 bp, Homo sapiens
cctgggcatcaacaagcagaga

SEQ ID NO: 7283886 - DNA, 21 bp, Homo sapiens
cctgggccaaattccctggac

SEQ ID NO: 7283887 - DNA, 22 bp, Homo sapiens
tgtggggctgtggtgttcttct

SEQ ID NO: 7283888 - DNA, 22 bp, Homo sapiens
tgtggggcttacaaaggcagat

SEQ ID NO: 7283889 - DNA, 22 bp, Homo sapiens
tgtggggcagctagccggcctg

SEQ ID NO: 7283890 - DNA, 22 bp, Homo sapiens
tgtggggccaaagcccagccac

SEQ ID NO: 7283891 - DNA, 22 bp, Homo sapiens
tgtggggcctcgtgctagctgg

SEQ ID NO: 7283892 - DNA, 22 bp, Homo sapiens
tgtggggctccctggcagcctg

SEQ ID NO: 7283893 - DNA, 22 bp, Homo sapiens
tgtggggctgtcaggcaactgg

SEQ ID NO: 7283894 - DNA, 22 bp, Homo sapiens
cctgggcctcacccagctcttg

SEQ ID NO: 7283895 - DNA, 20 bp, Homo sapiens
cctgggctcaaagcatcctc

SEQ ID NO: 7283896 - DNA, 22 bp, Homo sapiens
cctgggctttgctggcaaggcc

SEQ ID NO: 7283897 - DNA, 22 bp, Homo sapiens
cctgggctcaagcgatcttgtc

SEQ ID NO: 7283898 - DNA, 22 bp, Homo sapiens
cctgggctcaagtgatcctcct

SEQ ID NO: 7283899 - DNA, 22 bp, Homo sapiens
tgtgttcatttctctctgctgt

SEQ ID NO: 7283900 - DNA, 22 bp, Homo sapiens
tgtgttctcctacagataagga

SEQ ID NO: 7283901 - DNA, 23 bp, Homo sapiens
cctggctgtggatttgggcctgc

SEQ ID NO: 7283902 - DNA, 22 bp, Homo sapiens
cctggctgtgcattgccggccc

SEQ ID NO: 7283903 - DNA, 19 bp, Homo sapiens
cctggctgtgaagcctgca

SEQ ID NO: 7283904 - DNA, 22 bp, Homo sapiens
cctggctgccgagtgtgcagcg

SEQ ID NO: 7283905 - DNA, 22 bp, Homo sapiens
cctggctgctatagcagcatgt

SEQ ID NO: 7283906 - DNA, 22 bp, Homo sapiens
cctggctgcccatggaccctct

SEQ ID NO: 7283907 - DNA, 22 bp, Homo sapiens
cctggctgcattttgctggatg

SEQ ID NO: 7283908 - DNA, 22 bp, Homo sapiens
cctggctgtttgagcggggaat

SEQ ID NO: 7283909 - DNA, 22 bp, Homo sapiens
cctggctgtgtgaccttggcaa

SEQ ID NO: 7283910 - DNA, 22 bp, Homo sapiens
cctggctgtggcggtgctctca

SEQ ID NO: 7283911 - DNA, 22 bp, Homo sapiens
tgtgcccatccctctggagtgt

SEQ ID NO: 7283912 - DNA, 22 bp, Homo sapiens
tgtgcccattccacttgagtac

SEQ ID NO: 7283913 - DNA, 22 bp, Homo sapiens
cctggctgagggacctcgggta

SEQ ID NO: 7283914 - DNA, 21 bp, Homo sapiens
cctggctgcacagttgctggt

SEQ ID NO: 7283915 - DNA, 22 bp, Homo sapiens
cctggctgaacaaagtccctcc

SEQ ID NO: 7283916 - DNA, 23 bp, Homo sapiens
cctggctgacctgaaggtgtagt

SEQ ID NO: 7283917 - DNA, 22 bp, Homo sapiens
cctggctgcagtttttgcagaa

SEQ ID NO: 7283918 - DNA, 22 bp, Homo sapiens
tgtctcttgagtttgttttaat

SEQ ID NO: 7283919 - DNA, 22 bp, Homo sapiens
tgtctcttactttgattcttgg

SEQ ID NO: 7283920 - DNA, 22 bp, Homo sapiens
tgtcctggagacacaaggtggt

SEQ ID NO: 7283921 - DNA, 22 bp, Homo sapiens
cctggcctcgtgctcacggctc

SEQ ID NO: 7283922 - DNA, 22 bp, Homo sapiens
cctggcctctccgagtaacctg

SEQ ID NO: 7283923 - DNA, 22 bp, Homo sapiens
cctggcctgtgaatctgagagc

SEQ ID NO: 7283924 - DNA, 22 bp, Homo sapiens
cctggccttaagggcagggagc

SEQ ID NO: 7283925 - DNA, 22 bp, Homo sapiens
cctggctctagaggccactcct

SEQ ID NO: 7283926 - DNA, 22 bp, Homo sapiens
cctggcagactgtgagggcagg

SEQ ID NO: 7283927 - DNA, 23 bp, Homo sapiens
cctggcagcaaacgaggaggtta

SEQ ID NO: 7283928 - DNA, 22 bp, Homo sapiens
cctggcagcagcacatgccttc

SEQ ID NO: 7283929 - DNA, 18 bp, Homo sapiens
cctggcagccatgcgcgc

SEQ ID NO: 7283930 - DNA, 22 bp, Homo sapiens
cctggcaggcaagaggaaggga

SEQ ID NO: 7283931 - DNA, 20 bp, Homo sapiens
cctggcaggcgggttactta

SEQ ID NO: 7283932 - DNA, 22 bp, Homo sapiens
cctggcaggctggggacagtgc

SEQ ID NO: 7283933 - DNA, 22 bp, Homo sapiens
cctggcaggctggggacagtgc

SEQ ID NO: 7283934 - DNA, 22 bp, Homo sapiens
cctggcagtcaggggagtcctt

SEQ ID NO: 7283935 - DNA, 22 bp, Homo sapiens
cctggcaggttacaaccagtta

SEQ ID NO: 7283936 - DNA, 22 bp, Homo sapiens
cctggcaggtggaggttgcagt

SEQ ID NO: 7283937 - DNA, 22 bp, Homo sapiens
cctggcaggtggcgccctcggc

SEQ ID NO: 7283938 - DNA, 22 bp, Homo sapiens
cctggcaggtggcgccctcggc

SEQ ID NO: 7283939 - DNA, 22 bp, Homo sapiens
cctggcccacatggcttctccc

SEQ ID NO: 7283940 - DNA, 22 bp, Homo sapiens
cctggccagggtctgggctgct

SEQ ID NO: 7283941 - DNA, 22 bp, Homo sapiens
cctggccagctaattgcccatc

SEQ ID NO: 7283942 - DNA, 22 bp, Homo sapiens
cctggcagtggtgaagaagagg

SEQ ID NO: 7283943 - DNA, 22 bp, Homo sapiens
cctggcagttcatcaaatggca

SEQ ID NO: 7283944 - DNA, 22 bp, Homo sapiens
cctgccatgccagcatgcccgt

SEQ ID NO: 7283945 - DNA, 22 bp, Homo sapiens
cctggactcaggctgtgggcac

SEQ ID NO: 7283946 - DNA, 22 bp, Homo sapiens
cctggactgtgtcctgtggtca

SEQ ID NO: 7283947 - DNA, 22 bp, Homo sapiens
tgtcatggcactagagtggggt

SEQ ID NO: 7283948 - DNA, 22 bp, Homo sapiens
tgtcatggctgaaagtgggggc

SEQ ID NO: 7283949 - DNA, 22 bp, Homo sapiens
tgtcatggcgttgtggggacta

SEQ ID NO: 7283950 - DNA, 22 bp, Homo sapiens
tgtcatggtagctgaaggatgt

SEQ ID NO: 7283951 - DNA, 22 bp, Homo sapiens
tgtcatggtctgtaaggagccc

SEQ ID NO: 7283952 - DNA, 22 bp, Homo sapiens
cctggcagactgtgagggcagg

SEQ ID NO: 7283953 - DNA, 22 bp, Homo sapiens
cctggcagacagcactgaagct

SEQ ID NO: 7283954 - DNA, 22 bp, Homo sapiens
cctggcagaatattaaagtgca

SEQ ID NO: 7283955 - DNA, 22 bp, Homo sapiens
cctggcagaatattaaagtgca

SEQ ID NO: 7283956 - DNA, 21 bp, Homo sapiens
cctggcagaagcctgatatgc

SEQ ID NO: 7283957 - DNA, 21 bp, Homo sapiens
cctggcactggcctgctgagc

SEQ ID NO: 7283958 - DNA, 22 bp, Homo sapiens
cctggcacatgcagtactcaag

SEQ ID NO: 7283959 - DNA, 22 bp, Homo sapiens
cctggcaccttcacagactact

SEQ ID NO: 7283960 - DNA, 20 bp, Homo sapiens
tgtaggtgtacagtaaggag

SEQ ID NO: 7283961 - DNA, 22 bp, Homo sapiens
gagacacaagaagacatgcaca

SEQ ID NO: 7283962 - DNA, 22 bp, Homo sapiens
gagacagagaggtactcaacat

SEQ ID NO: 7283963 - DNA, 22 bp, Homo sapiens
gagacacaggtggttcctgtca

SEQ ID NO: 7283964 - DNA, 22 bp, Homo sapiens
gagacacaggcacagaagaggc

SEQ ID NO: 7283965 - DNA, 22 bp, Homo sapiens
gagacacagcagatattcaatc

SEQ ID NO: 7283966 - DNA, 22 bp, Homo sapiens
gagacacaagacgcaactctgt

SEQ ID NO: 7283967 - DNA, 18 bp, Homo sapiens
gagacacaagggcctgga

SEQ ID NO: 7283968 - DNA, 22 bp, Homo sapiens
gagacacaatctcatttacatt

SEQ ID NO: 7283969 - DNA, 22 bp, Homo sapiens
gagacacacattctggagagaa

SEQ ID NO: 7283970 - DNA, 22 bp, Homo sapiens
gagacacacacaggaggtggca

SEQ ID NO: 7283971 - DNA, 22 bp, Homo sapiens
gagagcccttaggtttagagtt

SEQ ID NO: 7283972 - DNA, 22 bp, Homo sapiens
gagagctgatagatgagctact

SEQ ID NO: 7283973 - DNA, 22 bp, Homo sapiens
gagagctgaggggcctggcact

SEQ ID NO: 7283974 - DNA, 22 bp, Homo sapiens
gagagctgcattctcagacaca

SEQ ID NO: 7283975 - DNA, 20 bp, Homo sapiens
gagagctggggatgaggctg

SEQ ID NO: 7283976 - DNA, 22 bp, Homo sapiens
gagagctgggttcaagtagctg

SEQ ID NO: 7283977 - DNA, 22 bp, Homo sapiens
gactttaagtcctatctgtgcg

SEQ ID NO: 7283978 - DNA, 22 bp, Homo sapiens
gactttaaaatgctagaacagg

SEQ ID NO: 7283979 - DNA, 22 bp, Homo sapiens
gacttgggtgtcggggcagtct

SEQ ID NO: 7283980 - DNA, 22 bp, Homo sapiens
gacccaggctcgtgggacggct

SEQ ID NO: 7283981 - DNA, 18 bp, Homo sapiens
gacccaggaaagagtcct

SEQ ID NO: 7283982 - DNA, 22 bp, Homo sapiens
gaattgggggttttgcaaggca

SEQ ID NO: 7283983 - DNA, 22 bp, Homo sapiens
gaaggctgcgaggggagtgccg

SEQ ID NO: 7283984 - DNA, 21 bp, Homo sapiens
ctttggtttcctcctgccttc

SEQ ID NO: 7283985 - DNA, 22 bp, Homo sapiens
ctttggttctgtccttcccaga

SEQ ID NO: 7283986 - DNA, 22 bp, Homo sapiens
cttgggatgtaacctttgttcc

SEQ ID NO: 7283987 - DNA, 22 bp, Homo sapiens
cttgggatttgagatctggata

SEQ ID NO: 7283988 - DNA, 22 bp, Homo sapiens
cttgaaaataagaaagactttc

SEQ ID NO: 7283989 - DNA, 22 bp, Homo sapiens
cttgaaaaatatgccttgcttc

SEQ ID NO: 7283990 - DNA, 22 bp, Homo sapiens
cttctttgaaaaaggcagtcag

SEQ ID NO: 7283991 - DNA, 22 bp, Homo sapiens
cttctcttggtagttcttgttg

SEQ ID NO: 7283992 - DNA, 22 bp, Homo sapiens
cttctcttcctttgtcaactga

SEQ ID NO: 7283993 - DNA, 22 bp, Homo sapiens
cttctccagccacgcccactcc

SEQ ID NO: 7283994 - DNA, 22 bp, Homo sapiens
cttctctccctggcactcagac

SEQ ID NO: 7283995 - DNA, 22 bp, Homo sapiens
cttctctcggtgcatccctcac

SEQ ID NO: 7283996 - DNA, 22 bp, Homo sapiens
ctggctggagtgcaggtgagtg

SEQ ID NO: 7283997 - DNA, 22 bp, Homo sapiens
ctggctgggcagacagaatgct

SEQ ID NO: 7283998 - DNA, 22 bp, Homo sapiens
gaacacagtttagaaaatgctg

SEQ ID NO: 7283999 - DNA, 22 bp, Homo sapiens
gaaatacaaagccagccatttt

SEQ ID NO: 7284000 - DNA, 22 bp, Homo sapiens
gaaataacctcatgcaccatga

SEQ ID NO: 7284001 - DNA, 22 bp, Homo sapiens
gaacagaattaccgaagatctg

SEQ ID NO: 7284002 - DNA, 22 bp, Homo sapiens
gaactacaggtgcagcaagtga

SEQ ID NO: 7284003 - DNA, 22 bp, Homo sapiens
gaaaatacttcagtgttctggc

SEQ ID NO: 7284004 - DNA, 22 bp, Homo sapiens
gaaaggcagtacagctgagcct

SEQ ID NO: 7284005 - DNA, 21 bp, Homo sapiens
gaaaatacaatgagcttgacc

SEQ ID NO: 7284006 - DNA, 22 bp, Homo sapiens
gaaaatacaaatagccttgaaa

SEQ ID NO: 7284007 - DNA, 22 bp, Homo sapiens
cttttacactcatctgggaggg

SEQ ID NO: 7284008 - DNA, 22 bp, Homo sapiens
gaaaaggattggtaaaatatct

SEQ ID NO: 7284009 - DNA, 22 bp, Homo sapiens
gaaaagggcaagagagagggca

SEQ ID NO: 7284010 - DNA, 21 bp, Homo sapiens
gaaaagcaagggagtagaaca

SEQ ID NO: 7284011 - DNA, 22 bp, Homo sapiens
gagtgtggtatgctctgaggct

SEQ ID NO: 7284012 - DNA, 22 bp, Homo sapiens
gagtgtgggggtgctgaggaca

SEQ ID NO: 7284013 - DNA, 18 bp, Homo sapiens
gagtgtggcactgggccc

SEQ ID NO: 7284014 - DNA, 22 bp, Homo sapiens
gataaaataactatggaatact

SEQ ID NO: 7284015 - DNA, 22 bp, Homo sapiens
gatgagaaatggacaggagtgg

SEQ ID NO: 7284016 - DNA, 22 bp, Homo sapiens
gatcttttcagtcttggtagtt

SEQ ID NO: 7284017 - DNA, 22 bp, Homo sapiens
gatcttttcaggtttctctagt

SEQ ID NO: 7284018 - DNA, 22 bp, Homo sapiens
gatcttttcagaatttatcagt

SEQ ID NO: 7284019 - DNA, 22 bp, Homo sapiens
gatcaccagttgtaggtatttt

SEQ ID NO: 7284020 - DNA, 22 bp, Homo sapiens
gaggggcaatgagggaaagagt

SEQ ID NO: 7284021 - DNA, 22 bp, Homo sapiens
gagggcagtagcctcgtaccct

SEQ ID NO: 7284022 - DNA, 22 bp, Homo sapiens
gagggcaggggtcttgcacggt

SEQ ID NO: 7284023 - DNA, 22 bp, Homo sapiens
gagggcagtgaattttgaagct

SEQ ID NO: 7284024 - DNA, 16 bp, Homo sapiens
gagggcagaggcggaa

SEQ ID NO: 7284025 - DNA, 22 bp, Homo sapiens
gagggcagagtctaatgatgca

SEQ ID NO: 7284026 - DNA, 22 bp, Homo sapiens
gaggctgggaagtccaagatca

SEQ ID NO: 7284027 - DNA, 22 bp, Homo sapiens
gaggctgggaagtccaagacca

SEQ ID NO: 7284028 - DNA, 22 bp, Homo sapiens
gaggctgggaagtccaagacca

SEQ ID NO: 7284029 - DNA, 22 bp, Homo sapiens
gaggctgggaagtccaatatca

SEQ ID NO: 7284030 - DNA, 22 bp, Homo sapiens
gaggctgggggctgccttcctc

SEQ ID NO: 7284031 - DNA, 22 bp, Homo sapiens
gaggctggagatattccaatct

SEQ ID NO: 7284032 - DNA, 22 bp, Homo sapiens
gaggctggaggtcaaagatgaa

SEQ ID NO: 7284033 - DNA, 16 bp, Homo sapiens
gaggctggcagatgtc

SEQ ID NO: 7284034 - DNA, 22 bp, Homo sapiens
gaggctggcagaaaagcacagg

SEQ ID NO: 7284035 - DNA, 22 bp, Homo sapiens
gaggctggcagaaaagcacagg

SEQ ID NO: 7284036 - DNA, 22 bp, Homo sapiens
gaggctggaatattagaaatgt

SEQ ID NO: 7284037 - DNA, 22 bp, Homo sapiens
gaggctggacgtgcatttctac

SEQ ID NO: 7284038 - DNA, 22 bp, Homo sapiens
gaggctggacgtgcatttctac

SEQ ID NO: 7284039 - DNA, 22 bp, Homo sapiens
gaggtaggtgtaggaggcctgc

SEQ ID NO: 7284040 - DNA, 22 bp, Homo sapiens
gaggggccggcatgtgcctctc

SEQ ID NO: 7284041 - DNA, 22 bp, Homo sapiens
gaggtgggcggatcacaaggtc

SEQ ID NO: 7284042 - DNA, 22 bp, Homo sapiens
gaggtgggcggatcacaaggtc

SEQ ID NO: 7284043 - DNA, 22 bp, Homo sapiens
gaggtgggatgtgtgtgctact

SEQ ID NO: 7284044 - DNA, 22 bp, Homo sapiens
gaggtgtcccgcagtccccaag

SEQ ID NO: 7284045 - DNA, 19 bp, Homo sapiens
gaggtgggtccccgcagcc

SEQ ID NO: 7284046 - DNA, 22 bp, Homo sapiens
gaggtggggttttgttcttgaa

SEQ ID NO: 7284047 - DNA, 19 bp, Homo sapiens
gaggtgggtccccgcagcc

SEQ ID NO: 7284048 - DNA, 22 bp, Homo sapiens
gaggtgggtgtatcacaggtca

SEQ ID NO: 7284049 - DNA, 22 bp, Homo sapiens
gaggtgggtgtatcacaggtca

SEQ ID NO: 7284050 - DNA, 19 bp, Homo sapiens
gaggaggcttcagctttct

SEQ ID NO: 7284051 - DNA, 22 bp, Homo sapiens
gaggaggctgtttctctgcatt

SEQ ID NO: 7284052 - DNA, 22 bp, Homo sapiens
gaggagggagctggaagctctt

SEQ ID NO: 7284053 - DNA, 22 bp, Homo sapiens
gaggcagagtcacaaagagtct

SEQ ID NO: 7284054 - DNA, 22 bp, Homo sapiens
gaggcagaggttgttgcagtga

SEQ ID NO: 7284055 - DNA, 22 bp, Homo sapiens
gaggcagagtgcaccccaggag

SEQ ID NO: 7284056 - DNA, 22 bp, Homo sapiens
gaggaggtcgctgctgagcccc

SEQ ID NO: 7284057 - DNA, 22 bp, Homo sapiens
gaggcagcagggctggttcctt

SEQ ID NO: 7284058 - DNA, 22 bp, Homo sapiens
gaggcagctgggctggtggttt

SEQ ID NO: 7284059 - DNA, 22 bp, Homo sapiens
gaggccctccagctgtcagctg

SEQ ID NO: 7284060 - DNA, 22 bp, Homo sapiens
gaggaatgtcagcacaggcctc

SEQ ID NO: 7284061 - DNA, 22 bp, Homo sapiens
gaggaatgttattaaaggagct

SEQ ID NO: 7284062 - DNA, 21 bp, Homo sapiens
gaggaatggtttgcaaagcac

SEQ ID NO: 7284063 - DNA, 22 bp, Homo sapiens
gaggaatgggtgtctcgtgatt

SEQ ID NO: 7284064 - DNA, 22 bp, Homo sapiens
gagagtgtctggaggaagctaa

SEQ ID NO: 7284065 - DNA, 22 bp, Homo sapiens
gagctggcagtggtagacatgg

SEQ ID NO: 7284066 - DNA, 22 bp, Homo sapiens
gagctggccgcagagagggcag

SEQ ID NO: 7284067 - DNA, 22 bp, Homo sapiens
gagctggcaagtctgtccttgg

SEQ ID NO: 7284068 - DNA, 22 bp, Homo sapiens
gattaaaaataacccatgctga

SEQ ID NO: 7284069 - DNA, 22 bp, Homo sapiens
gatgtgtttccaggatttgttt

SEQ ID NO: 7284070 - DNA, 22 bp, Homo sapiens
gatgttaagaaggaattgaagt

SEQ ID NO: 7284071 - DNA, 22 bp, Homo sapiens
gatttacagatctaagggtcac

SEQ ID NO: 7284072 - DNA, 22 bp, Homo sapiens
gatttacaaagctctctagtgt

SEQ ID NO: 7284073 - DNA, 22 bp, Homo sapiens
gatggcctgggtccccttccgg

SEQ ID NO: 7284074 - DNA, 22 bp, Homo sapiens
gatgggctgtctgagcgctgtg

SEQ ID NO: 7284075 - DNA, 22 bp, Homo sapiens
gatgcctgcatttcaggagagt

SEQ ID NO: 7284076 - DNA, 22 bp, Homo sapiens
gatgcccaggcccaaccatgga

SEQ ID NO: 7284077 - DNA, 22 bp, Homo sapiens
gatgctgggaccacagagtgtt

SEQ ID NO: 7284078 - DNA, 22 bp, Homo sapiens
gatgtagacacttggaggctta

SEQ ID NO: 7284079 - DNA, 18 bp, Homo sapiens
gatgggtaaaggcataaa

SEQ ID NO: 7284080 - DNA, 22 bp, Homo sapiens
gatgggtactcgttggactgag

SEQ ID NO: 7284081 - DNA, 22 bp, Homo sapiens
gcacccctggacggtagggcca

SEQ ID NO: 7284082 - DNA, 22 bp, Homo sapiens
gcacccctcagcttgtttacta

SEQ ID NO: 7284083 - DNA, 22 bp, Homo sapiens
gcacccctgcgtgccttccctt

SEQ ID NO: 7284084 - DNA, 22 bp, Homo sapiens
gcagagcccctcaagccagcct

SEQ ID NO: 7284085 - DNA, 22 bp, Homo sapiens
gcagagccagaatggccaggac

SEQ ID NO: 7284086 - DNA, 22 bp, Homo sapiens
gcagagccaggctggggcaggt

SEQ ID NO: 7284087 - DNA, 22 bp, Homo sapiens
gcagagccaggagcccaggatc

SEQ ID NO: 7284088 - DNA, 22 bp, Homo sapiens
gcagaaggatccgcaggtgcaa

SEQ ID NO: 7284089 - DNA, 17 bp, Homo sapiens
gcagaaaagtcaaggga

SEQ ID NO: 7284090 - DNA, 22 bp, Homo sapiens
gcagaaatatgatgcataaagg

SEQ ID NO: 7284091 - DNA, 22 bp, Homo sapiens
gattttactgtctgtgtatctc

SEQ ID NO: 7284092 - DNA, 22 bp, Homo sapiens
gattttacatgtcatatctatt

SEQ ID NO: 7284093 - DNA, 22 bp, Homo sapiens
gattttacaaactgcaggaccc

SEQ ID NO: 7284094 - DNA, 22 bp, Homo sapiens
gcacaaaaggtacttcatgtag

SEQ ID NO: 7284095 - DNA, 22 bp, Homo sapiens
gatttttcagtataaaatatat

SEQ ID NO: 7284096 - DNA, 21 bp, Homo sapiens
gcaggcactctagaggagctg

SEQ ID NO: 7284097 - DNA, 22 bp, Homo sapiens
gcaggcactcctaggaccatca

SEQ ID NO: 7284098 - DNA, 17 bp, Homo sapiens
gcaggcactgctgcctg

SEQ ID NO: 7284099 - DNA, 22 bp, Homo sapiens
gcaggcagaggtggaggagaca

SEQ ID NO: 7284100 - DNA, 22 bp, Homo sapiens
gcagggcagagggagaatctct

SEQ ID NO: 7284101 - DNA, 22 bp, Homo sapiens
gcagggcagacctccagcctat

SEQ ID NO: 7284102 - DNA, 22 bp, Homo sapiens
gcagggcacagacagtgccaag

SEQ ID NO: 7284103 - DNA, 22 bp, Homo sapiens
gcagggcagaaggtgctgagga

SEQ ID NO: 7284104 - DNA, 22 bp, Homo sapiens
gcagggcaaatgtggaaaggag

SEQ ID NO: 7284105 - DNA, 20 bp, Homo sapiens
gcagggcaagggatatgaaa

SEQ ID NO: 7284106 - DNA, 22 bp, Homo sapiens
gcagggcacaaggacgcacagg

SEQ ID NO: 7284107 - DNA, 21 bp, Homo sapiens
gcaggggatagaaatggtctg

SEQ ID NO: 7284108 - DNA, 22 bp, Homo sapiens
gcagggcagccacaggccccct

SEQ ID NO: 7284109 - DNA, 22 bp, Homo sapiens
gcaggggctactctgagcttcc

SEQ ID NO: 7284110 - DNA, 22 bp, Homo sapiens
gcaggagaacaaagcaagctgc

SEQ ID NO: 7284111 - DNA, 22 bp, Homo sapiens
gcaggagctcgtttccaggctg

SEQ ID NO: 7284112 - DNA, 22 bp, Homo sapiens
gcaggagctgctctcctgacga

SEQ ID NO: 7284113 - DNA, 22 bp, Homo sapiens
gcaggcaccacggctcaggtct

SEQ ID NO: 7284114 - DNA, 21 bp, Homo sapiens
gcagagccggggcgagaaggc

SEQ ID NO: 7284115 - DNA, 22 bp, Homo sapiens
gccagatgccgtaaagatgggc

SEQ ID NO: 7284116 - DNA, 20 bp, Homo sapiens
gccagaggccggcaggggct

SEQ ID NO: 7284117 - DNA, 22 bp, Homo sapiens
gccagcagggaagccttgggct

SEQ ID NO: 7284118 - DNA, 22 bp, Homo sapiens
gccagcagctcttgggcgggca

SEQ ID NO: 7284119 - DNA, 22 bp, Homo sapiens
gcatgtggcccaaggaggctgt

SEQ ID NO: 7284120 - DNA, 22 bp, Homo sapiens
gcatgggcaccagtctctaggt

SEQ ID NO: 7284121 - DNA, 22 bp, Homo sapiens
gcatgggcaagaggactggggg

SEQ ID NO: 7284122 - DNA, 22 bp, Homo sapiens
gcagtgggcaacaagagctgga

SEQ ID NO: 7284123 - DNA, 22 bp, Homo sapiens
gcagtggggcgctgggagttgg

SEQ ID NO: 7284124 - DNA, 22 bp, Homo sapiens
gcagtggggaatgctggggaga

SEQ ID NO: 7284125 - DNA, 22 bp, Homo sapiens
gcagtgggcctgaggaagggtg

SEQ ID NO: 7284126 - DNA, 23 bp, Homo sapiens
gcaggtggttcgaacagaagttt

SEQ ID NO: 7284127 - DNA, 22 bp, Homo sapiens
gcaggtggtgggggagccgttc

SEQ ID NO: 7284128 - DNA, 22 bp, Homo sapiens
gcaggtggtccccgtggagtgg

SEQ ID NO: 7284129 - DNA, 22 bp, Homo sapiens
gcaggtggtccccgtggagtgg

SEQ ID NO: 7284130 - DNA, 22 bp, Homo sapiens
gcaggtgggggtcggtgcatct

SEQ ID NO: 7284131 - DNA, 22 bp, Homo sapiens
gcagggtgatagtgaggctcag

SEQ ID NO: 7284132 - DNA, 22 bp, Homo sapiens
gcaggtggaagcagcagactca

SEQ ID NO: 7284133 - DNA, 19 bp, Homo sapiens
gcagggtggcagagctctt

SEQ ID NO: 7284134 - DNA, 22 bp, Homo sapiens
gcaggtggattatcagaagtgc

SEQ ID NO: 7284135 - DNA, 19 bp, Homo sapiens
gcaggtggatgtggtcagc

SEQ ID NO: 7284136 - DNA, 22 bp, Homo sapiens
gcaggtggcagaggtgggatct

SEQ ID NO: 7284137 - DNA, 22 bp, Homo sapiens
gcaggtggcagaggtgggatct

SEQ ID NO: 7284138 - DNA, 22 bp, Homo sapiens
gcaggtgggagccgctgcctga

SEQ ID NO: 7284139 - DNA, 22 bp, Homo sapiens
gccctcgcttcttcctaggggt

SEQ ID NO: 7284140 - DNA, 22 bp, Homo sapiens
gccctttcttcttctggactgg

SEQ ID NO: 7284141 - DNA, 22 bp, Homo sapiens
gcccttctgctgttaggtagcc

SEQ ID NO: 7284142 - DNA, 22 bp, Homo sapiens
gccggggctggggagagacatg

SEQ ID NO: 7284143 - DNA, 17 bp, Homo sapiens
gccagttgtcttggcat

SEQ ID NO: 7284144 - DNA, 22 bp, Homo sapiens
gccagcagggcccaaatgctgg

SEQ ID NO: 7284145 - DNA, 21 bp, Homo sapiens
gccatttcacacagacatttg

SEQ ID NO: 7284146 - DNA, 22 bp, Homo sapiens
gcctggccgctccgagctccgc

SEQ ID NO: 7284147 - DNA, 22 bp, Homo sapiens
gcctggcattggagccggggca

SEQ ID NO: 7284148 - DNA, 22 bp, Homo sapiens
gcctggcagttgacagtttgct

SEQ ID NO: 7284149 - DNA, 22 bp, Homo sapiens
gcctggcagtgtaattcctgtc

SEQ ID NO: 7284150 - DNA, 22 bp, Homo sapiens
gcctggcaggggcctgggagtg

SEQ ID NO: 7284151 - DNA, 22 bp, Homo sapiens
gcctgtgtctgggtggccagag

SEQ ID NO: 7284152 - DNA, 22 bp, Homo sapiens
gcctgtgtccttcccagtgggg

SEQ ID NO: 7284153 - DNA, 22 bp, Homo sapiens
gcctgtgtgtttagctctgggg

SEQ ID NO: 7284154 - DNA, 22 bp, Homo sapiens
gcctgtgtgtgaggactggctg

SEQ ID NO: 7284155 - DNA, 22 bp, Homo sapiens
gcctgtgtggatgggcccctgg

SEQ ID NO: 7284156 - DNA, 22 bp, Homo sapiens
gcctgtgctttcttccctcctg

SEQ ID NO: 7284157 - DNA, 21 bp, Homo sapiens
gcctgggatagtggcctccgg

SEQ ID NO: 7284158 - DNA, 22 bp, Homo sapiens
gcctgctgttgagggaagagct

SEQ ID NO: 7284159 - DNA, 21 bp, Homo sapiens
gcctgctgttcaccctgccac

SEQ ID NO: 7284160 - DNA, 22 bp, Homo sapiens
gcctgctgttaactgcaggaat

SEQ ID NO: 7284161 - DNA, 23 bp, Homo sapiens
gcctgctgtcacagcgggcccag

SEQ ID NO: 7284162 - DNA, 22 bp, Homo sapiens
gcctgctcagacctagcaggcc

SEQ ID NO: 7284163 - DNA, 22 bp, Homo sapiens
gcctgcctttgtgaggaagcgg

SEQ ID NO: 7284164 - DNA, 22 bp, Homo sapiens
gcctgccttttggaggcacatt

SEQ ID NO: 7284165 - DNA, 22 bp, Homo sapiens
gcctgcctttgtatgaccctga

SEQ ID NO: 7284166 - DNA, 22 bp, Homo sapiens
gcctgccttcggtgcgcagcgg

SEQ ID NO: 7284167 - DNA, 22 bp, Homo sapiens
gcctgcctgttggctgaggtgc

SEQ ID NO: 7284168 - DNA, 22 bp, Homo sapiens
gcctgcctgttggctgaggtgc

SEQ ID NO: 7284169 - DNA, 22 bp, Homo sapiens
gcctgcctgctgtcatctgcct

SEQ ID NO: 7284170 - DNA, 21 bp, Homo sapiens
gcctgcctgcgtgaccctctt

SEQ ID NO: 7284171 - DNA, 22 bp, Homo sapiens
gcctgcctgctgtcatctgcct

SEQ ID NO: 7284172 - DNA, 22 bp, Homo sapiens
gcctgcctgctgtgtgcaagtt

SEQ ID NO: 7284173 - DNA, 22 bp, Homo sapiens
gcctgcctgctgtgtgcaagtt

SEQ ID NO: 7284174 - DNA, 22 bp, Homo sapiens
gcctgcctggagcttgaggtga

SEQ ID NO: 7284175 - DNA, 19 bp, Homo sapiens
gcctgcctgggtttctgag

SEQ ID NO: 7284176 - DNA, 22 bp, Homo sapiens
gcctgcctgaaggctgtaccag

SEQ ID NO: 7284177 - DNA, 23 bp, Homo sapiens
gcctgcctgacctgtgcaaagtc

SEQ ID NO: 7284178 - DNA, 20 bp, Homo sapiens
gcctgcctcagctagctgag

SEQ ID NO: 7284179 - DNA, 20 bp, Homo sapiens
gcctgcctcagctagctgag

SEQ ID NO: 7284180 - DNA, 22 bp, Homo sapiens
gcctgcctcaaaatcccagttc

SEQ ID NO: 7284181 - DNA, 22 bp, Homo sapiens
gctgagccctcatccctagttt

SEQ ID NO: 7284182 - DNA, 22 bp, Homo sapiens
gctgagccacccttgcttccct

SEQ ID NO: 7284183 - DNA, 22 bp, Homo sapiens
gctgggcaatgccagagaggag

SEQ ID NO: 7284184 - DNA, 22 bp, Homo sapiens
gctgggcaggcctcgtgagggc

SEQ ID NO: 7284185 - DNA, 22 bp, Homo sapiens
gctggcctgggcagcctgtcgg

SEQ ID NO: 7284186 - DNA, 22 bp, Homo sapiens
gctggcctgacctgaggctggg

SEQ ID NO: 7284187 - DNA, 22 bp, Homo sapiens
gctcagactctggcctgatgat

SEQ ID NO: 7284188 - DNA, 22 bp, Homo sapiens
gctccagctcgtggctcccagc

SEQ ID NO: 7284189 - DNA, 22 bp, Homo sapiens
gctcctggcaggcagtgtgtgt

SEQ ID NO: 7284190 - DNA, 22 bp, Homo sapiens
gctcctggctctctgagggctg

SEQ ID NO: 7284191 - DNA, 21 bp, Homo sapiens
gctctgccacttaccagattt

SEQ ID NO: 7284192 - DNA, 22 bp, Homo sapiens
gctctgcccaaagctgtggctg

SEQ ID NO: 7284193 - DNA, 22 bp, Homo sapiens
gctctgccagacactgtggcca

SEQ ID NO: 7284194 - DNA, 22 bp, Homo sapiens
gctgagagtgggtgcagtgctt

SEQ ID NO: 7284195 - DNA, 22 bp, Homo sapiens
gctgagagtgtgagatcagatt

SEQ ID NO: 7284196 - DNA, 22 bp, Homo sapiens
gctgagcacacctagggtagag

SEQ ID NO: 7284197 - DNA, 22 bp, Homo sapiens
gggggtggttctaagtcctata

SEQ ID NO: 7284198 - DNA, 20 bp, Homo sapiens
ggggggcttcagggcctgtg

SEQ ID NO: 7284199 - DNA, 19 bp, Homo sapiens
ggggagaactagagacagc

SEQ ID NO: 7284200 - DNA, 22 bp, Homo sapiens
gggtgagacagaaagagcaaaa

SEQ ID NO: 7284201 - DNA, 22 bp, Homo sapiens
gggtgagagtcaggcagagatt

SEQ ID NO: 7284202 - DNA, 22 bp, Homo sapiens
gggtctggacggctgcaggaag

SEQ ID NO: 7284203 - DNA, 22 bp, Homo sapiens
gggtgaggagctgccagtcatg

SEQ ID NO: 7284204 - DNA, 22 bp, Homo sapiens
gggtgggatggcaggagccgct

SEQ ID NO: 7284205 - DNA, 22 bp, Homo sapiens
gggtgggaacaggatgccagga

SEQ ID NO: 7284206 - DNA, 22 bp, Homo sapiens
gggctggcaggacctgggctga

SEQ ID NO: 7284207 - DNA, 22 bp, Homo sapiens
gggctggcatcggttgctgaga

SEQ ID NO: 7284208 - DNA, 22 bp, Homo sapiens
gggctggcatcagttgccgaga

SEQ ID NO: 7284209 - DNA, 22 bp, Homo sapiens
gggctggaccgctcgcctccct

SEQ ID NO: 7284210 - DNA, 22 bp, Homo sapiens
gggctggagcctggcggtggtt

SEQ ID NO: 7284211 - DNA, 22 bp, Homo sapiens
ggggaagggagtccaagtgtta

SEQ ID NO: 7284212 - DNA, 16 bp, Homo sapiens
ggggaaggcaagaggg

SEQ ID NO: 7284213 - DNA, 22 bp, Homo sapiens
gggctctgtgttctagctctcg

SEQ ID NO: 7284214 - DNA, 22 bp, Homo sapiens
gggctctgtggttgtgctttgt

SEQ ID NO: 7284215 - DNA, 22 bp, Homo sapiens
gggctgagacgatggggtcttc

SEQ ID NO: 7284216 - DNA, 22 bp, Homo sapiens
gggctaggcttggccagcactg

SEQ ID NO: 7284217 - DNA, 22 bp, Homo sapiens
gggctctggtacttcctggctc

SEQ ID NO: 7284218 - DNA, 22 bp, Homo sapiens
gggctctggtgccttcacagaa

SEQ ID NO: 7284219 - DNA, 22 bp, Homo sapiens
gggccagttctccgcctctttt

SEQ ID NO: 7284220 - DNA, 22 bp, Homo sapiens
gggccagtagcacctgtgtgga

SEQ ID NO: 7284221 - DNA, 22 bp, Homo sapiens
gggcagctcctgtggaatccac

SEQ ID NO: 7284222 - DNA, 22 bp, Homo sapiens
gggcagctcggaagtgggaaag

SEQ ID NO: 7284223 - DNA, 22 bp, Homo sapiens
gggcagcagagccctgccgagt

SEQ ID NO: 7284224 - DNA, 22 bp, Homo sapiens
gggcagatcacctgaggtcagg

SEQ ID NO: 7284225 - DNA, 22 bp, Homo sapiens
gggcagatggggcacaggctga

SEQ ID NO: 7284226 - DNA, 22 bp, Homo sapiens
gggcagatgtctggacacctca

SEQ ID NO: 7284227 - DNA, 22 bp, Homo sapiens
gggatcgtcatggaaagtgcta

SEQ ID NO: 7284228 - DNA, 22 bp, Homo sapiens
gggaggctggctctggccacag

SEQ ID NO: 7284229 - DNA, 22 bp, Homo sapiens
gggatggggagctggaaagggg

SEQ ID NO: 7284230 - DNA, 22 bp, Homo sapiens
gggacgagccccaggctggagg

SEQ ID NO: 7284231 - DNA, 22 bp, Homo sapiens
gggacgagatcttggcagtgtg

SEQ ID NO: 7284232 - DNA, 22 bp, Homo sapiens
gggagaagaatgtgtcaattgt

SEQ ID NO: 7284233 - DNA, 22 bp, Homo sapiens
gggaggctgccatccttcagga

SEQ ID NO: 7284234 - DNA, 22 bp, Homo sapiens
gggaggagggtgctggctaaac

SEQ ID NO: 7284235 - DNA, 22 bp, Homo sapiens
gggaggaggaatgttttgtgta

SEQ ID NO: 7284236 - DNA, 20 bp, Homo sapiens
gggagaagggctgatgagag

SEQ ID NO: 7284237 - DNA, 22 bp, Homo sapiens
gggagaaggaggactgtgctgt

SEQ ID NO: 7284238 - DNA, 22 bp, Homo sapiens
gggagaaggagctagttcttga

SEQ ID NO: 7284239 - DNA, 22 bp, Homo sapiens
gggaactgtttaacaggggttt

SEQ ID NO: 7284240 - DNA, 19 bp, Homo sapiens
ggcttcagtttagcaggct

SEQ ID NO: 7284241 - DNA, 22 bp, Homo sapiens
ggctcctgggagatagaggtca

SEQ ID NO: 7284242 - DNA, 22 bp, Homo sapiens
ggctcctgggagaagttttatt

SEQ ID NO: 7284243 - DNA, 22 bp, Homo sapiens
ggctgcagagctgggtgggcct

SEQ ID NO: 7284244 - DNA, 22 bp, Homo sapiens
ggctgcagaggcgatctgaggt

SEQ ID NO: 7284245 - DNA, 22 bp, Homo sapiens
ggctgccttccctgagccccgg

SEQ ID NO: 7284246 - DNA, 22 bp, Homo sapiens
ggctgcctgtgcccaggcacac

SEQ ID NO: 7284247 - DNA, 22 bp, Homo sapiens
ggccctgcgattaggtggcagg

SEQ ID NO: 7284248 - DNA, 22 bp, Homo sapiens
ggccctgcaaggtacccaggcc

SEQ ID NO: 7284249 - DNA, 22 bp, Homo sapiens
ggccctgcatgagattaaggtt

SEQ ID NO: 7284250 - DNA, 22 bp, Homo sapiens
ggccttgagagccagtgcaggc

SEQ ID NO: 7284251 - DNA, 19 bp, Homo sapiens
ggccttgatgagtggggag

SEQ ID NO: 7284252 - DNA, 22 bp, Homo sapiens
ggctcagcgcgctgggagggag

SEQ ID NO: 7284253 - DNA, 22 bp, Homo sapiens
ggctcagcttatctgggcaggc

SEQ ID NO: 7284254 - DNA, 22 bp, Homo sapiens
ggctcagcttggtgcgcagaaa

SEQ ID NO: 7284255 - DNA, 22 bp, Homo sapiens
ggctcaggactgcagcgtagag

SEQ ID NO: 7284256 - DNA, 21 bp, Homo sapiens
ggctcctgctttgtgaggggc

SEQ ID NO: 7284257 - DNA, 22 bp, Homo sapiens
ggccagaggccatcctcctgct

SEQ ID NO: 7284258 - DNA, 22 bp, Homo sapiens
ggccagagagcagccaggattc

SEQ ID NO: 7284259 - DNA, 22 bp, Homo sapiens
ggcaggtgctctgtgggcctgg

SEQ ID NO: 7284260 - DNA, 22 bp, Homo sapiens
ggaaactgagtgacactccctc

SEQ ID NO: 7284261 - DNA, 22 bp, Homo sapiens
ggaagaaaatgggcaacaggtg

SEQ ID NO: 7284262 - DNA, 22 bp, Homo sapiens
ggaagaacaggtttattttcct

SEQ ID NO: 7284263 - DNA, 22 bp, Homo sapiens
gctgggctcttatcacctgtac

SEQ ID NO: 7284264 - DNA, 22 bp, Homo sapiens
gctgggctctttacccctgtac

SEQ ID NO: 7284265 - DNA, 22 bp, Homo sapiens
gctgggctgagctagacttggc

SEQ ID NO: 7284266 - DNA, 22 bp, Homo sapiens
gctgggctgagaagttaagcaa

SEQ ID NO: 7284267 - DNA, 22 bp, Homo sapiens
gctgggctctgtcatgccttcc

SEQ ID NO: 7284268 - DNA, 21 bp, Homo sapiens
gctgggctccagtctgccgct

SEQ ID NO: 7284269 - DNA, 22 bp, Homo sapiens
gctgggctcatttgtgtgtctg

SEQ ID NO: 7284270 - DNA, 22 bp, Homo sapiens
gctgggctccaggccagggtga

SEQ ID NO: 7284271 - DNA, 22 bp, Homo sapiens
gctgggccagactttcaatgtc

SEQ ID NO: 7284272 - DNA, 22 bp, Homo sapiens
gctgggctgcccaacctctgac

SEQ ID NO: 7284273 - DNA, 22 bp, Homo sapiens
gctgggctgcgtcggggaagcc

SEQ ID NO: 7284274 - DNA, 22 bp, Homo sapiens
gctgggctggaaggccaaggca

SEQ ID NO: 7284275 - DNA, 17 bp, Homo sapiens
gcttcctgtgctgggga

SEQ ID NO: 7284276 - DNA, 22 bp, Homo sapiens
gcttctcaattctcaccctcca

SEQ ID NO: 7284277 - DNA, 22 bp, Homo sapiens
ggaggagcatgagagggtagtg

SEQ ID NO: 7284278 - DNA, 22 bp, Homo sapiens
ggaggcagaatagagtgtgggt

SEQ ID NO: 7284279 - DNA, 22 bp, Homo sapiens
ggaggcagaatagagtgtgggt

SEQ ID NO: 7284280 - DNA, 22 bp, Homo sapiens
ggagagggtgtggaaagttatc

SEQ ID NO: 7284281 - DNA, 22 bp, Homo sapiens
ggaagtggtagagccatgagtg

SEQ ID NO: 7284282 - DNA, 22 bp, Homo sapiens
ggagaaggaagaaagctactat

SEQ ID NO: 7284283 - DNA, 22 bp, Homo sapiens
ggaagtttgtatactggcctct

SEQ ID NO: 7284284 - DNA, 22 bp, Homo sapiens
ggaagtttgggagctggtaatc

SEQ ID NO: 7284285 - DNA, 22 bp, Homo sapiens
ggagaaggaatattggagtagg

SEQ ID NO: 7284286 - DNA, 22 bp, Homo sapiens
ggagaaggaatattggagtagg

SEQ ID NO: 7284287 - DNA, 22 bp, Homo sapiens
ggagaaggaagaaagctactat

SEQ ID NO: 7284288 - DNA, 21 bp, Homo sapiens
ggagaaggacaatgttgagta

SEQ ID NO: 7284289 - DNA, 22 bp, Homo sapiens
ggagaaggcacacccacctctg

SEQ ID NO: 7284290 - DNA, 22 bp, Homo sapiens
ggcaagggacggccgtgagaca

SEQ ID NO: 7284291 - DNA, 22 bp, Homo sapiens
ggagtgggaacaatgacatggt

SEQ ID NO: 7284292 - DNA, 22 bp, Homo sapiens
ggagtgggcagcactgccctgt

SEQ ID NO: 7284293 - DNA, 22 bp, Homo sapiens
ggagtgctttgaagccttcatt

SEQ ID NO: 7284294 - DNA, 22 bp, Homo sapiens
ggcagacacaaaaacataaggt

SEQ ID NO: 7284295 - DNA, 22 bp, Homo sapiens
ggcagaggaagctggaagtggg

SEQ ID NO: 7284296 - DNA, 22 bp, Homo sapiens
ggcagaggaagctggaagtggg

SEQ ID NO: 7284297 - DNA, 22 bp, Homo sapiens
ggcagctgggttggccagaaac

SEQ ID NO: 7284298 - DNA, 22 bp, Homo sapiens
ggcagctgtaagatgagtgaat

SEQ ID NO: 7284299 - DNA, 22 bp, Homo sapiens
ggcaggtgctaagagaggtaaa

SEQ ID NO: 7284300 - DNA, 22 bp, Homo sapiens
ggcaggtgcgcatgttgcatta

SEQ ID NO: 7284301 - DNA, 22 bp, Homo sapiens
ggcaggctgggagtcatcagag

SEQ ID NO: 7284302 - DNA, 22 bp, Homo sapiens
ggcaggtgaggcatgtgcctgg

SEQ ID NO: 7284303 - DNA, 22 bp, Homo sapiens
ggcaggctgcttgggtcatgtc

SEQ ID NO: 7284304 - DNA, 22 bp, Homo sapiens
ggcaggctcttggccttatgag

SEQ ID NO: 7284305 - DNA, 22 bp, Homo sapiens
ggcaggctccagagccctctcc

SEQ ID NO: 7284306 - DNA, 22 bp, Homo sapiens
ggcaggctagcactgatgtcct

SEQ ID NO: 7284307 - DNA, 22 bp, Homo sapiens
ggaggctgagaagtccaagatc

SEQ ID NO: 7284308 - DNA, 22 bp, Homo sapiens
ggaggctcttgagaggggagta

SEQ ID NO: 7284309 - DNA, 22 bp, Homo sapiens
ggaggctgagaggtcgcagtgg

SEQ ID NO: 7284310 - DNA, 22 bp, Homo sapiens
ggaggctgctgcctcacgtggg

SEQ ID NO: 7284311 - DNA, 22 bp, Homo sapiens
ggaggctgaggcccctcacagg

SEQ ID NO: 7284312 - DNA, 22 bp, Homo sapiens
ggaggctgctgcctcacgtggg

SEQ ID NO: 7284313 - DNA, 22 bp, Homo sapiens
ggaggcggaggttgcagtgagt

SEQ ID NO: 7284314 - DNA, 22 bp, Homo sapiens
ggaggctcagtgaggaaatgga

SEQ ID NO: 7284315 - DNA, 22 bp, Homo sapiens
ggaggcctcctgggggaggttc

SEQ ID NO: 7284316 - DNA, 22 bp, Homo sapiens
ggaggcggaggttgcagtgagc

SEQ ID NO: 7284317 - DNA, 22 bp, Homo sapiens
ggagggctccctgggagtggat

SEQ ID NO: 7284318 - DNA, 22 bp, Homo sapiens
ggagggctgccaggtggagcgg

SEQ ID NO: 7284319 - DNA, 21 bp, Homo sapiens
ggagggcagcccagactggct

SEQ ID NO: 7284320 - DNA, 22 bp, Homo sapiens
ggagggcatcaatcaggcctgg

SEQ ID NO: 7284321 - DNA, 22 bp, Homo sapiens
ggagggtgcagaccctttgcaa

SEQ ID NO: 7284322 - DNA, 22 bp, Homo sapiens
ggaggtggcagggaacataatt

SEQ ID NO: 7284323 - DNA, 22 bp, Homo sapiens
ggaggtgggagcctccagtggt

SEQ ID NO: 7284324 - DNA, 22 bp, Homo sapiens
ggaggtggtggcagtgacaatt

SEQ ID NO: 7284325 - DNA, 22 bp, Homo sapiens
ggaggtggtggcagtgacaatt

SEQ ID NO: 7284326 - DNA, 16 bp, Homo sapiens
ggaggtgggtaaggtg

SEQ ID NO: 7284327 - DNA, 22 bp, Homo sapiens
ggaggtgggctaaggactctct

SEQ ID NO: 7284328 - DNA, 22 bp, Homo sapiens
ggaggtggcagagggacattct

SEQ ID NO: 7284329 - DNA, 22 bp, Homo sapiens
gtgggccaggacccgctgtccg

SEQ ID NO: 7284330 - DNA, 22 bp, Homo sapiens
gtgggcaggaggccctgccctg

SEQ ID NO: 7284331 - DNA, 22 bp, Homo sapiens
gtggggaggcattcttctccct

SEQ ID NO: 7284332 - DNA, 22 bp, Homo sapiens
gtggggagcagccttagcccct

SEQ ID NO: 7284333 - DNA, 22 bp, Homo sapiens
gtgggcttttgacagtgcctgg

SEQ ID NO: 7284334 - DNA, 22 bp, Homo sapiens
gtggggcttcctggggcaagtt

SEQ ID NO: 7284335 - DNA, 22 bp, Homo sapiens
gtgggggcaggcagtgctagga

SEQ ID NO: 7284336 - DNA, 22 bp, Homo sapiens
gtgggctttgctggatccttcc

SEQ ID NO: 7284337 - DNA, 22 bp, Homo sapiens
gtgggctggaccctcctgctcc

SEQ ID NO: 7284338 - DNA, 22 bp, Homo sapiens
gtgggctcccctggcatgtcca

SEQ ID NO: 7284339 - DNA, 22 bp, Homo sapiens
gtgggctcaggcctctgtgggg

SEQ ID NO: 7284340 - DNA, 22 bp, Homo sapiens
gtgggcctgatgctgccatgag

SEQ ID NO: 7284341 - DNA, 22 bp, Homo sapiens
gtgggccttcaaccctgtctgg

SEQ ID NO: 7284342 - DNA, 22 bp, Homo sapiens
gtgtaatgttgtcagcatcatc

SEQ ID NO: 7284343 - DNA, 22 bp, Homo sapiens
gtgtaaaggaatccaggtggtc

SEQ ID NO: 7284344 - DNA, 22 bp, Homo sapiens
gtggtgcaggccagcaggggcg

SEQ ID NO: 7284345 - DNA, 22 bp, Homo sapiens
gtggtcaggggctgaggtgccc

SEQ ID NO: 7284346 - DNA, 22 bp, Homo sapiens
gtggtcagcagcagtgggagtg

SEQ ID NO: 7284347 - DNA, 22 bp, Homo sapiens
gtggtcagagatgacagtgggt

SEQ ID NO: 7284348 - DNA, 22 bp, Homo sapiens
gtgggtgatgtactggaggcca

SEQ ID NO: 7284349 - DNA, 22 bp, Homo sapiens
gtggggtagatctttctcagga

SEQ ID NO: 7284350 - DNA, 22 bp, Homo sapiens
gtgggggctggctcgtcctgtg

SEQ ID NO: 7284351 - DNA, 22 bp, Homo sapiens
gtgtggggtcttctcttggcct

SEQ ID NO: 7284352 - DNA, 22 bp, Homo sapiens
taaaaccattcctgctttcatg

SEQ ID NO: 7284353 - DNA, 22 bp, Homo sapiens
taaaggaatcagttttagagat

SEQ ID NO: 7284354 - DNA, 22 bp, Homo sapiens
gtttttctttgtgtgaagacaa

SEQ ID NO: 7284355 - DNA, 22 bp, Homo sapiens
gtttttctttgtgtgaagacaa

SEQ ID NO: 7284356 - DNA, 22 bp, Homo sapiens
taaaacacataaactctctatt

SEQ ID NO: 7284357 - DNA, 22 bp, Homo sapiens
taaaaaacattactctgtcctg

SEQ ID NO: 7284358 - DNA, 22 bp, Homo sapiens
taaaaaacattactctgtcctg

SEQ ID NO: 7284359 - DNA, 20 bp, Homo sapiens
gtttttcttgggcgagctat

SEQ ID NO: 7284360 - DNA, 22 bp, Homo sapiens
gtttttctctgaaatagttgac

SEQ ID NO: 7284361 - DNA, 22 bp, Homo sapiens
gtttttctagactgggagtttg

SEQ ID NO: 7284362 - DNA, 22 bp, Homo sapiens
gtttttctaggaccatgtgatt

SEQ ID NO: 7284363 - DNA, 22 bp, Homo sapiens
taacagagatagaaatgtaaag

SEQ ID NO: 7284364 - DNA, 22 bp, Homo sapiens
taacagagtgaaaatcagcaca

SEQ ID NO: 7284365 - DNA, 22 bp, Homo sapiens
taacactgtccaaagaattcca

SEQ ID NO: 7284366 - DNA, 21 bp, Homo sapiens
gtatatccaactgttggagtt

SEQ ID NO: 7284367 - DNA, 22 bp, Homo sapiens
gtaaagcaggtagttgggacac

SEQ ID NO: 7284368 - DNA, 22 bp, Homo sapiens
gtaaaatagaataacgtggcta

SEQ ID NO: 7284369 - DNA, 22 bp, Homo sapiens
ggtggcaggctggcattggcaa

SEQ ID NO: 7284370 - DNA, 22 bp, Homo sapiens
ggtgcaggaatctgcaattgaa

SEQ ID NO: 7284371 - DNA, 22 bp, Homo sapiens
ggtgcaggacgaagtgggggtt

SEQ ID NO: 7284372 - DNA, 22 bp, Homo sapiens
ggtgcaggcggtggggcaagta

SEQ ID NO: 7284373 - DNA, 19 bp, Homo sapiens
gtctctgctccagggtctc

SEQ ID NO: 7284374 - DNA, 22 bp, Homo sapiens
gtctctgcctggggggatcaga

SEQ ID NO: 7284375 - DNA, 22 bp, Homo sapiens
gtctgggctcccagggtcggcg

SEQ ID NO: 7284376 - DNA, 22 bp, Homo sapiens
gtcctgtgtgacttcccaaatg

SEQ ID NO: 7284377 - DNA, 22 bp, Homo sapiens
gtcccagggaggttcagggctt

SEQ ID NO: 7284378 - DNA, 18 bp, Homo sapiens
gtcagaggatggggaaat

SEQ ID NO: 7284379 - DNA, 22 bp, Homo sapiens
gtcagaggggcagctgccaggc

SEQ ID NO: 7284380 - DNA, 21 bp, Homo sapiens
gtcaggcccatagcagtgcct

SEQ ID NO: 7284381 - DNA, 18 bp, Homo sapiens
gtcaggcatgaatctggg

SEQ ID NO: 7284382 - DNA, 22 bp, Homo sapiens
gtggcctggctggcaccacctc

SEQ ID NO: 7284383 - DNA, 22 bp, Homo sapiens
gtggcctggggtttgttctgag

SEQ ID NO: 7284384 - DNA, 22 bp, Homo sapiens
gtggcctggcgagctggcgcgg

SEQ ID NO: 7284385 - DNA, 22 bp, Homo sapiens
gtggcctggaaaggctggtctg

SEQ ID NO: 7284386 - DNA, 19 bp, Homo sapiens
gtggcctgcgctgggtgcg

SEQ ID NO: 7284387 - DNA, 22 bp, Homo sapiens
gtggcctgatgccagccctgtg

SEQ ID NO: 7284388 - DNA, 22 bp, Homo sapiens
gtggcctgagcttcagagttgg

SEQ ID NO: 7284389 - DNA, 22 bp, Homo sapiens
gtgggagctgcggaggcctggg

SEQ ID NO: 7284390 - DNA, 22 bp, Homo sapiens
gtgggagctgcggaggcctggg

SEQ ID NO: 7284391 - DNA, 22 bp, Homo sapiens
gtgggagctttggcatcaggct

SEQ ID NO: 7284392 - DNA, 22 bp, Homo sapiens
gtggccagaatcttgaggcctt

SEQ ID NO: 7284393 - DNA, 20 bp, Homo sapiens
gtggcaggcagtgaaggagc

SEQ ID NO: 7284394 - DNA, 22 bp, Homo sapiens
gtggcagggtgctcatcatgca

SEQ ID NO: 7284395 - DNA, 22 bp, Homo sapiens
gtggcagttgctgtggcaataa

SEQ ID NO: 7284396 - DNA, 20 bp, Homo sapiens
gtggcagtggtggcagcagt

SEQ ID NO: 7284397 - DNA, 20 bp, Homo sapiens
gtggcagtggtggcagcagt

SEQ ID NO: 7284398 - DNA, 22 bp, Homo sapiens
gtggcagtgtggagggaggagt

SEQ ID NO: 7284399 - DNA, 20 bp, Homo sapiens
gtgcctggagaagaggctgt

SEQ ID NO: 7284400 - DNA, 22 bp, Homo sapiens
gtgacaggcccagtgggatgca

SEQ ID NO: 7284401 - DNA, 20 bp, Homo sapiens
gtgaagggagtcaggtgtgc

SEQ ID NO: 7284402 - DNA, 22 bp, Homo sapiens
tcttctttgaatcatagtgacc

SEQ ID NO: 7284403 - DNA, 22 bp, Homo sapiens
tcttctctcatgtaggagggaa

SEQ ID NO: 7284404 - DNA, 22 bp, Homo sapiens
tcttccaggagggcatttcttt

SEQ ID NO: 7284405 - DNA, 22 bp, Homo sapiens
tcttccttctttgatgacaagg

SEQ ID NO: 7284406 - DNA, 22 bp, Homo sapiens
tcttcggaacacaaagttttcc

SEQ ID NO: 7284407 - DNA, 22 bp, Homo sapiens
tcttcctttcattcatgtgtta

SEQ ID NO: 7284408 - DNA, 22 bp, Homo sapiens
tcttcacagatgcatatacttc

SEQ ID NO: 7284409 - DNA, 22 bp, Homo sapiens
tcttcatactcatcacataggt

SEQ ID NO: 7284410 - DNA, 22 bp, Homo sapiens
tcttccagctcatattctatca

SEQ ID NO: 7284411 - DNA, 22 bp, Homo sapiens
tctttcccagtagctctcccag

SEQ ID NO: 7284412 - DNA, 21 bp, Homo sapiens
tctttccaatattcatgtctc

SEQ ID NO: 7284413 - DNA, 22 bp, Homo sapiens
tctttagagcacgggaaaaaca

SEQ ID NO: 7284414 - DNA, 22 bp, Homo sapiens
tctttagagctcagaaatacag

SEQ ID NO: 7284415 - DNA, 22 bp, Homo sapiens
tctttagtattgagttatggta

SEQ ID NO: 7284416 - DNA, 22 bp, Homo sapiens
tctttagtgaccatctcattct

SEQ ID NO: 7284417 - DNA, 22 bp, Homo sapiens
tctttcctactttattgtgaac

SEQ ID NO: 7284418 - DNA, 17 bp, Homo sapiens
tctttccctgggagatg

SEQ ID NO: 7284419 - DNA, 22 bp, Homo sapiens
tctttccctgtgttagcctgta

SEQ ID NO: 7284420 - DNA, 22 bp, Homo sapiens
tctttacagtcctctgtcaatc

SEQ ID NO: 7284421 - DNA, 23 bp, Homo sapiens
tctttagaagaacatcagaaatg

SEQ ID NO: 7284422 - DNA, 22 bp, Homo sapiens
tctttacttgtgtattgtatat

SEQ ID NO: 7284423 - DNA, 22 bp, Homo sapiens
tctttacaatctaagcatagtt

SEQ ID NO: 7284424 - DNA, 22 bp, Homo sapiens
tcttgggaccatttacacatac

SEQ ID NO: 7284425 - DNA, 22 bp, Homo sapiens
tcttgggagtcccaggacatag

SEQ ID NO: 7284426 - DNA, 22 bp, Homo sapiens
tcttggaacttattattgtaga

SEQ ID NO: 7284427 - DNA, 22 bp, Homo sapiens
tcttggccaggtgtggtgcctc

SEQ ID NO: 7284428 - DNA, 22 bp, Homo sapiens
tcttgaagaaagtcaagttatt

SEQ ID NO: 7284429 - DNA, 22 bp, Homo sapiens
tctgtaaaacaatattgtattc

SEQ ID NO: 7284430 - DNA, 22 bp, Homo sapiens
tctggggcagttactggggcct

SEQ ID NO: 7284431 - DNA, 22 bp, Homo sapiens
tctgggcttggttagggctgtt

SEQ ID NO: 7284432 - DNA, 22 bp, Homo sapiens
tctgggctgtctacaggttggc

SEQ ID NO: 7284433 - DNA, 22 bp, Homo sapiens
tctgtgtaagaccagtgctggg

SEQ ID NO: 7284434 - DNA, 22 bp, Homo sapiens
tcttaggagtagaattctcaca

SEQ ID NO: 7284435 - DNA, 22 bp, Homo sapiens
tctgccctaattcagtgcttag

SEQ ID NO: 7284436 - DNA, 22 bp, Homo sapiens
tctgccctcattgctgcctgga

SEQ ID NO: 7284437 - DNA, 22 bp, Homo sapiens
tctgccctcattgctgcctgga

SEQ ID NO: 7284438 - DNA, 18 bp, Homo sapiens
tctgccctgccattcact

SEQ ID NO: 7284439 - DNA, 22 bp, Homo sapiens
tctgccctgccattcactggaa

SEQ ID NO: 7284440 - DNA, 22 bp, Homo sapiens
tctgccctggggtcagcctcca

SEQ ID NO: 7284441 - DNA, 22 bp, Homo sapiens
tctgccctggggtcagcctcca

SEQ ID NO: 7284442 - DNA, 22 bp, Homo sapiens
tctgcctgccagtctggtcctc

SEQ ID NO: 7284443 - DNA, 22 bp, Homo sapiens
tctgcctgcagtgtggcagggc

SEQ ID NO: 7284444 - DNA, 22 bp, Homo sapiens
tctgcctgttcaagtcttctag

SEQ ID NO: 7284445 - DNA, 22 bp, Homo sapiens
tctgcctgtggatacatgctct

SEQ ID NO: 7284446 - DNA, 22 bp, Homo sapiens
tctgcctgttgagcctaaggcc

SEQ ID NO: 7284447 - DNA, 22 bp, Homo sapiens
tctgcctggattccattctcca

SEQ ID NO: 7284448 - DNA, 22 bp, Homo sapiens
tctgcctggcggactcccggaa

SEQ ID NO: 7284449 - DNA, 22 bp, Homo sapiens
tctgcctggatgatggcagggc

SEQ ID NO: 7284450 - DNA, 22 bp, Homo sapiens
tctgcctgctaactcctgcacc

SEQ ID NO: 7284451 - DNA, 22 bp, Homo sapiens
tctgagagatacaaggaggcaa

SEQ ID NO: 7284452 - DNA, 22 bp, Homo sapiens
tctgagagagggtcagatgcta

SEQ ID NO: 7284453 - DNA, 22 bp, Homo sapiens
tctgagctagtgatttataaga

SEQ ID NO: 7284454 - DNA, 20 bp, Homo sapiens
tctgagaagcaaacaatgtt

SEQ ID NO: 7284455 - DNA, 22 bp, Homo sapiens
tctgcaaacccccatctatcat

SEQ ID NO: 7284456 - DNA, 22 bp, Homo sapiens
tctgcaaacttaagttgaaata

SEQ ID NO: 7284457 - DNA, 22 bp, Homo sapiens
tctgaggaaaagttcttgtcac

SEQ ID NO: 7284458 - DNA, 23 bp, Homo sapiens
tctgggctgagacttggaaggtc

SEQ ID NO: 7284459 - DNA, 22 bp, Homo sapiens
tctgggctgctatgaggcagag

SEQ ID NO: 7284460 - DNA, 22 bp, Homo sapiens
tctgggagtaaggcctaggcat

SEQ ID NO: 7284461 - DNA, 22 bp, Homo sapiens
tctggctgattccctgggactg

SEQ ID NO: 7284462 - DNA, 22 bp, Homo sapiens
tctgctgtgattctactagtgt

SEQ ID NO: 7284463 - DNA, 22 bp, Homo sapiens
tctgctgtgggcagagacccct

SEQ ID NO: 7284464 - DNA, 22 bp, Homo sapiens
tctgctgtcctttatatagatt

SEQ ID NO: 7284465 - DNA, 22 bp, Homo sapiens
tctgctgtgaaaggtgaatatt

SEQ ID NO: 7284466 - DNA, 22 bp, Homo sapiens
tctgctgtgttgaatgattggt

SEQ ID NO: 7284467 - DNA, 22 bp, Homo sapiens
tctgctggtcaaggctgggtcc

SEQ ID NO: 7284468 - DNA, 22 bp, Homo sapiens
tctgctggtgatgacctcataa

SEQ ID NO: 7284469 - DNA, 23 bp, Homo sapiens
tctgctggtgacacggtcacatt

SEQ ID NO: 7284470 - DNA, 22 bp, Homo sapiens
tctgctggttccgaattaggcc

SEQ ID NO: 7284471 - DNA, 20 bp, Homo sapiens
tctgctggccaaaacttcac

SEQ ID NO: 7284472 - DNA, 22 bp, Homo sapiens
tctgctggccttagcaggtcta

SEQ ID NO: 7284473 - DNA, 19 bp, Homo sapiens
tctgctggcagaattccct

SEQ ID NO: 7284474 - DNA, 22 bp, Homo sapiens
tctgctggaaaaccagggaatt

SEQ ID NO: 7284475 - DNA, 22 bp, Homo sapiens
tctctggggatggacctgggag

SEQ ID NO: 7284476 - DNA, 22 bp, Homo sapiens
tctctgcttggtgtatgtgagt

SEQ ID NO: 7284477 - DNA, 19 bp, Homo sapiens
tctctggcagttcagagca

SEQ ID NO: 7284478 - DNA, 22 bp, Homo sapiens
tctctggcagaggccctatccc

SEQ ID NO: 7284479 - DNA, 22 bp, Homo sapiens
tctctggccccatggctgagct

SEQ ID NO: 7284480 - DNA, 22 bp, Homo sapiens
tctctctgagccctgctttttc

SEQ ID NO: 7284481 - DNA, 22 bp, Homo sapiens
tctctcccaaatctgcagatag

SEQ ID NO: 7284482 - DNA, 22 bp, Homo sapiens
tctctccctttccttatcagtt

SEQ ID NO: 7284483 - DNA, 22 bp, Homo sapiens
tctctcagaaagcccatgtctg

SEQ ID NO: 7284484 - DNA, 18 bp, Homo sapiens
tctctcagggaaacagaa

SEQ ID NO: 7284485 - DNA, 22 bp, Homo sapiens
tctctctgcgaattaggtttgc

SEQ ID NO: 7284486 - DNA, 22 bp, Homo sapiens
tctctgagaagctgaggctggg

SEQ ID NO: 7284487 - DNA, 22 bp, Homo sapiens
tctctgaggacttggggttgcc

SEQ ID NO: 7284488 - DNA, 22 bp, Homo sapiens
tctctgagctcaggagctgcag

SEQ ID NO: 7284489 - DNA, 22 bp, Homo sapiens
tctctttaaagactcagagatt

SEQ ID NO: 7284490 - DNA, 22 bp, Homo sapiens
tctgaaaatgttgactttgttt

SEQ ID NO: 7284491 - DNA, 20 bp, Homo sapiens
tctcttttagcttacagctg

SEQ ID NO: 7284492 - DNA, 22 bp, Homo sapiens
tctctttgtctgctcttagttg

SEQ ID NO: 7284493 - DNA, 21 bp, Homo sapiens
tctctttgggaacattaatca

SEQ ID NO: 7284494 - DNA, 22 bp, Homo sapiens
tctctgtggcaagcatgctgct

SEQ ID NO: 7284495 - DNA, 22 bp, Homo sapiens
tctctgtgcccagtagttctct

SEQ ID NO: 7284496 - DNA, 22 bp, Homo sapiens
tctctgtgtctcatgttcctat

SEQ ID NO: 7284497 - DNA, 22 bp, Homo sapiens
tctctgtggtttgagagccggg

SEQ ID NO: 7284498 - DNA, 21 bp, Homo sapiens
tctctgtggtccaatcccagc

SEQ ID NO: 7284499 - DNA, 22 bp, Homo sapiens
tctctgtggtgggaggctgagt

SEQ ID NO: 7284500 - DNA, 22 bp, Homo sapiens
tctcttctgaaacctgtcttta

SEQ ID NO: 7284501 - DNA, 22 bp, Homo sapiens
tctcttagtcttatatgtaaaa

SEQ ID NO: 7284502 - DNA, 22 bp, Homo sapiens
tctccctactgactccaggacc

SEQ ID NO: 7284503 - DNA, 22 bp, Homo sapiens
tctccctcattcctgcttccat

SEQ ID NO: 7284504 - DNA, 22 bp, Homo sapiens
tctcctgctcccaactgctgca

SEQ ID NO: 7284505 - DNA, 22 bp, Homo sapiens
tctcctgcttcaactgatggac

SEQ ID NO: 7284506 - DNA, 22 bp, Homo sapiens
tctcctcccaggctcttccagg

SEQ ID NO: 7284507 - DNA, 22 bp, Homo sapiens
tctcgctctgtcgcccaggctg

SEQ ID NO: 7284508 - DNA, 22 bp, Homo sapiens
tctccttgtaagtaaattttac

SEQ ID NO: 7284509 - DNA, 22 bp, Homo sapiens
tctccttcgaggcccagctccc

SEQ ID NO: 7284510 - DNA, 22 bp, Homo sapiens
tctcctggtcacctcagaagtc

SEQ ID NO: 7284511 - DNA, 22 bp, Homo sapiens
tctcattgccttcactcttcag

SEQ ID NO: 7284512 - DNA, 17 bp, Homo sapiens
tctcattgttggttcag

SEQ ID NO: 7284513 - DNA, 22 bp, Homo sapiens
tctccaaatcaatcaatatgaa

SEQ ID NO: 7284514 - DNA, 22 bp, Homo sapiens
tctccacaagctgatgctagga

SEQ ID NO: 7284515 - DNA, 22 bp, Homo sapiens
tctccacaagctttctcctttt

SEQ ID NO: 7284516 - DNA, 23 bp, Homo sapiens
tctcagtgcacgcaccatgcctg

SEQ ID NO: 7284517 - DNA, 22 bp, Homo sapiens
tctcactgatttgagaccaagg

SEQ ID NO: 7284518 - DNA, 22 bp, Homo sapiens
tctagaaaaccaatattacatg

SEQ ID NO: 7284519 - DNA, 23 bp, Homo sapiens
tctagaaaatgaaagaatgcagt

SEQ ID NO: 7284520 - DNA, 18 bp, Homo sapiens
tctaccctctcagagtct

SEQ ID NO: 7284521 - DNA, 22 bp, Homo sapiens
tctagcatgggaaaatcacagc

SEQ ID NO: 7284522 - DNA, 22 bp, Homo sapiens
tctagcatttctttcctgagga

SEQ ID NO: 7284523 - DNA, 22 bp, Homo sapiens
tctagggagaagctctgtctgt

SEQ ID NO: 7284524 - DNA, 22 bp, Homo sapiens
tccttcagggctgaccacaggc

SEQ ID NO: 7284525 - DNA, 19 bp, Homo sapiens
tccttctccggccaccccg

SEQ ID NO: 7284526 - DNA, 22 bp, Homo sapiens
tcgttaaatgctaaaactgaca

SEQ ID NO: 7284527 - DNA, 22 bp, Homo sapiens
tctaaactgcgagcatgccccc

SEQ ID NO: 7284528 - DNA, 18 bp, Homo sapiens
tcctttctccctcatctt

SEQ ID NO: 7284529 - DNA, 22 bp, Homo sapiens
tcctttccctttccatcctggc

SEQ ID NO: 7284530 - DNA, 20 bp, Homo sapiens
tcctttcctccttctaaatg

SEQ ID NO: 7284531 - DNA, 22 bp, Homo sapiens
tcctttccatgcttctagaggc

SEQ ID NO: 7284532 - DNA, 22 bp, Homo sapiens
tcctttcttcttctgcccatgg

SEQ ID NO: 7284533 - DNA, 22 bp, Homo sapiens
tcctgggtcccgcacatctgtc

SEQ ID NO: 7284534 - DNA, 22 bp, Homo sapiens
tcctgggtgaaagaacaggcag

SEQ ID NO: 7284535 - DNA, 22 bp, Homo sapiens
tcctgtctaaagacctgcaggc

SEQ ID NO: 7284536 - DNA, 22 bp, Homo sapiens
tcctgtgatggcttgcgatgtg

SEQ ID NO: 7284537 - DNA, 22 bp, Homo sapiens
tcctgtgatggcttgcgatgtg

SEQ ID NO: 7284538 - DNA, 22 bp, Homo sapiens
tcctgtgatattgtttgttata

SEQ ID NO: 7284539 - DNA, 22 bp, Homo sapiens
tcctgtgagtagatagtattgt

SEQ ID NO: 7284540 - DNA, 21 bp, Homo sapiens
tcctgtgaggacctgtcagtg

SEQ ID NO: 7284541 - DNA, 22 bp, Homo sapiens
tcctgtgagcagcacagagaca

SEQ ID NO: 7284542 - DNA, 22 bp, Homo sapiens
tcctgtgagacttgtccattat

SEQ ID NO: 7284543 - DNA, 22 bp, Homo sapiens
tcctgtgacggagcgccagagg

SEQ ID NO: 7284544 - DNA, 22 bp, Homo sapiens
tcctgtgaccagcttccatgct

SEQ ID NO: 7284545 - DNA, 23 bp, Homo sapiens
tcctgtgaagccatgtttgttgt

SEQ ID NO: 7284546 - DNA, 22 bp, Homo sapiens
tcctgtgaagaatagcactcaa

SEQ ID NO: 7284547 - DNA, 22 bp, Homo sapiens
tcctgggaggcggaggttgcag

SEQ ID NO: 7284548 - DNA, 22 bp, Homo sapiens
tcctgggaggctgtgcctggct

SEQ ID NO: 7284549 - DNA, 21 bp, Homo sapiens
tcctgggaagcactggggtgg

SEQ ID NO: 7284550 - DNA, 22 bp, Homo sapiens
tcctgggaagcgccggcctgcg

SEQ ID NO: 7284551 - DNA, 22 bp, Homo sapiens
tcctgggaagtggctggctgag

SEQ ID NO: 7284552 - DNA, 22 bp, Homo sapiens
tcctgggacaagccgtggaagt

SEQ ID NO: 7284553 - DNA, 22 bp, Homo sapiens
tcctgggaagagacctgagcat

SEQ ID NO: 7284554 - DNA, 22 bp, Homo sapiens
tcctgggaagactgtgaggaca

SEQ ID NO: 7284555 - DNA, 22 bp, Homo sapiens
tcctgggcagcgggacgctcag

SEQ ID NO: 7284556 - DNA, 22 bp, Homo sapiens
taagaacagtagaacagtaggt

SEQ ID NO: 7284557 - DNA, 22 bp, Homo sapiens
taagaatagtccctagatgtgt

SEQ ID NO: 7284558 - DNA, 22 bp, Homo sapiens
taagaatattgggaatggatgg

SEQ ID NO: 7284559 - DNA, 22 bp, Homo sapiens
tcctggcacattgcaggggctc

SEQ ID NO: 7284560 - DNA, 22 bp, Homo sapiens
tgatctttactgctgtttataa

SEQ ID NO: 7284561 - DNA, 22 bp, Homo sapiens
tgatgcccccaaatctggctca

SEQ ID NO: 7284562 - DNA, 22 bp, Homo sapiens
tgatctttgggccattaataaa

SEQ ID NO: 7284563 - DNA, 22 bp, Homo sapiens
tgcaatttcaggcatatattgt

SEQ ID NO: 7284564 - DNA, 21 bp, Homo sapiens
tgcaatttagacttgaacatt

SEQ ID NO: 7284565 - DNA, 22 bp, Homo sapiens
tgcaattttaatacattagagg

SEQ ID NO: 7284566 - DNA, 22 bp, Homo sapiens
tgcaaaataatgaacgattttt

SEQ ID NO: 7284567 - DNA, 22 bp, Homo sapiens
tgcaaaatgacttctgaaaaga

SEQ ID NO: 7284568 - DNA, 22 bp, Homo sapiens
tgcaaaaattgctggaatcttt

SEQ ID NO: 7284569 - DNA, 22 bp, Homo sapiens
tgcaaaaactgcaattgctttt

SEQ ID NO: 7284570 - DNA, 22 bp, Homo sapiens
tgcaaaaagagcgaggagccct

SEQ ID NO: 7284571 - DNA, 22 bp, Homo sapiens
tgcaaaaaggcagactggtgat

SEQ ID NO: 7284572 - DNA, 22 bp, Homo sapiens
tgcaaaaacagccttgaggcct

SEQ ID NO: 7284573 - DNA, 23 bp, Homo sapiens
tgcaaaatttgcagagttcgatg

SEQ ID NO: 7284574 - DNA, 22 bp, Homo sapiens
tgcaggagtccaatcaggagac

SEQ ID NO: 7284575 - DNA, 22 bp, Homo sapiens
tgcaggctcacctgccagggcc

SEQ ID NO: 7284576 - DNA, 22 bp, Homo sapiens
tgcaggcagctgaaaggtgcct

SEQ ID NO: 7284577 - DNA, 22 bp, Homo sapiens
tgcaggcagctaaaccatgtaa

SEQ ID NO: 7284578 - DNA, 22 bp, Homo sapiens
tgcagctgtgcctgaaaagtac

SEQ ID NO: 7284579 - DNA, 22 bp, Homo sapiens
tgcagcagagtgggcctgggtg

SEQ ID NO: 7284580 - DNA, 22 bp, Homo sapiens
tgcagcagcagggaggaggctc

SEQ ID NO: 7284581 - DNA, 21 bp, Homo sapiens
tgcagcagagtaagcagggga

SEQ ID NO: 7284582 - DNA, 22 bp, Homo sapiens
tgcagctggaacttagaggaga

SEQ ID NO: 7284583 - DNA, 22 bp, Homo sapiens
tgcagctggtttagaactagat

SEQ ID NO: 7284584 - DNA, 17 bp, Homo sapiens
tgcagctgatggggaaa

SEQ ID NO: 7284585 - DNA, 22 bp, Homo sapiens
tgcagaggagctggaaggctgg

SEQ ID NO: 7284586 - DNA, 22 bp, Homo sapiens
tgcagaggagtcagcctgggca

SEQ ID NO: 7284587 - DNA, 22 bp, Homo sapiens
tgcagagggaaaaggtgctcct

SEQ ID NO: 7284588 - DNA, 22 bp, Homo sapiens
tgcagaggctggctcgccgggt

SEQ ID NO: 7284589 - DNA, 22 bp, Homo sapiens
tgcagaggcgccgtgggtgggg

SEQ ID NO: 7284590 - DNA, 19 bp, Homo sapiens
tgcagagggtaggaaggcc

SEQ ID NO: 7284591 - DNA, 21 bp, Homo sapiens
tgcagataattgaaagctgac

SEQ ID NO: 7284592 - DNA, 22 bp, Homo sapiens
tgcagatgaatgctgagacact

SEQ ID NO: 7284593 - DNA, 22 bp, Homo sapiens
tgcagatggggatcagtggctc

SEQ ID NO: 7284594 - DNA, 21 bp, Homo sapiens
tgcagaaagcggcttgaagca

SEQ ID NO: 7284595 - DNA, 22 bp, Homo sapiens
tgcattcctccacctcctgcac

SEQ ID NO: 7284596 - DNA, 21 bp, Homo sapiens
tgcattcctccatccaacagg

SEQ ID NO: 7284597 - DNA, 23 bp, Homo sapiens
tgccacccttctcttcccagctt

SEQ ID NO: 7284598 - DNA, 22 bp, Homo sapiens
tgccactgggcatgcagatgtc

SEQ ID NO: 7284599 - DNA, 22 bp, Homo sapiens
tgccactggctcaatggtgcag

SEQ ID NO: 7284600 - DNA, 22 bp, Homo sapiens
tgcatgatagagatggtattag

SEQ ID NO: 7284601 - DNA, 23 bp, Homo sapiens
tgcatggggctatactgctgttc

SEQ ID NO: 7284602 - DNA, 22 bp, Homo sapiens
tgcaggtgtctccagggcaggt

SEQ ID NO: 7284603 - DNA, 22 bp, Homo sapiens
tgcaggtggtttggacactgct

SEQ ID NO: 7284604 - DNA, 22 bp, Homo sapiens
tgcaggtgtgtgcaagggaggg

SEQ ID NO: 7284605 - DNA, 20 bp, Homo sapiens
tgcaggtgttggagaaggta

SEQ ID NO: 7284606 - DNA, 22 bp, Homo sapiens
tgcaggtgtgggcaggggagca

SEQ ID NO: 7284607 - DNA, 22 bp, Homo sapiens
tgcaggtgaaaattatgaggat

SEQ ID NO: 7284608 - DNA, 22 bp, Homo sapiens
tgcaggtggctccagggactgc

SEQ ID NO: 7284609 - DNA, 22 bp, Homo sapiens
tgcaggtggcagcggggcacca

SEQ ID NO: 7284610 - DNA, 22 bp, Homo sapiens
tgcaggtgattctgatgcagtt

SEQ ID NO: 7284611 - DNA, 23 bp, Homo sapiens
tgcaggggaggcttaaagcaggt

SEQ ID NO: 7284612 - DNA, 22 bp, Homo sapiens
tgcaggggcttgtctgggcctg

SEQ ID NO: 7284613 - DNA, 22 bp, Homo sapiens
tgcaggctctctgctgccagat

SEQ ID NO: 7284614 - DNA, 22 bp, Homo sapiens
tgcaggctgctggcagtagctt

SEQ ID NO: 7284615 - DNA, 21 bp, Homo sapiens
tgcaggctgtgcgctcctgcc

SEQ ID NO: 7284616 - DNA, 22 bp, Homo sapiens
tgcagggcagatatgactgtag

SEQ ID NO: 7284617 - DNA, 22 bp, Homo sapiens
tgcagggcccctctgcatgagt

SEQ ID NO: 7284618 - DNA, 22 bp, Homo sapiens
tgccctgtctaagctgtcagta

SEQ ID NO: 7284619 - DNA, 22 bp, Homo sapiens
tgccctgggaggctttcctgtt

SEQ ID NO: 7284620 - DNA, 22 bp, Homo sapiens
tgcccttgggtaacttgctgat

SEQ ID NO: 7284621 - DNA, 22 bp, Homo sapiens
tgccctgttcctgcctccagct

SEQ ID NO: 7284622 - DNA, 22 bp, Homo sapiens
tgccctgtgggtatctgatggc

SEQ ID NO: 7284623 - DNA, 17 bp, Homo sapiens
tgccctgtgcctggtgt

SEQ ID NO: 7284624 - DNA, 22 bp, Homo sapiens
tgccctgtgccagacttcctgg

SEQ ID NO: 7284625 - DNA, 22 bp, Homo sapiens
tgccctgcttggtttattttca

SEQ ID NO: 7284626 - DNA, 22 bp, Homo sapiens
tgccctgctgtggctctgccca

SEQ ID NO: 7284627 - DNA, 22 bp, Homo sapiens
tgccctgcttctcttgggacag

SEQ ID NO: 7284628 - DNA, 22 bp, Homo sapiens
tgccctgcagaccctgcagtgt

SEQ ID NO: 7284629 - DNA, 22 bp, Homo sapiens
tgccctgcatgcagggagctgt

SEQ ID NO: 7284630 - DNA, 22 bp, Homo sapiens
tgccctgcagtgagtgcgtctg

SEQ ID NO: 7284631 - DNA, 22 bp, Homo sapiens
tgccctgccaagactgagtggt

SEQ ID NO: 7284632 - DNA, 22 bp, Homo sapiens
tgccctgcccatctaccctgtc

SEQ ID NO: 7284633 - DNA, 19 bp, Homo sapiens
tgccctgcccgcagccttg

SEQ ID NO: 7284634 - DNA, 22 bp, Homo sapiens
tgccctgccaagactcagtggt

SEQ ID NO: 7284635 - DNA, 22 bp, Homo sapiens
tgccctgccaagaccaagtggt

SEQ ID NO: 7284636 - DNA, 22 bp, Homo sapiens
tgccctgcccttgctatttcta

SEQ ID NO: 7284637 - DNA, 22 bp, Homo sapiens
tgccctgcggctatctagatga

SEQ ID NO: 7284638 - DNA, 22 bp, Homo sapiens
tgccctgcctgagagacagtaa

SEQ ID NO: 7284639 - DNA, 22 bp, Homo sapiens
tgccctgctaaatataggtagc

SEQ ID NO: 7284640 - DNA, 22 bp, Homo sapiens
tgccctgctaaccttggttcca

SEQ ID NO: 7284641 - DNA, 22 bp, Homo sapiens
tgccctgctgtgcctggagcca

SEQ ID NO: 7284642 - DNA, 20 bp, Homo sapiens
tgcctgcccaggtcctgcac

SEQ ID NO: 7284643 - DNA, 17 bp, Homo sapiens
tgcctgccagcattgga

SEQ ID NO: 7284644 - DNA, 22 bp, Homo sapiens
tgcctgcattttgtggctggct

SEQ ID NO: 7284645 - DNA, 22 bp, Homo sapiens
tgcctgcatcttggaggcccca

SEQ ID NO: 7284646 - DNA, 22 bp, Homo sapiens
tgcctgcagcgtctccagcagg

SEQ ID NO: 7284647 - DNA, 22 bp, Homo sapiens
tgcctggcactcctggagctca

SEQ ID NO: 7284648 - DNA, 19 bp, Homo sapiens
tgcctggcaccagctccac

SEQ ID NO: 7284649 - DNA, 22 bp, Homo sapiens
tgcctggcaactgtggtgggct

SEQ ID NO: 7284650 - DNA, 22 bp, Homo sapiens
tgcctggcaatgccagaagcca

SEQ ID NO: 7284651 - DNA, 22 bp, Homo sapiens
tgcctggcaagaggggctggct

SEQ ID NO: 7284652 - DNA, 22 bp, Homo sapiens
tgcctctgtggaaatggtggtc

SEQ ID NO: 7284653 - DNA, 22 bp, Homo sapiens
tgcctctgtgtgcaggtgagca

SEQ ID NO: 7284654 - DNA, 22 bp, Homo sapiens
tgcctgagtgatgtggcagcca

SEQ ID NO: 7284655 - DNA, 22 bp, Homo sapiens
tgcctgaggagtcagggcaggt

SEQ ID NO: 7284656 - DNA, 22 bp, Homo sapiens
tgcctccctctctgccactgga

SEQ ID NO: 7284657 - DNA, 22 bp, Homo sapiens
tgccagggaccctgtcggccct

SEQ ID NO: 7284658 - DNA, 22 bp, Homo sapiens
tgccagggtcctgagggccttg

SEQ ID NO: 7284659 - DNA, 22 bp, Homo sapiens
tgccatttaaaaatgaccaaat

SEQ ID NO: 7284660 - DNA, 22 bp, Homo sapiens
tgccatttacgagcagtatgac

SEQ ID NO: 7284661 - DNA, 22 bp, Homo sapiens
tgccatttactgagattagaag

SEQ ID NO: 7284662 - DNA, 22 bp, Homo sapiens
tgccatttctttcaatattctt

SEQ ID NO: 7284663 - DNA, 22 bp, Homo sapiens
tgccatttataaccagtggcct

SEQ ID NO: 7284664 - DNA, 22 bp, Homo sapiens
tgccatttctcaaatatgacta

SEQ ID NO: 7284665 - DNA, 22 bp, Homo sapiens
tgccatttctcaggctatttca

SEQ ID NO: 7284666 - DNA, 22 bp, Homo sapiens
tgccatttctcacatatgtatg

SEQ ID NO: 7284667 - DNA, 22 bp, Homo sapiens
tgccatttgtaactatcattct

SEQ ID NO: 7284668 - DNA, 22 bp, Homo sapiens
tgccatttggacctaactgggc

SEQ ID NO: 7284669 - DNA, 22 bp, Homo sapiens
tgccatttgctggttttctgat

SEQ ID NO: 7284670 - DNA, 22 bp, Homo sapiens
tgccatttgttactatcaggac

SEQ ID NO: 7284671 - DNA, 21 bp, Homo sapiens
tgccattttaaccaagtgtgc

SEQ ID NO: 7284672 - DNA, 22 bp, Homo sapiens
tgccattttgagatgttaatga

SEQ ID NO: 7284673 - DNA, 23 bp, Homo sapiens
tgccattttccatctcatgcaga

SEQ ID NO: 7284674 - DNA, 22 bp, Homo sapiens
tgcccagcactgtgccagtcac

SEQ ID NO: 7284675 - DNA, 22 bp, Homo sapiens
tgcccccagacagaatccagtt

SEQ ID NO: 7284676 - DNA, 22 bp, Homo sapiens
tgcccatggcaggatttctgaa

SEQ ID NO: 7284677 - DNA, 22 bp, Homo sapiens
tgcccatgtttctctgtatccc

SEQ ID NO: 7284678 - DNA, 22 bp, Homo sapiens
tgcccatgcatgacagatggct

SEQ ID NO: 7284679 - DNA, 22 bp, Homo sapiens
tgaaataatatctggatcaatc

SEQ ID NO: 7284680 - DNA, 22 bp, Homo sapiens
tgaacacacacctatgtacaaa

SEQ ID NO: 7284681 - DNA, 22 bp, Homo sapiens
tgaaagaagggtggaaaatgta

SEQ ID NO: 7284682 - DNA, 22 bp, Homo sapiens
tgaaaatatagttttccagact

SEQ ID NO: 7284683 - DNA, 22 bp, Homo sapiens
tgaaaatggcctgaagaagcaa

SEQ ID NO: 7284684 - DNA, 22 bp, Homo sapiens
tgaaaattgttgtacttgataa

SEQ ID NO: 7284685 - DNA, 22 bp, Homo sapiens
tgaaaaacctcagtccgcttta

SEQ ID NO: 7284686 - DNA, 22 bp, Homo sapiens
tgaaaaactttaatccataaag

SEQ ID NO: 7284687 - DNA, 22 bp, Homo sapiens
tctttttttcctgtgcagagct

SEQ ID NO: 7284688 - DNA, 22 bp, Homo sapiens
tgaaaaaacaagttggcccatt

SEQ ID NO: 7284689 - DNA, 22 bp, Homo sapiens
tctttggaaggagcagtttttg

SEQ ID NO: 7284690 - DNA, 22 bp, Homo sapiens
tctttggcatcagggccagcta

SEQ ID NO: 7284691 - DNA, 22 bp, Homo sapiens
tctttggcatttaggagcagga

SEQ ID NO: 7284692 - DNA, 22 bp, Homo sapiens
tctttggacatgttgaggttgc

SEQ ID NO: 7284693 - DNA, 22 bp, Homo sapiens
tcttttgttgatggaattaatg

SEQ ID NO: 7284694 - DNA, 22 bp, Homo sapiens
tcttttaagcctctggcatagg

SEQ ID NO: 7284695 - DNA, 22 bp, Homo sapiens
tctttgtttgtactgttagaat

SEQ ID NO: 7284696 - DNA, 22 bp, Homo sapiens
tgacaaattcatatttcagagg

SEQ ID NO: 7284697 - DNA, 22 bp, Homo sapiens
tgaaggcacgtgggtggatact

SEQ ID NO: 7284698 - DNA, 20 bp, Homo sapiens
tgacctcctgggctcaagcc

SEQ ID NO: 7284699 - DNA, 22 bp, Homo sapiens
tgacttaagctgttctttagat

SEQ ID NO: 7284700 - DNA, 22 bp, Homo sapiens
tgacacatgcaccagtctttaa

SEQ ID NO: 7284701 - DNA, 22 bp, Homo sapiens
tgacacataccgaaaatatttg

SEQ ID NO: 7284702 - DNA, 22 bp, Homo sapiens
tgacagggacagtggagatgga

SEQ ID NO: 7284703 - DNA, 19 bp, Homo sapiens
tgagcatgcgagctgagaa

SEQ ID NO: 7284704 - DNA, 22 bp, Homo sapiens
tgagcatggtgggtgcagagca

SEQ ID NO: 7284705 - DNA, 19 bp, Homo sapiens
tgagctgctgctgcccatc

SEQ ID NO: 7284706 - DNA, 22 bp, Homo sapiens
tgagctttcatgtatgaaaaga

SEQ ID NO: 7284707 - DNA, 22 bp, Homo sapiens
tgagccagtggaagatggcagt

SEQ ID NO: 7284708 - DNA, 22 bp, Homo sapiens
tgagccccaggaaattgaggag

SEQ ID NO: 7284709 - DNA, 22 bp, Homo sapiens
tgagccccggagtttcaggctg

SEQ ID NO: 7284710 - DNA, 23 bp, Homo sapiens
tgagcctgttaatactggctctg

SEQ ID NO: 7284711 - DNA, 22 bp, Homo sapiens
tgagcctgggctttctctggag

SEQ ID NO: 7284712 - DNA, 22 bp, Homo sapiens
tgagagagcgcctgggatcatt

SEQ ID NO: 7284713 - DNA, 21 bp, Homo sapiens
tgagagagtagcaggacatat

SEQ ID NO: 7284714 - DNA, 22 bp, Homo sapiens
tgagagggcccagagcacacca

SEQ ID NO: 7284715 - DNA, 22 bp, Homo sapiens
tgaggtggctagggaggcactc

SEQ ID NO: 7284716 - DNA, 22 bp, Homo sapiens
tgaggtggcacacacttcctgc

SEQ ID NO: 7284717 - DNA, 22 bp, Homo sapiens
tgaggtggttcaagagccttgt

SEQ ID NO: 7284718 - DNA, 22 bp, Homo sapiens
tgaggtggtccaaagactgttt

SEQ ID NO: 7284719 - DNA, 22 bp, Homo sapiens
tgaggtggtgctaatctctgct

SEQ ID NO: 7284720 - DNA, 22 bp, Homo sapiens
tgaggggcggcctgcagaggcc

SEQ ID NO: 7284721 - DNA, 22 bp, Homo sapiens
tgaggggcggcctgcagaggcc

SEQ ID NO: 7284722 - DNA, 22 bp, Homo sapiens
tgaggctcaaggtctggtggag

SEQ ID NO: 7284723 - DNA, 22 bp, Homo sapiens
tgaggctccagccaggccagca

SEQ ID NO: 7284724 - DNA, 18 bp, Homo sapiens
tgaggctcagctcctggt

SEQ ID NO: 7284725 - DNA, 17 bp, Homo sapiens
tgaggctcggtgaggag

SEQ ID NO: 7284726 - DNA, 22 bp, Homo sapiens
tgaggctggatgggatgcctcc

SEQ ID NO: 7284727 - DNA, 22 bp, Homo sapiens
tgaggctggcaaggctggtatt

SEQ ID NO: 7284728 - DNA, 21 bp, Homo sapiens
tgaggctgttgtaccagggag

SEQ ID NO: 7284729 - DNA, 22 bp, Homo sapiens
tgaggctgttctaccagggcca

SEQ ID NO: 7284730 - DNA, 22 bp, Homo sapiens
tgaggctgttctaccagggcca

SEQ ID NO: 7284731 - DNA, 21 bp, Homo sapiens
tgaggctgttgtaccagggag

SEQ ID NO: 7284732 - DNA, 22 bp, Homo sapiens
tgaggcttccaacatgtgagaa

SEQ ID NO: 7284733 - DNA, 22 bp, Homo sapiens
tgaggcttagagaattaagtga

SEQ ID NO: 7284734 - DNA, 22 bp, Homo sapiens
tgaggcttgatttgcccgagag

SEQ ID NO: 7284735 - DNA, 22 bp, Homo sapiens
tgaggcttggcaaaagagtggt

SEQ ID NO: 7284736 - DNA, 22 bp, Homo sapiens
tgaggctttatgtaagggtgca

SEQ ID NO: 7284737 - DNA, 22 bp, Homo sapiens
tgaggaggtcagagtctggctg

SEQ ID NO: 7284738 - DNA, 21 bp, Homo sapiens
tgaggcctctcctgggctggc

SEQ ID NO: 7284739 - DNA, 22 bp, Homo sapiens
tggaacactgtggatgagaaga

SEQ ID NO: 7284740 - DNA, 19 bp, Homo sapiens
tggaacactcaaactgggt

SEQ ID NO: 7284741 - DNA, 22 bp, Homo sapiens
tggaacaccttgctccagaaag

SEQ ID NO: 7284742 - DNA, 22 bp, Homo sapiens
tggaacacatctaaggaagcag

SEQ ID NO: 7284743 - DNA, 22 bp, Homo sapiens
tggaacacaggactatcagctg

SEQ ID NO: 7284744 - DNA, 22 bp, Homo sapiens
tggaacacacttcaaggagaaa

SEQ ID NO: 7284745 - DNA, 22 bp, Homo sapiens
tggaacacaagtcattgagggg

SEQ ID NO: 7284746 - DNA, 22 bp, Homo sapiens
tgcttgtgagagttttttcaga

SEQ ID NO: 7284747 - DNA, 22 bp, Homo sapiens
tggaatttagttaattccattt

SEQ ID NO: 7284748 - DNA, 22 bp, Homo sapiens
tggaattttgtattagctttga

SEQ ID NO: 7284749 - DNA, 22 bp, Homo sapiens
tggaagttgaatctcagtcatg

SEQ ID NO: 7284750 - DNA, 22 bp, Homo sapiens
tggaagaggcccatgactgcct

SEQ ID NO: 7284751 - DNA, 22 bp, Homo sapiens
tggaggagggctggtgtctgta

SEQ ID NO: 7284752 - DNA, 22 bp, Homo sapiens
tggaggctggagtgcagtggcg

SEQ ID NO: 7284753 - DNA, 22 bp, Homo sapiens
tggaggtgtggagtcaaaggga

SEQ ID NO: 7284754 - DNA, 22 bp, Homo sapiens
tggagggcatctgtggtcaggc

SEQ ID NO: 7284755 - DNA, 22 bp, Homo sapiens
tggagggcgcttagatggaggg

SEQ ID NO: 7284756 - DNA, 22 bp, Homo sapiens
tggaggtggggctcaggaatct

SEQ ID NO: 7284757 - DNA, 20 bp, Homo sapiens
tggaggtggtctgctgtcct

SEQ ID NO: 7284758 - DNA, 22 bp, Homo sapiens
tggaggtgggagggactgtcct

SEQ ID NO: 7284759 - DNA, 22 bp, Homo sapiens
tggaggtggcatctgacagctg

SEQ ID NO: 7284760 - DNA, 22 bp, Homo sapiens
tggagggctaagctgagggata

SEQ ID NO: 7284761 - DNA, 22 bp, Homo sapiens
tggagggctctttcacctggta

SEQ ID NO: 7284762 - DNA, 22 bp, Homo sapiens
tgctgggctagaagctgaggcc

SEQ ID NO: 7284763 - DNA, 22 bp, Homo sapiens
tgctgggctagggtggagctct

SEQ ID NO: 7284764 - DNA, 18 bp, Homo sapiens
tgctgggcattaggctta

SEQ ID NO: 7284765 - DNA, 22 bp, Homo sapiens
tgctgggcatcgtaggaggtac

SEQ ID NO: 7284766 - DNA, 23 bp, Homo sapiens
tgctgggcagagctggtgctgag

SEQ ID NO: 7284767 - DNA, 22 bp, Homo sapiens
tgctgggtcccttgagagctca

SEQ ID NO: 7284768 - DNA, 22 bp, Homo sapiens
tgctggctgcagtgctgtcaaa

SEQ ID NO: 7284769 - DNA, 22 bp, Homo sapiens
tgctggctgggctgctggagac

SEQ ID NO: 7284770 - DNA, 22 bp, Homo sapiens
tgctggcttcctgtgcacagca

SEQ ID NO: 7284771 - DNA, 22 bp, Homo sapiens
tgctggctctaggctgagacag

SEQ ID NO: 7284772 - DNA, 22 bp, Homo sapiens
tgctggctccaacctggcatct

SEQ ID NO: 7284773 - DNA, 22 bp, Homo sapiens
tgctggctcagtttgcagactc

SEQ ID NO: 7284774 - DNA, 22 bp, Homo sapiens
tgctgagatgaatagggctgtc

SEQ ID NO: 7284775 - DNA, 22 bp, Homo sapiens
tgctctggtcctccctcggcgc

SEQ ID NO: 7284776 - DNA, 20 bp, Homo sapiens
tgctctgggggtggagagac

SEQ ID NO: 7284777 - DNA, 22 bp, Homo sapiens
tgctgagggagcatcaaagaaa

SEQ ID NO: 7284778 - DNA, 22 bp, Homo sapiens
tgctcctggctccttccctaac

SEQ ID NO: 7284779 - DNA, 22 bp, Homo sapiens
tgctcctggatgaggtactcca

SEQ ID NO: 7284780 - DNA, 22 bp, Homo sapiens
tgctctgggctcaatggcagct

SEQ ID NO: 7284781 - DNA, 22 bp, Homo sapiens
tgctctggggagctcctctgcg

SEQ ID NO: 7284782 - DNA, 22 bp, Homo sapiens
tgctccagggcctccagtgggg

SEQ ID NO: 7284783 - DNA, 22 bp, Homo sapiens
tgctccaggcaagctgagagtt

SEQ ID NO: 7284784 - DNA, 22 bp, Homo sapiens
tgctccagcgctgccaccagtt

SEQ ID NO: 7284785 - DNA, 23 bp, Homo sapiens
tgctccagcctctttgatagtgt

SEQ ID NO: 7284786 - DNA, 22 bp, Homo sapiens
tgctcctgaggttggagatcca

SEQ ID NO: 7284787 - DNA, 22 bp, Homo sapiens
tgctcctgccgtggtcgggact

SEQ ID NO: 7284788 - DNA, 22 bp, Homo sapiens
tgctccagaacctgaccatgct

SEQ ID NO: 7284789 - DNA, 22 bp, Homo sapiens
tgctcagcaaaaagcttgtgag

SEQ ID NO: 7284790 - DNA, 22 bp, Homo sapiens
tgctcagcacagaccaggccag

SEQ ID NO: 7284791 - DNA, 22 bp, Homo sapiens
tgctcagccgtgagcagagccg

SEQ ID NO: 7284792 - DNA, 19 bp, Homo sapiens
tgctcagctcctgtgagtc

SEQ ID NO: 7284793 - DNA, 22 bp, Homo sapiens
tgctcagctgctctgtattctt

SEQ ID NO: 7284794 - DNA, 22 bp, Homo sapiens
tgctcagctggtgccagggtcc

SEQ ID NO: 7284795 - DNA, 22 bp, Homo sapiens
tgcctgtgtatgtgcatgcaca

SEQ ID NO: 7284796 - DNA, 22 bp, Homo sapiens
tgcctgtgtccccttcttggca

SEQ ID NO: 7284797 - DNA, 22 bp, Homo sapiens
tgcctgtgcccttcttggcatt

SEQ ID NO: 7284798 - DNA, 22 bp, Homo sapiens
tgcctgtgccctttgctgggag

SEQ ID NO: 7284799 - DNA, 22 bp, Homo sapiens
tgcctgtggaaaggctggtgct

SEQ ID NO: 7284800 - DNA, 22 bp, Homo sapiens
tgcctggccctgacagccctgg

SEQ ID NO: 7284801 - DNA, 20 bp, Homo sapiens
tgcctggcctttctctgccc

SEQ ID NO: 7284802 - DNA, 22 bp, Homo sapiens
tgcctggctgggctgctcatgg

SEQ ID NO: 7284803 - DNA, 22 bp, Homo sapiens
tgcctggctgaggtgacaggtt

SEQ ID NO: 7284804 - DNA, 22 bp, Homo sapiens
tgcctggctgaggtgacaggtt

SEQ ID NO: 7284805 - DNA, 22 bp, Homo sapiens
tgcctggctctatcagtggtgg

SEQ ID NO: 7284806 - DNA, 22 bp, Homo sapiens
tgcctgggtgctggctggtcac

SEQ ID NO: 7284807 - DNA, 22 bp, Homo sapiens
tgcctgtgaaaaccctggggtt

SEQ ID NO: 7284808 - DNA, 22 bp, Homo sapiens
tgcctgtgatcagctgagttca

SEQ ID NO: 7284809 - DNA, 22 bp, Homo sapiens
tgcctgtcttaatatctggaaa

SEQ ID NO: 7284810 - DNA, 22 bp, Homo sapiens
tgcctgtcttcaggagtgtcac

SEQ ID NO: 7284811 - DNA, 18 bp, Homo sapiens
tggattgaattgagaggt

SEQ ID NO: 7284812 - DNA, 22 bp, Homo sapiens
tggattgataaaatgggatgtt

SEQ ID NO: 7284813 - DNA, 22 bp, Homo sapiens
tggcagagctggctgcggatga

SEQ ID NO: 7284814 - DNA, 22 bp, Homo sapiens
tggcagagcccagactccagtc

SEQ ID NO: 7284815 - DNA, 22 bp, Homo sapiens
tggcagagacaaggccgggcct

SEQ ID NO: 7284816 - DNA, 22 bp, Homo sapiens
tggcagagagactctccttgat

SEQ ID NO: 7284817 - DNA, 22 bp, Homo sapiens
tggcagagagagtgcagtcgac

SEQ ID NO: 7284818 - DNA, 22 bp, Homo sapiens
tggcagctcctggggccagcac

SEQ ID NO: 7284819 - DNA, 22 bp, Homo sapiens
tggcagcagtggaggtagaaag

SEQ ID NO: 7284820 - DNA, 22 bp, Homo sapiens
tggcagcatgtcccggcctcag

SEQ ID NO: 7284821 - DNA, 22 bp, Homo sapiens
tggcagagtaggatggccctgt

SEQ ID NO: 7284822 - DNA, 22 bp, Homo sapiens
tggcagagttcgctgtgccttt

SEQ ID NO: 7284823 - DNA, 22 bp, Homo sapiens
tggcagataaaataatagggaa

SEQ ID NO: 7284824 - DNA, 22 bp, Homo sapiens
tggcagataacctgctgtgccc

SEQ ID NO: 7284825 - DNA, 22 bp, Homo sapiens
tggcagatacccaggcaaatgg

SEQ ID NO: 7284826 - DNA, 23 bp, Homo sapiens
tggcagatacaggcatgacttct

SEQ ID NO: 7284827 - DNA, 22 bp, Homo sapiens
tggcagctgcaggcctcctgag

SEQ ID NO: 7284828 - DNA, 22 bp, Homo sapiens
tggcagctgccatgtccacgtg

SEQ ID NO: 7284829 - DNA, 22 bp, Homo sapiens
tggcaggaaataccctgcctag

SEQ ID NO: 7284830 - DNA, 21 bp, Homo sapiens
tggcaggggtagtagtacagc

SEQ ID NO: 7284831 - DNA, 22 bp, Homo sapiens
tggcagggtacaccttaacacc

SEQ ID NO: 7284832 - DNA, 22 bp, Homo sapiens
tggcaggggaggtgcttgctta

SEQ ID NO: 7284833 - DNA, 18 bp, Homo sapiens
tggcaggggcagtacgcc

SEQ ID NO: 7284834 - DNA, 18 bp, Homo sapiens
tggcaggggcagtacgcc

SEQ ID NO: 7284835 - DNA, 22 bp, Homo sapiens
tggcagggcctaccccaatatc

SEQ ID NO: 7284836 - DNA, 22 bp, Homo sapiens
tggcagggagttgcaggatttc

SEQ ID NO: 7284837 - DNA, 22 bp, Homo sapiens
tggcagggcctgaatcttatac

SEQ ID NO: 7284838 - DNA, 22 bp, Homo sapiens
tggcagggcctgctcatcatcc

SEQ ID NO: 7284839 - DNA, 21 bp, Homo sapiens
tggcaggcagctggaagcttg

SEQ ID NO: 7284840 - DNA, 18 bp, Homo sapiens
tggcagggaggaaatata

SEQ ID NO: 7284841 - DNA, 19 bp, Homo sapiens
tggcagggagtgatattag

SEQ ID NO: 7284842 - DNA, 22 bp, Homo sapiens
tggcagggagttcgttcacaac

SEQ ID NO: 7284843 - DNA, 22 bp, Homo sapiens
tggcatttcacctttcatttcc

SEQ ID NO: 7284844 - DNA, 22 bp, Homo sapiens
tggcagtcttgtaggcatctcc

SEQ ID NO: 7284845 - DNA, 22 bp, Homo sapiens
tggcagtcctcttcctcgggcg

SEQ ID NO: 7284846 - DNA, 22 bp, Homo sapiens
tggcagtcccctgtgcctggaa

SEQ ID NO: 7284847 - DNA, 22 bp, Homo sapiens
tggcagtcggacttctatctca

SEQ ID NO: 7284848 - DNA, 22 bp, Homo sapiens
tggcagtcgatcatattcagca

SEQ ID NO: 7284849 - DNA, 22 bp, Homo sapiens
tggcagtctgggttggcagtta

SEQ ID NO: 7284850 - DNA, 22 bp, Homo sapiens
tggcagtcttcatcagttctgg

SEQ ID NO: 7284851 - DNA, 22 bp, Homo sapiens
tggcagggtcttgctgtgttgc

SEQ ID NO: 7284852 - DNA, 22 bp, Homo sapiens
tggcagggtggcaacttttggt

SEQ ID NO: 7284853 - DNA, 22 bp, Homo sapiens
tggcagggtgccagttgcgagt

SEQ ID NO: 7284854 - DNA, 22 bp, Homo sapiens
tggcagggtgccagttgcgagt

SEQ ID NO: 7284855 - DNA, 22 bp, Homo sapiens
tggcatgataggaggtgcagaa

SEQ ID NO: 7284856 - DNA, 22 bp, Homo sapiens
tggcatgaagtcagcagctggg

SEQ ID NO: 7284857 - DNA, 23 bp, Homo sapiens
tggccctgaatctgtcctggagg

SEQ ID NO: 7284858 - DNA, 22 bp, Homo sapiens
tggccctgaatcaaggccagca

SEQ ID NO: 7284859 - DNA, 22 bp, Homo sapiens
tggccctgaaggccttgagcat

SEQ ID NO: 7284860 - DNA, 22 bp, Homo sapiens
tggccctgccactcactgctga

SEQ ID NO: 7284861 - DNA, 22 bp, Homo sapiens
tggccctgcagaactagcctgg

SEQ ID NO: 7284862 - DNA, 22 bp, Homo sapiens
tggccctgaggggctgtgcccc

SEQ ID NO: 7284863 - DNA, 22 bp, Homo sapiens
tggccctgagggctcggagcca

SEQ ID NO: 7284864 - DNA, 22 bp, Homo sapiens
tggccctgcacccagagcagtt

SEQ ID NO: 7284865 - DNA, 22 bp, Homo sapiens
tggccctgacttggaggcctga

SEQ ID NO: 7284866 - DNA, 22 bp, Homo sapiens
tggccctgaggacccagtgtgg

SEQ ID NO: 7284867 - DNA, 22 bp, Homo sapiens
tggccctgactgatgtggaggg

SEQ ID NO: 7284868 - DNA, 22 bp, Homo sapiens
tggccctgacaggtcctgggca

SEQ ID NO: 7284869 - DNA, 22 bp, Homo sapiens
tggccatgggatagtgcagggg

SEQ ID NO: 7284870 - DNA, 22 bp, Homo sapiens
tggccagttgaagacaatgctc

SEQ ID NO: 7284871 - DNA, 22 bp, Homo sapiens
tggccagtgattaatgacgctt

SEQ ID NO: 7284872 - DNA, 22 bp, Homo sapiens
tggccagtctgtggaagccagg

SEQ ID NO: 7284873 - DNA, 22 bp, Homo sapiens
tggcctgcccagagcagctctg

SEQ ID NO: 7284874 - DNA, 22 bp, Homo sapiens
tggcctgcagaggctgtggggc

SEQ ID NO: 7284875 - DNA, 20 bp, Homo sapiens
tggcctctgagatgccacgg

SEQ ID NO: 7284876 - DNA, 22 bp, Homo sapiens
tggcctctggctgaggactaac

SEQ ID NO: 7284877 - DNA, 20 bp, Homo sapiens
tggcctctgtagaggccaag

SEQ ID NO: 7284878 - DNA, 22 bp, Homo sapiens
tggcctcttaggacatcctcta

SEQ ID NO: 7284879 - DNA, 22 bp, Homo sapiens
tggcctctgtgggagctgagca

SEQ ID NO: 7284880 - DNA, 22 bp, Homo sapiens
tggcctcttaaggatgacacaa

SEQ ID NO: 7284881 - DNA, 22 bp, Homo sapiens
tggcctggccctgaggccctgt

SEQ ID NO: 7284882 - DNA, 22 bp, Homo sapiens
tggcctgctctgactttggggg

SEQ ID NO: 7284883 - DNA, 22 bp, Homo sapiens
tggcctgccttcgctgagctga

SEQ ID NO: 7284884 - DNA, 22 bp, Homo sapiens
tggccctgtgactgagttctag

SEQ ID NO: 7284885 - DNA, 22 bp, Homo sapiens
tggccctgtctgcacacaggat

SEQ ID NO: 7284886 - DNA, 22 bp, Homo sapiens
tggccctgtccctggagcctgg

SEQ ID NO: 7284887 - DNA, 22 bp, Homo sapiens
tggccctggtggcacagcctgc

SEQ ID NO: 7284888 - DNA, 22 bp, Homo sapiens
tggccctgccctcttcatcttt

SEQ ID NO: 7284889 - DNA, 22 bp, Homo sapiens
tggccctgccgcactatcctca

SEQ ID NO: 7284890 - DNA, 22 bp, Homo sapiens
tggccctgccgccacgacgtct

SEQ ID NO: 7284891 - DNA, 22 bp, Homo sapiens
tggccctgggcatctttcgtga

SEQ ID NO: 7284892 - DNA, 22 bp, Homo sapiens
tggccctgttctgtacctcata

SEQ ID NO: 7284893 - DNA, 20 bp, Homo sapiens
tggccctgttttctccaggc

SEQ ID NO: 7284894 - DNA, 23 bp, Homo sapiens
tggccctgtgcatgctgcttccc

SEQ ID NO: 7284895 - DNA, 22 bp, Homo sapiens
tggccctgtgtcctgctgccag

SEQ ID NO: 7284896 - DNA, 22 bp, Homo sapiens
tggccctgtgtgcaggctgcac

SEQ ID NO: 7284897 - DNA, 22 bp, Homo sapiens
tggctcagctttccccatctgg

SEQ ID NO: 7284898 - DNA, 22 bp, Homo sapiens
tggctcagcttacttttgaggg

SEQ ID NO: 7284899 - DNA, 22 bp, Homo sapiens
tggctcaggcctacgacgcctt

SEQ ID NO: 7284900 - DNA, 22 bp, Homo sapiens
tggctcaggccacttcttttat

SEQ ID NO: 7284901 - DNA, 22 bp, Homo sapiens
tggctcagggtccccaaatggt

SEQ ID NO: 7284902 - DNA, 22 bp, Homo sapiens
tggctcagtaatcgagtctcct

SEQ ID NO: 7284903 - DNA, 22 bp, Homo sapiens
tggctcagtctgggttgactga

SEQ ID NO: 7284904 - DNA, 22 bp, Homo sapiens
tggctcagtgcattcacagtaa

SEQ ID NO: 7284905 - DNA, 22 bp, Homo sapiens
tggctcagtgacattcctccca

SEQ ID NO: 7284906 - DNA, 22 bp, Homo sapiens
tggcctggctcacagtgagatt

SEQ ID NO: 7284907 - DNA, 22 bp, Homo sapiens
tggcctggttgttgctgccgtt

SEQ ID NO: 7284908 - DNA, 22 bp, Homo sapiens
tggctcagaggggaagtggttt

SEQ ID NO: 7284909 - DNA, 22 bp, Homo sapiens
tggctcagatgctcttccagtg

SEQ ID NO: 7284910 - DNA, 22 bp, Homo sapiens
tggctcagaactacttctagtt

SEQ ID NO: 7284911 - DNA, 21 bp, Homo sapiens
tggcggggacttgtggctgcc

SEQ ID NO: 7284912 - DNA, 21 bp, Homo sapiens
tggctgcaagcagctgcctcc

SEQ ID NO: 7284913 - DNA, 22 bp, Homo sapiens
tggctgaggctggagtgcagtg

SEQ ID NO: 7284914 - DNA, 23 bp, Homo sapiens
tggctctgtggatccctcaggag

SEQ ID NO: 7284915 - DNA, 22 bp, Homo sapiens
tgggaactctctgggaggcatc

SEQ ID NO: 7284916 - DNA, 22 bp, Homo sapiens
tggcttcttgtctaatttgtta

SEQ ID NO: 7284917 - DNA, 22 bp, Homo sapiens
tggctttatgtgttacgaaaat

SEQ ID NO: 7284918 - DNA, 22 bp, Homo sapiens
tggcttcaggagcacctggctt

SEQ ID NO: 7284919 - DNA, 22 bp, Homo sapiens
tggcttcagacttctgctacgt

SEQ ID NO: 7284920 - DNA, 22 bp, Homo sapiens
tggcttctcagtttcataatga

SEQ ID NO: 7284921 - DNA, 22 bp, Homo sapiens
tggcttctccagaaatcttggt

SEQ ID NO: 7284922 - DNA, 22 bp, Homo sapiens
tggcttctagagcccatccttc

SEQ ID NO: 7284923 - DNA, 22 bp, Homo sapiens
tggcttctcccgacaccctggc

SEQ ID NO: 7284924 - DNA, 18 bp, Homo sapiens
tggcttctgaacaactgc

SEQ ID NO: 7284925 - DNA, 20 bp, Homo sapiens
tggcttctcttcactcctgt

SEQ ID NO: 7284926 - DNA, 22 bp, Homo sapiens
tggcttctgagtctcctgacat

SEQ ID NO: 7284927 - DNA, 22 bp, Homo sapiens
tggcttctggggtggcctgcat

SEQ ID NO: 7284928 - DNA, 22 bp, Homo sapiens
tggctggcaaggctggagtcag

SEQ ID NO: 7284929 - DNA, 22 bp, Homo sapiens
tggctggcatagccattgctcc

SEQ ID NO: 7284930 - DNA, 22 bp, Homo sapiens
tggctggcagttatctttggat

SEQ ID NO: 7284931 - DNA, 22 bp, Homo sapiens
tggctggccctgggagtgcaga

SEQ ID NO: 7284932 - DNA, 22 bp, Homo sapiens
tggctggcgccgggctagccac

SEQ ID NO: 7284933 - DNA, 18 bp, Homo sapiens
tggctggcagtgggcagc

SEQ ID NO: 7284934 - DNA, 22 bp, Homo sapiens
tggctggcagtaggctagtggc

SEQ ID NO: 7284935 - DNA, 23 bp, Homo sapiens
tggctggcagaaactgaagcatg

SEQ ID NO: 7284936 - DNA, 23 bp, Homo sapiens
tggctggcgcctgcctcaccctg

SEQ ID NO: 7284937 - DNA, 22 bp, Homo sapiens
tggctggcgttggggccagtga

SEQ ID NO: 7284938 - DNA, 22 bp, Homo sapiens
tggctggctagaatggaaatgt

SEQ ID NO: 7284939 - DNA, 22 bp, Homo sapiens
tggctgggccgggccttgtgcc

SEQ ID NO: 7284940 - DNA, 22 bp, Homo sapiens
tggcttcacaatttcataacta

SEQ ID NO: 7284941 - DNA, 22 bp, Homo sapiens
tggctgtgtccctgtccagagt

SEQ ID NO: 7284942 - DNA, 22 bp, Homo sapiens
tggctgtgggatatgtgactga

SEQ ID NO: 7284943 - DNA, 19 bp, Homo sapiens
tggctgggtgccaatggcc

SEQ ID NO: 7284944 - DNA, 22 bp, Homo sapiens
tggctggggcctgaatcctgca

SEQ ID NO: 7284945 - DNA, 22 bp, Homo sapiens
tgggaaggtacacgggaaagag

SEQ ID NO: 7284946 - DNA, 22 bp, Homo sapiens
tgggaaggtgtagaaagaacaa

SEQ ID NO: 7284947 - DNA, 22 bp, Homo sapiens
tgggaagggagtttcttggagt

SEQ ID NO: 7284948 - DNA, 22 bp, Homo sapiens
tgggaatgggcctagaaggctg

SEQ ID NO: 7284949 - DNA, 22 bp, Homo sapiens
tgggagcaaatgactgggagat

SEQ ID NO: 7284950 - DNA, 22 bp, Homo sapiens
tgggagcaagctacttagggaa

SEQ ID NO: 7284951 - DNA, 22 bp, Homo sapiens
tgggagatattgctgtggctgt

SEQ ID NO: 7284952 - DNA, 22 bp, Homo sapiens
tgggagaacccagggtcaggct

SEQ ID NO: 7284953 - DNA, 22 bp, Homo sapiens
tgggagaaactgtctctcccac

SEQ ID NO: 7284954 - DNA, 22 bp, Homo sapiens
tgggaggatctcttgaggccag

SEQ ID NO: 7284955 - DNA, 22 bp, Homo sapiens
tgggaggcagaagttgactgga

SEQ ID NO: 7284956 - DNA, 22 bp, Homo sapiens
tgggaggatcgcttgagcccag

SEQ ID NO: 7284957 - DNA, 20 bp, Homo sapiens
tgggagctggtgaggtctca

SEQ ID NO: 7284958 - DNA, 22 bp, Homo sapiens
tgggagcagctttgcgagggag

SEQ ID NO: 7284959 - DNA, 22 bp, Homo sapiens
tgggagcaccttgagggcagaa

SEQ ID NO: 7284960 - DNA, 22 bp, Homo sapiens
tgggagcaccctgaggagcttc

SEQ ID NO: 7284961 - DNA, 22 bp, Homo sapiens
tgggggcagccaggctgtcaag

SEQ ID NO: 7284962 - DNA, 22 bp, Homo sapiens
tgggggagccttcacagtagct

SEQ ID NO: 7284963 - DNA, 22 bp, Homo sapiens
tgggggcacttcgaggtcgcct

SEQ ID NO: 7284964 - DNA, 22 bp, Homo sapiens
tgggggagagtgcaagcatgaa

SEQ ID NO: 7284965 - DNA, 22 bp, Homo sapiens
tgggggagagtttagatgattt

SEQ ID NO: 7284966 - DNA, 22 bp, Homo sapiens
tggggccaggtggctgcaggtc

SEQ ID NO: 7284967 - DNA, 22 bp, Homo sapiens
tggggcctcaggccttttccta

SEQ ID NO: 7284968 - DNA, 19 bp, Homo sapiens
tggggcctcctgtccctgg

SEQ ID NO: 7284969 - DNA, 22 bp, Homo sapiens
tggggcctgaggtggagctgca

SEQ ID NO: 7284970 - DNA, 22 bp, Homo sapiens
tggggccagagatggggcgcag

SEQ ID NO: 7284971 - DNA, 22 bp, Homo sapiens
tggggccttggcctcattagat

SEQ ID NO: 7284972 - DNA, 20 bp, Homo sapiens
tggggcctgtttctgtggtt

SEQ ID NO: 7284973 - DNA, 22 bp, Homo sapiens
tggggctagaatcctgcaggaa

SEQ ID NO: 7284974 - DNA, 22 bp, Homo sapiens
tggggctcacctaggctggaag

SEQ ID NO: 7284975 - DNA, 22 bp, Homo sapiens
tggggcctggtcagagctgcac

SEQ ID NO: 7284976 - DNA, 23 bp, Homo sapiens
tggggctctggcaggcctgaggt

SEQ ID NO: 7284977 - DNA, 22 bp, Homo sapiens
tggggctctccacagtgtctca

SEQ ID NO: 7284978 - DNA, 23 bp, Homo sapiens
tgggcttctgagaaagcacctaa

SEQ ID NO: 7284979 - DNA, 18 bp, Homo sapiens
tgggctgcctggcctctg

SEQ ID NO: 7284980 - DNA, 22 bp, Homo sapiens
tggggtctgagtatctgcattt

SEQ ID NO: 7284981 - DNA, 20 bp, Homo sapiens
tggggtctagttggcctggg

SEQ ID NO: 7284982 - DNA, 22 bp, Homo sapiens
tggggtgggcatgcgctgtcct

SEQ ID NO: 7284983 - DNA, 22 bp, Homo sapiens
tgggtagaaacaaggctggact

SEQ ID NO: 7284984 - DNA, 22 bp, Homo sapiens
tgggtagagacacagtctgggg

SEQ ID NO: 7284985 - DNA, 22 bp, Homo sapiens
tgggtagagcaggctggggctt

SEQ ID NO: 7284986 - DNA, 22 bp, Homo sapiens
tgggtagaggaattgggctacc

SEQ ID NO: 7284987 - DNA, 22 bp, Homo sapiens
tgggtctccagttcagggcagg

SEQ ID NO: 7284988 - DNA, 22 bp, Homo sapiens
tggtatgtaaattgtaactcaa

SEQ ID NO: 7284989 - DNA, 22 bp, Homo sapiens
tggtaaaaaccgcaattacatt

SEQ ID NO: 7284990 - DNA, 22 bp, Homo sapiens
tgggttataatttgttatgaat

SEQ ID NO: 7284991 - DNA, 22 bp, Homo sapiens
tggtaaaaactgcaattacttt

SEQ ID NO: 7284992 - DNA, 22 bp, Homo sapiens
tgggaggccaaggcaggcggat

SEQ ID NO: 7284993 - DNA, 22 bp, Homo sapiens
tgggaggcccaggcctggcagg

SEQ ID NO: 7284994 - DNA, 22 bp, Homo sapiens
tgggaggccgaggcaggtggat

SEQ ID NO: 7284995 - DNA, 22 bp, Homo sapiens
tgggagtccaaggtttttatag

SEQ ID NO: 7284996 - DNA, 22 bp, Homo sapiens
tgggaggcttccagaccttgct

SEQ ID NO: 7284997 - DNA, 22 bp, Homo sapiens
tgggatgagttgttaggactga

SEQ ID NO: 7284998 - DNA, 22 bp, Homo sapiens
tgggatctgcagtttaacaaaa

SEQ ID NO: 7284999 - DNA, 22 bp, Homo sapiens
tgggatcttttgagatactgtg

SEQ ID NO: 7285000 - DNA, 22 bp, Homo sapiens
tgggcaggttgttatttgacat

SEQ ID NO: 7285001 - DNA, 19 bp, Homo sapiens
tgggcaggttcagtaatgg

SEQ ID NO: 7285002 - DNA, 22 bp, Homo sapiens
tgggcagggatctcttttgcaa

SEQ ID NO: 7285003 - DNA, 22 bp, Homo sapiens
tgggcaggggccctgcttccgt

SEQ ID NO: 7285004 - DNA, 22 bp, Homo sapiens
tgggcagatgtggctctccttg

SEQ ID NO: 7285005 - DNA, 21 bp, Homo sapiens
tgggcagatggcagtgtggct

SEQ ID NO: 7285006 - DNA, 22 bp, Homo sapiens
tgggccttggatcgctaagctg

SEQ ID NO: 7285007 - DNA, 22 bp, Homo sapiens
tgggccttgtcccctcagctgt

SEQ ID NO: 7285008 - DNA, 22 bp, Homo sapiens
tgggccttacttggggctgact

SEQ ID NO: 7285009 - DNA, 22 bp, Homo sapiens
tgggccttctaatctggtccct

SEQ ID NO: 7285010 - DNA, 22 bp, Homo sapiens
tgggccttctcaatgcactgga

SEQ ID NO: 7285011 - DNA, 22 bp, Homo sapiens
tgggcctgttgcctgagtccat

SEQ ID NO: 7285012 - DNA, 22 bp, Homo sapiens
tgggcctgtttcccttcagggc

SEQ ID NO: 7285013 - DNA, 20 bp, Homo sapiens
tgggcctgtggcagaagtct

SEQ ID NO: 7285014 - DNA, 22 bp, Homo sapiens
tgggcctgtggcttggctctag

SEQ ID NO: 7285015 - DNA, 22 bp, Homo sapiens
tgggcctgtgatgctgggctat

SEQ ID NO: 7285016 - DNA, 21 bp, Homo sapiens
tgggcctgtccctcttggagg

SEQ ID NO: 7285017 - DNA, 22 bp, Homo sapiens
tgggcctgggttcctcctgggc

SEQ ID NO: 7285018 - DNA, 22 bp, Homo sapiens
tgggctatgtaggagtggagtt

SEQ ID NO: 7285019 - DNA, 22 bp, Homo sapiens
tgggctcaaactggaggttgtt

SEQ ID NO: 7285020 - DNA, 22 bp, Homo sapiens
tgggctcaatctgcttctgttt

SEQ ID NO: 7285021 - DNA, 22 bp, Homo sapiens
tgggcgaggcccagggctgcgt

SEQ ID NO: 7285022 - DNA, 22 bp, Homo sapiens
tgggctcagtctgcacctgcgg

SEQ ID NO: 7285023 - DNA, 22 bp, Homo sapiens
tgggctcagggaagcttggcct

SEQ ID NO: 7285024 - DNA, 22 bp, Homo sapiens
tgggctcaggaccccagaggcc

SEQ ID NO: 7285025 - DNA, 22 bp, Homo sapiens
tgggctcactggggcagggacc

SEQ ID NO: 7285026 - DNA, 22 bp, Homo sapiens
tgggctcagaagatagtttcca

SEQ ID NO: 7285027 - DNA, 22 bp, Homo sapiens
tgggctcagccatgacctccac

SEQ ID NO: 7285028 - DNA, 22 bp, Homo sapiens
tgggctcagcctcagtctgtgg

SEQ ID NO: 7285029 - DNA, 22 bp, Homo sapiens
tgggctcagccttcatgtggcc

SEQ ID NO: 7285030 - DNA, 22 bp, Homo sapiens
tgggctgccggcaggctctgcc

SEQ ID NO: 7285031 - DNA, 22 bp, Homo sapiens
tgggctgccctgatggtcctca

SEQ ID NO: 7285032 - DNA, 21 bp, Homo sapiens
tgggctctttaacccaggcac

SEQ ID NO: 7285033 - DNA, 22 bp, Homo sapiens
tgggctctgaagggtcccggat

SEQ ID NO: 7285034 - DNA, 22 bp, Homo sapiens
tgggctctgaagtcagtctgct

SEQ ID NO: 7285035 - DNA, 22 bp, Homo sapiens
tgggctctctcacctggaggct

SEQ ID NO: 7285036 - DNA, 22 bp, Homo sapiens
tgggctctcgtccctgcagaag

SEQ ID NO: 7285037 - DNA, 22 bp, Homo sapiens
tgggctctcaaagtgcggcttg

SEQ ID NO: 7285038 - DNA, 22 bp, Homo sapiens
tgggctcagtctgcttggtcct

SEQ ID NO: 7285039 - DNA, 22 bp, Homo sapiens
tgggctctgggtggcctgagca

SEQ ID NO: 7285040 - DNA, 22 bp, Homo sapiens
tgggctctggtttcctggctgg

SEQ ID NO: 7285041 - DNA, 22 bp, Homo sapiens
tgggctctggagggcctaggat

SEQ ID NO: 7285042 - DNA, 22 bp, Homo sapiens
tgggccaggtctgtgtcagctg

SEQ ID NO: 7285043 - DNA, 22 bp, Homo sapiens
tgggccaggtctgcggtcattt

SEQ ID NO: 7285044 - DNA, 22 bp, Homo sapiens
tgggccaggggcctcttctgat

SEQ ID NO: 7285045 - DNA, 22 bp, Homo sapiens
tgggccagggcacccagtccag

SEQ ID NO: 7285046 - DNA, 22 bp, Homo sapiens
tgggccaggtgcagtgctttag

SEQ ID NO: 7285047 - DNA, 21 bp, Homo sapiens
tgggcctcaggcagctgtgac

SEQ ID NO: 7285048 - DNA, 22 bp, Homo sapiens
tgggcctcccatgtcttaggga

SEQ ID NO: 7285049 - DNA, 22 bp, Homo sapiens
tgggcctcctgccctggcctag

SEQ ID NO: 7285050 - DNA, 22 bp, Homo sapiens
tgggcctcatcttcaatgagtc

SEQ ID NO: 7285051 - DNA, 22 bp, Homo sapiens
tgggcctcagtttccttaggat

SEQ ID NO: 7285052 - DNA, 20 bp, Homo sapiens
tgggcctctggtgcctctgg

SEQ ID NO: 7285053 - DNA, 22 bp, Homo sapiens
tgggcctctgtttcctcatctg

SEQ ID NO: 7285054 - DNA, 22 bp, Homo sapiens
tgggcctgaaggagctgcgccc

SEQ ID NO: 7285055 - DNA, 22 bp, Homo sapiens
tgggcctgaaattcccatttta

SEQ ID NO: 7285056 - DNA, 22 bp, Homo sapiens
tgggcctcctttccattcagag

SEQ ID NO: 7285057 - DNA, 22 bp, Homo sapiens
tgggcctctgccacgctccccc

SEQ ID NO: 7285058 - DNA, 21 bp, Homo sapiens
tgggcctgattcccagggtca

SEQ ID NO: 7285059 - DNA, 22 bp, Homo sapiens
tgggcctgagtttgggaactgg

SEQ ID NO: 7285060 - DNA, 22 bp, Homo sapiens
tgggcctgagctcaccaggggc

SEQ ID NO: 7285061 - DNA, 20 bp, Homo sapiens
tgggcctgagcctgtgggct

SEQ ID NO: 7285062 - DNA, 22 bp, Homo sapiens
tgggcctgacacttactaggga

SEQ ID NO: 7285063 - DNA, 22 bp, Homo sapiens
tgggcctgactcacctgcctcc

SEQ ID NO: 7285064 - DNA, 18 bp, Homo sapiens
tgggcctgcatcctagtc

SEQ ID NO: 7285065 - DNA, 19 bp, Homo sapiens
tgggcctgcatctgggtct

SEQ ID NO: 7285066 - DNA, 22 bp, Homo sapiens
tgggcctggacaaggccactag

SEQ ID NO: 7285067 - DNA, 22 bp, Homo sapiens
tgggcctgggctcctgtcctct

SEQ ID NO: 7285068 - DNA, 23 bp, Homo sapiens
tgggcctggaaagccttagagag

SEQ ID NO: 7285069 - DNA, 22 bp, Homo sapiens
tgggcctgggtctttgctgcca

SEQ ID NO: 7285070 - DNA, 22 bp, Homo sapiens
tggttaagtccagaaaggaagc

SEQ ID NO: 7285071 - DNA, 22 bp, Homo sapiens
tgtaaaataattctccatgttt

SEQ ID NO: 7285072 - DNA, 22 bp, Homo sapiens
tgtaaagatccttagcaacatc

SEQ ID NO: 7285073 - DNA, 22 bp, Homo sapiens
tggtgcccactctggacccagc

SEQ ID NO: 7285074 - DNA, 22 bp, Homo sapiens
tggtccagactttgacctctca

SEQ ID NO: 7285075 - DNA, 22 bp, Homo sapiens
tggtcctgagcaccagcctgac

SEQ ID NO: 7285076 - DNA, 22 bp, Homo sapiens
tggtcctggaaggtcctgaggg

SEQ ID NO: 7285077 - DNA, 23 bp, Homo sapiens
tggtcctgccaacggtgcccctc

SEQ ID NO: 7285078 - DNA, 22 bp, Homo sapiens
tggtcctgcccacgcccatctg

SEQ ID NO: 7285079 - DNA, 22 bp, Homo sapiens
tggtgagatgtatggagggttg

SEQ ID NO: 7285080 - DNA, 22 bp, Homo sapiens
tggtgagatgcagcaacagaca

SEQ ID NO: 7285081 - DNA, 22 bp, Homo sapiens
tggtgagaagttttgagattct

SEQ ID NO: 7285082 - DNA, 22 bp, Homo sapiens
tggtgagacaggatcaacccct

SEQ ID NO: 7285083 - DNA, 22 bp, Homo sapiens
tggtgagaccttgttccttatg

SEQ ID NO: 7285084 - DNA, 20 bp, Homo sapiens
tggtgagagcacctgatggg

SEQ ID NO: 7285085 - DNA, 22 bp, Homo sapiens
tggtgagagcagaccttctttt

SEQ ID NO: 7285086 - DNA, 22 bp, Homo sapiens
tggtgagagctgaccgtgcgag

SEQ ID NO: 7285087 - DNA, 22 bp, Homo sapiens
tggtgagataactttcggcaag

SEQ ID NO: 7285088 - DNA, 22 bp, Homo sapiens
tggtcctggggtgcaggctgac

SEQ ID NO: 7285089 - DNA, 22 bp, Homo sapiens
tgtagaagtttatgaacacatt

SEQ ID NO: 7285090 - DNA, 18 bp, Homo sapiens
tgtagaaaagataggaat

SEQ ID NO: 7285091 - DNA, 22 bp, Homo sapiens
tgtagaaactacacatgcaaca

SEQ ID NO: 7285092 - DNA, 22 bp, Homo sapiens
tgtagaaactacacatgcaaca

SEQ ID NO: 7285093 - DNA, 22 bp, Homo sapiens
tgtagatatagaaaaagactga

SEQ ID NO: 7285094 - DNA, 22 bp, Homo sapiens
tgtcacagggataccatggggc

SEQ ID NO: 7285095 - DNA, 20 bp, Homo sapiens
tgtatttaatgaaggctttt

SEQ ID NO: 7285096 - DNA, 22 bp, Homo sapiens
tgtatttatattagaatggttg

SEQ ID NO: 7285097 - DNA, 22 bp, Homo sapiens
tgtcattttagtgcatcactca

SEQ ID NO: 7285098 - DNA, 22 bp, Homo sapiens
tgtcattttctggttagttaat

SEQ ID NO: 7285099 - DNA, 22 bp, Homo sapiens
tgtcagttaaatgaggtacaag

SEQ ID NO: 7285100 - DNA, 22 bp, Homo sapiens
tgtcagttcaattatagtaatt

SEQ ID NO: 7285101 - DNA, 22 bp, Homo sapiens
tgtcagttcagtgattacaaaa

SEQ ID NO: 7285102 - DNA, 22 bp, Homo sapiens
tgtcctgtccttcctggaagtc

SEQ ID NO: 7285103 - DNA, 22 bp, Homo sapiens
tgtcctggtgctccaggtggct

SEQ ID NO: 7285104 - DNA, 22 bp, Homo sapiens
ttcaggaaatttgtgtcacagg

SEQ ID NO: 7285105 - DNA, 22 bp, Homo sapiens
ttcacatttgcccttatgtgtg

SEQ ID NO: 7285106 - DNA, 22 bp, Homo sapiens
ttcacatttgaaaggaaagata

SEQ ID NO: 7285107 - DNA, 20 bp, Homo sapiens
ttcacatttctgtagtgatt

SEQ ID NO: 7285108 - DNA, 19 bp, Homo sapiens
ttcacatttttgtggcact

SEQ ID NO: 7285109 - DNA, 19 bp, Homo sapiens
ttcacattttgctctgagg

SEQ ID NO: 7285110 - DNA, 22 bp, Homo sapiens
ttcacatttcataccacagctt

SEQ ID NO: 7285111 - DNA, 22 bp, Homo sapiens
ttcacatttctctgctgtttga

SEQ ID NO: 7285112 - DNA, 22 bp, Homo sapiens
ttcacatttactggtttgtccg

SEQ ID NO: 7285113 - DNA, 22 bp, Homo sapiens
ttcacattgttttaatgtgaat

SEQ ID NO: 7285114 - DNA, 22 bp, Homo sapiens
ttcacattgtggttcatgtgaa

SEQ ID NO: 7285115 - DNA, 22 bp, Homo sapiens
ttcacattggtgatatgtttct

SEQ ID NO: 7285116 - DNA, 22 bp, Homo sapiens
ttcacattggttcttgatagct

SEQ ID NO: 7285117 - DNA, 22 bp, Homo sapiens
ttcacattgtgcagattatggt

SEQ ID NO: 7285118 - DNA, 22 bp, Homo sapiens
ttccagaggggaggtggcagcc

SEQ ID NO: 7285119 - DNA, 22 bp, Homo sapiens
ttccagctaactcacatccctt

SEQ ID NO: 7285120 - DNA, 22 bp, Homo sapiens
ttccagaggctctaggggagaa

SEQ ID NO: 7285121 - DNA, 22 bp, Homo sapiens
ttcattcattcatgaatgttaa

SEQ ID NO: 7285122 - DNA, 22 bp, Homo sapiens
ttagtacaagagattaattact

SEQ ID NO: 7285123 - DNA, 22 bp, Homo sapiens
ttagtacagaatcaaaagcaat

SEQ ID NO: 7285124 - DNA, 22 bp, Homo sapiens
ttagtacatagatgatggttga

SEQ ID NO: 7285125 - DNA, 22 bp, Homo sapiens
ttaggaagagctttcaatcact

SEQ ID NO: 7285126 - DNA, 22 bp, Homo sapiens
ttatgatttgccacagattggt

SEQ ID NO: 7285127 - DNA, 22 bp, Homo sapiens
ttaatggcagggcagaatatta

SEQ ID NO: 7285128 - DNA, 22 bp, Homo sapiens
ttaaagaatagtgcccctattg

SEQ ID NO: 7285129 - DNA, 22 bp, Homo sapiens
ttaaagagaactcaatgaatga

SEQ ID NO: 7285130 - DNA, 22 bp, Homo sapiens
ttacatgcagagggaagggaga

SEQ ID NO: 7285131 - DNA, 22 bp, Homo sapiens
ttacatgggcttgtgagtcctt

SEQ ID NO: 7285132 - DNA, 22 bp, Homo sapiens
ttacattcattgaagtgattca

SEQ ID NO: 7285133 - DNA, 22 bp, Homo sapiens
ttacattcccagtgtgcagcat

SEQ ID NO: 7285134 - DNA, 22 bp, Homo sapiens
ttacattcttggaatcttgttt

SEQ ID NO: 7285135 - DNA, 22 bp, Homo sapiens
ttacattcttatctcagttatt

SEQ ID NO: 7285136 - DNA, 22 bp, Homo sapiens
ttacattgtccagaaattattg

SEQ ID NO: 7285137 - DNA, 21 bp, Homo sapiens
ttacattcagaggagtggaag

SEQ ID NO: 7285138 - DNA, 22 bp, Homo sapiens
ttacattcagaaagatttgagt

SEQ ID NO: 7285139 - DNA, 22 bp, Homo sapiens
ttacattcaatttctagaggta

SEQ ID NO: 7285140 - DNA, 22 bp, Homo sapiens
ttacattcaaggaactcattct

SEQ ID NO: 7285141 - DNA, 22 bp, Homo sapiens
ttacatgtggtgtgaagaagag

SEQ ID NO: 7285142 - DNA, 22 bp, Homo sapiens
tgtgcctgatggtcacgtggcc

SEQ ID NO: 7285143 - DNA, 22 bp, Homo sapiens
tgtgcctggcattctgggcttc

SEQ ID NO: 7285144 - DNA, 22 bp, Homo sapiens
tgtgcctggatctctgtgacaa

SEQ ID NO: 7285145 - DNA, 20 bp, Homo sapiens
tgtgcctggctttgtcctga

SEQ ID NO: 7285146 - DNA, 22 bp, Homo sapiens
tgtgcctggtccctgagtcgag

SEQ ID NO: 7285147 - DNA, 22 bp, Homo sapiens
tgtgcctgtcccgcattctggt

SEQ ID NO: 7285148 - DNA, 22 bp, Homo sapiens
tgtgcctgttcccactttgcct

SEQ ID NO: 7285149 - DNA, 22 bp, Homo sapiens
tgtgcaggtgcaggaagggggc

SEQ ID NO: 7285150 - DNA, 22 bp, Homo sapiens
tgtgaccctctccgatgggcag

SEQ ID NO: 7285151 - DNA, 23 bp, Homo sapiens
tgtgacccctaggagtggggacc

SEQ ID NO: 7285152 - DNA, 22 bp, Homo sapiens
tgtgacccccgtcacggctgct

SEQ ID NO: 7285153 - DNA, 19 bp, Homo sapiens
tgtgaccccagacaagctg

SEQ ID NO: 7285154 - DNA, 22 bp, Homo sapiens
tgtgacccagactcatcttctt

SEQ ID NO: 7285155 - DNA, 22 bp, Homo sapiens
tgtgaaaggggtcacagggaaa

SEQ ID NO: 7285156 - DNA, 22 bp, Homo sapiens
tgtgaaaggagccatagacagt

SEQ ID NO: 7285157 - DNA, 22 bp, Homo sapiens
tgtgaaaggaaggcatgaaaag

SEQ ID NO: 7285158 - DNA, 22 bp, Homo sapiens
tgtgaaagatactaggcagagg

SEQ ID NO: 7285159 - DNA, 22 bp, Homo sapiens
tgtgaaagcagccatgggcatt

SEQ ID NO: 7285160 - DNA, 20 bp, Homo sapiens
tgtctgtgccacggcactcc

SEQ ID NO: 7285161 - DNA, 22 bp, Homo sapiens
tgtctgtgcccaaggctcccgg

SEQ ID NO: 7285162 - DNA, 22 bp, Homo sapiens
tgtctctgctttccttgcaggg

SEQ ID NO: 7285163 - DNA, 22 bp, Homo sapiens
tgtgggaggtctggaaggctcc

SEQ ID NO: 7285164 - DNA, 20 bp, Homo sapiens
tgtgggccttcggcgtgctc

SEQ ID NO: 7285165 - DNA, 22 bp, Homo sapiens
tgtgggctctaatggcagcaga

SEQ ID NO: 7285166 - DNA, 22 bp, Homo sapiens
tgtgggctgtactgagggcagg

SEQ ID NO: 7285167 - DNA, 22 bp, Homo sapiens
tgtgggcccagattctgaggct

SEQ ID NO: 7285168 - DNA, 22 bp, Homo sapiens
tgtgggccctaggcaccttgtc

SEQ ID NO: 7285169 - DNA, 22 bp, Homo sapiens
tgtgggcctgggaaggtgacac

SEQ ID NO: 7285170 - DNA, 22 bp, Homo sapiens
tgtgggcctcagcaggactcca

SEQ ID NO: 7285171 - DNA, 20 bp, Homo sapiens
tgtgggcccttggctggcaa

SEQ ID NO: 7285172 - DNA, 22 bp, Homo sapiens
tgtgggctttggagtcaggaag

SEQ ID NO: 7285173 - DNA, 22 bp, Homo sapiens
tgtggctctcctcctgctgccc

SEQ ID NO: 7285174 - DNA, 22 bp, Homo sapiens
tgtggccttgcagcctggaggt

SEQ ID NO: 7285175 - DNA, 22 bp, Homo sapiens
tgtggcctttcaaggatggaat

SEQ ID NO: 7285176 - DNA, 21 bp, Homo sapiens
tgtggctgcctctggccctgg

SEQ ID NO: 7285177 - DNA, 22 bp, Homo sapiens
tgtgggagaaggaagcaagctg

SEQ ID NO: 7285178 - DNA, 22 bp, Homo sapiens
tgtgggaggaattagaatggga

SEQ ID NO: 7285179 - DNA, 22 bp, Homo sapiens
tgttaaaaccacaggtgaggac

SEQ ID NO: 7285180 - DNA, 22 bp, Homo sapiens
tgttaaaaattcagctctagat

SEQ ID NO: 7285181 - DNA, 22 bp, Homo sapiens
tgtgtattctgaggtaggtata

SEQ ID NO: 7285182 - DNA, 22 bp, Homo sapiens
ttaaaagaatcctgttatcctc

SEQ ID NO: 7285183 - DNA, 22 bp, Homo sapiens
ttaaaatgcagattctgattca

SEQ ID NO: 7285184 - DNA, 22 bp, Homo sapiens
ttaaaaaccatcttcctttcct

SEQ ID NO: 7285185 - DNA, 18 bp, Homo sapiens
tgttaaatgaagatttgc

SEQ ID NO: 7285186 - DNA, 22 bp, Homo sapiens
tgttcttgagcctttagaccta

SEQ ID NO: 7285187 - DNA, 22 bp, Homo sapiens
agcatccagaaaactctcagaa

SEQ ID NO: 7285188 - DNA, 22 bp, Homo sapiens
agcatccactcactgggagagg

SEQ ID NO: 7285189 - DNA, 22 bp, Homo sapiens
agcatccaactttgattagaga

SEQ ID NO: 7285190 - DNA, 22 bp, Homo sapiens
agcatccaggccaggttgggca

SEQ ID NO: 7285191 - DNA, 19 bp, Homo sapiens
agcatccagtcatgggatc

SEQ ID NO: 7285192 - DNA, 22 bp, Homo sapiens
agcagggcctctggcactggtc

SEQ ID NO: 7285193 - DNA, 22 bp, Homo sapiens
agcagggctgtgctccttccga

SEQ ID NO: 7285194 - DNA, 22 bp, Homo sapiens
agcagggcttctgtgcctgtgc

SEQ ID NO: 7285195 - DNA, 22 bp, Homo sapiens
agcagggctgtgtaggtaatga

SEQ ID NO: 7285196 - DNA, 22 bp, Homo sapiens
agcagggcttgccgcttgtcct

SEQ ID NO: 7285197 - DNA, 23 bp, Homo sapiens
agcaggcatctgtggcacaaggc

SEQ ID NO: 7285198 - DNA, 19 bp, Homo sapiens
agcaggcaggtggcccagg

SEQ ID NO: 7285199 - DNA, 22 bp, Homo sapiens
agcaggagctgtgggaagatgg

SEQ ID NO: 7285200 - DNA, 22 bp, Homo sapiens
agcaggcaggctgccagtgaat

SEQ ID NO: 7285201 - DNA, 22 bp, Homo sapiens
agcaggagtgtcccctggctgt

SEQ ID NO: 7285202 - DNA, 22 bp, Homo sapiens
acacactgtaaggactatcact

SEQ ID NO: 7285203 - DNA, 22 bp, Homo sapiens
agattttatagataatttccca

SEQ ID NO: 7285204 - DNA, 22 bp, Homo sapiens
agattttagtttggggaggtgc

SEQ ID NO: 7285205 - DNA, 22 bp, Homo sapiens
agattttagtgtagaggacttg

SEQ ID NO: 7285206 - DNA, 22 bp, Homo sapiens
agcctggcttaatcctcctttt

SEQ ID NO: 7285207 - DNA, 22 bp, Homo sapiens
agcctggctgggaagagcctct

SEQ ID NO: 7285208 - DNA, 22 bp, Homo sapiens
agcctggctgtaacctcatggt

SEQ ID NO: 7285209 - DNA, 22 bp, Homo sapiens
agcctgtgtgaagccctcagag

SEQ ID NO: 7285210 - DNA, 22 bp, Homo sapiens
agctcagggcgatctgtctcgg

SEQ ID NO: 7285211 - DNA, 22 bp, Homo sapiens
agctcaggtagactcagcatct

SEQ ID NO: 7285212 - DNA, 22 bp, Homo sapiens
agccctgcacaggtctgtggct

SEQ ID NO: 7285213 - DNA, 22 bp, Homo sapiens
agccctgcacagttcgggagga

SEQ ID NO: 7285214 - DNA, 22 bp, Homo sapiens
agccctgcaggaggtgggagag

SEQ ID NO: 7285215 - DNA, 22 bp, Homo sapiens
agccctgcaggatgagggaggt

SEQ ID NO: 7285216 - DNA, 22 bp, Homo sapiens
agccctgcataaatcagttggt

SEQ ID NO: 7285217 - DNA, 22 bp, Homo sapiens
agccctgccctgccatgtggca

SEQ ID NO: 7285218 - DNA, 22 bp, Homo sapiens
agccctgcctctccaatgccca

SEQ ID NO: 7285219 - DNA, 16 bp, Homo sapiens
agccctgccgtgtact

SEQ ID NO: 7285220 - DNA, 22 bp, Homo sapiens
agccctgcatagaagggaacac

SEQ ID NO: 7285221 - DNA, 22 bp, Homo sapiens
agccctgccattctctggagct

SEQ ID NO: 7285222 - DNA, 22 bp, Homo sapiens
agccctgcgctcacgttctgca

SEQ ID NO: 7285223 - DNA, 22 bp, Homo sapiens
agccctgcgatcgtgatttctt

SEQ ID NO: 7285224 - DNA, 22 bp, Homo sapiens
agccctgcgtgccaggggactg

SEQ ID NO: 7285225 - DNA, 22 bp, Homo sapiens
agccaggcgcagtggcttatgc

SEQ ID NO: 7285226 - DNA, 22 bp, Homo sapiens
agccaggctactccttgctgac

SEQ ID NO: 7285227 - DNA, 22 bp, Homo sapiens
agccaggctaaatgagccatga

SEQ ID NO: 7285228 - DNA, 22 bp, Homo sapiens
agcccaggtctcaaagtacagg

SEQ ID NO: 7285229 - DNA, 22 bp, Homo sapiens
agcccagggctaataggaacca

SEQ ID NO: 7285230 - DNA, 22 bp, Homo sapiens
acagaacaggctgagaaaaaca

SEQ ID NO: 7285231 - DNA, 22 bp, Homo sapiens
agaggtggccatgggcgctgga

SEQ ID NO: 7285232 - DNA, 22 bp, Homo sapiens
agaggtgggagcctggtcacat

SEQ ID NO: 7285233 - DNA, 22 bp, Homo sapiens
agatctttaaaagttattatta

SEQ ID NO: 7285234 - DNA, 21 bp, Homo sapiens
aattttgaaggaagattaagg

SEQ ID NO: 7285235 - DNA, 22 bp, Homo sapiens
agaataaaatagtctgaagatg

SEQ ID NO: 7285236 - DNA, 22 bp, Homo sapiens
agaataaatgctacctatcaca

SEQ ID NO: 7285237 - DNA, 22 bp, Homo sapiens
aatggaatacctaggtggccca

SEQ ID NO: 7285238 - DNA, 22 bp, Homo sapiens
acaggaaagagctaggcatagg

SEQ ID NO: 7285239 - DNA, 22 bp, Homo sapiens
acagattttaaatgacactccc

SEQ ID NO: 7285240 - DNA, 22 bp, Homo sapiens
acagatttggcccagccaatgc

SEQ ID NO: 7285241 - DNA, 22 bp, Homo sapiens
acaggcagagagtggcggactc

SEQ ID NO: 7285242 - DNA, 22 bp, Homo sapiens
acaggcagagaactcagccaga

SEQ ID NO: 7285243 - DNA, 22 bp, Homo sapiens
acagtgcagtgtgatgagtatt

SEQ ID NO: 7285244 - DNA, 22 bp, Homo sapiens
acagtgcataaaaacaactttt

SEQ ID NO: 7285245 - DNA, 22 bp, Homo sapiens
acagtgcaggtctcaacaatta

SEQ ID NO: 7285246 - DNA, 19 bp, Homo sapiens
acagtgcatgggacctggt

SEQ ID NO: 7285247 - DNA, 20 bp, Homo sapiens
acagtgcatggggggacagc

SEQ ID NO: 7285248 - DNA, 22 bp, Homo sapiens
acagtgcattattgctgaatgc

SEQ ID NO: 7285249 - DNA, 22 bp, Homo sapiens
aaggtttctccgaggctatttt

SEQ ID NO: 7285250 - DNA, 22 bp, Homo sapiens
aagtaaaagctttaccatgcgc

SEQ ID NO: 7285251 - DNA, 22 bp, Homo sapiens
accaggaaaaacactgtgttgg

SEQ ID NO: 7285252 - DNA, 22 bp, Homo sapiens
aagggcagcctgactcacggtc

SEQ ID NO: 7285253 - DNA, 22 bp, Homo sapiens
accactgcccatggtgaaaact

SEQ ID NO: 7285254 - DNA, 22 bp, Homo sapiens
aagggcagctgacagatgctta

SEQ ID NO: 7285255 - DNA, 22 bp, Homo sapiens
aagggcagctattatcgtcatc

SEQ ID NO: 7285256 - DNA, 22 bp, Homo sapiens
aagggcagcttaaattggtagc

SEQ ID NO: 7285257 - DNA, 22 bp, Homo sapiens
accagcagagttgaggaggaca

SEQ ID NO: 7285258 - DNA, 22 bp, Homo sapiens
accaccccagaatttttcaagg

SEQ ID NO: 7285259 - DNA, 22 bp, Homo sapiens
acattcaagatgcattcactta

SEQ ID NO: 7285260 - DNA, 21 bp, Homo sapiens
acattacagggtgatgtgtct

SEQ ID NO: 7285261 - DNA, 21 bp, Homo sapiens
acatgggacctgcgaaaggaa

SEQ ID NO: 7285262 - DNA, 22 bp, Homo sapiens
acataccatctcctggaaagct

SEQ ID NO: 7285263 - DNA, 22 bp, Homo sapiens
aatactttcctatataaggtgc

SEQ ID NO: 7285264 - DNA, 22 bp, Homo sapiens
aatatgaattattgttacaagt

SEQ ID NO: 7285265 - DNA, 22 bp, Homo sapiens
agaaaattactccagagacaag

SEQ ID NO: 7285266 - DNA, 22 bp, Homo sapiens
agaaaatgtgaacttgtgaatt

SEQ ID NO: 7285267 - DNA, 22 bp, Homo sapiens
aatattcatttgcagaagaagt

SEQ ID NO: 7285268 - DNA, 22 bp, Homo sapiens
aatgaaaattggaccctagaac

SEQ ID NO: 7285269 - DNA, 22 bp, Homo sapiens
aagtgcaggagtggggaaagta

SEQ ID NO: 7285270 - DNA, 22 bp, Homo sapiens
aagtctcttttcttcctgtatt

SEQ ID NO: 7285271 - DNA, 18 bp, Homo sapiens
acctgcctgttcttctct

SEQ ID NO: 7285272 - DNA, 22 bp, Homo sapiens
aagtaacacggaacttgaagca

SEQ ID NO: 7285273 - DNA, 18 bp, Homo sapiens
aagtaacagaagagcaca

SEQ ID NO: 7285274 - DNA, 22 bp, Homo sapiens
aacattcacctctacctccttc

SEQ ID NO: 7285275 - DNA, 22 bp, Homo sapiens
aacattcaattgaggaagttaa

SEQ ID NO: 7285276 - DNA, 22 bp, Homo sapiens
aacagtacaactccacaagact

SEQ ID NO: 7285277 - DNA, 22 bp, Homo sapiens
aactcagatgtttggctacctt

SEQ ID NO: 7285278 - DNA, 22 bp, Homo sapiens
aacacaaagaagctgcaggatc

SEQ ID NO: 7285279 - DNA, 22 bp, Homo sapiens
aacacaaaaattctcaggggca

SEQ ID NO: 7285280 - DNA, 23 bp, Homo sapiens
aacacaaagctgattccagtggc

SEQ ID NO: 7285281 - DNA, 22 bp, Homo sapiens
aaagcacattacaagctcagtc

SEQ ID NO: 7285282 - DNA, 22 bp, Homo sapiens
aaagcacagggtgctagagagt

SEQ ID NO: 7285283 - DNA, 22 bp, Homo sapiens
aacaaattagttgcaagactgg

SEQ ID NO: 7285284 - DNA, 17 bp, Homo sapiens
aaatatgacctcaaagt

SEQ ID NO: 7285285 - DNA, 22 bp, Homo sapiens
aagcacttagaagagtgcctgc

SEQ ID NO: 7285286 - DNA, 22 bp, Homo sapiens
aaagcaatcagattcagatgtc

SEQ ID NO: 7285287 - DNA, 22 bp, Homo sapiens
aaagcaatggatgagaatctgt

SEQ ID NO: 7285288 - DNA, 22 bp, Homo sapiens
aaatactgttgaatgaagtaag

SEQ ID NO: 7285289 - DNA, 22 bp, Homo sapiens
aaatatgtatggagttcatgaa

SEQ ID NO: 7285290 - DNA, 22 bp, Homo sapiens
aaactactatgggaatgtactt

SEQ ID NO: 7285291 - DNA, 22 bp, Homo sapiens
aaatgctctccaaaatgaaagt

SEQ ID NO: 7285292 - DNA, 22 bp, Homo sapiens
aaatgctctgcatctgatagac

SEQ ID NO: 7285293 - DNA, 22 bp, Homo sapiens
aaatgctctctaatgtaataca

SEQ ID NO: 7285294 - DNA, 22 bp, Homo sapiens
aaatcatgttggcacaataaaa

SEQ ID NO: 7285295 - DNA, 22 bp, Homo sapiens
aaatcatggtggaagaaacaga

SEQ ID NO: 7285296 - DNA, 22 bp, Homo sapiens
aaagaactacctgtatgatatt

SEQ ID NO: 7285297 - DNA, 22 bp, Homo sapiens
aaagaacttatcctagaatttg

SEQ ID NO: 7285298 - DNA, 22 bp, Homo sapiens
aaaccactcctgattcacttca

SEQ ID NO: 7285299 - DNA, 22 bp, Homo sapiens
aaaccacttatatcgtgatttg

SEQ ID NO: 7285300 - DNA, 22 bp, Homo sapiens
aaacagtcgtcttaatagtatt

SEQ ID NO: 7285301 - DNA, 22 bp, Homo sapiens
aaaaatgaattcttcagtggca

SEQ ID NO: 7285302 - DNA, 22 bp, Homo sapiens
aaaaatgaattcttcagtggca

SEQ ID NO: 7285303 - DNA, 21 bp, Homo sapiens
aaaaatgaagttgttcaggaa

SEQ ID NO: 7285304 - DNA, 22 bp, Homo sapiens
aaaagggactactctcagctcc

SEQ ID NO: 7285305 - DNA, 22 bp, Homo sapiens
aaaaatgcttggacttaataaa

SEQ ID NO: 7285306 - DNA, 22 bp, Homo sapiens
aaaatagattctaggatgtctt

SEQ ID NO: 7285307 - DNA, 22 bp, Homo sapiens
aaaattcattcctcagactgcc

SEQ ID NO: 7285308 - DNA, 22 bp, Homo sapiens
aaaatagcatgaaaggcctttg

SEQ ID NO: 7285309 - DNA, 22 bp, Homo sapiens
aaacaactcggcaactgctttt

SEQ ID NO: 7285310 - DNA, 22 bp, Homo sapiens
aaacacacagaaatgaatgagg

SEQ ID NO: 7285311 - DNA, 22 bp, Homo sapiens
aaattatcatgggggagaaaca

SEQ ID NO: 7285312 - DNA, 22 bp, Homo sapiens
aagcccagatgagatccctgga

SEQ ID NO: 7285313 - DNA, 22 bp, Homo sapiens
aagctggcctcaaactcctagc

SEQ ID NO: 7285314 - DNA, 22 bp, Homo sapiens
aagctggcctgtacctgctgag

SEQ ID NO: 7285315 - DNA, 22 bp, Homo sapiens
aacaagtctttggttttggcta

SEQ ID NO: 7285316 - DNA, 22 bp, Homo sapiens
aacaagtctaagagaatggcag

SEQ ID NO: 7285317 - DNA, 22 bp, Homo sapiens
aacaagtcattccatttgacag

SEQ ID NO: 7285318 - DNA, 23 bp, Homo sapiens
aatcaccagcagccaatgtgcag

SEQ ID NO: 7285319 - DNA, 22 bp, Homo sapiens
aatcaccatctctcttgtcccc

SEQ ID NO: 7285320 - DNA, 22 bp, Homo sapiens
aagtttctgccatactgtggtg

SEQ ID NO: 7285321 - DNA, 22 bp, Homo sapiens
aagacacacacatatgctgagt

SEQ ID NO: 7285322 - DNA, 22 bp, Homo sapiens
aagacacagcgaaatgttcctg

SEQ ID NO: 7285323 - DNA, 22 bp, Homo sapiens
aattcaacagtcagttatctca

SEQ ID NO: 7285324 - DNA, 22 bp, Homo sapiens
aagacaagcatcaaatcaggca

SEQ ID NO: 7285325 - DNA, 22 bp, Homo sapiens
aatgttaagtttagattataac

SEQ ID NO: 7285326 - DNA, 22 bp, Homo sapiens
aatgttaatgtgtttgcttatg

SEQ ID NO: 7285327 - DNA, 22 bp, Homo sapiens
aatgttaatttactgtcttcat

SEQ ID NO: 7285328 - DNA, 22 bp, Homo sapiens
aatgttaattcacagccaaata

SEQ ID NO: 7285329 - DNA, 22 bp, Homo sapiens
aatgttaaaaccttcagtgctt

SEQ ID NO: 7285330 - DNA, 22 bp, Homo sapiens
aactctttacatgtttgattca

SEQ ID NO: 7285331 - DNA, 22 bp, Homo sapiens
aactctttcatctgtggcctgg

SEQ ID NO: 7285332 - DNA, 22 bp, Homo sapiens
aactcttttctgggtcagcaca

SEQ ID NO: 7285333 - DNA, 22 bp, Homo sapiens
aactctttgaacagtgaggcta

SEQ ID NO: 7285334 - DNA, 22 bp, Homo sapiens
aactctttgtggacattaaatt

SEQ ID NO: 7285335 - DNA, 22 bp, Homo sapiens
aactctatttaccctactaaac

SEQ ID NO: 7285336 - DNA, 22 bp, Homo sapiens
aatgtcttgagaagagaaatct

SEQ ID NO: 7285337 - DNA, 22 bp, Homo sapiens
aagaggttgtctgtgatgagtt

SEQ ID NO: 7285338 - DNA, 22 bp, Homo sapiens
aagaggttctccttggagtggg

SEQ ID NO: 7285339 - DNA, 22 bp, Homo sapiens
aagaggaggattgatgtgggag

SEQ ID NO: 7285340 - DNA, 22 bp, Homo sapiens
aagaggaagtctccatggagag

SEQ ID NO: 7285341 - DNA, 22 bp, Homo sapiens
acagaggaagcatatagcacaa

SEQ ID NO: 7285342 - DNA, 17 bp, Homo sapiens
acagaggcaggagtgga

SEQ ID NO: 7285343 - DNA, 22 bp, Homo sapiens
acagaggacaactaggcgctca

SEQ ID NO: 7285344 - DNA, 22 bp, Homo sapiens
acagaagcagcgcggctcttct

SEQ ID NO: 7285345 - DNA, 22 bp, Homo sapiens
acagaagaccagagagctaact

SEQ ID NO: 7285346 - DNA, 22 bp, Homo sapiens
aagatttttttccacagactca

SEQ ID NO: 7285347 - DNA, 22 bp, Homo sapiens
aagattttctcaactgtatttg

SEQ ID NO: 7285348 - DNA, 22 bp, Homo sapiens
aagattttcagtgcctaaaaca

SEQ ID NO: 7285349 - DNA, 22 bp, Homo sapiens
aagattttcagctaatggtgca

SEQ ID NO: 7285350 - DNA, 22 bp, Homo sapiens
agcctggccactcagggcctga

SEQ ID NO: 7285351 - DNA, 19 bp, Homo sapiens
agcctggctttgctctgct

SEQ ID NO: 7285352 - DNA, 22 bp, Homo sapiens
agcctggccactcagggcctga

SEQ ID NO: 7285353 - DNA, 22 bp, Homo sapiens
cagatgtgcatgatgggaaggg

SEQ ID NO: 7285354 - DNA, 23 bp, Homo sapiens
cagatgtgcaactctaggcaatg

SEQ ID NO: 7285355 - DNA, 22 bp, Homo sapiens
cagatgtgagctggggagagtg

SEQ ID NO: 7285356 - DNA, 20 bp, Homo sapiens
cagatgggacgtggaggagt

SEQ ID NO: 7285357 - DNA, 22 bp, Homo sapiens
agctcctgggagcaggtggtac

SEQ ID NO: 7285358 - DNA, 22 bp, Homo sapiens
agctcctggcaaggtcatggtg

SEQ ID NO: 7285359 - DNA, 22 bp, Homo sapiens
agctctttggaaggtgtgcact

SEQ ID NO: 7285360 - DNA, 22 bp, Homo sapiens
agctagcctaggcagagtgcat

SEQ ID NO: 7285361 - DNA, 20 bp, Homo sapiens
agctaggagaaagcatggag

SEQ ID NO: 7285362 - DNA, 22 bp, Homo sapiens
cagagctcagagctgccaggca

SEQ ID NO: 7285363 - DNA, 22 bp, Homo sapiens
agccaggccttttctcaaggtt

SEQ ID NO: 7285364 - DNA, 22 bp, Homo sapiens
agccaggccttagggagaggca

SEQ ID NO: 7285365 - DNA, 22 bp, Homo sapiens
agccaggccagctgtcttgagt

SEQ ID NO: 7285366 - DNA, 22 bp, Homo sapiens
agcccaggttctaaagccaaac

SEQ ID NO: 7285367 - DNA, 22 bp, Homo sapiens
agcccaggttgaggctgcagtg

SEQ ID NO: 7285368 - DNA, 22 bp, Homo sapiens
agcccatggtgtactctgtggc

SEQ ID NO: 7285369 - DNA, 23 bp, Homo sapiens
agccctgctgagacccagctccc

SEQ ID NO: 7285370 - DNA, 22 bp, Homo sapiens
agccctgctgcctgaattagct

SEQ ID NO: 7285371 - DNA, 22 bp, Homo sapiens
agccctgctcatctggatcccg

SEQ ID NO: 7285372 - DNA, 22 bp, Homo sapiens
agccctgctgcttcttgtattt

SEQ ID NO: 7285373 - DNA, 22 bp, Homo sapiens
agccctgcttcaccatttactt

SEQ ID NO: 7285374 - DNA, 22 bp, Homo sapiens
agcaggcttggtccccagcctc

SEQ ID NO: 7285375 - DNA, 22 bp, Homo sapiens
agcaggacacgatgcggcagga

SEQ ID NO: 7285376 - DNA, 22 bp, Homo sapiens
agcaggaccaagaaggggaaaa

SEQ ID NO: 7285377 - DNA, 22 bp, Homo sapiens
agcagggctctgtggagggtgg

SEQ ID NO: 7285378 - DNA, 22 bp, Homo sapiens
caccagctacagactactgtgt

SEQ ID NO: 7285379 - DNA, 20 bp, Homo sapiens
caccagcagcagctgccacc

SEQ ID NO: 7285380 - DNA, 22 bp, Homo sapiens
agcagggcactggaaggcactg

SEQ ID NO: 7285381 - DNA, 22 bp, Homo sapiens
agcagggcagctgatgcgcacg

SEQ ID NO: 7285382 - DNA, 22 bp, Homo sapiens
agcagggcagcttttttcagaa

SEQ ID NO: 7285383 - DNA, 22 bp, Homo sapiens
agcagggcaggtaaggatcaga

SEQ ID NO: 7285384 - DNA, 22 bp, Homo sapiens
agcagggcagtgatcagaaagg

SEQ ID NO: 7285385 - DNA, 22 bp, Homo sapiens
agcagtggcctggggctctgtg

SEQ ID NO: 7285386 - DNA, 19 bp, Homo sapiens
agcagtggagccatgcctg

SEQ ID NO: 7285387 - DNA, 22 bp, Homo sapiens
agcagggctgcggccccaccac

SEQ ID NO: 7285388 - DNA, 22 bp, Homo sapiens
agcagggctggggcacgagcca

SEQ ID NO: 7285389 - DNA, 22 bp, Homo sapiens
agcagagctgcagtggcctgct

SEQ ID NO: 7285390 - DNA, 22 bp, Homo sapiens
agcactcctgtctttccccttt

SEQ ID NO: 7285391 - DNA, 22 bp, Homo sapiens
cacagagatcggaacagaagta

SEQ ID NO: 7285392 - DNA, 22 bp, Homo sapiens
cacagagattagaattagacta

SEQ ID NO: 7285393 - DNA, 20 bp, Homo sapiens
agcagcagatgttggaggtg

SEQ ID NO: 7285394 - DNA, 22 bp, Homo sapiens
agcagcccctcggcgggtgcgc

SEQ ID NO: 7285395 - DNA, 23 bp, Homo sapiens
agcagccctgggacctggcctgc

SEQ ID NO: 7285396 - DNA, 21 bp, Homo sapiens
agcagcagatctggtgagggc

SEQ ID NO: 7285397 - DNA, 19 bp, Homo sapiens
agcagcagaagtgtgcctt

SEQ ID NO: 7285398 - DNA, 22 bp, Homo sapiens
agagaaaactcattgaggtgtc

SEQ ID NO: 7285399 - DNA, 22 bp, Homo sapiens
agagacaatgccaatgcacacg

SEQ ID NO: 7285400 - DNA, 22 bp, Homo sapiens
agagagcccgggccagggcaca

SEQ ID NO: 7285401 - DNA, 21 bp, Homo sapiens
agagagaaggccatatggtcc

SEQ ID NO: 7285402 - DNA, 22 bp, Homo sapiens
agagctggccagggatcactct

SEQ ID NO: 7285403 - DNA, 22 bp, Homo sapiens
agagctggctggtagccctgat

SEQ ID NO: 7285404 - DNA, 22 bp, Homo sapiens
agagcagatggagctggaagag

SEQ ID NO: 7285405 - DNA, 22 bp, Homo sapiens
agacagaatttgtcagataaat

SEQ ID NO: 7285406 - DNA, 22 bp, Homo sapiens
agaccccatacctcagcaggta

SEQ ID NO: 7285407 - DNA, 17 bp, Homo sapiens
atctgctgacattctgt

SEQ ID NO: 7285408 - DNA, 20 bp, Homo sapiens
atctgctgagaatgaaaggc

SEQ ID NO: 7285409 - DNA, 22 bp, Homo sapiens
atctgctgtgtgtaatggaatg

SEQ ID NO: 7285410 - DNA, 22 bp, Homo sapiens
agacagaaataggagaaaccag

SEQ ID NO: 7285411 - DNA, 22 bp, Homo sapiens
agacaacttacctgatgtatgt

SEQ ID NO: 7285412 - DNA, 22 bp, Homo sapiens
agatggaaaatatagacagaga

SEQ ID NO: 7285413 - DNA, 17 bp, Homo sapiens
agatggcaggaggcaga

SEQ ID NO: 7285414 - DNA, 22 bp, Homo sapiens
agatggagaccttggatgaact

SEQ ID NO: 7285415 - DNA, 22 bp, Homo sapiens
agatggagtggagatgagtaaa

SEQ ID NO: 7285416 - DNA, 22 bp, Homo sapiens
agatcacagtggcaactccctt

SEQ ID NO: 7285417 - DNA, 22 bp, Homo sapiens
agatcacagtggcaactccctt

SEQ ID NO: 7285418 - DNA, 22 bp, Homo sapiens
agatgtgggcaatggaatggag

SEQ ID NO: 7285419 - DNA, 22 bp, Homo sapiens
agatgtgggagatgcttctgca

SEQ ID NO: 7285420 - DNA, 22 bp, Homo sapiens
agatgttatcattcagagtagc

SEQ ID NO: 7285421 - DNA, 22 bp, Homo sapiens
agatgtggccggctagggagag

SEQ ID NO: 7285422 - DNA, 22 bp, Homo sapiens
agaggctgggcaggacccacag

SEQ ID NO: 7285423 - DNA, 22 bp, Homo sapiens
agaggtggagctcttggcatca

SEQ ID NO: 7285424 - DNA, 22 bp, Homo sapiens
agaggctgcaggctggaaatca

SEQ ID NO: 7285425 - DNA, 18 bp, Homo sapiens
agaggctggacaggggat

SEQ ID NO: 7285426 - DNA, 22 bp, Homo sapiens
agagctgggaccgtctggaagt

SEQ ID NO: 7285427 - DNA, 22 bp, Homo sapiens
agtagaaagaaggcactgggcc

SEQ ID NO: 7285428 - DNA, 22 bp, Homo sapiens
aggtgggcccagtgggctccag

SEQ ID NO: 7285429 - DNA, 22 bp, Homo sapiens
actctcccttggagcctcaggc

SEQ ID NO: 7285430 - DNA, 22 bp, Homo sapiens
aggtccagttgccagaatggcc

SEQ ID NO: 7285431 - DNA, 22 bp, Homo sapiens
acctttcctggctgaccgagga

SEQ ID NO: 7285432 - DNA, 22 bp, Homo sapiens
acctttccaagtatcaggtggt

SEQ ID NO: 7285433 - DNA, 19 bp, Homo sapiens
acctttcctttctcagatg

SEQ ID NO: 7285434 - DNA, 22 bp, Homo sapiens
aggtccaggatttgtggggtct

SEQ ID NO: 7285435 - DNA, 22 bp, Homo sapiens
aggtccagaacgtgcctactct

SEQ ID NO: 7285436 - DNA, 22 bp, Homo sapiens
aggtgagaaaacgagggttgca

SEQ ID NO: 7285437 - DNA, 22 bp, Homo sapiens
aggtgggcaccaggcttgtggt

SEQ ID NO: 7285438 - DNA, 22 bp, Homo sapiens
aggtgaagttgaggaggcagaa

SEQ ID NO: 7285439 - DNA, 22 bp, Homo sapiens
agtgaagtaaaagatgtgcatc

SEQ ID NO: 7285440 - DNA, 22 bp, Homo sapiens
actctgctaaatgtaagttggt

SEQ ID NO: 7285441 - DNA, 22 bp, Homo sapiens
actctgctaaatgtgtaggctc

SEQ ID NO: 7285442 - DNA, 22 bp, Homo sapiens
actgagagttgtgcattcatgc

SEQ ID NO: 7285443 - DNA, 22 bp, Homo sapiens
actgagagttgaaaagggagga

SEQ ID NO: 7285444 - DNA, 22 bp, Homo sapiens
actgagagtcttagaaacacat

SEQ ID NO: 7285445 - DNA, 22 bp, Homo sapiens
actgagagtcaagatagcatgg

SEQ ID NO: 7285446 - DNA, 22 bp, Homo sapiens
actgagaggtgatagtgacatt

SEQ ID NO: 7285447 - DNA, 22 bp, Homo sapiens
actgagagggaggctgtccggt

SEQ ID NO: 7285448 - DNA, 22 bp, Homo sapiens
actgagaggaaattgagactat

SEQ ID NO: 7285449 - DNA, 22 bp, Homo sapiens
actgagagcgtgtacaaactta

SEQ ID NO: 7285450 - DNA, 21 bp, Homo sapiens
actgagagatgttggatcata

SEQ ID NO: 7285451 - DNA, 22 bp, Homo sapiens
actgggaggcaaagagcaagga

SEQ ID NO: 7285452 - DNA, 22 bp, Homo sapiens
actgggccaggggctttggagc

SEQ ID NO: 7285453 - DNA, 22 bp, Homo sapiens
actgggccaggtgtgggtgagt

SEQ ID NO: 7285454 - DNA, 22 bp, Homo sapiens
actgggcctgattgggtcggag

SEQ ID NO: 7285455 - DNA, 22 bp, Homo sapiens
actgggcctggattggcgtgtc

SEQ ID NO: 7285456 - DNA, 22 bp, Homo sapiens
actgggccgcgctgcagagggc

SEQ ID NO: 7285457 - DNA, 22 bp, Homo sapiens
actgggccggtgcagagtagtt

SEQ ID NO: 7285458 - DNA, 22 bp, Homo sapiens
actgggcctacccagattggca

SEQ ID NO: 7285459 - DNA, 20 bp, Homo sapiens
actgggcctaggggaggcat

SEQ ID NO: 7285460 - DNA, 19 bp, Homo sapiens
actgcctgaggctcacagg

SEQ ID NO: 7285461 - DNA, 22 bp, Homo sapiens
actttggcacagaacttccatt

SEQ ID NO: 7285462 - DNA, 21 bp, Homo sapiens
actttacaatttacatagtga

SEQ ID NO: 7285463 - DNA, 21 bp, Homo sapiens
actttacaatttacatagtga

SEQ ID NO: 7285464 - DNA, 22 bp, Homo sapiens
atacaaagacaaatctcaatct

SEQ ID NO: 7285465 - DNA, 22 bp, Homo sapiens
actttaaagcagaatggctatg

SEQ ID NO: 7285466 - DNA, 22 bp, Homo sapiens
acttaaaaagaatcttttcacg

SEQ ID NO: 7285467 - DNA, 22 bp, Homo sapiens
acttaaaaacagatccagcagg

SEQ ID NO: 7285468 - DNA, 22 bp, Homo sapiens
agtttttctcccctggcttcat

SEQ ID NO: 7285469 - DNA, 22 bp, Homo sapiens
agtttttcctgattttacagaa

SEQ ID NO: 7285470 - DNA, 22 bp, Homo sapiens
atcccacctcaatctgaagctc

SEQ ID NO: 7285471 - DNA, 22 bp, Homo sapiens
atctctgctagccttcttcagg

SEQ ID NO: 7285472 - DNA, 22 bp, Homo sapiens
agaagccacaggaaagcagctt

SEQ ID NO: 7285473 - DNA, 22 bp, Homo sapiens
agaaaaagtcaaggaattggac

SEQ ID NO: 7285474 - DNA, 21 bp, Homo sapiens
agaaaaacacgatataagccc

SEQ ID NO: 7285475 - DNA, 22 bp, Homo sapiens
acttttctccctcctgccttca

SEQ ID NO: 7285476 - DNA, 19 bp, Homo sapiens
aggcatgggaagagaagtc

SEQ ID NO: 7285477 - DNA, 22 bp, Homo sapiens
aggcatgggtagaagagaagcc

SEQ ID NO: 7285478 - DNA, 22 bp, Homo sapiens
acatgaaaagactatctgatta

SEQ ID NO: 7285479 - DNA, 22 bp, Homo sapiens
aggccaggtggtcatgcttgct

SEQ ID NO: 7285480 - DNA, 22 bp, Homo sapiens
acattctattctgcaggacaag

SEQ ID NO: 7285481 - DNA, 19 bp, Homo sapiens
acattcccatcagcaatgt

SEQ ID NO: 7285482 - DNA, 22 bp, Homo sapiens
acattcccaccaacagtgtaaa

SEQ ID NO: 7285483 - DNA, 22 bp, Homo sapiens
acattcccttggcttgaagcag

SEQ ID NO: 7285484 - DNA, 22 bp, Homo sapiens
aggcttcagaaagagtaattgg

SEQ ID NO: 7285485 - DNA, 22 bp, Homo sapiens
aggcttcagcagccctctcttg

SEQ ID NO: 7285486 - DNA, 22 bp, Homo sapiens
aggcttcaggaagtctcctggg

SEQ ID NO: 7285487 - DNA, 22 bp, Homo sapiens
aggcttcagttgtaccttcttg

SEQ ID NO: 7285488 - DNA, 22 bp, Homo sapiens
agggcctgagctctcctccagt

SEQ ID NO: 7285489 - DNA, 22 bp, Homo sapiens
agggcctgacacccttgccagc

SEQ ID NO: 7285490 - DNA, 22 bp, Homo sapiens
agggcctgagaccgtggcttga

SEQ ID NO: 7285491 - DNA, 21 bp, Homo sapiens
accctgggttctccataccct

SEQ ID NO: 7285492 - DNA, 22 bp, Homo sapiens
accccagcgcatatggtctgcg

SEQ ID NO: 7285493 - DNA, 22 bp, Homo sapiens
accctgcctgacaacagaggat

SEQ ID NO: 7285494 - DNA, 22 bp, Homo sapiens
acccatggtctggtggggccct

SEQ ID NO: 7285495 - DNA, 22 bp, Homo sapiens
acccatgggccagttggggtgg

SEQ ID NO: 7285496 - DNA, 22 bp, Homo sapiens
acccatgagtgtatctttaaaa

SEQ ID NO: 7285497 - DNA, 22 bp, Homo sapiens
accagttctactcacctcgccc

SEQ ID NO: 7285498 - DNA, 22 bp, Homo sapiens
accagttctttctctgtttctg

SEQ ID NO: 7285499 - DNA, 18 bp, Homo sapiens
accaggaagcttcttgtc

SEQ ID NO: 7285500 - DNA, 20 bp, Homo sapiens
accaggaatcttttctgagc

SEQ ID NO: 7285501 - DNA, 22 bp, Homo sapiens
aggaaaaaagtctgtgattata

SEQ ID NO: 7285502 - DNA, 22 bp, Homo sapiens
aggaagccaagcctgacactca

SEQ ID NO: 7285503 - DNA, 22 bp, Homo sapiens
agctgggaggtgggcagtgaga

SEQ ID NO: 7285504 - DNA, 22 bp, Homo sapiens
agctgggagctgaaggctgatt

SEQ ID NO: 7285505 - DNA, 22 bp, Homo sapiens
agctgggcaaaatgtgaggttg

SEQ ID NO: 7285506 - DNA, 22 bp, Homo sapiens
agctgggatgataacctcagtc

SEQ ID NO: 7285507 - DNA, 19 bp, Homo sapiens
agctggcagcttccacttc

SEQ ID NO: 7285508 - DNA, 22 bp, Homo sapiens
agctggcaggggttcacactgc

SEQ ID NO: 7285509 - DNA, 20 bp, Homo sapiens
agctggcctgtcctaggcct

SEQ ID NO: 7285510 - DNA, 22 bp, Homo sapiens
agctggctcagccgggtggtct

SEQ ID NO: 7285511 - DNA, 22 bp, Homo sapiens
agctgctggtttaagggatggg

SEQ ID NO: 7285512 - DNA, 22 bp, Homo sapiens
acaggggctccgaaggtgaggg

SEQ ID NO: 7285513 - DNA, 22 bp, Homo sapiens
aggaagcccttgtcatttctgt

SEQ ID NO: 7285514 - DNA, 22 bp, Homo sapiens
aggaagcctggggctgccctcg

SEQ ID NO: 7285515 - DNA, 22 bp, Homo sapiens
aggaagcctggagtcctgccca

SEQ ID NO: 7285516 - DNA, 22 bp, Homo sapiens
aggagcctgaatcagagggtga

SEQ ID NO: 7285517 - DNA, 22 bp, Homo sapiens
aggcacagaatggcattcagtg

SEQ ID NO: 7285518 - DNA, 22 bp, Homo sapiens
aggagggtacaatgggtggaaa

SEQ ID NO: 7285519 - DNA, 22 bp, Homo sapiens
aggatggcgattcgagcacctc

SEQ ID NO: 7285520 - DNA, 22 bp, Homo sapiens
aggatggcttgcaggaggctgt

SEQ ID NO: 7285521 - DNA, 22 bp, Homo sapiens
aggcaaagaagttggtcaggag

SEQ ID NO: 7285522 - DNA, 22 bp, Homo sapiens
aggcaaagcgataccagagcta

SEQ ID NO: 7285523 - DNA, 20 bp, Homo sapiens
aggagggacctggattggcg

SEQ ID NO: 7285524 - DNA, 22 bp, Homo sapiens
ccagcaggagatgcctgtgtct

SEQ ID NO: 7285525 - DNA, 22 bp, Homo sapiens
ccagcaggagagaacatttccc

SEQ ID NO: 7285526 - DNA, 22 bp, Homo sapiens
ccagcaggcagtcatatccttt

SEQ ID NO: 7285527 - DNA, 22 bp, Homo sapiens
ccagctggcccagctgtgctcc

SEQ ID NO: 7285528 - DNA, 22 bp, Homo sapiens
ccagctggcactgtggctgccc

SEQ ID NO: 7285529 - DNA, 22 bp, Homo sapiens
ccaggaaggcctggatgccccc

SEQ ID NO: 7285530 - DNA, 22 bp, Homo sapiens
aggcctgctgtgtagcctgttg

SEQ ID NO: 7285531 - DNA, 22 bp, Homo sapiens
aggcctgtctggggctcagcca

SEQ ID NO: 7285532 - DNA, 18 bp, Homo sapiens
aggcaggctggagtgact

SEQ ID NO: 7285533 - DNA, 22 bp, Homo sapiens
ccagaaatcctctctttcttgc

SEQ ID NO: 7285534 - DNA, 22 bp, Homo sapiens
ccagaccaccctggccatgcac

SEQ ID NO: 7285535 - DNA, 20 bp, Homo sapiens
aggccactgaatgccaatca

SEQ ID NO: 7285536 - DNA, 22 bp, Homo sapiens
aggccagaaatgtcagggagtg

SEQ ID NO: 7285537 - DNA, 22 bp, Homo sapiens
ccagcaggagactagcaacata

SEQ ID NO: 7285538 - DNA, 22 bp, Homo sapiens
ccagcaggactttggaaatatg

SEQ ID NO: 7285539 - DNA, 22 bp, Homo sapiens
ccagcaggaaagtgacgtttga

SEQ ID NO: 7285540 - DNA, 22 bp, Homo sapiens
aggctggcccacctcttgtctt

SEQ ID NO: 7285541 - DNA, 22 bp, Homo sapiens
aggctggcgtcaggggctgtac

SEQ ID NO: 7285542 - DNA, 22 bp, Homo sapiens
aggctggcgtcaggggctgtac

SEQ ID NO: 7285543 - DNA, 22 bp, Homo sapiens
aggctggcggtgactgctctga

SEQ ID NO: 7285544 - DNA, 22 bp, Homo sapiens
aggctggcgacatctggcgggc

SEQ ID NO: 7285545 - DNA, 22 bp, Homo sapiens
aggctggccctactggctgcct

SEQ ID NO: 7285546 - DNA, 22 bp, Homo sapiens
aggctggccctactggctgcct

SEQ ID NO: 7285547 - DNA, 22 bp, Homo sapiens
aggctggcctatttctttatcg

SEQ ID NO: 7285548 - DNA, 17 bp, Homo sapiens
aggctggccttcacagt

SEQ ID NO: 7285549 - DNA, 17 bp, Homo sapiens
aggctggccttcacagt

SEQ ID NO: 7285550 - DNA, 22 bp, Homo sapiens
aggctggctggggatgcgtctt

SEQ ID NO: 7285551 - DNA, 22 bp, Homo sapiens
aggctgggctccgcccaactcc

SEQ ID NO: 7285552 - DNA, 22 bp, Homo sapiens
ccaggctggagtgcaatggcat

SEQ ID NO: 7285553 - DNA, 22 bp, Homo sapiens
ccaggctggagtatagtggcgc

SEQ ID NO: 7285554 - DNA, 22 bp, Homo sapiens
ccagggcaggagaaagactcac

SEQ ID NO: 7285555 - DNA, 19 bp, Homo sapiens
ccagggctccaagctgagt

SEQ ID NO: 7285556 - DNA, 22 bp, Homo sapiens
ccagggctggtgggagatgctg

SEQ ID NO: 7285557 - DNA, 22 bp, Homo sapiens
ccagggctgggtttgtcggtgt

SEQ ID NO: 7285558 - DNA, 22 bp, Homo sapiens
ccctgctgtcaggtgctgggag

SEQ ID NO: 7285559 - DNA, 22 bp, Homo sapiens
ccctgctgtgcctgactgccat

SEQ ID NO: 7285560 - DNA, 22 bp, Homo sapiens
ccctgctgtgtcccacctggaa

SEQ ID NO: 7285561 - DNA, 22 bp, Homo sapiens
ccctgcacactcgtgtcttgac

SEQ ID NO: 7285562 - DNA, 22 bp, Homo sapiens
ccctgcacagcctggctctctt

SEQ ID NO: 7285563 - DNA, 22 bp, Homo sapiens
ccctgcacagcctggctctctt

SEQ ID NO: 7285564 - DNA, 22 bp, Homo sapiens
cccatgggttttcctccctgcc

SEQ ID NO: 7285565 - DNA, 22 bp, Homo sapiens
cccatggggacaccatgaagga

SEQ ID NO: 7285566 - DNA, 22 bp, Homo sapiens
cccatggagtgcctgagggcca

SEQ ID NO: 7285567 - DNA, 22 bp, Homo sapiens
cccatgccttctgactcacagg

SEQ ID NO: 7285568 - DNA, 22 bp, Homo sapiens
ccccactttgagtagcacttga

SEQ ID NO: 7285569 - DNA, 22 bp, Homo sapiens
ccccacttgctcagcatgtcca

SEQ ID NO: 7285570 - DNA, 22 bp, Homo sapiens
ccctcaccaggctccaggcatg

SEQ ID NO: 7285571 - DNA, 22 bp, Homo sapiens
ccctagggtttggccagagccc

SEQ ID NO: 7285572 - DNA, 22 bp, Homo sapiens
cccaggaggtcgaagctgcagt

SEQ ID NO: 7285573 - DNA, 22 bp, Homo sapiens
aggctggtgcttcctagggcag

SEQ ID NO: 7285574 - DNA, 22 bp, Homo sapiens
aggctggtgcttcctagggcag

SEQ ID NO: 7285575 - DNA, 22 bp, Homo sapiens
aggctggtgattagaagcagcc

SEQ ID NO: 7285576 - DNA, 22 bp, Homo sapiens
aggctgtgacagggtcatggag

SEQ ID NO: 7285577 - DNA, 22 bp, Homo sapiens
aggctgtcttcctccctcttgg

SEQ ID NO: 7285578 - DNA, 21 bp, Homo sapiens
aggctgtcctttgccagccct

SEQ ID NO: 7285579 - DNA, 22 bp, Homo sapiens
cctgagagtgagtgccacctta

SEQ ID NO: 7285580 - DNA, 22 bp, Homo sapiens
cctgagagtgagtgcctcctta

SEQ ID NO: 7285581 - DNA, 22 bp, Homo sapiens
cctgagagtgagggcctcctta

SEQ ID NO: 7285582 - DNA, 22 bp, Homo sapiens
cctgagagccctagccaggcgc

SEQ ID NO: 7285583 - DNA, 22 bp, Homo sapiens
cctgagagccagtgcctgccca

SEQ ID NO: 7285584 - DNA, 22 bp, Homo sapiens
cctgagagagtgagccctgaca

SEQ ID NO: 7285585 - DNA, 22 bp, Homo sapiens
cctcttccactgggccccatcc

SEQ ID NO: 7285586 - DNA, 22 bp, Homo sapiens
aggggcagcctcacaatcctct

SEQ ID NO: 7285587 - DNA, 22 bp, Homo sapiens
aggggatgcctagtggagtctc

SEQ ID NO: 7285588 - DNA, 22 bp, Homo sapiens
aggggagcaacatagtcactct

SEQ ID NO: 7285589 - DNA, 22 bp, Homo sapiens
agggctggagccacagctggga

SEQ ID NO: 7285590 - DNA, 22 bp, Homo sapiens
agggctggagccacagctggga

SEQ ID NO: 7285591 - DNA, 22 bp, Homo sapiens
agggctggcatctctaatgctg

SEQ ID NO: 7285592 - DNA, 22 bp, Homo sapiens
agggcctggcgcgtggccgccg

SEQ ID NO: 7285593 - DNA, 22 bp, Homo sapiens
agggcctggactaattggatcc

SEQ ID NO: 7285594 - DNA, 20 bp, Homo sapiens
agggcctgctctgtggtgtc

SEQ ID NO: 7285595 - DNA, 22 bp, Homo sapiens
agggcctgctctatcactctca

SEQ ID NO: 7285596 - DNA, 23 bp, Homo sapiens
agggcctgatggctcccgctggc

SEQ ID NO: 7285597 - DNA, 22 bp, Homo sapiens
agggcctgaggctgacggggag

SEQ ID NO: 7285598 - DNA, 22 bp, Homo sapiens
agggcctgagctggctgacctc

SEQ ID NO: 7285599 - DNA, 22 bp, Homo sapiens
caggaaccagaaccttcccccg

SEQ ID NO: 7285600 - DNA, 22 bp, Homo sapiens
caggaaccaggagagtccctga

SEQ ID NO: 7285601 - DNA, 22 bp, Homo sapiens
caggaaccaggagagtccctga

SEQ ID NO: 7285602 - DNA, 22 bp, Homo sapiens
caggaaccatgaagacatatac

SEQ ID NO: 7285603 - DNA, 22 bp, Homo sapiens
caggaaccattttctctttata

SEQ ID NO: 7285604 - DNA, 20 bp, Homo sapiens
caggaaccaaagaggactcc

SEQ ID NO: 7285605 - DNA, 22 bp, Homo sapiens
caggaacccccactctcagctc

SEQ ID NO: 7285606 - DNA, 22 bp, Homo sapiens
caggaacccccactctcagctc

SEQ ID NO: 7285607 - DNA, 22 bp, Homo sapiens
caggaacccaatgggccaggcc

SEQ ID NO: 7285608 - DNA, 22 bp, Homo sapiens
caggaacctaaagagacattac

SEQ ID NO: 7285609 - DNA, 22 bp, Homo sapiens
caggaacctaatgaaggctcac

SEQ ID NO: 7285610 - DNA, 22 bp, Homo sapiens
caggaacctacatctgtttggg

SEQ ID NO: 7285611 - DNA, 18 bp, Homo sapiens
caggaacctctccttttt

SEQ ID NO: 7285612 - DNA, 22 bp, Homo sapiens
caggaagaaagaggtgaggtgt

SEQ ID NO: 7285613 - DNA, 16 bp, Homo sapiens
caggaacctgtctggc

SEQ ID NO: 7285614 - DNA, 22 bp, Homo sapiens
caggaacctgctccaagaggca

SEQ ID NO: 7285615 - DNA, 22 bp, Homo sapiens
caggaacctgtgcgtagggatg

SEQ ID NO: 7285616 - DNA, 22 bp, Homo sapiens
caggaaccttgtctgtgttgtt

SEQ ID NO: 7285617 - DNA, 22 bp, Homo sapiens
agctgggcagactgcagtggtt

SEQ ID NO: 7285618 - DNA, 21 bp, Homo sapiens
agctgggcctcagcctgcagt

SEQ ID NO: 7285619 - DNA, 23 bp, Homo sapiens
agctgggccaggtggtcagacct

SEQ ID NO: 7285620 - DNA, 22 bp, Homo sapiens
agctgggcctgatttgcagggg

SEQ ID NO: 7285621 - DNA, 22 bp, Homo sapiens
agctgggcctgagctggaagct

SEQ ID NO: 7285622 - DNA, 22 bp, Homo sapiens
agctgggcgcagtggctggtga

SEQ ID NO: 7285623 - DNA, 22 bp, Homo sapiens
agctgggctccaagagggatct

SEQ ID NO: 7285624 - DNA, 22 bp, Homo sapiens
agctgggctgatgactcatgtt

SEQ ID NO: 7285625 - DNA, 22 bp, Homo sapiens
agctgggctggagctccaagcg

SEQ ID NO: 7285626 - DNA, 22 bp, Homo sapiens
caggcagagtgagaagcccttg

SEQ ID NO: 7285627 - DNA, 22 bp, Homo sapiens
caggcagagtcagattagactt

SEQ ID NO: 7285628 - DNA, 22 bp, Homo sapiens
caggcagaggtaccaagattga

SEQ ID NO: 7285629 - DNA, 22 bp, Homo sapiens
caggcagaggcttttcatggct

SEQ ID NO: 7285630 - DNA, 22 bp, Homo sapiens
caggcagaggaggccttctcct

SEQ ID NO: 7285631 - DNA, 22 bp, Homo sapiens
caggcagaggaagtctgggtct

SEQ ID NO: 7285632 - DNA, 20 bp, Homo sapiens
caggcagaggatgctgacca

SEQ ID NO: 7285633 - DNA, 22 bp, Homo sapiens
caggcagagtgaggtggtctaa

SEQ ID NO: 7285634 - DNA, 22 bp, Homo sapiens
aggaatgtcgtcataaacatga

SEQ ID NO: 7285635 - DNA, 22 bp, Homo sapiens
aggaatgtgcctagcctccctg

SEQ ID NO: 7285636 - DNA, 22 bp, Homo sapiens
aggaatgtggaaggtggcggcg

SEQ ID NO: 7285637 - DNA, 16 bp, Homo sapiens
aggaatgtggcggaac

SEQ ID NO: 7285638 - DNA, 22 bp, Homo sapiens
aggaatgtggcctagggaggag

SEQ ID NO: 7285639 - DNA, 22 bp, Homo sapiens
aggaatgtggcaatcttcaagt

SEQ ID NO: 7285640 - DNA, 22 bp, Homo sapiens
aggaatgtgactattttttcag

SEQ ID NO: 7285641 - DNA, 23 bp, Homo sapiens
aggaatgtgcccacccatctcct

SEQ ID NO: 7285642 - DNA, 22 bp, Homo sapiens
aggaatgtgaggcaagttgtga

SEQ ID NO: 7285643 - DNA, 22 bp, Homo sapiens
aggaatgtgaccactagactct

SEQ ID NO: 7285644 - DNA, 22 bp, Homo sapiens
aggaatgtgaaacaggtggctg

SEQ ID NO: 7285645 - DNA, 22 bp, Homo sapiens
aggaatgtctgagaaagaggca

SEQ ID NO: 7285646 - DNA, 22 bp, Homo sapiens
aggaatgtttagaatgtcagaa

SEQ ID NO: 7285647 - DNA, 22 bp, Homo sapiens
aggaatgtttacacgacagaaa

SEQ ID NO: 7285648 - DNA, 22 bp, Homo sapiens
aggaatgttagttctgtataca

SEQ ID NO: 7285649 - DNA, 22 bp, Homo sapiens
aggaatgttaggagatgagtct

SEQ ID NO: 7285650 - DNA, 22 bp, Homo sapiens
aggaatgttaagaaggtctacc

SEQ ID NO: 7285651 - DNA, 22 bp, Homo sapiens
aggaatgttaaagattaagagc

SEQ ID NO: 7285652 - DNA, 22 bp, Homo sapiens
aggaatgtgtttctaggctgtt

SEQ ID NO: 7285653 - DNA, 22 bp, Homo sapiens
aggaatgtgtgtccaccgggga

SEQ ID NO: 7285654 - DNA, 21 bp, Homo sapiens
aggaatgtgtatatatacaat

SEQ ID NO: 7285655 - DNA, 22 bp, Homo sapiens
aggaagggttctttctgtttat

SEQ ID NO: 7285656 - DNA, 22 bp, Homo sapiens
agctttcacgatttggaacagg

SEQ ID NO: 7285657 - DNA, 22 bp, Homo sapiens
agctttcagtctctgaaggaac

SEQ ID NO: 7285658 - DNA, 22 bp, Homo sapiens
agctttcaggataatgaaaaag

SEQ ID NO: 7285659 - DNA, 22 bp, Homo sapiens
agctttcagttactaatgaagg

SEQ ID NO: 7285660 - DNA, 22 bp, Homo sapiens
aggaaaagtgtgaagtatggag

SEQ ID NO: 7285661 - DNA, 20 bp, Homo sapiens
aggaaaagggtggtggtaga

SEQ ID NO: 7285662 - DNA, 22 bp, Homo sapiens
cagggacattggtggccaggtt

SEQ ID NO: 7285663 - DNA, 20 bp, Homo sapiens
aggcagagcgcacttttaga

SEQ ID NO: 7285664 - DNA, 22 bp, Homo sapiens
aggcagagctgatgttctgtga

SEQ ID NO: 7285665 - DNA, 22 bp, Homo sapiens
aggcagaggagaatgatcttcc

SEQ ID NO: 7285666 - DNA, 22 bp, Homo sapiens
aggcaggaaaatcgcttgaacc

SEQ ID NO: 7285667 - DNA, 22 bp, Homo sapiens
aggcaggcccctgagaatagac

SEQ ID NO: 7285668 - DNA, 22 bp, Homo sapiens
aggcaggctctgggtatgtgca

SEQ ID NO: 7285669 - DNA, 22 bp, Homo sapiens
aggcaggctcaggcccatgctt

SEQ ID NO: 7285670 - DNA, 22 bp, Homo sapiens
aggcaggctagtcgcttgagcc

SEQ ID NO: 7285671 - DNA, 22 bp, Homo sapiens
aggcaggccctgggccatcccg

SEQ ID NO: 7285672 - DNA, 22 bp, Homo sapiens
aggcaggccgtgtccctcctca

SEQ ID NO: 7285673 - DNA, 22 bp, Homo sapiens
aggcaggccctctggaaaggta

SEQ ID NO: 7285674 - DNA, 22 bp, Homo sapiens
aggcaggcctacacaatgggag

SEQ ID NO: 7285675 - DNA, 22 bp, Homo sapiens
aggcagagagcagtggccgtct

SEQ ID NO: 7285676 - DNA, 22 bp, Homo sapiens
catccaaactctcattatctgt

SEQ ID NO: 7285677 - DNA, 22 bp, Homo sapiens
aggaggtgacagcctgcatctg

SEQ ID NO: 7285678 - DNA, 22 bp, Homo sapiens
aggaggtgagcggtcatgtggt

SEQ ID NO: 7285679 - DNA, 22 bp, Homo sapiens
aggaggtgcgtggtgatcccct

SEQ ID NO: 7285680 - DNA, 22 bp, Homo sapiens
aggagggttctctggacagagg

SEQ ID NO: 7285681 - DNA, 21 bp, Homo sapiens
aggaggctgtctctttcagct

SEQ ID NO: 7285682 - DNA, 22 bp, Homo sapiens
aggaggctggttcaggccatat

SEQ ID NO: 7285683 - DNA, 22 bp, Homo sapiens
aggaggctgggcacagtggcct

SEQ ID NO: 7285684 - DNA, 22 bp, Homo sapiens
aggaggctgcaaccctgaggcc

SEQ ID NO: 7285685 - DNA, 22 bp, Homo sapiens
cagtgcagctgccccgctggta

SEQ ID NO: 7285686 - DNA, 22 bp, Homo sapiens
cagtgcaggaagtgagatgcct

SEQ ID NO: 7285687 - DNA, 22 bp, Homo sapiens
cagtgcaggctgggggccctgc

SEQ ID NO: 7285688 - DNA, 23 bp, Homo sapiens
cagtgcagggcaactcagactcc

SEQ ID NO: 7285689 - DNA, 22 bp, Homo sapiens
cagtgcaggcttgtggccgcag

SEQ ID NO: 7285690 - DNA, 21 bp, Homo sapiens
cagtgcaggggttagcgtgta

SEQ ID NO: 7285691 - DNA, 22 bp, Homo sapiens
cagtgaggctctgctgagcggt

SEQ ID NO: 7285692 - DNA, 22 bp, Homo sapiens
cagtgcagccaaggacaggcac

SEQ ID NO: 7285693 - DNA, 17 bp, Homo sapiens
cagtgcagataagtgag

SEQ ID NO: 7285694 - DNA, 22 bp, Homo sapiens
aggagccacctaggagctgttt

SEQ ID NO: 7285695 - DNA, 22 bp, Homo sapiens
aggagccaaattttagactctg

SEQ ID NO: 7285696 - DNA, 22 bp, Homo sapiens
aggagccaaattactagctctg

SEQ ID NO: 7285697 - DNA, 22 bp, Homo sapiens
ctggggcttcaatgcttcggtg

SEQ ID NO: 7285698 - DNA, 23 bp, Homo sapiens
ctggggctttcaaatctgggcag

SEQ ID NO: 7285699 - DNA, 19 bp, Homo sapiens
ctggggctttggtactgcc

SEQ ID NO: 7285700 - DNA, 22 bp, Homo sapiens
ctggtccctggacctccctgga

SEQ ID NO: 7285701 - DNA, 22 bp, Homo sapiens
atccatcttgatgtaatagcca

SEQ ID NO: 7285702 - DNA, 22 bp, Homo sapiens
atctggctctctcatttacaaa

SEQ ID NO: 7285703 - DNA, 22 bp, Homo sapiens
atctctctatgcactgaggact

SEQ ID NO: 7285704 - DNA, 22 bp, Homo sapiens
cttctgtgcttcacagttgcca

SEQ ID NO: 7285705 - DNA, 22 bp, Homo sapiens
cttctgtgtagaaaggtagccc

SEQ ID NO: 7285706 - DNA, 22 bp, Homo sapiens
ctggcctctctgagcagggagc

SEQ ID NO: 7285707 - DNA, 22 bp, Homo sapiens
ctggctatgtggttagacataa

SEQ ID NO: 7285708 - DNA, 22 bp, Homo sapiens
ctggcgagcaggaggcgacggc

SEQ ID NO: 7285709 - DNA, 22 bp, Homo sapiens
atatactgaggagactttatat

SEQ ID NO: 7285710 - DNA, 22 bp, Homo sapiens
atacacatgtgtatgtgcatgc

SEQ ID NO: 7285711 - DNA, 22 bp, Homo sapiens
atacacatgttattgtggaagc

SEQ ID NO: 7285712 - DNA, 22 bp, Homo sapiens
atacacattactttctgtctga

SEQ ID NO: 7285713 - DNA, 20 bp, Homo sapiens
atacacattcatagaaaaat

SEQ ID NO: 7285714 - DNA, 22 bp, Homo sapiens
ctggcaagtggttgggatggat

SEQ ID NO: 7285715 - DNA, 22 bp, Homo sapiens
ctggcctcggcagcaggaacag

SEQ ID NO: 7285716 - DNA, 22 bp, Homo sapiens
ctggccggtatttgcctctggg

SEQ ID NO: 7285717 - DNA, 22 bp, Homo sapiens
ctggccctatgagcctcctgat

SEQ ID NO: 7285718 - DNA, 22 bp, Homo sapiens
ctggccagactacacatgtgtg

SEQ ID NO: 7285719 - DNA, 22 bp, Homo sapiens
ctggcaggtggaggttgcagtg

SEQ ID NO: 7285720 - DNA, 22 bp, Homo sapiens
ataaagcaagcataccattaag

SEQ ID NO: 7285721 - DNA, 22 bp, Homo sapiens
ataaagcaggtccccagacact

SEQ ID NO: 7285722 - DNA, 22 bp, Homo sapiens
ataaagcatctagtctgtcact

SEQ ID NO: 7285723 - DNA, 22 bp, Homo sapiens
ataaaagaagttttggtacttg

SEQ ID NO: 7285724 - DNA, 22 bp, Homo sapiens
ctgcctggtctcaggcatgggg

SEQ ID NO: 7285725 - DNA, 22 bp, Homo sapiens
ctgcctggaaggagcaagggga

SEQ ID NO: 7285726 - DNA, 22 bp, Homo sapiens
ctgcctgtgccaatgctccttt

SEQ ID NO: 7285727 - DNA, 22 bp, Homo sapiens
ctgctgggctcctcatgtgact

SEQ ID NO: 7285728 - DNA, 22 bp, Homo sapiens
ctgctgggcctggtctctgagg

SEQ ID NO: 7285729 - DNA, 22 bp, Homo sapiens
ctgctgcccagtgtgcattggg

SEQ ID NO: 7285730 - DNA, 18 bp, Homo sapiens
ctgctgtgtcgtctgggc

SEQ ID NO: 7285731 - DNA, 22 bp, Homo sapiens
atacacatatgtgtgtatatgt

SEQ ID NO: 7285732 - DNA, 20 bp, Homo sapiens
atacacatattcttgcaact

SEQ ID NO: 7285733 - DNA, 22 bp, Homo sapiens
atacacatgcacacatgtgtgt

SEQ ID NO: 7285734 - DNA, 20 bp, Homo sapiens
atacacatgcagacagatgc

SEQ ID NO: 7285735 - DNA, 15 bp, Homo sapiens
atacacatgagggag

SEQ ID NO: 7285736 - DNA, 22 bp, Homo sapiens
atacacatctatttaagagaca

SEQ ID NO: 7285737 - DNA, 21 bp, Homo sapiens
atacacatacacataaatgtg

SEQ ID NO: 7285738 - DNA, 19 bp, Homo sapiens
atacacatacgtaaactga

SEQ ID NO: 7285739 - DNA, 22 bp, Homo sapiens
atacacatatatacacgtttaa

SEQ ID NO: 7285740 - DNA, 22 bp, Homo sapiens
atacacatatcaggtgtataca

SEQ ID NO: 7285741 - DNA, 18 bp, Homo sapiens
ctatccctggagcttggg

SEQ ID NO: 7285742 - DNA, 20 bp, Homo sapiens
agtcacattgagcttttgga

SEQ ID NO: 7285743 - DNA, 22 bp, Homo sapiens
agtcacatagaagtgggtttaa

SEQ ID NO: 7285744 - DNA, 22 bp, Homo sapiens
agtcacatgagtttctctttat

SEQ ID NO: 7285745 - DNA, 22 bp, Homo sapiens
agtcacatagctctggtttctt

SEQ ID NO: 7285746 - DNA, 22 bp, Homo sapiens
agtagaaatgtaagaaggatta

SEQ ID NO: 7285747 - DNA, 22 bp, Homo sapiens
ccttctctctgaagaccccaaa

SEQ ID NO: 7285748 - DNA, 22 bp, Homo sapiens
agtaaaaattgaggtgcaaaat

SEQ ID NO: 7285749 - DNA, 22 bp, Homo sapiens
ccttctctaccatgtgaggaaa

SEQ ID NO: 7285750 - DNA, 22 bp, Homo sapiens
ccttctcctgccttgggttcat

SEQ ID NO: 7285751 - DNA, 22 bp, Homo sapiens
agtaaatgaaagcaattttaga

SEQ ID NO: 7285752 - DNA, 22 bp, Homo sapiens
ccttccagaggcgtgacaccct

SEQ ID NO: 7285753 - DNA, 22 bp, Homo sapiens
agggtgggctagactcttcccc

SEQ ID NO: 7285754 - DNA, 22 bp, Homo sapiens
cctgagtagctggaattaaagg

SEQ ID NO: 7285755 - DNA, 22 bp, Homo sapiens
agggtttcttgcttatggtgct

SEQ ID NO: 7285756 - DNA, 19 bp, Homo sapiens
agggtttcttgactttgct

SEQ ID NO: 7285757 - DNA, 22 bp, Homo sapiens
aggtaaggctgtaagctaagcc

SEQ ID NO: 7285758 - DNA, 22 bp, Homo sapiens
aggtaaggtttggaggcagtgg

SEQ ID NO: 7285759 - DNA, 22 bp, Homo sapiens
agtggggccgcggtcctgccct

SEQ ID NO: 7285760 - DNA, 22 bp, Homo sapiens
agtggcctggagccccgcctgg

SEQ ID NO: 7285761 - DNA, 22 bp, Homo sapiens
agtgtattatgcagcggaggtc

SEQ ID NO: 7285762 - DNA, 22 bp, Homo sapiens
agtgtattctgcatgggagact

SEQ ID NO: 7285763 - DNA, 22 bp, Homo sapiens
ctgagctattttccactactat

SEQ ID NO: 7285764 - DNA, 22 bp, Homo sapiens
agtgtttttgggtagggtgagt

SEQ ID NO: 7285765 - DNA, 22 bp, Homo sapiens
agtgttttggagtgggaaggca

SEQ ID NO: 7285766 - DNA, 22 bp, Homo sapiens
agttaaatcattactgacagag

SEQ ID NO: 7285767 - DNA, 22 bp, Homo sapiens
agttaaatcatggccattggaa

SEQ ID NO: 7285768 - DNA, 22 bp, Homo sapiens
agttaaatgtgttagccagggt

SEQ ID NO: 7285769 - DNA, 22 bp, Homo sapiens
agttaaatgtcagtagcttaac

SEQ ID NO: 7285770 - DNA, 22 bp, Homo sapiens
agtgtgggggctttggtgtcac

SEQ ID NO: 7285771 - DNA, 22 bp, Homo sapiens
agtgccctttacaacttcttga

SEQ ID NO: 7285772 - DNA, 20 bp, Homo sapiens
agtgccctccgacattgttt

SEQ ID NO: 7285773 - DNA, 22 bp, Homo sapiens
agtgccatggaggaacagatgc

SEQ ID NO: 7285774 - DNA, 22 bp, Homo sapiens
agtgcagggcctgcccagcagg

SEQ ID NO: 7285775 - DNA, 22 bp, Homo sapiens
agtgcagggggaaagggtgtct

SEQ ID NO: 7285776 - DNA, 22 bp, Homo sapiens
agtgcattctctaattacaggt

SEQ ID NO: 7285777 - DNA, 22 bp, Homo sapiens
agtggagtgagtggcagaagga

SEQ ID NO: 7285778 - DNA, 18 bp, Homo sapiens
gcagtgcaggaagaagag

SEQ ID NO: 7285779 - DNA, 22 bp, Homo sapiens
attgtacaatgctgaggtttgg

SEQ ID NO: 7285780 - DNA, 22 bp, Homo sapiens
gccactggcgctgtgcagagtg

SEQ ID NO: 7285781 - DNA, 22 bp, Homo sapiens
gccactggacccagaaagggaa

SEQ ID NO: 7285782 - DNA, 22 bp, Homo sapiens
gcaggagccacttcagggatgc

SEQ ID NO: 7285783 - DNA, 22 bp, Homo sapiens
gcaggagcagtcaggggcagct

SEQ ID NO: 7285784 - DNA, 22 bp, Homo sapiens
gcaggtggatcacctgaggtca

SEQ ID NO: 7285785 - DNA, 22 bp, Homo sapiens
gcaggtggatcacctgaggtca

SEQ ID NO: 7285786 - DNA, 22 bp, Homo sapiens
gcagggattgtgcagggggcta

SEQ ID NO: 7285787 - DNA, 22 bp, Homo sapiens
gcagggtacattgggatgggat

SEQ ID NO: 7285788 - DNA, 21 bp, Homo sapiens
gcagggtcctttccattccta

SEQ ID NO: 7285789 - DNA, 22 bp, Homo sapiens
gcagggtctgaggccacagagg

SEQ ID NO: 7285790 - DNA, 22 bp, Homo sapiens
gcagatgagtgagatagacttc

SEQ ID NO: 7285791 - DNA, 18 bp, Homo sapiens
gcagatgagtagtgtacc

SEQ ID NO: 7285792 - DNA, 22 bp, Homo sapiens
gcagaggggaagctgaggaatt

SEQ ID NO: 7285793 - DNA, 22 bp, Homo sapiens
gcagaaggttgtttgggaaagg

SEQ ID NO: 7285794 - DNA, 22 bp, Homo sapiens
gcagaaggtcaaagcaagatgt

SEQ ID NO: 7285795 - DNA, 21 bp, Homo sapiens
gcagaggaatggtatacataa

SEQ ID NO: 7285796 - DNA, 22 bp, Homo sapiens
gcaggagagtctgtgccaggtt

SEQ ID NO: 7285797 - DNA, 22 bp, Homo sapiens
gcagcctgatgatctgggttgt

SEQ ID NO: 7285798 - DNA, 22 bp, Homo sapiens
gcagcctgggcaacagagtgag

SEQ ID NO: 7285799 - DNA, 22 bp, Homo sapiens
gcagatgccactaggtgaagtg

SEQ ID NO: 7285800 - DNA, 22 bp, Homo sapiens
gcagccagggctaagctgggga

SEQ ID NO: 7285801 - DNA, 19 bp, Homo sapiens
gcagccaggtgctctacct

SEQ ID NO: 7285802 - DNA, 22 bp, Homo sapiens
gcacagggagacagccgtggcc

SEQ ID NO: 7285803 - DNA, 22 bp, Homo sapiens
gcacagggagacagccgtggcc

SEQ ID NO: 7285804 - DNA, 22 bp, Homo sapiens
gcacagggccctgtgcgtaggt

SEQ ID NO: 7285805 - DNA, 22 bp, Homo sapiens
gcacagggcaacaggtctgtta

SEQ ID NO: 7285806 - DNA, 22 bp, Homo sapiens
gcacagggaggctggcctggcc

SEQ ID NO: 7285807 - DNA, 22 bp, Homo sapiens
gcacagggaggctggcctggcc

SEQ ID NO: 7285808 - DNA, 20 bp, Homo sapiens
gcaaaataggctctgttggt

SEQ ID NO: 7285809 - DNA, 22 bp, Homo sapiens
gcaaaatttacactccttcttc

SEQ ID NO: 7285810 - DNA, 22 bp, Homo sapiens
atttgattagctgtgtaatttt

SEQ ID NO: 7285811 - DNA, 23 bp, Homo sapiens
attttacaggtcagttccttgaa

SEQ ID NO: 7285812 - DNA, 22 bp, Homo sapiens
atttgcctttcgaatcaacagg

SEQ ID NO: 7285813 - DNA, 21 bp, Homo sapiens
gcctgccctctgtgatggcca

SEQ ID NO: 7285814 - DNA, 22 bp, Homo sapiens
gcctgcctagaattgcagcttt

SEQ ID NO: 7285815 - DNA, 22 bp, Homo sapiens
gcctgcccacggggctggcata

SEQ ID NO: 7285816 - DNA, 22 bp, Homo sapiens
attttacataaggaaggtttaa

SEQ ID NO: 7285817 - DNA, 22 bp, Homo sapiens
gcctggctcctaagagcacaac

SEQ ID NO: 7285818 - DNA, 22 bp, Homo sapiens
atttacatttatttgagaaggt

SEQ ID NO: 7285819 - DNA, 17 bp, Homo sapiens
atttacattgtcaccga

SEQ ID NO: 7285820 - DNA, 22 bp, Homo sapiens
atttacattccatggtggttac

SEQ ID NO: 7285821 - DNA, 22 bp, Homo sapiens
atttacataatagactttaggt

SEQ ID NO: 7285822 - DNA, 22 bp, Homo sapiens
atttacagacgtggattagtgc

SEQ ID NO: 7285823 - DNA, 22 bp, Homo sapiens
gccagaggtatcaaagatagta

SEQ ID NO: 7285824 - DNA, 22 bp, Homo sapiens
gccctccaccagagcccttctc

SEQ ID NO: 7285825 - DNA, 22 bp, Homo sapiens
gccctccagctgttgcgcgtcg

SEQ ID NO: 7285826 - DNA, 22 bp, Homo sapiens
gccctgccctctcggcactcgc

SEQ ID NO: 7285827 - DNA, 22 bp, Homo sapiens
gccctgccctctcggcactcgc

SEQ ID NO: 7285828 - DNA, 19 bp, Homo sapiens
gccctgcaggaggtggggc

SEQ ID NO: 7285829 - DNA, 22 bp, Homo sapiens
gccctgccgggtattttgtgct

SEQ ID NO: 7285830 - DNA, 22 bp, Homo sapiens
gccctgcctgccggtgtgggtc

SEQ ID NO: 7285831 - DNA, 22 bp, Homo sapiens
gccctgccctgttgaaactaga

SEQ ID NO: 7285832 - DNA, 23 bp, Homo sapiens
gccctgcccttagcacactcaca

SEQ ID NO: 7285833 - DNA, 22 bp, Homo sapiens
gccctgccctgagccgtagacc

SEQ ID NO: 7285834 - DNA, 22 bp, Homo sapiens
gccctgccctgagccgtagacc

SEQ ID NO: 7285835 - DNA, 21 bp, Homo sapiens
gcctggctctcactggcctgg

SEQ ID NO: 7285836 - DNA, 22 bp, Homo sapiens
gcctggctcctaaggactggct

SEQ ID NO: 7285837 - DNA, 22 bp, Homo sapiens
gcctggctctgagggagctcct

SEQ ID NO: 7285838 - DNA, 22 bp, Homo sapiens
caaatgaatttccctgcaaatg

SEQ ID NO: 7285839 - DNA, 22 bp, Homo sapiens
caaattcaaatttcatcagtgt

SEQ ID NO: 7285840 - DNA, 22 bp, Homo sapiens
caaatctttaattgaggaatca

SEQ ID NO: 7285841 - DNA, 21 bp, Homo sapiens
gagtgcaggtctgatgccatc

SEQ ID NO: 7285842 - DNA, 22 bp, Homo sapiens
gatctgggagcctcatggagac

SEQ ID NO: 7285843 - DNA, 22 bp, Homo sapiens
gagggggcgtgcaaggctccgc

SEQ ID NO: 7285844 - DNA, 22 bp, Homo sapiens
gagggcagaaaattatgcggtg

SEQ ID NO: 7285845 - DNA, 22 bp, Homo sapiens
gaggttggggctgcagtgagct

SEQ ID NO: 7285846 - DNA, 22 bp, Homo sapiens
gaggctgtgtgtccctctggac

SEQ ID NO: 7285847 - DNA, 22 bp, Homo sapiens
gagggaagaaagaattgatgcg

SEQ ID NO: 7285848 - DNA, 22 bp, Homo sapiens
gaggctgttagggcctgaggta

SEQ ID NO: 7285849 - DNA, 22 bp, Homo sapiens
gaggctgttcagtgtccagctt

SEQ ID NO: 7285850 - DNA, 22 bp, Homo sapiens
gagggaaaataaaattgcagta

SEQ ID NO: 7285851 - DNA, 22 bp, Homo sapiens
atgtacaaaatgttttgaaatg

SEQ ID NO: 7285852 - DNA, 22 bp, Homo sapiens
atgtacaagctgttttactgca

SEQ ID NO: 7285853 - DNA, 22 bp, Homo sapiens
atgtaaagtatctgaaatgctg

SEQ ID NO: 7285854 - DNA, 22 bp, Homo sapiens
gaggaagccccattgaagccag

SEQ ID NO: 7285855 - DNA, 22 bp, Homo sapiens
gaggaagctgcgtggcatttca

SEQ ID NO: 7285856 - DNA, 22 bp, Homo sapiens
gaggaaggatttagtttgaggg

SEQ ID NO: 7285857 - DNA, 22 bp, Homo sapiens
gaggaaggaatgcagtgtatgc

SEQ ID NO: 7285858 - DNA, 22 bp, Homo sapiens
gagcagggagacaactctggtg

SEQ ID NO: 7285859 - DNA, 17 bp, Homo sapiens
gagcagggatgcggttc

SEQ ID NO: 7285860 - DNA, 22 bp, Homo sapiens
gagcctgtgtttcctgtagcca

SEQ ID NO: 7285861 - DNA, 22 bp, Homo sapiens
gagaggtgaaggctgccctggg

SEQ ID NO: 7285862 - DNA, 22 bp, Homo sapiens
gagaggtgaatgtggatgccac

SEQ ID NO: 7285863 - DNA, 22 bp, Homo sapiens
gagaggtggaggttgcagtgag

SEQ ID NO: 7285864 - DNA, 18 bp, Homo sapiens
atgccctgttgacttcag

SEQ ID NO: 7285865 - DNA, 22 bp, Homo sapiens
atgccctgtggttcatgtgaga

SEQ ID NO: 7285866 - DNA, 22 bp, Homo sapiens
atgccctgggagtgctgtacca

SEQ ID NO: 7285867 - DNA, 22 bp, Homo sapiens
atgccctggacttctagtattc

SEQ ID NO: 7285868 - DNA, 22 bp, Homo sapiens
atgccctggggctacctctgag

SEQ ID NO: 7285869 - DNA, 23 bp, Homo sapiens
atgccctgtgcagaaatgtggaa

SEQ ID NO: 7285870 - DNA, 22 bp, Homo sapiens
atgccctgtggcagtacatatt

SEQ ID NO: 7285871 - DNA, 20 bp, Homo sapiens
atgccctgtcctcttctgtt

SEQ ID NO: 7285872 - DNA, 23 bp, Homo sapiens
atgccctgtagaggctgctgacc

SEQ ID NO: 7285873 - DNA, 22 bp, Homo sapiens
atgccctgtgactctcctggac

SEQ ID NO: 7285874 - DNA, 22 bp, Homo sapiens
atgccctgaaagattcaaaggc

SEQ ID NO: 7285875 - DNA, 22 bp, Homo sapiens
atgcccaggcccatacctagat

SEQ ID NO: 7285876 - DNA, 22 bp, Homo sapiens
atgccctgctgccatctggccg

SEQ ID NO: 7285877 - DNA, 22 bp, Homo sapiens
gaatgttagagattcttaggtt

SEQ ID NO: 7285878 - DNA, 22 bp, Homo sapiens
gaatgttatgtatccagtcaca

SEQ ID NO: 7285879 - DNA, 22 bp, Homo sapiens
gaatgttattggacagcagtgg

SEQ ID NO: 7285880 - DNA, 22 bp, Homo sapiens
gaatgttattgaactacgagct

SEQ ID NO: 7285881 - DNA, 22 bp, Homo sapiens
gaatgttactttgattttgtcc

SEQ ID NO: 7285882 - DNA, 22 bp, Homo sapiens
gaatgttaatgcacttctagct

SEQ ID NO: 7285883 - DNA, 23 bp, Homo sapiens
gacagggctgacttggcagctgc

SEQ ID NO: 7285884 - DNA, 22 bp, Homo sapiens
gacataaaccttgagatattaa

SEQ ID NO: 7285885 - DNA, 22 bp, Homo sapiens
gaaaaccacctcccatcaagca

SEQ ID NO: 7285886 - DNA, 22 bp, Homo sapiens
gaaaagaactgcatgggattaa

SEQ ID NO: 7285887 - DNA, 22 bp, Homo sapiens
cttgagagccactcctggggcc

SEQ ID NO: 7285888 - DNA, 22 bp, Homo sapiens
gaagaaagatcaaatagtttcc

SEQ ID NO: 7285889 - DNA, 18 bp, Homo sapiens
caaattcagtgctggaag

SEQ ID NO: 7285890 - DNA, 18 bp, Homo sapiens
caaattcagtgctggaag

SEQ ID NO: 7285891 - DNA, 22 bp, Homo sapiens
caaatttaggtaacagtctgta

SEQ ID NO: 7285892 - DNA, 22 bp, Homo sapiens
caaatttaagttagaaagcaat

SEQ ID NO: 7285893 - DNA, 22 bp, Homo sapiens
caaatttaagtgaggtctttgt

SEQ ID NO: 7285894 - DNA, 22 bp, Homo sapiens
gctggcagagagctggtgagga

SEQ ID NO: 7285895 - DNA, 22 bp, Homo sapiens
gctggcagcattagaccctggg

SEQ ID NO: 7285896 - DNA, 20 bp, Homo sapiens
gctggcagatgtcttgagat

SEQ ID NO: 7285897 - DNA, 21 bp, Homo sapiens
gctgggcctgtacttgccctg

SEQ ID NO: 7285898 - DNA, 22 bp, Homo sapiens
gctgggccttccgattctcaag

SEQ ID NO: 7285899 - DNA, 20 bp, Homo sapiens
gctgggctaccactggccct

SEQ ID NO: 7285900 - DNA, 22 bp, Homo sapiens
gctgggccgacctgggctgcag

SEQ ID NO: 7285901 - DNA, 22 bp, Homo sapiens
gctgggccctgggtgccctagc

SEQ ID NO: 7285902 - DNA, 22 bp, Homo sapiens
gctgggctcaccaggccactag

SEQ ID NO: 7285903 - DNA, 22 bp, Homo sapiens
ggaaatggtggaggaaggctta

SEQ ID NO: 7285904 - DNA, 22 bp, Homo sapiens
ggaacacagaagggctgaaaaa

SEQ ID NO: 7285905 - DNA, 18 bp, Homo sapiens
ggagagtgacagagtcgt

SEQ ID NO: 7285906 - DNA, 22 bp, Homo sapiens
ggagagtgggagcaactgttgc

SEQ ID NO: 7285907 - DNA, 18 bp, Homo sapiens
ggagagtgagatcaaaca

SEQ ID NO: 7285908 - DNA, 17 bp, Homo sapiens
ggagagtgggaatggcc

SEQ ID NO: 7285909 - DNA, 22 bp, Homo sapiens
ggagagtggattccagctgtat

SEQ ID NO: 7285910 - DNA, 22 bp, Homo sapiens
ggacagcatatcagcagggcag

SEQ ID NO: 7285911 - DNA, 22 bp, Homo sapiens
cacagagaatgatgagtcactg

SEQ ID NO: 7285912 - DNA, 22 bp, Homo sapiens
ggagcagcttgcatgctcaggg

SEQ ID NO: 7285913 - DNA, 22 bp, Homo sapiens
ggagggcaacttttcagtaggt

SEQ ID NO: 7285914 - DNA, 22 bp, Homo sapiens
cacaggagagctgggaggtgcc

SEQ ID NO: 7285915 - DNA, 22 bp, Homo sapiens
ggctcctgtcccctcagctgct

SEQ ID NO: 7285916 - DNA, 22 bp, Homo sapiens
cactgcctccccaggctccaca

SEQ ID NO: 7285917 - DNA, 22 bp, Homo sapiens
ggctgcagcggattggggattg

SEQ ID NO: 7285918 - DNA, 22 bp, Homo sapiens
ggcttgcacacagcctcagttt

SEQ ID NO: 7285919 - DNA, 22 bp, Homo sapiens
ggcttcaggggcccagtcagca

SEQ ID NO: 7285920 - DNA, 22 bp, Homo sapiens
cagaaatgcctgcttctctctc

SEQ ID NO: 7285921 - DNA, 20 bp, Homo sapiens
cagaaatttgtaaaagggat

SEQ ID NO: 7285922 - DNA, 22 bp, Homo sapiens
cagaaattggaatagagaaata

SEQ ID NO: 7285923 - DNA, 22 bp, Homo sapiens
cagaaatgttctaatgattcag

SEQ ID NO: 7285924 - DNA, 22 bp, Homo sapiens
ggcaggaaaacaatgagccagg

SEQ ID NO: 7285925 - DNA, 22 bp, Homo sapiens
ggcaggaagaggagggtgaact

SEQ ID NO: 7285926 - DNA, 22 bp, Homo sapiens
ggagtctgggaattggagagaa

SEQ ID NO: 7285927 - DNA, 22 bp, Homo sapiens
ggcaggtgtggtgaccagagat

SEQ ID NO: 7285928 - DNA, 20 bp, Homo sapiens
ggcaggacccggtagggagc

SEQ ID NO: 7285929 - DNA, 22 bp, Homo sapiens
ggcgcacaatgtgcaggtttgt

SEQ ID NO: 7285930 - DNA, 22 bp, Homo sapiens
ggcgagggagcagtgcggtggg

SEQ ID NO: 7285931 - DNA, 22 bp, Homo sapiens
ggcgagggagcagtgcggtggg

SEQ ID NO: 7285932 - DNA, 22 bp, Homo sapiens
cagaggcagccgggggagaacg

SEQ ID NO: 7285933 - DNA, 22 bp, Homo sapiens
gggctcagggacacatgtgtgt

SEQ ID NO: 7285934 - DNA, 22 bp, Homo sapiens
gggctcaggagtttgaggctgc

SEQ ID NO: 7285935 - DNA, 22 bp, Homo sapiens
gggctcagtcggcaagcccctt

SEQ ID NO: 7285936 - DNA, 21 bp, Homo sapiens
gggctcagtggaaaagagtgt

SEQ ID NO: 7285937 - DNA, 21 bp, Homo sapiens
gggctctgccctcctggagct

SEQ ID NO: 7285938 - DNA, 22 bp, Homo sapiens
gggccctggctttcctgttctt

SEQ ID NO: 7285939 - DNA, 20 bp, Homo sapiens
gggccctgggattcagagca

SEQ ID NO: 7285940 - DNA, 22 bp, Homo sapiens
gggccctgggattcagagcaag

SEQ ID NO: 7285941 - DNA, 22 bp, Homo sapiens
cagagcagcctccagggggagc

SEQ ID NO: 7285942 - DNA, 22 bp, Homo sapiens
cagagagagtggggtgtggatt

SEQ ID NO: 7285943 - DNA, 22 bp, Homo sapiens
gggccctggccgaatccctctg

SEQ ID NO: 7285944 - DNA, 22 bp, Homo sapiens
gggccctgcgtccggaagtctg

SEQ ID NO: 7285945 - DNA, 20 bp, Homo sapiens
cagcagagacccatggggag

SEQ ID NO: 7285946 - DNA, 22 bp, Homo sapiens
cagatgcttttgattctggggt

SEQ ID NO: 7285947 - DNA, 22 bp, Homo sapiens
ggtggcagtagcactgggcctg

SEQ ID NO: 7285948 - DNA, 22 bp, Homo sapiens
ggtggcagttacaggggcaaat

SEQ ID NO: 7285949 - DNA, 18 bp, Homo sapiens
ggtgggaagccagggcct

SEQ ID NO: 7285950 - DNA, 22 bp, Homo sapiens
ggtgggaaggccactgaaggtt

SEQ ID NO: 7285951 - DNA, 22 bp, Homo sapiens
ggggtcctggaggccagctgga

SEQ ID NO: 7285952 - DNA, 22 bp, Homo sapiens
cagaggctgccagccatgtgca

SEQ ID NO: 7285953 - DNA, 22 bp, Homo sapiens
ggtgagaggcagaggacagctt

SEQ ID NO: 7285954 - DNA, 22 bp, Homo sapiens
cagataataatatgacttcact

SEQ ID NO: 7285955 - DNA, 22 bp, Homo sapiens
cagataaatagatagataaact

SEQ ID NO: 7285956 - DNA, 20 bp, Homo sapiens
cagataaacgggaaagaagc

SEQ ID NO: 7285957 - DNA, 22 bp, Homo sapiens
ggtgcagaaggaagggagctgg

SEQ ID NO: 7285958 - DNA, 22 bp, Homo sapiens
ggtgcagagcagtgtcagagca

SEQ ID NO: 7285959 - DNA, 22 bp, Homo sapiens
ggtgcagaggagccagctgggg

SEQ ID NO: 7285960 - DNA, 22 bp, Homo sapiens
ggtgcagaagaaagcagtcatt

SEQ ID NO: 7285961 - DNA, 22 bp, Homo sapiens
gtgccctgacacacctggtgtg

SEQ ID NO: 7285962 - DNA, 22 bp, Homo sapiens
cagcagggaagctgtgctgttt

SEQ ID NO: 7285963 - DNA, 22 bp, Homo sapiens
cagcaggtgggctttgcggatg

SEQ ID NO: 7285964 - DNA, 22 bp, Homo sapiens
cagcaggtgtctagcaagggtc

SEQ ID NO: 7285965 - DNA, 22 bp, Homo sapiens
gtcctgagaatactaggcacaa

SEQ ID NO: 7285966 - DNA, 22 bp, Homo sapiens
gtgaagttcaagcttgccatct

SEQ ID NO: 7285967 - DNA, 22 bp, Homo sapiens
gtctttggaggcactgttgagt

SEQ ID NO: 7285968 - DNA, 18 bp, Homo sapiens
gtctttggagtggaggta

SEQ ID NO: 7285969 - DNA, 20 bp, Homo sapiens
gtctccactgggggttaacc

SEQ ID NO: 7285970 - DNA, 22 bp, Homo sapiens
gtgcaggagcaggagccatgtc

SEQ ID NO: 7285971 - DNA, 22 bp, Homo sapiens
gtgcaggagccaggggtaggaa

SEQ ID NO: 7285972 - DNA, 16 bp, Homo sapiens
gtgcaaaagtgaggag

SEQ ID NO: 7285973 - DNA, 22 bp, Homo sapiens
gtgcaaaatgatatcctgaagc

SEQ ID NO: 7285974 - DNA, 22 bp, Homo sapiens
gtgcaaaatttggccaataaca

SEQ ID NO: 7285975 - DNA, 22 bp, Homo sapiens
gtgcaaaagtaattacagtttt

SEQ ID NO: 7285976 - DNA, 22 bp, Homo sapiens
gtgcaaaagtaattgaggtttt

SEQ ID NO: 7285977 - DNA, 22 bp, Homo sapiens
gtgcaaaagtaattgcagtact

SEQ ID NO: 7285978 - DNA, 22 bp, Homo sapiens
gtgcaaaagtacttgcggattt

SEQ ID NO: 7285979 - DNA, 22 bp, Homo sapiens
gtgcaaaagtcattgtggtttt

SEQ ID NO: 7285980 - DNA, 22 bp, Homo sapiens
gtgcaaaagtaattgtggtttt

SEQ ID NO: 7285981 - DNA, 22 bp, Homo sapiens
gtgcaaaagtaattgctgtttt

SEQ ID NO: 7285982 - DNA, 22 bp, Homo sapiens
gtgcaaaagtaattgcggtttt

SEQ ID NO: 7285983 - DNA, 22 bp, Homo sapiens
gtgcaaaagtaattgcagtttt

SEQ ID NO: 7285984 - DNA, 22 bp, Homo sapiens
gtgaagttttagtatatgtaga

SEQ ID NO: 7285985 - DNA, 22 bp, Homo sapiens
tccaagatctacagcagtttag

SEQ ID NO: 7285986 - DNA, 22 bp, Homo sapiens
catgccaacaacaagcaatgag

SEQ ID NO: 7285987 - DNA, 22 bp, Homo sapiens
tccagcagaaccagagacctgg

SEQ ID NO: 7285988 - DNA, 22 bp, Homo sapiens
tccagcagaaaagaggtaggga

SEQ ID NO: 7285989 - DNA, 22 bp, Homo sapiens
catggaaagcactcagcccagt

SEQ ID NO: 7285990 - DNA, 22 bp, Homo sapiens
catgggctcttctggactgcac

SEQ ID NO: 7285991 - DNA, 22 bp, Homo sapiens
catgtgggaagaggccagctgg

SEQ ID NO: 7285992 - DNA, 22 bp, Homo sapiens
catgtggctttggcatgtgccc

SEQ ID NO: 7285993 - DNA, 22 bp, Homo sapiens
tcaggcagaattatcaaaagat

SEQ ID NO: 7285994 - DNA, 22 bp, Homo sapiens
tcaggcagaaaaatcactaatt

SEQ ID NO: 7285995 - DNA, 22 bp, Homo sapiens
tcaggagggagtgtggatagag

SEQ ID NO: 7285996 - DNA, 22 bp, Homo sapiens
tcaggaggcgtctcgctggggc

SEQ ID NO: 7285997 - DNA, 22 bp, Homo sapiens
tcaggaggccaccaggacctgt

SEQ ID NO: 7285998 - DNA, 22 bp, Homo sapiens
catcacatttaaggggaaggac

SEQ ID NO: 7285999 - DNA, 22 bp, Homo sapiens
tcaggctgcccgttcagggctc

SEQ ID NO: 7286000 - DNA, 22 bp, Homo sapiens
tctctgggataaactgggccag

SEQ ID NO: 7286001 - DNA, 22 bp, Homo sapiens
ccagatgttcccctggaggcct

SEQ ID NO: 7286002 - DNA, 22 bp, Homo sapiens
ccagagcccgggacctggactt

SEQ ID NO: 7286003 - DNA, 22 bp, Homo sapiens
ccagagccggctccctcagctt

SEQ ID NO: 7286004 - DNA, 22 bp, Homo sapiens
tctcagtgggaagggcacagtt

SEQ ID NO: 7286005 - DNA, 22 bp, Homo sapiens
tcctgtgtgctttctttaggtt

SEQ ID NO: 7286006 - DNA, 22 bp, Homo sapiens
ccacccctgggtgcagggagcg

SEQ ID NO: 7286007 - DNA, 22 bp, Homo sapiens
ccacccatgtgactacctcatg

SEQ ID NO: 7286008 - DNA, 22 bp, Homo sapiens
ccacccctgtagagggacagac

SEQ ID NO: 7286009 - DNA, 19 bp, Homo sapiens
ccacccctttgctgggccc

SEQ ID NO: 7286010 - DNA, 22 bp, Homo sapiens
tctagaaagtactagagctggt

SEQ ID NO: 7286011 - DNA, 21 bp, Homo sapiens
tcctgccttagtccagagcag

SEQ ID NO: 7286012 - DNA, 22 bp, Homo sapiens
tcctgccttagagcaaggaaaa

SEQ ID NO: 7286013 - DNA, 22 bp, Homo sapiens
tcctgccttgcctgggacatca

SEQ ID NO: 7286014 - DNA, 22 bp, Homo sapiens
tcctgccttgcctgggacatca

SEQ ID NO: 7286015 - DNA, 22 bp, Homo sapiens
tcctgccttcatactgctgtat

SEQ ID NO: 7286016 - DNA, 22 bp, Homo sapiens
tcctgctccaccgtgggctgga

SEQ ID NO: 7286017 - DNA, 22 bp, Homo sapiens
cattttggctattgtaaatagt

SEQ ID NO: 7286018 - DNA, 22 bp, Homo sapiens
cattttacctagaagctgaaag

SEQ ID NO: 7286019 - DNA, 22 bp, Homo sapiens
cattttacgacatagggcaggc

SEQ ID NO: 7286020 - DNA, 22 bp, Homo sapiens
cattttactgactcttgaatta

SEQ ID NO: 7286021 - DNA, 22 bp, Homo sapiens
caggtggggggcttccgagcct

SEQ ID NO: 7286022 - DNA, 22 bp, Homo sapiens
caggtggggcagctgtgggagc

SEQ ID NO: 7286023 - DNA, 22 bp, Homo sapiens
caggtggggcgccctcaggcag

SEQ ID NO: 7286024 - DNA, 22 bp, Homo sapiens
caggtggggagagtgtggagca

SEQ ID NO: 7286025 - DNA, 22 bp, Homo sapiens
caggtgggctgcctctccagct

SEQ ID NO: 7286026 - DNA, 22 bp, Homo sapiens
caggtggcttagtcccatttta

SEQ ID NO: 7286027 - DNA, 22 bp, Homo sapiens
cagggctgaggacacaagtaaa

SEQ ID NO: 7286028 - DNA, 22 bp, Homo sapiens
tagtacactctgtaagtttaaa

SEQ ID NO: 7286029 - DNA, 22 bp, Homo sapiens
tagtacaactcacttgatttta

SEQ ID NO: 7286030 - DNA, 19 bp, Homo sapiens
tagtacaaaagcagccata

SEQ ID NO: 7286031 - DNA, 22 bp, Homo sapiens
tcacattctcagcatctataca

SEQ ID NO: 7286032 - DNA, 19 bp, Homo sapiens
tcacattcagccttgctga

SEQ ID NO: 7286033 - DNA, 22 bp, Homo sapiens
tcacattctagaatgttatcgt

SEQ ID NO: 7286034 - DNA, 22 bp, Homo sapiens
tcacattcatggtgctaataaa

SEQ ID NO: 7286035 - DNA, 22 bp, Homo sapiens
tcacattcttccctgacttctt

SEQ ID NO: 7286036 - DNA, 23 bp, Homo sapiens
tcacactggatacacatgcaaga

SEQ ID NO: 7286037 - DNA, 22 bp, Homo sapiens
cagtgcagtttcccagatgctg

SEQ ID NO: 7286038 - DNA, 22 bp, Homo sapiens
cagtgcagtcaaggaagaacca

SEQ ID NO: 7286039 - DNA, 22 bp, Homo sapiens
cagtgcagttggtggcaggggt

SEQ ID NO: 7286040 - DNA, 22 bp, Homo sapiens
cagtgcaggtttagggctgggg

SEQ ID NO: 7286041 - DNA, 22 bp, Homo sapiens
cagtgcaggtggcagaggacag

SEQ ID NO: 7286042 - DNA, 22 bp, Homo sapiens
cagtgcagaggtgcaagcatgt

SEQ ID NO: 7286043 - DNA, 22 bp, Homo sapiens
tcaaagcatggttttgaaagac

SEQ ID NO: 7286044 - DNA, 22 bp, Homo sapiens
tcaaagcatcagtcaatttagg

SEQ ID NO: 7286045 - DNA, 22 bp, Homo sapiens
tcaaagcagcacattcgcaagc

SEQ ID NO: 7286046 - DNA, 22 bp, Homo sapiens
tattccctgatgtacactggca

SEQ ID NO: 7286047 - DNA, 22 bp, Homo sapiens
tcaacaaatacttaaagcagag

SEQ ID NO: 7286048 - DNA, 22 bp, Homo sapiens
caggccttagtaggtgctccct

SEQ ID NO: 7286049 - DNA, 22 bp, Homo sapiens
caggcctggagtgcaatggcac

SEQ ID NO: 7286050 - DNA, 22 bp, Homo sapiens
caggctcccacaagctcccagc

SEQ ID NO: 7286051 - DNA, 22 bp, Homo sapiens
tacagttcctctcgtggaggtg

SEQ ID NO: 7286052 - DNA, 22 bp, Homo sapiens
caggctcctcactcatgctccc

SEQ ID NO: 7286053 - DNA, 22 bp, Homo sapiens
caggctccctaagtcagcagcc

SEQ ID NO: 7286054 - DNA, 22 bp, Homo sapiens
tacactgtttttggaaagaaga

SEQ ID NO: 7286055 - DNA, 22 bp, Homo sapiens
tacactgtgacaatcatgacag

SEQ ID NO: 7286056 - DNA, 22 bp, Homo sapiens
tagaaacaagtttctctttggg

SEQ ID NO: 7286057 - DNA, 22 bp, Homo sapiens
cagggacagccttggggtggcg

SEQ ID NO: 7286058 - DNA, 22 bp, Homo sapiens
cagggcagtttgtgcctatgag

SEQ ID NO: 7286059 - DNA, 22 bp, Homo sapiens
cagggcagtgaagaacacacgt

SEQ ID NO: 7286060 - DNA, 22 bp, Homo sapiens
cagggcagtaccgccctctggc

SEQ ID NO: 7286061 - DNA, 22 bp, Homo sapiens
cagggcagttttacttctctct

SEQ ID NO: 7286062 - DNA, 22 bp, Homo sapiens
cagggcataagatgaggctgta

SEQ ID NO: 7286063 - DNA, 22 bp, Homo sapiens
cagggagctttgtcttctcatt

SEQ ID NO: 7286064 - DNA, 22 bp, Homo sapiens
cagggagcggagtcccatgcct

SEQ ID NO: 7286065 - DNA, 22 bp, Homo sapiens
tctgggcttttgcactggccat

SEQ ID NO: 7286066 - DNA, 22 bp, Homo sapiens
tctgggctctgtcagcacctct

SEQ ID NO: 7286067 - DNA, 22 bp, Homo sapiens
tctgttcagttgatgtagtttt

SEQ ID NO: 7286068 - DNA, 22 bp, Homo sapiens
ccaggcagatgggccggcttca

SEQ ID NO: 7286069 - DNA, 22 bp, Homo sapiens
ccaggcagagtgctccagaaag

SEQ ID NO: 7286070 - DNA, 22 bp, Homo sapiens
ccaggcagagggatccccatcc

SEQ ID NO: 7286071 - DNA, 22 bp, Homo sapiens
ccaggcagcaaattttctgaat

SEQ ID NO: 7286072 - DNA, 22 bp, Homo sapiens
ccaggcaggcagcgttctcagg

SEQ ID NO: 7286073 - DNA, 22 bp, Homo sapiens
ccaggcagcctgctccattctg

SEQ ID NO: 7286074 - DNA, 17 bp, Homo sapiens
tcttctcttccagtctt

SEQ ID NO: 7286075 - DNA, 22 bp, Homo sapiens
ccagggcaaatgagatcatagc

SEQ ID NO: 7286076 - DNA, 22 bp, Homo sapiens
ccagggcacgttgggacagtac

SEQ ID NO: 7286077 - DNA, 22 bp, Homo sapiens
ccagggctccccagaagtaccc

SEQ ID NO: 7286078 - DNA, 22 bp, Homo sapiens
ccagggctctatgagggtggag

SEQ ID NO: 7286079 - DNA, 22 bp, Homo sapiens
tcttgatttactctaatagctt

SEQ ID NO: 7286080 - DNA, 22 bp, Homo sapiens
tcttttctgtaactcagtgtct

SEQ ID NO: 7286081 - DNA, 22 bp, Homo sapiens
tcttttgtgattcttcagttac

SEQ ID NO: 7286082 - DNA, 22 bp, Homo sapiens
tcttttcttgcattattgcact

SEQ ID NO: 7286083 - DNA, 22 bp, Homo sapiens
ccagtgccttttgtgggtttgt

SEQ ID NO: 7286084 - DNA, 22 bp, Homo sapiens
tgaggctgaaactggcgataga

SEQ ID NO: 7286085 - DNA, 22 bp, Homo sapiens
tgaggctgagatatcagggagg

SEQ ID NO: 7286086 - DNA, 22 bp, Homo sapiens
ccatcctgcaggacctccatat

SEQ ID NO: 7286087 - DNA, 22 bp, Homo sapiens
tgagtcatgtaataatgctgct

SEQ ID NO: 7286088 - DNA, 22 bp, Homo sapiens
ccatcccttctctggccagcag

SEQ ID NO: 7286089 - DNA, 22 bp, Homo sapiens
tgataaacttagaaagaatgtt

SEQ ID NO: 7286090 - DNA, 22 bp, Homo sapiens
tgcagctgattaaagggcagac

SEQ ID NO: 7286091 - DNA, 20 bp, Homo sapiens
tgcagctgcaggagggtggg

SEQ ID NO: 7286092 - DNA, 22 bp, Homo sapiens
tgcagctgcaggagggtgggag

SEQ ID NO: 7286093 - DNA, 22 bp, Homo sapiens
cccagcaggaggaggttgcagt

SEQ ID NO: 7286094 - DNA, 22 bp, Homo sapiens
cccagcagggtctctgtgtcta

SEQ ID NO: 7286095 - DNA, 22 bp, Homo sapiens
tgcaggcaggggatgagcagcc

SEQ ID NO: 7286096 - DNA, 22 bp, Homo sapiens
cccagcagccttgtcccttctc

SEQ ID NO: 7286097 - DNA, 22 bp, Homo sapiens
cccttggggatgctgtgtctgg

SEQ ID NO: 7286098 - DNA, 19 bp, Homo sapiens
tggcagggagagtttgaag

SEQ ID NO: 7286099 - DNA, 22 bp, Homo sapiens
tggcagggaatacagatgttta

SEQ ID NO: 7286100 - DNA, 22 bp, Homo sapiens
tggcagggagccaccggtcatg

SEQ ID NO: 7286101 - DNA, 22 bp, Homo sapiens
ccctgggagaagttgagggctg

SEQ ID NO: 7286102 - DNA, 22 bp, Homo sapiens
ccctggctgctaccaggtagct

SEQ ID NO: 7286103 - DNA, 21 bp, Homo sapiens
tgcttgggggcttcaggagct

SEQ ID NO: 7286104 - DNA, 22 bp, Homo sapiens
tgcttgggcggccagcatggcg

SEQ ID NO: 7286105 - DNA, 22 bp, Homo sapiens
cccagtggcttttgcccaggtt

SEQ ID NO: 7286106 - DNA, 22 bp, Homo sapiens
ccccagctgcatacttgccaag

SEQ ID NO: 7286107 - DNA, 22 bp, Homo sapiens
tgctgggggtgtctcaccaggc

SEQ ID NO: 7286108 - DNA, 22 bp, Homo sapiens
tgctgggggtagctctgcgtag

SEQ ID NO: 7286109 - DNA, 22 bp, Homo sapiens
tgctgggggctttctggatacc

SEQ ID NO: 7286110 - DNA, 22 bp, Homo sapiens
tgcaggtgctccgggggtgccc

SEQ ID NO: 7286111 - DNA, 22 bp, Homo sapiens
tgctctggaatagtcctaggca

SEQ ID NO: 7286112 - DNA, 22 bp, Homo sapiens
cccagtggcccagcatgtggtg

SEQ ID NO: 7286113 - DNA, 22 bp, Homo sapiens
tgggagagaattctggtgactg

SEQ ID NO: 7286114 - DNA, 22 bp, Homo sapiens
cctctccagttttaacgtgacc

SEQ ID NO: 7286115 - DNA, 22 bp, Homo sapiens
cctctcccagggagagcctgag

SEQ ID NO: 7286116 - DNA, 19 bp, Homo sapiens
cctctcccatgcttacctc

SEQ ID NO: 7286117 - DNA, 22 bp, Homo sapiens
tgggaaggcgtggaagtagaag

SEQ ID NO: 7286118 - DNA, 22 bp, Homo sapiens
cctctcccgggtgccgctgggc

SEQ ID NO: 7286119 - DNA, 23 bp, Homo sapiens
tggcattttagttagcttcagtg

SEQ ID NO: 7286120 - DNA, 22 bp, Homo sapiens
tggcattttgtagctgtgtatc

SEQ ID NO: 7286121 - DNA, 22 bp, Homo sapiens
tggcatttctgttagactctca

SEQ ID NO: 7286122 - DNA, 22 bp, Homo sapiens
cctcccacattgaggacatgct

SEQ ID NO: 7286123 - DNA, 22 bp, Homo sapiens
cctcctgggactcattagcacc

SEQ ID NO: 7286124 - DNA, 22 bp, Homo sapiens
cctcctggcctgtgcagagccc

SEQ ID NO: 7286125 - DNA, 22 bp, Homo sapiens
tggggagaagcaatagactcta

SEQ ID NO: 7286126 - DNA, 22 bp, Homo sapiens
tgggcctggacatctgtatttt

SEQ ID NO: 7286127 - DNA, 22 bp, Homo sapiens
tgggcctggagccctggagagt

SEQ ID NO: 7286128 - DNA, 22 bp, Homo sapiens
tgggcctggagtttgtccagag

SEQ ID NO: 7286129 - DNA, 22 bp, Homo sapiens
tgggcaggcaagtgaatacctt

SEQ ID NO: 7286130 - DNA, 22 bp, Homo sapiens
tgggcaggataatatctcatgt

SEQ ID NO: 7286131 - DNA, 22 bp, Homo sapiens
tgggctccagcacctgtgctct

SEQ ID NO: 7286132 - DNA, 19 bp, Homo sapiens
tgggctcattcaggtggtt

SEQ ID NO: 7286133 - DNA, 22 bp, Homo sapiens
tgggctcatgtttctttgagga

SEQ ID NO: 7286134 - DNA, 22 bp, Homo sapiens
tgggctccgttgcctggggcag

SEQ ID NO: 7286135 - DNA, 22 bp, Homo sapiens
tgggctccggcggcctcaggct

SEQ ID NO: 7286136 - DNA, 22 bp, Homo sapiens
tgggctcatggcccagcactgg

SEQ ID NO: 7286137 - DNA, 22 bp, Homo sapiens
tgggctcatgctggagatgaga

SEQ ID NO: 7286138 - DNA, 22 bp, Homo sapiens
tgggcctgggagggcagacgct

SEQ ID NO: 7286139 - DNA, 22 bp, Homo sapiens
tgggcctggccctgtggaggag

SEQ ID NO: 7286140 - DNA, 22 bp, Homo sapiens
tgggcctggccctgtggaggag

SEQ ID NO: 7286141 - DNA, 22 bp, Homo sapiens
cctgcaggtttcccccggacgg

SEQ ID NO: 7286142 - DNA, 22 bp, Homo sapiens
cctgccactgtaggtgacagtt

SEQ ID NO: 7286143 - DNA, 19 bp, Homo sapiens
cctgcagggatgagaggtt

SEQ ID NO: 7286144 - DNA, 22 bp, Homo sapiens
cctgccctgtcactggctaggg

SEQ ID NO: 7286145 - DNA, 22 bp, Homo sapiens
cctgcccttctttccccagcat

SEQ ID NO: 7286146 - DNA, 22 bp, Homo sapiens
cctgccctgtgtttggggacta

SEQ ID NO: 7286147 - DNA, 22 bp, Homo sapiens
cctgcctgcaaaatgggacaag

SEQ ID NO: 7286148 - DNA, 22 bp, Homo sapiens
cctgcctgaaggtcagccaccc

SEQ ID NO: 7286149 - DNA, 22 bp, Homo sapiens
cctgcctcccagaggtcctcta

SEQ ID NO: 7286150 - DNA, 22 bp, Homo sapiens
cctggggagaagagcttccccc

SEQ ID NO: 7286151 - DNA, 22 bp, Homo sapiens
tgtttcttctcacacaaactca

SEQ ID NO: 7286152 - DNA, 22 bp, Homo sapiens
tgtttcttacgtttttagaggc

SEQ ID NO: 7286153 - DNA, 21 bp, Homo sapiens
tgttttccaccttgaggcaag

SEQ ID NO: 7286154 - DNA, 22 bp, Homo sapiens
ttaaaatagccagtgcccctct

SEQ ID NO: 7286155 - DNA, 22 bp, Homo sapiens
ttaatatgttgaaatttattag

SEQ ID NO: 7286156 - DNA, 22 bp, Homo sapiens
cctgtggacattctgtgtggaa

SEQ ID NO: 7286157 - DNA, 22 bp, Homo sapiens
cctgtggcacatgcagggattc

SEQ ID NO: 7286158 - DNA, 22 bp, Homo sapiens
cctgtggctgccacttgggtga

SEQ ID NO: 7286159 - DNA, 18 bp, Homo sapiens
cctgtggctcagcccaca

SEQ ID NO: 7286160 - DNA, 22 bp, Homo sapiens
cctgtggcgggggccagtgcct

SEQ ID NO: 7286161 - DNA, 22 bp, Homo sapiens
cctttggctgcatagggaaggg

SEQ ID NO: 7286162 - DNA, 22 bp, Homo sapiens
cctttggccgctttatggagga

SEQ ID NO: 7286163 - DNA, 22 bp, Homo sapiens
cctttggcattttgaggatgcg

SEQ ID NO: 7286164 - DNA, 22 bp, Homo sapiens
cctttggccctgagagatgatt

SEQ ID NO: 7286165 - DNA, 22 bp, Homo sapiens
ttatgtaatttgtttgctcttc

SEQ ID NO: 7286166 - DNA, 22 bp, Homo sapiens
ttatttttaaaagttcacacag

SEQ ID NO: 7286167 - DNA, 22 bp, Homo sapiens
cgcagagggagccgcgggctgc

SEQ ID NO: 7286168 - DNA, 22 bp, Homo sapiens
cgcagagggcaggcagtgctgg

SEQ ID NO: 7286169 - DNA, 22 bp, Homo sapiens
cgcagcagccccgtggtaggtg

SEQ ID NO: 7286170 - DNA, 22 bp, Homo sapiens
ttcaaaaaggtatgttcaagtc

SEQ ID NO: 7286171 - DNA, 17 bp, Homo sapiens
ttattttttgggctgag

SEQ ID NO: 7286172 - DNA, 21 bp, Homo sapiens
ccttctcttgcttcagcttca

SEQ ID NO: 7286173 - DNA, 22 bp, Homo sapiens
ccttgtcttgcacagatgcagc

SEQ ID NO: 7286174 - DNA, 22 bp, Homo sapiens
cctttaaagactgcataacttc

SEQ ID NO: 7286175 - DNA, 22 bp, Homo sapiens
cctttaaatggatgttcaactg

SEQ ID NO: 7286176 - DNA, 22 bp, Homo sapiens
ccttgcctccactgttttaggt

SEQ ID NO: 7286177 - DNA, 22 bp, Homo sapiens
ccttggctggaattactctggg

SEQ ID NO: 7286178 - DNA, 19 bp, Homo sapiens
ccttgcctgtccctgcagc

SEQ ID NO: 7286179 - DNA, 19 bp, Homo sapiens
ccttgcctgtccctgcagc

SEQ ID NO: 7286180 - DNA, 22 bp, Homo sapiens
ccttggctgtgctgccctttgc

SEQ ID NO: 7286181 - DNA, 22 bp, Homo sapiens
ccttggctgtgttgcctgccct

SEQ ID NO: 7286182 - DNA, 21 bp, Homo sapiens
ccttgggatgcaagtgagact

SEQ ID NO: 7286183 - DNA, 22 bp, Homo sapiens
ccttgggatgcataagagccca

SEQ ID NO: 7286184 - DNA, 22 bp, Homo sapiens
ccttgggatttctcatgccaat

SEQ ID NO: 7286185 - DNA, 22 bp, Homo sapiens
ccttgggagaaattgcagagtc

SEQ ID NO: 7286186 - DNA, 22 bp, Homo sapiens
ccttgggaggctcccagggaga

SEQ ID NO: 7286187 - DNA, 22 bp, Homo sapiens
ccttggcttccttccctctaga

SEQ ID NO: 7286188 - DNA, 22 bp, Homo sapiens
ccttggcttgcacacggccacc

SEQ ID NO: 7286189 - DNA, 22 bp, Homo sapiens
ccttggcttgtgggctgcagcc

SEQ ID NO: 7286190 - DNA, 20 bp, Homo sapiens
ccttgggaaacaaagtagag

SEQ ID NO: 7286191 - DNA, 22 bp, Homo sapiens
ttcttcagggaagcttgttaat

SEQ ID NO: 7286192 - DNA, 22 bp, Homo sapiens
ttcttacaagtattccaggtcc

SEQ ID NO: 7286193 - DNA, 22 bp, Homo sapiens
ttctctttttgcatctcaacct

SEQ ID NO: 7286194 - DNA, 22 bp, Homo sapiens
ttcttcagtttggtaaatgtaa

SEQ ID NO: 7286195 - DNA, 22 bp, Homo sapiens
ctcagaaaacctctttcttgat

SEQ ID NO: 7286196 - DNA, 20 bp, Homo sapiens
ctcagaaaagctaaggagaa

SEQ ID NO: 7286197 - DNA, 23 bp, Homo sapiens
ttgcacattggagctggtcttct

SEQ ID NO: 7286198 - DNA, 18 bp, Homo sapiens
ctcaggcctttccctgtg

SEQ ID NO: 7286199 - DNA, 22 bp, Homo sapiens
ttgctgaggacgcagtgcagtg

SEQ ID NO: 7286200 - DNA, 22 bp, Homo sapiens
ttgcaaaaaccacaattacttt

SEQ ID NO: 7286201 - DNA, 22 bp, Homo sapiens
ttgcaaaaactgcaattacttt

SEQ ID NO: 7286202 - DNA, 22 bp, Homo sapiens
ttgcaaaagcaattgcagtttt

SEQ ID NO: 7286203 - DNA, 22 bp, Homo sapiens
ttgcaaaaccatcctaagtaaa

SEQ ID NO: 7286204 - DNA, 22 bp, Homo sapiens
ttgcaaaagccgaggcactcca

SEQ ID NO: 7286205 - DNA, 22 bp, Homo sapiens
ttgcaaaatcatttctcaggat

SEQ ID NO: 7286206 - DNA, 23 bp, Homo sapiens
ttgcaaaatgcaattgagttaga

SEQ ID NO: 7286207 - DNA, 23 bp, Homo sapiens
ttgcaaaatgagtcttgagtgaa

SEQ ID NO: 7286208 - DNA, 22 bp, Homo sapiens
ctcagccagacatgacccagtc

SEQ ID NO: 7286209 - DNA, 22 bp, Homo sapiens
ctcagccaggagagtgttcaca

SEQ ID NO: 7286210 - DNA, 22 bp, Homo sapiens
ctcaggcccacagcagacccac

SEQ ID NO: 7286211 - DNA, 22 bp, Homo sapiens
ctcaggccaggtttctcccaca

SEQ ID NO: 7286212 - DNA, 22 bp, Homo sapiens
ctcaggccattcttccagctgc

SEQ ID NO: 7286213 - DNA, 22 bp, Homo sapiens
ttcagtttgaattctgtagaac

SEQ ID NO: 7286214 - DNA, 22 bp, Homo sapiens
ttccactgaaggatctagggaa

SEQ ID NO: 7286215 - DNA, 22 bp, Homo sapiens
ttcctctcctcccaccaggtga

SEQ ID NO: 7286216 - DNA, 22 bp, Homo sapiens
ttcctctattctaacaaaagta

SEQ ID NO: 7286217 - DNA, 22 bp, Homo sapiens
ttcctctagcttctcactaaca

SEQ ID NO: 7286218 - DNA, 22 bp, Homo sapiens
ttctcctttgtaattctcatcc

SEQ ID NO: 7286219 - DNA, 22 bp, Homo sapiens
ctagtgtttattaacataattc

SEQ ID NO: 7286220 - DNA, 22 bp, Homo sapiens
ctagtgtacaagtggtggagat

SEQ ID NO: 7286221 - DNA, 22 bp, Homo sapiens
ctagttgtttaatattgattga

SEQ ID NO: 7286222 - DNA, 22 bp, Homo sapiens
ctgcccctggctggtgaagcag

SEQ ID NO: 7286223 - DNA, 18 bp, Homo sapiens
ctgccccttctctgagat

SEQ ID NO: 7286224 - DNA, 22 bp, Homo sapiens
ctgccctgagggcctgtgtgtt

SEQ ID NO: 7286225 - DNA, 23 bp, Homo sapiens
ctgccctgatcttgatctattgt

SEQ ID NO: 7286226 - DNA, 20 bp, Homo sapiens
ctgccctgccctgggtcctg

SEQ ID NO: 7286227 - DNA, 22 bp, Homo sapiens
ctgccctgcctggccagtgtgg

SEQ ID NO: 7286228 - DNA, 22 bp, Homo sapiens
ctgccctgcccaggccttgggc

SEQ ID NO: 7286229 - DNA, 22 bp, Homo sapiens
ctgccctgcttgatgacagcga

SEQ ID NO: 7286230 - DNA, 22 bp, Homo sapiens
ctgccctgctaatgagttccaa

SEQ ID NO: 7286231 - DNA, 22 bp, Homo sapiens
ctgccctgctctccgggatctt

SEQ ID NO: 7286232 - DNA, 22 bp, Homo sapiens
ctgcctctggttttggtccctg

SEQ ID NO: 7286233 - DNA, 22 bp, Homo sapiens
ctgcctctggcctcaggcccag

SEQ ID NO: 7286234 - DNA, 22 bp, Homo sapiens
ctgcctctgttgggcatggtct

SEQ ID NO: 7286235 - DNA, 22 bp, Homo sapiens
ctgcctctattcactgaggcag

SEQ ID NO: 7286236 - DNA, 22 bp, Homo sapiens
ctgccctgggagtacctgtcct

SEQ ID NO: 7286237 - DNA, 22 bp, Homo sapiens
ctgccctgcttgtttccagtgg

SEQ ID NO: 7286238 - DNA, 22 bp, Homo sapiens
ctgccctggcagcctaccatgg

SEQ ID NO: 7286239 - DNA, 22 bp, Homo sapiens
ctgctgagcatttgcagggaca

SEQ ID NO: 7286240 - DNA, 22 bp, Homo sapiens
ctgctgagcctggtgcgggatg

SEQ ID NO: 7286241 - DNA, 22 bp, Homo sapiens
ctgctgagccgcacccaggagc

SEQ ID NO: 7286242 - DNA, 22 bp, Homo sapiens
ctgctgagccctggcacaggtg

SEQ ID NO: 7286243 - DNA, 21 bp, Homo sapiens
ctgctgctggggtctgggcag

SEQ ID NO: 7286244 - DNA, 22 bp, Homo sapiens
ctgctggaagtttgctgtggat

SEQ ID NO: 7286245 - DNA, 22 bp, Homo sapiens
ctgcctcttaagtggatggagt

SEQ ID NO: 7286246 - DNA, 22 bp, Homo sapiens
ctgcctgcatcccacagtgggg

SEQ ID NO: 7286247 - DNA, 22 bp, Homo sapiens
ctgcctgcactgcctggctcca

SEQ ID NO: 7286248 - DNA, 22 bp, Homo sapiens
ctgcctgccacgttcagctgta

SEQ ID NO: 7286249 - DNA, 22 bp, Homo sapiens
ctgctccccagcctgcgccttt

SEQ ID NO: 7286250 - DNA, 19 bp, Homo sapiens
ctgctccctccttctggca

SEQ ID NO: 7286251 - DNA, 19 bp, Homo sapiens
ctgctccctccttctggca

SEQ ID NO: 7286252 - DNA, 22 bp, Homo sapiens
tttttcttaaatgtgggttggc

SEQ ID NO: 7286253 - DNA, 22 bp, Homo sapiens
tttttcttaaatgtgggttggc

SEQ ID NO: 7286254 - DNA, 19 bp, Homo sapiens
tttttacaagtaggtgtga

SEQ ID NO: 7286255 - DNA, 22 bp, Homo sapiens
ctgagagtagctggagaacatt

SEQ ID NO: 7286256 - DNA, 22 bp, Homo sapiens
ctgagagtattggcaggcttgg

SEQ ID NO: 7286257 - DNA, 22 bp, Homo sapiens
ctgagagtaattttctacttga

SEQ ID NO: 7286258 - DNA, 22 bp, Homo sapiens
ctgagaggtgctggtggctgca

SEQ ID NO: 7286259 - DNA, 22 bp, Homo sapiens
ctgagaggggaccagggtgttt

SEQ ID NO: 7286260 - DNA, 22 bp, Homo sapiens
ctgagagttcgttccaccctcc

SEQ ID NO: 7286261 - DNA, 22 bp, Homo sapiens
ctgagccttgatgtcccttgtc

SEQ ID NO: 7286262 - DNA, 22 bp, Homo sapiens
ctgagggagaagtgatctctac

SEQ ID NO: 7286263 - DNA, 22 bp, Homo sapiens
ctgagggagttcctgagcccac

SEQ ID NO: 7286264 - DNA, 22 bp, Homo sapiens
ctccctgcttgtttcccttcag

SEQ ID NO: 7286265 - DNA, 22 bp, Homo sapiens
ctcccaggggaactatcaagta

SEQ ID NO: 7286266 - DNA, 22 bp, Homo sapiens
ctcccagggccatcgagtcact

SEQ ID NO: 7286267 - DNA, 22 bp, Homo sapiens
ctccccacatttctccctgtct

SEQ ID NO: 7286268 - DNA, 22 bp, Homo sapiens
ttgtttaatccttgtacccatg

SEQ ID NO: 7286269 - DNA, 22 bp, Homo sapiens
ctcctgtgaggcttaagcccag

SEQ ID NO: 7286270 - DNA, 22 bp, Homo sapiens
ctcctggagtcctttcctattc

SEQ ID NO: 7286271 - DNA, 22 bp, Homo sapiens
ctcctggaccaccttgtggcca

SEQ ID NO: 7286272 - DNA, 22 bp, Homo sapiens
tttacacaaaagatagcacacc

SEQ ID NO: 7286273 - DNA, 22 bp, Homo sapiens
ctcctggaagcccgccctgctg

SEQ ID NO: 7286274 - DNA, 22 bp, Homo sapiens
ctctgctgggatgtaaagtctt

SEQ ID NO: 7286275 - DNA, 21 bp, Homo sapiens
ctctgctgtctaccagctgtt

SEQ ID NO: 7286276 - DNA, 22 bp, Homo sapiens
ctctgctgttttgtatacaggc

SEQ ID NO: 7286277 - DNA, 22 bp, Homo sapiens
ctctgctggccatgaagagaga

SEQ ID NO: 7286278 - DNA, 22 bp, Homo sapiens
ctctgctgcccatgatggtata

SEQ ID NO: 7286279 - DNA, 22 bp, Homo sapiens
tttcttgaagtcctaaccctca

SEQ ID NO: 7286280 - DNA, 22 bp, Homo sapiens
tttcttcttaatactggctgct

SEQ ID NO: 7286281 - DNA, 22 bp, Homo sapiens
tttgaagtgttatttctatcac

SEQ ID NO: 7286282 - DNA, 22 bp, Homo sapiens
tttgaagtcaggctttctaccc

SEQ ID NO: 7286283 - DNA, 22 bp, Homo sapiens
tttgaagggcacgacaatagtt

SEQ ID NO: 7286284 - DNA, 22 bp, Homo sapiens
ctctactgagagcagcagatat

SEQ ID NO: 7286285 - DNA, 19 bp, Homo sapiens
tttctctccctcatcccga

SEQ ID NO: 7286286 - DNA, 22 bp, Homo sapiens
tttctctctacagtactttcat

SEQ ID NO: 7286287 - DNA, 22 bp, Homo sapiens
ctctgaggtcctacagtgaccc

SEQ ID NO: 7286288 - DNA, 22 bp, Homo sapiens
ctctgaggtctaggaccatggc

SEQ ID NO: 7286289 - DNA, 22 bp, Homo sapiens
tttctgcagtctctcagaagcc

SEQ ID NO: 7286290 - DNA, 22 bp, Homo sapiens
gaaaatttagaactgaacttct

SEQ ID NO: 7286291 - DNA, 22 bp, Homo sapiens
gaaaatttaattctcttctgtg

SEQ ID NO: 7286292 - DNA, 22 bp, Homo sapiens
gaaacaactactattgatttct

SEQ ID NO: 7286293 - DNA, 22 bp, Homo sapiens
gaaagagaggggctgagatgca

SEQ ID NO: 7286294 - DNA, 21 bp, Homo sapiens
cttttacattcagtcatgatg

SEQ ID NO: 7286295 - DNA, 22 bp, Homo sapiens
cttttacagtggacctgccatt

SEQ ID NO: 7286296 - DNA, 22 bp, Homo sapiens
cttttacatttgttgaagagta

SEQ ID NO: 7286297 - DNA, 21 bp, Homo sapiens
ctttgcaagatgtctatgaaa

SEQ ID NO: 7286298 - DNA, 22 bp, Homo sapiens
ctttgcaaacgattaccacatg

SEQ ID NO: 7286299 - DNA, 22 bp, Homo sapiens
ctttgcaaactgtcacactttc

SEQ ID NO: 7286300 - DNA, 22 bp, Homo sapiens
ctttacaaactataaagtgcgg

SEQ ID NO: 7286301 - DNA, 22 bp, Homo sapiens
ctttgaaaacttaaataacagc

SEQ ID NO: 7286302 - DNA, 22 bp, Homo sapiens
ctttgaaaacacacgaatagac

SEQ ID NO: 7286303 - DNA, 22 bp, Homo sapiens
ctttgaaacctgctctgcagaa

SEQ ID NO: 7286304 - DNA, 22 bp, Homo sapiens
cttacattgtgtgcatgagggg

SEQ ID NO: 7286305 - DNA, 22 bp, Homo sapiens
cttagaaattgttactcattca

SEQ ID NO: 7286306 - DNA, 22 bp, Homo sapiens
cttaggaacgctctgcctagtg

SEQ ID NO: 7286307 - DNA, 22 bp, Homo sapiens
cttataaagtccatctgaacaa

SEQ ID NO: 7286308 - DNA, 22 bp, Homo sapiens
cttatacacgaacacaaggtgt

SEQ ID NO: 7286309 - DNA, 22 bp, Homo sapiens
ctgggaagaagtgggctacatt

SEQ ID NO: 7286310 - DNA, 21 bp, Homo sapiens
ctgcttcctctcttcatggca

SEQ ID NO: 7286311 - DNA, 22 bp, Homo sapiens
ctgctgtgttcctcctgcatct

SEQ ID NO: 7286312 - DNA, 22 bp, Homo sapiens
ctgggagatctgttgggactgg

SEQ ID NO: 7286313 - DNA, 22 bp, Homo sapiens
ctgggagaggtggtgggaagta

SEQ ID NO: 7286314 - DNA, 22 bp, Homo sapiens
ctgggagatatgaggatctgga

SEQ ID NO: 7286315 - DNA, 22 bp, Homo sapiens
ctgggcagctaccaccactgct

SEQ ID NO: 7286316 - DNA, 22 bp, Homo sapiens
ctgggcagagctaacacctgag

SEQ ID NO: 7286317 - DNA, 22 bp, Homo sapiens
ctgggcactgcagggtgttgag

SEQ ID NO: 7286318 - DNA, 17 bp, Homo sapiens
ctgggatgtggactctt

SEQ ID NO: 7286319 - DNA, 22 bp, Homo sapiens
ctgggccttgcatcccagagcc

SEQ ID NO: 7286320 - DNA, 22 bp, Homo sapiens
ctgggccttgagaatcatgttt

SEQ ID NO: 7286321 - DNA, 22 bp, Homo sapiens
ctgggccttcattgctctccca

SEQ ID NO: 7286322 - DNA, 22 bp, Homo sapiens
ctgggccttatgagtacctgga

SEQ ID NO: 7286323 - DNA, 17 bp, Homo sapiens
ctgggcctcccctgtcc

SEQ ID NO: 7286324 - DNA, 22 bp, Homo sapiens
ctgggcctgtcagggctttttg

SEQ ID NO: 7286325 - DNA, 22 bp, Homo sapiens
ctgggcctgtccctgattgagg

SEQ ID NO: 7286326 - DNA, 22 bp, Homo sapiens
ctgggcgtgtcttccagctggc

SEQ ID NO: 7286327 - DNA, 22 bp, Homo sapiens
ctgggcctttgggagttcggtg

SEQ ID NO: 7286328 - DNA, 18 bp, Homo sapiens
ctgggcctttgtattttt

SEQ ID NO: 7286329 - DNA, 22 bp, Homo sapiens
ctgggccttggattgacactgt

SEQ ID NO: 7286330 - DNA, 22 bp, Homo sapiens
ctgggcctttacctacggagtt

SEQ ID NO: 7286331 - DNA, 22 bp, Homo sapiens
ctgggctggataattctttgct

SEQ ID NO: 7286332 - DNA, 22 bp, Homo sapiens
ctggtgagactcagggatgctt

SEQ ID NO: 7286333 - DNA, 20 bp, Homo sapiens
ctggggagcctcgcggtggc

SEQ ID NO: 7286334 - DNA, 22 bp, Homo sapiens
ctgtgccctttcgctgcactgt

SEQ ID NO: 7286335 - DNA, 22 bp, Homo sapiens
ctgtgccctgtggctggcacct

SEQ ID NO: 7286336 - DNA, 22 bp, Homo sapiens
gactctgctgactagttgacta

SEQ ID NO: 7286337 - DNA, 19 bp, Homo sapiens
gacattcctgacactggct

SEQ ID NO: 7286338 - DNA, 22 bp, Homo sapiens
gacagcagatgaagcctgcaga

SEQ ID NO: 7286339 - DNA, 22 bp, Homo sapiens
gagactgaggtcaccaggctgt

SEQ ID NO: 7286340 - DNA, 22 bp, Homo sapiens
gagactgatggggctcccagaa

SEQ ID NO: 7286341 - DNA, 22 bp, Homo sapiens
gaaggcagtaaatggctgtttt

SEQ ID NO: 7286342 - DNA, 22 bp, Homo sapiens
gaaggcaggtttttcaaaactg

SEQ ID NO: 7286343 - DNA, 22 bp, Homo sapiens
gaaggcagggaatgtggtgcta

SEQ ID NO: 7286344 - DNA, 22 bp, Homo sapiens
gaaggcaggcttctgattaggt

SEQ ID NO: 7286345 - DNA, 22 bp, Homo sapiens
gaagccacgttaaattggctgt

SEQ ID NO: 7286346 - DNA, 22 bp, Homo sapiens
gaaaggaaatattctaagcact

SEQ ID NO: 7286347 - DNA, 22 bp, Homo sapiens
gaaaggaacttgtgagtgggag

SEQ ID NO: 7286348 - DNA, 22 bp, Homo sapiens
gaaaggaagaaaggtcatttta

SEQ ID NO: 7286349 - DNA, 22 bp, Homo sapiens
gagcaggcttgcagagaagggg

SEQ ID NO: 7286350 - DNA, 22 bp, Homo sapiens
gagcagtggtctgatcttctaa

SEQ ID NO: 7286351 - DNA, 22 bp, Homo sapiens
gagcccaggaagtggaggctga

SEQ ID NO: 7286352 - DNA, 22 bp, Homo sapiens
gaggaaccaaatcagcttgcac

SEQ ID NO: 7286353 - DNA, 22 bp, Homo sapiens
gaggaacccagctggggttgcc

SEQ ID NO: 7286354 - DNA, 22 bp, Homo sapiens
gaggaacctatgatttagagca

SEQ ID NO: 7286355 - DNA, 22 bp, Homo sapiens
gaggaacctgggcttccatcct

SEQ ID NO: 7286356 - DNA, 22 bp, Homo sapiens
gaggaacctcctgaaaagtata

SEQ ID NO: 7286357 - DNA, 22 bp, Homo sapiens
gaggaaccaccttgggtaggct

SEQ ID NO: 7286358 - DNA, 22 bp, Homo sapiens
gaggaaccaatctgtgatattc

SEQ ID NO: 7286359 - DNA, 22 bp, Homo sapiens
gaggaaccactctgagaagcca

SEQ ID NO: 7286360 - DNA, 20 bp, Homo sapiens
gaggaaccactgggaggaga

SEQ ID NO: 7286361 - DNA, 22 bp, Homo sapiens
gaggaacccaagctcaccgtca

SEQ ID NO: 7286362 - DNA, 22 bp, Homo sapiens
gagggcttccatggggagcccc

SEQ ID NO: 7286363 - DNA, 22 bp, Homo sapiens
gagggagggactagcattctct

SEQ ID NO: 7286364 - DNA, 22 bp, Homo sapiens
gaggctgcccaactggagtgga

SEQ ID NO: 7286365 - DNA, 22 bp, Homo sapiens
gaggcagtgtttactgccctgt

SEQ ID NO: 7286366 - DNA, 22 bp, Homo sapiens
gaggagccaaggtatgtgtgtt

SEQ ID NO: 7286367 - DNA, 22 bp, Homo sapiens
gaggagcacatgaggctgaggg

SEQ ID NO: 7286368 - DNA, 22 bp, Homo sapiens
gaggagaggctggacgcggtga

SEQ ID NO: 7286369 - DNA, 22 bp, Homo sapiens
gaggagaggggctcccaagagc

SEQ ID NO: 7286370 - DNA, 22 bp, Homo sapiens
gaggagagatggtagattgggt

SEQ ID NO: 7286371 - DNA, 22 bp, Homo sapiens
gaggcaggcagattgcttgagg

SEQ ID NO: 7286372 - DNA, 22 bp, Homo sapiens
gaggcaggccctgaatgagtca

SEQ ID NO: 7286373 - DNA, 22 bp, Homo sapiens
gaggagcccagcaccatcactt

SEQ ID NO: 7286374 - DNA, 22 bp, Homo sapiens
gaggcagcttggggctgtgggt

SEQ ID NO: 7286375 - DNA, 22 bp, Homo sapiens
gaggcaggaggattgcttgagc

SEQ ID NO: 7286376 - DNA, 22 bp, Homo sapiens
gccagtgggacccgctgtgggc

SEQ ID NO: 7286377 - DNA, 22 bp, Homo sapiens
gccaggtgtagtggccacacct

SEQ ID NO: 7286378 - DNA, 22 bp, Homo sapiens
gccaggagaatgctagcagagg

SEQ ID NO: 7286379 - DNA, 22 bp, Homo sapiens
gccaggagaaaaggcgaatgat

SEQ ID NO: 7286380 - DNA, 22 bp, Homo sapiens
gcccatggaaaacctgtcctct

SEQ ID NO: 7286381 - DNA, 23 bp, Homo sapiens
gcccatgctgttgggcccgagca

SEQ ID NO: 7286382 - DNA, 22 bp, Homo sapiens
gcccatggacacccaagtgcca

SEQ ID NO: 7286383 - DNA, 23 bp, Homo sapiens
gcccatggagtctggatctggcc

SEQ ID NO: 7286384 - DNA, 22 bp, Homo sapiens
gcccatgcactttctgtgatgg

SEQ ID NO: 7286385 - DNA, 22 bp, Homo sapiens
gcccatggcagaactgtgagca

SEQ ID NO: 7286386 - DNA, 22 bp, Homo sapiens
gccctctggggcacacagagga

SEQ ID NO: 7286387 - DNA, 22 bp, Homo sapiens
gcatgaggttcttggccagcat

SEQ ID NO: 7286388 - DNA, 22 bp, Homo sapiens
gcatgatgaaggaggaggagtc

SEQ ID NO: 7286389 - DNA, 22 bp, Homo sapiens
gcatccaaatgtttcatttctt

SEQ ID NO: 7286390 - DNA, 22 bp, Homo sapiens
gcagggctccccaggcccgagg

SEQ ID NO: 7286391 - DNA, 22 bp, Homo sapiens
gcagggctccactgtggccaag

SEQ ID NO: 7286392 - DNA, 22 bp, Homo sapiens
gccagaggcccaaggacagctg

SEQ ID NO: 7286393 - DNA, 22 bp, Homo sapiens
gccagcaggttgtcaaggagct

SEQ ID NO: 7286394 - DNA, 22 bp, Homo sapiens
gccagcagtatgtcctggcagt

SEQ ID NO: 7286395 - DNA, 22 bp, Homo sapiens
gcagctgcagagaccgggtggg

SEQ ID NO: 7286396 - DNA, 22 bp, Homo sapiens
gcagaggaggacccaggaatta

SEQ ID NO: 7286397 - DNA, 22 bp, Homo sapiens
gcagcaggaatttaaatttata

SEQ ID NO: 7286398 - DNA, 22 bp, Homo sapiens
gcagcaggaataggataagcaa

SEQ ID NO: 7286399 - DNA, 22 bp, Homo sapiens
gcagcaggactgccgttaaagt

SEQ ID NO: 7286400 - DNA, 22 bp, Homo sapiens
gcagcaggagagtaatagcggt

SEQ ID NO: 7286401 - DNA, 22 bp, Homo sapiens
gcagcaggagagtttgtcctgc

SEQ ID NO: 7286402 - DNA, 22 bp, Homo sapiens
gcagcaggcacggtctcgacat

SEQ ID NO: 7286403 - DNA, 22 bp, Homo sapiens
gcagcaggatggccaattgcca

SEQ ID NO: 7286404 - DNA, 22 bp, Homo sapiens
gcagcaggtgtgcttttaatga

SEQ ID NO: 7286405 - DNA, 22 bp, Homo sapiens
gcagcaggcacttaccgttgct

SEQ ID NO: 7286406 - DNA, 22 bp, Homo sapiens
gcagcaggtctgtcaatgtcat

SEQ ID NO: 7286407 - DNA, 22 bp, Homo sapiens
gcagctgcctattcagggcttg

SEQ ID NO: 7286408 - DNA, 22 bp, Homo sapiens
gcagctggatttcaagagggag

SEQ ID NO: 7286409 - DNA, 22 bp, Homo sapiens
gcaggaggttgagccaggactg

SEQ ID NO: 7286410 - DNA, 22 bp, Homo sapiens
gcaggcctctgttgagggcctt

SEQ ID NO: 7286411 - DNA, 22 bp, Homo sapiens
gcaggctcgttggaagtcccct

SEQ ID NO: 7286412 - DNA, 20 bp, Homo sapiens
gcaggctccgggcttgggag

SEQ ID NO: 7286413 - DNA, 22 bp, Homo sapiens
gcaggctccaaggcctgggaga

SEQ ID NO: 7286414 - DNA, 22 bp, Homo sapiens
gcaggctgatgactggagttgg

SEQ ID NO: 7286415 - DNA, 22 bp, Homo sapiens
gcagggcgcgtttgagcgggct

SEQ ID NO: 7286416 - DNA, 22 bp, Homo sapiens
gcagggcggcccagagcaggcc

SEQ ID NO: 7286417 - DNA, 22 bp, Homo sapiens
gcagggctagatatttgcaagt

SEQ ID NO: 7286418 - DNA, 22 bp, Homo sapiens
gcagggctaggtcttctagggc

SEQ ID NO: 7286419 - DNA, 22 bp, Homo sapiens
gcactgggaagaatgagcctgt

SEQ ID NO: 7286420 - DNA, 22 bp, Homo sapiens
gcagaggagcaagctggacacc

SEQ ID NO: 7286421 - DNA, 22 bp, Homo sapiens
gcagaggacagggatttagatt

SEQ ID NO: 7286422 - DNA, 22 bp, Homo sapiens
gcagaggagatgaagatacttt

SEQ ID NO: 7286423 - DNA, 22 bp, Homo sapiens
gcagaggacacaggagggcaag

SEQ ID NO: 7286424 - DNA, 22 bp, Homo sapiens
gcactgggaatgctgatgggct

SEQ ID NO: 7286425 - DNA, 22 bp, Homo sapiens
gcacaggaggccgatgctcatg

SEQ ID NO: 7286426 - DNA, 22 bp, Homo sapiens
gcacaggaatcttcatttttta

SEQ ID NO: 7286427 - DNA, 19 bp, Homo sapiens
gcacaggacatctgatgga

SEQ ID NO: 7286428 - DNA, 20 bp, Homo sapiens
gcacagctgagttcagggtc

SEQ ID NO: 7286429 - DNA, 22 bp, Homo sapiens
gagggggcgaacagaagcaagg

SEQ ID NO: 7286430 - DNA, 22 bp, Homo sapiens
ggacagagggcaggagcccaga

SEQ ID NO: 7286431 - DNA, 22 bp, Homo sapiens
ggacagagccctggtggcctaa

SEQ ID NO: 7286432 - DNA, 22 bp, Homo sapiens
ggaagcccagctgtctcctgtc

SEQ ID NO: 7286433 - DNA, 22 bp, Homo sapiens
ggaagccccagacccagagtct

SEQ ID NO: 7286434 - DNA, 22 bp, Homo sapiens
ggaagctgttgtgagtgcagca

SEQ ID NO: 7286435 - DNA, 18 bp, Homo sapiens
gcttcctgaaagctgccc

SEQ ID NO: 7286436 - DNA, 22 bp, Homo sapiens
gctgggaatgattttggagagg

SEQ ID NO: 7286437 - DNA, 22 bp, Homo sapiens
gctgggaagtgcaagatcaagg

SEQ ID NO: 7286438 - DNA, 22 bp, Homo sapiens
gctgggaaccatgggaaggcag

SEQ ID NO: 7286439 - DNA, 22 bp, Homo sapiens
gctgggaagaacaggagagaat

SEQ ID NO: 7286440 - DNA, 22 bp, Homo sapiens
gctggcagctggaagttgggct

SEQ ID NO: 7286441 - DNA, 22 bp, Homo sapiens
gctggcagagacaagaagacta

SEQ ID NO: 7286442 - DNA, 22 bp, Homo sapiens
gctggcaggataacttctaagc

SEQ ID NO: 7286443 - DNA, 22 bp, Homo sapiens
gctggcaggatagaagtctaat

SEQ ID NO: 7286444 - DNA, 22 bp, Homo sapiens
gctggcagacttcctctggaac

SEQ ID NO: 7286445 - DNA, 22 bp, Homo sapiens
gctggcagaatttcttcttgct

SEQ ID NO: 7286446 - DNA, 22 bp, Homo sapiens
gctgtgcccagctccagctctg

SEQ ID NO: 7286447 - DNA, 22 bp, Homo sapiens
gctgtgcccatattctgctgac

SEQ ID NO: 7286448 - DNA, 18 bp, Homo sapiens
gctggggttgagctctcc

SEQ ID NO: 7286449 - DNA, 22 bp, Homo sapiens
gctgcaggagctggagctgtgg

SEQ ID NO: 7286450 - DNA, 22 bp, Homo sapiens
gctcaggctggattgcagtggc

SEQ ID NO: 7286451 - DNA, 21 bp, Homo sapiens
gctcctggtgctgcgtggcgc

SEQ ID NO: 7286452 - DNA, 17 bp, Homo sapiens
gctctgcctctcccacc

SEQ ID NO: 7286453 - DNA, 22 bp, Homo sapiens
gctctgcctctttgctgcgtca

SEQ ID NO: 7286454 - DNA, 17 bp, Homo sapiens
gctctgcctctcccacc

SEQ ID NO: 7286455 - DNA, 17 bp, Homo sapiens
gctctgccccagcctct

SEQ ID NO: 7286456 - DNA, 18 bp, Homo sapiens
gctctgcccaggctgccc

SEQ ID NO: 7286457 - DNA, 22 bp, Homo sapiens
gctctgcccagtgccctgagac

SEQ ID NO: 7286458 - DNA, 22 bp, Homo sapiens
gccttctctgtgagctcctagg

SEQ ID NO: 7286459 - DNA, 22 bp, Homo sapiens
gctcaagccttctgcccacctc

SEQ ID NO: 7286460 - DNA, 18 bp, Homo sapiens
gctcaggccctagtcagt

SEQ ID NO: 7286461 - DNA, 21 bp, Homo sapiens
gcctggctagaagctcctagc

SEQ ID NO: 7286462 - DNA, 22 bp, Homo sapiens
gcctggctgccggccttggcaa

SEQ ID NO: 7286463 - DNA, 22 bp, Homo sapiens
gcctggctggtcactgcctggc

SEQ ID NO: 7286464 - DNA, 22 bp, Homo sapiens
gcctggcttgccagccctggcg

SEQ ID NO: 7286465 - DNA, 22 bp, Homo sapiens
gccttcagagtaccatgtcctc

SEQ ID NO: 7286466 - DNA, 18 bp, Homo sapiens
gccttcagactgcatgct

SEQ ID NO: 7286467 - DNA, 22 bp, Homo sapiens
gccttcagtagtgtcagctgta

SEQ ID NO: 7286468 - DNA, 22 bp, Homo sapiens
ggctccagggagtggagagaag

SEQ ID NO: 7286469 - DNA, 22 bp, Homo sapiens
ggcggtggttgagaggacggcg

SEQ ID NO: 7286470 - DNA, 22 bp, Homo sapiens
ggctaggcctcaggcctgcctg

SEQ ID NO: 7286471 - DNA, 22 bp, Homo sapiens
ggctacagggcctggccaaggt

SEQ ID NO: 7286472 - DNA, 22 bp, Homo sapiens
ggctgagccactgcgcctggct

SEQ ID NO: 7286473 - DNA, 22 bp, Homo sapiens
ggctctgtcacctatgagctga

SEQ ID NO: 7286474 - DNA, 22 bp, Homo sapiens
ggctctgtttactttcagaggc

SEQ ID NO: 7286475 - DNA, 22 bp, Homo sapiens
ggctctgggtctgtggggagcg

SEQ ID NO: 7286476 - DNA, 22 bp, Homo sapiens
ggctcctgatgctcagatttca

SEQ ID NO: 7286477 - DNA, 22 bp, Homo sapiens
ggctgctgtttcagagactgtt

SEQ ID NO: 7286478 - DNA, 22 bp, Homo sapiens
ggctggacatagacatagccat

SEQ ID NO: 7286479 - DNA, 22 bp, Homo sapiens
ggctggaccatgctgccccttc

SEQ ID NO: 7286480 - DNA, 22 bp, Homo sapiens
ggctgggtcccagctgggagga

SEQ ID NO: 7286481 - DNA, 21 bp, Homo sapiens
ggctgggtcatgcagctggcc

SEQ ID NO: 7286482 - DNA, 22 bp, Homo sapiens
ggctgtgagtttgtcctccatg

SEQ ID NO: 7286483 - DNA, 22 bp, Homo sapiens
ggctgtgcagggcagagtctca

SEQ ID NO: 7286484 - DNA, 22 bp, Homo sapiens
gggaagtgagctggaatcaagg

SEQ ID NO: 7286485 - DNA, 22 bp, Homo sapiens
gggaagtgaagtgtagctgtct

SEQ ID NO: 7286486 - DNA, 22 bp, Homo sapiens
gggaagtgaggagcccctctgc

SEQ ID NO: 7286487 - DNA, 23 bp, Homo sapiens
gggaagtgaggagcccctcagcc

SEQ ID NO: 7286488 - DNA, 23 bp, Homo sapiens
gggaagtgaggagcccctctgcc

SEQ ID NO: 7286489 - DNA, 17 bp, Homo sapiens
gggaagtggagaaagct

SEQ ID NO: 7286490 - DNA, 23 bp, Homo sapiens
gggaagtggggatttgaagtcat

SEQ ID NO: 7286491 - DNA, 22 bp, Homo sapiens
gggaaggctgcctgagggatgg

SEQ ID NO: 7286492 - DNA, 22 bp, Homo sapiens
gggaagggacttgtttaaggtc

SEQ ID NO: 7286493 - DNA, 22 bp, Homo sapiens
ggctgtgcctcaaggctactca

SEQ ID NO: 7286494 - DNA, 22 bp, Homo sapiens
gggaggtgttctgccaacgcgg

SEQ ID NO: 7286495 - DNA, 22 bp, Homo sapiens
gggaggtgttccagtgttggta

SEQ ID NO: 7286496 - DNA, 22 bp, Homo sapiens
gggaggtgatggcaagcagcgg

SEQ ID NO: 7286497 - DNA, 22 bp, Homo sapiens
gggaggtgattaggaccatgta

SEQ ID NO: 7286498 - DNA, 22 bp, Homo sapiens
gggcagtgacaaaggggatgaa

SEQ ID NO: 7286499 - DNA, 22 bp, Homo sapiens
gggcagtgaatattggtgggaa

SEQ ID NO: 7286500 - DNA, 19 bp, Homo sapiens
gggcagtggcactagggag

SEQ ID NO: 7286501 - DNA, 22 bp, Homo sapiens
gggcaggttattggagtaggga

SEQ ID NO: 7286502 - DNA, 22 bp, Homo sapiens
gggcacagtctaaagttgggcc

SEQ ID NO: 7286503 - DNA, 22 bp, Homo sapiens
gggcactgaacaccctcttcgc

SEQ ID NO: 7286504 - DNA, 22 bp, Homo sapiens
gggcactggaaggctctcaggc

SEQ ID NO: 7286505 - DNA, 22 bp, Homo sapiens
gggcactgctttgctctgtcac

SEQ ID NO: 7286506 - DNA, 22 bp, Homo sapiens
ggcctgctttccgagcctgcag

SEQ ID NO: 7286507 - DNA, 22 bp, Homo sapiens
ggcctgctggctccagcgcccg

SEQ ID NO: 7286508 - DNA, 22 bp, Homo sapiens
ggcctgctctgtttagaggggg

SEQ ID NO: 7286509 - DNA, 22 bp, Homo sapiens
ggcctgctctgcagcctctaca

SEQ ID NO: 7286510 - DNA, 22 bp, Homo sapiens
ggcctgctctggctgtggtcag

SEQ ID NO: 7286511 - DNA, 22 bp, Homo sapiens
ggcctgctattggtgggcagac

SEQ ID NO: 7286512 - DNA, 22 bp, Homo sapiens
ggcctggctggttcagtaccct

SEQ ID NO: 7286513 - DNA, 22 bp, Homo sapiens
ggcggtggcgtgaaggtggctg

SEQ ID NO: 7286514 - DNA, 23 bp, Homo sapiens
ggcctggcccagggccctgatga

SEQ ID NO: 7286515 - DNA, 22 bp, Homo sapiens
ggccctgctcaggctgcgatga

SEQ ID NO: 7286516 - DNA, 22 bp, Homo sapiens
ggccctgctgaagccgggtcta

SEQ ID NO: 7286517 - DNA, 22 bp, Homo sapiens
ggccctgctgagtggagtggag

SEQ ID NO: 7286518 - DNA, 22 bp, Homo sapiens
ggcatgagtaacgtgagtgagg

SEQ ID NO: 7286519 - DNA, 20 bp, Homo sapiens
ggcatgagatgtgagggagg

SEQ ID NO: 7286520 - DNA, 21 bp, Homo sapiens
ggcatgagggcagtgagcaga

SEQ ID NO: 7286521 - DNA, 22 bp, Homo sapiens
ggcaggggtgaggccactctga

SEQ ID NO: 7286522 - DNA, 22 bp, Homo sapiens
ggcaggggtggccttcctttgg

SEQ ID NO: 7286523 - DNA, 22 bp, Homo sapiens
ggcaggggttcattttgtctta

SEQ ID NO: 7286524 - DNA, 22 bp, Homo sapiens
ggcagggtctggactgaaagct

SEQ ID NO: 7286525 - DNA, 22 bp, Homo sapiens
ggcaggagctctccagtttgcc

SEQ ID NO: 7286526 - DNA, 22 bp, Homo sapiens
ggcaggaggaagagttagcacc

SEQ ID NO: 7286527 - DNA, 18 bp, Homo sapiens
ggcaggagcaagaatagg

SEQ ID NO: 7286528 - DNA, 22 bp, Homo sapiens
ggcagggtgtggagttgggaca

SEQ ID NO: 7286529 - DNA, 22 bp, Homo sapiens
ggcagggtgtggagttgggaca

SEQ ID NO: 7286530 - DNA, 17 bp, Homo sapiens
ggcagggtgctgggtat

SEQ ID NO: 7286531 - DNA, 22 bp, Homo sapiens
ggcaggtgacggggatgagtat

SEQ ID NO: 7286532 - DNA, 20 bp, Homo sapiens
ggcagcaggagtttcctctt

SEQ ID NO: 7286533 - DNA, 22 bp, Homo sapiens
ggcagaagaaaggctaagtctc

SEQ ID NO: 7286534 - DNA, 22 bp, Homo sapiens
ggcagaagataggacagggaat

SEQ ID NO: 7286535 - DNA, 18 bp, Homo sapiens
ggcactggtgatgcagag

SEQ ID NO: 7286536 - DNA, 22 bp, Homo sapiens
ggcagctgttggctctctagga

SEQ ID NO: 7286537 - DNA, 22 bp, Homo sapiens
ggcagcagggctgtctccctac

SEQ ID NO: 7286538 - DNA, 22 bp, Homo sapiens
ggatgcaggagttgaagaagga

SEQ ID NO: 7286539 - DNA, 22 bp, Homo sapiens
ggatgcccactatctgctggct

SEQ ID NO: 7286540 - DNA, 22 bp, Homo sapiens
ggatggaggttctcagatgctc

SEQ ID NO: 7286541 - DNA, 22 bp, Homo sapiens
ggagaggcttggcccagcctgg

SEQ ID NO: 7286542 - DNA, 22 bp, Homo sapiens
ggatctttaagttcttttccat

SEQ ID NO: 7286543 - DNA, 22 bp, Homo sapiens
ggtaggagtattttgcagcagt

SEQ ID NO: 7286544 - DNA, 22 bp, Homo sapiens
ggtcagggggatctgtgaggta

SEQ ID NO: 7286545 - DNA, 22 bp, Homo sapiens
ggtgaaggtcagagcaggaaaa

SEQ ID NO: 7286546 - DNA, 20 bp, Homo sapiens
ggtgcaggtaacgctgtgct

SEQ ID NO: 7286547 - DNA, 22 bp, Homo sapiens
ggtgcatgtgagaaagactggg

SEQ ID NO: 7286548 - DNA, 22 bp, Homo sapiens
ggtgcggagactccatgaggcc

SEQ ID NO: 7286549 - DNA, 22 bp, Homo sapiens
ggtgcccttcagacagtgggca

SEQ ID NO: 7286550 - DNA, 22 bp, Homo sapiens
ggtgccctgtaaaagccatgca

SEQ ID NO: 7286551 - DNA, 22 bp, Homo sapiens
ggtgccctgccaggatgtgcca

SEQ ID NO: 7286552 - DNA, 22 bp, Homo sapiens
ggtgccctggaagctgctgcat

SEQ ID NO: 7286553 - DNA, 21 bp, Homo sapiens
ggtgggcacaggagagcagag

SEQ ID NO: 7286554 - DNA, 22 bp, Homo sapiens
ggtgggcaacatttggcctgag

SEQ ID NO: 7286555 - DNA, 22 bp, Homo sapiens
ggtgggagtggaacgtggaaga

SEQ ID NO: 7286556 - DNA, 22 bp, Homo sapiens
gggctcctggcagtcatgctca

SEQ ID NO: 7286557 - DNA, 22 bp, Homo sapiens
gggctcctgcctcctggcacct

SEQ ID NO: 7286558 - DNA, 20 bp, Homo sapiens
gggctggcgcatggggaaag

SEQ ID NO: 7286559 - DNA, 22 bp, Homo sapiens
gggctggcgggaaaggcaattc

SEQ ID NO: 7286560 - DNA, 22 bp, Homo sapiens
gggctggctaagacttttctgt

SEQ ID NO: 7286561 - DNA, 20 bp, Homo sapiens
gggctggctcaactggatcc

SEQ ID NO: 7286562 - DNA, 22 bp, Homo sapiens
gggctggctcccaggtgttgaa

SEQ ID NO: 7286563 - DNA, 23 bp, Homo sapiens
gggctccagtctctgctcagttg

SEQ ID NO: 7286564 - DNA, 22 bp, Homo sapiens
gggctcctcctctgactgtggc

SEQ ID NO: 7286565 - DNA, 22 bp, Homo sapiens
gggcatgagaggcaggcaagtg

SEQ ID NO: 7286566 - DNA, 22 bp, Homo sapiens
gggcctcagctctgctctgcaa

SEQ ID NO: 7286567 - DNA, 22 bp, Homo sapiens
gggcctctcccttctcacgcat

SEQ ID NO: 7286568 - DNA, 22 bp, Homo sapiens
gggcctctccggcctttgcatc

SEQ ID NO: 7286569 - DNA, 22 bp, Homo sapiens
gggcctccgtgtgctggtgctc

SEQ ID NO: 7286570 - DNA, 22 bp, Homo sapiens
gggcctccggggtgagctgtgg

SEQ ID NO: 7286571 - DNA, 22 bp, Homo sapiens
gggcctggcatgcagccccgtt

SEQ ID NO: 7286572 - DNA, 22 bp, Homo sapiens
gggcctgctggtgcttccattg

SEQ ID NO: 7286573 - DNA, 21 bp, Homo sapiens
gggcctggctgcgcaggacgg

SEQ ID NO: 7286574 - DNA, 22 bp, Homo sapiens
ggggcacttccaggctgaggct

SEQ ID NO: 7286575 - DNA, 22 bp, Homo sapiens
ggggatggaggcgtgtggtcct

SEQ ID NO: 7286576 - DNA, 22 bp, Homo sapiens
ggggatggaatgtagtagtgat

SEQ ID NO: 7286577 - DNA, 22 bp, Homo sapiens
gggctggctctgtctagaaagg

SEQ ID NO: 7286578 - DNA, 22 bp, Homo sapiens
gggctggctgattttcctctct

SEQ ID NO: 7286579 - DNA, 22 bp, Homo sapiens
gggctgggattgcttgctgtga

SEQ ID NO: 7286580 - DNA, 22 bp, Homo sapiens
gggctgggcatggtgttccctc

SEQ ID NO: 7286581 - DNA, 22 bp, Homo sapiens
gggggccttattcatctgccag

SEQ ID NO: 7286582 - DNA, 22 bp, Homo sapiens
ggtgggcaggcgaggcccaggt

SEQ ID NO: 7286583 - DNA, 22 bp, Homo sapiens
gtcagttattttgagcaattgg

SEQ ID NO: 7286584 - DNA, 22 bp, Homo sapiens
gtcagttattcaattggtttaa

SEQ ID NO: 7286585 - DNA, 22 bp, Homo sapiens
gtcagttacagccacggcgggt

SEQ ID NO: 7286586 - DNA, 19 bp, Homo sapiens
gtcacatttgtctcccagg

SEQ ID NO: 7286587 - DNA, 22 bp, Homo sapiens
gtccctggagctgagcagtgct

SEQ ID NO: 7286588 - DNA, 22 bp, Homo sapiens
gtccctggatctgggacagctg

SEQ ID NO: 7286589 - DNA, 22 bp, Homo sapiens
gtgaggcagggaaagaggataa

SEQ ID NO: 7286590 - DNA, 22 bp, Homo sapiens
gtgaggtgggctggccagagac

SEQ ID NO: 7286591 - DNA, 22 bp, Homo sapiens
gtgaggtgggctgggctctatg

SEQ ID NO: 7286592 - DNA, 22 bp, Homo sapiens
gtgaggctactcagctgtccga

SEQ ID NO: 7286593 - DNA, 22 bp, Homo sapiens
gtgccctgagtgggtaggagag

SEQ ID NO: 7286594 - DNA, 22 bp, Homo sapiens
gtgccctgaggtcttcactttg

SEQ ID NO: 7286595 - DNA, 22 bp, Homo sapiens
gtgccctgagcttatgcattct

SEQ ID NO: 7286596 - DNA, 22 bp, Homo sapiens
gtgccctggaggggttgaaggg

SEQ ID NO: 7286597 - DNA, 22 bp, Homo sapiens
gtgccctggatgactttggtct

SEQ ID NO: 7286598 - DNA, 22 bp, Homo sapiens
gtgccctgcatgccccgggtat

SEQ ID NO: 7286599 - DNA, 22 bp, Homo sapiens
gtgcaaaaataattgtggtttt

SEQ ID NO: 7286600 - DNA, 22 bp, Homo sapiens
gtgcaaaagcagttggattttt

SEQ ID NO: 7286601 - DNA, 22 bp, Homo sapiens
gtgcaaaaatctatcaccagca

SEQ ID NO: 7286602 - DNA, 22 bp, Homo sapiens
gtgcaaaagcaattgcagtttt

SEQ ID NO: 7286603 - DNA, 22 bp, Homo sapiens
gtgcaaaagtaatggcagtttt

SEQ ID NO: 7286604 - DNA, 22 bp, Homo sapiens
gtgcaaaagtaactgtggtttt

SEQ ID NO: 7286605 - DNA, 22 bp, Homo sapiens
gtgcaaaagtaaatgtggtttt

SEQ ID NO: 7286606 - DNA, 22 bp, Homo sapiens
gtgcaaaaggcattgtggtttt

SEQ ID NO: 7286607 - DNA, 22 bp, Homo sapiens
gtgcaaaagcagttgtggtttt

SEQ ID NO: 7286608 - DNA, 22 bp, Homo sapiens
gtgcctctgagctctgctacag

SEQ ID NO: 7286609 - DNA, 22 bp, Homo sapiens
gtgccctgttcatttctctccc

SEQ ID NO: 7286610 - DNA, 20 bp, Homo sapiens
gtgccctgtgggctattttc

SEQ ID NO: 7286611 - DNA, 22 bp, Homo sapiens
gtgccctgtgaactgtaaggaa

SEQ ID NO: 7286612 - DNA, 22 bp, Homo sapiens
gtgccctgttgcacacttgagg

SEQ ID NO: 7286613 - DNA, 22 bp, Homo sapiens
gtgcccttcagctttgctgaaa

SEQ ID NO: 7286614 - DNA, 22 bp, Homo sapiens
gtgccctgggccttcagggcca

SEQ ID NO: 7286615 - DNA, 20 bp, Homo sapiens
tattcaactttaaaaactta

SEQ ID NO: 7286616 - DNA, 22 bp, Homo sapiens
tatgcctggggtgctcaggcca

SEQ ID NO: 7286617 - DNA, 22 bp, Homo sapiens
tagttaaagccctaaattgata

SEQ ID NO: 7286618 - DNA, 22 bp, Homo sapiens
tatactctgagaaacgtgtcac

SEQ ID NO: 7286619 - DNA, 22 bp, Homo sapiens
tagcaaaagccacgattacttt

SEQ ID NO: 7286620 - DNA, 22 bp, Homo sapiens
tagccaaaaagtagcaattatt

SEQ ID NO: 7286621 - DNA, 22 bp, Homo sapiens
tagtcagttgggtctagtggca

SEQ ID NO: 7286622 - DNA, 22 bp, Homo sapiens
tagtcagtgcacagacacttgt

SEQ ID NO: 7286623 - DNA, 22 bp, Homo sapiens
tagtcagtgatcagtggagttg

SEQ ID NO: 7286624 - DNA, 22 bp, Homo sapiens
tagtcagtcttacatatttgaa

SEQ ID NO: 7286625 - DNA, 23 bp, Homo sapiens
tagtcagtatgtaagtctaattg

SEQ ID NO: 7286626 - DNA, 22 bp, Homo sapiens
tagtcagtatgaaattgctcaa

SEQ ID NO: 7286627 - DNA, 22 bp, Homo sapiens
tagtcagtagcaaggtattttg

SEQ ID NO: 7286628 - DNA, 22 bp, Homo sapiens
taggctgggagcctgaggctag

SEQ ID NO: 7286629 - DNA, 22 bp, Homo sapiens
taggctgggaagaaagattctc

SEQ ID NO: 7286630 - DNA, 22 bp, Homo sapiens
taggctggaacttaggcagagg

SEQ ID NO: 7286631 - DNA, 22 bp, Homo sapiens
taggctggaggaagcagtgcct

SEQ ID NO: 7286632 - DNA, 22 bp, Homo sapiens
taggctggaggaagcagtgcct

SEQ ID NO: 7286633 - DNA, 22 bp, Homo sapiens
tagtaaaagtttagttgaaagt

SEQ ID NO: 7286634 - DNA, 22 bp, Homo sapiens
tagtagcatttggaaaaattgg

SEQ ID NO: 7286635 - DNA, 22 bp, Homo sapiens
taggaatgattggaattccagg

SEQ ID NO: 7286636 - DNA, 22 bp, Homo sapiens
taggaacccgcagcagtccgag

SEQ ID NO: 7286637 - DNA, 22 bp, Homo sapiens
taggaacctactgtggttttaa

SEQ ID NO: 7286638 - DNA, 22 bp, Homo sapiens
taggaaccttgatcttggattt

SEQ ID NO: 7286639 - DNA, 22 bp, Homo sapiens
taggaagcctgctgtgcacagc

SEQ ID NO: 7286640 - DNA, 22 bp, Homo sapiens
tacagtttttattcatgacaag

SEQ ID NO: 7286641 - DNA, 22 bp, Homo sapiens
tacagtttttcactgaagatgt

SEQ ID NO: 7286642 - DNA, 22 bp, Homo sapiens
tacaggaaccagattgttcagc

SEQ ID NO: 7286643 - DNA, 20 bp, Homo sapiens
tacattcaaaacaaactctg

SEQ ID NO: 7286644 - DNA, 22 bp, Homo sapiens
tacattcaaacgatttattgat

SEQ ID NO: 7286645 - DNA, 22 bp, Homo sapiens
tacattcaacatgtcactatgt

SEQ ID NO: 7286646 - DNA, 22 bp, Homo sapiens
tacattcacagttgttcatctc

SEQ ID NO: 7286647 - DNA, 22 bp, Homo sapiens
tacattcagaagaatggacacg

SEQ ID NO: 7286648 - DNA, 22 bp, Homo sapiens
tacattcacttgttgaaggtgg

SEQ ID NO: 7286649 - DNA, 22 bp, Homo sapiens
tacattcagcaaaagaatggtt

SEQ ID NO: 7286650 - DNA, 22 bp, Homo sapiens
tacattcagagaaagtttccat

SEQ ID NO: 7286651 - DNA, 22 bp, Homo sapiens
tacattcagaattgggaggcaa

SEQ ID NO: 7286652 - DNA, 22 bp, Homo sapiens
tacattcatatgtgtgcataca

SEQ ID NO: 7286653 - DNA, 22 bp, Homo sapiens
tacattcatggtgacttgtatg

SEQ ID NO: 7286654 - DNA, 23 bp, Homo sapiens
tacattcatttgcacagccagta

SEQ ID NO: 7286655 - DNA, 15 bp, Homo sapiens
tacattcatttccac

SEQ ID NO: 7286656 - DNA, 22 bp, Homo sapiens
tactgctgagctgggtagaagg

SEQ ID NO: 7286657 - DNA, 22 bp, Homo sapiens
tactggccaagagaatgcagta

SEQ ID NO: 7286658 - DNA, 22 bp, Homo sapiens
tacattcccccaattaccaatg

SEQ ID NO: 7286659 - DNA, 22 bp, Homo sapiens
tacattccatgtgtgtgtattc

SEQ ID NO: 7286660 - DNA, 22 bp, Homo sapiens
taccttcaccagcgaatgtttg

SEQ ID NO: 7286661 - DNA, 22 bp, Homo sapiens
tacctgggaagtgggacctgag

SEQ ID NO: 7286662 - DNA, 22 bp, Homo sapiens
tacctgggcccaccagtgcctg

SEQ ID NO: 7286663 - DNA, 22 bp, Homo sapiens
tactgaaatagcactctgatgc

SEQ ID NO: 7286664 - DNA, 22 bp, Homo sapiens
tacaaaaaattgatactgacga

SEQ ID NO: 7286665 - DNA, 21 bp, Homo sapiens
tacacaaagcgtggtccagag

SEQ ID NO: 7286666 - DNA, 22 bp, Homo sapiens
tacacaaaggcactctgttgtt

SEQ ID NO: 7286667 - DNA, 22 bp, Homo sapiens
tacacatgatcatttagtagca

SEQ ID NO: 7286668 - DNA, 22 bp, Homo sapiens
tacacatgacagtggactgaga

SEQ ID NO: 7286669 - DNA, 22 bp, Homo sapiens
tacacatgtttggcaagtatgt

SEQ ID NO: 7286670 - DNA, 22 bp, Homo sapiens
tacacatgtgcacgcgtgtcct

SEQ ID NO: 7286671 - DNA, 22 bp, Homo sapiens
tacacatgtccaaggtgtcacc

SEQ ID NO: 7286672 - DNA, 22 bp, Homo sapiens
tacacatgtatttatgtgtaca

SEQ ID NO: 7286673 - DNA, 22 bp, Homo sapiens
tacacatgctcagattcctgtg

SEQ ID NO: 7286674 - DNA, 22 bp, Homo sapiens
tacacatgcatgtactccagga

SEQ ID NO: 7286675 - DNA, 22 bp, Homo sapiens
taaagtttattggcaccaccat

SEQ ID NO: 7286676 - DNA, 22 bp, Homo sapiens
taaagaataatacccatggagc

SEQ ID NO: 7286677 - DNA, 22 bp, Homo sapiens
taaagacaatttcgagctgtag

SEQ ID NO: 7286678 - DNA, 22 bp, Homo sapiens
taagataatccattataatgtt

SEQ ID NO: 7286679 - DNA, 22 bp, Homo sapiens
taaatttttgttaacagcctct

SEQ ID NO: 7286680 - DNA, 22 bp, Homo sapiens
gttttacaaggttaatcagcag

SEQ ID NO: 7286681 - DNA, 23 bp, Homo sapiens
gttttacaggtgagaaaatggag

SEQ ID NO: 7286682 - DNA, 22 bp, Homo sapiens
gttttacacacctatgaaagac

SEQ ID NO: 7286683 - DNA, 22 bp, Homo sapiens
gtttctctgtacctctgtccca

SEQ ID NO: 7286684 - DNA, 22 bp, Homo sapiens
tcccttggttaaatatgtagga

SEQ ID NO: 7286685 - DNA, 21 bp, Homo sapiens
tcccttgggaaactttcttga

SEQ ID NO: 7286686 - DNA, 19 bp, Homo sapiens
tcccttctatagtaataaa

SEQ ID NO: 7286687 - DNA, 18 bp, Homo sapiens
tcccttctcccttgcctc

SEQ ID NO: 7286688 - DNA, 22 bp, Homo sapiens
tccctgtgaatcagaagcaggt

SEQ ID NO: 7286689 - DNA, 22 bp, Homo sapiens
tccctgtggaagactgccagag

SEQ ID NO: 7286690 - DNA, 22 bp, Homo sapiens
tccctgggcctcctgctatgca

SEQ ID NO: 7286691 - DNA, 22 bp, Homo sapiens
tccctggggaagggcaagcaag

SEQ ID NO: 7286692 - DNA, 22 bp, Homo sapiens
tcccaggatgtttatggctggt

SEQ ID NO: 7286693 - DNA, 22 bp, Homo sapiens
tccctgccaatgattggagcaa

SEQ ID NO: 7286694 - DNA, 22 bp, Homo sapiens
tccctgccagtcctggtctgaa

SEQ ID NO: 7286695 - DNA, 22 bp, Homo sapiens
tccctgccctcagtgcacccgg

SEQ ID NO: 7286696 - DNA, 22 bp, Homo sapiens
tccctgccctcagtgcacccgg

SEQ ID NO: 7286697 - DNA, 23 bp, Homo sapiens
tcctcctgacacagcctgagtga

SEQ ID NO: 7286698 - DNA, 22 bp, Homo sapiens
tccacagggatgcctgcggctt

SEQ ID NO: 7286699 - DNA, 19 bp, Homo sapiens
tccaccccagccagctctg

SEQ ID NO: 7286700 - DNA, 22 bp, Homo sapiens
tccacccccagacagctggtga

SEQ ID NO: 7286701 - DNA, 22 bp, Homo sapiens
tccagcccgactgggcctgccg

SEQ ID NO: 7286702 - DNA, 17 bp, Homo sapiens
tccagccctgcccgacg

SEQ ID NO: 7286703 - DNA, 23 bp, Homo sapiens
tccaggagcatgctggctggcga

SEQ ID NO: 7286704 - DNA, 22 bp, Homo sapiens
tcccagaaaaaggaggctatga

SEQ ID NO: 7286705 - DNA, 22 bp, Homo sapiens
tcccagcagatgagctgaccta

SEQ ID NO: 7286706 - DNA, 22 bp, Homo sapiens
tcccagcttagatttgctcatt

SEQ ID NO: 7286707 - DNA, 22 bp, Homo sapiens
tccaggccctgggatgggagca

SEQ ID NO: 7286708 - DNA, 22 bp, Homo sapiens
tccaggccgcaggggcagcccc

SEQ ID NO: 7286709 - DNA, 21 bp, Homo sapiens
tccaggcctcaggaagggatg

SEQ ID NO: 7286710 - DNA, 22 bp, Homo sapiens
tccaggcctaggccaagtgatt

SEQ ID NO: 7286711 - DNA, 22 bp, Homo sapiens
tccagggacctccctgagagct

SEQ ID NO: 7286712 - DNA, 22 bp, Homo sapiens
tccaggcccagacggggtgagg

SEQ ID NO: 7286713 - DNA, 22 bp, Homo sapiens
tccaggcccactcggtggggct

SEQ ID NO: 7286714 - DNA, 22 bp, Homo sapiens
tccaggcccactcagctgaaat

SEQ ID NO: 7286715 - DNA, 20 bp, Homo sapiens
tccaggcccactcagctgaa

SEQ ID NO: 7286716 - DNA, 21 bp, Homo sapiens
tccaggccatggtggggaggc

SEQ ID NO: 7286717 - DNA, 19 bp, Homo sapiens
tccaggccattcccagagc

SEQ ID NO: 7286718 - DNA, 22 bp, Homo sapiens
tccaggccagggtaagaggaga

SEQ ID NO: 7286719 - DNA, 22 bp, Homo sapiens
tcaaaatcaaagatacttgaaa

SEQ ID NO: 7286720 - DNA, 22 bp, Homo sapiens
tcacagaattgacatgggaatc

SEQ ID NO: 7286721 - DNA, 20 bp, Homo sapiens
tcacatcctctcccaacatg

SEQ ID NO: 7286722 - DNA, 22 bp, Homo sapiens
tcagaacattgacattcttatt

SEQ ID NO: 7286723 - DNA, 22 bp, Homo sapiens
tcacccctaccaaggagcactg

SEQ ID NO: 7286724 - DNA, 22 bp, Homo sapiens
tcacccctccattctctcatgt

SEQ ID NO: 7286725 - DNA, 22 bp, Homo sapiens
tcacccctggcccagtcttgga

SEQ ID NO: 7286726 - DNA, 22 bp, Homo sapiens
tcaccccttgtgaatgctgctc

SEQ ID NO: 7286727 - DNA, 22 bp, Homo sapiens
tcacccctacatttcccttgct

SEQ ID NO: 7286728 - DNA, 22 bp, Homo sapiens
tcaccccctgtattagtagcta

SEQ ID NO: 7286729 - DNA, 22 bp, Homo sapiens
tcacatgagtattattttccaa

SEQ ID NO: 7286730 - DNA, 22 bp, Homo sapiens
tcactgggccctgaggtgggac

SEQ ID NO: 7286731 - DNA, 18 bp, Homo sapiens
tcactgggtgtatgtggc

SEQ ID NO: 7286732 - DNA, 20 bp, Homo sapiens
tcactgtaacatttgggggg

SEQ ID NO: 7286733 - DNA, 22 bp, Homo sapiens
tcactgtcactaggcaccaaac

SEQ ID NO: 7286734 - DNA, 22 bp, Homo sapiens
tcagggcagcctaaggcacctc

SEQ ID NO: 7286735 - DNA, 22 bp, Homo sapiens
tcagggcagaatccaaagaatt

SEQ ID NO: 7286736 - DNA, 22 bp, Homo sapiens
tcagggcaaaagggaaaccatt

SEQ ID NO: 7286737 - DNA, 22 bp, Homo sapiens
tcagggcaaagggcagagtttg

SEQ ID NO: 7286738 - DNA, 22 bp, Homo sapiens
tcagggcaagtctcagaaggtt

SEQ ID NO: 7286739 - DNA, 22 bp, Homo sapiens
tcaggctgaatcatcctagctt

SEQ ID NO: 7286740 - DNA, 22 bp, Homo sapiens
tcaggctgaaaggactccagtt

SEQ ID NO: 7286741 - DNA, 22 bp, Homo sapiens
tcaggctctcagaccaacagca

SEQ ID NO: 7286742 - DNA, 22 bp, Homo sapiens
tcaggctctacacttgacacac

SEQ ID NO: 7286743 - DNA, 22 bp, Homo sapiens
tcaggctccctgctgggctctg

SEQ ID NO: 7286744 - DNA, 22 bp, Homo sapiens
tcaggctcaggttaggggccaa

SEQ ID NO: 7286745 - DNA, 22 bp, Homo sapiens
tcatccatgtgcaaactttggt

SEQ ID NO: 7286746 - DNA, 22 bp, Homo sapiens
tcatccatatagaaagatgatt

SEQ ID NO: 7286747 - DNA, 22 bp, Homo sapiens
tcatccatcctcgcctttgctt

SEQ ID NO: 7286748 - DNA, 22 bp, Homo sapiens
tcagccatggtgagagtgagag

SEQ ID NO: 7286749 - DNA, 22 bp, Homo sapiens
tcagcctgcgtcatggtgacac

SEQ ID NO: 7286750 - DNA, 22 bp, Homo sapiens
tcaggagggtgacaggccctgg

SEQ ID NO: 7286751 - DNA, 22 bp, Homo sapiens
tcaggcaggatcccagggaagg

SEQ ID NO: 7286752 - DNA, 21 bp, Homo sapiens
tcaggcaggcgcagagggaag

SEQ ID NO: 7286753 - DNA, 22 bp, Homo sapiens
tcaggcaggttggctgcaggtc

SEQ ID NO: 7286754 - DNA, 22 bp, Homo sapiens
tcaggcaggctcagaggaaaac

SEQ ID NO: 7286755 - DNA, 22 bp, Homo sapiens
tcaggaggtccgcccgggaggg

SEQ ID NO: 7286756 - DNA, 22 bp, Homo sapiens
tttgtcttcatccttcgagctg

SEQ ID NO: 7286757 - DNA, 22 bp, Homo sapiens
tttgtgagtgcacatgcccaca

SEQ ID NO: 7286758 - DNA, 22 bp, Homo sapiens
ttttacagttccatgcaaagcg

SEQ ID NO: 7286759 - DNA, 22 bp, Homo sapiens
ttttacagtcagtcaaactcag

SEQ ID NO: 7286760 - DNA, 22 bp, Homo sapiens
ttttacaggtgaaaaatgaaga

SEQ ID NO: 7286761 - DNA, 22 bp, Homo sapiens
ttttacaggtgtgagccaccat

SEQ ID NO: 7286762 - DNA, 22 bp, Homo sapiens
ttttacacctcagatgagcaga

SEQ ID NO: 7286763 - DNA, 22 bp, Homo sapiens
ttttacaggtcataggtatagt

SEQ ID NO: 7286764 - DNA, 21 bp, Homo sapiens
ttttacagatgaggggaaggg

SEQ ID NO: 7286765 - DNA, 22 bp, Homo sapiens
ttttcccagagctgtcctcaag

SEQ ID NO: 7286766 - DNA, 22 bp, Homo sapiens
ttttccttcacctcttgagcct

SEQ ID NO: 7286767 - DNA, 22 bp, Homo sapiens
ttttttatatcaactgaagtct

SEQ ID NO: 7286768 - DNA, 22 bp, Homo sapiens
ttttttatagcaatgaacccac

SEQ ID NO: 7286769 - DNA, 22 bp, Homo sapiens
ttttttatctatggtagtacca

SEQ ID NO: 7286770 - DNA, 22 bp, Homo sapiens
tttgaacatgctgcatgataat

SEQ ID NO: 7286771 - DNA, 22 bp, Homo sapiens
tttgggaaagtgtcttttgtat

SEQ ID NO: 7286772 - DNA, 22 bp, Homo sapiens
tttggctaagttgtaatgtaaa

SEQ ID NO: 7286773 - DNA, 22 bp, Homo sapiens
tttggcatttttcagatgactg

SEQ ID NO: 7286774 - DNA, 22 bp, Homo sapiens
tttggctagagaaattactata

SEQ ID NO: 7286775 - DNA, 21 bp, Homo sapiens
tttggcttctctgctgcagcc

SEQ ID NO: 7286776 - DNA, 22 bp, Homo sapiens
tttggctgtcatttgaaaatgt

SEQ ID NO: 7286777 - DNA, 20 bp, Homo sapiens
tttggcttcaagtgcattgc

SEQ ID NO: 7286778 - DNA, 22 bp, Homo sapiens
tttggcttgcactggcaccaac

SEQ ID NO: 7286779 - DNA, 22 bp, Homo sapiens
tttggctttagtgccttctgat

SEQ ID NO: 7286780 - DNA, 22 bp, Homo sapiens
tttggcttaacttacatgatat

SEQ ID NO: 7286781 - DNA, 22 bp, Homo sapiens
ttctttttggatagctgatgaa

SEQ ID NO: 7286782 - DNA, 22 bp, Homo sapiens
ttctttttatcttcccataaga

SEQ ID NO: 7286783 - DNA, 20 bp, Homo sapiens
ttgaaaatgcattgtgcagt

SEQ ID NO: 7286784 - DNA, 22 bp, Homo sapiens
ttgagactcctggtgtagaata

SEQ ID NO: 7286785 - DNA, 22 bp, Homo sapiens
ttgagagtttgggggcaatatg

SEQ ID NO: 7286786 - DNA, 22 bp, Homo sapiens
ttgagagttaccagcagaggaa

SEQ ID NO: 7286787 - DNA, 22 bp, Homo sapiens
ttgagagtcatttaaggtgttg

SEQ ID NO: 7286788 - DNA, 22 bp, Homo sapiens
ttgagagtagagatggcagggc

SEQ ID NO: 7286789 - DNA, 22 bp, Homo sapiens
ttctttctcactctttaggaag

SEQ ID NO: 7286790 - DNA, 22 bp, Homo sapiens
ttcttctgattgccttctgcaa

SEQ ID NO: 7286791 - DNA, 22 bp, Homo sapiens
ttctttggggaatattctggtt

SEQ ID NO: 7286792 - DNA, 22 bp, Homo sapiens
ttctttggggtctccagcatag

SEQ ID NO: 7286793 - DNA, 22 bp, Homo sapiens
ttctttggctgccagtctggag

SEQ ID NO: 7286794 - DNA, 22 bp, Homo sapiens
ttctttggcttacgtctggcct

SEQ ID NO: 7286795 - DNA, 22 bp, Homo sapiens
ttctttgggattgtagctgtct

SEQ ID NO: 7286796 - DNA, 22 bp, Homo sapiens
ttctttgggcaattgctggccc

SEQ ID NO: 7286797 - DNA, 23 bp, Homo sapiens
ttctttggaattgggctgcaagg

SEQ ID NO: 7286798 - DNA, 22 bp, Homo sapiens
ttcttcagactccctctttaag

SEQ ID NO: 7286799 - DNA, 22 bp, Homo sapiens
ttctctttctacagtgtgattg

SEQ ID NO: 7286800 - DNA, 23 bp, Homo sapiens
ttctctttagatttacattactc

SEQ ID NO: 7286801 - DNA, 22 bp, Homo sapiens
ttctctttgacattattcaggt

SEQ ID NO: 7286802 - DNA, 20 bp, Homo sapiens
ttctctttgggtccagagaa

SEQ ID NO: 7286803 - DNA, 22 bp, Homo sapiens
ttctgagggaggttctctggga

SEQ ID NO: 7286804 - DNA, 22 bp, Homo sapiens
ttctcttgagctggtcatgttt

SEQ ID NO: 7286805 - DNA, 23 bp, Homo sapiens
ttctctttagatttacattactc

SEQ ID NO: 7286806 - DNA, 22 bp, Homo sapiens
ttctcttgtgccaagttgttgc

SEQ ID NO: 7286807 - DNA, 22 bp, Homo sapiens
ttctcttcatctcagtaaatgt

SEQ ID NO: 7286808 - DNA, 22 bp, Homo sapiens
ttctccctgccaaagctgcctc

SEQ ID NO: 7286809 - DNA, 21 bp, Homo sapiens
ttctccccagcgaatcctcgg

SEQ ID NO: 7286810 - DNA, 17 bp, Homo sapiens
ttctcctctgtgtcctt

SEQ ID NO: 7286811 - DNA, 22 bp, Homo sapiens
ttccctctttcactgtgatttt

SEQ ID NO: 7286812 - DNA, 22 bp, Homo sapiens
ttccctcttttccaacagttgt

SEQ ID NO: 7286813 - DNA, 22 bp, Homo sapiens
ttccctctcacttaaagcttgg

SEQ ID NO: 7286814 - DNA, 22 bp, Homo sapiens
ttccctctccaggagccctgag

SEQ ID NO: 7286815 - DNA, 22 bp, Homo sapiens
ttccctctgcgcattgaatttc

SEQ ID NO: 7286816 - DNA, 22 bp, Homo sapiens
ttccctctctccagggctgcct

SEQ ID NO: 7286817 - DNA, 22 bp, Homo sapiens
ttccctctcctactcaggaaag

SEQ ID NO: 7286818 - DNA, 22 bp, Homo sapiens
ttccctctcctactcaggaaag

SEQ ID NO: 7286819 - DNA, 22 bp, Homo sapiens
ttccctctctagctttccccaa

SEQ ID NO: 7286820 - DNA, 22 bp, Homo sapiens
ttatggcatattcctcattgta

SEQ ID NO: 7286821 - DNA, 22 bp, Homo sapiens
ttatgctaagtgcaacaagcca

SEQ ID NO: 7286822 - DNA, 22 bp, Homo sapiens
ttatacacaattcttttactac

SEQ ID NO: 7286823 - DNA, 22 bp, Homo sapiens
ttatacactgcagaaccagcat

SEQ ID NO: 7286824 - DNA, 22 bp, Homo sapiens
ttatacacgtttatggagctac

SEQ ID NO: 7286825 - DNA, 22 bp, Homo sapiens
ttatacaccatcactgccttgg

SEQ ID NO: 7286826 - DNA, 22 bp, Homo sapiens
ttatttaaaagtggtaagattc

SEQ ID NO: 7286827 - DNA, 21 bp, Homo sapiens
ttcccagcacctagcacaggt

SEQ ID NO: 7286828 - DNA, 22 bp, Homo sapiens
ttccaactctgaaatgtgaaat

SEQ ID NO: 7286829 - DNA, 22 bp, Homo sapiens
tttaggaatattttctttcagg

SEQ ID NO: 7286830 - DNA, 22 bp, Homo sapiens
tttaggaatagctgacaatctt

SEQ ID NO: 7286831 - DNA, 22 bp, Homo sapiens
tttaggaagtttcagataggaa

SEQ ID NO: 7286832 - DNA, 22 bp, Homo sapiens
tttaggaaatactgtcctatga

SEQ ID NO: 7286833 - DNA, 22 bp, Homo sapiens
tttacacttattatgaagcttt

SEQ ID NO: 7286834 - DNA, 22 bp, Homo sapiens
tttacagcactgaagccagggg

SEQ ID NO: 7286835 - DNA, 22 bp, Homo sapiens
ttgtttaaaagaaatcatagaa

SEQ ID NO: 7286836 - DNA, 22 bp, Homo sapiens
tttaacatgtaattgctgcttt

SEQ ID NO: 7286837 - DNA, 22 bp, Homo sapiens
tttcacattcttctgaatctac

SEQ ID NO: 7286838 - DNA, 22 bp, Homo sapiens
tttcacattagatatgtcattt

SEQ ID NO: 7286839 - DNA, 23 bp, Homo sapiens
tttcacattaatgtttagcagga

SEQ ID NO: 7286840 - DNA, 22 bp, Homo sapiens
tttcacatttaggcgtgaattg

SEQ ID NO: 7286841 - DNA, 20 bp, Homo sapiens
tttcacaatgaacatgtctc

SEQ ID NO: 7286842 - DNA, 22 bp, Homo sapiens
tttcacatcatgggatggaagc

SEQ ID NO: 7286843 - DNA, 22 bp, Homo sapiens
tttcacatatggttgttgattg

SEQ ID NO: 7286844 - DNA, 20 bp, Homo sapiens
tttcacatctgtccctttaa

SEQ ID NO: 7286845 - DNA, 22 bp, Homo sapiens
tttcacatggaagctctcgaga

SEQ ID NO: 7286846 - DNA, 22 bp, Homo sapiens
tttcacatgcagcagggaagtg

SEQ ID NO: 7286847 - DNA, 22 bp, Homo sapiens
tttcacatgtatataggcatta

SEQ ID NO: 7286848 - DNA, 22 bp, Homo sapiens
tttcataagggtttctagactt

SEQ ID NO: 7286849 - DNA, 22 bp, Homo sapiens
tttccaaataaggtcacattct

SEQ ID NO: 7286850 - DNA, 22 bp, Homo sapiens
tttccttttataaggcttgagg

SEQ ID NO: 7286851 - DNA, 22 bp, Homo sapiens
tttcctttgtgcaggccttggg

SEQ ID NO: 7286852 - DNA, 22 bp, Homo sapiens
ttgggggcatattgagtagtgg

SEQ ID NO: 7286853 - DNA, 22 bp, Homo sapiens
ttgggggcagagggagcatctg

SEQ ID NO: 7286854 - DNA, 22 bp, Homo sapiens
ttgttcatggttgtaagtttga

SEQ ID NO: 7286855 - DNA, 18 bp, Homo sapiens
ttggctttgagaactggt

SEQ ID NO: 7286856 - DNA, 22 bp, Homo sapiens
ttggctttcaggctggaaatct

SEQ ID NO: 7286857 - DNA, 22 bp, Homo sapiens
ttgggaaattactctgctagga

SEQ ID NO: 7286858 - DNA, 21 bp, Homo sapiens
ttgggccttttctggtagctt

SEQ ID NO: 7286859 - DNA, 23 bp, Homo sapiens
ttgggaaatagttaagacatgag

SEQ ID NO: 7286860 - DNA, 22 bp, Homo sapiens
ttggcttgatgactggcagtgt

SEQ ID NO: 7286861 - DNA, 22 bp, Homo sapiens
ttggcttctgttttggctctgt

SEQ ID NO: 7286862 - DNA, 22 bp, Homo sapiens
ttggcttcattgatctcacttt

SEQ ID NO: 7286863 - DNA, 22 bp, Homo sapiens
ttgggctcaggagtttgagacc

SEQ ID NO: 7286864 - DNA, 22 bp, Homo sapiens
ttgccatttcaagtggccactg

SEQ ID NO: 7286865 - DNA, 22 bp, Homo sapiens
ttgccattttgagaaggatata

SEQ ID NO: 7286866 - DNA, 22 bp, Homo sapiens
ttgccatttagtatgcttgtat

SEQ ID NO: 7286867 - DNA, 22 bp, Homo sapiens
ttgccatttatactgcaagtca

SEQ ID NO: 7286868 - DNA, 22 bp, Homo sapiens
ttgccatttaggctggctgtgg

SEQ ID NO: 7286869 - DNA, 22 bp, Homo sapiens
ttgccatttagaggttaaacct

SEQ ID NO: 7286870 - DNA, 22 bp, Homo sapiens
ttgccattggcaggcctcttgt

SEQ ID NO: 7286871 - DNA, 22 bp, Homo sapiens
ttgccatttcgtaagccgggag

SEQ ID NO: 7286872 - DNA, 22 bp, Homo sapiens
ttgccattatcatttatgatac

SEQ ID NO: 7286873 - DNA, 22 bp, Homo sapiens
ttgccattaaaacatgttatct

SEQ ID NO: 7286874 - DNA, 22 bp, Homo sapiens
ttgccattgctcagtgaacaga

SEQ ID NO: 7286875 - DNA, 22 bp, Homo sapiens
ttgccattgcaaagtactatga

SEQ ID NO: 7286876 - DNA, 23 bp, Homo sapiens
ttgccattccaaataatttccta

SEQ ID NO: 7286877 - DNA, 22 bp, Homo sapiens
ttgccattccagggtattaggg

SEQ ID NO: 7286878 - DNA, 22 bp, Homo sapiens
ttgcccagagctgcctgttaca

SEQ ID NO: 7286879 - DNA, 22 bp, Homo sapiens
ttgcccagagtcacccagctca

SEQ ID NO: 7286880 - DNA, 22 bp, Homo sapiens
ttgcctgctacggtcttcactg

SEQ ID NO: 7286881 - DNA, 22 bp, Homo sapiens
ttgccttgttattctctcagaa

SEQ ID NO: 7286882 - DNA, 22 bp, Homo sapiens
ttgcctggagggacatggagac

SEQ ID NO: 7286883 - DNA, 22 bp, Homo sapiens
ttgcctgtgtcagcaggtggaa

SEQ ID NO: 7286884 - DNA, 23 bp, Homo sapiens
ttggaacacagtaaatgcacaat

SEQ ID NO: 7286885 - DNA, 20 bp, Homo sapiens
ttggaacagtggatcagcag

SEQ ID NO: 7286886 - DNA, 22 bp, Homo sapiens
ttggaacagaaacagacaaata

SEQ ID NO: 7286887 - DNA, 22 bp, Homo sapiens
ttgcttcttagatattcctctc

SEQ ID NO: 7286888 - DNA, 23 bp, Homo sapiens
ttgcttctgtgcaattcagtact

SEQ ID NO: 7286889 - DNA, 22 bp, Homo sapiens
ttggaattaatatttgtataca

SEQ ID NO: 7286890 - DNA, 22 bp, Homo sapiens
ttggaagttcttagccttttca

SEQ ID NO: 7286891 - DNA, 22 bp, Homo sapiens
aattactgatctacaaaatcca

SEQ ID NO: 7286892 - DNA, 22 bp, Homo sapiens
aatttacaggtgcactcgccat

SEQ ID NO: 7286893 - DNA, 22 bp, Homo sapiens
aatttacagttgctgatggtac

SEQ ID NO: 7286894 - DNA, 22 bp, Homo sapiens
aatgtgttcagttaaatgaact

SEQ ID NO: 7286895 - DNA, 22 bp, Homo sapiens
aatgtctgcctgaactttatat

SEQ ID NO: 7286896 - DNA, 22 bp, Homo sapiens
acaattagtgatcagtgatgcc

SEQ ID NO: 7286897 - DNA, 22 bp, Homo sapiens
acaagtttatttgattagaaca

SEQ ID NO: 7286898 - DNA, 22 bp, Homo sapiens
acaagtctttttcatgtcttct

SEQ ID NO: 7286899 - DNA, 22 bp, Homo sapiens
acaagtctgttatgcacctgga

SEQ ID NO: 7286900 - DNA, 22 bp, Homo sapiens
acaagtctcaacagcagccagc

SEQ ID NO: 7286901 - DNA, 22 bp, Homo sapiens
acaaatgtctacattgagaata

SEQ ID NO: 7286902 - DNA, 22 bp, Homo sapiens
acaaacagagttgaaaaatagg

SEQ ID NO: 7286903 - DNA, 22 bp, Homo sapiens
acaaaattatgaagaggccttg

SEQ ID NO: 7286904 - DNA, 22 bp, Homo sapiens
acaaaatttttagacaaggctt

SEQ ID NO: 7286905 - DNA, 19 bp, Homo sapiens
acaaatgatgttgcactga

SEQ ID NO: 7286906 - DNA, 22 bp, Homo sapiens
acaaatgcttagttcaccaaaa

SEQ ID NO: 7286907 - DNA, 23 bp, Homo sapiens
acaaatgcccatacatctagttc

SEQ ID NO: 7286908 - DNA, 20 bp, Homo sapiens
acaaaataggtactgggtag

SEQ ID NO: 7286909 - DNA, 22 bp, Homo sapiens
aattttcacagtgctgtgagat

SEQ ID NO: 7286910 - DNA, 22 bp, Homo sapiens
acagaaattgctaatagctcat

SEQ ID NO: 7286911 - DNA, 22 bp, Homo sapiens
acagaaattagcagtgagttta

SEQ ID NO: 7286912 - DNA, 19 bp, Homo sapiens
acagaaattagttattttc

SEQ ID NO: 7286913 - DNA, 19 bp, Homo sapiens
acacatttgcacaatccac

SEQ ID NO: 7286914 - DNA, 22 bp, Homo sapiens
acacattttcaacactgtcaag

SEQ ID NO: 7286915 - DNA, 22 bp, Homo sapiens
acacattttctaacagggatca

SEQ ID NO: 7286916 - DNA, 22 bp, Homo sapiens
acacattttggctaggtggaga

SEQ ID NO: 7286917 - DNA, 22 bp, Homo sapiens
agcagggccaacagtaaacacc

SEQ ID NO: 7286918 - DNA, 18 bp, Homo sapiens
agcagggcattttgccat

SEQ ID NO: 7286919 - DNA, 22 bp, Homo sapiens
agcagggcatgaataagggttt

SEQ ID NO: 7286920 - DNA, 22 bp, Homo sapiens
agcagggcagttaaagggtcct

SEQ ID NO: 7286921 - DNA, 22 bp, Homo sapiens
agcagggcccactaggggagat

SEQ ID NO: 7286922 - DNA, 22 bp, Homo sapiens
agcagcagtcctttgtgtaatt

SEQ ID NO: 7286923 - DNA, 22 bp, Homo sapiens
agcagcagtgtgtggtcatgtt

SEQ ID NO: 7286924 - DNA, 22 bp, Homo sapiens
acacaggaagcaatttcagagc

SEQ ID NO: 7286925 - DNA, 22 bp, Homo sapiens
acacaggaagcaatttcagagc

SEQ ID NO: 7286926 - DNA, 22 bp, Homo sapiens
acacaggaagagagataataat

SEQ ID NO: 7286927 - DNA, 22 bp, Homo sapiens
acacaggaagagagataataat

SEQ ID NO: 7286928 - DNA, 22 bp, Homo sapiens
acacaggacagggatgtgtttt

SEQ ID NO: 7286929 - DNA, 21 bp, Homo sapiens
acacaggagtttcttctttct

SEQ ID NO: 7286930 - DNA, 22 bp, Homo sapiens
acacaggaggaggatggtggtc

SEQ ID NO: 7286931 - DNA, 22 bp, Homo sapiens
agcccccaggagtctccacgcc

SEQ ID NO: 7286932 - DNA, 22 bp, Homo sapiens
agcctgcctgtgaggctttgag

SEQ ID NO: 7286933 - DNA, 22 bp, Homo sapiens
agcctgcctcagactcaggata

SEQ ID NO: 7286934 - DNA, 17 bp, Homo sapiens
agcctgccccatgctgc

SEQ ID NO: 7286935 - DNA, 22 bp, Homo sapiens
agcctgccaggcgctgcctgga

SEQ ID NO: 7286936 - DNA, 20 bp, Homo sapiens
agcctgccagctggcccaga

SEQ ID NO: 7286937 - DNA, 22 bp, Homo sapiens
acagcaggaattaacatataag

SEQ ID NO: 7286938 - DNA, 22 bp, Homo sapiens
acagcaggagccttcatatgct

SEQ ID NO: 7286939 - DNA, 22 bp, Homo sapiens
acagcaggatttggcgatgttg

SEQ ID NO: 7286940 - DNA, 22 bp, Homo sapiens
acagcaggcatgaagaaatgtt

SEQ ID NO: 7286941 - DNA, 22 bp, Homo sapiens
acagcaggcacacaaggataga

SEQ ID NO: 7286942 - DNA, 22 bp, Homo sapiens
acagcaggcatgaatgacactg

SEQ ID NO: 7286943 - DNA, 22 bp, Homo sapiens
accatgttggccaagctggtct

SEQ ID NO: 7286944 - DNA, 22 bp, Homo sapiens
aagggcaggaaaagatggatgt

SEQ ID NO: 7286945 - DNA, 22 bp, Homo sapiens
aagggaaatcctcagcccagga

SEQ ID NO: 7286946 - DNA, 19 bp, Homo sapiens
aaggctttctgagtgaaaa

SEQ ID NO: 7286947 - DNA, 22 bp, Homo sapiens
aaggctggtttccttgatgttt

SEQ ID NO: 7286948 - DNA, 22 bp, Homo sapiens
aaggctggggtgcagacggcct

SEQ ID NO: 7286949 - DNA, 22 bp, Homo sapiens
aagctgcagatgtgcctgtgga

SEQ ID NO: 7286950 - DNA, 22 bp, Homo sapiens
acaggcaggtcctgtcccagct

SEQ ID NO: 7286951 - DNA, 22 bp, Homo sapiens
acaggcaggttgagaaacattt

SEQ ID NO: 7286952 - DNA, 22 bp, Homo sapiens
acaggcagtgggccagatttgt

SEQ ID NO: 7286953 - DNA, 22 bp, Homo sapiens
aagccaggctgcacttgctggg

SEQ ID NO: 7286954 - DNA, 22 bp, Homo sapiens
aagccaggccattctctggttc

SEQ ID NO: 7286955 - DNA, 22 bp, Homo sapiens
aagccagggattcctgagggag

SEQ ID NO: 7286956 - DNA, 22 bp, Homo sapiens
aagccaggggttggtatgctat

SEQ ID NO: 7286957 - DNA, 22 bp, Homo sapiens
aagccaggggctgcttaggaga

SEQ ID NO: 7286958 - DNA, 22 bp, Homo sapiens
aagccagggtcaggggcctcct

SEQ ID NO: 7286959 - DNA, 22 bp, Homo sapiens
aagccaggtgtttaggccagcg

SEQ ID NO: 7286960 - DNA, 22 bp, Homo sapiens
aagccaggtgttgtggtaagag

SEQ ID NO: 7286961 - DNA, 18 bp, Homo sapiens
aagccaggtcaagataag

SEQ ID NO: 7286962 - DNA, 22 bp, Homo sapiens
aagccaggtgtgcccaggatcc

SEQ ID NO: 7286963 - DNA, 22 bp, Homo sapiens
aagccagggtttgtggatctat

SEQ ID NO: 7286964 - DNA, 22 bp, Homo sapiens
acaggcagttgaggtttgtgtg

SEQ ID NO: 7286965 - DNA, 22 bp, Homo sapiens
aaggaaagacatataaatgact

SEQ ID NO: 7286966 - DNA, 22 bp, Homo sapiens
aaggcagccttttgagttgatt

SEQ ID NO: 7286967 - DNA, 22 bp, Homo sapiens
aaggcagctcagctcatggcag

SEQ ID NO: 7286968 - DNA, 22 bp, Homo sapiens
aaggcagatataaagactagag

SEQ ID NO: 7286969 - DNA, 22 bp, Homo sapiens
aaggcagagatattcttgatct

SEQ ID NO: 7286970 - DNA, 22 bp, Homo sapiens
aaggcaggtattgatgccacag

SEQ ID NO: 7286971 - DNA, 22 bp, Homo sapiens
aaggcagggaaagtggattagg

SEQ ID NO: 7286972 - DNA, 22 bp, Homo sapiens
aaggaacctgagggaccccaaa

SEQ ID NO: 7286973 - DNA, 22 bp, Homo sapiens
aaggaaccatttgtgtgcatgg

SEQ ID NO: 7286974 - DNA, 22 bp, Homo sapiens
aaggaacctggagtagagggag

SEQ ID NO: 7286975 - DNA, 19 bp, Homo sapiens
aaggaaccctgggttgctc

SEQ ID NO: 7286976 - DNA, 22 bp, Homo sapiens
aaggaacctctaagcctctgtt

SEQ ID NO: 7286977 - DNA, 19 bp, Homo sapiens
aaggcagaagttggatatg

SEQ ID NO: 7286978 - DNA, 22 bp, Homo sapiens
aaggcagaaattcaactactgg

SEQ ID NO: 7286979 - DNA, 21 bp, Homo sapiens
aaggcagaagcatggaatgag

SEQ ID NO: 7286980 - DNA, 22 bp, Homo sapiens
aaggcagaaagggatgtgagtg

SEQ ID NO: 7286981 - DNA, 22 bp, Homo sapiens
aaggaacctgggaacctatcat

SEQ ID NO: 7286982 - DNA, 22 bp, Homo sapiens
aagtcagaaattattcaggaat

SEQ ID NO: 7286983 - DNA, 22 bp, Homo sapiens
aagtcagaccttgttgatagct

SEQ ID NO: 7286984 - DNA, 22 bp, Homo sapiens
aagtcagagcaactgagacatt

SEQ ID NO: 7286985 - DNA, 22 bp, Homo sapiens
actgcctgtttggcatggcccc

SEQ ID NO: 7286986 - DNA, 22 bp, Homo sapiens
agaaaacattacataggtgtgt

SEQ ID NO: 7286987 - DNA, 22 bp, Homo sapiens
agaaaacagaaagtcattggtg

SEQ ID NO: 7286988 - DNA, 22 bp, Homo sapiens
agaaataagagctttccttggg

SEQ ID NO: 7286989 - DNA, 22 bp, Homo sapiens
agaagggaactcagagatgatt

SEQ ID NO: 7286990 - DNA, 22 bp, Homo sapiens
agaagggagagaaagttggtta

SEQ ID NO: 7286991 - DNA, 22 bp, Homo sapiens
actttaaaaagagccttctaac

SEQ ID NO: 7286992 - DNA, 22 bp, Homo sapiens
aatcaacaggatgtgcattgta

SEQ ID NO: 7286993 - DNA, 22 bp, Homo sapiens
acttgtctttgtaaaatagaaa

SEQ ID NO: 7286994 - DNA, 22 bp, Homo sapiens
acttgtgttaccaaggtttggt

SEQ ID NO: 7286995 - DNA, 19 bp, Homo sapiens
acttcttttcaacacagga

SEQ ID NO: 7286996 - DNA, 22 bp, Homo sapiens
acttgaaagaagtttccttaaa

SEQ ID NO: 7286997 - DNA, 22 bp, Homo sapiens
aaacaatgagcttttacacact

SEQ ID NO: 7286998 - DNA, 22 bp, Homo sapiens
aaagttcagtgccttctataca

SEQ ID NO: 7286999 - DNA, 22 bp, Homo sapiens
aaatgcactgaacacatgttgt

SEQ ID NO: 7287000 - DNA, 22 bp, Homo sapiens
aaattaagggtgagaagagttg

SEQ ID NO: 7287001 - DNA, 22 bp, Homo sapiens
aaattactttacactttcatct

SEQ ID NO: 7287002 - DNA, 22 bp, Homo sapiens
aaacagaagggtaggtaaacat

SEQ ID NO: 7287003 - DNA, 22 bp, Homo sapiens
aaaagacaggtgtctgcggccc

SEQ ID NO: 7287004 - DNA, 22 bp, Homo sapiens
aaaagacaggtgtctgcggccc

SEQ ID NO: 7287005 - DNA, 22 bp, Homo sapiens
aaaaatcacttttataggcagc

SEQ ID NO: 7287006 - DNA, 22 bp, Homo sapiens
aaaaatagcttctcttgtccct

SEQ ID NO: 7287007 - DNA, 22 bp, Homo sapiens
aaaaaattccattctgtgcctt

SEQ ID NO: 7287008 - DNA, 22 bp, Homo sapiens
aaaaacacaactgtctttctct

SEQ ID NO: 7287009 - DNA, 22 bp, Homo sapiens
aaaaaattatcatagttcctga

SEQ ID NO: 7287010 - DNA, 22 bp, Homo sapiens
aaaaaattatcatagttcctga

SEQ ID NO: 7287011 - DNA, 22 bp, Homo sapiens
aaaaaattccattctgtgcctt

SEQ ID NO: 7287012 - DNA, 22 bp, Homo sapiens
aaaaaagattgatggtggatgc

SEQ ID NO: 7287013 - DNA, 23 bp, Homo sapiens
aaaaaaccatgtaggcactcagt

SEQ ID NO: 7287014 - DNA, 22 bp, Homo sapiens
aaaagagaatcctgtacagaga

SEQ ID NO: 7287015 - DNA, 22 bp, Homo sapiens
aaaagagagttgccagtctgta

SEQ ID NO: 7287016 - DNA, 22 bp, Homo sapiens
aaaagagagctgaggagctcca

SEQ ID NO: 7287017 - DNA, 22 bp, Homo sapiens
aaacccagagactagaaagacc

SEQ ID NO: 7287018 - DNA, 22 bp, Homo sapiens
aaactcaagtctatgaacaagg

SEQ ID NO: 7287019 - DNA, 22 bp, Homo sapiens
aaacaagtttagaataatgaat

SEQ ID NO: 7287020 - DNA, 22 bp, Homo sapiens
aaacaagtcactttatcttgaa

SEQ ID NO: 7287021 - DNA, 22 bp, Homo sapiens
aaacaagtgtaaactagtctgt

SEQ ID NO: 7287022 - DNA, 23 bp, Homo sapiens
aaacaagtctctcaatggcttgc

SEQ ID NO: 7287023 - DNA, 22 bp, Homo sapiens
aaacaagtttgtagactagcca

SEQ ID NO: 7287024 - DNA, 22 bp, Homo sapiens
aaaatccacaacgctcatttca

SEQ ID NO: 7287025 - DNA, 22 bp, Homo sapiens
aaaatcacacaagtagatgggg

SEQ ID NO: 7287026 - DNA, 22 bp, Homo sapiens
aaagacattgaagaaggactta

SEQ ID NO: 7287027 - DNA, 23 bp, Homo sapiens
aagcacagaatggtttaggagtt

SEQ ID NO: 7287028 - DNA, 22 bp, Homo sapiens
aagcacagctggaacagcagga

SEQ ID NO: 7287029 - DNA, 22 bp, Homo sapiens
aaataactttctgtgtatagtc

SEQ ID NO: 7287030 - DNA, 22 bp, Homo sapiens
aaataactttctgtgtatagtc

SEQ ID NO: 7287031 - DNA, 22 bp, Homo sapiens
aaataatcaatttttgtagata

SEQ ID NO: 7287032 - DNA, 23 bp, Homo sapiens
aaataggagtatctggatcatga

SEQ ID NO: 7287033 - DNA, 22 bp, Homo sapiens
aaatagcagcctttagttaaca

SEQ ID NO: 7287034 - DNA, 22 bp, Homo sapiens
aactaaaactggtttgttctct

SEQ ID NO: 7287035 - DNA, 22 bp, Homo sapiens
aactaaaagtgtgtctcttgta

SEQ ID NO: 7287036 - DNA, 22 bp, Homo sapiens
aaagtacaaggaaaggatctga

SEQ ID NO: 7287037 - DNA, 22 bp, Homo sapiens
aaaggaagattgagcttttcca

SEQ ID NO: 7287038 - DNA, 22 bp, Homo sapiens
aaaggaaaataagtagttccat

SEQ ID NO: 7287039 - DNA, 22 bp, Homo sapiens
aacaaacaaacattttgtcatc

SEQ ID NO: 7287040 - DNA, 21 bp, Homo sapiens
aaattttcttggctgtagtgt

SEQ ID NO: 7287041 - DNA, 22 bp, Homo sapiens
aaattttcagagcactagagaa

SEQ ID NO: 7287042 - DNA, 22 bp, Homo sapiens
aaagatcacgtcccaggactcg

SEQ ID NO: 7287043 - DNA, 22 bp, Homo sapiens
aacagcagcatgacagctgggt

SEQ ID NO: 7287044 - DNA, 22 bp, Homo sapiens
aacaaagtttcaggaagataga

SEQ ID NO: 7287045 - DNA, 22 bp, Homo sapiens
aaattctcaagtgatcctgttg

SEQ ID NO: 7287046 - DNA, 23 bp, Homo sapiens
aacttaatactgggataagatgc

SEQ ID NO: 7287047 - DNA, 22 bp, Homo sapiens
aatgatcattataaagtgctct

SEQ ID NO: 7287048 - DNA, 22 bp, Homo sapiens
aacatgctctgtttcttggatg

SEQ ID NO: 7287049 - DNA, 22 bp, Homo sapiens
aacatgcttgcttagaatcagc

SEQ ID NO: 7287050 - DNA, 22 bp, Homo sapiens
aacatgctgcctttctacgagt

SEQ ID NO: 7287051 - DNA, 22 bp, Homo sapiens
acagagtacattcagagactat

SEQ ID NO: 7287052 - DNA, 22 bp, Homo sapiens
acagagtagctcaagaagattg

SEQ ID NO: 7287053 - DNA, 22 bp, Homo sapiens
aagccaggaagagagccttcac

SEQ ID NO: 7287054 - DNA, 22 bp, Homo sapiens
aagccaggcatgcttggacagt

SEQ ID NO: 7287055 - DNA, 22 bp, Homo sapiens
aagccaggataaagttgtttta

SEQ ID NO: 7287056 - DNA, 22 bp, Homo sapiens
aagccaggagcgaggcctcggc

SEQ ID NO: 7287057 - DNA, 22 bp, Homo sapiens
aagccaggaccaaactcatcct

SEQ ID NO: 7287058 - DNA, 22 bp, Homo sapiens
aagccaggaatggagtcttcgc

SEQ ID NO: 7287059 - DNA, 22 bp, Homo sapiens
aagccaggaagggagctgtccc

SEQ ID NO: 7287060 - DNA, 22 bp, Homo sapiens
aagcacaggatcttgaggagcg

SEQ ID NO: 7287061 - DNA, 22 bp, Homo sapiens
aagcacagtgggcagagcagcc

SEQ ID NO: 7287062 - DNA, 22 bp, Homo sapiens
acacaggggaaagtggagctga

SEQ ID NO: 7287063 - DNA, 22 bp, Homo sapiens
acacaggaaatggtttagtttt

SEQ ID NO: 7287064 - DNA, 22 bp, Homo sapiens
acacaggaactctgagaggtgg

SEQ ID NO: 7287065 - DNA, 22 bp, Homo sapiens
acacagggggcattctaggagt

SEQ ID NO: 7287066 - DNA, 22 bp, Homo sapiens
acacagggtctagagttaggcc

SEQ ID NO: 7287067 - DNA, 22 bp, Homo sapiens
acaaagcacgagtgccatggac

SEQ ID NO: 7287068 - DNA, 22 bp, Homo sapiens
aagaggaactgggggctgagtc

SEQ ID NO: 7287069 - DNA, 22 bp, Homo sapiens
aagagctggagtttgcagccct

SEQ ID NO: 7287070 - DNA, 22 bp, Homo sapiens
aagagcagtgttttactcagct

SEQ ID NO: 7287071 - DNA, 22 bp, Homo sapiens
aagaaatgcagaaatgtgctgg

SEQ ID NO: 7287072 - DNA, 22 bp, Homo sapiens
aagaaatgctgatgttggatgg

SEQ ID NO: 7287073 - DNA, 22 bp, Homo sapiens
aagaaatggcttcatctgagta

SEQ ID NO: 7287074 - DNA, 22 bp, Homo sapiens
aagaaatggaagatccatggtg

SEQ ID NO: 7287075 - DNA, 22 bp, Homo sapiens
aagaaatgcacacaactgctgg

SEQ ID NO: 7287076 - DNA, 22 bp, Homo sapiens
aacttagtttagggtattgatt

SEQ ID NO: 7287077 - DNA, 22 bp, Homo sapiens
aagaaagcattagacaggcatt

SEQ ID NO: 7287078 - DNA, 22 bp, Homo sapiens
caaaataccacgacttgtttta

SEQ ID NO: 7287079 - DNA, 22 bp, Homo sapiens
caagatttagcctgctgcctgt

SEQ ID NO: 7287080 - DNA, 22 bp, Homo sapiens
caagatttagctcccttatctc

SEQ ID NO: 7287081 - DNA, 22 bp, Homo sapiens
caagatttccaaccctgggtaa

SEQ ID NO: 7287082 - DNA, 22 bp, Homo sapiens
caagatttatattttcacacaa

SEQ ID NO: 7287083 - DNA, 22 bp, Homo sapiens
caagatttgacttcgtggtttg

SEQ ID NO: 7287084 - DNA, 22 bp, Homo sapiens
caagatttgccagtggccaact

SEQ ID NO: 7287085 - DNA, 22 bp, Homo sapiens
caagatttggcattctgaggag

SEQ ID NO: 7287086 - DNA, 22 bp, Homo sapiens
caagatttggcaactttgtcat

SEQ ID NO: 7287087 - DNA, 22 bp, Homo sapiens
caagattttatctccgtttctg

SEQ ID NO: 7287088 - DNA, 22 bp, Homo sapiens
caagatttgtattgggcctctg

SEQ ID NO: 7287089 - DNA, 22 bp, Homo sapiens
caagatttgggggcacggaatc

SEQ ID NO: 7287090 - DNA, 19 bp, Homo sapiens
caagatttgttcacacatg

SEQ ID NO: 7287091 - DNA, 22 bp, Homo sapiens
agcagcagattatggtctacat

SEQ ID NO: 7287092 - DNA, 22 bp, Homo sapiens
agcagcaggctagggaactgct

SEQ ID NO: 7287093 - DNA, 22 bp, Homo sapiens
agcaggcaggaatggtggaaca

SEQ ID NO: 7287094 - DNA, 22 bp, Homo sapiens
agcaggcagcctaggaagtgaa

SEQ ID NO: 7287095 - DNA, 22 bp, Homo sapiens
agcaggcaggaaggcagcactg

SEQ ID NO: 7287096 - DNA, 22 bp, Homo sapiens
agcaggcagctgggggagttga

SEQ ID NO: 7287097 - DNA, 22 bp, Homo sapiens
agcaggcactatgccaggatct

SEQ ID NO: 7287098 - DNA, 22 bp, Homo sapiens
agcaggcagccatttggaaggc

SEQ ID NO: 7287099 - DNA, 20 bp, Homo sapiens
agcaggctgcagggtgaaat

SEQ ID NO: 7287100 - DNA, 17 bp, Homo sapiens
agcaggctgcagaggcc

SEQ ID NO: 7287101 - DNA, 22 bp, Homo sapiens
agcaggctgatgggcatgcttg

SEQ ID NO: 7287102 - DNA, 22 bp, Homo sapiens
agcaggctgagcacccaggggg

SEQ ID NO: 7287103 - DNA, 22 bp, Homo sapiens
agcaggctccttccttctctgg

SEQ ID NO: 7287104 - DNA, 22 bp, Homo sapiens
agcaggctccaggctggccatc

SEQ ID NO: 7287105 - DNA, 22 bp, Homo sapiens
cacagtttgcataggaaaaaca

SEQ ID NO: 7287106 - DNA, 22 bp, Homo sapiens
cacacaaatattctggaggcaa

SEQ ID NO: 7287107 - DNA, 22 bp, Homo sapiens
agcaggcacaagaaagggaggt

SEQ ID NO: 7287108 - DNA, 23 bp, Homo sapiens
agcaggctgcttctccacagctg

SEQ ID NO: 7287109 - DNA, 22 bp, Homo sapiens
agcaggggctcctccacagcca

SEQ ID NO: 7287110 - DNA, 22 bp, Homo sapiens
agcaggggtaacagaaggaaag

SEQ ID NO: 7287111 - DNA, 22 bp, Homo sapiens
agcagggggagttagactagat

SEQ ID NO: 7287112 - DNA, 22 bp, Homo sapiens
agcagggggcatccttgccctt

SEQ ID NO: 7287113 - DNA, 22 bp, Homo sapiens
agcaggggtctctgctaatgaa

SEQ ID NO: 7287114 - DNA, 22 bp, Homo sapiens
agcaggggtggaaggtagcttt

SEQ ID NO: 7287115 - DNA, 22 bp, Homo sapiens
agcagggtcctgaggtgagtca

SEQ ID NO: 7287116 - DNA, 22 bp, Homo sapiens
caccctttgctgctcttcctcc

SEQ ID NO: 7287117 - DNA, 22 bp, Homo sapiens
cagaatcagtgacacatgtata

SEQ ID NO: 7287118 - DNA, 22 bp, Homo sapiens
cagagaaaaaatcctgctctca

SEQ ID NO: 7287119 - DNA, 22 bp, Homo sapiens
cagacttttgacattaatacag

SEQ ID NO: 7287120 - DNA, 22 bp, Homo sapiens
cagagaaactcagatagctgat

SEQ ID NO: 7287121 - DNA, 22 bp, Homo sapiens
cagagggagccctccaggagca

SEQ ID NO: 7287122 - DNA, 21 bp, Homo sapiens
cagaggcaggtcctgggacgg

SEQ ID NO: 7287123 - DNA, 22 bp, Homo sapiens
agcctggcactgaggcagggcg

SEQ ID NO: 7287124 - DNA, 22 bp, Homo sapiens
cagcagggcccccgggtgcgcc

SEQ ID NO: 7287125 - DNA, 22 bp, Homo sapiens
agctcagccctcctgtgcagct

SEQ ID NO: 7287126 - DNA, 22 bp, Homo sapiens
agctcaggcaactctgggcccc

SEQ ID NO: 7287127 - DNA, 22 bp, Homo sapiens
agctcagcttcctctccatgct

SEQ ID NO: 7287128 - DNA, 22 bp, Homo sapiens
agctcagcgggcttctggtaag

SEQ ID NO: 7287129 - DNA, 22 bp, Homo sapiens
agctcctgatacatgcaggaat

SEQ ID NO: 7287130 - DNA, 22 bp, Homo sapiens
cagcagggggcagcgcagatca

SEQ ID NO: 7287131 - DNA, 22 bp, Homo sapiens
atttcacagctgctgttcaggt

SEQ ID NO: 7287132 - DNA, 22 bp, Homo sapiens
agataaaatggttcaaaggcta

SEQ ID NO: 7287133 - DNA, 22 bp, Homo sapiens
agataaaatggttcaaaggcta

SEQ ID NO: 7287134 - DNA, 22 bp, Homo sapiens
atttcacagctgtcagtgttac

SEQ ID NO: 7287135 - DNA, 22 bp, Homo sapiens
agagtgggtgatctctgttgtc

SEQ ID NO: 7287136 - DNA, 18 bp, Homo sapiens
atttggcagatgatgaac

SEQ ID NO: 7287137 - DNA, 21 bp, Homo sapiens
caaaaggataggaaattaggg

SEQ ID NO: 7287138 - DNA, 22 bp, Homo sapiens
atttggagacaggatttttcag

SEQ ID NO: 7287139 - DNA, 22 bp, Homo sapiens
atttggaggcccatcccttaca

SEQ ID NO: 7287140 - DNA, 22 bp, Homo sapiens
atttggaggcctctcctgcttg

SEQ ID NO: 7287141 - DNA, 22 bp, Homo sapiens
atttggagtagggcctgggtat

SEQ ID NO: 7287142 - DNA, 22 bp, Homo sapiens
atttctctcattgttagctagg

SEQ ID NO: 7287143 - DNA, 22 bp, Homo sapiens
agagctggtttactcaggaatt

SEQ ID NO: 7287144 - DNA, 17 bp, Homo sapiens
agagggaaaatgcggtt

SEQ ID NO: 7287145 - DNA, 18 bp, Homo sapiens
agagggaaagcaggctga

SEQ ID NO: 7287146 - DNA, 22 bp, Homo sapiens
agagggaaatccaggagtgctt

SEQ ID NO: 7287147 - DNA, 22 bp, Homo sapiens
agaggcggaggttgcagtgagc

SEQ ID NO: 7287148 - DNA, 22 bp, Homo sapiens
agaggcggagcttgcagtgagc

SEQ ID NO: 7287149 - DNA, 22 bp, Homo sapiens
attcatttaggtattcacttac

SEQ ID NO: 7287150 - DNA, 23 bp, Homo sapiens
agagacatttggatacagaaaca

SEQ ID NO: 7287151 - DNA, 22 bp, Homo sapiens
agagaagcattcttctcagggc

SEQ ID NO: 7287152 - DNA, 22 bp, Homo sapiens
agagaagcagggagtcatctgt

SEQ ID NO: 7287153 - DNA, 22 bp, Homo sapiens
agagccagcaactctagccctg

SEQ ID NO: 7287154 - DNA, 22 bp, Homo sapiens
atgtggggactctgagagaatt

SEQ ID NO: 7287155 - DNA, 22 bp, Homo sapiens
agagatgaatcttgagactctg

SEQ ID NO: 7287156 - DNA, 22 bp, Homo sapiens
agaagtcaccctgttgctgtga

SEQ ID NO: 7287157 - DNA, 22 bp, Homo sapiens
atgacaagggttgacacatgtc

SEQ ID NO: 7287158 - DNA, 22 bp, Homo sapiens
atgacaagggagggtcctgcta

SEQ ID NO: 7287159 - DNA, 22 bp, Homo sapiens
atgacaagagtgttcagggaga

SEQ ID NO: 7287160 - DNA, 22 bp, Homo sapiens
agacagcatttctagcaccagg

SEQ ID NO: 7287161 - DNA, 22 bp, Homo sapiens
acctgagagctataaggtttta

SEQ ID NO: 7287162 - DNA, 22 bp, Homo sapiens
acctgagacctaatctgactgt

SEQ ID NO: 7287163 - DNA, 22 bp, Homo sapiens
acctctttgaacctcagtgtga

SEQ ID NO: 7287164 - DNA, 22 bp, Homo sapiens
acctgagaatgggggcatgtgt

SEQ ID NO: 7287165 - DNA, 22 bp, Homo sapiens
acctggcacacactggggagtg

SEQ ID NO: 7287166 - DNA, 22 bp, Homo sapiens
acctggcactacaggcacctgt

SEQ ID NO: 7287167 - DNA, 22 bp, Homo sapiens
agtaaaatcaccatctctttgt

SEQ ID NO: 7287168 - DNA, 22 bp, Homo sapiens
agtggcagtagatgagctggtt

SEQ ID NO: 7287169 - DNA, 22 bp, Homo sapiens
agtggcagtggctgggcagagc

SEQ ID NO: 7287170 - DNA, 22 bp, Homo sapiens
agtgcagtgatgaataatggtt

SEQ ID NO: 7287171 - DNA, 22 bp, Homo sapiens
agtgcaggttaaggaactggcc

SEQ ID NO: 7287172 - DNA, 22 bp, Homo sapiens
actgaggatggataggtcatat

SEQ ID NO: 7287173 - DNA, 22 bp, Homo sapiens
actgaggattagcccaggctag

SEQ ID NO: 7287174 - DNA, 22 bp, Homo sapiens
agtcttgcattttctgaagatg

SEQ ID NO: 7287175 - DNA, 23 bp, Homo sapiens
actttcccatagcatggcttcct

SEQ ID NO: 7287176 - DNA, 22 bp, Homo sapiens
atattacataaacatgagtgaa

SEQ ID NO: 7287177 - DNA, 22 bp, Homo sapiens
agaaaataaattgatggtggaa

SEQ ID NO: 7287178 - DNA, 22 bp, Homo sapiens
agaaaagtgctctagtgagagc

SEQ ID NO: 7287179 - DNA, 22 bp, Homo sapiens
actgggaagatggaggcaagca

SEQ ID NO: 7287180 - DNA, 22 bp, Homo sapiens
actgtgcatctattgccattta

SEQ ID NO: 7287181 - DNA, 22 bp, Homo sapiens
atactgaaggcattcagataac

SEQ ID NO: 7287182 - DNA, 22 bp, Homo sapiens
acaggggcaggcaggacccttt

SEQ ID NO: 7287183 - DNA, 22 bp, Homo sapiens
aggaagaacagataatggacgc

SEQ ID NO: 7287184 - DNA, 22 bp, Homo sapiens
acaggcaggcgggacagcccga

SEQ ID NO: 7287185 - DNA, 22 bp, Homo sapiens
acaggcaggcttcggccagagc

SEQ ID NO: 7287186 - DNA, 21 bp, Homo sapiens
agctggcaatgttgtcctctt

SEQ ID NO: 7287187 - DNA, 22 bp, Homo sapiens
agctggcaatgtaagtccctgg

SEQ ID NO: 7287188 - DNA, 23 bp, Homo sapiens
acaggaggggacaggtggccgtg

SEQ ID NO: 7287189 - DNA, 22 bp, Homo sapiens
acaggatcgccctgttgcccag

SEQ ID NO: 7287190 - DNA, 22 bp, Homo sapiens
aggcagctaagatggataatga

SEQ ID NO: 7287191 - DNA, 22 bp, Homo sapiens
acatatttccatgcagcatgtc

SEQ ID NO: 7287192 - DNA, 21 bp, Homo sapiens
aggacacagagacacctattg

SEQ ID NO: 7287193 - DNA, 22 bp, Homo sapiens
aggccagggtagggcccattgt

SEQ ID NO: 7287194 - DNA, 22 bp, Homo sapiens
aggccagggcactgctctttag

SEQ ID NO: 7287195 - DNA, 22 bp, Homo sapiens
aggctgaggagggatgttgctt

SEQ ID NO: 7287196 - DNA, 22 bp, Homo sapiens
aggctgagctggtagtgagtac

SEQ ID NO: 7287197 - DNA, 22 bp, Homo sapiens
aggggcctggcactgagctggc

SEQ ID NO: 7287198 - DNA, 22 bp, Homo sapiens
accctccactttatctgtcttt

SEQ ID NO: 7287199 - DNA, 20 bp, Homo sapiens
accctccactgttcactgtg

SEQ ID NO: 7287200 - DNA, 21 bp, Homo sapiens
aggctttacctctgggtaggt

SEQ ID NO: 7287201 - DNA, 22 bp, Homo sapiens
aggcttggtgccaaggagcctg

SEQ ID NO: 7287202 - DNA, 20 bp, Homo sapiens
aggcttggcttggcaggaac

SEQ ID NO: 7287203 - DNA, 22 bp, Homo sapiens
accagcagctgccagagtggag

SEQ ID NO: 7287204 - DNA, 22 bp, Homo sapiens
accagcagttatgaggccagga

SEQ ID NO: 7287205 - DNA, 22 bp, Homo sapiens
accagcagggctgggccaatgg

SEQ ID NO: 7287206 - DNA, 22 bp, Homo sapiens
accagccagccacagtggctcc

SEQ ID NO: 7287207 - DNA, 22 bp, Homo sapiens
accagccaccaccaggagatcg

SEQ ID NO: 7287208 - DNA, 22 bp, Homo sapiens
caggtgggagcgaggagctact

SEQ ID NO: 7287209 - DNA, 22 bp, Homo sapiens
caggtgggagcgaggagctact

SEQ ID NO: 7287210 - DNA, 22 bp, Homo sapiens
caggtggcttctctgcagcctt

SEQ ID NO: 7287211 - DNA, 22 bp, Homo sapiens
cagtggcctttcctgctgctca

SEQ ID NO: 7287212 - DNA, 22 bp, Homo sapiens
aggagaaggaggcccctcacac

SEQ ID NO: 7287213 - DNA, 22 bp, Homo sapiens
aggagggagcttaagccaggca

SEQ ID NO: 7287214 - DNA, 22 bp, Homo sapiens
aggaggctgtggagcactccat

SEQ ID NO: 7287215 - DNA, 22 bp, Homo sapiens
catatttagtgtttggagatcg

SEQ ID NO: 7287216 - DNA, 23 bp, Homo sapiens
cagtggtcagaacgtgggagggt

SEQ ID NO: 7287217 - DNA, 17 bp, Homo sapiens
cagtggtctgaggtatg

SEQ ID NO: 7287218 - DNA, 22 bp, Homo sapiens
cattaaaatatctcatggtgtt

SEQ ID NO: 7287219 - DNA, 21 bp, Homo sapiens
aggcagcaggatccagggaca

SEQ ID NO: 7287220 - DNA, 19 bp, Homo sapiens
aggcagcaggccagggatg

SEQ ID NO: 7287221 - DNA, 23 bp, Homo sapiens
aggcagcaggttgtccagggtga

SEQ ID NO: 7287222 - DNA, 22 bp, Homo sapiens
ccaatacttagattaaaatagt

SEQ ID NO: 7287223 - DNA, 22 bp, Homo sapiens
catgggcttgctctctgagctc

SEQ ID NO: 7287224 - DNA, 22 bp, Homo sapiens
catgggctgctgacaggggctc

SEQ ID NO: 7287225 - DNA, 22 bp, Homo sapiens
catgggctgtgaacccaggctg

SEQ ID NO: 7287226 - DNA, 22 bp, Homo sapiens
catgggctttggaggctggagg

SEQ ID NO: 7287227 - DNA, 22 bp, Homo sapiens
catgggctgaaaatctgcaaac

SEQ ID NO: 7287228 - DNA, 19 bp, Homo sapiens
catggtgaaaccccgtctc

SEQ ID NO: 7287229 - DNA, 21 bp, Homo sapiens
aggagggcacaaggccaggaa

SEQ ID NO: 7287230 - DNA, 22 bp, Homo sapiens
catggaattttctaggcataaa

SEQ ID NO: 7287231 - DNA, 22 bp, Homo sapiens
catggaatgtgagttgtttagt

SEQ ID NO: 7287232 - DNA, 22 bp, Homo sapiens
catggcagagaaggggaactgg

SEQ ID NO: 7287233 - DNA, 22 bp, Homo sapiens
catggcagaaacctgagctgct

SEQ ID NO: 7287234 - DNA, 22 bp, Homo sapiens
caggggctgaaatgttggggtt

SEQ ID NO: 7287235 - DNA, 22 bp, Homo sapiens
cagggctcccttgcaaggaggg

SEQ ID NO: 7287236 - DNA, 22 bp, Homo sapiens
cagggctccccagagagcctct

SEQ ID NO: 7287237 - DNA, 22 bp, Homo sapiens
cagggctctgccttgagggatg

SEQ ID NO: 7287238 - DNA, 22 bp, Homo sapiens
cagggctcgctcttgcccttcg

SEQ ID NO: 7287239 - DNA, 22 bp, Homo sapiens
cagggcctgagggctgctctgc

SEQ ID NO: 7287240 - DNA, 22 bp, Homo sapiens
caggctggagtgcagttgtgca

SEQ ID NO: 7287241 - DNA, 22 bp, Homo sapiens
caggctggagttacctttaggg

SEQ ID NO: 7287242 - DNA, 22 bp, Homo sapiens
caggctggagtacaattgtgtg

SEQ ID NO: 7287243 - DNA, 22 bp, Homo sapiens
caggctggagtgcagtgtcgcc

SEQ ID NO: 7287244 - DNA, 22 bp, Homo sapiens
caggctggacattagatacata

SEQ ID NO: 7287245 - DNA, 22 bp, Homo sapiens
cagggagctctgggccggactc

SEQ ID NO: 7287246 - DNA, 22 bp, Homo sapiens
caggctcagatgccctgcgctg

SEQ ID NO: 7287247 - DNA, 22 bp, Homo sapiens
agctgggctgggctgagctgag

SEQ ID NO: 7287248 - DNA, 22 bp, Homo sapiens
agctgggcttggccaggtcgct

SEQ ID NO: 7287249 - DNA, 22 bp, Homo sapiens
agctggcctccgggtgcctggg

SEQ ID NO: 7287250 - DNA, 22 bp, Homo sapiens
agctggccggcctccaggtgga

SEQ ID NO: 7287251 - DNA, 22 bp, Homo sapiens
agctggccattgtgagtggcct

SEQ ID NO: 7287252 - DNA, 20 bp, Homo sapiens
agctggcccccggtggcctg

SEQ ID NO: 7287253 - DNA, 20 bp, Homo sapiens
agctggcccacaggtgtggg

SEQ ID NO: 7287254 - DNA, 22 bp, Homo sapiens
caggaggacatactggctcaca

SEQ ID NO: 7287255 - DNA, 22 bp, Homo sapiens
caggaggaggtgaggtagaact

SEQ ID NO: 7287256 - DNA, 22 bp, Homo sapiens
caggaggattgcttgaggccag

SEQ ID NO: 7287257 - DNA, 22 bp, Homo sapiens
caggaagagaacatggaggctg

SEQ ID NO: 7287258 - DNA, 22 bp, Homo sapiens
ccagggtcttggagaggagtgc

SEQ ID NO: 7287259 - DNA, 17 bp, Homo sapiens
aggctggctcacaggga

SEQ ID NO: 7287260 - DNA, 17 bp, Homo sapiens
aggctggctcacaggga

SEQ ID NO: 7287261 - DNA, 22 bp, Homo sapiens
aggctggctgacttctgaagca

SEQ ID NO: 7287262 - DNA, 22 bp, Homo sapiens
aggctggctgaaaaacaccctt

SEQ ID NO: 7287263 - DNA, 22 bp, Homo sapiens
aggctggctcggcttttctgtc

SEQ ID NO: 7287264 - DNA, 22 bp, Homo sapiens
ccatgtggctagcgtgcctgca

SEQ ID NO: 7287265 - DNA, 20 bp, Homo sapiens
aggctgcctaaggctctgca

SEQ ID NO: 7287266 - DNA, 22 bp, Homo sapiens
ccatgtacatgaacacggcggc

SEQ ID NO: 7287267 - DNA, 22 bp, Homo sapiens
ccatgggctggctgccttatca

SEQ ID NO: 7287268 - DNA, 22 bp, Homo sapiens
ccatgggcgcacaggcctggag

SEQ ID NO: 7287269 - DNA, 22 bp, Homo sapiens
aggctgaggtgtgctgtgatcg

SEQ ID NO: 7287270 - DNA, 22 bp, Homo sapiens
aggctgaggggcgagggaccct

SEQ ID NO: 7287271 - DNA, 22 bp, Homo sapiens
aggccagagttaaggagaacag

SEQ ID NO: 7287272 - DNA, 19 bp, Homo sapiens
ccagctggcctgggacctc

SEQ ID NO: 7287273 - DNA, 22 bp, Homo sapiens
aggcagggtcttgctatgttgc

SEQ ID NO: 7287274 - DNA, 22 bp, Homo sapiens
aggcagggtgatgataatgatt

SEQ ID NO: 7287275 - DNA, 22 bp, Homo sapiens
aggcatggacatttcggcagct

SEQ ID NO: 7287276 - DNA, 22 bp, Homo sapiens
aggcatggcactgagcagcttc

SEQ ID NO: 7287277 - DNA, 22 bp, Homo sapiens
aggcatggatgtagcagtgacc

SEQ ID NO: 7287278 - DNA, 18 bp, Homo sapiens
cctctgccatagccagca

SEQ ID NO: 7287279 - DNA, 22 bp, Homo sapiens
cctctgggcaggtagcagcagc

SEQ ID NO: 7287280 - DNA, 19 bp, Homo sapiens
cctcctgctagatatgcaa

SEQ ID NO: 7287281 - DNA, 22 bp, Homo sapiens
cctcctgcacttgctttccttc

SEQ ID NO: 7287282 - DNA, 22 bp, Homo sapiens
aggggagaaaaatgccttctgt

SEQ ID NO: 7287283 - DNA, 22 bp, Homo sapiens
aggggagaatttcaactcaggt

SEQ ID NO: 7287284 - DNA, 22 bp, Homo sapiens
aggggagactggaatctaacat

SEQ ID NO: 7287285 - DNA, 22 bp, Homo sapiens
aggggagaggtgagcaacttct

SEQ ID NO: 7287286 - DNA, 22 bp, Homo sapiens
aggggagagaacataaggaagt

SEQ ID NO: 7287287 - DNA, 17 bp, Homo sapiens
aggggagagtgggaaga

SEQ ID NO: 7287288 - DNA, 22 bp, Homo sapiens
cctgagagtgcgtgcctcctta

SEQ ID NO: 7287289 - DNA, 22 bp, Homo sapiens
aggggagagttaatgtgaatgt

SEQ ID NO: 7287290 - DNA, 22 bp, Homo sapiens
aggggctgggacagagccaagc

SEQ ID NO: 7287291 - DNA, 18 bp, Homo sapiens
agggctctctgctgggtt

SEQ ID NO: 7287292 - DNA, 22 bp, Homo sapiens
agggctcattgacatggaaaag

SEQ ID NO: 7287293 - DNA, 22 bp, Homo sapiens
agggccctagggaatgagacat

SEQ ID NO: 7287294 - DNA, 22 bp, Homo sapiens
ccctttcctgaagaatattttt

SEQ ID NO: 7287295 - DNA, 22 bp, Homo sapiens
ccctttcccttctggctcaggg

SEQ ID NO: 7287296 - DNA, 22 bp, Homo sapiens
ccgaggctggagtgcagtggcg

SEQ ID NO: 7287297 - DNA, 22 bp, Homo sapiens
agggcagagatctgagtgggca

SEQ ID NO: 7287298 - DNA, 22 bp, Homo sapiens
agggcagagagatgaatgggat

SEQ ID NO: 7287299 - DNA, 23 bp, Homo sapiens
cccaggagtttcactgcaaaggt

SEQ ID NO: 7287300 - DNA, 22 bp, Homo sapiens
cccagggctgcagatggaggct

SEQ ID NO: 7287301 - DNA, 19 bp, Homo sapiens
aggcttggaacagccttat

SEQ ID NO: 7287302 - DNA, 22 bp, Homo sapiens
cccaggagttggaggctacggt

SEQ ID NO: 7287303 - DNA, 21 bp, Homo sapiens
aggcttggatctagacaggcc

SEQ ID NO: 7287304 - DNA, 22 bp, Homo sapiens
aggcttctctgcaagatgttaa

SEQ ID NO: 7287305 - DNA, 22 bp, Homo sapiens
aggcttctgtctttaggagttg

SEQ ID NO: 7287306 - DNA, 22 bp, Homo sapiens
aggcttctccacataaagttac

SEQ ID NO: 7287307 - DNA, 22 bp, Homo sapiens
aggcttctacgtggtcccaggg

SEQ ID NO: 7287308 - DNA, 22 bp, Homo sapiens
aggctggctggcaggggacaca

SEQ ID NO: 7287309 - DNA, 22 bp, Homo sapiens
aggctggctgagctgcagcctg

SEQ ID NO: 7287310 - DNA, 22 bp, Homo sapiens
aggctggctgagctgcagcctg

SEQ ID NO: 7287311 - DNA, 22 bp, Homo sapiens
aggcttcacctgcacctgagct

SEQ ID NO: 7287312 - DNA, 22 bp, Homo sapiens
ctgggctgtcccagggcggcag

SEQ ID NO: 7287313 - DNA, 22 bp, Homo sapiens
ctggggatgggacctggcataa

SEQ ID NO: 7287314 - DNA, 22 bp, Homo sapiens
ctggtggggagtcctggtctcc

SEQ ID NO: 7287315 - DNA, 22 bp, Homo sapiens
ctggtgctgtagcctgattgag

SEQ ID NO: 7287316 - DNA, 22 bp, Homo sapiens
atagtcttcagcactttgatca

SEQ ID NO: 7287317 - DNA, 22 bp, Homo sapiens
atagtcagtgtctatatcgttg

SEQ ID NO: 7287318 - DNA, 22 bp, Homo sapiens
atagtacatgggtgtcctcaca

SEQ ID NO: 7287319 - DNA, 22 bp, Homo sapiens
atagtacagcatttttcctgag

SEQ ID NO: 7287320 - DNA, 22 bp, Homo sapiens
ctgggccagggaggtgtctgta

SEQ ID NO: 7287321 - DNA, 22 bp, Homo sapiens
ctgggccagttatgtctcatct

SEQ ID NO: 7287322 - DNA, 22 bp, Homo sapiens
ctgggccatctcctttgtgtgg

SEQ ID NO: 7287323 - DNA, 17 bp, Homo sapiens
ctgggcctctgcccttt

SEQ ID NO: 7287324 - DNA, 22 bp, Homo sapiens
ctgggccatggaagtctctgcc

SEQ ID NO: 7287325 - DNA, 22 bp, Homo sapiens
ctgggctgtaatgtggcactga

SEQ ID NO: 7287326 - DNA, 22 bp, Homo sapiens
ctgggctgcagcgggagcgacg

SEQ ID NO: 7287327 - DNA, 22 bp, Homo sapiens
ctgggctgcagcgggagcgacg

SEQ ID NO: 7287328 - DNA, 22 bp, Homo sapiens
ctgggcctggggctgttgagag

SEQ ID NO: 7287329 - DNA, 22 bp, Homo sapiens
ctgggcctgagctctgaagagt

SEQ ID NO: 7287330 - DNA, 19 bp, Homo sapiens
ctgggcctgcatggttgtt

SEQ ID NO: 7287331 - DNA, 22 bp, Homo sapiens
ctgggcctgccaccatcttagg

SEQ ID NO: 7287332 - DNA, 22 bp, Homo sapiens
ctgggcctggacgggcagatct

SEQ ID NO: 7287333 - DNA, 22 bp, Homo sapiens
ctgggcctgggaggccaggtct

SEQ ID NO: 7287334 - DNA, 22 bp, Homo sapiens
ctgggcctggagcccacgagcc

SEQ ID NO: 7287335 - DNA, 22 bp, Homo sapiens
atccttctccaaaactggctcc

SEQ ID NO: 7287336 - DNA, 22 bp, Homo sapiens
ctgtgtccccctcagccaggtg

SEQ ID NO: 7287337 - DNA, 22 bp, Homo sapiens
ctgtgccttggcgctgtgccac

SEQ ID NO: 7287338 - DNA, 22 bp, Homo sapiens
ctgtgcctttgtagctgtgcct

SEQ ID NO: 7287339 - DNA, 22 bp, Homo sapiens
ctgtgtccaatggccttagcag

SEQ ID NO: 7287340 - DNA, 22 bp, Homo sapiens
atacatctctttgaagtgcttt

SEQ ID NO: 7287341 - DNA, 22 bp, Homo sapiens
ataatgtttttgtataagcatg

SEQ ID NO: 7287342 - DNA, 22 bp, Homo sapiens
ctggccaggcttgggacagaca

SEQ ID NO: 7287343 - DNA, 22 bp, Homo sapiens
ctggccagggtgcgatcgtggt

SEQ ID NO: 7287344 - DNA, 22 bp, Homo sapiens
ctggccagtgcctgtgggcccc

SEQ ID NO: 7287345 - DNA, 22 bp, Homo sapiens
atagtacagatccattaattat

SEQ ID NO: 7287346 - DNA, 22 bp, Homo sapiens
atagtacagagggctactggtt

SEQ ID NO: 7287347 - DNA, 22 bp, Homo sapiens
atagtacacatcctacaatgtt

SEQ ID NO: 7287348 - DNA, 22 bp, Homo sapiens
atagtacaagggaagagtgaag

SEQ ID NO: 7287349 - DNA, 22 bp, Homo sapiens
atagtacaatcagttaattagt

SEQ ID NO: 7287350 - DNA, 20 bp, Homo sapiens
atagacaaagacatgccaga

SEQ ID NO: 7287351 - DNA, 22 bp, Homo sapiens
atagacaatcccccatcctacc

SEQ ID NO: 7287352 - DNA, 22 bp, Homo sapiens
atagacaacacttattattcct

SEQ ID NO: 7287353 - DNA, 18 bp, Homo sapiens
ctgcctgctctccagctt

SEQ ID NO: 7287354 - DNA, 22 bp, Homo sapiens
ctgcctgctgcctgtggagggt

SEQ ID NO: 7287355 - DNA, 22 bp, Homo sapiens
ctgcctgcttttctgggagccg

SEQ ID NO: 7287356 - DNA, 22 bp, Homo sapiens
ctgccctgtctgcagcctggct

SEQ ID NO: 7287357 - DNA, 22 bp, Homo sapiens
ctgccctgtctttttctgatga

SEQ ID NO: 7287358 - DNA, 22 bp, Homo sapiens
ctgccctgtgagggtccttggg

SEQ ID NO: 7287359 - DNA, 22 bp, Homo sapiens
ctgccctgtggctctgagtcat

SEQ ID NO: 7287360 - DNA, 22 bp, Homo sapiens
agttttctgcctctggatgcgt

SEQ ID NO: 7287361 - DNA, 22 bp, Homo sapiens
agttttcttcattttgtggcca

SEQ ID NO: 7287362 - DNA, 22 bp, Homo sapiens
ctgccctcgggccctcccatag

SEQ ID NO: 7287363 - DNA, 22 bp, Homo sapiens
ctgccctcccagttggtccgtg

SEQ ID NO: 7287364 - DNA, 22 bp, Homo sapiens
ctgccctctagggatgcactgg

SEQ ID NO: 7287365 - DNA, 22 bp, Homo sapiens
ctgccctctagaggaggactga

SEQ ID NO: 7287366 - DNA, 22 bp, Homo sapiens
ctgccctggtcccatggctgat

SEQ ID NO: 7287367 - DNA, 22 bp, Homo sapiens
ctgccctgactgaccttttgaa

SEQ ID NO: 7287368 - DNA, 22 bp, Homo sapiens
ctgagaggatgctgcagtggag

SEQ ID NO: 7287369 - DNA, 22 bp, Homo sapiens
agtggcaggcggagatgtagga

SEQ ID NO: 7287370 - DNA, 17 bp, Homo sapiens
agtggcaggcagatggg

SEQ ID NO: 7287371 - DNA, 19 bp, Homo sapiens
agtgcagggagcaccctca

SEQ ID NO: 7287372 - DNA, 22 bp, Homo sapiens
agtgcaggctcgcttgtgaggc

SEQ ID NO: 7287373 - DNA, 22 bp, Homo sapiens
agtgcaggctcgcttgtgaggc

SEQ ID NO: 7287374 - DNA, 22 bp, Homo sapiens
agtgcaggccccaggccaggcc

SEQ ID NO: 7287375 - DNA, 22 bp, Homo sapiens
agtgggctggtggcagggagaa

SEQ ID NO: 7287376 - DNA, 22 bp, Homo sapiens
agtgggcttttttccgttccat

SEQ ID NO: 7287377 - DNA, 22 bp, Homo sapiens
agtgggcttactgagggagtgt

SEQ ID NO: 7287378 - DNA, 22 bp, Homo sapiens
agtgggccaaatggaggcaagt

SEQ ID NO: 7287379 - DNA, 22 bp, Homo sapiens
agtgggccttagaaggttccct

SEQ ID NO: 7287380 - DNA, 22 bp, Homo sapiens
agtgggctgagcttgctgggtg

SEQ ID NO: 7287381 - DNA, 22 bp, Homo sapiens
ctctgacttatcggagaagtcc

SEQ ID NO: 7287382 - DNA, 22 bp, Homo sapiens
agtgcagagacctggtcaggca

SEQ ID NO: 7287383 - DNA, 22 bp, Homo sapiens
agtgcagaggctgggaaatgct

SEQ ID NO: 7287384 - DNA, 22 bp, Homo sapiens
agtgcagatttttagtcagctt

SEQ ID NO: 7287385 - DNA, 21 bp, Homo sapiens
ctcccagggtgactgttcaac

SEQ ID NO: 7287386 - DNA, 22 bp, Homo sapiens
agtgcaggagcctggccagagc

SEQ ID NO: 7287387 - DNA, 22 bp, Homo sapiens
ctcctctccatcagcgccaccc

SEQ ID NO: 7287388 - DNA, 19 bp, Homo sapiens
agtcatattgttcatcttg

SEQ ID NO: 7287389 - DNA, 22 bp, Homo sapiens
agtcatatggctatttagtggg

SEQ ID NO: 7287390 - DNA, 22 bp, Homo sapiens
agtccaaagcagatgagggcca

SEQ ID NO: 7287391 - DNA, 22 bp, Homo sapiens
agtctctcacagaggattctcc

SEQ ID NO: 7287392 - DNA, 22 bp, Homo sapiens
agtctctccacattgttataaa

SEQ ID NO: 7287393 - DNA, 20 bp, Homo sapiens
agtctctcccagaatgagca

SEQ ID NO: 7287394 - DNA, 22 bp, Homo sapiens
agtctctctcctcgtggtaacc

SEQ ID NO: 7287395 - DNA, 21 bp, Homo sapiens
agtctctctaataaatgcttg

SEQ ID NO: 7287396 - DNA, 22 bp, Homo sapiens
ctcaggcacttttgtcacagac

SEQ ID NO: 7287397 - DNA, 22 bp, Homo sapiens
aggttggcctcagggaggctct

SEQ ID NO: 7287398 - DNA, 22 bp, Homo sapiens
aggtgtctgggctttggagtca

SEQ ID NO: 7287399 - DNA, 19 bp, Homo sapiens
aggtgtgggggctgcagac

SEQ ID NO: 7287400 - DNA, 21 bp, Homo sapiens
aggtttctcttttatggaggg

SEQ ID NO: 7287401 - DNA, 21 bp, Homo sapiens
agtacaaaaattcctttctca

SEQ ID NO: 7287402 - DNA, 22 bp, Homo sapiens
agtacaaaggcccttgattact

SEQ ID NO: 7287403 - DNA, 22 bp, Homo sapiens
agtacaaactgtttcaaagtag

SEQ ID NO: 7287404 - DNA, 22 bp, Homo sapiens
agtacaaaatgcagcatcatca

SEQ ID NO: 7287405 - DNA, 22 bp, Homo sapiens
agtacaaattatagcgcttgga

SEQ ID NO: 7287406 - DNA, 22 bp, Homo sapiens
agtacaaatgcagccagagtag

SEQ ID NO: 7287407 - DNA, 22 bp, Homo sapiens
agtacaaagtgctcctggttct

SEQ ID NO: 7287408 - DNA, 22 bp, Homo sapiens
cgcggtggcggcctccagcgcc

SEQ ID NO: 7287409 - DNA, 22 bp, Homo sapiens
cgtgccctgcgcaagtgctgct

SEQ ID NO: 7287410 - DNA, 22 bp, Homo sapiens
agtcagttaaactttgtaaagt

SEQ ID NO: 7287411 - DNA, 22 bp, Homo sapiens
agtcagggcctggcctgctgaa

SEQ ID NO: 7287412 - DNA, 18 bp, Homo sapiens
agtcagttgatggggacc

SEQ ID NO: 7287413 - DNA, 19 bp, Homo sapiens
agtcagttctgaggaggaa

SEQ ID NO: 7287414 - DNA, 22 bp, Homo sapiens
agtcagttaacctcacagcatc

SEQ ID NO: 7287415 - DNA, 22 bp, Homo sapiens
agtcagttcatggctctgtcct

SEQ ID NO: 7287416 - DNA, 22 bp, Homo sapiens
agtcagttgcaaacatcaggca

SEQ ID NO: 7287417 - DNA, 22 bp, Homo sapiens
agtcagttgcagtttatggatg

SEQ ID NO: 7287418 - DNA, 22 bp, Homo sapiens
agtcagttgtggagatttaact

SEQ ID NO: 7287419 - DNA, 22 bp, Homo sapiens
agtcagttttcttaaagggaag

SEQ ID NO: 7287420 - DNA, 22 bp, Homo sapiens
agtcagttttctccagggggct

SEQ ID NO: 7287421 - DNA, 22 bp, Homo sapiens
agtcagttttaccaatctcagt

SEQ ID NO: 7287422 - DNA, 22 bp, Homo sapiens
agtcagtttccctggaaagcag

SEQ ID NO: 7287423 - DNA, 21 bp, Homo sapiens
ctacactgtgttagaaaatgg

SEQ ID NO: 7287424 - DNA, 22 bp, Homo sapiens
ctacactgagagctcttcaggg

SEQ ID NO: 7287425 - DNA, 22 bp, Homo sapiens
cctgggcagggctggactctca

SEQ ID NO: 7287426 - DNA, 22 bp, Homo sapiens
cctgggcagggagaccaggctc

SEQ ID NO: 7287427 - DNA, 22 bp, Homo sapiens
cctgggcaggccggacgctggg

SEQ ID NO: 7287428 - DNA, 22 bp, Homo sapiens
cctgggcaggatgggcccggtg

SEQ ID NO: 7287429 - DNA, 22 bp, Homo sapiens
aggtgagggtgccagtgcatgg

SEQ ID NO: 7287430 - DNA, 22 bp, Homo sapiens
cctgcctgctttctgctttgca

SEQ ID NO: 7287431 - DNA, 22 bp, Homo sapiens
cctgcctgcgtcctctgagggc

SEQ ID NO: 7287432 - DNA, 22 bp, Homo sapiens
cctgcctgcgtcctctgagggc

SEQ ID NO: 7287433 - DNA, 22 bp, Homo sapiens
cctggccagccagggctggggt

SEQ ID NO: 7287434 - DNA, 22 bp, Homo sapiens
cctggcctttgaacgctagact

SEQ ID NO: 7287435 - DNA, 21 bp, Homo sapiens
gagtgggctgagatggggctg

SEQ ID NO: 7287436 - DNA, 22 bp, Homo sapiens
gatgtcttgttgatttcattct

SEQ ID NO: 7287437 - DNA, 22 bp, Homo sapiens
gcaccatgatggagcctcatta

SEQ ID NO: 7287438 - DNA, 22 bp, Homo sapiens
attctcttctgatgtcttgcca

SEQ ID NO: 7287439 - DNA, 22 bp, Homo sapiens
gcagctgttcagctggccagat

SEQ ID NO: 7287440 - DNA, 22 bp, Homo sapiens
gcaggcaggagcccaactgcct

SEQ ID NO: 7287441 - DNA, 20 bp, Homo sapiens
gcaggcagggaatgggggtg

SEQ ID NO: 7287442 - DNA, 22 bp, Homo sapiens
gcaggcaggcttccttgaactg

SEQ ID NO: 7287443 - DNA, 22 bp, Homo sapiens
attccaccttctacctgggaga

SEQ ID NO: 7287444 - DNA, 20 bp, Homo sapiens
gcagggcatcttggccccca

SEQ ID NO: 7287445 - DNA, 22 bp, Homo sapiens
gcagggcatccctgagcgggtg

SEQ ID NO: 7287446 - DNA, 22 bp, Homo sapiens
gcagggcatagaggcacggagg

SEQ ID NO: 7287447 - DNA, 22 bp, Homo sapiens
gcagggcagtgtgtctgtgggg

SEQ ID NO: 7287448 - DNA, 22 bp, Homo sapiens
gcagggcaaacccaggtgttca

SEQ ID NO: 7287449 - DNA, 22 bp, Homo sapiens
gcaggcaggtggcatcttgtga

SEQ ID NO: 7287450 - DNA, 22 bp, Homo sapiens
gcatccaaaccattcatcagcc

SEQ ID NO: 7287451 - DNA, 22 bp, Homo sapiens
gcatggcagaacacctcgcccg

SEQ ID NO: 7287452 - DNA, 22 bp, Homo sapiens
caaaagcaaagtccctgaatgt

SEQ ID NO: 7287453 - DNA, 20 bp, Homo sapiens
caaaagcaatgaagttatga

SEQ ID NO: 7287454 - DNA, 22 bp, Homo sapiens
caaaagcagcaagtttatatgt

SEQ ID NO: 7287455 - DNA, 22 bp, Homo sapiens
attttgcacactatgcagcttt

SEQ ID NO: 7287456 - DNA, 22 bp, Homo sapiens
caaagacacgggaaacaacgtt

SEQ ID NO: 7287457 - DNA, 22 bp, Homo sapiens
caaagaatcactcatctttagc

SEQ ID NO: 7287458 - DNA, 22 bp, Homo sapiens
gctctgctgtcttcttgcaggc

SEQ ID NO: 7287459 - DNA, 22 bp, Homo sapiens
attttcagttgaaaaagttggt

SEQ ID NO: 7287460 - DNA, 22 bp, Homo sapiens
gcctgtgctgttccctctgcca

SEQ ID NO: 7287461 - DNA, 22 bp, Homo sapiens
attttccttctaagaggaaggt

SEQ ID NO: 7287462 - DNA, 22 bp, Homo sapiens
atttgggaattatttgcctaat

SEQ ID NO: 7287463 - DNA, 22 bp, Homo sapiens
atttgggagttgctagtgagtt

SEQ ID NO: 7287464 - DNA, 20 bp, Homo sapiens
atttgggacgattggccacc

SEQ ID NO: 7287465 - DNA, 22 bp, Homo sapiens
atttggggctcaccagggctga

SEQ ID NO: 7287466 - DNA, 22 bp, Homo sapiens
atttgggaatgtgcattatact

SEQ ID NO: 7287467 - DNA, 22 bp, Homo sapiens
attttagatttaagaataaggt

SEQ ID NO: 7287468 - DNA, 22 bp, Homo sapiens
attttcagcccccactcgtggc

SEQ ID NO: 7287469 - DNA, 22 bp, Homo sapiens
attttcaggttttgccattgta

SEQ ID NO: 7287470 - DNA, 22 bp, Homo sapiens
attttcagtctggctggaccca

SEQ ID NO: 7287471 - DNA, 22 bp, Homo sapiens
gccagctggaaatctgcttgaa

SEQ ID NO: 7287472 - DNA, 22 bp, Homo sapiens
attgtacaggttggaggaagtg

SEQ ID NO: 7287473 - DNA, 20 bp, Homo sapiens
gcatggcatgtagtgaagtg

SEQ ID NO: 7287474 - DNA, 22 bp, Homo sapiens
attgtacagatgaggtaagtga

SEQ ID NO: 7287475 - DNA, 22 bp, Homo sapiens
gccatctcggagctatcaaagg

SEQ ID NO: 7287476 - DNA, 17 bp, Homo sapiens
gccctgcctgctgccct

SEQ ID NO: 7287477 - DNA, 22 bp, Homo sapiens
atgggcagagtggggacaggaa

SEQ ID NO: 7287478 - DNA, 22 bp, Homo sapiens
gagccccaggacagctctagtt

SEQ ID NO: 7287479 - DNA, 21 bp, Homo sapiens
atgggcagaggcagagaggct

SEQ ID NO: 7287480 - DNA, 22 bp, Homo sapiens
atggcagacgaggcagcagggg

SEQ ID NO: 7287481 - DNA, 22 bp, Homo sapiens
atggcagacacaggcaggcaga

SEQ ID NO: 7287482 - DNA, 22 bp, Homo sapiens
atggcagacctgggctggagaa

SEQ ID NO: 7287483 - DNA, 22 bp, Homo sapiens
atgctggggcctcagaccagaa

SEQ ID NO: 7287484 - DNA, 22 bp, Homo sapiens
atgctggcagccgagtgctcca

SEQ ID NO: 7287485 - DNA, 22 bp, Homo sapiens
atgttaaaagtgaggatggcca

SEQ ID NO: 7287486 - DNA, 22 bp, Homo sapiens
atgttaaaagtctgagtgggag

SEQ ID NO: 7287487 - DNA, 23 bp, Homo sapiens
atgttaaacataactgaagagcc

SEQ ID NO: 7287488 - DNA, 22 bp, Homo sapiens
atgttacagagaaagtggaagc

SEQ ID NO: 7287489 - DNA, 22 bp, Homo sapiens
gaggtgtggtcctcagccccca

SEQ ID NO: 7287490 - DNA, 22 bp, Homo sapiens
atgtggaatgaacaaaggaggc

SEQ ID NO: 7287491 - DNA, 22 bp, Homo sapiens
atgggcagctgcagcagtggtg

SEQ ID NO: 7287492 - DNA, 22 bp, Homo sapiens
atgtatttactgagaaggaaac

SEQ ID NO: 7287493 - DNA, 22 bp, Homo sapiens
atgtatttctatgtagtgaaga

SEQ ID NO: 7287494 - DNA, 23 bp, Homo sapiens
ctttgccacccagagcctgacag

SEQ ID NO: 7287495 - DNA, 20 bp, Homo sapiens
ctttgcctattctctgcctg

SEQ ID NO: 7287496 - DNA, 22 bp, Homo sapiens
ctttgcttactggtgtctgcat

SEQ ID NO: 7287497 - DNA, 22 bp, Homo sapiens
ctttgcttctccaacctgctca

SEQ ID NO: 7287498 - DNA, 22 bp, Homo sapiens
ctttgcttgacactgtgattgt

SEQ ID NO: 7287499 - DNA, 22 bp, Homo sapiens
ctttgctttactcccactgtgt

SEQ ID NO: 7287500 - DNA, 22 bp, Homo sapiens
ctttggaaagtaagcagctaga

SEQ ID NO: 7287501 - DNA, 22 bp, Homo sapiens
ctttggaaagtggttcaggtga

SEQ ID NO: 7287502 - DNA, 22 bp, Homo sapiens
ctttggctcatggttttatcca

SEQ ID NO: 7287503 - DNA, 22 bp, Homo sapiens
ctttggcttgccctggcagtac

SEQ ID NO: 7287504 - DNA, 22 bp, Homo sapiens
ctttggcttttagatatccatt

SEQ ID NO: 7287505 - DNA, 22 bp, Homo sapiens
ctttggcttgcactattacact

SEQ ID NO: 7287506 - DNA, 22 bp, Homo sapiens
ctttggctgacgaggaggaggc

SEQ ID NO: 7287507 - DNA, 22 bp, Homo sapiens
ctttggctgcattcgagttgct

SEQ ID NO: 7287508 - DNA, 22 bp, Homo sapiens
ctttggctgggcaaagggaggt

SEQ ID NO: 7287509 - DNA, 22 bp, Homo sapiens
atctttgggatcctgatttact

SEQ ID NO: 7287510 - DNA, 22 bp, Homo sapiens
ctttacagcctccagaaggaac

SEQ ID NO: 7287511 - DNA, 22 bp, Homo sapiens
ctttacatcctgtttcccgttt

SEQ ID NO: 7287512 - DNA, 22 bp, Homo sapiens
cttctccctgggggctctttat

SEQ ID NO: 7287513 - DNA, 18 bp, Homo sapiens
cttctcccatcttggcca

SEQ ID NO: 7287514 - DNA, 22 bp, Homo sapiens
cttctccctggcttctgcacac

SEQ ID NO: 7287515 - DNA, 22 bp, Homo sapiens
atctttcactttttgtggatga

SEQ ID NO: 7287516 - DNA, 22 bp, Homo sapiens
atgatgtcactcttctgcctaa

SEQ ID NO: 7287517 - DNA, 22 bp, Homo sapiens
atgatgtcattcttgtttgctc

SEQ ID NO: 7287518 - DNA, 22 bp, Homo sapiens
atgatgtcattttaatttctaa

SEQ ID NO: 7287519 - DNA, 22 bp, Homo sapiens
atgagctcaggtgtgcaaaata

SEQ ID NO: 7287520 - DNA, 22 bp, Homo sapiens
atgccactgcacttcagcttgg

SEQ ID NO: 7287521 - DNA, 22 bp, Homo sapiens
atgccactgcacttcagcctgg

SEQ ID NO: 7287522 - DNA, 22 bp, Homo sapiens
ggagagctagtgcctgccagta

SEQ ID NO: 7287523 - DNA, 22 bp, Homo sapiens
cacaggatacattgtctatatc

SEQ ID NO: 7287524 - DNA, 22 bp, Homo sapiens
ggcaaggggtcaggctgagaca

SEQ ID NO: 7287525 - DNA, 22 bp, Homo sapiens
cacagtgcatgatgggcagaag

SEQ ID NO: 7287526 - DNA, 21 bp, Homo sapiens
cacaggtgggtcagtgaggcc

SEQ ID NO: 7287527 - DNA, 22 bp, Homo sapiens
cacatgaccactctttacttct

SEQ ID NO: 7287528 - DNA, 23 bp, Homo sapiens
cacatgacctgacctaggctagg

SEQ ID NO: 7287529 - DNA, 22 bp, Homo sapiens
cacatgactctggctacccaga

SEQ ID NO: 7287530 - DNA, 22 bp, Homo sapiens
cacatgacactattttgttcta

SEQ ID NO: 7287531 - DNA, 20 bp, Homo sapiens
ggcagatgcagagctatgca

SEQ ID NO: 7287532 - DNA, 18 bp, Homo sapiens
ggcagatgacaggagaga

SEQ ID NO: 7287533 - DNA, 22 bp, Homo sapiens
ggcagatggaagaggctgggtc

SEQ ID NO: 7287534 - DNA, 22 bp, Homo sapiens
ggcagatgacagaccagtatgt

SEQ ID NO: 7287535 - DNA, 22 bp, Homo sapiens
cacattcaggtggcatgttaga

SEQ ID NO: 7287536 - DNA, 22 bp, Homo sapiens
cacattccccagagctggggct

SEQ ID NO: 7287537 - DNA, 21 bp, Homo sapiens
cacattccatgggtctattta

SEQ ID NO: 7287538 - DNA, 22 bp, Homo sapiens
cacattcctggtgctcagcagc

SEQ ID NO: 7287539 - DNA, 22 bp, Homo sapiens
cacattcctgagcttcgacctg

SEQ ID NO: 7287540 - DNA, 22 bp, Homo sapiens
cacattccttacattcatagag

SEQ ID NO: 7287541 - DNA, 22 bp, Homo sapiens
caccactggaggtcttggcttt

SEQ ID NO: 7287542 - DNA, 22 bp, Homo sapiens
caccactgtatccctagcactt

SEQ ID NO: 7287543 - DNA, 22 bp, Homo sapiens
cacattcagggaacattggagg

SEQ ID NO: 7287544 - DNA, 22 bp, Homo sapiens
cacattcacttctctgtccacc

SEQ ID NO: 7287545 - DNA, 22 bp, Homo sapiens
cactccctctagttgcattctg

SEQ ID NO: 7287546 - DNA, 22 bp, Homo sapiens
cactcccttcaggagcctagga

SEQ ID NO: 7287547 - DNA, 23 bp, Homo sapiens
cacggcagcctccgagggtgctg

SEQ ID NO: 7287548 - DNA, 22 bp, Homo sapiens
ggccagggccaaggctttccca

SEQ ID NO: 7287549 - DNA, 22 bp, Homo sapiens
cacctggcagctgttggccacg

SEQ ID NO: 7287550 - DNA, 22 bp, Homo sapiens
cacctgcctggtccttagggct

SEQ ID NO: 7287551 - DNA, 22 bp, Homo sapiens
cacctgctgagctgctgggggt

SEQ ID NO: 7287552 - DNA, 22 bp, Homo sapiens
cacctgggctaaactatgcagg

SEQ ID NO: 7287553 - DNA, 22 bp, Homo sapiens
cacctgcctcatttgtccctgc

SEQ ID NO: 7287554 - DNA, 22 bp, Homo sapiens
cacctgcccagcacctgggatc

SEQ ID NO: 7287555 - DNA, 22 bp, Homo sapiens
cacctgccccagtcttggagct

SEQ ID NO: 7287556 - DNA, 22 bp, Homo sapiens
cactgggcaattctgagcctaa

SEQ ID NO: 7287557 - DNA, 22 bp, Homo sapiens
ggctggcaagtcagtgctgatg

SEQ ID NO: 7287558 - DNA, 22 bp, Homo sapiens
gctgccctgcatctgtgccttc

SEQ ID NO: 7287559 - DNA, 22 bp, Homo sapiens
gctgccctgtccggctctcctg

SEQ ID NO: 7287560 - DNA, 22 bp, Homo sapiens
caaagtcagctgccagtcccaa

SEQ ID NO: 7287561 - DNA, 22 bp, Homo sapiens
caaattttgtgtgttctctagt

SEQ ID NO: 7287562 - DNA, 22 bp, Homo sapiens
gctggacaggccacatggagga

SEQ ID NO: 7287563 - DNA, 18 bp, Homo sapiens
gctgcctgcattcctcac

SEQ ID NO: 7287564 - DNA, 22 bp, Homo sapiens
gctgcctgcagtgttttcccag

SEQ ID NO: 7287565 - DNA, 22 bp, Homo sapiens
gctgctggccgcccagcttctc

SEQ ID NO: 7287566 - DNA, 22 bp, Homo sapiens
gctgctggcgctgggcgtccgg

SEQ ID NO: 7287567 - DNA, 22 bp, Homo sapiens
gctgcctgcctgcatttaatcc

SEQ ID NO: 7287568 - DNA, 22 bp, Homo sapiens
gctggctgaggtctagctcttt

SEQ ID NO: 7287569 - DNA, 17 bp, Homo sapiens
gctggctgacccatgcc

SEQ ID NO: 7287570 - DNA, 22 bp, Homo sapiens
gctgggcttgtggccagctggg

SEQ ID NO: 7287571 - DNA, 22 bp, Homo sapiens
gctgggctcagacctagtgaac

SEQ ID NO: 7287572 - DNA, 22 bp, Homo sapiens
caaggctggagtgtaatggcat

SEQ ID NO: 7287573 - DNA, 22 bp, Homo sapiens
ggagaaggtggctcagcaaagg

SEQ ID NO: 7287574 - DNA, 22 bp, Homo sapiens
ggagaaggtgctggtcactgtg

SEQ ID NO: 7287575 - DNA, 22 bp, Homo sapiens
ggagaagggtatgtgtggcgga

SEQ ID NO: 7287576 - DNA, 22 bp, Homo sapiens
ggagaagggccaattccatgta

SEQ ID NO: 7287577 - DNA, 22 bp, Homo sapiens
ggagaagggcatggtagtttta

SEQ ID NO: 7287578 - DNA, 22 bp, Homo sapiens
ggagaagggacagactcagctt

SEQ ID NO: 7287579 - DNA, 22 bp, Homo sapiens
ggagaagggacagactcagctt

SEQ ID NO: 7287580 - DNA, 22 bp, Homo sapiens
ggagaagggaactgagtttttg

SEQ ID NO: 7287581 - DNA, 22 bp, Homo sapiens
ggagaaggcgaagtcattcttt

SEQ ID NO: 7287582 - DNA, 22 bp, Homo sapiens
ggaagctgaacttagcaaggaa

SEQ ID NO: 7287583 - DNA, 22 bp, Homo sapiens
ggaagctgccagtccaccagct

SEQ ID NO: 7287584 - DNA, 22 bp, Homo sapiens
cacaaatcattccatcattctt

SEQ ID NO: 7287585 - DNA, 22 bp, Homo sapiens
cacaaataccagtttcctaaca

SEQ ID NO: 7287586 - DNA, 20 bp, Homo sapiens
ggaagctgtgggtccccagg

SEQ ID NO: 7287587 - DNA, 22 bp, Homo sapiens
ggacatggagctccatggaggc

SEQ ID NO: 7287588 - DNA, 22 bp, Homo sapiens
gtagaaaaagcagtaagtctca

SEQ ID NO: 7287589 - DNA, 22 bp, Homo sapiens
gtagaaaattaggatgaggctt

SEQ ID NO: 7287590 - DNA, 22 bp, Homo sapiens
gtaggctgtgtgaggctagaga

SEQ ID NO: 7287591 - DNA, 22 bp, Homo sapiens
cagcagcctagaagctctacca

SEQ ID NO: 7287592 - DNA, 22 bp, Homo sapiens
gtacacatactattcaaagaga

SEQ ID NO: 7287593 - DNA, 22 bp, Homo sapiens
gtacacataggttactgattaa

SEQ ID NO: 7287594 - DNA, 23 bp, Homo sapiens
gtacacatagtgtagttatattt

SEQ ID NO: 7287595 - DNA, 22 bp, Homo sapiens
cagccaggacagggaaactagt

SEQ ID NO: 7287596 - DNA, 22 bp, Homo sapiens
cagccaggcccagatcatgctg

SEQ ID NO: 7287597 - DNA, 22 bp, Homo sapiens
cagccaggactcccatttagga

SEQ ID NO: 7287598 - DNA, 22 bp, Homo sapiens
cagccaggagcctctgcaacta

SEQ ID NO: 7287599 - DNA, 22 bp, Homo sapiens
gtgagagcctgtctggatgtcg

SEQ ID NO: 7287600 - DNA, 22 bp, Homo sapiens
gtgagagggctgggctcatgat

SEQ ID NO: 7287601 - DNA, 22 bp, Homo sapiens
gtgagagctcagctgccctggg

SEQ ID NO: 7287602 - DNA, 22 bp, Homo sapiens
cagaatttaagtggattattct

SEQ ID NO: 7287603 - DNA, 22 bp, Homo sapiens
cagaaaatagagtttctctgag

SEQ ID NO: 7287604 - DNA, 22 bp, Homo sapiens
ggctggcactgaggagagctct

SEQ ID NO: 7287605 - DNA, 22 bp, Homo sapiens
cagaaacacttgtagagaagtt

SEQ ID NO: 7287606 - DNA, 22 bp, Homo sapiens
ggctggcacccttggggatagg

SEQ ID NO: 7287607 - DNA, 22 bp, Homo sapiens
ggctggcacctgccctccgctg

SEQ ID NO: 7287608 - DNA, 22 bp, Homo sapiens
ggctggcacgaagccctgctgg

SEQ ID NO: 7287609 - DNA, 22 bp, Homo sapiens
ggctggcactctgtccagtgtc

SEQ ID NO: 7287610 - DNA, 22 bp, Homo sapiens
ggctggcactgaggagagctct

SEQ ID NO: 7287611 - DNA, 22 bp, Homo sapiens
ggctggcaagtgtctgctcatg

SEQ ID NO: 7287612 - DNA, 22 bp, Homo sapiens
ggctggcaagtgtctgctcatg

SEQ ID NO: 7287613 - DNA, 22 bp, Homo sapiens
ggctggcacagagggctggtgt

SEQ ID NO: 7287614 - DNA, 22 bp, Homo sapiens
ggctggcacaaagctccaaatc

SEQ ID NO: 7287615 - DNA, 22 bp, Homo sapiens
gggaggcagtgctggaggctgg

SEQ ID NO: 7287616 - DNA, 22 bp, Homo sapiens
gggaggcacgaggcgcgcagtg

SEQ ID NO: 7287617 - DNA, 22 bp, Homo sapiens
gggatgagagtagggtgtgaaa

SEQ ID NO: 7287618 - DNA, 22 bp, Homo sapiens
cagagcagaagcggtcctcaca

SEQ ID NO: 7287619 - DNA, 22 bp, Homo sapiens
gggatgagagctgggacagaag

SEQ ID NO: 7287620 - DNA, 22 bp, Homo sapiens
gggatctttctgatgctgtggc

SEQ ID NO: 7287621 - DNA, 22 bp, Homo sapiens
gggatcttgtttaatattgttt

SEQ ID NO: 7287622 - DNA, 21 bp, Homo sapiens
gggatcttgtactggcgtgga

SEQ ID NO: 7287623 - DNA, 22 bp, Homo sapiens
gggatcttgggaacacccttac

SEQ ID NO: 7287624 - DNA, 22 bp, Homo sapiens
gggatcttgaaacagctggatt

SEQ ID NO: 7287625 - DNA, 20 bp, Homo sapiens
gggatcttccaggctctcct

SEQ ID NO: 7287626 - DNA, 20 bp, Homo sapiens
gggaggcattggtccctcac

SEQ ID NO: 7287627 - DNA, 20 bp, Homo sapiens
cagagcagtgcccaggcggc

SEQ ID NO: 7287628 - DNA, 22 bp, Homo sapiens
cagagccaaacctcagggcccg

SEQ ID NO: 7287629 - DNA, 22 bp, Homo sapiens
cagagccactgtctgccaggca

SEQ ID NO: 7287630 - DNA, 22 bp, Homo sapiens
gggcaggtactgggtggtgagc

SEQ ID NO: 7287631 - DNA, 22 bp, Homo sapiens
gggcaggggtagcattccaagt

SEQ ID NO: 7287632 - DNA, 22 bp, Homo sapiens
gggcaggggtcagtggccccaa

SEQ ID NO: 7287633 - DNA, 18 bp, Homo sapiens
cagagcagaggtggagcg

SEQ ID NO: 7287634 - DNA, 22 bp, Homo sapiens
cagagcagaaggtccaagcctg

SEQ ID NO: 7287635 - DNA, 22 bp, Homo sapiens
gggtcctgcgtgggcccaggac

SEQ ID NO: 7287636 - DNA, 21 bp, Homo sapiens
gggtcctgggatgggatccag

SEQ ID NO: 7287637 - DNA, 18 bp, Homo sapiens
gggtcctgtgggagacag

SEQ ID NO: 7287638 - DNA, 22 bp, Homo sapiens
gggtcctggaatctgcatttta

SEQ ID NO: 7287639 - DNA, 18 bp, Homo sapiens
gggtcctgttcttggaag

SEQ ID NO: 7287640 - DNA, 22 bp, Homo sapiens
gggttactgcttcaaaaaatta

SEQ ID NO: 7287641 - DNA, 19 bp, Homo sapiens
cagatgagaaaagtgaggt

SEQ ID NO: 7287642 - DNA, 22 bp, Homo sapiens
ggggccttggatctgtgccccg

SEQ ID NO: 7287643 - DNA, 22 bp, Homo sapiens
ggggcctgtagagcttcaggga

SEQ ID NO: 7287644 - DNA, 22 bp, Homo sapiens
ggggccttttctgaatgtggaa

SEQ ID NO: 7287645 - DNA, 22 bp, Homo sapiens
gggctggaggtgagcaggacag

SEQ ID NO: 7287646 - DNA, 22 bp, Homo sapiens
tgcagaggtttgtggtgttgct

SEQ ID NO: 7287647 - DNA, 23 bp, Homo sapiens
cccagcagagatgaggaggggtc

SEQ ID NO: 7287648 - DNA, 22 bp, Homo sapiens
cccagcagatggctatgtgcta

SEQ ID NO: 7287649 - DNA, 22 bp, Homo sapiens
cccacccagcctggctgagggg

SEQ ID NO: 7287650 - DNA, 22 bp, Homo sapiens
tgcagaggtttccaggcaagtt

SEQ ID NO: 7287651 - DNA, 22 bp, Homo sapiens
tgcagaggtgaaagactagcaa

SEQ ID NO: 7287652 - DNA, 22 bp, Homo sapiens
tgcagaggtgttgctgagataa

SEQ ID NO: 7287653 - DNA, 22 bp, Homo sapiens
ccatggaagaactgatgtgcca

SEQ ID NO: 7287654 - DNA, 22 bp, Homo sapiens
ccatggcagccatgggagccac

SEQ ID NO: 7287655 - DNA, 22 bp, Homo sapiens
cccaggaggaggaaaaagctcg

SEQ ID NO: 7287656 - DNA, 22 bp, Homo sapiens
tgccctcttaggtctgcgcagc

SEQ ID NO: 7287657 - DNA, 22 bp, Homo sapiens
tgccctctgcaggccgccatgg

SEQ ID NO: 7287658 - DNA, 22 bp, Homo sapiens
tgccctgtcgctcactcccacc

SEQ ID NO: 7287659 - DNA, 19 bp, Homo sapiens
tgccctgcacgctgtcctg

SEQ ID NO: 7287660 - DNA, 22 bp, Homo sapiens
tgcaggtggacacgggagacgg

SEQ ID NO: 7287661 - DNA, 22 bp, Homo sapiens
tgcagtggaagaggtggagatc

SEQ ID NO: 7287662 - DNA, 22 bp, Homo sapiens
tgcagtggaggccgtgagacag

SEQ ID NO: 7287663 - DNA, 21 bp, Homo sapiens
cccaggagaagaaaagatgca

SEQ ID NO: 7287664 - DNA, 22 bp, Homo sapiens
cccagctcccatgttctccaat

SEQ ID NO: 7287665 - DNA, 18 bp, Homo sapiens
cccagcccaccatttctc

SEQ ID NO: 7287666 - DNA, 22 bp, Homo sapiens
tgcagcagtttaatgcagggtt

SEQ ID NO: 7287667 - DNA, 22 bp, Homo sapiens
cccagccaaggtgctggtgttg

SEQ ID NO: 7287668 - DNA, 22 bp, Homo sapiens
ccagtgggaacactggcattgc

SEQ ID NO: 7287669 - DNA, 23 bp, Homo sapiens
tgagctgggcctgcaggggtctc

SEQ ID NO: 7287670 - DNA, 22 bp, Homo sapiens
tgagagtgaaatgtcacatgtc

SEQ ID NO: 7287671 - DNA, 22 bp, Homo sapiens
tgagagtgccttgtaaacctgc

SEQ ID NO: 7287672 - DNA, 22 bp, Homo sapiens
tgagagtggttcagctcagaag

SEQ ID NO: 7287673 - DNA, 18 bp, Homo sapiens
tgagagtgtgtgctcttg

SEQ ID NO: 7287674 - DNA, 22 bp, Homo sapiens
tgacccatggtctgatcatagg

SEQ ID NO: 7287675 - DNA, 22 bp, Homo sapiens
tgacccattggtccctagatcc

SEQ ID NO: 7287676 - DNA, 22 bp, Homo sapiens
tgacccattaaccactttccct

SEQ ID NO: 7287677 - DNA, 22 bp, Homo sapiens
tgacccatcaggccacatgagg

SEQ ID NO: 7287678 - DNA, 22 bp, Homo sapiens
tgaccaaaggtggtttatttgg

SEQ ID NO: 7287679 - DNA, 22 bp, Homo sapiens
tgaccaaagactttagatgttc

SEQ ID NO: 7287680 - DNA, 22 bp, Homo sapiens
tgacccatttgcttttcctgta

SEQ ID NO: 7287681 - DNA, 22 bp, Homo sapiens
ccagggtcttcgaggcagcaat

SEQ ID NO: 7287682 - DNA, 22 bp, Homo sapiens
ccagcccttgaggtctgtccat

SEQ ID NO: 7287683 - DNA, 18 bp, Homo sapiens
tcttgcctgcaccctctc

SEQ ID NO: 7287684 - DNA, 22 bp, Homo sapiens
tcttgcctcttcccctttccat

SEQ ID NO: 7287685 - DNA, 22 bp, Homo sapiens
tcttgccttatgccatgaagca

SEQ ID NO: 7287686 - DNA, 21 bp, Homo sapiens
tcttgtgtgggaaacaatttg

SEQ ID NO: 7287687 - DNA, 22 bp, Homo sapiens
tcttgtgtggtggaagatatgg

SEQ ID NO: 7287688 - DNA, 22 bp, Homo sapiens
tctttaaagttggagcttgcaa

SEQ ID NO: 7287689 - DNA, 22 bp, Homo sapiens
tctttaagagttcatttgcatg

SEQ ID NO: 7287690 - DNA, 22 bp, Homo sapiens
tgaacacattttcttcagtaga

SEQ ID NO: 7287691 - DNA, 22 bp, Homo sapiens
tgaacacatttctggccaattt

SEQ ID NO: 7287692 - DNA, 22 bp, Homo sapiens
tgaacacatttgggaaaatctt

SEQ ID NO: 7287693 - DNA, 22 bp, Homo sapiens
tgaacacagggccaaacttgag

SEQ ID NO: 7287694 - DNA, 18 bp, Homo sapiens
tgaacacagtacaattcc

SEQ ID NO: 7287695 - DNA, 21 bp, Homo sapiens
tgtaagtttcatctgaattgg

SEQ ID NO: 7287696 - DNA, 22 bp, Homo sapiens
cctgctgttttcttcacttcag

SEQ ID NO: 7287697 - DNA, 20 bp, Homo sapiens
cctgctgtttccatggggcc

SEQ ID NO: 7287698 - DNA, 22 bp, Homo sapiens
tgtaaagacagataaaacagca

SEQ ID NO: 7287699 - DNA, 22 bp, Homo sapiens
cctgctggacgtggaggagggg

SEQ ID NO: 7287700 - DNA, 22 bp, Homo sapiens
cctgctggacctcaacacattt

SEQ ID NO: 7287701 - DNA, 22 bp, Homo sapiens
cctgctggacaggggtgttcat

SEQ ID NO: 7287702 - DNA, 22 bp, Homo sapiens
cctgctgggcctgagcaatgag

SEQ ID NO: 7287703 - DNA, 22 bp, Homo sapiens
cctgctgggacgtgtggttgcc

SEQ ID NO: 7287704 - DNA, 22 bp, Homo sapiens
cctgctggcgtggctggcgccc

SEQ ID NO: 7287705 - DNA, 22 bp, Homo sapiens
cctgctggctggtagagttccg

SEQ ID NO: 7287706 - DNA, 22 bp, Homo sapiens
cctgctggctctgttgctcggc

SEQ ID NO: 7287707 - DNA, 20 bp, Homo sapiens
cctgctgggaaccctctgaa

SEQ ID NO: 7287708 - DNA, 22 bp, Homo sapiens
cctgctggccagtggagggctg

SEQ ID NO: 7287709 - DNA, 22 bp, Homo sapiens
cctgctggccactgctccacct

SEQ ID NO: 7287710 - DNA, 22 bp, Homo sapiens
cctgctggcagagggggttact

SEQ ID NO: 7287711 - DNA, 22 bp, Homo sapiens
cctgctggcattcttgctccct

SEQ ID NO: 7287712 - DNA, 22 bp, Homo sapiens
cctgctggcgcttgtctgggag

SEQ ID NO: 7287713 - DNA, 22 bp, Homo sapiens
cctgctggcggggacccagtga

SEQ ID NO: 7287714 - DNA, 22 bp, Homo sapiens
cctgctgtccctctgggctcca

SEQ ID NO: 7287715 - DNA, 22 bp, Homo sapiens
cctgctgtcagtggggcaggca

SEQ ID NO: 7287716 - DNA, 22 bp, Homo sapiens
cctgctggtgtccaggctttgg

SEQ ID NO: 7287717 - DNA, 22 bp, Homo sapiens
cctgctggtttttacaaagatg

SEQ ID NO: 7287718 - DNA, 22 bp, Homo sapiens
cctgctgtagggcccctggggc

SEQ ID NO: 7287719 - DNA, 22 bp, Homo sapiens
tgggtcagaatcagagagttgc

SEQ ID NO: 7287720 - DNA, 23 bp, Homo sapiens
cctgcctgttctaactccatttc

SEQ ID NO: 7287721 - DNA, 22 bp, Homo sapiens
cctgcctgtccctcagtccaca

SEQ ID NO: 7287722 - DNA, 22 bp, Homo sapiens
cctgcctgtcatcgcctgcgcc

SEQ ID NO: 7287723 - DNA, 22 bp, Homo sapiens
cctgcctgtactagagacccag

SEQ ID NO: 7287724 - DNA, 22 bp, Homo sapiens
cctgcctgtaagatgggtacaa

SEQ ID NO: 7287725 - DNA, 20 bp, Homo sapiens
cctgcctgcctcggctcatt

SEQ ID NO: 7287726 - DNA, 22 bp, Homo sapiens
cctgcctgcctgctggccggga

SEQ ID NO: 7287727 - DNA, 22 bp, Homo sapiens
tggctctcccaatacctttctg

SEQ ID NO: 7287728 - DNA, 22 bp, Homo sapiens
tgggagcaggtgtgctagggaa

SEQ ID NO: 7287729 - DNA, 22 bp, Homo sapiens
cctgaataggctctgctcaaaa

SEQ ID NO: 7287730 - DNA, 22 bp, Homo sapiens
cctgcaccaggcccagcatggt

SEQ ID NO: 7287731 - DNA, 22 bp, Homo sapiens
cctgcaccaggcccagcatggt

SEQ ID NO: 7287732 - DNA, 22 bp, Homo sapiens
cctgcactacctggggctgctg

SEQ ID NO: 7287733 - DNA, 22 bp, Homo sapiens
cctgcagaagagtccagctcat

SEQ ID NO: 7287734 - DNA, 22 bp, Homo sapiens
cctgcacttctcacagctgctg

SEQ ID NO: 7287735 - DNA, 19 bp, Homo sapiens
tggggtcaagagaggcttc

SEQ ID NO: 7287736 - DNA, 22 bp, Homo sapiens
cctgacctatttttctcagctg

SEQ ID NO: 7287737 - DNA, 22 bp, Homo sapiens
cctgagacatgaaccaggctcc

SEQ ID NO: 7287738 - DNA, 22 bp, Homo sapiens
cctgagggtcaaggagccctag

SEQ ID NO: 7287739 - DNA, 22 bp, Homo sapiens
ccctttccatggctctcctagg

SEQ ID NO: 7287740 - DNA, 22 bp, Homo sapiens
ccctgtgagcggctggatgcct

SEQ ID NO: 7287741 - DNA, 22 bp, Homo sapiens
ccctgtctgtaccgtgatgagc

SEQ ID NO: 7287742 - DNA, 22 bp, Homo sapiens
cctcacccagtcacctaggtgg

SEQ ID NO: 7287743 - DNA, 22 bp, Homo sapiens
tggcctctcctggcagcatcca

SEQ ID NO: 7287744 - DNA, 22 bp, Homo sapiens
tggcctctctaccaggcagcct

SEQ ID NO: 7287745 - DNA, 22 bp, Homo sapiens
tggcctcggcatccagcaagag

SEQ ID NO: 7287746 - DNA, 22 bp, Homo sapiens
cctcagaagactttagggaaga

SEQ ID NO: 7287747 - DNA, 22 bp, Homo sapiens
tggcctcaatctgtcctccagc

SEQ ID NO: 7287748 - DNA, 22 bp, Homo sapiens
tggcctcaagtctgagggcctt

SEQ ID NO: 7287749 - DNA, 21 bp, Homo sapiens
tggccctggccacggctgcca

SEQ ID NO: 7287750 - DNA, 22 bp, Homo sapiens
tggcctcatttggaaatagggc

SEQ ID NO: 7287751 - DNA, 23 bp, Homo sapiens
tggctcagctagttttccatttc

SEQ ID NO: 7287752 - DNA, 22 bp, Homo sapiens
tggctcagcctggccctttcat

SEQ ID NO: 7287753 - DNA, 22 bp, Homo sapiens
tggctcagccattcgtgttgcc

SEQ ID NO: 7287754 - DNA, 22 bp, Homo sapiens
tggctaggacctctgcggagca

SEQ ID NO: 7287755 - DNA, 22 bp, Homo sapiens
tggctaggctccaagagctgga

SEQ ID NO: 7287756 - DNA, 22 bp, Homo sapiens
ccctgccttcttggcctttaaa

SEQ ID NO: 7287757 - DNA, 22 bp, Homo sapiens
ccctgccttggggtccacaccg

SEQ ID NO: 7287758 - DNA, 22 bp, Homo sapiens
ccctgccttggggtccacaccg

SEQ ID NO: 7287759 - DNA, 22 bp, Homo sapiens
ccctgccttgtctgggctaggt

SEQ ID NO: 7287760 - DNA, 22 bp, Homo sapiens
ccctgccttgttggagcctatg

SEQ ID NO: 7287761 - DNA, 22 bp, Homo sapiens
ccctgctgaatcccatggagtc

SEQ ID NO: 7287762 - DNA, 22 bp, Homo sapiens
tggaggtggagttggaaactga

SEQ ID NO: 7287763 - DNA, 17 bp, Homo sapiens
ccctgcaccctactctc

SEQ ID NO: 7287764 - DNA, 17 bp, Homo sapiens
ccctgcaccctactctc

SEQ ID NO: 7287765 - DNA, 22 bp, Homo sapiens
ccctgcagatctagggtccttc

SEQ ID NO: 7287766 - DNA, 22 bp, Homo sapiens
ccctgcctacagggttttcttt

SEQ ID NO: 7287767 - DNA, 22 bp, Homo sapiens
ccctgcctgtgggcatcaacat

SEQ ID NO: 7287768 - DNA, 22 bp, Homo sapiens
ccctgcctgtgggcatcaacat

SEQ ID NO: 7287769 - DNA, 22 bp, Homo sapiens
ccctgcctctgaagctgctcag

SEQ ID NO: 7287770 - DNA, 22 bp, Homo sapiens
tgctttcacttctctgcagcca

SEQ ID NO: 7287771 - DNA, 22 bp, Homo sapiens
tgctttcacatgtatgcacaaa

SEQ ID NO: 7287772 - DNA, 22 bp, Homo sapiens
tgcctgctaggccctgctgggt

SEQ ID NO: 7287773 - DNA, 17 bp, Homo sapiens
tgcctccagcagggtga

SEQ ID NO: 7287774 - DNA, 23 bp, Homo sapiens
tgcctccaccgagggccaggcat

SEQ ID NO: 7287775 - DNA, 22 bp, Homo sapiens
tgcctccaggaggggcagctct

SEQ ID NO: 7287776 - DNA, 22 bp, Homo sapiens
tgcctgccctttccacacagcc

SEQ ID NO: 7287777 - DNA, 22 bp, Homo sapiens
tgcctgcctgcatagtcccacg

SEQ ID NO: 7287778 - DNA, 22 bp, Homo sapiens
tggaagaaggcagagaggcatt

SEQ ID NO: 7287779 - DNA, 22 bp, Homo sapiens
tcgggctcctgcacttggagac

SEQ ID NO: 7287780 - DNA, 22 bp, Homo sapiens
tcctttccagcctcacctcagc

SEQ ID NO: 7287781 - DNA, 22 bp, Homo sapiens
ccagaaaactctacatgcttgt

SEQ ID NO: 7287782 - DNA, 22 bp, Homo sapiens
tctccacaccagaaggagctga

SEQ ID NO: 7287783 - DNA, 22 bp, Homo sapiens
tctccacaagtgttgagagtac

SEQ ID NO: 7287784 - DNA, 22 bp, Homo sapiens
tctccacactttctctcccagg

SEQ ID NO: 7287785 - DNA, 22 bp, Homo sapiens
tctccacagtcccacctcgctt

SEQ ID NO: 7287786 - DNA, 22 bp, Homo sapiens
tctccacagaaggttccaggcc

SEQ ID NO: 7287787 - DNA, 22 bp, Homo sapiens
tctccacattctattggctata

SEQ ID NO: 7287788 - DNA, 22 bp, Homo sapiens
tctccctctcagatttattcac

SEQ ID NO: 7287789 - DNA, 22 bp, Homo sapiens
tctccctctttgtctgctttgg

SEQ ID NO: 7287790 - DNA, 21 bp, Homo sapiens
tctgagagcaactgcccttta

SEQ ID NO: 7287791 - DNA, 22 bp, Homo sapiens
tctgagagcctctagcctaagt

SEQ ID NO: 7287792 - DNA, 22 bp, Homo sapiens
tctgagagcatcactggggtac

SEQ ID NO: 7287793 - DNA, 22 bp, Homo sapiens
tctgagagcaggaggagctgct

SEQ ID NO: 7287794 - DNA, 22 bp, Homo sapiens
tctgagagcaaggcattagcag

SEQ ID NO: 7287795 - DNA, 22 bp, Homo sapiens
tctgagagctctggggcccctt

SEQ ID NO: 7287796 - DNA, 22 bp, Homo sapiens
tctgagaggattcctgtcccga

SEQ ID NO: 7287797 - DNA, 22 bp, Homo sapiens
tctgagagctgtagaagcctat

SEQ ID NO: 7287798 - DNA, 22 bp, Homo sapiens
tctgagagtccatctccaagcc

SEQ ID NO: 7287799 - DNA, 22 bp, Homo sapiens
tctgagagtctctgaggcagat

SEQ ID NO: 7287800 - DNA, 22 bp, Homo sapiens
tctgagagtagagctgcctctt

SEQ ID NO: 7287801 - DNA, 22 bp, Homo sapiens
tctgagagtacgggctgcgcgc

SEQ ID NO: 7287802 - DNA, 22 bp, Homo sapiens
tctctgtgttccctgttttctc

SEQ ID NO: 7287803 - DNA, 21 bp, Homo sapiens
tctctgtgttcaaggtgccag

SEQ ID NO: 7287804 - DNA, 22 bp, Homo sapiens
tctctgtgtgggagatcttttt

SEQ ID NO: 7287805 - DNA, 23 bp, Homo sapiens
tctctgtgtgcctcagtttcttc

SEQ ID NO: 7287806 - DNA, 19 bp, Homo sapiens
ccagcaggttcatttcagg

SEQ ID NO: 7287807 - DNA, 22 bp, Homo sapiens
ccagcaggtgtagggctcatgg

SEQ ID NO: 7287808 - DNA, 22 bp, Homo sapiens
ccagcagggttggtttcttctg

SEQ ID NO: 7287809 - DNA, 23 bp, Homo sapiens
tctcctggctgcactgtggccac

SEQ ID NO: 7287810 - DNA, 22 bp, Homo sapiens
tctctgagttgtaaaaaatagt

SEQ ID NO: 7287811 - DNA, 22 bp, Homo sapiens
tctctgcccatcctcagtccac

SEQ ID NO: 7287812 - DNA, 22 bp, Homo sapiens
ccagcaggggaatatttttagg

SEQ ID NO: 7287813 - DNA, 22 bp, Homo sapiens
ccagcagggcagtgccctggac

SEQ ID NO: 7287814 - DNA, 22 bp, Homo sapiens
ccagcagctttattggctctcc

SEQ ID NO: 7287815 - DNA, 22 bp, Homo sapiens
tcctctccatattttctgattt

SEQ ID NO: 7287816 - DNA, 22 bp, Homo sapiens
cattgcaacttcaaactcctgg

SEQ ID NO: 7287817 - DNA, 22 bp, Homo sapiens
tcccagggtcctcttctggaat

SEQ ID NO: 7287818 - DNA, 22 bp, Homo sapiens
tcccgtcttgctgttgtctgcg

SEQ ID NO: 7287819 - DNA, 22 bp, Homo sapiens
catgttaactaagattaactat

SEQ ID NO: 7287820 - DNA, 22 bp, Homo sapiens
catgttaatatgcattgagtac

SEQ ID NO: 7287821 - DNA, 22 bp, Homo sapiens
tcccagcccagacttctccagt

SEQ ID NO: 7287822 - DNA, 22 bp, Homo sapiens
catgttaaaatatacattctga

SEQ ID NO: 7287823 - DNA, 22 bp, Homo sapiens
tccaggcccctgcctgggcctg

SEQ ID NO: 7287824 - DNA, 22 bp, Homo sapiens
tccaggcccgagatgggctgga

SEQ ID NO: 7287825 - DNA, 22 bp, Homo sapiens
tccaggccccactgaagcccct

SEQ ID NO: 7287826 - DNA, 22 bp, Homo sapiens
tccaggcccatggagcagagct

SEQ ID NO: 7287827 - DNA, 22 bp, Homo sapiens
tcatgacaggtgagtttttagg

SEQ ID NO: 7287828 - DNA, 22 bp, Homo sapiens
catgaaaaatttactgttaaca

SEQ ID NO: 7287829 - DNA, 22 bp, Homo sapiens
tccacagggcctttctggtgtg

SEQ ID NO: 7287830 - DNA, 22 bp, Homo sapiens
tcattctcagactcttggcctc

SEQ ID NO: 7287831 - DNA, 22 bp, Homo sapiens
cagttaaagctgcatgtgtcag

SEQ ID NO: 7287832 - DNA, 22 bp, Homo sapiens
cagttaaagtgcttatcacaga

SEQ ID NO: 7287833 - DNA, 22 bp, Homo sapiens
cagttaaaggcccaatatctgg

SEQ ID NO: 7287834 - DNA, 22 bp, Homo sapiens
cagttaaattctccagttacca

SEQ ID NO: 7287835 - DNA, 22 bp, Homo sapiens
cagttaaatttggctgttttct

SEQ ID NO: 7287836 - DNA, 22 bp, Homo sapiens
cagttaaatgatgtgccctaga

SEQ ID NO: 7287837 - DNA, 22 bp, Homo sapiens
cataaaatggcttgttctttaa

SEQ ID NO: 7287838 - DNA, 22 bp, Homo sapiens
cagttaaaagaagtctatctta

SEQ ID NO: 7287839 - DNA, 22 bp, Homo sapiens
cagttaaaatgtgctataagaa

SEQ ID NO: 7287840 - DNA, 22 bp, Homo sapiens
cagttaaaaggtatgctaccaa

SEQ ID NO: 7287841 - DNA, 22 bp, Homo sapiens
cagttaaacgggccatgtgagt

SEQ ID NO: 7287842 - DNA, 22 bp, Homo sapiens
cagttaaacgatgatggggtca

SEQ ID NO: 7287843 - DNA, 22 bp, Homo sapiens
cagttaaacagattgagtgtta

SEQ ID NO: 7287844 - DNA, 21 bp, Homo sapiens
cagtgggctgctgcgctccag

SEQ ID NO: 7287845 - DNA, 22 bp, Homo sapiens
cagtgccacaggaatggccaat

SEQ ID NO: 7287846 - DNA, 22 bp, Homo sapiens
tcacagttgattgaaacacagc

SEQ ID NO: 7287847 - DNA, 22 bp, Homo sapiens
cagtgacgtaaactgcatgtgc

SEQ ID NO: 7287848 - DNA, 22 bp, Homo sapiens
cagtgaagtttaaagtgtagat

SEQ ID NO: 7287849 - DNA, 22 bp, Homo sapiens
cagtgagctcctgtctgtccct

SEQ ID NO: 7287850 - DNA, 22 bp, Homo sapiens
cagggtgggcacccagcctcca

SEQ ID NO: 7287851 - DNA, 22 bp, Homo sapiens
cagggtggccctgtggtctcat

SEQ ID NO: 7287852 - DNA, 22 bp, Homo sapiens
cagggtggggaaatagcgccct

SEQ ID NO: 7287853 - DNA, 22 bp, Homo sapiens
tatttccaagctgaatccaatg

SEQ ID NO: 7287854 - DNA, 19 bp, Homo sapiens
tagtctttattcttaattt

SEQ ID NO: 7287855 - DNA, 22 bp, Homo sapiens
caggggagttttatgcaacaga

SEQ ID NO: 7287856 - DNA, 22 bp, Homo sapiens
caggggagtgagtccctctctg

SEQ ID NO: 7287857 - DNA, 22 bp, Homo sapiens
tagggcaggggaggaatctgaa

SEQ ID NO: 7287858 - DNA, 22 bp, Homo sapiens
tagggcaggtgaagaaaagcta

SEQ ID NO: 7287859 - DNA, 21 bp, Homo sapiens
tagggcaggcattggaagaga

SEQ ID NO: 7287860 - DNA, 22 bp, Homo sapiens
cagggcagccaggccccgtggg

SEQ ID NO: 7287861 - DNA, 22 bp, Homo sapiens
cagggcagagccaggatttcaa

SEQ ID NO: 7287862 - DNA, 22 bp, Homo sapiens
cagggcagagggaaactccttt

SEQ ID NO: 7287863 - DNA, 18 bp, Homo sapiens
taggaaccacttgcagag

SEQ ID NO: 7287864 - DNA, 22 bp, Homo sapiens
taggaaccagagcactctgggc

SEQ ID NO: 7287865 - DNA, 22 bp, Homo sapiens
cagggcctggagctgggcctgc

SEQ ID NO: 7287866 - DNA, 22 bp, Homo sapiens
cagggctcaggctctgggattc

SEQ ID NO: 7287867 - DNA, 22 bp, Homo sapiens
cagggctcactcggctggcgtc

SEQ ID NO: 7287868 - DNA, 22 bp, Homo sapiens
cagggctcaccactgggatcct

SEQ ID NO: 7287869 - DNA, 22 bp, Homo sapiens
cagggctcaccactgggatcct

SEQ ID NO: 7287870 - DNA, 21 bp, Homo sapiens
cagggctagagagaatgacaa

SEQ ID NO: 7287871 - DNA, 22 bp, Homo sapiens
tactatttggaattttaaattg

SEQ ID NO: 7287872 - DNA, 22 bp, Homo sapiens
caggctggagtgagtgtagtgg

SEQ ID NO: 7287873 - DNA, 22 bp, Homo sapiens
caggctggagtgcagtggcgcc

SEQ ID NO: 7287874 - DNA, 22 bp, Homo sapiens
caggctggagtgcaatggtgct

SEQ ID NO: 7287875 - DNA, 22 bp, Homo sapiens
caggctggagtgcaatggtgct

SEQ ID NO: 7287876 - DNA, 22 bp, Homo sapiens
caggctggagtgcaatggcaca

SEQ ID NO: 7287877 - DNA, 22 bp, Homo sapiens
caggctggagtgcaatgacgcc

SEQ ID NO: 7287878 - DNA, 22 bp, Homo sapiens
caggctggagtgcagtggggcg

SEQ ID NO: 7287879 - DNA, 22 bp, Homo sapiens
caggctggagtgcagtggcgct

SEQ ID NO: 7287880 - DNA, 22 bp, Homo sapiens
caggctggtcccagagcattgc

SEQ ID NO: 7287881 - DNA, 22 bp, Homo sapiens
caggctgggctccggagataaa

SEQ ID NO: 7287882 - DNA, 22 bp, Homo sapiens
caggctgggctggtgttagagt

SEQ ID NO: 7287883 - DNA, 22 bp, Homo sapiens
caggctgggcagcctccccggc

SEQ ID NO: 7287884 - DNA, 21 bp, Homo sapiens
cagggcaaccaagtccagaga

SEQ ID NO: 7287885 - DNA, 22 bp, Homo sapiens
cagggcaaagagagcacatgct

SEQ ID NO: 7287886 - DNA, 22 bp, Homo sapiens
cagggcagaaggcactctactc

SEQ ID NO: 7287887 - DNA, 22 bp, Homo sapiens
cagggcacagatcggggcgcac

SEQ ID NO: 7287888 - DNA, 22 bp, Homo sapiens
tttcacatataggggaagctac

SEQ ID NO: 7287889 - DNA, 22 bp, Homo sapiens
ctccttcatgtcatgtgtccgg

SEQ ID NO: 7287890 - DNA, 22 bp, Homo sapiens
tttctacaatttttggcatgag

SEQ ID NO: 7287891 - DNA, 22 bp, Homo sapiens
ctctctttgatgtataaataat

SEQ ID NO: 7287892 - DNA, 18 bp, Homo sapiens
ctctctggtctggatccc

SEQ ID NO: 7287893 - DNA, 22 bp, Homo sapiens
tttgaaaatttaagtgctacac

SEQ ID NO: 7287894 - DNA, 22 bp, Homo sapiens
tttgaaaagaaccatcgcctta

SEQ ID NO: 7287895 - DNA, 22 bp, Homo sapiens
tttgaaagagctgatacatgaa

SEQ ID NO: 7287896 - DNA, 22 bp, Homo sapiens
tttgcaaagaaattattgctgt

SEQ ID NO: 7287897 - DNA, 22 bp, Homo sapiens
tttgcaaacacttaagaagaga

SEQ ID NO: 7287898 - DNA, 22 bp, Homo sapiens
tttgcaaacggccctgagtccc

SEQ ID NO: 7287899 - DNA, 22 bp, Homo sapiens
tttggaattccatttctgcatt

SEQ ID NO: 7287900 - DNA, 22 bp, Homo sapiens
tttggaatggaatagagattgc

SEQ ID NO: 7287901 - DNA, 22 bp, Homo sapiens
tttggaatgtatttgaccaaag

SEQ ID NO: 7287902 - DNA, 22 bp, Homo sapiens
tttggaatgttaggtgtctcat

SEQ ID NO: 7287903 - DNA, 22 bp, Homo sapiens
tttggaattatgcttaaagttt

SEQ ID NO: 7287904 - DNA, 22 bp, Homo sapiens
tttggaatgacagatatcaata

SEQ ID NO: 7287905 - DNA, 22 bp, Homo sapiens
tttggaatattgagaaagtgaa

SEQ ID NO: 7287906 - DNA, 22 bp, Homo sapiens
tttggaatagcatagaagctca

SEQ ID NO: 7287907 - DNA, 22 bp, Homo sapiens
tttggaatattaaaatgtctca

SEQ ID NO: 7287908 - DNA, 22 bp, Homo sapiens
ctctgtgcctcagttttcttct

SEQ ID NO: 7287909 - DNA, 22 bp, Homo sapiens
ctctgtgggtatttatatgtat

SEQ ID NO: 7287910 - DNA, 22 bp, Homo sapiens
ctctgtgttcagcctagcagaa

SEQ ID NO: 7287911 - DNA, 22 bp, Homo sapiens
ctgctgtgagtttggaggtcta

SEQ ID NO: 7287912 - DNA, 19 bp, Homo sapiens
ctgctgggtgctgagggag

SEQ ID NO: 7287913 - DNA, 22 bp, Homo sapiens
ctgctgggtttgcctttcacca

SEQ ID NO: 7287914 - DNA, 22 bp, Homo sapiens
ctgctgagaaaagactgaggga

SEQ ID NO: 7287915 - DNA, 22 bp, Homo sapiens
ctgctgagcatcagggctgccc

SEQ ID NO: 7287916 - DNA, 22 bp, Homo sapiens
ctgctgagatgccaggagctct

SEQ ID NO: 7287917 - DNA, 22 bp, Homo sapiens
ctgctgagagctgaaggctgta

SEQ ID NO: 7287918 - DNA, 20 bp, Homo sapiens
ctgctgagagcctggcttgc

SEQ ID NO: 7287919 - DNA, 22 bp, Homo sapiens
ctgccttccaaccccagactcc

SEQ ID NO: 7287920 - DNA, 22 bp, Homo sapiens
ctgcctgtttcctcttgctccc

SEQ ID NO: 7287921 - DNA, 22 bp, Homo sapiens
ctgcctgtggacaccctggagg

SEQ ID NO: 7287922 - DNA, 22 bp, Homo sapiens
ctgcctgtgtctattccttttt

SEQ ID NO: 7287923 - DNA, 22 bp, Homo sapiens
ctgcctgtgtgtgcctgcagaa

SEQ ID NO: 7287924 - DNA, 22 bp, Homo sapiens
ctgctctgtttcttagctgggt

SEQ ID NO: 7287925 - DNA, 22 bp, Homo sapiens
ctgcggctggggacagctgttg

SEQ ID NO: 7287926 - DNA, 22 bp, Homo sapiens
ctgcggctctgcgggcagctgg

SEQ ID NO: 7287927 - DNA, 22 bp, Homo sapiens
ctgcccaggaaggagaggatgg

SEQ ID NO: 7287928 - DNA, 22 bp, Homo sapiens
ctgcccaggctgaaggaacatc

SEQ ID NO: 7287929 - DNA, 22 bp, Homo sapiens
ctgcccctgccaggcagctgtc

SEQ ID NO: 7287930 - DNA, 22 bp, Homo sapiens
ctgcccaggaaccagaggggca

SEQ ID NO: 7287931 - DNA, 22 bp, Homo sapiens
ctgcagcttatttgctgtgtga

SEQ ID NO: 7287932 - DNA, 22 bp, Homo sapiens
ctgcagctgtgagtgctggatg

SEQ ID NO: 7287933 - DNA, 22 bp, Homo sapiens
ctgagcagtctagccaggtgtt

SEQ ID NO: 7287934 - DNA, 22 bp, Homo sapiens
ctgagcagtagagggtctcttt

SEQ ID NO: 7287935 - DNA, 19 bp, Homo sapiens
ctgagcaggcaggtaggat

SEQ ID NO: 7287936 - DNA, 22 bp, Homo sapiens
ctgagcagaccatggcagaggt

SEQ ID NO: 7287937 - DNA, 22 bp, Homo sapiens
ctgagcagcgtggggagctggc

SEQ ID NO: 7287938 - DNA, 19 bp, Homo sapiens
ttttggaaatgtgaacagc

SEQ ID NO: 7287939 - DNA, 22 bp, Homo sapiens
ttttggaacacagacattagaa

SEQ ID NO: 7287940 - DNA, 22 bp, Homo sapiens
ttttggaaccaacagtgcacct

SEQ ID NO: 7287941 - DNA, 22 bp, Homo sapiens
ttttggaatcatttacagagca

SEQ ID NO: 7287942 - DNA, 22 bp, Homo sapiens
ttttggaatctgggaaaacagt

SEQ ID NO: 7287943 - DNA, 22 bp, Homo sapiens
ctgaggctggagtgcagtggtg

SEQ ID NO: 7287944 - DNA, 18 bp, Homo sapiens
ctgaggctggcaggagcc

SEQ ID NO: 7287945 - DNA, 22 bp, Homo sapiens
ctgaggctcaagggcaggtggg

SEQ ID NO: 7287946 - DNA, 22 bp, Homo sapiens
ttggctctgtgtctccactcaa

SEQ ID NO: 7287947 - DNA, 22 bp, Homo sapiens
ttggctctgaaacccaagctct

SEQ ID NO: 7287948 - DNA, 22 bp, Homo sapiens
ctccactcaccagatgccagga

SEQ ID NO: 7287949 - DNA, 22 bp, Homo sapiens
ttggagttctgggcacagctgc

SEQ ID NO: 7287950 - DNA, 22 bp, Homo sapiens
ctcagtcagtttttgtgagaga

SEQ ID NO: 7287951 - DNA, 22 bp, Homo sapiens
ttgccctgcctccctgaggtga

SEQ ID NO: 7287952 - DNA, 22 bp, Homo sapiens
ttgccctgaagaacgtcccaga

SEQ ID NO: 7287953 - DNA, 22 bp, Homo sapiens
ttgccctgcgttaccatctctt

SEQ ID NO: 7287954 - DNA, 22 bp, Homo sapiens
ttgccctgcgggtcctgcgcaa

SEQ ID NO: 7287955 - DNA, 22 bp, Homo sapiens
ttgccctgtcttaagctggcaa

SEQ ID NO: 7287956 - DNA, 22 bp, Homo sapiens
ttgccctgtggggcctccagcc

SEQ ID NO: 7287957 - DNA, 22 bp, Homo sapiens
ttgcccagagtccacagcgtac

SEQ ID NO: 7287958 - DNA, 22 bp, Homo sapiens
ttgcatatgaagctgacttaaa

SEQ ID NO: 7287959 - DNA, 22 bp, Homo sapiens
ctagaaatattttacagtcaag

SEQ ID NO: 7287960 - DNA, 22 bp, Homo sapiens
ctaaaaactctacgatgcacag

SEQ ID NO: 7287961 - DNA, 22 bp, Homo sapiens
ctaaaaatccacactaggtgaa

SEQ ID NO: 7287962 - DNA, 22 bp, Homo sapiens
ctatagaaacaacctctctttc

SEQ ID NO: 7287963 - DNA, 22 bp, Homo sapiens
ctcacccctgtaattccagcac

SEQ ID NO: 7287964 - DNA, 22 bp, Homo sapiens
ttctggctctcccctgctgggt

SEQ ID NO: 7287965 - DNA, 22 bp, Homo sapiens
ttacagtgttacttgatgtcca

SEQ ID NO: 7287966 - DNA, 22 bp, Homo sapiens
ttacagtgtgcaatcccagaat

SEQ ID NO: 7287967 - DNA, 22 bp, Homo sapiens
ttacagtggtcatttgggaaaa

SEQ ID NO: 7287968 - DNA, 22 bp, Homo sapiens
ttacagtttatccaggaagagc

SEQ ID NO: 7287969 - DNA, 22 bp, Homo sapiens
ccttaaaagaactatctcttct

SEQ ID NO: 7287970 - DNA, 22 bp, Homo sapiens
ttaagcaacaagaatcccattg

SEQ ID NO: 7287971 - DNA, 22 bp, Homo sapiens
ttaaatagtaggtctattttgg

SEQ ID NO: 7287972 - DNA, 22 bp, Homo sapiens
ccttgcctcattgtgcttctcc

SEQ ID NO: 7287973 - DNA, 22 bp, Homo sapiens
ttattgagtttacagctttaga

SEQ ID NO: 7287974 - DNA, 19 bp, Homo sapiens
ccttttttaacttcagcaa

SEQ ID NO: 7287975 - DNA, 22 bp, Homo sapiens
cgtggggcgggtggacacttgc

SEQ ID NO: 7287976 - DNA, 22 bp, Homo sapiens
cgtgggctgcgcccagttcttc

SEQ ID NO: 7287977 - DNA, 22 bp, Homo sapiens
cgtgggccccagccactccctc

SEQ ID NO: 7287978 - DNA, 22 bp, Homo sapiens
cggggcctaccgctgcgtggcc

SEQ ID NO: 7287979 - DNA, 22 bp, Homo sapiens
cggggcctagtctacctcggca

SEQ ID NO: 7287980 - DNA, 22 bp, Homo sapiens
cggggcctagctgcacaccctc

SEQ ID NO: 7287981 - DNA, 22 bp, Homo sapiens
cggggcctcagtttccccacct

SEQ ID NO: 7287982 - DNA, 22 bp, Homo sapiens
cggcagggttggttttctctga

SEQ ID NO: 7287983 - DNA, 22 bp, Homo sapiens
cggcagggctccatgcatttct

SEQ ID NO: 7287984 - DNA, 22 bp, Homo sapiens
gagctcagcccaaagagcagtg

SEQ ID NO: 7287985 - DNA, 22 bp, Homo sapiens
gagctcagcctgaggcctggct

SEQ ID NO: 7287986 - DNA, 22 bp, Homo sapiens
gagcaggcattctagtggctga

SEQ ID NO: 7287987 - DNA, 22 bp, Homo sapiens
gagcaggcattctagtggctga

SEQ ID NO: 7287988 - DNA, 22 bp, Homo sapiens
gagcaggcaaagatgaaaggag

SEQ ID NO: 7287989 - DNA, 22 bp, Homo sapiens
gagcaggcctggggtgaggcct

SEQ ID NO: 7287990 - DNA, 22 bp, Homo sapiens
gagcaggccagcaatggaaggg

SEQ ID NO: 7287991 - DNA, 22 bp, Homo sapiens
gagctgggtctccaccttggca

SEQ ID NO: 7287992 - DNA, 18 bp, Homo sapiens
gaggatggaaggagatgc

SEQ ID NO: 7287993 - DNA, 22 bp, Homo sapiens
gaggagagagggactgtctgca

SEQ ID NO: 7287994 - DNA, 22 bp, Homo sapiens
gaggaggttgacggcactgtga

SEQ ID NO: 7287995 - DNA, 22 bp, Homo sapiens
gagggtggcctttagagcccat

SEQ ID NO: 7287996 - DNA, 22 bp, Homo sapiens
gagggtggcctttagagcccat

SEQ ID NO: 7287997 - DNA, 22 bp, Homo sapiens
gagggtggaagagctgctgaga

SEQ ID NO: 7287998 - DNA, 22 bp, Homo sapiens
gagggtggctcctccctgggcc

SEQ ID NO: 7287999 - DNA, 20 bp, Homo sapiens
gagggtgggacttcctaggc

SEQ ID NO: 7288000 - DNA, 22 bp, Homo sapiens
gagggtggctcctccctgggcc

SEQ ID NO: 7288001 - DNA, 22 bp, Homo sapiens
gagggtggaaagggtgtacctg

SEQ ID NO: 7288002 - DNA, 22 bp, Homo sapiens
gagggtgggtttcttgcacgtc

SEQ ID NO: 7288003 - DNA, 22 bp, Homo sapiens
gagggtgggtacaccagccctc

SEQ ID NO: 7288004 - DNA, 22 bp, Homo sapiens
gagggtggggaatagactgcta

SEQ ID NO: 7288005 - DNA, 22 bp, Homo sapiens
gagggtgggctcctatctgggt

SEQ ID NO: 7288006 - DNA, 22 bp, Homo sapiens
gagggtgggctttgttcctcca

SEQ ID NO: 7288007 - DNA, 22 bp, Homo sapiens
gaggtggctgcttgctgggaaa

SEQ ID NO: 7288008 - DNA, 22 bp, Homo sapiens
gaggtggctccttcagggaata

SEQ ID NO: 7288009 - DNA, 22 bp, Homo sapiens
gaggtggctccttcagggaata

SEQ ID NO: 7288010 - DNA, 22 bp, Homo sapiens
gaggtggctgggagtagggaat

SEQ ID NO: 7288011 - DNA, 22 bp, Homo sapiens
gaggtggctgcttgctgggaaa

SEQ ID NO: 7288012 - DNA, 22 bp, Homo sapiens
gaggtggctggctcagagccag

SEQ ID NO: 7288013 - DNA, 22 bp, Homo sapiens
gaggtggctggctcagagccag

SEQ ID NO: 7288014 - DNA, 22 bp, Homo sapiens
gaggtgagtggatcacgaggtc

SEQ ID NO: 7288015 - DNA, 22 bp, Homo sapiens
gaggtgagtggatcacgaggtc

SEQ ID NO: 7288016 - DNA, 22 bp, Homo sapiens
gagtaattcttgggagactcca

SEQ ID NO: 7288017 - DNA, 22 bp, Homo sapiens
gagtaattgatttctgcttcta

SEQ ID NO: 7288018 - DNA, 22 bp, Homo sapiens
gagtaattccttagtgtgctta

SEQ ID NO: 7288019 - DNA, 22 bp, Homo sapiens
gagtaattctggtaaatcattg

SEQ ID NO: 7288020 - DNA, 22 bp, Homo sapiens
gagtaattagagcaatgacttt

SEQ ID NO: 7288021 - DNA, 22 bp, Homo sapiens
gagtaattccaatataaatcac

SEQ ID NO: 7288022 - DNA, 22 bp, Homo sapiens
gagtaattttcttaaaacatca

SEQ ID NO: 7288023 - DNA, 22 bp, Homo sapiens
gagtaattgtgtctggcacact

SEQ ID NO: 7288024 - DNA, 22 bp, Homo sapiens
gagtaatttatccagtgaagta

SEQ ID NO: 7288025 - DNA, 22 bp, Homo sapiens
gagtaattttcttgatttctta

SEQ ID NO: 7288026 - DNA, 22 bp, Homo sapiens
gaggtggcttagtctctggaca

SEQ ID NO: 7288027 - DNA, 22 bp, Homo sapiens
gaggtgggagggcagtccctaa

SEQ ID NO: 7288028 - DNA, 21 bp, Homo sapiens
gaggctgtctgctgctggcct

SEQ ID NO: 7288029 - DNA, 22 bp, Homo sapiens
gaggctggtttgccttttggca

SEQ ID NO: 7288030 - DNA, 22 bp, Homo sapiens
gagggaagattccccatatggg

SEQ ID NO: 7288031 - DNA, 22 bp, Homo sapiens
gaggctggtcagccctaagatc

SEQ ID NO: 7288032 - DNA, 22 bp, Homo sapiens
gaggctggtggttagttccatt

SEQ ID NO: 7288033 - DNA, 22 bp, Homo sapiens
gaggctggtggttagttccatt

SEQ ID NO: 7288034 - DNA, 22 bp, Homo sapiens
gaggctggttctgaagtactgt

SEQ ID NO: 7288035 - DNA, 22 bp, Homo sapiens
gaggctggttcccttgatcttt

SEQ ID NO: 7288036 - DNA, 22 bp, Homo sapiens
gaggcgggcagatcacctgagg

SEQ ID NO: 7288037 - DNA, 22 bp, Homo sapiens
gaggctggggtctgcctttctg

SEQ ID NO: 7288038 - DNA, 22 bp, Homo sapiens
gaggctggtaggaaaggaaaca

SEQ ID NO: 7288039 - DNA, 22 bp, Homo sapiens
gagagccctacaaggcgttttg

SEQ ID NO: 7288040 - DNA, 18 bp, Homo sapiens
gagaggagccagaatttt

SEQ ID NO: 7288041 - DNA, 22 bp, Homo sapiens
gagaggagtaggctgatggtgc

SEQ ID NO: 7288042 - DNA, 22 bp, Homo sapiens
gagaggagacttatccagattg

SEQ ID NO: 7288043 - DNA, 22 bp, Homo sapiens
gagagctgtccggctgagcagc

SEQ ID NO: 7288044 - DNA, 22 bp, Homo sapiens
gagagctgtccggctgagcagc

SEQ ID NO: 7288045 - DNA, 22 bp, Homo sapiens
gagagctgtcagcgtagcaccg

SEQ ID NO: 7288046 - DNA, 19 bp, Homo sapiens
gagcagcttcctatctggt

SEQ ID NO: 7288047 - DNA, 22 bp, Homo sapiens
gacagcagggaaagtccagacc

SEQ ID NO: 7288048 - DNA, 22 bp, Homo sapiens
gaattttattactagtcaactg

SEQ ID NO: 7288049 - DNA, 22 bp, Homo sapiens
gacaaagagaagtaacagtacc

SEQ ID NO: 7288050 - DNA, 22 bp, Homo sapiens
gacaaaagtgttttgaacaagg

SEQ ID NO: 7288051 - DNA, 22 bp, Homo sapiens
gaatgtttttaggaatgttatg

SEQ ID NO: 7288052 - DNA, 22 bp, Homo sapiens
gaccttccttctttgctccggg

SEQ ID NO: 7288053 - DNA, 22 bp, Homo sapiens
gaccttccatgccttcttccaa

SEQ ID NO: 7288054 - DNA, 22 bp, Homo sapiens
gacattaatggcaaattaatta

SEQ ID NO: 7288055 - DNA, 22 bp, Homo sapiens
gacctgcccactctgaggacat

SEQ ID NO: 7288056 - DNA, 22 bp, Homo sapiens
gaaaaatgctccaaatctgtgg

SEQ ID NO: 7288057 - DNA, 22 bp, Homo sapiens
gaaaaatgagctgatgtcaggg

SEQ ID NO: 7288058 - DNA, 22 bp, Homo sapiens
ctttggaatattttattgagaa

SEQ ID NO: 7288059 - DNA, 22 bp, Homo sapiens
ctttggaagtgaccacaatcct

SEQ ID NO: 7288060 - DNA, 22 bp, Homo sapiens
ctttggaataaaattagttgtt

SEQ ID NO: 7288061 - DNA, 22 bp, Homo sapiens
ctttggaagtgatagatatgat

SEQ ID NO: 7288062 - DNA, 22 bp, Homo sapiens
ctttggaagtaaagtcagcagg

SEQ ID NO: 7288063 - DNA, 22 bp, Homo sapiens
ctttggaaggaagacctttcag

SEQ ID NO: 7288064 - DNA, 22 bp, Homo sapiens
ctttggaaggcagagctctgtg

SEQ ID NO: 7288065 - DNA, 22 bp, Homo sapiens
ctttggaacatactgctgagct

SEQ ID NO: 7288066 - DNA, 22 bp, Homo sapiens
ctttggaactgtaaggagatgg

SEQ ID NO: 7288067 - DNA, 22 bp, Homo sapiens
ctttggatttttatcaggcaat

SEQ ID NO: 7288068 - DNA, 22 bp, Homo sapiens
ctttggaggtcatagccaagag

SEQ ID NO: 7288069 - DNA, 19 bp, Homo sapiens
ctttggagtcttttactct

SEQ ID NO: 7288070 - DNA, 22 bp, Homo sapiens
ctttggagttccctaatttccc

SEQ ID NO: 7288071 - DNA, 22 bp, Homo sapiens
ctttggagggcctttcctagcc

SEQ ID NO: 7288072 - DNA, 19 bp, Homo sapiens
ctttggaggatgaggctgg

SEQ ID NO: 7288073 - DNA, 22 bp, Homo sapiens
ctttggaggacctatgtgcaat

SEQ ID NO: 7288074 - DNA, 19 bp, Homo sapiens
ctttggagaatggtttgct

SEQ ID NO: 7288075 - DNA, 22 bp, Homo sapiens
ctttggaggaaaattgaggtca

SEQ ID NO: 7288076 - DNA, 20 bp, Homo sapiens
ctttggagaaagctaacaga

SEQ ID NO: 7288077 - DNA, 20 bp, Homo sapiens
ctttggagaaagatgcaata

SEQ ID NO: 7288078 - DNA, 22 bp, Homo sapiens
ctttggagaagaatgcatcctt

SEQ ID NO: 7288079 - DNA, 22 bp, Homo sapiens
ctttggagaaaagttcttgggc

SEQ ID NO: 7288080 - DNA, 22 bp, Homo sapiens
cttttgttctacagctggggaa

SEQ ID NO: 7288081 - DNA, 22 bp, Homo sapiens
gaaagacatagttgcaagatgg

SEQ ID NO: 7288082 - DNA, 22 bp, Homo sapiens
ctttggaacacatgggcatggt

SEQ ID NO: 7288083 - DNA, 22 bp, Homo sapiens
ctttggaacacccagctctgtg

SEQ ID NO: 7288084 - DNA, 22 bp, Homo sapiens
ctttccttaataagcaggtata

SEQ ID NO: 7288085 - DNA, 22 bp, Homo sapiens
ctttccttctcgtggttctcac

SEQ ID NO: 7288086 - DNA, 22 bp, Homo sapiens
ctttcctctggcactgtctggt

SEQ ID NO: 7288087 - DNA, 22 bp, Homo sapiens
cttggaattgatgattttcata

SEQ ID NO: 7288088 - DNA, 18 bp, Homo sapiens
cttggagaactaatgata

SEQ ID NO: 7288089 - DNA, 22 bp, Homo sapiens
cttggaacttagtaatatgaca

SEQ ID NO: 7288090 - DNA, 22 bp, Homo sapiens
cttggaacaaattaaacaatac

SEQ ID NO: 7288091 - DNA, 21 bp, Homo sapiens
cttggaacgggtagaactcac

SEQ ID NO: 7288092 - DNA, 19 bp, Homo sapiens
cttggagaaggctatgacc

SEQ ID NO: 7288093 - DNA, 19 bp, Homo sapiens
cttcccctgttacctcact

SEQ ID NO: 7288094 - DNA, 19 bp, Homo sapiens
cttctgtgatacatcagtc

SEQ ID NO: 7288095 - DNA, 22 bp, Homo sapiens
cttctgtgaatgaagtgtggga

SEQ ID NO: 7288096 - DNA, 22 bp, Homo sapiens
cttctgtgaccaccagcagccc

SEQ ID NO: 7288097 - DNA, 20 bp, Homo sapiens
ctgttaaaaggtatgaattc

SEQ ID NO: 7288098 - DNA, 22 bp, Homo sapiens
cttcagaaccagccagaagagg

SEQ ID NO: 7288099 - DNA, 22 bp, Homo sapiens
cttcagaaataacaacaattac

SEQ ID NO: 7288100 - DNA, 22 bp, Homo sapiens
ctgtcatggtttgaatgctcgc

SEQ ID NO: 7288101 - DNA, 22 bp, Homo sapiens
ctgtcccctgtgctttcacttg

SEQ ID NO: 7288102 - DNA, 21 bp, Homo sapiens
ctgtgacctttctttcctcct

SEQ ID NO: 7288103 - DNA, 22 bp, Homo sapiens
ctgtgaccttagcaagggaaat

SEQ ID NO: 7288104 - DNA, 22 bp, Homo sapiens
ctgtgacctccaggaaggggtg

SEQ ID NO: 7288105 - DNA, 22 bp, Homo sapiens
ctgtgagatttttaaataactt

SEQ ID NO: 7288106 - DNA, 22 bp, Homo sapiens
ctgtgaaatgctttgcgatggt

SEQ ID NO: 7288107 - DNA, 22 bp, Homo sapiens
ctgtgacccagttcctggcacc

SEQ ID NO: 7288108 - DNA, 20 bp, Homo sapiens
ctgtgaccagagacccagga

SEQ ID NO: 7288109 - DNA, 21 bp, Homo sapiens
ctgtccctctttgcttccctc

SEQ ID NO: 7288110 - DNA, 21 bp, Homo sapiens
ctgtggtacagctgggacgga

SEQ ID NO: 7288111 - DNA, 22 bp, Homo sapiens
ctgtggggagctgatcagatca

SEQ ID NO: 7288112 - DNA, 22 bp, Homo sapiens
ctgtggggaagatagaaccgac

SEQ ID NO: 7288113 - DNA, 22 bp, Homo sapiens
ctgggcctccagctctgccagc

SEQ ID NO: 7288114 - DNA, 22 bp, Homo sapiens
ctgggctcagcccatgctgtcc

SEQ ID NO: 7288115 - DNA, 22 bp, Homo sapiens
ctgggctcaagaagtcttccct

SEQ ID NO: 7288116 - DNA, 22 bp, Homo sapiens
ctgggctcaaatcctggccctg

SEQ ID NO: 7288117 - DNA, 22 bp, Homo sapiens
ctgggctcagtggctcatggct

SEQ ID NO: 7288118 - DNA, 22 bp, Homo sapiens
ctgggctccactacttgctaac

SEQ ID NO: 7288119 - DNA, 22 bp, Homo sapiens
ctgggcctcatgcacagagatg

SEQ ID NO: 7288120 - DNA, 22 bp, Homo sapiens
ctgggcctcatcctcagagttt

SEQ ID NO: 7288121 - DNA, 22 bp, Homo sapiens
ctgggcctcatccccagagttt

SEQ ID NO: 7288122 - DNA, 22 bp, Homo sapiens
ctgggcctcaatctcagagttt

SEQ ID NO: 7288123 - DNA, 22 bp, Homo sapiens
ctgggcctcaagctcagatttc

SEQ ID NO: 7288124 - DNA, 22 bp, Homo sapiens
ctgggcctaacccacagcgttt

SEQ ID NO: 7288125 - DNA, 22 bp, Homo sapiens
ctgggcctagaggaagctgaca

SEQ ID NO: 7288126 - DNA, 22 bp, Homo sapiens
ctgggcctagcaacagaggagt

SEQ ID NO: 7288127 - DNA, 22 bp, Homo sapiens
ctgggccaggaccagggttgaa

SEQ ID NO: 7288128 - DNA, 22 bp, Homo sapiens
ctgggtgttcaggagctgggct

SEQ ID NO: 7288129 - DNA, 22 bp, Homo sapiens
ctgggttacaagaagcaaaaac

SEQ ID NO: 7288130 - DNA, 22 bp, Homo sapiens
ctgggttaccatgaggaaatga

SEQ ID NO: 7288131 - DNA, 22 bp, Homo sapiens
ctggtgcctcctccctgtgctt

SEQ ID NO: 7288132 - DNA, 22 bp, Homo sapiens
ctggggctgtaggaggacttat

SEQ ID NO: 7288133 - DNA, 20 bp, Homo sapiens
ctgggctcggtggccctggc

SEQ ID NO: 7288134 - DNA, 22 bp, Homo sapiens
ctgggctccctcatgtgtctgc

SEQ ID NO: 7288135 - DNA, 22 bp, Homo sapiens
ctggggtctcaattctagcggg

SEQ ID NO: 7288136 - DNA, 22 bp, Homo sapiens
ctggggtccttgccatgtgtca

SEQ ID NO: 7288137 - DNA, 22 bp, Homo sapiens
gcagagtcattatttatgcaat

SEQ ID NO: 7288138 - DNA, 22 bp, Homo sapiens
gcagaggtgctcagtggcagaa

SEQ ID NO: 7288139 - DNA, 22 bp, Homo sapiens
gcagagtgaggaagagcttcca

SEQ ID NO: 7288140 - DNA, 22 bp, Homo sapiens
gcagatgttgttgctgggagtt

SEQ ID NO: 7288141 - DNA, 22 bp, Homo sapiens
gcaaggcagcgcggagtagcta

SEQ ID NO: 7288142 - DNA, 20 bp, Homo sapiens
gcaaggcacagtgaggaggg

SEQ ID NO: 7288143 - DNA, 22 bp, Homo sapiens
gcaaggaagcagagttgctatc

SEQ ID NO: 7288144 - DNA, 22 bp, Homo sapiens
gcagggcagcttagtccctgtc

SEQ ID NO: 7288145 - DNA, 22 bp, Homo sapiens
gcagggcagctgaagctaggtg

SEQ ID NO: 7288146 - DNA, 22 bp, Homo sapiens
gcagggcagctcactgtggttc

SEQ ID NO: 7288147 - DNA, 22 bp, Homo sapiens
gcaggcatggtcgctgccaggt

SEQ ID NO: 7288148 - DNA, 22 bp, Homo sapiens
gcaggccacagtggagtctctg

SEQ ID NO: 7288149 - DNA, 22 bp, Homo sapiens
gcagggcagggcaagaactggg

SEQ ID NO: 7288150 - DNA, 22 bp, Homo sapiens
gcagggcagtaagagctagagt

SEQ ID NO: 7288151 - DNA, 22 bp, Homo sapiens
gcagggcatgggccctgtctgc

SEQ ID NO: 7288152 - DNA, 19 bp, Homo sapiens
gcagggtgttgactgtccc

SEQ ID NO: 7288153 - DNA, 23 bp, Homo sapiens
gcagctggttagaagggaaggag

SEQ ID NO: 7288154 - DNA, 22 bp, Homo sapiens
gcagctggttaatgggagaatt

SEQ ID NO: 7288155 - DNA, 22 bp, Homo sapiens
gcagctgggtctgtgtgggctg

SEQ ID NO: 7288156 - DNA, 22 bp, Homo sapiens
gcagctggggaggtcgtgggga

SEQ ID NO: 7288157 - DNA, 22 bp, Homo sapiens
gcagctggggaggtcgtgggga

SEQ ID NO: 7288158 - DNA, 22 bp, Homo sapiens
gcagctgggacactgaggccag

SEQ ID NO: 7288159 - DNA, 22 bp, Homo sapiens
gcagccaggaaagctggaccct

SEQ ID NO: 7288160 - DNA, 22 bp, Homo sapiens
gccaggcgggtctcaaactcct

SEQ ID NO: 7288161 - DNA, 22 bp, Homo sapiens
gccaggctaagaaaggtgtgat

SEQ ID NO: 7288162 - DNA, 23 bp, Homo sapiens
gccaggctccggtctgtggccac

SEQ ID NO: 7288163 - DNA, 22 bp, Homo sapiens
gccagctgagcaaattccagct

SEQ ID NO: 7288164 - DNA, 22 bp, Homo sapiens
gcctgcaaacctgaagatttaa

SEQ ID NO: 7288165 - DNA, 22 bp, Homo sapiens
gcctgcagggcctgggcctacc

SEQ ID NO: 7288166 - DNA, 22 bp, Homo sapiens
gcctccacccctggggagtgga

SEQ ID NO: 7288167 - DNA, 22 bp, Homo sapiens
gcccctctcccttgaggcaggc

SEQ ID NO: 7288168 - DNA, 18 bp, Homo sapiens
gcctccaccatggagggt

SEQ ID NO: 7288169 - DNA, 22 bp, Homo sapiens
gccctgcttggtcatggccttc

SEQ ID NO: 7288170 - DNA, 22 bp, Homo sapiens
gccctgcttctggcatgcagaa

SEQ ID NO: 7288171 - DNA, 22 bp, Homo sapiens
gccctgctgtcttcagagtata

SEQ ID NO: 7288172 - DNA, 22 bp, Homo sapiens
gccctgctgctggcagaggcgc

SEQ ID NO: 7288173 - DNA, 22 bp, Homo sapiens
gccctgcctgtctgctgggagg

SEQ ID NO: 7288174 - DNA, 23 bp, Homo sapiens
gccctgctactcacaagctgtgt

SEQ ID NO: 7288175 - DNA, 22 bp, Homo sapiens
gccctgctcatttcacgtgttt

SEQ ID NO: 7288176 - DNA, 23 bp, Homo sapiens
gccctgctcctggctgggaggga

SEQ ID NO: 7288177 - DNA, 22 bp, Homo sapiens
gctttacaagtggtgcagatta

SEQ ID NO: 7288178 - DNA, 22 bp, Homo sapiens
gctttacacagatgaatatttc

SEQ ID NO: 7288179 - DNA, 22 bp, Homo sapiens
gctttacatgatttctcaccct

SEQ ID NO: 7288180 - DNA, 22 bp, Homo sapiens
gctttaaatggcttgcccaagt

SEQ ID NO: 7288181 - DNA, 22 bp, Homo sapiens
gctttaaacctctactctgtcc

SEQ ID NO: 7288182 - DNA, 22 bp, Homo sapiens
gcttgtctgctgagccacctgt

SEQ ID NO: 7288183 - DNA, 23 bp, Homo sapiens
gcttgtctagtgaattcatatct

SEQ ID NO: 7288184 - DNA, 22 bp, Homo sapiens
gcttgtctctcagccccagtca

SEQ ID NO: 7288185 - DNA, 22 bp, Homo sapiens
gctttacattttggaaaggtga

SEQ ID NO: 7288186 - DNA, 22 bp, Homo sapiens
gcttttcatagataaaattcta

SEQ ID NO: 7288187 - DNA, 22 bp, Homo sapiens
ggacagagggttgacagagtat

SEQ ID NO: 7288188 - DNA, 22 bp, Homo sapiens
ggaaggaattccaagactaaag

SEQ ID NO: 7288189 - DNA, 19 bp, Homo sapiens
ggaaggagagaaatgcatg

SEQ ID NO: 7288190 - DNA, 22 bp, Homo sapiens
ggagaaaggcatagcagaacct

SEQ ID NO: 7288191 - DNA, 22 bp, Homo sapiens
ggacagggtaagtactagtgtg

SEQ ID NO: 7288192 - DNA, 22 bp, Homo sapiens
ggaggaggggtgactgaatgct

SEQ ID NO: 7288193 - DNA, 22 bp, Homo sapiens
ggagctggctacagagaactcc

SEQ ID NO: 7288194 - DNA, 22 bp, Homo sapiens
ggagctgggaattggatcatct

SEQ ID NO: 7288195 - DNA, 18 bp, Homo sapiens
ggagctgggcctggttcc

SEQ ID NO: 7288196 - DNA, 22 bp, Homo sapiens
ggagccagtgccctctggtgga

SEQ ID NO: 7288197 - DNA, 18 bp, Homo sapiens
ggagccagtctgtctctg

SEQ ID NO: 7288198 - DNA, 22 bp, Homo sapiens
ggagccaggcatatcggggcac

SEQ ID NO: 7288199 - DNA, 22 bp, Homo sapiens
ggagccagggaagctgcttcct

SEQ ID NO: 7288200 - DNA, 22 bp, Homo sapiens
ggagccaggggaccttcacaga

SEQ ID NO: 7288201 - DNA, 22 bp, Homo sapiens
ggagccaggcaatctgtacttt

SEQ ID NO: 7288202 - DNA, 22 bp, Homo sapiens
gctgcagggctctcacaggggg

SEQ ID NO: 7288203 - DNA, 22 bp, Homo sapiens
gctgcctccactggctcccagt

SEQ ID NO: 7288204 - DNA, 22 bp, Homo sapiens
gctgcctcctgaaagcgctctg

SEQ ID NO: 7288205 - DNA, 22 bp, Homo sapiens
gctgctggggtggagaaacgct

SEQ ID NO: 7288206 - DNA, 22 bp, Homo sapiens
gctgctgggtccctctgtgcca

SEQ ID NO: 7288207 - DNA, 18 bp, Homo sapiens
gctgctggtggagggagc

SEQ ID NO: 7288208 - DNA, 22 bp, Homo sapiens
gctgctggtcctcagagctcat

SEQ ID NO: 7288209 - DNA, 22 bp, Homo sapiens
gctgctggggccttccctcggg

SEQ ID NO: 7288210 - DNA, 22 bp, Homo sapiens
gctgctgggggaacagttaaaa

SEQ ID NO: 7288211 - DNA, 22 bp, Homo sapiens
gctgctggggtcacatggtaag

SEQ ID NO: 7288212 - DNA, 22 bp, Homo sapiens
gctgctgggcaccccctgagct

SEQ ID NO: 7288213 - DNA, 22 bp, Homo sapiens
gctgctgggaatgaacagtgtt

SEQ ID NO: 7288214 - DNA, 22 bp, Homo sapiens
gctgctgggatcctgggtctca

SEQ ID NO: 7288215 - DNA, 22 bp, Homo sapiens
gctgctgggagggatcgtaaat

SEQ ID NO: 7288216 - DNA, 19 bp, Homo sapiens
gctgctggctctggctgga

SEQ ID NO: 7288217 - DNA, 22 bp, Homo sapiens
gctgctggcttcctgctgtttt

SEQ ID NO: 7288218 - DNA, 22 bp, Homo sapiens
gctgcctgaaatgttgcctagc

SEQ ID NO: 7288219 - DNA, 22 bp, Homo sapiens
gctgctggaacaaatcacccca

SEQ ID NO: 7288220 - DNA, 22 bp, Homo sapiens
gctgctggaagcatgcgatgaa

SEQ ID NO: 7288221 - DNA, 22 bp, Homo sapiens
gctggcagtttcctcaccgagg

SEQ ID NO: 7288222 - DNA, 22 bp, Homo sapiens
gctggcagtaaagggtttggca

SEQ ID NO: 7288223 - DNA, 22 bp, Homo sapiens
gctggcagtcccatcagctggg

SEQ ID NO: 7288224 - DNA, 22 bp, Homo sapiens
gctggcagtgtattgttagctg

SEQ ID NO: 7288225 - DNA, 22 bp, Homo sapiens
gctggcaggtccaagatagagc

SEQ ID NO: 7288226 - DNA, 22 bp, Homo sapiens
gctctgtatgagggtgagagat

SEQ ID NO: 7288227 - DNA, 22 bp, Homo sapiens
gctctgtacctgcggagatgag

SEQ ID NO: 7288228 - DNA, 22 bp, Homo sapiens
gctctctgggtgtgtctagata

SEQ ID NO: 7288229 - DNA, 20 bp, Homo sapiens
gctccccttctctgggcctc

SEQ ID NO: 7288230 - DNA, 22 bp, Homo sapiens
gctccccttggtcctcctggga

SEQ ID NO: 7288231 - DNA, 20 bp, Homo sapiens
gctccccttctctgggcctc

SEQ ID NO: 7288232 - DNA, 22 bp, Homo sapiens
gctccccattgatctgcaggct

SEQ ID NO: 7288233 - DNA, 22 bp, Homo sapiens
gctctctccctaggcaagtgag

SEQ ID NO: 7288234 - DNA, 22 bp, Homo sapiens
gctagcctgcagtggctatggt

SEQ ID NO: 7288235 - DNA, 22 bp, Homo sapiens
gctaggcttcaaaatctccctg

SEQ ID NO: 7288236 - DNA, 22 bp, Homo sapiens
gcctggcagcctccaaccttca

SEQ ID NO: 7288237 - DNA, 22 bp, Homo sapiens
gcctggcactgggctcctggcc

SEQ ID NO: 7288238 - DNA, 22 bp, Homo sapiens
gcctggcactcaatcatctgct

SEQ ID NO: 7288239 - DNA, 22 bp, Homo sapiens
ggctctgccacttcttggctgt

SEQ ID NO: 7288240 - DNA, 22 bp, Homo sapiens
ggctctgcatgtgagtgggtgg

SEQ ID NO: 7288241 - DNA, 22 bp, Homo sapiens
ggctcagcacagggctggcatc

SEQ ID NO: 7288242 - DNA, 22 bp, Homo sapiens
ggctagggactcctcctcaggg

SEQ ID NO: 7288243 - DNA, 22 bp, Homo sapiens
ggctagggaaaatgattggata

SEQ ID NO: 7288244 - DNA, 22 bp, Homo sapiens
ggcctctcttgggacagctgtc

SEQ ID NO: 7288245 - DNA, 22 bp, Homo sapiens
ggcctctctggcatggctgccc

SEQ ID NO: 7288246 - DNA, 22 bp, Homo sapiens
ggcagtgggtggatctcaggga

SEQ ID NO: 7288247 - DNA, 22 bp, Homo sapiens
ggcagtggcatgtgggtagtgg

SEQ ID NO: 7288248 - DNA, 22 bp, Homo sapiens
ggaggatgagctacgaggagct

SEQ ID NO: 7288249 - DNA, 22 bp, Homo sapiens
ggaggaggtgggttaagttgta

SEQ ID NO: 7288250 - DNA, 22 bp, Homo sapiens
ggaggaggggtttacattggaa

SEQ ID NO: 7288251 - DNA, 22 bp, Homo sapiens
ggcagatggggtgacaagagag

SEQ ID NO: 7288252 - DNA, 22 bp, Homo sapiens
ggcagatggagaagcagcaggt

SEQ ID NO: 7288253 - DNA, 22 bp, Homo sapiens
ggcagatgttatatgatctgag

SEQ ID NO: 7288254 - DNA, 22 bp, Homo sapiens
ggcagaggtgacagtgtctttt

SEQ ID NO: 7288255 - DNA, 22 bp, Homo sapiens
ggcactcagagattcaggctgt

SEQ ID NO: 7288256 - DNA, 22 bp, Homo sapiens
ggcagatgttgcagtgagcaga

SEQ ID NO: 7288257 - DNA, 22 bp, Homo sapiens
ggcagcagaactggccctgtat

SEQ ID NO: 7288258 - DNA, 22 bp, Homo sapiens
ggcagggaaacagctgatccca

SEQ ID NO: 7288259 - DNA, 22 bp, Homo sapiens
ggcagggcttgtctctgtgatg

SEQ ID NO: 7288260 - DNA, 22 bp, Homo sapiens
ggcaggggtcctggtgttgact

SEQ ID NO: 7288261 - DNA, 20 bp, Homo sapiens
ggcagggcatcaacagctct

SEQ ID NO: 7288262 - DNA, 22 bp, Homo sapiens
ggcagtggaggaccctgtgtct

SEQ ID NO: 7288263 - DNA, 18 bp, Homo sapiens
ggcagtgcagtctcaggg

SEQ ID NO: 7288264 - DNA, 22 bp, Homo sapiens
ggcagtgccactaagctctgct

SEQ ID NO: 7288265 - DNA, 22 bp, Homo sapiens
ggcagtgagtcccggagaggcc

SEQ ID NO: 7288266 - DNA, 20 bp, Homo sapiens
ggcaggctttatatggaggg

SEQ ID NO: 7288267 - DNA, 22 bp, Homo sapiens
ggcaggctgttcacctgctttt

SEQ ID NO: 7288268 - DNA, 22 bp, Homo sapiens
ggcaggctgttcacctgctttt

SEQ ID NO: 7288269 - DNA, 22 bp, Homo sapiens
gggagtgggtttggcctaggcc

SEQ ID NO: 7288270 - DNA, 17 bp, Homo sapiens
gggcagggactcctggg

SEQ ID NO: 7288271 - DNA, 20 bp, Homo sapiens
gggcagagccagccagtccc

SEQ ID NO: 7288272 - DNA, 22 bp, Homo sapiens
gggcagaggctctggcccatcc

SEQ ID NO: 7288273 - DNA, 23 bp, Homo sapiens
gggctcagatttcattctgtgcc

SEQ ID NO: 7288274 - DNA, 22 bp, Homo sapiens
gggctcagagcatttgggttgg

SEQ ID NO: 7288275 - DNA, 22 bp, Homo sapiens
gggctcagctgggcgtgctggt

SEQ ID NO: 7288276 - DNA, 22 bp, Homo sapiens
gggctcagttctgcttcatgct

SEQ ID NO: 7288277 - DNA, 22 bp, Homo sapiens
gggctctggaaatgggagctcc

SEQ ID NO: 7288278 - DNA, 22 bp, Homo sapiens
gggctcattcatctgggcttgg

SEQ ID NO: 7288279 - DNA, 22 bp, Homo sapiens
gggccctgtgatttcttgagga

SEQ ID NO: 7288280 - DNA, 22 bp, Homo sapiens
gggctcagacatccctcctgga

SEQ ID NO: 7288281 - DNA, 22 bp, Homo sapiens
gggccctggggcctgatttgca

SEQ ID NO: 7288282 - DNA, 22 bp, Homo sapiens
gggccctggggatgtggacgcg

SEQ ID NO: 7288283 - DNA, 22 bp, Homo sapiens
gggccctgcctaaggaacacac

SEQ ID NO: 7288284 - DNA, 22 bp, Homo sapiens
gggccctgccccgtggctctga

SEQ ID NO: 7288285 - DNA, 22 bp, Homo sapiens
gggccctgatctgtgagcgcag

SEQ ID NO: 7288286 - DNA, 22 bp, Homo sapiens
gggccccttgtatctctggctc

SEQ ID NO: 7288287 - DNA, 22 bp, Homo sapiens
gggcaggtgtgcagagctgttg

SEQ ID NO: 7288288 - DNA, 22 bp, Homo sapiens
gggaagagggagctggaatgat

SEQ ID NO: 7288289 - DNA, 22 bp, Homo sapiens
ggctgtggtcattaggaggttg

SEQ ID NO: 7288290 - DNA, 22 bp, Homo sapiens
ggctgtgcttggtgtccttgga

SEQ ID NO: 7288291 - DNA, 22 bp, Homo sapiens
ggctggccagggccctcgctgg

SEQ ID NO: 7288292 - DNA, 18 bp, Homo sapiens
ggctgtgcgtggaggctg

SEQ ID NO: 7288293 - DNA, 22 bp, Homo sapiens
gggaaggcatacctgagggaga

SEQ ID NO: 7288294 - DNA, 22 bp, Homo sapiens
gggaagcatctgagggtccact

SEQ ID NO: 7288295 - DNA, 22 bp, Homo sapiens
gggaagagtgtcggttgaagtg

SEQ ID NO: 7288296 - DNA, 22 bp, Homo sapiens
gggaagagtgtcggttgaagtg

SEQ ID NO: 7288297 - DNA, 22 bp, Homo sapiens
ggctgcagttgtgtgaaggccg

SEQ ID NO: 7288298 - DNA, 22 bp, Homo sapiens
ggctgcaggttggttggcagct

SEQ ID NO: 7288299 - DNA, 22 bp, Homo sapiens
ggctgcaggttggttggcagct

SEQ ID NO: 7288300 - DNA, 22 bp, Homo sapiens
ggctggcaggggatgtcagatg

SEQ ID NO: 7288301 - DNA, 22 bp, Homo sapiens
ggctggcagtgtgagagaggga

SEQ ID NO: 7288302 - DNA, 22 bp, Homo sapiens
ggctggcaggcacagtatgcaa

SEQ ID NO: 7288303 - DNA, 22 bp, Homo sapiens
ggctggcagaggggagtctgtg

SEQ ID NO: 7288304 - DNA, 22 bp, Homo sapiens
ggctggcagaagtgtgctggct

SEQ ID NO: 7288305 - DNA, 17 bp, Homo sapiens
ggctggaggggacccgg

SEQ ID NO: 7288306 - DNA, 17 bp, Homo sapiens
ggctggagcagctcccc

SEQ ID NO: 7288307 - DNA, 22 bp, Homo sapiens
ggctgcctgaggctgaggcccg

SEQ ID NO: 7288308 - DNA, 22 bp, Homo sapiens
gtaggtcagacataagaggaca

SEQ ID NO: 7288309 - DNA, 22 bp, Homo sapiens
gtacaaattttgacatctagga

SEQ ID NO: 7288310 - DNA, 22 bp, Homo sapiens
gtacaaattgatacaggttttc

SEQ ID NO: 7288311 - DNA, 22 bp, Homo sapiens
gtacaaattgatacagatttga

SEQ ID NO: 7288312 - DNA, 22 bp, Homo sapiens
gtacaaattaggaagctttgtg

SEQ ID NO: 7288313 - DNA, 22 bp, Homo sapiens
gtacaaatgtacacttgtataa

SEQ ID NO: 7288314 - DNA, 22 bp, Homo sapiens
gtacaaatgcaggtttgttaca

SEQ ID NO: 7288315 - DNA, 22 bp, Homo sapiens
gtacaaatgagagttctgtttt

SEQ ID NO: 7288316 - DNA, 22 bp, Homo sapiens
gtacaaatgaaaatagaccact

SEQ ID NO: 7288317 - DNA, 22 bp, Homo sapiens
gtacaaatgaaaatagaccact

SEQ ID NO: 7288318 - DNA, 22 bp, Homo sapiens
gtacaaatacattctgaaggta

SEQ ID NO: 7288319 - DNA, 22 bp, Homo sapiens
gtatttcctatagtgagggcct

SEQ ID NO: 7288320 - DNA, 22 bp, Homo sapiens
gtatttcctcgcttgtgggatt

SEQ ID NO: 7288321 - DNA, 22 bp, Homo sapiens
gtatacactggtaagatttgtc

SEQ ID NO: 7288322 - DNA, 22 bp, Homo sapiens
gtcagaggaggctgagtaggaa

SEQ ID NO: 7288323 - DNA, 22 bp, Homo sapiens
gtccaggctaagtcccttctgc

SEQ ID NO: 7288324 - DNA, 22 bp, Homo sapiens
gtccagggaaatagcgacaggg

SEQ ID NO: 7288325 - DNA, 22 bp, Homo sapiens
gtccaggctgacccctagagga

SEQ ID NO: 7288326 - DNA, 22 bp, Homo sapiens
gtcctgctggcttcaggagatt

SEQ ID NO: 7288327 - DNA, 22 bp, Homo sapiens
gtcttgggacccgcactgtggg

SEQ ID NO: 7288328 - DNA, 22 bp, Homo sapiens
gtgaaaaatcatcatgacttga

SEQ ID NO: 7288329 - DNA, 22 bp, Homo sapiens
gtcttttttacaccttacatca

SEQ ID NO: 7288330 - DNA, 22 bp, Homo sapiens
gtctttttctacgatagcgcct

SEQ ID NO: 7288331 - DNA, 22 bp, Homo sapiens
gtctttttgtctggcagaggtc

SEQ ID NO: 7288332 - DNA, 22 bp, Homo sapiens
gtctttttattatagagtggag

SEQ ID NO: 7288333 - DNA, 21 bp, Homo sapiens
gtctttttaattgcgatttcc

SEQ ID NO: 7288334 - DNA, 22 bp, Homo sapiens
gtgaggagggctggtcccaggc

SEQ ID NO: 7288335 - DNA, 22 bp, Homo sapiens
gtgctgagtgcagagtgcagag

SEQ ID NO: 7288336 - DNA, 22 bp, Homo sapiens
gtgcccagctccacctcacaga

SEQ ID NO: 7288337 - DNA, 22 bp, Homo sapiens
gtgcccaggcccaaggcaccac

SEQ ID NO: 7288338 - DNA, 22 bp, Homo sapiens
gtgcagggcagccgaatgggct

SEQ ID NO: 7288339 - DNA, 22 bp, Homo sapiens
gtgcagggcagccgaatgggct

SEQ ID NO: 7288340 - DNA, 22 bp, Homo sapiens
gtgcaggggatcaggttgcagc

SEQ ID NO: 7288341 - DNA, 22 bp, Homo sapiens
gtgcagggctggcaccggaggc

SEQ ID NO: 7288342 - DNA, 22 bp, Homo sapiens
gtgcagggcaggtgtccttcca

SEQ ID NO: 7288343 - DNA, 22 bp, Homo sapiens
gtgcagggccctcctaacatct

SEQ ID NO: 7288344 - DNA, 22 bp, Homo sapiens
gtgcagggtagcgacggcagga

SEQ ID NO: 7288345 - DNA, 22 bp, Homo sapiens
gtgcaggggcctccccttgctg

SEQ ID NO: 7288346 - DNA, 17 bp, Homo sapiens
gtgcagggatgaaggat

SEQ ID NO: 7288347 - DNA, 22 bp, Homo sapiens
gtgcagggagcccagaaggtcc

SEQ ID NO: 7288348 - DNA, 22 bp, Homo sapiens
ggggtggatcaggcaggcccag

SEQ ID NO: 7288349 - DNA, 22 bp, Homo sapiens
ggggtggatttcaggcggtgtc

SEQ ID NO: 7288350 - DNA, 22 bp, Homo sapiens
ggggcccttgtggctgcaggcc

SEQ ID NO: 7288351 - DNA, 22 bp, Homo sapiens
ggggccagcaatgttgaggaat

SEQ ID NO: 7288352 - DNA, 22 bp, Homo sapiens
gggtgcagcagagctcctctgt

SEQ ID NO: 7288353 - DNA, 22 bp, Homo sapiens
ggggagaattaccaaaagcgct

SEQ ID NO: 7288354 - DNA, 22 bp, Homo sapiens
ggggagaattacatggcgtgga

SEQ ID NO: 7288355 - DNA, 22 bp, Homo sapiens
ggggagaataaatcagatttta

SEQ ID NO: 7288356 - DNA, 22 bp, Homo sapiens
ggggaggcaagatgaagtgagg

SEQ ID NO: 7288357 - DNA, 22 bp, Homo sapiens
ggggcagggaggttatcgccga

SEQ ID NO: 7288358 - DNA, 22 bp, Homo sapiens
gggctggtgaggctgccctgca

SEQ ID NO: 7288359 - DNA, 22 bp, Homo sapiens
gggctctgggatgctcttagag

SEQ ID NO: 7288360 - DNA, 19 bp, Homo sapiens
gggctctggcctcagtggg

SEQ ID NO: 7288361 - DNA, 22 bp, Homo sapiens
gggctctgggattcagagcaag

SEQ ID NO: 7288362 - DNA, 22 bp, Homo sapiens
gggcttcaaaattggcactctt

SEQ ID NO: 7288363 - DNA, 22 bp, Homo sapiens
gggcttcagggtacttcctcct

SEQ ID NO: 7288364 - DNA, 22 bp, Homo sapiens
gggcttcaggagggtcagccca

SEQ ID NO: 7288365 - DNA, 23 bp, Homo sapiens
gggcttcattttaattcagctgc

SEQ ID NO: 7288366 - DNA, 22 bp, Homo sapiens
ggtccctgaagaggcctggggt

SEQ ID NO: 7288367 - DNA, 22 bp, Homo sapiens
ggtccctgaagatgcctgagga

SEQ ID NO: 7288368 - DNA, 22 bp, Homo sapiens
ggtccctgcccacctgggagct

SEQ ID NO: 7288369 - DNA, 20 bp, Homo sapiens
ggtccctgccctctgtcatc

SEQ ID NO: 7288370 - DNA, 22 bp, Homo sapiens
ggtcccagttgcccaggtcagg

SEQ ID NO: 7288371 - DNA, 23 bp, Homo sapiens
ggtcccagtggagaggcctcacc

SEQ ID NO: 7288372 - DNA, 22 bp, Homo sapiens
ggtgaggctggcttgccttctt

SEQ ID NO: 7288373 - DNA, 22 bp, Homo sapiens
ggtgaggcgtccccaccatggg

SEQ ID NO: 7288374 - DNA, 22 bp, Homo sapiens
ggtgagaggcagtgctgtggaa

SEQ ID NO: 7288375 - DNA, 22 bp, Homo sapiens
ggtgagaggcctgagagctgga

SEQ ID NO: 7288376 - DNA, 22 bp, Homo sapiens
ggtccctgctgaagccttggtg

SEQ ID NO: 7288377 - DNA, 22 bp, Homo sapiens
ggtgaggcaggtggctgctgag

SEQ ID NO: 7288378 - DNA, 22 bp, Homo sapiens
ggtggggcccaggcatctgatg

SEQ ID NO: 7288379 - DNA, 22 bp, Homo sapiens
ggtggggccctggcactggtat

SEQ ID NO: 7288380 - DNA, 22 bp, Homo sapiens
ggtggggccagggctccaacct

SEQ ID NO: 7288381 - DNA, 22 bp, Homo sapiens
ggtgggtggaaacagcatgtac

SEQ ID NO: 7288382 - DNA, 22 bp, Homo sapiens
ggtggggcctgctccagcggcc

SEQ ID NO: 7288383 - DNA, 22 bp, Homo sapiens
ggtggggctaggacctcaggat

SEQ ID NO: 7288384 - DNA, 22 bp, Homo sapiens
ggtggcagagacataggacata

SEQ ID NO: 7288385 - DNA, 22 bp, Homo sapiens
tacatgcaattaagagggtgaa

SEQ ID NO: 7288386 - DNA, 19 bp, Homo sapiens
tacatgcagcaggcacgca

SEQ ID NO: 7288387 - DNA, 22 bp, Homo sapiens
tacatgcatgtcacagaatgaa

SEQ ID NO: 7288388 - DNA, 22 bp, Homo sapiens
tacagtgctttttggtggagaa

SEQ ID NO: 7288389 - DNA, 22 bp, Homo sapiens
tacagtgcaatgtgatgtagat

SEQ ID NO: 7288390 - DNA, 22 bp, Homo sapiens
tacagtgcacatttcttaggaa

SEQ ID NO: 7288391 - DNA, 22 bp, Homo sapiens
tacagtgcatagaggcatgata

SEQ ID NO: 7288392 - DNA, 22 bp, Homo sapiens
tacagtgcgatttttaggcctc

SEQ ID NO: 7288393 - DNA, 22 bp, Homo sapiens
tacagtgcgggtgcgggcctct

SEQ ID NO: 7288394 - DNA, 22 bp, Homo sapiens
tacagtgcttggtatctagtaa

SEQ ID NO: 7288395 - DNA, 22 bp, Homo sapiens
tacagtgctagaacctgctgta

SEQ ID NO: 7288396 - DNA, 22 bp, Homo sapiens
tacagtcaagcataagaagtca

SEQ ID NO: 7288397 - DNA, 22 bp, Homo sapiens
tacagtcaacattgatgatgat

SEQ ID NO: 7288398 - DNA, 22 bp, Homo sapiens
taagcctgcatgaaccatgaga

SEQ ID NO: 7288399 - DNA, 22 bp, Homo sapiens
tacacaatctgtttttccattt

SEQ ID NO: 7288400 - DNA, 22 bp, Homo sapiens
tacaacattgtgttgcttcata

SEQ ID NO: 7288401 - DNA, 22 bp, Homo sapiens
gttttacaaatgacggcattca

SEQ ID NO: 7288402 - DNA, 22 bp, Homo sapiens
taaagacatgcaaagtctaatt

SEQ ID NO: 7288403 - DNA, 20 bp, Homo sapiens
taaagacataagctactatc

SEQ ID NO: 7288404 - DNA, 22 bp, Homo sapiens
taaagatgttctcatttcatag

SEQ ID NO: 7288405 - DNA, 19 bp, Homo sapiens
taaagcacatagcaaaagt

SEQ ID NO: 7288406 - DNA, 22 bp, Homo sapiens
taaagcaatttgagcaagttct

SEQ ID NO: 7288407 - DNA, 20 bp, Homo sapiens
taaagcagccgtggagggta

SEQ ID NO: 7288408 - DNA, 22 bp, Homo sapiens
taacatcaaactgcattttcta

SEQ ID NO: 7288409 - DNA, 22 bp, Homo sapiens
taacaggtggtagtttgtgctc

SEQ ID NO: 7288410 - DNA, 22 bp, Homo sapiens
gtgctggctgccaggaggctgc

SEQ ID NO: 7288411 - DNA, 22 bp, Homo sapiens
gtgctggctggacatggagcac

SEQ ID NO: 7288412 - DNA, 22 bp, Homo sapiens
gtgtttcctctagaagccatgg

SEQ ID NO: 7288413 - DNA, 22 bp, Homo sapiens
gtttcaaataggtttcagcaaa

SEQ ID NO: 7288414 - DNA, 22 bp, Homo sapiens
gtttatctagtgaagtgaagaa

SEQ ID NO: 7288415 - DNA, 22 bp, Homo sapiens
tatcaccagagggatagtctct

SEQ ID NO: 7288416 - DNA, 21 bp, Homo sapiens
tatcagaagagaaagaatgat

SEQ ID NO: 7288417 - DNA, 22 bp, Homo sapiens
tataaaatggcatcagctccaa

SEQ ID NO: 7288418 - DNA, 22 bp, Homo sapiens
tatgaaaatttagctgaagcat

SEQ ID NO: 7288419 - DNA, 22 bp, Homo sapiens
tatgaaaaggtggccaatgtag

SEQ ID NO: 7288420 - DNA, 22 bp, Homo sapiens
tatccaaacatatagtctctct

SEQ ID NO: 7288421 - DNA, 22 bp, Homo sapiens
tcaaagtaccattatcagtgga

SEQ ID NO: 7288422 - DNA, 22 bp, Homo sapiens
tcaaataaggagtcatgaccat

SEQ ID NO: 7288423 - DNA, 22 bp, Homo sapiens
tcaaactggcagacttctactt

SEQ ID NO: 7288424 - DNA, 22 bp, Homo sapiens
tcaaaaataagatattctggac

SEQ ID NO: 7288425 - DNA, 22 bp, Homo sapiens
tagaacatgctcatgtataaat

SEQ ID NO: 7288426 - DNA, 22 bp, Homo sapiens
tagaacatgtgaaaatatagcc

SEQ ID NO: 7288427 - DNA, 22 bp, Homo sapiens
tagactttgatattgtacaccc

SEQ ID NO: 7288428 - DNA, 21 bp, Homo sapiens
tagagaaaagaagctgttcct

SEQ ID NO: 7288429 - DNA, 22 bp, Homo sapiens
tagagaaaagcagggatcagga

SEQ ID NO: 7288430 - DNA, 22 bp, Homo sapiens
tagagagagatatatacacaca

SEQ ID NO: 7288431 - DNA, 22 bp, Homo sapiens
tagcagcttaagtaattagaat

SEQ ID NO: 7288432 - DNA, 22 bp, Homo sapiens
tagcagctgtcagtttcacata

SEQ ID NO: 7288433 - DNA, 22 bp, Homo sapiens
tagcagggtccaatgtgaggca

SEQ ID NO: 7288434 - DNA, 22 bp, Homo sapiens
tagcaaatacatgatgtaattt

SEQ ID NO: 7288435 - DNA, 22 bp, Homo sapiens
tagcaaaatgtggatgtagttg

SEQ ID NO: 7288436 - DNA, 22 bp, Homo sapiens
tagtgcaggttaataggacttc

SEQ ID NO: 7288437 - DNA, 22 bp, Homo sapiens
tagtgcagggttttaagcactg

SEQ ID NO: 7288438 - DNA, 22 bp, Homo sapiens
tagttagcctcagagcctttgc

SEQ ID NO: 7288439 - DNA, 21 bp, Homo sapiens
taggcagaggagcaggtatct

SEQ ID NO: 7288440 - DNA, 22 bp, Homo sapiens
taggcagaggtatggtaaggac

SEQ ID NO: 7288441 - DNA, 22 bp, Homo sapiens
taggcagagtttaatggttaag

SEQ ID NO: 7288442 - DNA, 22 bp, Homo sapiens
taggcagattccatattttggc

SEQ ID NO: 7288443 - DNA, 22 bp, Homo sapiens
taggcagatgttaacaggaaaa

SEQ ID NO: 7288444 - DNA, 20 bp, Homo sapiens
taggcagagctgtgcagcct

SEQ ID NO: 7288445 - DNA, 22 bp, Homo sapiens
taggcagagaggccataagaat

SEQ ID NO: 7288446 - DNA, 22 bp, Homo sapiens
taggcagaattgtgggctctaa

SEQ ID NO: 7288447 - DNA, 22 bp, Homo sapiens
taggcagaattcattgtgctgc

SEQ ID NO: 7288448 - DNA, 22 bp, Homo sapiens
taggcagaattgttgaatgaag

SEQ ID NO: 7288449 - DNA, 22 bp, Homo sapiens
tagggcagctgcatcaggcact

SEQ ID NO: 7288450 - DNA, 23 bp, Homo sapiens
tagggcagctgggagggacatgc

SEQ ID NO: 7288451 - DNA, 22 bp, Homo sapiens
tagggcagagtccaggatgggc

SEQ ID NO: 7288452 - DNA, 22 bp, Homo sapiens
tagggcagattcggtggagttt

SEQ ID NO: 7288453 - DNA, 22 bp, Homo sapiens
tagggcagccacccaggctgct

SEQ ID NO: 7288454 - DNA, 17 bp, Homo sapiens
tcagcaaagacaaagga

SEQ ID NO: 7288455 - DNA, 22 bp, Homo sapiens
tcagcaggcaggaggcatgcca

SEQ ID NO: 7288456 - DNA, 22 bp, Homo sapiens
tcagcaggcggttccttgtggg

SEQ ID NO: 7288457 - DNA, 22 bp, Homo sapiens
tcagcaggcccatcctccaggc

SEQ ID NO: 7288458 - DNA, 22 bp, Homo sapiens
tcagcaggcagtgggtcacaat

SEQ ID NO: 7288459 - DNA, 22 bp, Homo sapiens
tcagcaggctgtcagcaggggc

SEQ ID NO: 7288460 - DNA, 22 bp, Homo sapiens
tcagcaggctctggttgaccat

SEQ ID NO: 7288461 - DNA, 22 bp, Homo sapiens
tcagcaggggccgttgggtgga

SEQ ID NO: 7288462 - DNA, 17 bp, Homo sapiens
tcagcaggggccaagct

SEQ ID NO: 7288463 - DNA, 22 bp, Homo sapiens
tcagcagggctgtggtgtggct

SEQ ID NO: 7288464 - DNA, 22 bp, Homo sapiens
tcagcagggctgggagctgtga

SEQ ID NO: 7288465 - DNA, 22 bp, Homo sapiens
tcagcagggagaggagaatgca

SEQ ID NO: 7288466 - DNA, 22 bp, Homo sapiens
tcagcagggaggctctgtgccc

SEQ ID NO: 7288467 - DNA, 22 bp, Homo sapiens
tcagcagggcctccttgtgcag

SEQ ID NO: 7288468 - DNA, 22 bp, Homo sapiens
tcagcagggccatgctctctct

SEQ ID NO: 7288469 - DNA, 22 bp, Homo sapiens
tcagcagggcatactgagccta

SEQ ID NO: 7288470 - DNA, 22 bp, Homo sapiens
tcaactaaggcacaatctctaa

SEQ ID NO: 7288471 - DNA, 22 bp, Homo sapiens
tcaactaactctattatttgaa

SEQ ID NO: 7288472 - DNA, 22 bp, Homo sapiens
tcagaaaatgaaatggactctc

SEQ ID NO: 7288473 - DNA, 22 bp, Homo sapiens
tcagaatatgctaatgacattt

SEQ ID NO: 7288474 - DNA, 22 bp, Homo sapiens
tcatttggtattaattttcaga

SEQ ID NO: 7288475 - DNA, 22 bp, Homo sapiens
tccaatattcattaaaatgcag

SEQ ID NO: 7288476 - DNA, 22 bp, Homo sapiens
tccaaaacagaactctgtgaat

SEQ ID NO: 7288477 - DNA, 18 bp, Homo sapiens
tccaaaatcatgtatttt

SEQ ID NO: 7288478 - DNA, 22 bp, Homo sapiens
tcagggcatactcttcaaggtc

SEQ ID NO: 7288479 - DNA, 17 bp, Homo sapiens
tcaggctgggtgcagtg

SEQ ID NO: 7288480 - DNA, 22 bp, Homo sapiens
tcagggcaggcgagcagctgct

SEQ ID NO: 7288481 - DNA, 22 bp, Homo sapiens
tcagggcaggttaacttgggtg

SEQ ID NO: 7288482 - DNA, 19 bp, Homo sapiens
tcagggcagtccggtcccc

SEQ ID NO: 7288483 - DNA, 21 bp, Homo sapiens
tcagggcagtgggaggttcct

SEQ ID NO: 7288484 - DNA, 22 bp, Homo sapiens
tcatagaaatatcacgtctttt

SEQ ID NO: 7288485 - DNA, 22 bp, Homo sapiens
tcatgaaaatagatcagaaatt

SEQ ID NO: 7288486 - DNA, 22 bp, Homo sapiens
tcagttaacaactatttattga

SEQ ID NO: 7288487 - DNA, 22 bp, Homo sapiens
tcagttaagactgcactggact

SEQ ID NO: 7288488 - DNA, 23 bp, Homo sapiens
tcagttaactgtgttacctgtgc

SEQ ID NO: 7288489 - DNA, 22 bp, Homo sapiens
tcagttaacggaaaggggtgtg

SEQ ID NO: 7288490 - DNA, 22 bp, Homo sapiens
tcagttaatggattctgtcaga

SEQ ID NO: 7288491 - DNA, 22 bp, Homo sapiens
tcagttaatcaatgtggtctaa

SEQ ID NO: 7288492 - DNA, 22 bp, Homo sapiens
tcagttaatatgggtaaagcat

SEQ ID NO: 7288493 - DNA, 20 bp, Homo sapiens
tcagttaagttgctgaatct

SEQ ID NO: 7288494 - DNA, 22 bp, Homo sapiens
tcagttaagcactataccctaa

SEQ ID NO: 7288495 - DNA, 22 bp, Homo sapiens
tcagttaagaggccacggcagt

SEQ ID NO: 7288496 - DNA, 22 bp, Homo sapiens
tcagttaatggtaagggtgaaa

SEQ ID NO: 7288497 - DNA, 22 bp, Homo sapiens
tcctgcctcttgccttcttcac

SEQ ID NO: 7288498 - DNA, 22 bp, Homo sapiens
tcctgcctcttttcttattcca

SEQ ID NO: 7288499 - DNA, 22 bp, Homo sapiens
tcctgcctgagcgtggaggagg

SEQ ID NO: 7288500 - DNA, 22 bp, Homo sapiens
tcctgcctgagcgtggaggagg

SEQ ID NO: 7288501 - DNA, 22 bp, Homo sapiens
tcctgcctgcaatcccagcact

SEQ ID NO: 7288502 - DNA, 22 bp, Homo sapiens
tcctgcctgcaatcccagcact

SEQ ID NO: 7288503 - DNA, 22 bp, Homo sapiens
tcctgcctagcaggtgacctat

SEQ ID NO: 7288504 - DNA, 22 bp, Homo sapiens
tcctgcctaccttgcggaggtg

SEQ ID NO: 7288505 - DNA, 22 bp, Homo sapiens
tcctgcctcacagttgaagttt

SEQ ID NO: 7288506 - DNA, 22 bp, Homo sapiens
tcctgcctcaggctctggagta

SEQ ID NO: 7288507 - DNA, 22 bp, Homo sapiens
tcctgcctctccatgctaacta

SEQ ID NO: 7288508 - DNA, 20 bp, Homo sapiens
tcctgagatttaaggggttc

SEQ ID NO: 7288509 - DNA, 22 bp, Homo sapiens
tcctgagcacctatgccatggc

SEQ ID NO: 7288510 - DNA, 22 bp, Homo sapiens
tcctgagatgagacagtgctgc

SEQ ID NO: 7288511 - DNA, 23 bp, Homo sapiens
tcctgagatgagacagtgctgcc

SEQ ID NO: 7288512 - DNA, 22 bp, Homo sapiens
tcctgagatgctgatttcgggg

SEQ ID NO: 7288513 - DNA, 22 bp, Homo sapiens
tcctgagaggtgtgaggtgcag

SEQ ID NO: 7288514 - DNA, 22 bp, Homo sapiens
tcctgagaggtttataacgcag

SEQ ID NO: 7288515 - DNA, 22 bp, Homo sapiens
tcctgagagtcaagaatgcagg

SEQ ID NO: 7288516 - DNA, 22 bp, Homo sapiens
tcctgagataggagttgaaggc

SEQ ID NO: 7288517 - DNA, 22 bp, Homo sapiens
tcctgagaatagagttgcatgt

SEQ ID NO: 7288518 - DNA, 22 bp, Homo sapiens
tccctgcctctcagacttcctt

SEQ ID NO: 7288519 - DNA, 22 bp, Homo sapiens
tccctgggaccggcagctcaca

SEQ ID NO: 7288520 - DNA, 22 bp, Homo sapiens
tccctgggagatgatgatgagg

SEQ ID NO: 7288521 - DNA, 22 bp, Homo sapiens
tccctgcctcctggcagtgcca

SEQ ID NO: 7288522 - DNA, 22 bp, Homo sapiens
tccctgcctcctggcagtgcca

SEQ ID NO: 7288523 - DNA, 22 bp, Homo sapiens
tccctgccctgccttcatggtt

SEQ ID NO: 7288524 - DNA, 22 bp, Homo sapiens
tccctgccctgccttcatggtt

SEQ ID NO: 7288525 - DNA, 22 bp, Homo sapiens
tcccagggactggatgatgcag

SEQ ID NO: 7288526 - DNA, 20 bp, Homo sapiens
tcccaggctccaccctagac

SEQ ID NO: 7288527 - DNA, 22 bp, Homo sapiens
tcccaggctggggccaggtgac

SEQ ID NO: 7288528 - DNA, 23 bp, Homo sapiens
tcccagggaaggtgagcgaggct

SEQ ID NO: 7288529 - DNA, 22 bp, Homo sapiens
tcccagcctttctttctccagc

SEQ ID NO: 7288530 - DNA, 22 bp, Homo sapiens
tcccagcattaatgcctgtcag

SEQ ID NO: 7288531 - DNA, 23 bp, Homo sapiens
tcccagcctcttctcttgcatac

SEQ ID NO: 7288532 - DNA, 22 bp, Homo sapiens
tccagggaagagcagaggctac

SEQ ID NO: 7288533 - DNA, 18 bp, Homo sapiens
tccaggcctgaagtgtcc

SEQ ID NO: 7288534 - DNA, 22 bp, Homo sapiens
tccaggccttgacaggtcagtt

SEQ ID NO: 7288535 - DNA, 20 bp, Homo sapiens
tccaggccttgttctcagat

SEQ ID NO: 7288536 - DNA, 22 bp, Homo sapiens
tttcctctccggggcctccagg

SEQ ID NO: 7288537 - DNA, 22 bp, Homo sapiens
tttcctctgactgctcccctgc

SEQ ID NO: 7288538 - DNA, 22 bp, Homo sapiens
tttcccttgttccttcctctga

SEQ ID NO: 7288539 - DNA, 22 bp, Homo sapiens
tttccctttgcactctacaatt

SEQ ID NO: 7288540 - DNA, 17 bp, Homo sapiens
tttccctccttccactc

SEQ ID NO: 7288541 - DNA, 22 bp, Homo sapiens
tttcccttctttcctgagtaat

SEQ ID NO: 7288542 - DNA, 22 bp, Homo sapiens
tttccctctgtgccagcttctc

SEQ ID NO: 7288543 - DNA, 22 bp, Homo sapiens
tttcttttccaatatccctact

SEQ ID NO: 7288544 - DNA, 22 bp, Homo sapiens
tttcttttgccctgtgggttag

SEQ ID NO: 7288545 - DNA, 22 bp, Homo sapiens
tttgacaagagggcatcttcag

SEQ ID NO: 7288546 - DNA, 22 bp, Homo sapiens
tttgctttcttgattcagatta

SEQ ID NO: 7288547 - DNA, 22 bp, Homo sapiens
tttgatttactggatattctca

SEQ ID NO: 7288548 - DNA, 22 bp, Homo sapiens
tttgatttactataagcagcac

SEQ ID NO: 7288549 - DNA, 22 bp, Homo sapiens
tttggtattgcacactgtcttc

SEQ ID NO: 7288550 - DNA, 22 bp, Homo sapiens
tttggtttgcctgagtaccctc

SEQ ID NO: 7288551 - DNA, 22 bp, Homo sapiens
tttggtttagggtcatttaaca

SEQ ID NO: 7288552 - DNA, 22 bp, Homo sapiens
ttttctcttgttaatgtactga

SEQ ID NO: 7288553 - DNA, 22 bp, Homo sapiens
tttgtgttaaatgttaaattca

SEQ ID NO: 7288554 - DNA, 22 bp, Homo sapiens
tttgtgtttgtacaatgcacta

SEQ ID NO: 7288555 - DNA, 22 bp, Homo sapiens
tttgtgttgttttaagccacta

SEQ ID NO: 7288556 - DNA, 22 bp, Homo sapiens
tttgtgtttaatacaaggacct

SEQ ID NO: 7288557 - DNA, 22 bp, Homo sapiens
tttgtgttttcactagcagtgt

SEQ ID NO: 7288558 - DNA, 22 bp, Homo sapiens
tttgtgttttagctggtgaggc

SEQ ID NO: 7288559 - DNA, 22 bp, Homo sapiens
tttttatactttgctcaagatt

SEQ ID NO: 7288560 - DNA, 22 bp, Homo sapiens
tttttatatgaaggatagtgcg

SEQ ID NO: 7288561 - DNA, 22 bp, Homo sapiens
tttttataggtcagggcaagtc

SEQ ID NO: 7288562 - DNA, 22 bp, Homo sapiens
tttttataactcttttgtgaca

SEQ ID NO: 7288563 - DNA, 22 bp, Homo sapiens
tttttataccacctctcactta

SEQ ID NO: 7288564 - DNA, 22 bp, Homo sapiens
ttttgtttaaaatcctggatgg

SEQ ID NO: 7288565 - DNA, 22 bp, Homo sapiens
tttttacacttagcattgagcg

SEQ ID NO: 7288566 - DNA, 22 bp, Homo sapiens
tttttacagtcatggtcactca

SEQ ID NO: 7288567 - DNA, 22 bp, Homo sapiens
ttgggcctcactctagaaggca

SEQ ID NO: 7288568 - DNA, 22 bp, Homo sapiens
ttgggcctcggccaaggacggg

SEQ ID NO: 7288569 - DNA, 22 bp, Homo sapiens
ttgggcctctcaaagtgctggg

SEQ ID NO: 7288570 - DNA, 20 bp, Homo sapiens
ttgggcctgtcagcactccc

SEQ ID NO: 7288571 - DNA, 22 bp, Homo sapiens
ttggcatcagtgtaggacctgt

SEQ ID NO: 7288572 - DNA, 22 bp, Homo sapiens
ttgggacatgtaagctggaagt

SEQ ID NO: 7288573 - DNA, 17 bp, Homo sapiens
ttgggagagaaaggtat

SEQ ID NO: 7288574 - DNA, 22 bp, Homo sapiens
ttgggagatggggagataatat

SEQ ID NO: 7288575 - DNA, 22 bp, Homo sapiens
ttggcagtagtctcggctaccc

SEQ ID NO: 7288576 - DNA, 20 bp, Homo sapiens
ttggagatacaacctttaag

SEQ ID NO: 7288577 - DNA, 22 bp, Homo sapiens
ttgcttcagagggagacacttt

SEQ ID NO: 7288578 - DNA, 22 bp, Homo sapiens
ttggaaacttggatggaaaacc

SEQ ID NO: 7288579 - DNA, 22 bp, Homo sapiens
ttggaatttagggaatattcat

SEQ ID NO: 7288580 - DNA, 22 bp, Homo sapiens
ttggaattgtgaactaagtgat

SEQ ID NO: 7288581 - DNA, 22 bp, Homo sapiens
ttggaattggacatgttgaagg

SEQ ID NO: 7288582 - DNA, 22 bp, Homo sapiens
ttggaattgctattgataacaa

SEQ ID NO: 7288583 - DNA, 22 bp, Homo sapiens
ttggaattgaggatttacatag

SEQ ID NO: 7288584 - DNA, 22 bp, Homo sapiens
ttggaattcagcttgcttataa

SEQ ID NO: 7288585 - DNA, 22 bp, Homo sapiens
ttggaattcctgttgtttcgtc

SEQ ID NO: 7288586 - DNA, 22 bp, Homo sapiens
ttgctctgtccagccagcaggt

SEQ ID NO: 7288587 - DNA, 23 bp, Homo sapiens
ttgcttagagacctcctcatcag

SEQ ID NO: 7288588 - DNA, 22 bp, Homo sapiens
ttgacaagtggagatatttaag

SEQ ID NO: 7288589 - DNA, 22 bp, Homo sapiens
ttgcagatcagctttcattgtc

SEQ ID NO: 7288590 - DNA, 22 bp, Homo sapiens
ttgcagattaaaacactgagct

SEQ ID NO: 7288591 - DNA, 22 bp, Homo sapiens
tttacagtctctatagtcaaaa

SEQ ID NO: 7288592 - DNA, 22 bp, Homo sapiens
tttacagtctatgttgaattaa

SEQ ID NO: 7288593 - DNA, 22 bp, Homo sapiens
tttacagtctatgttgaattaa

SEQ ID NO: 7288594 - DNA, 22 bp, Homo sapiens
tttacagtctgtctagcaatgt

SEQ ID NO: 7288595 - DNA, 22 bp, Homo sapiens
tttacagtccccaggtgaggat

SEQ ID NO: 7288596 - DNA, 22 bp, Homo sapiens
tttacagtcaccaaactttgct

SEQ ID NO: 7288597 - DNA, 22 bp, Homo sapiens
tttacagtcaccaaactttgct

SEQ ID NO: 7288598 - DNA, 22 bp, Homo sapiens
tttacagtatagtaggactcat

SEQ ID NO: 7288599 - DNA, 22 bp, Homo sapiens
tttacagtaaggtggatggtac

SEQ ID NO: 7288600 - DNA, 22 bp, Homo sapiens
tttaaagaaattcctcatcttt

SEQ ID NO: 7288601 - DNA, 22 bp, Homo sapiens
tttaaataggactcctgggggt

SEQ ID NO: 7288602 - DNA, 22 bp, Homo sapiens
tttagcatatttaaggaatgat

SEQ ID NO: 7288603 - DNA, 22 bp, Homo sapiens
tttagagtccaagttcttcact

SEQ ID NO: 7288604 - DNA, 22 bp, Homo sapiens
tttagagtccctttctcaccac

SEQ ID NO: 7288605 - DNA, 22 bp, Homo sapiens
tttagagttaattccattctgt

SEQ ID NO: 7288606 - DNA, 23 bp, Homo sapiens
tttaccagaatagcaggggagag

SEQ ID NO: 7288607 - DNA, 20 bp, Homo sapiens
tttacattttgaaacagtga

SEQ ID NO: 7288608 - DNA, 22 bp, Homo sapiens
tttacagtgtcttgttgactgt

SEQ ID NO: 7288609 - DNA, 22 bp, Homo sapiens
tttacagtgagagcttagtgag

SEQ ID NO: 7288610 - DNA, 23 bp, Homo sapiens
tttcaacaggcagagaagactta

SEQ ID NO: 7288611 - DNA, 22 bp, Homo sapiens
tttattgagtatctactatgtg

SEQ ID NO: 7288612 - DNA, 22 bp, Homo sapiens
tttcaaaggttttgtcatgtct

SEQ ID NO: 7288613 - DNA, 23 bp, Homo sapiens
ttcatttaggagttcataagagc

SEQ ID NO: 7288614 - DNA, 22 bp, Homo sapiens
ttcatttgtggttatttacaat

SEQ ID NO: 7288615 - DNA, 22 bp, Homo sapiens
ttcatttggcctctgcttaaaa

SEQ ID NO: 7288616 - DNA, 22 bp, Homo sapiens
ttccaggggcagcagtgatggt

SEQ ID NO: 7288617 - DNA, 21 bp, Homo sapiens
ttcaaagacttgatgctgacc

SEQ ID NO: 7288618 - DNA, 22 bp, Homo sapiens
ttaggaaagtctcttggctggg

SEQ ID NO: 7288619 - DNA, 22 bp, Homo sapiens
ttaggaaagcattgtgtaaaag

SEQ ID NO: 7288620 - DNA, 22 bp, Homo sapiens
ttaggaaatcactttgctcacc

SEQ ID NO: 7288621 - DNA, 22 bp, Homo sapiens
ttaggaaatcactttgctcacc

SEQ ID NO: 7288622 - DNA, 22 bp, Homo sapiens
ttatacatgtttataaggttga

SEQ ID NO: 7288623 - DNA, 22 bp, Homo sapiens
ttaggaaaatgaaattacctgt

SEQ ID NO: 7288624 - DNA, 22 bp, Homo sapiens
ttaggaaaatcatgagagatga

SEQ ID NO: 7288625 - DNA, 19 bp, Homo sapiens
ttaggaaaccactttcctt

SEQ ID NO: 7288626 - DNA, 22 bp, Homo sapiens
tcctgctggaatggaaaatgaa

SEQ ID NO: 7288627 - DNA, 18 bp, Homo sapiens
tcctgcctgcgggctccc

SEQ ID NO: 7288628 - DNA, 18 bp, Homo sapiens
tcctgcctgcgggctccc

SEQ ID NO: 7288629 - DNA, 19 bp, Homo sapiens
tcctgcctggggccgcctg

SEQ ID NO: 7288630 - DNA, 22 bp, Homo sapiens
tcctgcctgtttacctgtactt

SEQ ID NO: 7288631 - DNA, 18 bp, Homo sapiens
tcctgcctgtgccccagg

SEQ ID NO: 7288632 - DNA, 22 bp, Homo sapiens
ttattacactgaaagaattgcg

SEQ ID NO: 7288633 - DNA, 22 bp, Homo sapiens
ttattacagtcccagggagtag

SEQ ID NO: 7288634 - DNA, 19 bp, Homo sapiens
ttctgtaagggagagaggg

SEQ ID NO: 7288635 - DNA, 22 bp, Homo sapiens
ttctgttacaagtgaaaaaatg

SEQ ID NO: 7288636 - DNA, 22 bp, Homo sapiens
ttcttttaatgtctggctttca

SEQ ID NO: 7288637 - DNA, 22 bp, Homo sapiens
ttctttttaaagtgtgtatgca

SEQ ID NO: 7288638 - DNA, 22 bp, Homo sapiens
ttccttcttccaaacccatcat

SEQ ID NO: 7288639 - DNA, 22 bp, Homo sapiens
ttcctggggcttagcaatggag

SEQ ID NO: 7288640 - DNA, 22 bp, Homo sapiens
ttctctcttccagttcccactt

SEQ ID NO: 7288641 - DNA, 22 bp, Homo sapiens
ttctctctgtggtcccattttg

SEQ ID NO: 7288642 - DNA, 22 bp, Homo sapiens
ttctctcttactgccatgctgt

SEQ ID NO: 7288643 - DNA, 22 bp, Homo sapiens
ttctctcccatgaagcttctat

SEQ ID NO: 7288644 - DNA, 22 bp, Homo sapiens
actcttcttgctgctcattaat

SEQ ID NO: 7288645 - DNA, 22 bp, Homo sapiens
acctgcctcagtgcagctggat

SEQ ID NO: 7288646 - DNA, 22 bp, Homo sapiens
acctgcctctaagcagcaggtg

SEQ ID NO: 7288647 - DNA, 22 bp, Homo sapiens
actcttttatgcattccttcag

SEQ ID NO: 7288648 - DNA, 22 bp, Homo sapiens
actcttttataaagcatcttga

SEQ ID NO: 7288649 - DNA, 22 bp, Homo sapiens
aagttcaatcagatgaaaaagc

SEQ ID NO: 7288650 - DNA, 20 bp, Homo sapiens
aagttttctccaaatacagt

SEQ ID NO: 7288651 - DNA, 22 bp, Homo sapiens
aagttttcctgtgtccaagatg

SEQ ID NO: 7288652 - DNA, 20 bp, Homo sapiens
aagttttctccaaatacagt

SEQ ID NO: 7288653 - DNA, 22 bp, Homo sapiens
aataaaatgaactggtagagtt

SEQ ID NO: 7288654 - DNA, 22 bp, Homo sapiens
agaacacactgggggaaacaag

SEQ ID NO: 7288655 - DNA, 22 bp, Homo sapiens
agaaggaagccaggagggtgca

SEQ ID NO: 7288656 - DNA, 22 bp, Homo sapiens
aatcacatctcattcaacagcc

SEQ ID NO: 7288657 - DNA, 22 bp, Homo sapiens
aatagtacaatctacagacata

SEQ ID NO: 7288658 - DNA, 22 bp, Homo sapiens
aataggaagtcacatcaaggga

SEQ ID NO: 7288659 - DNA, 22 bp, Homo sapiens
aatagcatgtaagtttaaaaga

SEQ ID NO: 7288660 - DNA, 20 bp, Homo sapiens
aagggcagagggaacagact

SEQ ID NO: 7288661 - DNA, 22 bp, Homo sapiens
aagggcagaatagagaagatgg

SEQ ID NO: 7288662 - DNA, 22 bp, Homo sapiens
aagggtggatttctgagctcta

SEQ ID NO: 7288663 - DNA, 22 bp, Homo sapiens
acctgcctatggagccacatgg

SEQ ID NO: 7288664 - DNA, 22 bp, Homo sapiens
acctgcctatcagctgcctgct

SEQ ID NO: 7288665 - DNA, 22 bp, Homo sapiens
acctgcctagttggttctgccc

SEQ ID NO: 7288666 - DNA, 22 bp, Homo sapiens
acctctgcaaccctggaatggg

SEQ ID NO: 7288667 - DNA, 22 bp, Homo sapiens
acctctgcaatgcaatgtcatg

SEQ ID NO: 7288668 - DNA, 22 bp, Homo sapiens
acctctcaggtcttcctcatat

SEQ ID NO: 7288669 - DNA, 22 bp, Homo sapiens
acatgacatagtagaaaagccc

SEQ ID NO: 7288670 - DNA, 19 bp, Homo sapiens
acatgacaacaggggaggc

SEQ ID NO: 7288671 - DNA, 22 bp, Homo sapiens
acatgacaaggtttataaggct

SEQ ID NO: 7288672 - DNA, 22 bp, Homo sapiens
acatgacacaggcctggccaat

SEQ ID NO: 7288673 - DNA, 22 bp, Homo sapiens
acatgacacctctggctgggtg

SEQ ID NO: 7288674 - DNA, 22 bp, Homo sapiens
acatgacagggaatgaggtgaa

SEQ ID NO: 7288675 - DNA, 22 bp, Homo sapiens
acatgacagtgactttataaga

SEQ ID NO: 7288676 - DNA, 22 bp, Homo sapiens
acatgacagtgcttagcaaact

SEQ ID NO: 7288677 - DNA, 22 bp, Homo sapiens
acatgacaaaatgcacaggatt

SEQ ID NO: 7288678 - DNA, 22 bp, Homo sapiens
acatctcatgaatgataaatca

SEQ ID NO: 7288679 - DNA, 22 bp, Homo sapiens
acatcctcggggaaaggcactg

SEQ ID NO: 7288680 - DNA, 22 bp, Homo sapiens
aaggcaagttttagttttctgg

SEQ ID NO: 7288681 - DNA, 22 bp, Homo sapiens
aaggcaccataggcaaatccag

SEQ ID NO: 7288682 - DNA, 22 bp, Homo sapiens
aaggaagcagcaatgcatgatt

SEQ ID NO: 7288683 - DNA, 22 bp, Homo sapiens
aaggacaaagcagagctggatg

SEQ ID NO: 7288684 - DNA, 22 bp, Homo sapiens
acagcaggttttaactttgaag

SEQ ID NO: 7288685 - DNA, 18 bp, Homo sapiens
acagcaggtttcattctt

SEQ ID NO: 7288686 - DNA, 21 bp, Homo sapiens
acagcagggctggcatgacag

SEQ ID NO: 7288687 - DNA, 22 bp, Homo sapiens
acagcaggttattgttatggca

SEQ ID NO: 7288688 - DNA, 17 bp, Homo sapiens
acagcagggaagtgttg

SEQ ID NO: 7288689 - DNA, 19 bp, Homo sapiens
acagcagggatttttggag

SEQ ID NO: 7288690 - DNA, 22 bp, Homo sapiens
acagcagggaatatgggaattg

SEQ ID NO: 7288691 - DNA, 22 bp, Homo sapiens
acagcaggcccatactggaagg

SEQ ID NO: 7288692 - DNA, 17 bp, Homo sapiens
acagcaggcccggaggg

SEQ ID NO: 7288693 - DNA, 21 bp, Homo sapiens
agctgaggtaaggcaagagag

SEQ ID NO: 7288694 - DNA, 22 bp, Homo sapiens
acagaataggtacagtcagtca

SEQ ID NO: 7288695 - DNA, 22 bp, Homo sapiens
acagaatatttggcatgcgtct

SEQ ID NO: 7288696 - DNA, 22 bp, Homo sapiens
acagaatattgtaagtgccact

SEQ ID NO: 7288697 - DNA, 23 bp, Homo sapiens
acagaagccaggagccgctgggc

SEQ ID NO: 7288698 - DNA, 22 bp, Homo sapiens
agcgtgggtccaaggctctggt

SEQ ID NO: 7288699 - DNA, 22 bp, Homo sapiens
agcaggcttggtccccagcctc

SEQ ID NO: 7288700 - DNA, 19 bp, Homo sapiens
agcagggacatggaacttt

SEQ ID NO: 7288701 - DNA, 21 bp, Homo sapiens
agcaggtgtaaaggaggaaat

SEQ ID NO: 7288702 - DNA, 20 bp, Homo sapiens
agccaatacagcaaaatttg

SEQ ID NO: 7288703 - DNA, 22 bp, Homo sapiens
agccagaggtcatgagcacagg

SEQ ID NO: 7288704 - DNA, 22 bp, Homo sapiens
agcacaggaccaaggaagctgt

SEQ ID NO: 7288705 - DNA, 22 bp, Homo sapiens
agcaaatacttgaataaaaaga

SEQ ID NO: 7288706 - DNA, 22 bp, Homo sapiens
agcaaatacttttcactgagcc

SEQ ID NO: 7288707 - DNA, 22 bp, Homo sapiens
agcaaataattgtctttgaggg

SEQ ID NO: 7288708 - DNA, 22 bp, Homo sapiens
agcaaatacatttttagcataa

SEQ ID NO: 7288709 - DNA, 22 bp, Homo sapiens
acaacatcagctgagaccttca

SEQ ID NO: 7288710 - DNA, 22 bp, Homo sapiens
acaacattcttaaatacactga

SEQ ID NO: 7288711 - DNA, 20 bp, Homo sapiens
agatcttttctatagaagtg

SEQ ID NO: 7288712 - DNA, 22 bp, Homo sapiens
agatctttagaagatagaatca

SEQ ID NO: 7288713 - DNA, 22 bp, Homo sapiens
agatgctgaattattgtgcttt

SEQ ID NO: 7288714 - DNA, 23 bp, Homo sapiens
agagcaaggaaatgaggtgtgat

SEQ ID NO: 7288715 - DNA, 22 bp, Homo sapiens
agacatcatgttacagattaag

SEQ ID NO: 7288716 - DNA, 22 bp, Homo sapiens
aattccacaaaaggttctcttc

SEQ ID NO: 7288717 - DNA, 22 bp, Homo sapiens
aattccacagatgtctatctgt

SEQ ID NO: 7288718 - DNA, 22 bp, Homo sapiens
aattccacagctgcacagaggt

SEQ ID NO: 7288719 - DNA, 22 bp, Homo sapiens
agaggaagtaatcaggacctgc

SEQ ID NO: 7288720 - DNA, 22 bp, Homo sapiens
aaaacacactggaccaatttaa

SEQ ID NO: 7288721 - DNA, 22 bp, Homo sapiens
aaaagccaaggtcctcttcaga

SEQ ID NO: 7288722 - DNA, 20 bp, Homo sapiens
aaaagcagccagagatggta

SEQ ID NO: 7288723 - DNA, 22 bp, Homo sapiens
aaaagcaggtactcagcttggg

SEQ ID NO: 7288724 - DNA, 22 bp, Homo sapiens
aaaagcagaccacgctttgtgg

SEQ ID NO: 7288725 - DNA, 22 bp, Homo sapiens
aaaagcagaccacgctttgtgg

SEQ ID NO: 7288726 - DNA, 22 bp, Homo sapiens
aaaagcactacaatttcgcttc

SEQ ID NO: 7288727 - DNA, 22 bp, Homo sapiens
aaaagcagagactctggagcta

SEQ ID NO: 7288728 - DNA, 22 bp, Homo sapiens
aaaaatgaaacggctggttggc

SEQ ID NO: 7288729 - DNA, 22 bp, Homo sapiens
aaaaatgttatctactgtccga

SEQ ID NO: 7288730 - DNA, 22 bp, Homo sapiens
aaaaatttatggttcttctctg

SEQ ID NO: 7288731 - DNA, 22 bp, Homo sapiens
aaaacacaagaagcagggtaca

SEQ ID NO: 7288732 - DNA, 22 bp, Homo sapiens
aaaagcaagttgcctaggttga

SEQ ID NO: 7288733 - DNA, 22 bp, Homo sapiens
aaaataagttggtcctgtcctt

SEQ ID NO: 7288734 - DNA, 22 bp, Homo sapiens
aaaatactgtggagtgttgaaa

SEQ ID NO: 7288735 - DNA, 22 bp, Homo sapiens
aaaatactactgtcttcttccc

SEQ ID NO: 7288736 - DNA, 22 bp, Homo sapiens
aaaatgagccatgaaccaacca

SEQ ID NO: 7288737 - DNA, 22 bp, Homo sapiens
aaagcagggatgaggctagagg

SEQ ID NO: 7288738 - DNA, 22 bp, Homo sapiens
aaagcagggtccaaggagatgt

SEQ ID NO: 7288739 - DNA, 22 bp, Homo sapiens
aaagcaggcagcaggctggatt

SEQ ID NO: 7288740 - DNA, 22 bp, Homo sapiens
aaagcagctgtttgactttcca

SEQ ID NO: 7288741 - DNA, 22 bp, Homo sapiens
aaagcagctgctctggccttga

SEQ ID NO: 7288742 - DNA, 22 bp, Homo sapiens
aaaatgtatgatggaggtgcta

SEQ ID NO: 7288743 - DNA, 19 bp, Homo sapiens
aaagttttattctcatttg

SEQ ID NO: 7288744 - DNA, 22 bp, Homo sapiens
aaagtcatccaaatttttatgt

SEQ ID NO: 7288745 - DNA, 22 bp, Homo sapiens
aaagtacaatattgagattgat

SEQ ID NO: 7288746 - DNA, 22 bp, Homo sapiens
aaagtacagccacatccaagta

SEQ ID NO: 7288747 - DNA, 22 bp, Homo sapiens
aaagtacatagcatattccaac

SEQ ID NO: 7288748 - DNA, 22 bp, Homo sapiens
aaagtacatgtttggccatttg

SEQ ID NO: 7288749 - DNA, 22 bp, Homo sapiens
aaagtacatgcaattcttctga

SEQ ID NO: 7288750 - DNA, 22 bp, Homo sapiens
aaagtacatgagattcaagggg

SEQ ID NO: 7288751 - DNA, 22 bp, Homo sapiens
aaaattttgccctatccttcat

SEQ ID NO: 7288752 - DNA, 22 bp, Homo sapiens
aaaattttactggtgtttcctt

SEQ ID NO: 7288753 - DNA, 22 bp, Homo sapiens
aaaattttcagcttgacttgat

SEQ ID NO: 7288754 - DNA, 22 bp, Homo sapiens
aaatacagagttgcttaaaagc

SEQ ID NO: 7288755 - DNA, 22 bp, Homo sapiens
aaataaaggaactgttttccca

SEQ ID NO: 7288756 - DNA, 22 bp, Homo sapiens
aaatgacaataaaagtccatgc

SEQ ID NO: 7288757 - DNA, 23 bp, Homo sapiens
aaatgacatatggtttctgaagg

SEQ ID NO: 7288758 - DNA, 22 bp, Homo sapiens
aaatgacagttctctctgagta

SEQ ID NO: 7288759 - DNA, 22 bp, Homo sapiens
aaacttcagggaataaaagagt

SEQ ID NO: 7288760 - DNA, 22 bp, Homo sapiens
aaacttcagactccccacttct

SEQ ID NO: 7288761 - DNA, 22 bp, Homo sapiens
aaagacacatgtctcttagatt

SEQ ID NO: 7288762 - DNA, 22 bp, Homo sapiens
aaatgagtagcgatgcacatta

SEQ ID NO: 7288763 - DNA, 22 bp, Homo sapiens
aaatgacattaggatcctgcat

SEQ ID NO: 7288764 - DNA, 22 bp, Homo sapiens
aaatgagtttgcctctagatag

SEQ ID NO: 7288765 - DNA, 22 bp, Homo sapiens
aaatatgagatgttctctttcg

SEQ ID NO: 7288766 - DNA, 22 bp, Homo sapiens
aagagagagtgcgctcacagaa

SEQ ID NO: 7288767 - DNA, 22 bp, Homo sapiens
aaatatagtaaatgcatagttc

SEQ ID NO: 7288768 - DNA, 22 bp, Homo sapiens
aaatagtcctgggaatagtact

SEQ ID NO: 7288769 - DNA, 22 bp, Homo sapiens
aaatagtaaagtggtagccatc

SEQ ID NO: 7288770 - DNA, 22 bp, Homo sapiens
aaatacagcagactcctgttgt

SEQ ID NO: 7288771 - DNA, 22 bp, Homo sapiens
aagagagaagtctctctggttc

SEQ ID NO: 7288772 - DNA, 22 bp, Homo sapiens
aaagccaaatgaaagatggttc

SEQ ID NO: 7288773 - DNA, 22 bp, Homo sapiens
aaaggcagagtgctcagctggc

SEQ ID NO: 7288774 - DNA, 22 bp, Homo sapiens
aaattggatgcacatttagaaa

SEQ ID NO: 7288775 - DNA, 22 bp, Homo sapiens
aaagcaggttatgaccatggcc

SEQ ID NO: 7288776 - DNA, 22 bp, Homo sapiens
aaagggaaaatatttagacata

SEQ ID NO: 7288777 - DNA, 22 bp, Homo sapiens
aatatcctgaccagtaaactaa

SEQ ID NO: 7288778 - DNA, 22 bp, Homo sapiens
aataatcttgactactgaatca

SEQ ID NO: 7288779 - DNA, 22 bp, Homo sapiens
aagttacacagagttggaggct

SEQ ID NO: 7288780 - DNA, 22 bp, Homo sapiens
aagttacagttattatttaaaa

SEQ ID NO: 7288781 - DNA, 22 bp, Homo sapiens
aagttacagttaggggtgatga

SEQ ID NO: 7288782 - DNA, 22 bp, Homo sapiens
aagtacaacgcatacagagaaa

SEQ ID NO: 7288783 - DNA, 22 bp, Homo sapiens
aagtacaaattttgaagagctt

SEQ ID NO: 7288784 - DNA, 22 bp, Homo sapiens
aagggcaggtgggcatttctgg

SEQ ID NO: 7288785 - DNA, 22 bp, Homo sapiens
aagggcagggagtttgtgtcta

SEQ ID NO: 7288786 - DNA, 22 bp, Homo sapiens
aagggcaggagaagacggatat

SEQ ID NO: 7288787 - DNA, 22 bp, Homo sapiens
aagggcaggcagagatcatata

SEQ ID NO: 7288788 - DNA, 22 bp, Homo sapiens
acaaatgaacatataagcttga

SEQ ID NO: 7288789 - DNA, 22 bp, Homo sapiens
acaaatatttactgaatccact

SEQ ID NO: 7288790 - DNA, 22 bp, Homo sapiens
aagaacattcgaactattttct

SEQ ID NO: 7288791 - DNA, 22 bp, Homo sapiens
aagaaccaaaatgaagctaggt

SEQ ID NO: 7288792 - DNA, 22 bp, Homo sapiens
acaaaaattagctgggcatggt

SEQ ID NO: 7288793 - DNA, 22 bp, Homo sapiens
acacagagccagggaatacagt

SEQ ID NO: 7288794 - DNA, 22 bp, Homo sapiens
acaatagtcaatgcacgtcatt

SEQ ID NO: 7288795 - DNA, 22 bp, Homo sapiens
acaaatttgtgtagttatggca

SEQ ID NO: 7288796 - DNA, 22 bp, Homo sapiens
acaaatttggtgagagtaaata

SEQ ID NO: 7288797 - DNA, 22 bp, Homo sapiens
acaaatttgaatcctgacttct

SEQ ID NO: 7288798 - DNA, 22 bp, Homo sapiens
acaaatttattgaagggcatat

SEQ ID NO: 7288799 - DNA, 22 bp, Homo sapiens
acaaatttcataggcaaatttt

SEQ ID NO: 7288800 - DNA, 22 bp, Homo sapiens
acactgtaaacatctcaagcac

SEQ ID NO: 7288801 - DNA, 22 bp, Homo sapiens
acagacctgggcacagaaagga

SEQ ID NO: 7288802 - DNA, 22 bp, Homo sapiens
acagagatggcacagagaaggt

SEQ ID NO: 7288803 - DNA, 22 bp, Homo sapiens
acagagcaacttgagtatcctc

SEQ ID NO: 7288804 - DNA, 22 bp, Homo sapiens
acagaaataactttttatgttt

SEQ ID NO: 7288805 - DNA, 22 bp, Homo sapiens
acagcagggggagctgttggac

SEQ ID NO: 7288806 - DNA, 22 bp, Homo sapiens
acagcaggggtggaataaacgt

SEQ ID NO: 7288807 - DNA, 22 bp, Homo sapiens
acagcagggtcacattccctct

SEQ ID NO: 7288808 - DNA, 22 bp, Homo sapiens
acagcaggtagctttgtgcctc

SEQ ID NO: 7288809 - DNA, 19 bp, Homo sapiens
acagcaggtgtggggataa

SEQ ID NO: 7288810 - DNA, 22 bp, Homo sapiens
acagcaggaagctggagggaaa

SEQ ID NO: 7288811 - DNA, 22 bp, Homo sapiens
aagcaggcttggtgtggccgct

SEQ ID NO: 7288812 - DNA, 22 bp, Homo sapiens
aagccaggttccatggaggagc

SEQ ID NO: 7288813 - DNA, 22 bp, Homo sapiens
acagcaggttacagtggcacag

SEQ ID NO: 7288814 - DNA, 22 bp, Homo sapiens
atgattttctgataaagaactg

SEQ ID NO: 7288815 - DNA, 22 bp, Homo sapiens
atgaggaggccagtaagagcct

SEQ ID NO: 7288816 - DNA, 22 bp, Homo sapiens
atgactgctctgggctcccatg

SEQ ID NO: 7288817 - DNA, 19 bp, Homo sapiens
atgactcttattgtctgaa

SEQ ID NO: 7288818 - DNA, 22 bp, Homo sapiens
atcttacattccctcaccattt

SEQ ID NO: 7288819 - DNA, 22 bp, Homo sapiens
atcttacagcagcaaggaagta

SEQ ID NO: 7288820 - DNA, 22 bp, Homo sapiens
agacataagcgagcatcacagg

SEQ ID NO: 7288821 - DNA, 22 bp, Homo sapiens
agagaacagacagatgcaatga

SEQ ID NO: 7288822 - DNA, 22 bp, Homo sapiens
agagccagccttctcagcttac

SEQ ID NO: 7288823 - DNA, 22 bp, Homo sapiens
agagccagcatttgggccctgc

SEQ ID NO: 7288824 - DNA, 22 bp, Homo sapiens
atgttacagaaagcaaagatga

SEQ ID NO: 7288825 - DNA, 22 bp, Homo sapiens
attaagtgactaaagtaatgct

SEQ ID NO: 7288826 - DNA, 22 bp, Homo sapiens
atgtagttagaagattcaaaca

SEQ ID NO: 7288827 - DNA, 21 bp, Homo sapiens
agagactgtcactgcagtacc

SEQ ID NO: 7288828 - DNA, 22 bp, Homo sapiens
agagactgtcacataacagagg

SEQ ID NO: 7288829 - DNA, 22 bp, Homo sapiens
atgggctctatgtctaggagat

SEQ ID NO: 7288830 - DNA, 22 bp, Homo sapiens
atgggctcggcgctgctgggat

SEQ ID NO: 7288831 - DNA, 22 bp, Homo sapiens
atgggcctgttcctatgctggt

SEQ ID NO: 7288832 - DNA, 22 bp, Homo sapiens
atgggccttgacacatggagtg

SEQ ID NO: 7288833 - DNA, 22 bp, Homo sapiens
agagactgatggatcaccaaat

SEQ ID NO: 7288834 - DNA, 22 bp, Homo sapiens
agagactgtacgtggcaagtat

SEQ ID NO: 7288835 - DNA, 22 bp, Homo sapiens
agagactgcgtgtcagcgctgg

SEQ ID NO: 7288836 - DNA, 22 bp, Homo sapiens
agagactggagatgggcagtgt

SEQ ID NO: 7288837 - DNA, 22 bp, Homo sapiens
atgggcagtgtattggaaggaa

SEQ ID NO: 7288838 - DNA, 22 bp, Homo sapiens
agagaacattagcaaaaacagc

SEQ ID NO: 7288839 - DNA, 22 bp, Homo sapiens
atggaatgtttcctcttttatt

SEQ ID NO: 7288840 - DNA, 21 bp, Homo sapiens
agaggaagaagagtgtattat

SEQ ID NO: 7288841 - DNA, 22 bp, Homo sapiens
agagcttttgggaattcaggta

SEQ ID NO: 7288842 - DNA, 22 bp, Homo sapiens
agatgatgttggagtctgtgct

SEQ ID NO: 7288843 - DNA, 22 bp, Homo sapiens
agatgatgataattgaaaggca

SEQ ID NO: 7288844 - DNA, 22 bp, Homo sapiens
atttctcttagcaagacattac

SEQ ID NO: 7288845 - DNA, 22 bp, Homo sapiens
atttacaggtagaattttaagt

SEQ ID NO: 7288846 - DNA, 23 bp, Homo sapiens
atttacagctgtgtgagcaagtt

SEQ ID NO: 7288847 - DNA, 22 bp, Homo sapiens
agccctcctttgttcatgctgc

SEQ ID NO: 7288848 - DNA, 22 bp, Homo sapiens
agccctcctggggccacgctgg

SEQ ID NO: 7288849 - DNA, 22 bp, Homo sapiens
cagagtggagatgtgtgtggaa

SEQ ID NO: 7288850 - DNA, 22 bp, Homo sapiens
cagagtggcactctgctggatg

SEQ ID NO: 7288851 - DNA, 22 bp, Homo sapiens
cagagccaggtctaggagtctc

SEQ ID NO: 7288852 - DNA, 22 bp, Homo sapiens
cagagcagtaaatctggggcac

SEQ ID NO: 7288853 - DNA, 18 bp, Homo sapiens
cagagcagtatgaatgtt

SEQ ID NO: 7288854 - DNA, 22 bp, Homo sapiens
agccaggctcaaggcctgctcc

SEQ ID NO: 7288855 - DNA, 22 bp, Homo sapiens
agccaggctgcagttggctggc

SEQ ID NO: 7288856 - DNA, 22 bp, Homo sapiens
agccagggacgctgcaggctac

SEQ ID NO: 7288857 - DNA, 22 bp, Homo sapiens
cagcctctgacaccacagtcgt

SEQ ID NO: 7288858 - DNA, 17 bp, Homo sapiens
agctgagctggccaggg

SEQ ID NO: 7288859 - DNA, 23 bp, Homo sapiens
agctgaggcagaggggcattctc

SEQ ID NO: 7288860 - DNA, 22 bp, Homo sapiens
cagctggcaagtggagcagggt

SEQ ID NO: 7288861 - DNA, 22 bp, Homo sapiens
cagctgggtggctcttctgctc

SEQ ID NO: 7288862 - DNA, 22 bp, Homo sapiens
cagctggcatacctgggcccgg

SEQ ID NO: 7288863 - DNA, 22 bp, Homo sapiens
cagctggcagccctggccctgc

SEQ ID NO: 7288864 - DNA, 22 bp, Homo sapiens
cagctggcagccctggccctgc

SEQ ID NO: 7288865 - DNA, 22 bp, Homo sapiens
cagcatggggcttggagtcagc

SEQ ID NO: 7288866 - DNA, 22 bp, Homo sapiens
cagcatgggttccgggggcctg

SEQ ID NO: 7288867 - DNA, 22 bp, Homo sapiens
cagcatggagacaaagtgggca

SEQ ID NO: 7288868 - DNA, 22 bp, Homo sapiens
cagcatggacaggggtggcgtt

SEQ ID NO: 7288869 - DNA, 22 bp, Homo sapiens
cacacatgacccacttttaccg

SEQ ID NO: 7288870 - DNA, 22 bp, Homo sapiens
cacagctggggaagctgaggcc

SEQ ID NO: 7288871 - DNA, 22 bp, Homo sapiens
agcattttctgagagtatagat

SEQ ID NO: 7288872 - DNA, 22 bp, Homo sapiens
cactgggcgtgtcctgggtgag

SEQ ID NO: 7288873 - DNA, 22 bp, Homo sapiens
cactgggcgccagctgctgagc

SEQ ID NO: 7288874 - DNA, 23 bp, Homo sapiens
cactgggcccagggtgtggaggc

SEQ ID NO: 7288875 - DNA, 20 bp, Homo sapiens
cactgggctggagtcagggc

SEQ ID NO: 7288876 - DNA, 22 bp, Homo sapiens
cactgggctgataccaggcttc

SEQ ID NO: 7288877 - DNA, 22 bp, Homo sapiens
cactgggctttgtagttagcat

SEQ ID NO: 7288878 - DNA, 22 bp, Homo sapiens
agcaggtgggatcaagctggca

SEQ ID NO: 7288879 - DNA, 22 bp, Homo sapiens
cactaggagacaaggcaaacca

SEQ ID NO: 7288880 - DNA, 19 bp, Homo sapiens
agcaggctaggctgcctct

SEQ ID NO: 7288881 - DNA, 19 bp, Homo sapiens
agcaggctaggctgcctct

SEQ ID NO: 7288882 - DNA, 22 bp, Homo sapiens
agcaggctaggaacctcactgc

SEQ ID NO: 7288883 - DNA, 22 bp, Homo sapiens
agcaggctaggaacctcactgc

SEQ ID NO: 7288884 - DNA, 20 bp, Homo sapiens
agcaggccttggggagagga

SEQ ID NO: 7288885 - DNA, 22 bp, Homo sapiens
cacatggggcgctgcattggcc

SEQ ID NO: 7288886 - DNA, 22 bp, Homo sapiens
cacatgggtgtgcctggaggaa

SEQ ID NO: 7288887 - DNA, 22 bp, Homo sapiens
cacatgggtgtgcctggaggaa

SEQ ID NO: 7288888 - DNA, 19 bp, Homo sapiens
aggtgaggggcaccatgtc

SEQ ID NO: 7288889 - DNA, 22 bp, Homo sapiens
aggtgaggataggtggccaagg

SEQ ID NO: 7288890 - DNA, 22 bp, Homo sapiens
actctgctatcttagcaaaagg

SEQ ID NO: 7288891 - DNA, 22 bp, Homo sapiens
agtaagttagtacctgctcaga

SEQ ID NO: 7288892 - DNA, 22 bp, Homo sapiens
agtgctttccctgaaaccttcc

SEQ ID NO: 7288893 - DNA, 22 bp, Homo sapiens
agtgtcttagtccatttgggct

SEQ ID NO: 7288894 - DNA, 22 bp, Homo sapiens
agtgtgggttttatggagccct

SEQ ID NO: 7288895 - DNA, 22 bp, Homo sapiens
agtggggccggtgaggccgagg

SEQ ID NO: 7288896 - DNA, 22 bp, Homo sapiens
agtggggcggacaggaccagga

SEQ ID NO: 7288897 - DNA, 22 bp, Homo sapiens
agtgggggcagagcctctctcg

SEQ ID NO: 7288898 - DNA, 22 bp, Homo sapiens
agtgggggctggctctgtctgt

SEQ ID NO: 7288899 - DNA, 22 bp, Homo sapiens
agttaagtaaacatttcccaga

SEQ ID NO: 7288900 - DNA, 19 bp, Homo sapiens
agaagcccagatcccagcc

SEQ ID NO: 7288901 - DNA, 20 bp, Homo sapiens
agaaatattgagttcagagg

SEQ ID NO: 7288902 - DNA, 22 bp, Homo sapiens
atattacacacggtatcacggg

SEQ ID NO: 7288903 - DNA, 22 bp, Homo sapiens
agaaagaacgttggttatctta

SEQ ID NO: 7288904 - DNA, 22 bp, Homo sapiens
agttgaaagccttatttctctg

SEQ ID NO: 7288905 - DNA, 22 bp, Homo sapiens
atacacatttgctagagatggg

SEQ ID NO: 7288906 - DNA, 22 bp, Homo sapiens
ataaggaaaattggagaaattg

SEQ ID NO: 7288907 - DNA, 22 bp, Homo sapiens
actttacaggcacttcaagtat

SEQ ID NO: 7288908 - DNA, 22 bp, Homo sapiens
actttactcaacaaatatttat

SEQ ID NO: 7288909 - DNA, 23 bp, Homo sapiens
actttagataaattatgtgcaca

SEQ ID NO: 7288910 - DNA, 22 bp, Homo sapiens
actttagaaaaggaacagagga

SEQ ID NO: 7288911 - DNA, 22 bp, Homo sapiens
atagaacagggcactgtcatga

SEQ ID NO: 7288912 - DNA, 21 bp, Homo sapiens
atagaacaccaggcatatata

SEQ ID NO: 7288913 - DNA, 23 bp, Homo sapiens
agaaaagcttggacacatggcct

SEQ ID NO: 7288914 - DNA, 22 bp, Homo sapiens
agaaaagaggctttctaagcat

SEQ ID NO: 7288915 - DNA, 17 bp, Homo sapiens
agaaaagagaccagcag

SEQ ID NO: 7288916 - DNA, 23 bp, Homo sapiens
agaaaagcttggacacatggcct

SEQ ID NO: 7288917 - DNA, 20 bp, Homo sapiens
agaaaaagtgtggaaatttc

SEQ ID NO: 7288918 - DNA, 22 bp, Homo sapiens
ataggagactgttcttggcttc

SEQ ID NO: 7288919 - DNA, 22 bp, Homo sapiens
acaggacaaggggaagaagata

SEQ ID NO: 7288920 - DNA, 22 bp, Homo sapiens
acaggaataaaaggaataagga

SEQ ID NO: 7288921 - DNA, 22 bp, Homo sapiens
acagggcctcagccagggcaga

SEQ ID NO: 7288922 - DNA, 22 bp, Homo sapiens
acagggccaggtgagaggtgct

SEQ ID NO: 7288923 - DNA, 22 bp, Homo sapiens
acagggcatgtgcaagagacat

SEQ ID NO: 7288924 - DNA, 23 bp, Homo sapiens
acagggcattgctggcctcgagg

SEQ ID NO: 7288925 - DNA, 22 bp, Homo sapiens
acaggctctctattgagtgcag

SEQ ID NO: 7288926 - DNA, 22 bp, Homo sapiens
aggaaataggaccagacaaagc

SEQ ID NO: 7288927 - DNA, 22 bp, Homo sapiens
aggacttagaacattatgtact

SEQ ID NO: 7288928 - DNA, 22 bp, Homo sapiens
aggaggccaggccctcaagcct

SEQ ID NO: 7288929 - DNA, 19 bp, Homo sapiens
aggaggccatgccactaga

SEQ ID NO: 7288930 - DNA, 22 bp, Homo sapiens
acagtgcagggcgggaagaagg

SEQ ID NO: 7288931 - DNA, 22 bp, Homo sapiens
acagtgcagggtgggaagaagg

SEQ ID NO: 7288932 - DNA, 22 bp, Homo sapiens
aggcagatatttcagttcacat

SEQ ID NO: 7288933 - DNA, 22 bp, Homo sapiens
aggcagatcagtacagggttaa

SEQ ID NO: 7288934 - DNA, 22 bp, Homo sapiens
aggcagatcacttgaggccagg

SEQ ID NO: 7288935 - DNA, 22 bp, Homo sapiens
aggcagagaaaaaccagatatg

SEQ ID NO: 7288936 - DNA, 22 bp, Homo sapiens
aggcagattacttgaggccagg

SEQ ID NO: 7288937 - DNA, 22 bp, Homo sapiens
aggcagaagccagccagggtcc

SEQ ID NO: 7288938 - DNA, 22 bp, Homo sapiens
aggcaggggagctggaagggta

SEQ ID NO: 7288939 - DNA, 18 bp, Homo sapiens
aggcaggtgctggaagtc

SEQ ID NO: 7288940 - DNA, 22 bp, Homo sapiens
aggcagattttctttactcagt

SEQ ID NO: 7288941 - DNA, 23 bp, Homo sapiens
aggctggcttcaggagcctctcc

SEQ ID NO: 7288942 - DNA, 22 bp, Homo sapiens
aggctggccagtgctgcagtgg

SEQ ID NO: 7288943 - DNA, 22 bp, Homo sapiens
aggctggccagtgctgcagtgg

SEQ ID NO: 7288944 - DNA, 22 bp, Homo sapiens
aggctggcttcccaagcgtcct

SEQ ID NO: 7288945 - DNA, 23 bp, Homo sapiens
aggctggcttcaggagcctctcc

SEQ ID NO: 7288946 - DNA, 22 bp, Homo sapiens
aggctggcttggctctcctgtg

SEQ ID NO: 7288947 - DNA, 21 bp, Homo sapiens
accactgcctccaaggttcag

SEQ ID NO: 7288948 - DNA, 22 bp, Homo sapiens
aggctggctttggtagcatggt

SEQ ID NO: 7288949 - DNA, 22 bp, Homo sapiens
aggctggctttggtagcatggt

SEQ ID NO: 7288950 - DNA, 22 bp, Homo sapiens
aggctgtgagttttgtctcaga

SEQ ID NO: 7288951 - DNA, 20 bp, Homo sapiens
aggctcagctgagctcttgg

SEQ ID NO: 7288952 - DNA, 22 bp, Homo sapiens
aggctcagggacggggcccctt

SEQ ID NO: 7288953 - DNA, 22 bp, Homo sapiens
acatgtggtcaatctgtgtagg

SEQ ID NO: 7288954 - DNA, 22 bp, Homo sapiens
aggctcaggtctcaggtctggc

SEQ ID NO: 7288955 - DNA, 20 bp, Homo sapiens
aggctcagggtgtttaggaa

SEQ ID NO: 7288956 - DNA, 23 bp, Homo sapiens
aggggtggtcagtacccgcagtg

SEQ ID NO: 7288957 - DNA, 22 bp, Homo sapiens
aggggcctggacatggacgcgc

SEQ ID NO: 7288958 - DNA, 20 bp, Homo sapiens
aggggcctggaacaggcctt

SEQ ID NO: 7288959 - DNA, 22 bp, Homo sapiens
aggggcctcgcaggaccgctcc

SEQ ID NO: 7288960 - DNA, 22 bp, Homo sapiens
agggctcagcctcctcctcagc

SEQ ID NO: 7288961 - DNA, 22 bp, Homo sapiens
agggctcaggggccccaagctg

SEQ ID NO: 7288962 - DNA, 22 bp, Homo sapiens
agggctcactacaaccctggga

SEQ ID NO: 7288963 - DNA, 22 bp, Homo sapiens
agggctcagtaaacggtggatt

SEQ ID NO: 7288964 - DNA, 20 bp, Homo sapiens
agggaggtgctgggcctgag

SEQ ID NO: 7288965 - DNA, 22 bp, Homo sapiens
agggaggtccatccctgcagag

SEQ ID NO: 7288966 - DNA, 22 bp, Homo sapiens
agggctcaatggtgggcatgta

SEQ ID NO: 7288967 - DNA, 22 bp, Homo sapiens
cagctgggtttagtggggtgtg

SEQ ID NO: 7288968 - DNA, 22 bp, Homo sapiens
caggatggtcagatgcattgtc

SEQ ID NO: 7288969 - DNA, 22 bp, Homo sapiens
caggcacacagcacatggcctg

SEQ ID NO: 7288970 - DNA, 22 bp, Homo sapiens
caggcacacaggctccctgggc

SEQ ID NO: 7288971 - DNA, 22 bp, Homo sapiens
caggagcatgctgatgccagaa

SEQ ID NO: 7288972 - DNA, 21 bp, Homo sapiens
caggctctgctagaggagcct

SEQ ID NO: 7288973 - DNA, 22 bp, Homo sapiens
caggcccatgagggcagccaca

SEQ ID NO: 7288974 - DNA, 22 bp, Homo sapiens
caggcccatctgctcccaggct

SEQ ID NO: 7288975 - DNA, 22 bp, Homo sapiens
caggcagcctgcggtctgcaca

SEQ ID NO: 7288976 - DNA, 22 bp, Homo sapiens
caggcagccttctcgtctcaca

SEQ ID NO: 7288977 - DNA, 22 bp, Homo sapiens
caggtgggattttgctgcttga

SEQ ID NO: 7288978 - DNA, 22 bp, Homo sapiens
aggacagagcctgtgcagaccg

SEQ ID NO: 7288979 - DNA, 22 bp, Homo sapiens
aggacagacctaggactggagc

SEQ ID NO: 7288980 - DNA, 22 bp, Homo sapiens
aggacagagggaccagagccca

SEQ ID NO: 7288981 - DNA, 22 bp, Homo sapiens
caggctcttttggtggcaagga

SEQ ID NO: 7288982 - DNA, 22 bp, Homo sapiens
cagggcagtaacgggaacatct

SEQ ID NO: 7288983 - DNA, 22 bp, Homo sapiens
cagggcagggccacaccccctg

SEQ ID NO: 7288984 - DNA, 22 bp, Homo sapiens
cagggcagggatgttgcggcag

SEQ ID NO: 7288985 - DNA, 22 bp, Homo sapiens
aggaaaggcctcagcagaaacc

SEQ ID NO: 7288986 - DNA, 22 bp, Homo sapiens
aggaaaggcctcagcagaaacc

SEQ ID NO: 7288987 - DNA, 19 bp, Homo sapiens
aggaaaggatcaaaatagc

SEQ ID NO: 7288988 - DNA, 22 bp, Homo sapiens
aggaagagctggaccagaggac

SEQ ID NO: 7288989 - DNA, 18 bp, Homo sapiens
cagggctgtggggtcact

SEQ ID NO: 7288990 - DNA, 22 bp, Homo sapiens
aggcaggaggatcatggatgca

SEQ ID NO: 7288991 - DNA, 22 bp, Homo sapiens
aggcaggagtgaccctgacagg

SEQ ID NO: 7288992 - DNA, 18 bp, Homo sapiens
aggcaggatcctggcctc

SEQ ID NO: 7288993 - DNA, 22 bp, Homo sapiens
aggcaggagcaagccctacaag

SEQ ID NO: 7288994 - DNA, 17 bp, Homo sapiens
aggcaggagattggaga

SEQ ID NO: 7288995 - DNA, 22 bp, Homo sapiens
aggcaaggtgctacagacagtg

SEQ ID NO: 7288996 - DNA, 22 bp, Homo sapiens
cattggaaaatgcatgcttttt

SEQ ID NO: 7288997 - DNA, 22 bp, Homo sapiens
aggcaagcagtcagtctatgag

SEQ ID NO: 7288998 - DNA, 23 bp, Homo sapiens
aggcaagggtgtaaaggaaatga

SEQ ID NO: 7288999 - DNA, 22 bp, Homo sapiens
cataatatctccgattacttgc

SEQ ID NO: 7289000 - DNA, 22 bp, Homo sapiens
aggagccagaatccagactcgg

SEQ ID NO: 7289001 - DNA, 22 bp, Homo sapiens
aggagccagcgttcctcaggat

SEQ ID NO: 7289002 - DNA, 21 bp, Homo sapiens
cagtgtggtgaccagggtctc

SEQ ID NO: 7289003 - DNA, 22 bp, Homo sapiens
cagtgtggtgtgcacagcttag

SEQ ID NO: 7289004 - DNA, 22 bp, Homo sapiens
catccaaagcaaatatcttaaa

SEQ ID NO: 7289005 - DNA, 19 bp, Homo sapiens
catctctgcaaggagctgc

SEQ ID NO: 7289006 - DNA, 22 bp, Homo sapiens
catgaggtcagggggagccggt

SEQ ID NO: 7289007 - DNA, 22 bp, Homo sapiens
catgaggtgataaagctgggat

SEQ ID NO: 7289008 - DNA, 22 bp, Homo sapiens
catgagatttgggaggggccag

SEQ ID NO: 7289009 - DNA, 22 bp, Homo sapiens
aggatggggtctgcagcctggt

SEQ ID NO: 7289010 - DNA, 22 bp, Homo sapiens
catcttgccctacacatttatc

SEQ ID NO: 7289011 - DNA, 22 bp, Homo sapiens
cccagaggtgacatcccattct

SEQ ID NO: 7289012 - DNA, 22 bp, Homo sapiens
cccagaggtgcttcagaggtgc

SEQ ID NO: 7289013 - DNA, 22 bp, Homo sapiens
aggctgtggtgctgaaggaggg

SEQ ID NO: 7289014 - DNA, 22 bp, Homo sapiens
aggctgtgggaatggctgcttg

SEQ ID NO: 7289015 - DNA, 22 bp, Homo sapiens
aggctgtgctcagccaatggga

SEQ ID NO: 7289016 - DNA, 22 bp, Homo sapiens
aggctgtgcgaggtctcagagt

SEQ ID NO: 7289017 - DNA, 22 bp, Homo sapiens
cccaccctgggaagctaggcag

SEQ ID NO: 7289018 - DNA, 22 bp, Homo sapiens
cccacgtcgaacttgctccaga

SEQ ID NO: 7289019 - DNA, 21 bp, Homo sapiens
cccacggaatgatgaggcact

SEQ ID NO: 7289020 - DNA, 22 bp, Homo sapiens
cccactctggctcccttctagt

SEQ ID NO: 7289021 - DNA, 22 bp, Homo sapiens
ccagtgggtgctgggctctgcc

SEQ ID NO: 7289022 - DNA, 22 bp, Homo sapiens
ccagtgtattatttgagaaatt

SEQ ID NO: 7289023 - DNA, 22 bp, Homo sapiens
ccagtgggtaggccatggtgag

SEQ ID NO: 7289024 - DNA, 22 bp, Homo sapiens
ccagtgtatttttgggacctgc

SEQ ID NO: 7289025 - DNA, 16 bp, Homo sapiens
ccaggtggggctgtga

SEQ ID NO: 7289026 - DNA, 22 bp, Homo sapiens
ccaggtggtgaaagtgggccct

SEQ ID NO: 7289027 - DNA, 22 bp, Homo sapiens
aggctcagcctgggcctagagc

SEQ ID NO: 7289028 - DNA, 22 bp, Homo sapiens
aggctcagcatctgattcatat

SEQ ID NO: 7289029 - DNA, 22 bp, Homo sapiens
aggctcagatccttgtgtcctg

SEQ ID NO: 7289030 - DNA, 22 bp, Homo sapiens
aggctcagattcacatttggtt

SEQ ID NO: 7289031 - DNA, 19 bp, Homo sapiens
ccagaggtttgctgggcct

SEQ ID NO: 7289032 - DNA, 22 bp, Homo sapiens
aggcaggtagaaggatctttat

SEQ ID NO: 7289033 - DNA, 22 bp, Homo sapiens
ccagccagctggttggacgcct

SEQ ID NO: 7289034 - DNA, 22 bp, Homo sapiens
ccagccagatgataagctctat

SEQ ID NO: 7289035 - DNA, 22 bp, Homo sapiens
ccagcagggaaaaacccaccaa

SEQ ID NO: 7289036 - DNA, 20 bp, Homo sapiens
aggctcagatacccagggaa

SEQ ID NO: 7289037 - DNA, 22 bp, Homo sapiens
aggctcagaggtgagcatctgc

SEQ ID NO: 7289038 - DNA, 20 bp, Homo sapiens
aggctcagagcagtagtaca

SEQ ID NO: 7289039 - DNA, 22 bp, Homo sapiens
ccaggcactcagagactgggac

SEQ ID NO: 7289040 - DNA, 21 bp, Homo sapiens
aggctcagagagaaactcttg

SEQ ID NO: 7289041 - DNA, 22 bp, Homo sapiens
aggctcagagagctgtgtccat

SEQ ID NO: 7289042 - DNA, 22 bp, Homo sapiens
ccaggaggggtctctgtctccc

SEQ ID NO: 7289043 - DNA, 22 bp, Homo sapiens
ccaggaggggtctctgtctccc

SEQ ID NO: 7289044 - DNA, 22 bp, Homo sapiens
cccctgggtccaggcttctctg

SEQ ID NO: 7289045 - DNA, 22 bp, Homo sapiens
cccctgccatagtcaaatctaa

SEQ ID NO: 7289046 - DNA, 21 bp, Homo sapiens
cccctgggagccctgtcagta

SEQ ID NO: 7289047 - DNA, 22 bp, Homo sapiens
cccctgccagctatccctgaac

SEQ ID NO: 7289048 - DNA, 22 bp, Homo sapiens
cccctgccagctatccctgaac

SEQ ID NO: 7289049 - DNA, 22 bp, Homo sapiens
agggcagagaaatgtagttgag

SEQ ID NO: 7289050 - DNA, 22 bp, Homo sapiens
agggcagactaggatggaagtg

SEQ ID NO: 7289051 - DNA, 22 bp, Homo sapiens
agggcagaccacgtgcaaggat

SEQ ID NO: 7289052 - DNA, 22 bp, Homo sapiens
cccaggccctggcagagcttgt

SEQ ID NO: 7289053 - DNA, 22 bp, Homo sapiens
agggaaaggtagtgaggtcaca

SEQ ID NO: 7289054 - DNA, 22 bp, Homo sapiens
aggcttggctggcagccctggg

SEQ ID NO: 7289055 - DNA, 22 bp, Homo sapiens
cctcctggtgggcgcttctggc

SEQ ID NO: 7289056 - DNA, 22 bp, Homo sapiens
aggggctcaaagtgtgcaggga

SEQ ID NO: 7289057 - DNA, 22 bp, Homo sapiens
aggggctcctctctgagagtag

SEQ ID NO: 7289058 - DNA, 22 bp, Homo sapiens
aggggctcctggcctggagagc

SEQ ID NO: 7289059 - DNA, 22 bp, Homo sapiens
agggcctgtgcttcctgagata

SEQ ID NO: 7289060 - DNA, 22 bp, Homo sapiens
agggcctgtctgtagaactgaa

SEQ ID NO: 7289061 - DNA, 22 bp, Homo sapiens
agggcctgtccgctcccgcccg

SEQ ID NO: 7289062 - DNA, 22 bp, Homo sapiens
agggcctgtgaattctccctgc

SEQ ID NO: 7289063 - DNA, 22 bp, Homo sapiens
cctgtgagtcaacccctccttg

SEQ ID NO: 7289064 - DNA, 22 bp, Homo sapiens
cctgtgacattagaatttcatt

SEQ ID NO: 7289065 - DNA, 22 bp, Homo sapiens
cctgtgaccactctggttctgc

SEQ ID NO: 7289066 - DNA, 19 bp, Homo sapiens
cctgtgactatctttgtaa

SEQ ID NO: 7289067 - DNA, 22 bp, Homo sapiens
cctgtgacgtgtctcctggcac

SEQ ID NO: 7289068 - DNA, 22 bp, Homo sapiens
cctgtgacccttccagtctact

SEQ ID NO: 7289069 - DNA, 22 bp, Homo sapiens
cctgtgactctgtctgatggtc

SEQ ID NO: 7289070 - DNA, 22 bp, Homo sapiens
cctgtgacttggcaaacctcca

SEQ ID NO: 7289071 - DNA, 19 bp, Homo sapiens
cctgtgagaggacaggtgt

SEQ ID NO: 7289072 - DNA, 22 bp, Homo sapiens
cctgtcatatacatacctcctc

SEQ ID NO: 7289073 - DNA, 21 bp, Homo sapiens
aggtggggctgcacctctgct

SEQ ID NO: 7289074 - DNA, 22 bp, Homo sapiens
aggtggggaggagtgtctcttt

SEQ ID NO: 7289075 - DNA, 22 bp, Homo sapiens
aggtggggaggagtgtctcttt

SEQ ID NO: 7289076 - DNA, 22 bp, Homo sapiens
cctgggctttgagggcaggatg

SEQ ID NO: 7289077 - DNA, 22 bp, Homo sapiens
cctgggctttgagggcaggatg

SEQ ID NO: 7289078 - DNA, 22 bp, Homo sapiens
cctgggctttcggcggcttcct

SEQ ID NO: 7289079 - DNA, 22 bp, Homo sapiens
cctgtcagggtttgcctcagaa

SEQ ID NO: 7289080 - DNA, 22 bp, Homo sapiens
cctgggcttgcatctgtgctgg

SEQ ID NO: 7289081 - DNA, 22 bp, Homo sapiens
cctgggctcgcgcacttcaccc

SEQ ID NO: 7289082 - DNA, 22 bp, Homo sapiens
cctgggctcaggcttgggcagc

SEQ ID NO: 7289083 - DNA, 22 bp, Homo sapiens
cctgggctcacagccaaggctc

SEQ ID NO: 7289084 - DNA, 22 bp, Homo sapiens
cctgggctcaccatgccttgga

SEQ ID NO: 7289085 - DNA, 22 bp, Homo sapiens
cctggctctgcgtgcagctccg

SEQ ID NO: 7289086 - DNA, 18 bp, Homo sapiens
cctggcacactggctcat

SEQ ID NO: 7289087 - DNA, 22 bp, Homo sapiens
cctggcacaagagcagcattgg

SEQ ID NO: 7289088 - DNA, 23 bp, Homo sapiens
cctggagtactaaggggatggaa

SEQ ID NO: 7289089 - DNA, 22 bp, Homo sapiens
cctggagtgacaggtgtagcct

SEQ ID NO: 7289090 - DNA, 22 bp, Homo sapiens
aggtagggaagaaggcatgaaa

SEQ ID NO: 7289091 - DNA, 22 bp, Homo sapiens
aggtaggatgggtggagatgat

SEQ ID NO: 7289092 - DNA, 22 bp, Homo sapiens
ctagaactacatcttttaatag

SEQ ID NO: 7289093 - DNA, 22 bp, Homo sapiens
agtccaggtggaccttggccag

SEQ ID NO: 7289094 - DNA, 22 bp, Homo sapiens
agtattccaaaaataaggacaa

SEQ ID NO: 7289095 - DNA, 22 bp, Homo sapiens
cgcaggctggcgcggagtggca

SEQ ID NO: 7289096 - DNA, 22 bp, Homo sapiens
cgcaggctcggttcacagagca

SEQ ID NO: 7289097 - DNA, 22 bp, Homo sapiens
cgcaggggaggaaggtacacct

SEQ ID NO: 7289098 - DNA, 18 bp, Homo sapiens
aggtttggtggaaacata

SEQ ID NO: 7289099 - DNA, 22 bp, Homo sapiens
cgcaggcaagagagtacagtta

SEQ ID NO: 7289100 - DNA, 22 bp, Homo sapiens
cgcaggcacagagtggacagcg

SEQ ID NO: 7289101 - DNA, 22 bp, Homo sapiens
agtacaatgtctgacacagtag

SEQ ID NO: 7289102 - DNA, 22 bp, Homo sapiens
agtacacaagacacatttaaaa

SEQ ID NO: 7289103 - DNA, 22 bp, Homo sapiens
ctgaggagaggtggcctgtgtt

SEQ ID NO: 7289104 - DNA, 22 bp, Homo sapiens
ctctgggaagggctgagcactg

SEQ ID NO: 7289105 - DNA, 22 bp, Homo sapiens
ctctgggaccatggcaagtgcg

SEQ ID NO: 7289106 - DNA, 22 bp, Homo sapiens
ctctgggaccacgtgactctgc

SEQ ID NO: 7289107 - DNA, 22 bp, Homo sapiens
ctctcagtttcctcaactgtaa

SEQ ID NO: 7289108 - DNA, 22 bp, Homo sapiens
ctctcagtgccacacagccatt

SEQ ID NO: 7289109 - DNA, 22 bp, Homo sapiens
ctctcagggcaggtggcctttc

SEQ ID NO: 7289110 - DNA, 21 bp, Homo sapiens
ctctgctgagtcctaggattc

SEQ ID NO: 7289111 - DNA, 22 bp, Homo sapiens
ctctgctgatctcagctgggct

SEQ ID NO: 7289112 - DNA, 22 bp, Homo sapiens
ctctgcctgtgtcgccaccaca

SEQ ID NO: 7289113 - DNA, 22 bp, Homo sapiens
ctctgcctgtctcatcctgcaa

SEQ ID NO: 7289114 - DNA, 22 bp, Homo sapiens
ctccagcttccctcagctgtgg

SEQ ID NO: 7289115 - DNA, 22 bp, Homo sapiens
ctcatggaagacactccttcac

SEQ ID NO: 7289116 - DNA, 22 bp, Homo sapiens
ctcattgcagctgcattactgt

SEQ ID NO: 7289117 - DNA, 22 bp, Homo sapiens
ctcatggagggagtgctcttcc

SEQ ID NO: 7289118 - DNA, 22 bp, Homo sapiens
ctcatggatataagaactgttt

SEQ ID NO: 7289119 - DNA, 22 bp, Homo sapiens
ctctcagaagtttatgtcagaa

SEQ ID NO: 7289120 - DNA, 20 bp, Homo sapiens
ctcctgggactgctggttat

SEQ ID NO: 7289121 - DNA, 20 bp, Homo sapiens
ctcctgggactgctggttat

SEQ ID NO: 7289122 - DNA, 22 bp, Homo sapiens
ctcctgggaaaggctggacaca

SEQ ID NO: 7289123 - DNA, 22 bp, Homo sapiens
ctcctggggccatggaaggaac

SEQ ID NO: 7289124 - DNA, 22 bp, Homo sapiens
ctcctggggcacttagaagcaa

SEQ ID NO: 7289125 - DNA, 22 bp, Homo sapiens
ctgggctcacctgtggctggca

SEQ ID NO: 7289126 - DNA, 22 bp, Homo sapiens
ctgggctcagcaggccaaggcc

SEQ ID NO: 7289127 - DNA, 22 bp, Homo sapiens
ctgggctcagaaccttgttaag

SEQ ID NO: 7289128 - DNA, 22 bp, Homo sapiens
ctgggcctggtgtggcacctgc

SEQ ID NO: 7289129 - DNA, 22 bp, Homo sapiens
ctgggcctggtagggcttgaaa

SEQ ID NO: 7289130 - DNA, 20 bp, Homo sapiens
ctgggctcaagtgagcctcc

SEQ ID NO: 7289131 - DNA, 20 bp, Homo sapiens
ctgggctcaagtgatcctcc

SEQ ID NO: 7289132 - DNA, 22 bp, Homo sapiens
ctggctgggagcgagctgctca

SEQ ID NO: 7289133 - DNA, 22 bp, Homo sapiens
ctgggctcttctcaccctgttt

SEQ ID NO: 7289134 - DNA, 22 bp, Homo sapiens
ctgggctctgtgtttcagtttc

SEQ ID NO: 7289135 - DNA, 22 bp, Homo sapiens
atcagaaatagtcatgttactt

SEQ ID NO: 7289136 - DNA, 22 bp, Homo sapiens
atcaacatatgcatgggaaagt

SEQ ID NO: 7289137 - DNA, 22 bp, Homo sapiens
cttccatacagacaatgcaatg

SEQ ID NO: 7289138 - DNA, 20 bp, Homo sapiens
cttagaaatttttaccctgg

SEQ ID NO: 7289139 - DNA, 22 bp, Homo sapiens
cttcttcaacctgaaagtttca

SEQ ID NO: 7289140 - DNA, 22 bp, Homo sapiens
atctctgcatccctcaaggttg

SEQ ID NO: 7289141 - DNA, 22 bp, Homo sapiens
atccagggtgtggagagagctc

SEQ ID NO: 7289142 - DNA, 22 bp, Homo sapiens
atccaccctgtggtggctttct

SEQ ID NO: 7289143 - DNA, 22 bp, Homo sapiens
ctgtggctcaattgcctactga

SEQ ID NO: 7289144 - DNA, 22 bp, Homo sapiens
ctgtggctcaaaatcccatgat

SEQ ID NO: 7289145 - DNA, 22 bp, Homo sapiens
agttattcccttctggaggaga

SEQ ID NO: 7289146 - DNA, 22 bp, Homo sapiens
agttattcatttattctgtaca

SEQ ID NO: 7289147 - DNA, 22 bp, Homo sapiens
ctgctgaggccttccctgtcct

SEQ ID NO: 7289148 - DNA, 22 bp, Homo sapiens
atacaactttatctgtaatgag

SEQ ID NO: 7289149 - DNA, 22 bp, Homo sapiens
ctgctgaggtccttgctcagac

SEQ ID NO: 7289150 - DNA, 22 bp, Homo sapiens
ctgcctctgcgtcccacagagt

SEQ ID NO: 7289151 - DNA, 22 bp, Homo sapiens
ctgcctctccccagagtggccc

SEQ ID NO: 7289152 - DNA, 22 bp, Homo sapiens
ctgcctctcaggtccctgagat

SEQ ID NO: 7289153 - DNA, 22 bp, Homo sapiens
ataacagatgcttcagcataaa

SEQ ID NO: 7289154 - DNA, 22 bp, Homo sapiens
ataactgagagcaatctttctt

SEQ ID NO: 7289155 - DNA, 22 bp, Homo sapiens
ataacccattggccaggcttca

SEQ ID NO: 7289156 - DNA, 22 bp, Homo sapiens
ctggctggcagatgctcttgct

SEQ ID NO: 7289157 - DNA, 22 bp, Homo sapiens
ctggctggcagatgctcttgct

SEQ ID NO: 7289158 - DNA, 22 bp, Homo sapiens
atagcacaatattacctttatg

SEQ ID NO: 7289159 - DNA, 22 bp, Homo sapiens
atactacaatcataattgtaca

SEQ ID NO: 7289160 - DNA, 22 bp, Homo sapiens
atactacacattgactatattt

SEQ ID NO: 7289161 - DNA, 22 bp, Homo sapiens
atactacactatgcatggatgt

SEQ ID NO: 7289162 - DNA, 22 bp, Homo sapiens
atagcaaactggcagcttgtgg

SEQ ID NO: 7289163 - DNA, 22 bp, Homo sapiens
atacctgtgtatccacaagcgt

SEQ ID NO: 7289164 - DNA, 22 bp, Homo sapiens
ataccatttccatgttacatta

SEQ ID NO: 7289165 - DNA, 22 bp, Homo sapiens
ataccaccatctatgaaaggta

SEQ ID NO: 7289166 - DNA, 22 bp, Homo sapiens
caaatactacgattcttgcagt

SEQ ID NO: 7289167 - DNA, 22 bp, Homo sapiens
caaatactttatatacttcaaa

SEQ ID NO: 7289168 - DNA, 22 bp, Homo sapiens
caaaatgcatctgagaccaggc

SEQ ID NO: 7289169 - DNA, 22 bp, Homo sapiens
caaaattgatgaatgtatgatt

SEQ ID NO: 7289170 - DNA, 22 bp, Homo sapiens
caaaattgttgatgctgctttg

SEQ ID NO: 7289171 - DNA, 22 bp, Homo sapiens
attttgctttatgtaaatatgt

SEQ ID NO: 7289172 - DNA, 22 bp, Homo sapiens
atttttatgacaaaccatcctc

SEQ ID NO: 7289173 - DNA, 22 bp, Homo sapiens
caaaagcagttctatctgagtt

SEQ ID NO: 7289174 - DNA, 22 bp, Homo sapiens
atttttccattctctgttagta

SEQ ID NO: 7289175 - DNA, 22 bp, Homo sapiens
atttggaaatgtaagaatgcaa

SEQ ID NO: 7289176 - DNA, 22 bp, Homo sapiens
atttggaactgggcatgcaaac

SEQ ID NO: 7289177 - DNA, 22 bp, Homo sapiens
atttggaacttataataagttt

SEQ ID NO: 7289178 - DNA, 22 bp, Homo sapiens
gcccccagaagggccacagatt

SEQ ID NO: 7289179 - DNA, 22 bp, Homo sapiens
gcctgagacagtgtggtccaat

SEQ ID NO: 7289180 - DNA, 22 bp, Homo sapiens
gcctgagagtctgcatttctaa

SEQ ID NO: 7289181 - DNA, 22 bp, Homo sapiens
gcctgagagttgaagttcagtg

SEQ ID NO: 7289182 - DNA, 22 bp, Homo sapiens
gcctgagatcagccaagcccct

SEQ ID NO: 7289183 - DNA, 22 bp, Homo sapiens
gcctgagagacccatggggcaa

SEQ ID NO: 7289184 - DNA, 22 bp, Homo sapiens
gcctgagagtctccagaccttg

SEQ ID NO: 7289185 - DNA, 22 bp, Homo sapiens
atttggaatagctgtagaaata

SEQ ID NO: 7289186 - DNA, 22 bp, Homo sapiens
atttggaaggtttacaaagaga

SEQ ID NO: 7289187 - DNA, 22 bp, Homo sapiens
gcctgagattctgcatttctaa

SEQ ID NO: 7289188 - DNA, 22 bp, Homo sapiens
gcctggcaccacagcctttcag

SEQ ID NO: 7289189 - DNA, 22 bp, Homo sapiens
gcctggcaaggccctgttgact

SEQ ID NO: 7289190 - DNA, 23 bp, Homo sapiens
gcccaccctcagcgtcctcacgg

SEQ ID NO: 7289191 - DNA, 22 bp, Homo sapiens
gccaggctggccagcaccttct

SEQ ID NO: 7289192 - DNA, 22 bp, Homo sapiens
attcaactagtgattgtgttat

SEQ ID NO: 7289193 - DNA, 21 bp, Homo sapiens
attcaactagatgattatttc

SEQ ID NO: 7289194 - DNA, 22 bp, Homo sapiens
attcaacttataagatattaat

SEQ ID NO: 7289195 - DNA, 22 bp, Homo sapiens
attcaacttacaaaggagaaga

SEQ ID NO: 7289196 - DNA, 22 bp, Homo sapiens
attcaactgtaaacttgttcac

SEQ ID NO: 7289197 - DNA, 22 bp, Homo sapiens
attcaactatgtatagtcttct

SEQ ID NO: 7289198 - DNA, 22 bp, Homo sapiens
gcacggcaagacggggcctcct

SEQ ID NO: 7289199 - DNA, 22 bp, Homo sapiens
attcacatgatgtatgtagggc

SEQ ID NO: 7289200 - DNA, 22 bp, Homo sapiens
attcacatgtgcttcttatcac

SEQ ID NO: 7289201 - DNA, 22 bp, Homo sapiens
attcacatttagacatcaggta

SEQ ID NO: 7289202 - DNA, 22 bp, Homo sapiens
attcacatttacaaagcactca

SEQ ID NO: 7289203 - DNA, 22 bp, Homo sapiens
gcagcagatgtgggcccagagc

SEQ ID NO: 7289204 - DNA, 22 bp, Homo sapiens
gcagctgctggagggaggcagg

SEQ ID NO: 7289205 - DNA, 22 bp, Homo sapiens
gcagggctgcagagggcactgt

SEQ ID NO: 7289206 - DNA, 22 bp, Homo sapiens
gcagggctgcagagggcactgt

SEQ ID NO: 7289207 - DNA, 18 bp, Homo sapiens
gcagggctgcacacgcat

SEQ ID NO: 7289208 - DNA, 22 bp, Homo sapiens
gcagggctgagtcatgtgtgcc

SEQ ID NO: 7289209 - DNA, 22 bp, Homo sapiens
attgatttagctcaagacacat

SEQ ID NO: 7289210 - DNA, 22 bp, Homo sapiens
atgggaatccaccctttaaaat

SEQ ID NO: 7289211 - DNA, 22 bp, Homo sapiens
atgggagaaacatcatgaggca

SEQ ID NO: 7289212 - DNA, 22 bp, Homo sapiens
atgggctgtccattgctggctg

SEQ ID NO: 7289213 - DNA, 22 bp, Homo sapiens
atggttaaattggttatttatg

SEQ ID NO: 7289214 - DNA, 22 bp, Homo sapiens
gactgggctccaagagggagag

SEQ ID NO: 7289215 - DNA, 22 bp, Homo sapiens
atggaggatgtgcagcatgggc

SEQ ID NO: 7289216 - DNA, 22 bp, Homo sapiens
gaggtggctccaggagcaatgc

SEQ ID NO: 7289217 - DNA, 22 bp, Homo sapiens
gaggtggcactgtgaggagcac

SEQ ID NO: 7289218 - DNA, 22 bp, Homo sapiens
gaggtggcagaggcctggacct

SEQ ID NO: 7289219 - DNA, 22 bp, Homo sapiens
gaggtggcattaagattctggt

SEQ ID NO: 7289220 - DNA, 22 bp, Homo sapiens
gaggtggccaagcgaggaaggg

SEQ ID NO: 7289221 - DNA, 22 bp, Homo sapiens
gaggtggcctcaagcagtcttc

SEQ ID NO: 7289222 - DNA, 22 bp, Homo sapiens
gaggtggcctcaagcagtcttc

SEQ ID NO: 7289223 - DNA, 21 bp, Homo sapiens
gacacaaagggtagtaatggt

SEQ ID NO: 7289224 - DNA, 22 bp, Homo sapiens
gacacaaagtttgtcagaaatt

SEQ ID NO: 7289225 - DNA, 22 bp, Homo sapiens
gaaggctgtggctggtctcagt

SEQ ID NO: 7289226 - DNA, 22 bp, Homo sapiens
gaacaactttgaaacatgaaga

SEQ ID NO: 7289227 - DNA, 22 bp, Homo sapiens
gaataactgctatctttctggc

SEQ ID NO: 7289228 - DNA, 22 bp, Homo sapiens
gaataatagcagaaattagcag

SEQ ID NO: 7289229 - DNA, 22 bp, Homo sapiens
cttctttaatgtatacaaaaga

SEQ ID NO: 7289230 - DNA, 22 bp, Homo sapiens
ctttcaaagaccttggcatggg

SEQ ID NO: 7289231 - DNA, 22 bp, Homo sapiens
ctttcccttagccccattctat

SEQ ID NO: 7289232 - DNA, 22 bp, Homo sapiens
ctttccctgcttagaaggattt

SEQ ID NO: 7289233 - DNA, 22 bp, Homo sapiens
ctttcccttttgccttgcgtgg

SEQ ID NO: 7289234 - DNA, 23 bp, Homo sapiens
gaaagtcaatatggtagctttga

SEQ ID NO: 7289235 - DNA, 19 bp, Homo sapiens
gaaagtcatagagcttgtc

SEQ ID NO: 7289236 - DNA, 22 bp, Homo sapiens
gaaaccacagtacccaggaaaa

SEQ ID NO: 7289237 - DNA, 23 bp, Homo sapiens
cagaaataaactggtttgtagat

SEQ ID NO: 7289238 - DNA, 22 bp, Homo sapiens
cagaaatacccagcatttggag

SEQ ID NO: 7289239 - DNA, 22 bp, Homo sapiens
cagaaagcttggtacaatatgc

SEQ ID NO: 7289240 - DNA, 22 bp, Homo sapiens
ggctggtgttgagtgcctgtag

SEQ ID NO: 7289241 - DNA, 22 bp, Homo sapiens
cagaaaataaacatttgtggaa

SEQ ID NO: 7289242 - DNA, 22 bp, Homo sapiens
cagaaagccaactccaactgtc

SEQ ID NO: 7289243 - DNA, 22 bp, Homo sapiens
cagaaagccgacttacaatgga

SEQ ID NO: 7289244 - DNA, 23 bp, Homo sapiens
cagaaagccctttccccacagta

SEQ ID NO: 7289245 - DNA, 22 bp, Homo sapiens
cagaaagcgggatgcagcatgt

SEQ ID NO: 7289246 - DNA, 22 bp, Homo sapiens
ggcctgtgcaagacagcacccc

SEQ ID NO: 7289247 - DNA, 22 bp, Homo sapiens
ggcctctctccttggcttgcag

SEQ ID NO: 7289248 - DNA, 17 bp, Homo sapiens
ggcctgtgtggctgcag

SEQ ID NO: 7289249 - DNA, 22 bp, Homo sapiens
ggcctgtgtctgtgcctgtcct

SEQ ID NO: 7289250 - DNA, 22 bp, Homo sapiens
ggcctgtgtcggccccgggttc

SEQ ID NO: 7289251 - DNA, 22 bp, Homo sapiens
ggcctgtgtcctccttgccctg

SEQ ID NO: 7289252 - DNA, 22 bp, Homo sapiens
ggcctgtgggaggacagctggg

SEQ ID NO: 7289253 - DNA, 22 bp, Homo sapiens
ggcctgtgctgtcagccctagt

SEQ ID NO: 7289254 - DNA, 22 bp, Homo sapiens
ggcctgtgctgagaacctggct

SEQ ID NO: 7289255 - DNA, 19 bp, Homo sapiens
ggcctgtgcagagcccgtc

SEQ ID NO: 7289256 - DNA, 22 bp, Homo sapiens
ggctccaggtgcatgccaggct

SEQ ID NO: 7289257 - DNA, 22 bp, Homo sapiens
ggctgagcttttcatgatggtt

SEQ ID NO: 7289258 - DNA, 22 bp, Homo sapiens
ggctgagcggactggggtccct

SEQ ID NO: 7289259 - DNA, 22 bp, Homo sapiens
ggctgagccccctctgcgtagg

SEQ ID NO: 7289260 - DNA, 22 bp, Homo sapiens
ggctgagcctggagcatctggt

SEQ ID NO: 7289261 - DNA, 19 bp, Homo sapiens
ggctgagcgccttggctgc

SEQ ID NO: 7289262 - DNA, 22 bp, Homo sapiens
ggcattgatgggagatggtgga

SEQ ID NO: 7289263 - DNA, 22 bp, Homo sapiens
ggcaggtgcacctgagccatct

SEQ ID NO: 7289264 - DNA, 22 bp, Homo sapiens
ggcagggcaggaaagtcaggaa

SEQ ID NO: 7289265 - DNA, 22 bp, Homo sapiens
ggcagggcagcgctgattaggg

SEQ ID NO: 7289266 - DNA, 22 bp, Homo sapiens
ggcagggagtggagactcccta

SEQ ID NO: 7289267 - DNA, 22 bp, Homo sapiens
ggcctctctccctggcttgcag

SEQ ID NO: 7289268 - DNA, 21 bp, Homo sapiens
cacctgtgagactctcagacc

SEQ ID NO: 7289269 - DNA, 22 bp, Homo sapiens
ggccctgttagagctcccacaa

SEQ ID NO: 7289270 - DNA, 22 bp, Homo sapiens
ggccctgtggttttgcaaagtc

SEQ ID NO: 7289271 - DNA, 22 bp, Homo sapiens
ggccctgtcctggctgtctccg

SEQ ID NO: 7289272 - DNA, 22 bp, Homo sapiens
ggaggtggaggttgcagtgagc

SEQ ID NO: 7289273 - DNA, 22 bp, Homo sapiens
ggaggtggaggttgcagtgagc

SEQ ID NO: 7289274 - DNA, 22 bp, Homo sapiens
ggaggtggagctggaagttcca

SEQ ID NO: 7289275 - DNA, 22 bp, Homo sapiens
ggaggtggaggttgcaatgagc

SEQ ID NO: 7289276 - DNA, 22 bp, Homo sapiens
ggaggtggaggttgcaatgagc

SEQ ID NO: 7289277 - DNA, 22 bp, Homo sapiens
ggcaggcatggccactccctag

SEQ ID NO: 7289278 - DNA, 22 bp, Homo sapiens
ggcaggcatggggtctgccatt

SEQ ID NO: 7289279 - DNA, 22 bp, Homo sapiens
gctttgcagacaaaattccagc

SEQ ID NO: 7289280 - DNA, 22 bp, Homo sapiens
gctttcttcatactcaagcatc

SEQ ID NO: 7289281 - DNA, 22 bp, Homo sapiens
gctggctggtccagcaggggct

SEQ ID NO: 7289282 - DNA, 21 bp, Homo sapiens
gctggctgtcccagggaagca

SEQ ID NO: 7289283 - DNA, 22 bp, Homo sapiens
caaggcagcttaatagaatttg

SEQ ID NO: 7289284 - DNA, 22 bp, Homo sapiens
caaggcaggaagcctgtcttat

SEQ ID NO: 7289285 - DNA, 22 bp, Homo sapiens
caagatttaagagtcagccttg

SEQ ID NO: 7289286 - DNA, 22 bp, Homo sapiens
cacaggaatgaacagggaaaga

SEQ ID NO: 7289287 - DNA, 22 bp, Homo sapiens
cacaggaatcagcattaatggc

SEQ ID NO: 7289288 - DNA, 22 bp, Homo sapiens
cacaggaatctgcattttgacc

SEQ ID NO: 7289289 - DNA, 20 bp, Homo sapiens
ggagctggcatccagcctct

SEQ ID NO: 7289290 - DNA, 22 bp, Homo sapiens
ggagctggagagctagcctagg

SEQ ID NO: 7289291 - DNA, 22 bp, Homo sapiens
ggactgggtaggagcccagggc

SEQ ID NO: 7289292 - DNA, 22 bp, Homo sapiens
ggactgggtaggagcccagggc

SEQ ID NO: 7289293 - DNA, 22 bp, Homo sapiens
cacagaataattcacatggctc

SEQ ID NO: 7289294 - DNA, 20 bp, Homo sapiens
ggaaggggcaaagtgtgtga

SEQ ID NO: 7289295 - DNA, 22 bp, Homo sapiens
cagaggcacagtgcgggccact

SEQ ID NO: 7289296 - DNA, 22 bp, Homo sapiens
ggggagcaggctgggctgtctg

SEQ ID NO: 7289297 - DNA, 22 bp, Homo sapiens
ggggagcaatagttgaggtgtg

SEQ ID NO: 7289298 - DNA, 22 bp, Homo sapiens
ggggagcttagggtctctgaat

SEQ ID NO: 7289299 - DNA, 22 bp, Homo sapiens
cagagggtgtgaaggggatgaa

SEQ ID NO: 7289300 - DNA, 23 bp, Homo sapiens
cagagggttccatggagcatggt

SEQ ID NO: 7289301 - DNA, 22 bp, Homo sapiens
cagagggtcaccaggaagtgca

SEQ ID NO: 7289302 - DNA, 22 bp, Homo sapiens
cagagggaaaaggggagtaata

SEQ ID NO: 7289303 - DNA, 21 bp, Homo sapiens
cagagggtttctcaggtgttt

SEQ ID NO: 7289304 - DNA, 22 bp, Homo sapiens
cagcaaatactactagttttta

SEQ ID NO: 7289305 - DNA, 22 bp, Homo sapiens
ggtgacctcacctggtcccacc

SEQ ID NO: 7289306 - DNA, 20 bp, Homo sapiens
cagacctgcacccacttcga

SEQ ID NO: 7289307 - DNA, 22 bp, Homo sapiens
cagacctgggtccctggcctgt

SEQ ID NO: 7289308 - DNA, 22 bp, Homo sapiens
gggcagagactcagaaacagaa

SEQ ID NO: 7289309 - DNA, 22 bp, Homo sapiens
cagactgggctggtggaaagct

SEQ ID NO: 7289310 - DNA, 17 bp, Homo sapiens
ggcttcagggagctggg

SEQ ID NO: 7289311 - DNA, 22 bp, Homo sapiens
ggcttcagaagactggacaggt

SEQ ID NO: 7289312 - DNA, 22 bp, Homo sapiens
ggcttcagaggagaagagggtg

SEQ ID NO: 7289313 - DNA, 22 bp, Homo sapiens
ggcttcaatgtattcacattca

SEQ ID NO: 7289314 - DNA, 22 bp, Homo sapiens
gggcagtgtcgaggtctggtcc

SEQ ID NO: 7289315 - DNA, 22 bp, Homo sapiens
gggcagcattctgtgggcaggt

SEQ ID NO: 7289316 - DNA, 22 bp, Homo sapiens
gggcagtgtctgcaaatgaaca

SEQ ID NO: 7289317 - DNA, 22 bp, Homo sapiens
gggctcttctcaggagctatct

SEQ ID NO: 7289318 - DNA, 22 bp, Homo sapiens
gggctcttttctgagcttcact

SEQ ID NO: 7289319 - DNA, 20 bp, Homo sapiens
gggctcttaggtagcagggg

SEQ ID NO: 7289320 - DNA, 22 bp, Homo sapiens
cagaggcaaaagaggtggaggt

SEQ ID NO: 7289321 - DNA, 22 bp, Homo sapiens
gggctgagtctgctgcctgtca

SEQ ID NO: 7289322 - DNA, 22 bp, Homo sapiens
cagcccctcacagagctgtcct

SEQ ID NO: 7289323 - DNA, 22 bp, Homo sapiens
cagccccttcctggcatctgga

SEQ ID NO: 7289324 - DNA, 22 bp, Homo sapiens
gtccctgggaaaggagagggca

SEQ ID NO: 7289325 - DNA, 22 bp, Homo sapiens
cagccagggagggcaaatgaga

SEQ ID NO: 7289326 - DNA, 22 bp, Homo sapiens
cagccaggcctggtgaccaaag

SEQ ID NO: 7289327 - DNA, 20 bp, Homo sapiens
cagcaggaaaagtgcctcag

SEQ ID NO: 7289328 - DNA, 22 bp, Homo sapiens
gtcatattataaatgttctgtt

SEQ ID NO: 7289329 - DNA, 20 bp, Homo sapiens
cagcaggctatggggcaccc

SEQ ID NO: 7289330 - DNA, 22 bp, Homo sapiens
gtcatggaggattgtgagtggt

SEQ ID NO: 7289331 - DNA, 22 bp, Homo sapiens
cagcaggctctgagtggctgcc

SEQ ID NO: 7289332 - DNA, 22 bp, Homo sapiens
cagcaggctgtggaaatcctgg

SEQ ID NO: 7289333 - DNA, 22 bp, Homo sapiens
gtcccaggcagagtcaggaggg

SEQ ID NO: 7289334 - DNA, 22 bp, Homo sapiens
cagcctgtggcagaggtctaat

SEQ ID NO: 7289335 - DNA, 22 bp, Homo sapiens
cagctagtacaatgggagagca

SEQ ID NO: 7289336 - DNA, 22 bp, Homo sapiens
gtgcccagttgaggccaggact

SEQ ID NO: 7289337 - DNA, 22 bp, Homo sapiens
gtgcccagtgcaggcccgcagg

SEQ ID NO: 7289338 - DNA, 22 bp, Homo sapiens
tagattcagatatttaggacaa

SEQ ID NO: 7289339 - DNA, 22 bp, Homo sapiens
cagggacaaagtgagaaaggaa

SEQ ID NO: 7289340 - DNA, 22 bp, Homo sapiens
caggcttttatgaatttcagtg

SEQ ID NO: 7289341 - DNA, 22 bp, Homo sapiens
caggctggagtgcagtggtgcc

SEQ ID NO: 7289342 - DNA, 22 bp, Homo sapiens
caggctggagtgcagtggtgcc

SEQ ID NO: 7289343 - DNA, 22 bp, Homo sapiens
caggctggagttcagtggtgtg

SEQ ID NO: 7289344 - DNA, 22 bp, Homo sapiens
caggctggagttcagtggtgtg

SEQ ID NO: 7289345 - DNA, 22 bp, Homo sapiens
tagaaaatagggcctgtggagc

SEQ ID NO: 7289346 - DNA, 22 bp, Homo sapiens
caggctgggactgacccctgct

SEQ ID NO: 7289347 - DNA, 22 bp, Homo sapiens
caggctgggaacgccacccgct

SEQ ID NO: 7289348 - DNA, 22 bp, Homo sapiens
caggctggcaatgcgtcaagca

SEQ ID NO: 7289349 - DNA, 22 bp, Homo sapiens
caggcctgcttcttacccttca

SEQ ID NO: 7289350 - DNA, 19 bp, Homo sapiens
tacattgctggtggggatg

SEQ ID NO: 7289351 - DNA, 22 bp, Homo sapiens
caggcccaggccagtggttccc

SEQ ID NO: 7289352 - DNA, 22 bp, Homo sapiens
caggcccactgcttgtctagtc

SEQ ID NO: 7289353 - DNA, 22 bp, Homo sapiens
caggcccaaatgcaaccttctt

SEQ ID NO: 7289354 - DNA, 22 bp, Homo sapiens
taaggcaggaactggctgtttt

SEQ ID NO: 7289355 - DNA, 22 bp, Homo sapiens
taaggcagctgagcttctaaca

SEQ ID NO: 7289356 - DNA, 22 bp, Homo sapiens
cagctattttctcattaaggat

SEQ ID NO: 7289357 - DNA, 22 bp, Homo sapiens
caggcagagttagtgatttagg

SEQ ID NO: 7289358 - DNA, 22 bp, Homo sapiens
caggcagatatgttcgctttaa

SEQ ID NO: 7289359 - DNA, 22 bp, Homo sapiens
caggcagatgctgacaagagtt

SEQ ID NO: 7289360 - DNA, 22 bp, Homo sapiens
caggcagagttagagcaactgg

SEQ ID NO: 7289361 - DNA, 22 bp, Homo sapiens
caggcagagctgaagatagatg

SEQ ID NO: 7289362 - DNA, 22 bp, Homo sapiens
caggcacctcacgtgggtccca

SEQ ID NO: 7289363 - DNA, 22 bp, Homo sapiens
caggcacctgtgtgtctcaggg

SEQ ID NO: 7289364 - DNA, 22 bp, Homo sapiens
caggcagatttgctgccctcca

SEQ ID NO: 7289365 - DNA, 22 bp, Homo sapiens
cagggctcttccggagcaggga

SEQ ID NO: 7289366 - DNA, 22 bp, Homo sapiens
taggctgggctgagctggacgg

SEQ ID NO: 7289367 - DNA, 22 bp, Homo sapiens
taggctgggctgagctggacgg

SEQ ID NO: 7289368 - DNA, 18 bp, Homo sapiens
taggctgggggctgtagt

SEQ ID NO: 7289369 - DNA, 18 bp, Homo sapiens
taggctgggggctgtagt

SEQ ID NO: 7289370 - DNA, 22 bp, Homo sapiens
taggctgggggtaggaattgag

SEQ ID NO: 7289371 - DNA, 22 bp, Homo sapiens
taggctgggcctgccttccagg

SEQ ID NO: 7289372 - DNA, 22 bp, Homo sapiens
taggctgggcctgccttccagg

SEQ ID NO: 7289373 - DNA, 22 bp, Homo sapiens
tagcttcagggaaaccactgct

SEQ ID NO: 7289374 - DNA, 22 bp, Homo sapiens
cagggctccatgcagggactcc

SEQ ID NO: 7289375 - DNA, 22 bp, Homo sapiens
cagggagcaggctctgtccatc

SEQ ID NO: 7289376 - DNA, 22 bp, Homo sapiens
caggtgggtacatcacagagac

SEQ ID NO: 7289377 - DNA, 18 bp, Homo sapiens
caggtgggtctcctgccc

SEQ ID NO: 7289378 - DNA, 22 bp, Homo sapiens
caggtgggtacatcacagagac

SEQ ID NO: 7289379 - DNA, 23 bp, Homo sapiens
caggtggctccacgaggggtggg

SEQ ID NO: 7289380 - DNA, 22 bp, Homo sapiens
caggtggctaacggcctcatag

SEQ ID NO: 7289381 - DNA, 22 bp, Homo sapiens
tattttacatgatccagagttg

SEQ ID NO: 7289382 - DNA, 22 bp, Homo sapiens
tattttacatgacaggtgttta

SEQ ID NO: 7289383 - DNA, 22 bp, Homo sapiens
tattttactatttggcaaagtc

SEQ ID NO: 7289384 - DNA, 22 bp, Homo sapiens
tattttactttaaagcgagaga

SEQ ID NO: 7289385 - DNA, 22 bp, Homo sapiens
tattttacagactactttagat

SEQ ID NO: 7289386 - DNA, 22 bp, Homo sapiens
tattttacaaatgggaatgctg

SEQ ID NO: 7289387 - DNA, 22 bp, Homo sapiens
caggtgggtgtatgaatgcaaa

SEQ ID NO: 7289388 - DNA, 22 bp, Homo sapiens
catctgaagtgaattgcttttt

SEQ ID NO: 7289389 - DNA, 22 bp, Homo sapiens
catgaatgagtaatttacaaag

SEQ ID NO: 7289390 - DNA, 22 bp, Homo sapiens
catgacaatatgttctttcatt

SEQ ID NO: 7289391 - DNA, 22 bp, Homo sapiens
catgacaataagccagcagaaa

SEQ ID NO: 7289392 - DNA, 22 bp, Homo sapiens
catgacaaatcagaggggcttg

SEQ ID NO: 7289393 - DNA, 22 bp, Homo sapiens
catgacaaataaacctttgcca

SEQ ID NO: 7289394 - DNA, 23 bp, Homo sapiens
catgacaaaggatctcatgggcc

SEQ ID NO: 7289395 - DNA, 22 bp, Homo sapiens
catggcagtgattcagcctttg

SEQ ID NO: 7289396 - DNA, 22 bp, Homo sapiens
catggcaggcttcttcagcctt

SEQ ID NO: 7289397 - DNA, 22 bp, Homo sapiens
catggcaggaggctgctggcag

SEQ ID NO: 7289398 - DNA, 22 bp, Homo sapiens
catggcaggaaggacatgcact

SEQ ID NO: 7289399 - DNA, 22 bp, Homo sapiens
catggcagctttgggaggagga

SEQ ID NO: 7289400 - DNA, 22 bp, Homo sapiens
catggcagagcctgcaggtggg

SEQ ID NO: 7289401 - DNA, 22 bp, Homo sapiens
tcaggctgtgggcactggccat

SEQ ID NO: 7289402 - DNA, 17 bp, Homo sapiens
tcaggctgtgcctggta

SEQ ID NO: 7289403 - DNA, 22 bp, Homo sapiens
catagaatcatagcacatttga

SEQ ID NO: 7289404 - DNA, 22 bp, Homo sapiens
tcaggcctcagcagcccacagg

SEQ ID NO: 7289405 - DNA, 22 bp, Homo sapiens
cataatccttgattcaaataat

SEQ ID NO: 7289406 - DNA, 22 bp, Homo sapiens
cataatcctgtcctggattctt

SEQ ID NO: 7289407 - DNA, 22 bp, Homo sapiens
cataatcctggtgtagccctct

SEQ ID NO: 7289408 - DNA, 22 bp, Homo sapiens
cataatcccccatttgtgacat

SEQ ID NO: 7289409 - DNA, 22 bp, Homo sapiens
cataatcccaggcttgcattca

SEQ ID NO: 7289410 - DNA, 22 bp, Homo sapiens
cataatccatttgcactgcaga

SEQ ID NO: 7289411 - DNA, 22 bp, Homo sapiens
tcagcaggtgcctcagattctt

SEQ ID NO: 7289412 - DNA, 22 bp, Homo sapiens
tcagcaggtgaacatcatgcca

SEQ ID NO: 7289413 - DNA, 22 bp, Homo sapiens
tcagcaggtctgaggcggggcc

SEQ ID NO: 7289414 - DNA, 22 bp, Homo sapiens
tcagcagggtttgacttctaat

SEQ ID NO: 7289415 - DNA, 22 bp, Homo sapiens
tcagcaggtggtgggcaggtga

SEQ ID NO: 7289416 - DNA, 22 bp, Homo sapiens
tcagcaggtgctttgtttactc

SEQ ID NO: 7289417 - DNA, 22 bp, Homo sapiens
tcctggcagagagcatgaggcc

SEQ ID NO: 7289418 - DNA, 22 bp, Homo sapiens
tcctggcagcccgcaggtgctg

SEQ ID NO: 7289419 - DNA, 22 bp, Homo sapiens
tcctggcagggtggcagcgggt

SEQ ID NO: 7289420 - DNA, 22 bp, Homo sapiens
tcctggcaggtcagcaggagca

SEQ ID NO: 7289421 - DNA, 22 bp, Homo sapiens
ccactgtaagtttgaaaataac

SEQ ID NO: 7289422 - DNA, 22 bp, Homo sapiens
ccactgtataagcaaaatgaaa

SEQ ID NO: 7289423 - DNA, 22 bp, Homo sapiens
ccactgtgcccagcctcatggg

SEQ ID NO: 7289424 - DNA, 22 bp, Homo sapiens
tcctgggcttcacagactctgt

SEQ ID NO: 7289425 - DNA, 22 bp, Homo sapiens
tccctcctggccgtcaccgctg

SEQ ID NO: 7289426 - DNA, 22 bp, Homo sapiens
catttacaatgtacaggttgtg

SEQ ID NO: 7289427 - DNA, 22 bp, Homo sapiens
catttacacacagaggtgtgct

SEQ ID NO: 7289428 - DNA, 22 bp, Homo sapiens
tccctctctagcctgttcagta

SEQ ID NO: 7289429 - DNA, 22 bp, Homo sapiens
tccctctctagcctgttcagta

SEQ ID NO: 7289430 - DNA, 22 bp, Homo sapiens
tccctctccctattgcctggag

SEQ ID NO: 7289431 - DNA, 22 bp, Homo sapiens
tccctctctggctggggtgcgg

SEQ ID NO: 7289432 - DNA, 22 bp, Homo sapiens
tccctctcttgggcgtggctca

SEQ ID NO: 7289433 - DNA, 22 bp, Homo sapiens
tccctggggtatcgctgaggca

SEQ ID NO: 7289434 - DNA, 22 bp, Homo sapiens
catgggctacagaagcatgctg

SEQ ID NO: 7289435 - DNA, 22 bp, Homo sapiens
tccatttttcatgactcctcaa

SEQ ID NO: 7289436 - DNA, 20 bp, Homo sapiens
tcccaaaattctactttatc

SEQ ID NO: 7289437 - DNA, 22 bp, Homo sapiens
cccttctctttcactcactatt

SEQ ID NO: 7289438 - DNA, 22 bp, Homo sapiens
cccttccttgtgactggtgggg

SEQ ID NO: 7289439 - DNA, 22 bp, Homo sapiens
cccttctgtaaatgctgactgg

SEQ ID NO: 7289440 - DNA, 22 bp, Homo sapiens
cccttcctgggtgtcccggagt

SEQ ID NO: 7289441 - DNA, 22 bp, Homo sapiens
cctagccttcggcctacccatc

SEQ ID NO: 7289442 - DNA, 18 bp, Homo sapiens
cctagcctccaagctcat

SEQ ID NO: 7289443 - DNA, 22 bp, Homo sapiens
tggcagggttggccaccttacc

SEQ ID NO: 7289444 - DNA, 22 bp, Homo sapiens
tggcagggtgggcttcagcccc

SEQ ID NO: 7289445 - DNA, 22 bp, Homo sapiens
tggcctggctgccctgtctgga

SEQ ID NO: 7289446 - DNA, 22 bp, Homo sapiens
tggcccagatctctgaccttga

SEQ ID NO: 7289447 - DNA, 22 bp, Homo sapiens
cctcaggcttacgggcaatgga

SEQ ID NO: 7289448 - DNA, 22 bp, Homo sapiens
cctcaggctctgggtgcctacc

SEQ ID NO: 7289449 - DNA, 22 bp, Homo sapiens
tgggaaggaactgcctttagct

SEQ ID NO: 7289450 - DNA, 18 bp, Homo sapiens
cctctgcctttgtagagc

SEQ ID NO: 7289451 - DNA, 20 bp, Homo sapiens
cctctgccccggggctgcta

SEQ ID NO: 7289452 - DNA, 22 bp, Homo sapiens
tggctggctttcttgtatttac

SEQ ID NO: 7289453 - DNA, 22 bp, Homo sapiens
tggctgggagctggaactgggc

SEQ ID NO: 7289454 - DNA, 22 bp, Homo sapiens
tggctggcttgttcactgactg

SEQ ID NO: 7289455 - DNA, 20 bp, Homo sapiens
tggctggcttgtatttcctt

SEQ ID NO: 7289456 - DNA, 22 bp, Homo sapiens
tggctggctgtcaaggaaagcc

SEQ ID NO: 7289457 - DNA, 22 bp, Homo sapiens
tggctggctgtcagtaggctgt

SEQ ID NO: 7289458 - DNA, 22 bp, Homo sapiens
tggctggctgtccagctgggca

SEQ ID NO: 7289459 - DNA, 22 bp, Homo sapiens
tggctggctgtccagctgggca

SEQ ID NO: 7289460 - DNA, 22 bp, Homo sapiens
tggctggctggaccacacctgc

SEQ ID NO: 7289461 - DNA, 18 bp, Homo sapiens
tggctggctctgtcatct

SEQ ID NO: 7289462 - DNA, 22 bp, Homo sapiens
tggctggctagtgggcaggatt

SEQ ID NO: 7289463 - DNA, 22 bp, Homo sapiens
cctgagagagaagcgacctggt

SEQ ID NO: 7289464 - DNA, 22 bp, Homo sapiens
cctgagcatcagcgcctcctta

SEQ ID NO: 7289465 - DNA, 22 bp, Homo sapiens
tgggctgctgtctgcacatgct

SEQ ID NO: 7289466 - DNA, 22 bp, Homo sapiens
tgggctgctgcggtgctcttgg

SEQ ID NO: 7289467 - DNA, 22 bp, Homo sapiens
tgggctccttgggagcaagtga

SEQ ID NO: 7289468 - DNA, 22 bp, Homo sapiens
tgggctgcggataggcctcgga

SEQ ID NO: 7289469 - DNA, 22 bp, Homo sapiens
tgggccccagcacgtctgggga

SEQ ID NO: 7289470 - DNA, 22 bp, Homo sapiens
tgggctggagcttgttgcttcc

SEQ ID NO: 7289471 - DNA, 22 bp, Homo sapiens
ccccttctgtgtcctgtcagcc

SEQ ID NO: 7289472 - DNA, 22 bp, Homo sapiens
ccccttctctgcaagcctgctc

SEQ ID NO: 7289473 - DNA, 22 bp, Homo sapiens
tgctggctttttgtgtcaaaga

SEQ ID NO: 7289474 - DNA, 22 bp, Homo sapiens
tgctggctttgcgagatgcatt

SEQ ID NO: 7289475 - DNA, 22 bp, Homo sapiens
tgctggctacattattgctgtc

SEQ ID NO: 7289476 - DNA, 19 bp, Homo sapiens
ccctcttgcacaaagcaaa

SEQ ID NO: 7289477 - DNA, 22 bp, Homo sapiens
ccctctcctggctgcatggagc

SEQ ID NO: 7289478 - DNA, 18 bp, Homo sapiens
ccctctcctgctagtggg

SEQ ID NO: 7289479 - DNA, 22 bp, Homo sapiens
ccctctccctgcagaatgtggc

SEQ ID NO: 7289480 - DNA, 22 bp, Homo sapiens
ccctgaccccacggctggagaa

SEQ ID NO: 7289481 - DNA, 20 bp, Homo sapiens
ccctgagacgactgagctcc

SEQ ID NO: 7289482 - DNA, 22 bp, Homo sapiens
ccctgagatgcctcaccctagt

SEQ ID NO: 7289483 - DNA, 18 bp, Homo sapiens
ccctgagatgatgctgtg

SEQ ID NO: 7289484 - DNA, 19 bp, Homo sapiens
tggagcacctaggaataga

SEQ ID NO: 7289485 - DNA, 22 bp, Homo sapiens
ccctctacagggaagcgctttc

SEQ ID NO: 7289486 - DNA, 22 bp, Homo sapiens
ccctcctggaggcggatgccca

SEQ ID NO: 7289487 - DNA, 22 bp, Homo sapiens
tgctgtgctggcggcagaggcc

SEQ ID NO: 7289488 - DNA, 22 bp, Homo sapiens
tgcctgtgtggtctgcgcatta

SEQ ID NO: 7289489 - DNA, 22 bp, Homo sapiens
tgccttcctggagctgaaggct

SEQ ID NO: 7289490 - DNA, 22 bp, Homo sapiens
tgccttcatccatgttatagtg

SEQ ID NO: 7289491 - DNA, 22 bp, Homo sapiens
tgccttagtgactaaagcacac

SEQ ID NO: 7289492 - DNA, 22 bp, Homo sapiens
tgccctggttacactggagtcc

SEQ ID NO: 7289493 - DNA, 21 bp, Homo sapiens
tgccctggggctcttccctca

SEQ ID NO: 7289494 - DNA, 22 bp, Homo sapiens
tgaggagaaatgctcagagcca

SEQ ID NO: 7289495 - DNA, 22 bp, Homo sapiens
tgacaagaagacctggtaatga

SEQ ID NO: 7289496 - DNA, 22 bp, Homo sapiens
tgacaagaaagcgtcttctttt

SEQ ID NO: 7289497 - DNA, 22 bp, Homo sapiens
tgacaagagcattcccacacct

SEQ ID NO: 7289498 - DNA, 22 bp, Homo sapiens
tgacaagagacccctccgcagg

SEQ ID NO: 7289499 - DNA, 22 bp, Homo sapiens
tgacaagaatttgggactgtta

SEQ ID NO: 7289500 - DNA, 22 bp, Homo sapiens
ccaggctggagtgcagtggcac

SEQ ID NO: 7289501 - DNA, 22 bp, Homo sapiens
tgacaagatcacagtcaagtgt

SEQ ID NO: 7289502 - DNA, 22 bp, Homo sapiens
tgacaagatagattgagtttta

SEQ ID NO: 7289503 - DNA, 19 bp, Homo sapiens
tgacaagataatagccttg

SEQ ID NO: 7289504 - DNA, 22 bp, Homo sapiens
tgacaagaggcagaatcagctg

SEQ ID NO: 7289505 - DNA, 22 bp, Homo sapiens
ccagggctttgccaaagtccag

SEQ ID NO: 7289506 - DNA, 19 bp, Homo sapiens
ccagggctttaagttgagg

SEQ ID NO: 7289507 - DNA, 22 bp, Homo sapiens
ccagggcttcagttagtggtga

SEQ ID NO: 7289508 - DNA, 22 bp, Homo sapiens
ccatgccccaatacaggacacc

SEQ ID NO: 7289509 - DNA, 22 bp, Homo sapiens
ccatgccttcctttccctggaa

SEQ ID NO: 7289510 - DNA, 22 bp, Homo sapiens
ccatgcccttgtcatctccagg

SEQ ID NO: 7289511 - DNA, 22 bp, Homo sapiens
tgcaaatagcctgatgaaagaa

SEQ ID NO: 7289512 - DNA, 22 bp, Homo sapiens
ccaggacaggagttggcttcgc

SEQ ID NO: 7289513 - DNA, 22 bp, Homo sapiens
tctggctagattgatgagtccc

SEQ ID NO: 7289514 - DNA, 19 bp, Homo sapiens
tctcagaattaagagtgct

SEQ ID NO: 7289515 - DNA, 22 bp, Homo sapiens
ccaggccccagggctggctttc

SEQ ID NO: 7289516 - DNA, 22 bp, Homo sapiens
ccaggccagtgtttggtccagg

SEQ ID NO: 7289517 - DNA, 22 bp, Homo sapiens
tctttcttcctggagcccaaca

SEQ ID NO: 7289518 - DNA, 22 bp, Homo sapiens
tctttcttcagccctgtaagat

SEQ ID NO: 7289519 - DNA, 22 bp, Homo sapiens
tctttcttggtattctgagcta

SEQ ID NO: 7289520 - DNA, 22 bp, Homo sapiens
tctttcttggtattctgagcta

SEQ ID NO: 7289521 - DNA, 22 bp, Homo sapiens
tctttggctatgatttactgtt

SEQ ID NO: 7289522 - DNA, 22 bp, Homo sapiens
tctttggctgcctgaagcccaa

SEQ ID NO: 7289523 - DNA, 22 bp, Homo sapiens
tctttggctttgccacacccaa

SEQ ID NO: 7289524 - DNA, 22 bp, Homo sapiens
tctttggtgaatggtcatccag

SEQ ID NO: 7289525 - DNA, 22 bp, Homo sapiens
ccaggctggagtgcaatggcgt

SEQ ID NO: 7289526 - DNA, 22 bp, Homo sapiens
tcttccctaatcaccatcttca

SEQ ID NO: 7289527 - DNA, 22 bp, Homo sapiens
ccaggccagcctggagcatggc

SEQ ID NO: 7289528 - DNA, 22 bp, Homo sapiens
ccaggccagcaggcacacctgc

SEQ ID NO: 7289529 - DNA, 22 bp, Homo sapiens
tcttcacattcacgtaacatag

SEQ ID NO: 7289530 - DNA, 22 bp, Homo sapiens
ccaggaggttgaggctgcagtg

SEQ ID NO: 7289531 - DNA, 22 bp, Homo sapiens
ccaggaggttgaggctgcagtg

SEQ ID NO: 7289532 - DNA, 20 bp, Homo sapiens
ctgcaaaatgacattaggaa

SEQ ID NO: 7289533 - DNA, 22 bp, Homo sapiens
ctgcaaaattgttctttgctcc

SEQ ID NO: 7289534 - DNA, 19 bp, Homo sapiens
ctgcagggatgtgcagagt

SEQ ID NO: 7289535 - DNA, 20 bp, Homo sapiens
ctgcactgaacatgtctgag

SEQ ID NO: 7289536 - DNA, 22 bp, Homo sapiens
ctgcactgagcatctaacctta

SEQ ID NO: 7289537 - DNA, 22 bp, Homo sapiens
ctgcactgacttccccggctgc

SEQ ID NO: 7289538 - DNA, 22 bp, Homo sapiens
ctgcaccctcaaactcctgggc

SEQ ID NO: 7289539 - DNA, 22 bp, Homo sapiens
ctctttcctcgatgggctcctg

SEQ ID NO: 7289540 - DNA, 22 bp, Homo sapiens
ctctttggagaagcacgtatta

SEQ ID NO: 7289541 - DNA, 22 bp, Homo sapiens
ctctttggatagaattacaaag

SEQ ID NO: 7289542 - DNA, 22 bp, Homo sapiens
ctctttgcctaactgttttcaa

SEQ ID NO: 7289543 - DNA, 22 bp, Homo sapiens
ctctttggatgtttatgataag

SEQ ID NO: 7289544 - DNA, 22 bp, Homo sapiens
ctgagcctgtgtttctctggca

SEQ ID NO: 7289545 - DNA, 22 bp, Homo sapiens
tttgcctgggaattctagtgta

SEQ ID NO: 7289546 - DNA, 22 bp, Homo sapiens
tttgggaaatattgtgttcaag

SEQ ID NO: 7289547 - DNA, 20 bp, Homo sapiens
tttgggaaatgcaggtttca

SEQ ID NO: 7289548 - DNA, 22 bp, Homo sapiens
tttgggaacaatgaggatctga

SEQ ID NO: 7289549 - DNA, 22 bp, Homo sapiens
tttgggaaatagtagaaaatgt

SEQ ID NO: 7289550 - DNA, 22 bp, Homo sapiens
tttgggaagtttaaaataagta

SEQ ID NO: 7289551 - DNA, 22 bp, Homo sapiens
tttgggaataattgcacagatt

SEQ ID NO: 7289552 - DNA, 22 bp, Homo sapiens
tttgggaattgtagctgtcttg

SEQ ID NO: 7289553 - DNA, 18 bp, Homo sapiens
tttgggatcctcttttct

SEQ ID NO: 7289554 - DNA, 22 bp, Homo sapiens
tttgggattttacattgtatgg

SEQ ID NO: 7289555 - DNA, 22 bp, Homo sapiens
tttgggatgctagacacctcag

SEQ ID NO: 7289556 - DNA, 22 bp, Homo sapiens
tttgggaacttaattatgtctg

SEQ ID NO: 7289557 - DNA, 22 bp, Homo sapiens
tttgggaagaggaatctctgga

SEQ ID NO: 7289558 - DNA, 22 bp, Homo sapiens
tttgggaactggacttcctgct

SEQ ID NO: 7289559 - DNA, 23 bp, Homo sapiens
tttgggaagggagagagtaagca

SEQ ID NO: 7289560 - DNA, 22 bp, Homo sapiens
tttgggaagtgggagcaaggtg

SEQ ID NO: 7289561 - DNA, 22 bp, Homo sapiens
ctctgcccacgtcttgcccaga

SEQ ID NO: 7289562 - DNA, 22 bp, Homo sapiens
ctctgccatcagtttttctttg

SEQ ID NO: 7289563 - DNA, 19 bp, Homo sapiens
ctctgcctccctcctgggt

SEQ ID NO: 7289564 - DNA, 19 bp, Homo sapiens
ctctgcctccctcctgggt

SEQ ID NO: 7289565 - DNA, 22 bp, Homo sapiens
tttgcaaataaataagtgctcg

SEQ ID NO: 7289566 - DNA, 22 bp, Homo sapiens
ctctgcccgtgcctttcccagt

SEQ ID NO: 7289567 - DNA, 22 bp, Homo sapiens
ctctgcccgcggatgccacgtc

SEQ ID NO: 7289568 - DNA, 22 bp, Homo sapiens
ctctttactgctactacaaaga

SEQ ID NO: 7289569 - DNA, 20 bp, Homo sapiens
ctctttacatgtctcttcct

SEQ ID NO: 7289570 - DNA, 19 bp, Homo sapiens
ctctttactcccttgcctt

SEQ ID NO: 7289571 - DNA, 22 bp, Homo sapiens
ctcttcccagctccacgagagg

SEQ ID NO: 7289572 - DNA, 22 bp, Homo sapiens
ctctgttgagcatttttcccct

SEQ ID NO: 7289573 - DNA, 22 bp, Homo sapiens
ctcttagtttgtaaaaataatt

SEQ ID NO: 7289574 - DNA, 22 bp, Homo sapiens
ctcttcaggatggcttgtgatg

SEQ ID NO: 7289575 - DNA, 22 bp, Homo sapiens
ctcttcagtaaatgacactgtt

SEQ ID NO: 7289576 - DNA, 20 bp, Homo sapiens
ctctctctccattcccaggg

SEQ ID NO: 7289577 - DNA, 22 bp, Homo sapiens
tttccttgggtctcttagtggc

SEQ ID NO: 7289578 - DNA, 21 bp, Homo sapiens
ctctctgcttatgaatagtga

SEQ ID NO: 7289579 - DNA, 22 bp, Homo sapiens
ctctccaggagctcagagtcta

SEQ ID NO: 7289580 - DNA, 22 bp, Homo sapiens
ctctccaggcgaggtcctactg

SEQ ID NO: 7289581 - DNA, 22 bp, Homo sapiens
ctctccaggctgggacaggacc

SEQ ID NO: 7289582 - DNA, 22 bp, Homo sapiens
ctctccagtcatattctcagtc

SEQ ID NO: 7289583 - DNA, 22 bp, Homo sapiens
tttcacaaagcatagcacttta

SEQ ID NO: 7289584 - DNA, 23 bp, Homo sapiens
tttcaaattactctgcagatgac

SEQ ID NO: 7289585 - DNA, 22 bp, Homo sapiens
tttcacataaatggagtaaaga

SEQ ID NO: 7289586 - DNA, 22 bp, Homo sapiens
tttcacatacagtgtatagtag

SEQ ID NO: 7289587 - DNA, 22 bp, Homo sapiens
tttaggttttttcacgtggcta

SEQ ID NO: 7289588 - DNA, 22 bp, Homo sapiens
tttatttaaagtcgtgtgttaa

SEQ ID NO: 7289589 - DNA, 22 bp, Homo sapiens
ttgtctttcccagcttctagag

SEQ ID NO: 7289590 - DNA, 22 bp, Homo sapiens
ttgtcttaaatggatggacaat

SEQ ID NO: 7289591 - DNA, 22 bp, Homo sapiens
ctcccactcctggctcaccaca

SEQ ID NO: 7289592 - DNA, 22 bp, Homo sapiens
ctcccactcctggctcaccaca

SEQ ID NO: 7289593 - DNA, 22 bp, Homo sapiens
ctcccaggccatgctctagcca

SEQ ID NO: 7289594 - DNA, 20 bp, Homo sapiens
ctccacacctgttcgcaggc

SEQ ID NO: 7289595 - DNA, 22 bp, Homo sapiens
ctcatttaacagattaaaaagt

SEQ ID NO: 7289596 - DNA, 22 bp, Homo sapiens
tgttcattctgtatatgctgta

SEQ ID NO: 7289597 - DNA, 22 bp, Homo sapiens
tgttcattaaactactgtgtgg

SEQ ID NO: 7289598 - DNA, 22 bp, Homo sapiens
tgttcattagtggaagtaagtt

SEQ ID NO: 7289599 - DNA, 22 bp, Homo sapiens
cctgggcttccacgagcagagg

SEQ ID NO: 7289600 - DNA, 22 bp, Homo sapiens
cctgggcttacgacctctgact

SEQ ID NO: 7289601 - DNA, 22 bp, Homo sapiens
cctgggctgggcgtctcatggg

SEQ ID NO: 7289602 - DNA, 22 bp, Homo sapiens
cctgggctgtacctgtgcgcgg

SEQ ID NO: 7289603 - DNA, 22 bp, Homo sapiens
cctgggctggagtacagcagtg

SEQ ID NO: 7289604 - DNA, 22 bp, Homo sapiens
cctgggctgctcatggggatga

SEQ ID NO: 7289605 - DNA, 22 bp, Homo sapiens
cctgggctctatcctgacccag

SEQ ID NO: 7289606 - DNA, 22 bp, Homo sapiens
cctgggctctgaggagggagtc

SEQ ID NO: 7289607 - DNA, 22 bp, Homo sapiens
cctgggctctgaggagggagtc

SEQ ID NO: 7289608 - DNA, 22 bp, Homo sapiens
cctgggcaaattatgttactca

SEQ ID NO: 7289609 - DNA, 22 bp, Homo sapiens
cctgggcaacatagggagaccc

SEQ ID NO: 7289610 - DNA, 22 bp, Homo sapiens
cctgggcaatatagtgaggccc

SEQ ID NO: 7289611 - DNA, 22 bp, Homo sapiens
tgtgtattaatgtttgtatatg

SEQ ID NO: 7289612 - DNA, 22 bp, Homo sapiens
tgtgtattaccattttacagct

SEQ ID NO: 7289613 - DNA, 23 bp, Homo sapiens
tggggccaagtgaggaagggtct

SEQ ID NO: 7289614 - DNA, 22 bp, Homo sapiens
tggggcttctcctgtaggctca

SEQ ID NO: 7289615 - DNA, 19 bp, Homo sapiens
cctgggagtcagctgaagg

SEQ ID NO: 7289616 - DNA, 22 bp, Homo sapiens
cctgggaggctgaggctgcagt

SEQ ID NO: 7289617 - DNA, 22 bp, Homo sapiens
cctgggagtgtcagacttgctt

SEQ ID NO: 7289618 - DNA, 21 bp, Homo sapiens
ccttctccacagggtctccgg

SEQ ID NO: 7289619 - DNA, 22 bp, Homo sapiens
ttacttttgcaccaaactaata

SEQ ID NO: 7289620 - DNA, 22 bp, Homo sapiens
ccttcctggagcccatgcagat

SEQ ID NO: 7289621 - DNA, 22 bp, Homo sapiens
ccttccctaaagcgtcgcttag

SEQ ID NO: 7289622 - DNA, 22 bp, Homo sapiens
cctgtgtgtctgtcactgcaca

SEQ ID NO: 7289623 - DNA, 22 bp, Homo sapiens
ttaaagtgttaactgaagctta

SEQ ID NO: 7289624 - DNA, 22 bp, Homo sapiens
ttaaatagctcttgtagaagaa

SEQ ID NO: 7289625 - DNA, 22 bp, Homo sapiens
cctgtgtcctaatccatcaggc

SEQ ID NO: 7289626 - DNA, 22 bp, Homo sapiens
cctgtgtcagcccctgcctcca

SEQ ID NO: 7289627 - DNA, 18 bp, Homo sapiens
cctgtgctccagcatctg

SEQ ID NO: 7289628 - DNA, 20 bp, Homo sapiens
cctgtgcttatcacttgctg

SEQ ID NO: 7289629 - DNA, 22 bp, Homo sapiens
cctgtgcttcagctggaggagg

SEQ ID NO: 7289630 - DNA, 22 bp, Homo sapiens
cctgtctgttctgactggtcag

SEQ ID NO: 7289631 - DNA, 18 bp, Homo sapiens
cctgtgacagaggcatca

SEQ ID NO: 7289632 - DNA, 23 bp, Homo sapiens
cctgtgacactgtttgtggtaag

SEQ ID NO: 7289633 - DNA, 22 bp, Homo sapiens
cctgtgacaaacccgcctattc

SEQ ID NO: 7289634 - DNA, 22 bp, Homo sapiens
cctgtctggccaccagggcgat

SEQ ID NO: 7289635 - DNA, 22 bp, Homo sapiens
cctgtctggggactccctgggt

SEQ ID NO: 7289636 - DNA, 22 bp, Homo sapiens
cctgtctgtattggtttgctat

SEQ ID NO: 7289637 - DNA, 22 bp, Homo sapiens
cctgtctggtgagggggttgca

SEQ ID NO: 7289638 - DNA, 22 bp, Homo sapiens
cctgtctggaacatggcctgtt

SEQ ID NO: 7289639 - DNA, 22 bp, Homo sapiens
cctgtctgagccagggtgggca

SEQ ID NO: 7289640 - DNA, 22 bp, Homo sapiens
cctgtctgcaaggggtggatcc

SEQ ID NO: 7289641 - DNA, 20 bp, Homo sapiens
cctgtctgcaatggaggtca

SEQ ID NO: 7289642 - DNA, 17 bp, Homo sapiens
cctttctctttcatctc

SEQ ID NO: 7289643 - DNA, 22 bp, Homo sapiens
cctttctctatcgacccatcgc

SEQ ID NO: 7289644 - DNA, 22 bp, Homo sapiens
cctttcaaaacagaacactagc

SEQ ID NO: 7289645 - DNA, 18 bp, Homo sapiens
cgccctgctataaatgac

SEQ ID NO: 7289646 - DNA, 22 bp, Homo sapiens
ttcacactttggaattccacct

SEQ ID NO: 7289647 - DNA, 22 bp, Homo sapiens
ctaaagcaactgagacacatag

SEQ ID NO: 7289648 - DNA, 22 bp, Homo sapiens
ctagaaaaatactttattgtga

SEQ ID NO: 7289649 - DNA, 22 bp, Homo sapiens
ctactgtaatagatgaatttga

SEQ ID NO: 7289650 - DNA, 22 bp, Homo sapiens
ctactgccattgtctctgccat

SEQ ID NO: 7289651 - DNA, 22 bp, Homo sapiens
ctcaaaatccataaaatcaggt

SEQ ID NO: 7289652 - DNA, 22 bp, Homo sapiens
ctatggctcaattctagtggtt

SEQ ID NO: 7289653 - DNA, 22 bp, Homo sapiens
ctatgtgcagtagtttctttat

SEQ ID NO: 7289654 - DNA, 22 bp, Homo sapiens
ctggcttttttcccattatgca

SEQ ID NO: 7289655 - DNA, 22 bp, Homo sapiens
ctgggaggcggagcttgcagtg

SEQ ID NO: 7289656 - DNA, 22 bp, Homo sapiens
ctgggccacaagcctgtgtgat

SEQ ID NO: 7289657 - DNA, 22 bp, Homo sapiens
ctgggccaagaagttgtgtatg

SEQ ID NO: 7289658 - DNA, 22 bp, Homo sapiens
ctgggcatgaaaaggatgccag

SEQ ID NO: 7289659 - DNA, 22 bp, Homo sapiens
ctgggctctgcagttgatgttt

SEQ ID NO: 7289660 - DNA, 22 bp, Homo sapiens
ctgggccagaccttgtggtctt

SEQ ID NO: 7289661 - DNA, 22 bp, Homo sapiens
ctgggctctgcggtgtcgctct

SEQ ID NO: 7289662 - DNA, 22 bp, Homo sapiens
ctgggctgcaggagtggggcaa

SEQ ID NO: 7289663 - DNA, 22 bp, Homo sapiens
ctgggctgcaggagtggggcaa

SEQ ID NO: 7289664 - DNA, 22 bp, Homo sapiens
ctgggctgcagttcctggtcct

SEQ ID NO: 7289665 - DNA, 23 bp, Homo sapiens
ctgggctgcttgagtccctggct

SEQ ID NO: 7289666 - DNA, 22 bp, Homo sapiens
ctggggctggtgaggcaggctc

SEQ ID NO: 7289667 - DNA, 22 bp, Homo sapiens
ctggggctgcggtggaggagcc

SEQ ID NO: 7289668 - DNA, 22 bp, Homo sapiens
ctggggctcactccagccctgg

SEQ ID NO: 7289669 - DNA, 23 bp, Homo sapiens
ctggggctcattgcagtagccat

SEQ ID NO: 7289670 - DNA, 22 bp, Homo sapiens
ctggggctcactttggtcaggc

SEQ ID NO: 7289671 - DNA, 22 bp, Homo sapiens
ctggggctctctggaatgcttg

SEQ ID NO: 7289672 - DNA, 22 bp, Homo sapiens
ctggctgcaggaaggagtgggc

SEQ ID NO: 7289673 - DNA, 20 bp, Homo sapiens
ctggctggaaacttagcctt

SEQ ID NO: 7289674 - DNA, 22 bp, Homo sapiens
ctggctggagctgttgtaggct

SEQ ID NO: 7289675 - DNA, 19 bp, Homo sapiens
ctggccaggccaggggccc

SEQ ID NO: 7289676 - DNA, 22 bp, Homo sapiens
ctggccctcggagtccagctgc

SEQ ID NO: 7289677 - DNA, 22 bp, Homo sapiens
ctggccagagttggagggtgtg

SEQ ID NO: 7289678 - DNA, 22 bp, Homo sapiens
ctggccagatgttacgtccaat

SEQ ID NO: 7289679 - DNA, 22 bp, Homo sapiens
ctggccagctgacagcagggct

SEQ ID NO: 7289680 - DNA, 22 bp, Homo sapiens
ctggcaggctctctggtcggtt

SEQ ID NO: 7289681 - DNA, 22 bp, Homo sapiens
ctggcaggcggaggttgcagtg

SEQ ID NO: 7289682 - DNA, 22 bp, Homo sapiens
ctggcaggatctaaccagggaa

SEQ ID NO: 7289683 - DNA, 20 bp, Homo sapiens
ctggcaggagcgagtctacc

SEQ ID NO: 7289684 - DNA, 22 bp, Homo sapiens
ctggcaggaagaggaaaggtca

SEQ ID NO: 7289685 - DNA, 22 bp, Homo sapiens
ctggcaggaaggcatttagaca

SEQ ID NO: 7289686 - DNA, 22 bp, Homo sapiens
cttcagggtgacgcaggctgca

SEQ ID NO: 7289687 - DNA, 19 bp, Homo sapiens
cttcagggaggggccaggc

SEQ ID NO: 7289688 - DNA, 22 bp, Homo sapiens
cttcagggaggagcatgggttc

SEQ ID NO: 7289689 - DNA, 22 bp, Homo sapiens
cttcagtatcctccacatgtta

SEQ ID NO: 7289690 - DNA, 22 bp, Homo sapiens
cttcagtgttcccatctgtaaa

SEQ ID NO: 7289691 - DNA, 22 bp, Homo sapiens
cttcagaactataaaaagtact

SEQ ID NO: 7289692 - DNA, 21 bp, Homo sapiens
cttgtcttgcttagaatagac

SEQ ID NO: 7289693 - DNA, 22 bp, Homo sapiens
cttgggtataaaacttggctat

SEQ ID NO: 7289694 - DNA, 22 bp, Homo sapiens
cttgccatctaaccagactgcc

SEQ ID NO: 7289695 - DNA, 22 bp, Homo sapiens
ctgttcttctagtccactgaca

SEQ ID NO: 7289696 - DNA, 22 bp, Homo sapiens
ctgtggctctcagaggctgctg

SEQ ID NO: 7289697 - DNA, 22 bp, Homo sapiens
ctgtggctctctgcagggtccc

SEQ ID NO: 7289698 - DNA, 22 bp, Homo sapiens
ctgtggctgcagccttggtcct

SEQ ID NO: 7289699 - DNA, 19 bp, Homo sapiens
ctgtggctgacctctggcc

SEQ ID NO: 7289700 - DNA, 22 bp, Homo sapiens
ctgtggctgtatttggccagag

SEQ ID NO: 7289701 - DNA, 22 bp, Homo sapiens
ctgtgtagcctcatgtgggctt

SEQ ID NO: 7289702 - DNA, 22 bp, Homo sapiens
ctgtgtcctgcgtcaagccaat

SEQ ID NO: 7289703 - DNA, 22 bp, Homo sapiens
ctgtgtcctgtctcctaaggtg

SEQ ID NO: 7289704 - DNA, 22 bp, Homo sapiens
ctgtgcccataatctggtattt

SEQ ID NO: 7289705 - DNA, 23 bp, Homo sapiens
ctgtgcccggggctccacctgat

SEQ ID NO: 7289706 - DNA, 22 bp, Homo sapiens
ctgtgcccagctccctgactgc

SEQ ID NO: 7289707 - DNA, 22 bp, Homo sapiens
ctgtgcccacctggctctgagg

SEQ ID NO: 7289708 - DNA, 22 bp, Homo sapiens
ctgtcctgtggacctgaggacg

SEQ ID NO: 7289709 - DNA, 22 bp, Homo sapiens
ctgtcctgcccaccctgcaggg

SEQ ID NO: 7289710 - DNA, 22 bp, Homo sapiens
ctgtcctgccagtcctggactc

SEQ ID NO: 7289711 - DNA, 22 bp, Homo sapiens
ctgtcctgggggtggtccttgc

SEQ ID NO: 7289712 - DNA, 22 bp, Homo sapiens
ctgtcctggccgcccttgtgag

SEQ ID NO: 7289713 - DNA, 19 bp, Homo sapiens
ctgtcctggtttggtccct

SEQ ID NO: 7289714 - DNA, 22 bp, Homo sapiens
gaagcctcaacatctctgcgtc

SEQ ID NO: 7289715 - DNA, 22 bp, Homo sapiens
gaatacatctgaaggctatgaa

SEQ ID NO: 7289716 - DNA, 19 bp, Homo sapiens
gaatacagataataagcag

SEQ ID NO: 7289717 - DNA, 23 bp, Homo sapiens
gaatacagagataaatagaacac

SEQ ID NO: 7289718 - DNA, 22 bp, Homo sapiens
gaagttttctgaggctgtagct

SEQ ID NO: 7289719 - DNA, 22 bp, Homo sapiens
gaagttttagtcaaaatgtaga

SEQ ID NO: 7289720 - DNA, 22 bp, Homo sapiens
gaatacatggcagggagtcatc

SEQ ID NO: 7289721 - DNA, 22 bp, Homo sapiens
gaatacatgtgtgtatagaggt

SEQ ID NO: 7289722 - DNA, 22 bp, Homo sapiens
gacaagattaaccatagttaag

SEQ ID NO: 7289723 - DNA, 22 bp, Homo sapiens
gacaagatgagcagctcagtgt

SEQ ID NO: 7289724 - DNA, 22 bp, Homo sapiens
gacaagatgacatcatggcttc

SEQ ID NO: 7289725 - DNA, 22 bp, Homo sapiens
gacaagataatgaagtgcaatt

SEQ ID NO: 7289726 - DNA, 22 bp, Homo sapiens
gacaagatttagagtctgctaa

SEQ ID NO: 7289727 - DNA, 22 bp, Homo sapiens
gacccatatatacgtaatttgt

SEQ ID NO: 7289728 - DNA, 22 bp, Homo sapiens
gacccatataggaccctccaaa

SEQ ID NO: 7289729 - DNA, 22 bp, Homo sapiens
gacccataggaatctgttgtcc

SEQ ID NO: 7289730 - DNA, 22 bp, Homo sapiens
gacagggctgtgggaggagcag

SEQ ID NO: 7289731 - DNA, 22 bp, Homo sapiens
gaagatttaagcacaatagtct

SEQ ID NO: 7289732 - DNA, 22 bp, Homo sapiens
gaagacagaaacctgtttggct

SEQ ID NO: 7289733 - DNA, 22 bp, Homo sapiens
gagccaggtcgggccgcggcga

SEQ ID NO: 7289734 - DNA, 22 bp, Homo sapiens
gagccaggggtcagctccgagg

SEQ ID NO: 7289735 - DNA, 22 bp, Homo sapiens
gagatgatcgtacttgcaagaa

SEQ ID NO: 7289736 - DNA, 22 bp, Homo sapiens
gagatgatatacaggcttttgg

SEQ ID NO: 7289737 - DNA, 22 bp, Homo sapiens
gagaggcttaagggctgtgaag

SEQ ID NO: 7289738 - DNA, 22 bp, Homo sapiens
gagacacaaacacatttagagg

SEQ ID NO: 7289739 - DNA, 22 bp, Homo sapiens
gagacacaaacatttattccac

SEQ ID NO: 7289740 - DNA, 22 bp, Homo sapiens
gacctctcaggaatctcacatg

SEQ ID NO: 7289741 - DNA, 22 bp, Homo sapiens
gacctccagcggccctgcagag

SEQ ID NO: 7289742 - DNA, 22 bp, Homo sapiens
gagctcagactcgggcctgggg

SEQ ID NO: 7289743 - DNA, 22 bp, Homo sapiens
gaggcagaagttgcagtgagca

SEQ ID NO: 7289744 - DNA, 22 bp, Homo sapiens
gaggcagagaccttcaggacct

SEQ ID NO: 7289745 - DNA, 22 bp, Homo sapiens
gaggcagagactccaccttcag

SEQ ID NO: 7289746 - DNA, 22 bp, Homo sapiens
gaggcagaggttgcagtgagct

SEQ ID NO: 7289747 - DNA, 22 bp, Homo sapiens
gaggcagaggaaggtggtctct

SEQ ID NO: 7289748 - DNA, 22 bp, Homo sapiens
gaggaggcactagttagtgaca

SEQ ID NO: 7289749 - DNA, 22 bp, Homo sapiens
gaggaggccagtggaaggaagc

SEQ ID NO: 7289750 - DNA, 22 bp, Homo sapiens
gaggaaaataacaactaagggc

SEQ ID NO: 7289751 - DNA, 22 bp, Homo sapiens
gaggaaaatattcagggaggtt

SEQ ID NO: 7289752 - DNA, 22 bp, Homo sapiens
gggaggaaagagaagtggtcca

SEQ ID NO: 7289753 - DNA, 22 bp, Homo sapiens
gggaggagctgagtgtgtgtgc

SEQ ID NO: 7289754 - DNA, 22 bp, Homo sapiens
gggaggagcttggagattcact

SEQ ID NO: 7289755 - DNA, 22 bp, Homo sapiens
gggcaagaagctggaagcattc

SEQ ID NO: 7289756 - DNA, 22 bp, Homo sapiens
gggcaagcagtgaggacagcac

SEQ ID NO: 7289757 - DNA, 22 bp, Homo sapiens
gggcagctctggctgtgggaag

SEQ ID NO: 7289758 - DNA, 23 bp, Homo sapiens
gggcatggagtgtaggtggaagg

SEQ ID NO: 7289759 - DNA, 18 bp, Homo sapiens
gggcatggatgcagcatc

SEQ ID NO: 7289760 - DNA, 22 bp, Homo sapiens
gggcaggagaaggtggatgtcc

SEQ ID NO: 7289761 - DNA, 16 bp, Homo sapiens
gggcaggaatcagggt

SEQ ID NO: 7289762 - DNA, 22 bp, Homo sapiens
gggagctgtaagggacaggtag

SEQ ID NO: 7289763 - DNA, 22 bp, Homo sapiens
gggagagaattattgccagacc

SEQ ID NO: 7289764 - DNA, 22 bp, Homo sapiens
gggagaagtggaaatctcatta

SEQ ID NO: 7289765 - DNA, 22 bp, Homo sapiens
gggacaggctgagacttgagct

SEQ ID NO: 7289766 - DNA, 22 bp, Homo sapiens
ggctcttgggagctcagagttg

SEQ ID NO: 7289767 - DNA, 22 bp, Homo sapiens
ggctgagaacaggcccagcctc

SEQ ID NO: 7289768 - DNA, 22 bp, Homo sapiens
ggctctggcaaggggaggctac

SEQ ID NO: 7289769 - DNA, 19 bp, Homo sapiens
ggctctggcggctgtagcc

SEQ ID NO: 7289770 - DNA, 22 bp, Homo sapiens
ggctccagatgtcccctggcaa

SEQ ID NO: 7289771 - DNA, 22 bp, Homo sapiens
ggctccagaggccttacctgca

SEQ ID NO: 7289772 - DNA, 22 bp, Homo sapiens
ggctccaggaacctcctctcct

SEQ ID NO: 7289773 - DNA, 22 bp, Homo sapiens
ggctctgctggattgaggccag

SEQ ID NO: 7289774 - DNA, 22 bp, Homo sapiens
ggctctggagacatgtggagag

SEQ ID NO: 7289775 - DNA, 22 bp, Homo sapiens
ggctgctgggaatatgccagct

SEQ ID NO: 7289776 - DNA, 22 bp, Homo sapiens
ggctgggcaaacaagactcttc

SEQ ID NO: 7289777 - DNA, 22 bp, Homo sapiens
ggctgggcaggtctgcacaggg

SEQ ID NO: 7289778 - DNA, 22 bp, Homo sapiens
ggctgggccagggcctgtggac

SEQ ID NO: 7289779 - DNA, 22 bp, Homo sapiens
ggctgggccgcggctacccaga

SEQ ID NO: 7289780 - DNA, 22 bp, Homo sapiens
ggctgggcctctccctcagctg

SEQ ID NO: 7289781 - DNA, 22 bp, Homo sapiens
ggctgggctccgggagcatgcg

SEQ ID NO: 7289782 - DNA, 22 bp, Homo sapiens
ggctgggctccgggagcatgcg

SEQ ID NO: 7289783 - DNA, 22 bp, Homo sapiens
ggctgggctgcggctgtacctg

SEQ ID NO: 7289784 - DNA, 21 bp, Homo sapiens
ggcctcagccacctggctctg

SEQ ID NO: 7289785 - DNA, 18 bp, Homo sapiens
ggcatgtgagtgctgagg

SEQ ID NO: 7289786 - DNA, 22 bp, Homo sapiens
ggcatgtgcctgaggtcacaca

SEQ ID NO: 7289787 - DNA, 21 bp, Homo sapiens
ggccagtggccttgactttcc

SEQ ID NO: 7289788 - DNA, 22 bp, Homo sapiens
ggccagtggctctgtgcttggg

SEQ ID NO: 7289789 - DNA, 22 bp, Homo sapiens
ggcaggtgtgagatcgaggcca

SEQ ID NO: 7289790 - DNA, 22 bp, Homo sapiens
ggcaggtggtaaggatttcata

SEQ ID NO: 7289791 - DNA, 22 bp, Homo sapiens
ggcaggtggaagttggcagagc

SEQ ID NO: 7289792 - DNA, 22 bp, Homo sapiens
ggcaggcagatggctgcaccaa

SEQ ID NO: 7289793 - DNA, 22 bp, Homo sapiens
ggcaggtggcactgctgctccc

SEQ ID NO: 7289794 - DNA, 22 bp, Homo sapiens
ggcagtctagtgtccttgggcc

SEQ ID NO: 7289795 - DNA, 19 bp, Homo sapiens
ggcagtctcaagcagcaca

SEQ ID NO: 7289796 - DNA, 22 bp, Homo sapiens
ggcagtcttatcagcattggac

SEQ ID NO: 7289797 - DNA, 22 bp, Homo sapiens
ggcagtctttcccttgagctct

SEQ ID NO: 7289798 - DNA, 22 bp, Homo sapiens
ggcatgggccgaggtgcctcct

SEQ ID NO: 7289799 - DNA, 22 bp, Homo sapiens
ggcatggggtgtatgtggcacg

SEQ ID NO: 7289800 - DNA, 22 bp, Homo sapiens
ggcaggagggcggacaatgacc

SEQ ID NO: 7289801 - DNA, 22 bp, Homo sapiens
ggcagaggtagctggaaccagg

SEQ ID NO: 7289802 - DNA, 22 bp, Homo sapiens
ggcaggcaagtctgctctgtga

SEQ ID NO: 7289803 - DNA, 22 bp, Homo sapiens
ggcaggcaaggcagcctggtga

SEQ ID NO: 7289804 - DNA, 22 bp, Homo sapiens
ggcaggcactgtgttttgtgtt

SEQ ID NO: 7289805 - DNA, 22 bp, Homo sapiens
ggcagaggaggggtgaatttgc

SEQ ID NO: 7289806 - DNA, 20 bp, Homo sapiens
ggcagagggcctgggagaag

SEQ ID NO: 7289807 - DNA, 20 bp, Homo sapiens
ggcagagggcctgggagaag

SEQ ID NO: 7289808 - DNA, 22 bp, Homo sapiens
ggagccagaggctgctgctgtg

SEQ ID NO: 7289809 - DNA, 22 bp, Homo sapiens
ggagccagagtctgcagtgtaa

SEQ ID NO: 7289810 - DNA, 22 bp, Homo sapiens
ggagccagcagggtgacactga

SEQ ID NO: 7289811 - DNA, 22 bp, Homo sapiens
ggagtcagcctgtcagagtgta

SEQ ID NO: 7289812 - DNA, 20 bp, Homo sapiens
ggcaagcaactgagggagga

SEQ ID NO: 7289813 - DNA, 22 bp, Homo sapiens
ggagtgagtactggagtagctg

SEQ ID NO: 7289814 - DNA, 22 bp, Homo sapiens
ggtctcagactggcaggcagtg

SEQ ID NO: 7289815 - DNA, 22 bp, Homo sapiens
ggtccctggggaactaggctgt

SEQ ID NO: 7289816 - DNA, 22 bp, Homo sapiens
ggtccctggttccctctgagct

SEQ ID NO: 7289817 - DNA, 22 bp, Homo sapiens
gggtggcatagggtgatggctt

SEQ ID NO: 7289818 - DNA, 19 bp, Homo sapiens
ggtggctctccctcaggga

SEQ ID NO: 7289819 - DNA, 22 bp, Homo sapiens
ggtggctcggccagtgcaggcc

SEQ ID NO: 7289820 - DNA, 22 bp, Homo sapiens
ggtggctctctgtcagtgacag

SEQ ID NO: 7289821 - DNA, 22 bp, Homo sapiens
ggtggccttttatgagcagggt

SEQ ID NO: 7289822 - DNA, 21 bp, Homo sapiens
ggtggccttggtgagagacct

SEQ ID NO: 7289823 - DNA, 22 bp, Homo sapiens
ggtggcctccagggcataggtg

SEQ ID NO: 7289824 - DNA, 22 bp, Homo sapiens
ggtggctcaaagagagcacaga

SEQ ID NO: 7289825 - DNA, 22 bp, Homo sapiens
ggtggctcagtgtcaggccctg

SEQ ID NO: 7289826 - DNA, 22 bp, Homo sapiens
gggctgagtgtcccaggccgaa

SEQ ID NO: 7289827 - DNA, 22 bp, Homo sapiens
gggctgagctaagctgggttga

SEQ ID NO: 7289828 - DNA, 22 bp, Homo sapiens
gggctgagagtgactgttctgt

SEQ ID NO: 7289829 - DNA, 22 bp, Homo sapiens
gggctgagattggtgccctgtc

SEQ ID NO: 7289830 - DNA, 22 bp, Homo sapiens
gggcatggccaggtgaggggtc

SEQ ID NO: 7289831 - DNA, 22 bp, Homo sapiens
gggcatggtggcaggcacctgt

SEQ ID NO: 7289832 - DNA, 22 bp, Homo sapiens
gggtggaggagaacaggcccca

SEQ ID NO: 7289833 - DNA, 22 bp, Homo sapiens
gggctttatgagattgagatct

SEQ ID NO: 7289834 - DNA, 22 bp, Homo sapiens
ggggaaggatatgattagacta

SEQ ID NO: 7289835 - DNA, 22 bp, Homo sapiens
ggggaaggaaagttattagcag

SEQ ID NO: 7289836 - DNA, 22 bp, Homo sapiens
ggggctctgctctgagccgtgt

SEQ ID NO: 7289837 - DNA, 22 bp, Homo sapiens
ggggctctcaggtctccccaaa

SEQ ID NO: 7289838 - DNA, 22 bp, Homo sapiens
gtccctgccctcctgggactca

SEQ ID NO: 7289839 - DNA, 22 bp, Homo sapiens
gtccctgcatcaccacgggact

SEQ ID NO: 7289840 - DNA, 22 bp, Homo sapiens
gtcccctggtggctggagctgc

SEQ ID NO: 7289841 - DNA, 22 bp, Homo sapiens
gtacatttcatttaaatgatgt

SEQ ID NO: 7289842 - DNA, 22 bp, Homo sapiens
gtgcagttgaagcatggggaga

SEQ ID NO: 7289843 - DNA, 22 bp, Homo sapiens
gtgcagggtcctaattgttaag

SEQ ID NO: 7289844 - DNA, 22 bp, Homo sapiens
gtgcagtgaccctggagagctg

SEQ ID NO: 7289845 - DNA, 22 bp, Homo sapiens
gtgcagaggacgtggcggcctc

SEQ ID NO: 7289846 - DNA, 21 bp, Homo sapiens
gtgcagaggaatgtagggggc

SEQ ID NO: 7289847 - DNA, 22 bp, Homo sapiens
gtgcagagcaagggctgagggc

SEQ ID NO: 7289848 - DNA, 22 bp, Homo sapiens
gtgcagatcctgattgcagttc

SEQ ID NO: 7289849 - DNA, 22 bp, Homo sapiens
gtgcagagtgtctgtggactga

SEQ ID NO: 7289850 - DNA, 22 bp, Homo sapiens
gtgcagagaaggagcagtagtt

SEQ ID NO: 7289851 - DNA, 22 bp, Homo sapiens
gtgacccatgcagtggttttgg

SEQ ID NO: 7289852 - DNA, 22 bp, Homo sapiens
gtctgctgcagagcatggcttt

SEQ ID NO: 7289853 - DNA, 22 bp, Homo sapiens
gtgacccaggtaggtaagcaat

SEQ ID NO: 7289854 - DNA, 22 bp, Homo sapiens
gtgacccaggacactgtgtatc

SEQ ID NO: 7289855 - DNA, 22 bp, Homo sapiens
gtgacccagaggctgactaaca

SEQ ID NO: 7289856 - DNA, 23 bp, Homo sapiens
gtgacccaaggaccttccagaat

SEQ ID NO: 7289857 - DNA, 22 bp, Homo sapiens
gcaaagcatcagtagaaatgtt

SEQ ID NO: 7289858 - DNA, 22 bp, Homo sapiens
gcaaagcaatcaggagtagcat

SEQ ID NO: 7289859 - DNA, 22 bp, Homo sapiens
gcaaatacatgttgagcaccta

SEQ ID NO: 7289860 - DNA, 22 bp, Homo sapiens
gcaaagtaaagggttccagata

SEQ ID NO: 7289861 - DNA, 22 bp, Homo sapiens
gcacagggctgccaggcggctt

SEQ ID NO: 7289862 - DNA, 22 bp, Homo sapiens
gcagaggtcctagccaggagtc

SEQ ID NO: 7289863 - DNA, 22 bp, Homo sapiens
gcagagtggtttcagagttgag

SEQ ID NO: 7289864 - DNA, 22 bp, Homo sapiens
gcagatggagataaatggaact

SEQ ID NO: 7289865 - DNA, 22 bp, Homo sapiens
gcagaggatagcatatgaacct

SEQ ID NO: 7289866 - DNA, 22 bp, Homo sapiens
gcagaggatcaggctctggaaa

SEQ ID NO: 7289867 - DNA, 22 bp, Homo sapiens
gcagactgtacctggaagaggg

SEQ ID NO: 7289868 - DNA, 22 bp, Homo sapiens
gcagactgcgagcgtgctggtg

SEQ ID NO: 7289869 - DNA, 22 bp, Homo sapiens
gcagggaagatcttggagctgc

SEQ ID NO: 7289870 - DNA, 22 bp, Homo sapiens
gcaggcagttatttagtagaat

SEQ ID NO: 7289871 - DNA, 19 bp, Homo sapiens
gcaggcagtggcattcgga

SEQ ID NO: 7289872 - DNA, 22 bp, Homo sapiens
gcaggcagccacgattcccttg

SEQ ID NO: 7289873 - DNA, 19 bp, Homo sapiens
gcaggcagctggggtatcc

SEQ ID NO: 7289874 - DNA, 22 bp, Homo sapiens
gcagggcttagaaatggtggct

SEQ ID NO: 7289875 - DNA, 22 bp, Homo sapiens
gcagggcttgcagcagctagac

SEQ ID NO: 7289876 - DNA, 22 bp, Homo sapiens
gcagggctgttcaggagggtgg

SEQ ID NO: 7289877 - DNA, 22 bp, Homo sapiens
gcagggctgtggacactttggt

SEQ ID NO: 7289878 - DNA, 22 bp, Homo sapiens
gcagggctgtggacactttggt

SEQ ID NO: 7289879 - DNA, 22 bp, Homo sapiens
gcagggctgggtgggagacaga

SEQ ID NO: 7289880 - DNA, 22 bp, Homo sapiens
gcagggctgggtgggagacaga

SEQ ID NO: 7289881 - DNA, 22 bp, Homo sapiens
gcagggaccaaaagaggcagta

SEQ ID NO: 7289882 - DNA, 22 bp, Homo sapiens
gcagatggatcacctgaggtcg

SEQ ID NO: 7289883 - DNA, 22 bp, Homo sapiens
gcagatggcagcccaggctggg

SEQ ID NO: 7289884 - DNA, 23 bp, Homo sapiens
gcagatggccccagagtgctgcc

SEQ ID NO: 7289885 - DNA, 22 bp, Homo sapiens
gcagatggcgcagtggaagttc

SEQ ID NO: 7289886 - DNA, 22 bp, Homo sapiens
gcagatggctcagacactgggg

SEQ ID NO: 7289887 - DNA, 22 bp, Homo sapiens
gcagatggtgccatgtcttgtg

SEQ ID NO: 7289888 - DNA, 21 bp, Homo sapiens
gcagatgggagtcatcaggct

SEQ ID NO: 7289889 - DNA, 22 bp, Homo sapiens
gcagatggtgggggaggagtac

SEQ ID NO: 7289890 - DNA, 22 bp, Homo sapiens
gcagatggtggaggcaagaggc

SEQ ID NO: 7289891 - DNA, 22 bp, Homo sapiens
gcagatgggagccccaggggag

SEQ ID NO: 7289892 - DNA, 22 bp, Homo sapiens
gcagatggctgagcctgcagat

SEQ ID NO: 7289893 - DNA, 22 bp, Homo sapiens
gcagatgtaatggctggaggtc

SEQ ID NO: 7289894 - DNA, 22 bp, Homo sapiens
gcccagcctccaagctccaagg

SEQ ID NO: 7289895 - DNA, 22 bp, Homo sapiens
gcccagcactcctctctgacat

SEQ ID NO: 7289896 - DNA, 22 bp, Homo sapiens
gcccagcactcctctctgacat

SEQ ID NO: 7289897 - DNA, 18 bp, Homo sapiens
gcccatggtaaatgctgt

SEQ ID NO: 7289898 - DNA, 22 bp, Homo sapiens
gcccatggtcagggaggcaggg

SEQ ID NO: 7289899 - DNA, 22 bp, Homo sapiens
gcccatgggctccagacctggg

SEQ ID NO: 7289900 - DNA, 22 bp, Homo sapiens
gcccatggcttccctaggcaca

SEQ ID NO: 7289901 - DNA, 22 bp, Homo sapiens
gcccatggtggcgttcggtgca

SEQ ID NO: 7289902 - DNA, 22 bp, Homo sapiens
gcccatggttacttttctggct

SEQ ID NO: 7289903 - DNA, 22 bp, Homo sapiens
gccccacctgctaccttccagc

SEQ ID NO: 7289904 - DNA, 22 bp, Homo sapiens
gcccaggaagtgactcagatgt

SEQ ID NO: 7289905 - DNA, 22 bp, Homo sapiens
gcctcctggaagtcacatgttt

SEQ ID NO: 7289906 - DNA, 22 bp, Homo sapiens
gcctcctggggtgccatcatct

SEQ ID NO: 7289907 - DNA, 22 bp, Homo sapiens
gccaggcagatatgtgagctta

SEQ ID NO: 7289908 - DNA, 22 bp, Homo sapiens
gccaggcagccaccctctgcga

SEQ ID NO: 7289909 - DNA, 22 bp, Homo sapiens
gccaggcatgtcctctgcagaa

SEQ ID NO: 7289910 - DNA, 21 bp, Homo sapiens
gccacccctggcacaggtgct

SEQ ID NO: 7289911 - DNA, 22 bp, Homo sapiens
gccagctgaatttccaactgtt

SEQ ID NO: 7289912 - DNA, 22 bp, Homo sapiens
gcaggggagtggatgatggatt

SEQ ID NO: 7289913 - DNA, 22 bp, Homo sapiens
gcaggggagtccactctatgca

SEQ ID NO: 7289914 - DNA, 22 bp, Homo sapiens
gcaggggagtggcaggcccgga

SEQ ID NO: 7289915 - DNA, 22 bp, Homo sapiens
gcagtggccacatggaggagga

SEQ ID NO: 7289916 - DNA, 22 bp, Homo sapiens
gcagtgggagcttaggcagtgc

SEQ ID NO: 7289917 - DNA, 22 bp, Homo sapiens
gctgagagaaaagtgaggttct

SEQ ID NO: 7289918 - DNA, 22 bp, Homo sapiens
gctgagagatcaaggcaggatt

SEQ ID NO: 7289919 - DNA, 22 bp, Homo sapiens
gctgagagcacatagaaggggc

SEQ ID NO: 7289920 - DNA, 22 bp, Homo sapiens
gctgagagcaaagcatgtctag

SEQ ID NO: 7289921 - DNA, 22 bp, Homo sapiens
gctgagagcggccagctgggaa

SEQ ID NO: 7289922 - DNA, 22 bp, Homo sapiens
gctgagagcagtgtggccttaa

SEQ ID NO: 7289923 - DNA, 17 bp, Homo sapiens
gctgagaggcagcacag

SEQ ID NO: 7289924 - DNA, 22 bp, Homo sapiens
gctgagaggcagccagaccctc

SEQ ID NO: 7289925 - DNA, 22 bp, Homo sapiens
gctgagagtgagcactggatat

SEQ ID NO: 7289926 - DNA, 22 bp, Homo sapiens
gctgagagtccaggaaaacatc

SEQ ID NO: 7289927 - DNA, 21 bp, Homo sapiens
gctgagaggttgggaagttca

SEQ ID NO: 7289928 - DNA, 22 bp, Homo sapiens
gctgagggcatgtgtggcgact

SEQ ID NO: 7289929 - DNA, 22 bp, Homo sapiens
gctgagggcagcctcctaggtc

SEQ ID NO: 7289930 - DNA, 22 bp, Homo sapiens
gctgcctgtctgtttcttttat

SEQ ID NO: 7289931 - DNA, 19 bp, Homo sapiens
gctgcctgtcttagccagt

SEQ ID NO: 7289932 - DNA, 22 bp, Homo sapiens
gctgcctgtgcactttctcgta

SEQ ID NO: 7289933 - DNA, 22 bp, Homo sapiens
gctgcctgttgaagggtctgtg

SEQ ID NO: 7289934 - DNA, 20 bp, Homo sapiens
gcctgagctccgcctcctgt

SEQ ID NO: 7289935 - DNA, 20 bp, Homo sapiens
gcctgagctattgccaggat

SEQ ID NO: 7289936 - DNA, 22 bp, Homo sapiens
gccttgctgattaccttccttt

SEQ ID NO: 7289937 - DNA, 22 bp, Homo sapiens
gcctgagcccaggtgtgcagag

SEQ ID NO: 7289938 - DNA, 22 bp, Homo sapiens
gcggtggggaaaggaggtgctg

SEQ ID NO: 7289939 - DNA, 22 bp, Homo sapiens
gcggtgggggaaaggagcggtt

SEQ ID NO: 7289940 - DNA, 22 bp, Homo sapiens
gcctttcctgctctggcattca

SEQ ID NO: 7289941 - DNA, 22 bp, Homo sapiens
ggaatgtttttcattgctctct

SEQ ID NO: 7289942 - DNA, 22 bp, Homo sapiens
ggaatgttttccagacctagat

SEQ ID NO: 7289943 - DNA, 22 bp, Homo sapiens
ggaatgttctggaacaccgctt

SEQ ID NO: 7289944 - DNA, 22 bp, Homo sapiens
ggaatgttgtcatttacattat

SEQ ID NO: 7289945 - DNA, 22 bp, Homo sapiens
ggaatgttctggtctggttcat

SEQ ID NO: 7289946 - DNA, 22 bp, Homo sapiens
ggaatgttttagcttgactttt

SEQ ID NO: 7289947 - DNA, 22 bp, Homo sapiens
ggaatgtttgctcccttcaggg

SEQ ID NO: 7289948 - DNA, 23 bp, Homo sapiens
ggaatgtttacctgtgaatgtca

SEQ ID NO: 7289949 - DNA, 22 bp, Homo sapiens
ggaatgaatttccagctgggtc

SEQ ID NO: 7289950 - DNA, 22 bp, Homo sapiens
ggaatgaagaaatagatggtgt

SEQ ID NO: 7289951 - DNA, 22 bp, Homo sapiens
gctttcaaatcctaattccaac

SEQ ID NO: 7289952 - DNA, 22 bp, Homo sapiens
gctttcaaatcctaattccaac

SEQ ID NO: 7289953 - DNA, 22 bp, Homo sapiens
ggaagaagggtcattggcagcc

SEQ ID NO: 7289954 - DNA, 22 bp, Homo sapiens
ggacatggaaatcggcttgctc

SEQ ID NO: 7289955 - DNA, 22 bp, Homo sapiens
ggagcagtggtcattcagctgg

SEQ ID NO: 7289956 - DNA, 22 bp, Homo sapiens
ggagcagtctggtgatactcag

SEQ ID NO: 7289957 - DNA, 22 bp, Homo sapiens
ggagccagaaatgctgtggttg

SEQ ID NO: 7289958 - DNA, 22 bp, Homo sapiens
ggagcagggaattacagcgcag

SEQ ID NO: 7289959 - DNA, 22 bp, Homo sapiens
gctgtgggacaggtccagccag

SEQ ID NO: 7289960 - DNA, 19 bp, Homo sapiens
gctgtgcctctctcctgct

SEQ ID NO: 7289961 - DNA, 19 bp, Homo sapiens
gctgtgcccctgccgcttg

SEQ ID NO: 7289962 - DNA, 19 bp, Homo sapiens
gctgggcttgggtttgtag

SEQ ID NO: 7289963 - DNA, 22 bp, Homo sapiens
gctgggcttggtttccctgctt

SEQ ID NO: 7289964 - DNA, 22 bp, Homo sapiens
gcttgcctatctggtggtcgtt

SEQ ID NO: 7289965 - DNA, 22 bp, Homo sapiens
gcttgcctggcatttctggggc

SEQ ID NO: 7289966 - DNA, 23 bp, Homo sapiens
gcttgcctggtgtgtggctgacc

SEQ ID NO: 7289967 - DNA, 17 bp, Homo sapiens
gcttgccttgtcttcct

SEQ ID NO: 7289968 - DNA, 21 bp, Homo sapiens
gcttgccttcctatctttggc

SEQ ID NO: 7289969 - DNA, 22 bp, Homo sapiens
gctggctggaggagggaggttg

SEQ ID NO: 7289970 - DNA, 19 bp, Homo sapiens
gctggctggaggagggaca

SEQ ID NO: 7289971 - DNA, 22 bp, Homo sapiens
gctggctggaggtgaggaagaa

SEQ ID NO: 7289972 - DNA, 22 bp, Homo sapiens
gctggctgcgtcatcacagggc

SEQ ID NO: 7289973 - DNA, 22 bp, Homo sapiens
gctggctgtgttccttctgcca

SEQ ID NO: 7289974 - DNA, 22 bp, Homo sapiens
gctgggcttctcaatgctgcct

SEQ ID NO: 7289975 - DNA, 22 bp, Homo sapiens
gctgggcttcacctccagagtt

SEQ ID NO: 7289976 - DNA, 22 bp, Homo sapiens
gctgggctgtagtttgctgacc

SEQ ID NO: 7289977 - DNA, 22 bp, Homo sapiens
gctgggctggccgccgagatcg

SEQ ID NO: 7289978 - DNA, 22 bp, Homo sapiens
tccagcaggtgtttgccaactt

SEQ ID NO: 7289979 - DNA, 22 bp, Homo sapiens
tccagcaggtccgagacaagtt

SEQ ID NO: 7289980 - DNA, 22 bp, Homo sapiens
tccagcagccacacctctggac

SEQ ID NO: 7289981 - DNA, 22 bp, Homo sapiens
tccagcagcccgaaggcccatc

SEQ ID NO: 7289982 - DNA, 23 bp, Homo sapiens
tccagcagccaagaagggtagaa

SEQ ID NO: 7289983 - DNA, 22 bp, Homo sapiens
tccagcagagtctctgaggggg

SEQ ID NO: 7289984 - DNA, 23 bp, Homo sapiens
tccagcagagccttccaggaggg

SEQ ID NO: 7289985 - DNA, 22 bp, Homo sapiens
tccagcagaccatcaaggctca

SEQ ID NO: 7289986 - DNA, 22 bp, Homo sapiens
tccagagcaggtggtcagaagg

SEQ ID NO: 7289987 - DNA, 22 bp, Homo sapiens
tccagcaggttggtcaggtgca

SEQ ID NO: 7289988 - DNA, 22 bp, Homo sapiens
tccagcagtccatgtgagacac

SEQ ID NO: 7289989 - DNA, 22 bp, Homo sapiens
tccagcagtgctcaggactcac

SEQ ID NO: 7289990 - DNA, 22 bp, Homo sapiens
tccagcagtgctctagagcgtg

SEQ ID NO: 7289991 - DNA, 22 bp, Homo sapiens
tccaggccactgcagaggctct

SEQ ID NO: 7289992 - DNA, 22 bp, Homo sapiens
tccaggccacatggatggcgat

SEQ ID NO: 7289993 - DNA, 22 bp, Homo sapiens
tccaggccaatgtagcaggccc

SEQ ID NO: 7289994 - DNA, 20 bp, Homo sapiens
tccatcttgggcagaagcag

SEQ ID NO: 7289995 - DNA, 22 bp, Homo sapiens
tcccagggtgaaatgcagtagg

SEQ ID NO: 7289996 - DNA, 21 bp, Homo sapiens
tcccagggtcttatgggatgt

SEQ ID NO: 7289997 - DNA, 22 bp, Homo sapiens
tcccagggttacagccagggca

SEQ ID NO: 7289998 - DNA, 23 bp, Homo sapiens
tcccatgggctcactgccctgca

SEQ ID NO: 7289999 - DNA, 22 bp, Homo sapiens
tcccatggtctatatagaggca

SEQ ID NO: 7290000 - DNA, 22 bp, Homo sapiens
tcccatggatagtgaccttgtt

SEQ ID NO: 7290001 - DNA, 22 bp, Homo sapiens
tcccatcatctgttctggctac

SEQ ID NO: 7290002 - DNA, 20 bp, Homo sapiens
tcccatcacgcctgtgccag

SEQ ID NO: 7290003 - DNA, 22 bp, Homo sapiens
tccccacctacacactgctcct

SEQ ID NO: 7290004 - DNA, 22 bp, Homo sapiens
tccccacctaagatacccatct

SEQ ID NO: 7290005 - DNA, 22 bp, Homo sapiens
tcagcaccagttatcctcaggg

SEQ ID NO: 7290006 - DNA, 22 bp, Homo sapiens
tcagaaaagactcaggggctga

SEQ ID NO: 7290007 - DNA, 22 bp, Homo sapiens
tcagaaaagagaaaatcttata

SEQ ID NO: 7290008 - DNA, 22 bp, Homo sapiens
tcagaaaagaccacattattct

SEQ ID NO: 7290009 - DNA, 22 bp, Homo sapiens
tcagaaaataactgttagtttg

SEQ ID NO: 7290010 - DNA, 22 bp, Homo sapiens
tcactttggattatgtaatttc

SEQ ID NO: 7290011 - DNA, 22 bp, Homo sapiens
tcactttagaggaaacattgag

SEQ ID NO: 7290012 - DNA, 22 bp, Homo sapiens
tcactgaaaaccatacttcttt

SEQ ID NO: 7290013 - DNA, 22 bp, Homo sapiens
tcacattttcatattctctgag

SEQ ID NO: 7290014 - DNA, 22 bp, Homo sapiens
tcacagaagtgtagtgaggaaa

SEQ ID NO: 7290015 - DNA, 23 bp, Homo sapiens
tcacagggcactggctggggttg

SEQ ID NO: 7290016 - DNA, 22 bp, Homo sapiens
tcacaggctggtctccgaggac

SEQ ID NO: 7290017 - DNA, 22 bp, Homo sapiens
tcacaggctccagggcctggat

SEQ ID NO: 7290018 - DNA, 22 bp, Homo sapiens
tcacaggcctggggcagagggc

SEQ ID NO: 7290019 - DNA, 22 bp, Homo sapiens
tcacagggtatctgggatggat

SEQ ID NO: 7290020 - DNA, 22 bp, Homo sapiens
tcaattttatgaaacaaagtga

SEQ ID NO: 7290021 - DNA, 22 bp, Homo sapiens
tcaagtcttgagggacagcatt

SEQ ID NO: 7290022 - DNA, 22 bp, Homo sapiens
tatttcttcgggattcaagcta

SEQ ID NO: 7290023 - DNA, 22 bp, Homo sapiens
tcagggaaaggggagagtcatt

SEQ ID NO: 7290024 - DNA, 22 bp, Homo sapiens
tcagggaaacctaaggaagcca

SEQ ID NO: 7290025 - DNA, 22 bp, Homo sapiens
tcaggctggagtgcagtggcgc

SEQ ID NO: 7290026 - DNA, 22 bp, Homo sapiens
tcaggctggaatgcagtggggc

SEQ ID NO: 7290027 - DNA, 22 bp, Homo sapiens
tcaggccttcagacctggcccg

SEQ ID NO: 7290028 - DNA, 19 bp, Homo sapiens
tcaggcagttattcacaaa

SEQ ID NO: 7290029 - DNA, 22 bp, Homo sapiens
tcaggccacggctcactgagac

SEQ ID NO: 7290030 - DNA, 22 bp, Homo sapiens
tcaggccacttcacaggtgatt

SEQ ID NO: 7290031 - DNA, 22 bp, Homo sapiens
tcaggcctgcaggcttcctgga

SEQ ID NO: 7290032 - DNA, 21 bp, Homo sapiens
tcaggcagtgcaaatacatgg

SEQ ID NO: 7290033 - DNA, 22 bp, Homo sapiens
tcaggaaggcgccccatcagga

SEQ ID NO: 7290034 - DNA, 22 bp, Homo sapiens
tcaggaagctactgccagcagc

SEQ ID NO: 7290035 - DNA, 18 bp, Homo sapiens
tcagcctgttgtctgcct

SEQ ID NO: 7290036 - DNA, 22 bp, Homo sapiens
tcagcctggcaggatggcctgg

SEQ ID NO: 7290037 - DNA, 22 bp, Homo sapiens
tcagcctggtgattcctctgtc

SEQ ID NO: 7290038 - DNA, 22 bp, Homo sapiens
tcagcaggcacaccaaaaactg

SEQ ID NO: 7290039 - DNA, 21 bp, Homo sapiens
tcagcaggcaccagaaggctg

SEQ ID NO: 7290040 - DNA, 22 bp, Homo sapiens
tcagcaggcaccggaagtgttt

SEQ ID NO: 7290041 - DNA, 22 bp, Homo sapiens
tcagcaggcacggacaggctgc

SEQ ID NO: 7290042 - DNA, 22 bp, Homo sapiens
tcagcaggcagaaatctgcaga

SEQ ID NO: 7290043 - DNA, 22 bp, Homo sapiens
tcagcctgctccaagtgctgcc

SEQ ID NO: 7290044 - DNA, 22 bp, Homo sapiens
tcatggaagaggtattttttgt

SEQ ID NO: 7290045 - DNA, 22 bp, Homo sapiens
tcaggtttaggaatttggaaag

SEQ ID NO: 7290046 - DNA, 22 bp, Homo sapiens
tcagtgtaagttatgtagatgt

SEQ ID NO: 7290047 - DNA, 18 bp, Homo sapiens
tcagtgtagatctgtgta

SEQ ID NO: 7290048 - DNA, 22 bp, Homo sapiens
tcagtgcagggtgggagagaga

SEQ ID NO: 7290049 - DNA, 22 bp, Homo sapiens
gtgctcagggcctggctgggga

SEQ ID NO: 7290050 - DNA, 22 bp, Homo sapiens
gtgctcaggggcaatcctggga

SEQ ID NO: 7290051 - DNA, 22 bp, Homo sapiens
gtgtggctagaagtgtcttgtt

SEQ ID NO: 7290052 - DNA, 22 bp, Homo sapiens
gttacaaagcacttcaagtgaa

SEQ ID NO: 7290053 - DNA, 22 bp, Homo sapiens
gttgcaaactcctacttctcat

SEQ ID NO: 7290054 - DNA, 22 bp, Homo sapiens
gttgggctgggagctgccctga

SEQ ID NO: 7290055 - DNA, 22 bp, Homo sapiens
taaagtcaaaatatgggtaggc

SEQ ID NO: 7290056 - DNA, 22 bp, Homo sapiens
taaagtcaaggtactgtttcac

SEQ ID NO: 7290057 - DNA, 22 bp, Homo sapiens
taaatttttgttaacagcctct

SEQ ID NO: 7290058 - DNA, 22 bp, Homo sapiens
taaaattgcggtgaatatttcc

SEQ ID NO: 7290059 - DNA, 22 bp, Homo sapiens
taaaatgtagcttctaggctgg

SEQ ID NO: 7290060 - DNA, 21 bp, Homo sapiens
gttttctttgatagagggaag

SEQ ID NO: 7290061 - DNA, 22 bp, Homo sapiens
taaggcagtgagaagaaacagg

SEQ ID NO: 7290062 - DNA, 22 bp, Homo sapiens
taaggcagtgaaactattctgt

SEQ ID NO: 7290063 - DNA, 22 bp, Homo sapiens
taaggcagtagtgtctgtaggg

SEQ ID NO: 7290064 - DNA, 22 bp, Homo sapiens
taaggcagttttgcctgagata

SEQ ID NO: 7290065 - DNA, 22 bp, Homo sapiens
taaggcaggtagatgactacgg

SEQ ID NO: 7290066 - DNA, 22 bp, Homo sapiens
taaggcaggctttcatccagag

SEQ ID NO: 7290067 - DNA, 22 bp, Homo sapiens
taaggcaggtatggtaccaggc

SEQ ID NO: 7290068 - DNA, 22 bp, Homo sapiens
taaggcaggactggatagctat

SEQ ID NO: 7290069 - DNA, 22 bp, Homo sapiens
tacaggcatgtagcatggtgat

SEQ ID NO: 7290070 - DNA, 22 bp, Homo sapiens
tacattccttcgtttagagatt

SEQ ID NO: 7290071 - DNA, 22 bp, Homo sapiens
tacattcctgggctccacccta

SEQ ID NO: 7290072 - DNA, 22 bp, Homo sapiens
tacatccaaatgaattagaatt

SEQ ID NO: 7290073 - DNA, 21 bp, Homo sapiens
tacagatgaggagaccaaggc

SEQ ID NO: 7290074 - DNA, 22 bp, Homo sapiens
tacagaaacagcgtggttagaa

SEQ ID NO: 7290075 - DNA, 22 bp, Homo sapiens
tacacttttctggttactcttg

SEQ ID NO: 7290076 - DNA, 22 bp, Homo sapiens
tacactttttactacagattct

SEQ ID NO: 7290077 - DNA, 22 bp, Homo sapiens
tacactgagatgactttggttt

SEQ ID NO: 7290078 - DNA, 22 bp, Homo sapiens
tacactgagcaggaagaagtgg

SEQ ID NO: 7290079 - DNA, 22 bp, Homo sapiens
tacaacataacgggcattcagt

SEQ ID NO: 7290080 - DNA, 22 bp, Homo sapiens
tacaaatgaaccaactttgatg

SEQ ID NO: 7290081 - DNA, 22 bp, Homo sapiens
tatccaaagtttctcagaaact

SEQ ID NO: 7290082 - DNA, 22 bp, Homo sapiens
tatccatctatgtgtgtctgtg

SEQ ID NO: 7290083 - DNA, 22 bp, Homo sapiens
tatccattatgttggctagtct

SEQ ID NO: 7290084 - DNA, 22 bp, Homo sapiens
tatccatcttctttgagaatgg

SEQ ID NO: 7290085 - DNA, 22 bp, Homo sapiens
tatacacatttttacctatagt

SEQ ID NO: 7290086 - DNA, 22 bp, Homo sapiens
tatacacatttttacctatagt

SEQ ID NO: 7290087 - DNA, 22 bp, Homo sapiens
tatacacattacagtttcagga

SEQ ID NO: 7290088 - DNA, 22 bp, Homo sapiens
tatacacatgtgtgtattcata

SEQ ID NO: 7290089 - DNA, 22 bp, Homo sapiens
tatacacatatcttctaggcct

SEQ ID NO: 7290090 - DNA, 22 bp, Homo sapiens
tatacacatatacgtttgtgtg

SEQ ID NO: 7290091 - DNA, 17 bp, Homo sapiens
tatacacagacagactg

SEQ ID NO: 7290092 - DNA, 22 bp, Homo sapiens
tatacacaggaatctgtgaaaa

SEQ ID NO: 7290093 - DNA, 23 bp, Homo sapiens
tatacacatgtggcagtatagtg

SEQ ID NO: 7290094 - DNA, 22 bp, Homo sapiens
tatacacatcctccaaagatag

SEQ ID NO: 7290095 - DNA, 22 bp, Homo sapiens
tatacacaaacaaggggttaag

SEQ ID NO: 7290096 - DNA, 22 bp, Homo sapiens
tatacacacctccaaagcagga

SEQ ID NO: 7290097 - DNA, 22 bp, Homo sapiens
tatacacaaggtgtgcatttgt

SEQ ID NO: 7290098 - DNA, 22 bp, Homo sapiens
tatacacacatgctccggcctt

SEQ ID NO: 7290099 - DNA, 22 bp, Homo sapiens
tattctctccccaatcttgctt

SEQ ID NO: 7290100 - DNA, 22 bp, Homo sapiens
tatgtacataacatgaaatgca

SEQ ID NO: 7290101 - DNA, 22 bp, Homo sapiens
tatgtacagtccttaacttaaa

SEQ ID NO: 7290102 - DNA, 22 bp, Homo sapiens
tatgtacaccaaggattgaaaa

SEQ ID NO: 7290103 - DNA, 22 bp, Homo sapiens
tatgtacacttaagtttgagaa

SEQ ID NO: 7290104 - DNA, 22 bp, Homo sapiens
tagctttagtgaaaaatatcag

SEQ ID NO: 7290105 - DNA, 22 bp, Homo sapiens
taggctgggcattctggccagg

SEQ ID NO: 7290106 - DNA, 22 bp, Homo sapiens
taggctgggcattctggccagg

SEQ ID NO: 7290107 - DNA, 22 bp, Homo sapiens
taggcagaaaggaaggcaagtt

SEQ ID NO: 7290108 - DNA, 22 bp, Homo sapiens
taggcactgggctaggacaggt

SEQ ID NO: 7290109 - DNA, 22 bp, Homo sapiens
taggcactggatgaccgaagag

SEQ ID NO: 7290110 - DNA, 22 bp, Homo sapiens
taggcaagtggaccagaggttt

SEQ ID NO: 7290111 - DNA, 22 bp, Homo sapiens
tagggcagagcttgtacacgat

SEQ ID NO: 7290112 - DNA, 22 bp, Homo sapiens
tagcctctctcctccacaacct

SEQ ID NO: 7290113 - DNA, 22 bp, Homo sapiens
tagaggtgagacttcagtgaca

SEQ ID NO: 7290114 - DNA, 22 bp, Homo sapiens
tagacaaactgatacttggcga

SEQ ID NO: 7290115 - DNA, 22 bp, Homo sapiens
tagaaaagccccagctggaggg

SEQ ID NO: 7290116 - DNA, 22 bp, Homo sapiens
tagaaaagaagtctggccggga

SEQ ID NO: 7290117 - DNA, 22 bp, Homo sapiens
tagaaaagaattttatttgata

SEQ ID NO: 7290118 - DNA, 22 bp, Homo sapiens
tccccatgggtggggacacata

SEQ ID NO: 7290119 - DNA, 22 bp, Homo sapiens
tcccctgcagatgagggcagtg

SEQ ID NO: 7290120 - DNA, 18 bp, Homo sapiens
tcccctgctctggtgctc

SEQ ID NO: 7290121 - DNA, 19 bp, Homo sapiens
tgtggggagtcagggggct

SEQ ID NO: 7290122 - DNA, 17 bp, Homo sapiens
tgtggccttctgagctt

SEQ ID NO: 7290123 - DNA, 22 bp, Homo sapiens
tgtggcctgggagctgaggtct

SEQ ID NO: 7290124 - DNA, 22 bp, Homo sapiens
tgtggcctggaaggggctgctc

SEQ ID NO: 7290125 - DNA, 23 bp, Homo sapiens
tgtggcctgcagctctggtttgg

SEQ ID NO: 7290126 - DNA, 22 bp, Homo sapiens
tgtggcctctcaggcttgatca

SEQ ID NO: 7290127 - DNA, 22 bp, Homo sapiens
tgtggcctccccacttctgggg

SEQ ID NO: 7290128 - DNA, 22 bp, Homo sapiens
tgtggcctcaaggctgccctca

SEQ ID NO: 7290129 - DNA, 22 bp, Homo sapiens
tgttaaaaatgcagattcctat

SEQ ID NO: 7290130 - DNA, 22 bp, Homo sapiens
tgttccctcctccccactgggt

SEQ ID NO: 7290131 - DNA, 22 bp, Homo sapiens
tgttctctctggctgccagtac

SEQ ID NO: 7290132 - DNA, 22 bp, Homo sapiens
tgttctctctccttttgaagtg

SEQ ID NO: 7290133 - DNA, 22 bp, Homo sapiens
tgtttacaaggagtttatattg

SEQ ID NO: 7290134 - DNA, 22 bp, Homo sapiens
tgtttacagtttttagtaccct

SEQ ID NO: 7290135 - DNA, 22 bp, Homo sapiens
ttaagaatgtgccttttggttg

SEQ ID NO: 7290136 - DNA, 22 bp, Homo sapiens
ttaagtcactggacttgcctag

SEQ ID NO: 7290137 - DNA, 22 bp, Homo sapiens
ttaaatagtcaaatcagtggca

SEQ ID NO: 7290138 - DNA, 22 bp, Homo sapiens
ttagagaaaagcttgcttgctt

SEQ ID NO: 7290139 - DNA, 21 bp, Homo sapiens
ttactggctctcaagtcagct

SEQ ID NO: 7290140 - DNA, 22 bp, Homo sapiens
ttactctttggtgttaagttca

SEQ ID NO: 7290141 - DNA, 22 bp, Homo sapiens
ttaatttgaccataaatatctt

SEQ ID NO: 7290142 - DNA, 22 bp, Homo sapiens
ttacacatctagacccattttt

SEQ ID NO: 7290143 - DNA, 22 bp, Homo sapiens
ttacacttgtaattatataacg

SEQ ID NO: 7290144 - DNA, 22 bp, Homo sapiens
ttacacttgggtgtggatttta

SEQ ID NO: 7290145 - DNA, 20 bp, Homo sapiens
ttacactttgtagcattttt

SEQ ID NO: 7290146 - DNA, 22 bp, Homo sapiens
ttacactttggcaagctattaa

SEQ ID NO: 7290147 - DNA, 22 bp, Homo sapiens
ttacagtgactcacattaacaa

SEQ ID NO: 7290148 - DNA, 22 bp, Homo sapiens
ttacagtgagggtgacatttac

SEQ ID NO: 7290149 - DNA, 22 bp, Homo sapiens
ttacagtgacagttgctatgat

SEQ ID NO: 7290150 - DNA, 22 bp, Homo sapiens
ttacagtgaagtaccattaaaa

SEQ ID NO: 7290151 - DNA, 20 bp, Homo sapiens
ttacagtgggaccttcctga

SEQ ID NO: 7290152 - DNA, 22 bp, Homo sapiens
ttacagtggcagagttgggtag

SEQ ID NO: 7290153 - DNA, 22 bp, Homo sapiens
ttacagtgctcttcaagacttc

SEQ ID NO: 7290154 - DNA, 22 bp, Homo sapiens
ttacagtgaagattcaggttcc

SEQ ID NO: 7290155 - DNA, 22 bp, Homo sapiens
ttacagtcagtgaatggaaggg

SEQ ID NO: 7290156 - DNA, 22 bp, Homo sapiens
ttacatcactttacttaataat

SEQ ID NO: 7290157 - DNA, 22 bp, Homo sapiens
ttacatcagcaagagtgtatgt

SEQ ID NO: 7290158 - DNA, 22 bp, Homo sapiens
ttctcttttcaccagttgctaa

SEQ ID NO: 7290159 - DNA, 22 bp, Homo sapiens
ttcttgcatcaagacagcctgt

SEQ ID NO: 7290160 - DNA, 22 bp, Homo sapiens
ttgattctgatgaaagtccatt

SEQ ID NO: 7290161 - DNA, 23 bp, Homo sapiens
ttgatttagctgggattgcatgc

SEQ ID NO: 7290162 - DNA, 22 bp, Homo sapiens
ttgattttaaaatagtgacact

SEQ ID NO: 7290163 - DNA, 21 bp, Homo sapiens
ttgattttaggaagtttgtca

SEQ ID NO: 7290164 - DNA, 22 bp, Homo sapiens
ttgatttttccagcttctagag

SEQ ID NO: 7290165 - DNA, 22 bp, Homo sapiens
ttgaagaattaacagctgtgga

SEQ ID NO: 7290166 - DNA, 20 bp, Homo sapiens
ttccctggaaggagaagcag

SEQ ID NO: 7290167 - DNA, 22 bp, Homo sapiens
ttctagaaacacatgcaaacag

SEQ ID NO: 7290168 - DNA, 22 bp, Homo sapiens
ttctagaaactggagcaaacag

SEQ ID NO: 7290169 - DNA, 21 bp, Homo sapiens
ttctagaaaagtatgggactg

SEQ ID NO: 7290170 - DNA, 20 bp, Homo sapiens
ttctagaatgcccagggaca

SEQ ID NO: 7290171 - DNA, 22 bp, Homo sapiens
ttctagaagaactagccaggaa

SEQ ID NO: 7290172 - DNA, 22 bp, Homo sapiens
ttctagaacaggcaaaaccaat

SEQ ID NO: 7290173 - DNA, 22 bp, Homo sapiens
ttctagaaatccgtaagtgaat

SEQ ID NO: 7290174 - DNA, 22 bp, Homo sapiens
ttcctgtggccttacatctgtg

SEQ ID NO: 7290175 - DNA, 22 bp, Homo sapiens
ttcctgtgcttattcttctctg

SEQ ID NO: 7290176 - DNA, 22 bp, Homo sapiens
ttcctgtgcttaattctcactg

SEQ ID NO: 7290177 - DNA, 19 bp, Homo sapiens
ttcctgtgctgctgtgtcc

SEQ ID NO: 7290178 - DNA, 19 bp, Homo sapiens
ttcctgtgctgctgtgtcc

SEQ ID NO: 7290179 - DNA, 22 bp, Homo sapiens
ttcctgtgcctcaggtctcagc

SEQ ID NO: 7290180 - DNA, 22 bp, Homo sapiens
ttcctgtgaagccggtggtctc

SEQ ID NO: 7290181 - DNA, 22 bp, Homo sapiens
ttcctgtgaagccggtggtctc

SEQ ID NO: 7290182 - DNA, 22 bp, Homo sapiens
ttcctgtgatattagccactgt

SEQ ID NO: 7290183 - DNA, 22 bp, Homo sapiens
ttcctgtgcctcaggtctcagc

SEQ ID NO: 7290184 - DNA, 22 bp, Homo sapiens
ttcctgtggtgtttcccagaca

SEQ ID NO: 7290185 - DNA, 17 bp, Homo sapiens
ttcctgtggtttgatct

SEQ ID NO: 7290186 - DNA, 22 bp, Homo sapiens
ttcctgtggtccagagtcatcc

SEQ ID NO: 7290187 - DNA, 23 bp, Homo sapiens
ttcctgtggtatattttataggg

SEQ ID NO: 7290188 - DNA, 22 bp, Homo sapiens
ttcctgtggctgtcactcctgg

SEQ ID NO: 7290189 - DNA, 22 bp, Homo sapiens
ttcctgtgtgttggtggcagaa

SEQ ID NO: 7290190 - DNA, 22 bp, Homo sapiens
ttcctgtgtgctctcatttagt

SEQ ID NO: 7290191 - DNA, 22 bp, Homo sapiens
ttcctgtgtgactcaagtggtt

SEQ ID NO: 7290192 - DNA, 22 bp, Homo sapiens
ttcctgtgtgaccgagacagtg

SEQ ID NO: 7290193 - DNA, 22 bp, Homo sapiens
ttcctgtgtcctatttcgactt

SEQ ID NO: 7290194 - DNA, 22 bp, Homo sapiens
ttcctgtgtcccgggcaccctg

SEQ ID NO: 7290195 - DNA, 22 bp, Homo sapiens
ttcctgtgtacgtgtttcgctg

SEQ ID NO: 7290196 - DNA, 22 bp, Homo sapiens
ttcctgtgaagatctgggtgct

SEQ ID NO: 7290197 - DNA, 22 bp, Homo sapiens
ttcctgtgaaatataggtccat

SEQ ID NO: 7290198 - DNA, 22 bp, Homo sapiens
ttcacattagtggttctatata

SEQ ID NO: 7290199 - DNA, 22 bp, Homo sapiens
ttcacattagccaagagatgga

SEQ ID NO: 7290200 - DNA, 22 bp, Homo sapiens
ttcacattgaaggtgctttctt

SEQ ID NO: 7290201 - DNA, 22 bp, Homo sapiens
ttcacattctcacaagaggaaa

SEQ ID NO: 7290202 - DNA, 19 bp, Homo sapiens
ttcacattggaagaagtag

SEQ ID NO: 7290203 - DNA, 22 bp, Homo sapiens
ttcacattcagaaaaagcccgt

SEQ ID NO: 7290204 - DNA, 22 bp, Homo sapiens
ttcacattccgcggctattttc

SEQ ID NO: 7290205 - DNA, 22 bp, Homo sapiens
ttcacattatcaggattgtttc

SEQ ID NO: 7290206 - DNA, 22 bp, Homo sapiens
ttcacattataatcagttctgc

SEQ ID NO: 7290207 - DNA, 22 bp, Homo sapiens
ttcagtatgtgtaaactacttt

SEQ ID NO: 7290208 - DNA, 22 bp, Homo sapiens
ttcagtgacttacctggagcca

SEQ ID NO: 7290209 - DNA, 22 bp, Homo sapiens
ttcaactagaggtgattttgcc

SEQ ID NO: 7290210 - DNA, 22 bp, Homo sapiens
ttcaactagatttatacaattc

SEQ ID NO: 7290211 - DNA, 22 bp, Homo sapiens
ttcaactaatgtttattttatg

SEQ ID NO: 7290212 - DNA, 22 bp, Homo sapiens
ttcaactattatgaataaaatt

SEQ ID NO: 7290213 - DNA, 22 bp, Homo sapiens
ttcaagaagcccaaagactagc

SEQ ID NO: 7290214 - DNA, 22 bp, Homo sapiens
ttgtgttttcttatggcataaa

SEQ ID NO: 7290215 - DNA, 22 bp, Homo sapiens
ttgtgtttcccttgcatattcc

SEQ ID NO: 7290216 - DNA, 22 bp, Homo sapiens
ttgtgtttcccttgcatattcc

SEQ ID NO: 7290217 - DNA, 21 bp, Homo sapiens
ttgtgtttccccagtcacttt

SEQ ID NO: 7290218 - DNA, 22 bp, Homo sapiens
ttgtgtttctggccaagatgga

SEQ ID NO: 7290219 - DNA, 22 bp, Homo sapiens
ttgtgtttctgtgatatgtaaa

SEQ ID NO: 7290220 - DNA, 22 bp, Homo sapiens
ttgtgttaaggtgcatctagtg

SEQ ID NO: 7290221 - DNA, 22 bp, Homo sapiens
ttgcaacatctgaacatttatc

SEQ ID NO: 7290222 - DNA, 22 bp, Homo sapiens
ttggttttcaggggcaggataa

SEQ ID NO: 7290223 - DNA, 22 bp, Homo sapiens
ttgtctctaagtgtgatcttca

SEQ ID NO: 7290224 - DNA, 22 bp, Homo sapiens
tttaaaatttagacctctccac

SEQ ID NO: 7290225 - DNA, 22 bp, Homo sapiens
tttaaaatttagacctctccac

SEQ ID NO: 7290226 - DNA, 22 bp, Homo sapiens
tttaaaatcagatgggagttgg

SEQ ID NO: 7290227 - DNA, 22 bp, Homo sapiens
tttactttctcaagtatatagg

SEQ ID NO: 7290228 - DNA, 22 bp, Homo sapiens
tttactttgtgtcaagtcaaga

SEQ ID NO: 7290229 - DNA, 23 bp, Homo sapiens
tttatacaagaaaccgctggcct

SEQ ID NO: 7290230 - DNA, 22 bp, Homo sapiens
tttatacatggagaatttttgc

SEQ ID NO: 7290231 - DNA, 22 bp, Homo sapiens
tttctttatcctcctttgcaca

SEQ ID NO: 7290232 - DNA, 23 bp, Homo sapiens
tttcttcagaagccttgcgaggc

SEQ ID NO: 7290233 - DNA, 22 bp, Homo sapiens
tttcttcagcaggtttgtgaga

SEQ ID NO: 7290234 - DNA, 22 bp, Homo sapiens
tttctcttaatgtctctgtgct

SEQ ID NO: 7290235 - DNA, 22 bp, Homo sapiens
tttctcctgagttccacgctac

SEQ ID NO: 7290236 - DNA, 22 bp, Homo sapiens
tttctctttgacaggaatcaga

SEQ ID NO: 7290237 - DNA, 22 bp, Homo sapiens
tttctcttgcgatatgctacac

SEQ ID NO: 7290238 - DNA, 22 bp, Homo sapiens
tttctcttcactgtgtgcctca

SEQ ID NO: 7290239 - DNA, 22 bp, Homo sapiens
tttctcttcactgtgtgcctca

SEQ ID NO: 7290240 - DNA, 22 bp, Homo sapiens
tttcaggccatagcacagggaa

SEQ ID NO: 7290241 - DNA, 22 bp, Homo sapiens
tttcattttggttatgccataa

SEQ ID NO: 7290242 - DNA, 22 bp, Homo sapiens
tttccaaaatgaatctaatgca

SEQ ID NO: 7290243 - DNA, 22 bp, Homo sapiens
tttcctctgggccctgccaccc

SEQ ID NO: 7290244 - DNA, 22 bp, Homo sapiens
tttccaaataaggtcacactca

SEQ ID NO: 7290245 - DNA, 22 bp, Homo sapiens
tttttgctaatccccagccact

SEQ ID NO: 7290246 - DNA, 23 bp, Homo sapiens
ttttcctttggacaggctgtatt

SEQ ID NO: 7290247 - DNA, 22 bp, Homo sapiens
ttttcttctacctgctgtccaa

SEQ ID NO: 7290248 - DNA, 19 bp, Homo sapiens
ttttccttctcctcttaat

SEQ ID NO: 7290249 - DNA, 22 bp, Homo sapiens
ttttatcattacccagctgaaa

SEQ ID NO: 7290250 - DNA, 22 bp, Homo sapiens
ttttggcagattacttaatatg

SEQ ID NO: 7290251 - DNA, 22 bp, Homo sapiens
ttttggctccagtggtttgtgc

SEQ ID NO: 7290252 - DNA, 22 bp, Homo sapiens
ttttggctctgtctgtatcttt

SEQ ID NO: 7290253 - DNA, 22 bp, Homo sapiens
ttttggctctgcaggtttgcac

SEQ ID NO: 7290254 - DNA, 22 bp, Homo sapiens
ttttgcctaagaatctctctga

SEQ ID NO: 7290255 - DNA, 22 bp, Homo sapiens
ttttggaatgaggaacatccag

SEQ ID NO: 7290256 - DNA, 22 bp, Homo sapiens
ttttggaatttatacagtaatg

SEQ ID NO: 7290257 - DNA, 22 bp, Homo sapiens
tttggagtatggaggtgacaca

SEQ ID NO: 7290258 - DNA, 22 bp, Homo sapiens
tttggagtttaacaacttgaag

SEQ ID NO: 7290259 - DNA, 22 bp, Homo sapiens
tttgtacatgtaagattgcatc

SEQ ID NO: 7290260 - DNA, 23 bp, Homo sapiens
tttgtacattgaggaggcagaat

SEQ ID NO: 7290261 - DNA, 22 bp, Homo sapiens
tttggcagctcttgactgttct

SEQ ID NO: 7290262 - DNA, 19 bp, Homo sapiens
tttggcagcattaatatca

SEQ ID NO: 7290263 - DNA, 20 bp, Homo sapiens
tttgatttcacaaggccagt

SEQ ID NO: 7290264 - DNA, 22 bp, Homo sapiens
tttgcaaataccatgaaacttg

SEQ ID NO: 7290265 - DNA, 22 bp, Homo sapiens
tttgtttgaaagtctctacagc

SEQ ID NO: 7290266 - DNA, 22 bp, Homo sapiens
ttttatacacatgaacatgcag

SEQ ID NO: 7290267 - DNA, 22 bp, Homo sapiens
ttttatacttaagacagagttt

SEQ ID NO: 7290268 - DNA, 22 bp, Homo sapiens
gtgcccagttgaggccaggact

SEQ ID NO: 7290269 - DNA, 20 bp, Homo sapiens
gtgcccagttggtgacagac

SEQ ID NO: 7290270 - DNA, 22 bp, Homo sapiens
cagctacagttccactgagcat

SEQ ID NO: 7290271 - DNA, 22 bp, Homo sapiens
cagctacaggacgggcatctgc

SEQ ID NO: 7290272 - DNA, 22 bp, Homo sapiens
cagctacaggacctgatgcacc

SEQ ID NO: 7290273 - DNA, 22 bp, Homo sapiens
cagctacacaccagaactatta

SEQ ID NO: 7290274 - DNA, 22 bp, Homo sapiens
cagccttcaaggcttagctcag

SEQ ID NO: 7290275 - DNA, 22 bp, Homo sapiens
cagcctgggctccagagtccct

SEQ ID NO: 7290276 - DNA, 20 bp, Homo sapiens
cagcctccactcactcagct

SEQ ID NO: 7290277 - DNA, 22 bp, Homo sapiens
gtcccaggcagagtcaggaggg

SEQ ID NO: 7290278 - DNA, 22 bp, Homo sapiens
gtcatggaggattgtgagtggt

SEQ ID NO: 7290279 - DNA, 22 bp, Homo sapiens
gtcatgcagacagggttgtttt

SEQ ID NO: 7290280 - DNA, 22 bp, Homo sapiens
gtcatgcatgggctctgaagaa

SEQ ID NO: 7290281 - DNA, 22 bp, Homo sapiens
gtcatgaaattctagagcttga

SEQ ID NO: 7290282 - DNA, 22 bp, Homo sapiens
gtcataaagcttgttgcattta

SEQ ID NO: 7290283 - DNA, 22 bp, Homo sapiens
gtcataatataaaaactgactt

SEQ ID NO: 7290284 - DNA, 22 bp, Homo sapiens
cagcaggacatggaggagtaaa

SEQ ID NO: 7290285 - DNA, 22 bp, Homo sapiens
gtctggacagcagcacctcggc

SEQ ID NO: 7290286 - DNA, 22 bp, Homo sapiens
gtctggactgtggcagcttgcc

SEQ ID NO: 7290287 - DNA, 22 bp, Homo sapiens
gtcccaggcttatgtggagctt

SEQ ID NO: 7290288 - DNA, 22 bp, Homo sapiens
gtcccagggaagaaggcagcac

SEQ ID NO: 7290289 - DNA, 22 bp, Homo sapiens
gtcccaggctccatggcagcca

SEQ ID NO: 7290290 - DNA, 22 bp, Homo sapiens
gtcccaggcttatgtggagctt

SEQ ID NO: 7290291 - DNA, 22 bp, Homo sapiens
cagccccttcctggcatctgga

SEQ ID NO: 7290292 - DNA, 22 bp, Homo sapiens
cagccccttgtccggtagccac

SEQ ID NO: 7290293 - DNA, 22 bp, Homo sapiens
cagcccctcacagagctgtcct

SEQ ID NO: 7290294 - DNA, 22 bp, Homo sapiens
cagcccctggcgcacgccgagc

SEQ ID NO: 7290295 - DNA, 22 bp, Homo sapiens
cagcccctccctcaggcaggtg

SEQ ID NO: 7290296 - DNA, 22 bp, Homo sapiens
cagcccaggctcagatgttggg

SEQ ID NO: 7290297 - DNA, 22 bp, Homo sapiens
gtctgtcccaatagccaacagg

SEQ ID NO: 7290298 - DNA, 22 bp, Homo sapiens
gtctgtcactcaggggctggag

SEQ ID NO: 7290299 - DNA, 22 bp, Homo sapiens
gtctgtccacttggaagctccc

SEQ ID NO: 7290300 - DNA, 22 bp, Homo sapiens
gtctgttacctccaagaccatt

SEQ ID NO: 7290301 - DNA, 22 bp, Homo sapiens
cagaggatatactatctggaaa

SEQ ID NO: 7290302 - DNA, 22 bp, Homo sapiens
cagagctgggatcccatgggcg

SEQ ID NO: 7290303 - DNA, 22 bp, Homo sapiens
cagagctggggactgttggatg

SEQ ID NO: 7290304 - DNA, 22 bp, Homo sapiens
cagagctgggatcccatgggcg

SEQ ID NO: 7290305 - DNA, 22 bp, Homo sapiens
cagagctggctctgcatgtaca

SEQ ID NO: 7290306 - DNA, 22 bp, Homo sapiens
gggccagctctgtgatgtaggg

SEQ ID NO: 7290307 - DNA, 22 bp, Homo sapiens
cagaccccgagtttgcagagtt

SEQ ID NO: 7290308 - DNA, 19 bp, Homo sapiens
cagacctgtccagcctgtg

SEQ ID NO: 7290309 - DNA, 22 bp, Homo sapiens
ggtctgagtgggcaggggccgg

SEQ ID NO: 7290310 - DNA, 22 bp, Homo sapiens
ggtctgagtgccagggagagaa

SEQ ID NO: 7290311 - DNA, 22 bp, Homo sapiens
ggtctgaggtgggacccaggaa

SEQ ID NO: 7290312 - DNA, 22 bp, Homo sapiens
cagcaagacaaggaacaaactg

SEQ ID NO: 7290313 - DNA, 21 bp, Homo sapiens
cagcaaggaagtcgagtaggt

SEQ ID NO: 7290314 - DNA, 22 bp, Homo sapiens
cagcacattgatcagagacgct

SEQ ID NO: 7290315 - DNA, 22 bp, Homo sapiens
cagcacatggatggagttagga

SEQ ID NO: 7290316 - DNA, 22 bp, Homo sapiens
cagcacatctgattatatgact

SEQ ID NO: 7290317 - DNA, 22 bp, Homo sapiens
cagcacatctccaagaatttct

SEQ ID NO: 7290318 - DNA, 22 bp, Homo sapiens
cagcacatagtaggtattcact

SEQ ID NO: 7290319 - DNA, 22 bp, Homo sapiens
cagcacatagtaggtattcact

SEQ ID NO: 7290320 - DNA, 22 bp, Homo sapiens
cagcacataatcagtgattgtg

SEQ ID NO: 7290321 - DNA, 22 bp, Homo sapiens
cagagggaaaaggggagtaata

SEQ ID NO: 7290322 - DNA, 21 bp, Homo sapiens
ggaagggctctgaggacggct

SEQ ID NO: 7290323 - DNA, 22 bp, Homo sapiens
cacagaagtttcatagtctcga

SEQ ID NO: 7290324 - DNA, 22 bp, Homo sapiens
cacagaagtgtgtataactctt

SEQ ID NO: 7290325 - DNA, 22 bp, Homo sapiens
cacagaagaatcatgctgtgtt

SEQ ID NO: 7290326 - DNA, 22 bp, Homo sapiens
cacacaggagagtgctggaggt

SEQ ID NO: 7290327 - DNA, 20 bp, Homo sapiens
cacagactgtatgggcacca

SEQ ID NO: 7290328 - DNA, 19 bp, Homo sapiens
ggagccgccgcccttcatt

SEQ ID NO: 7290329 - DNA, 19 bp, Homo sapiens
ggagccgccgcccttcatt

SEQ ID NO: 7290330 - DNA, 22 bp, Homo sapiens
cacagatgaagtaaacaactct

SEQ ID NO: 7290331 - DNA, 19 bp, Homo sapiens
cacagatgattgacacata

SEQ ID NO: 7290332 - DNA, 19 bp, Homo sapiens
cacagatgattgacacata

SEQ ID NO: 7290333 - DNA, 22 bp, Homo sapiens
cacagatacctagtgaaacata

SEQ ID NO: 7290334 - DNA, 22 bp, Homo sapiens
cacagaggtgatagtggtcaag

SEQ ID NO: 7290335 - DNA, 23 bp, Homo sapiens
cacaggctgcgcataagcttctc

SEQ ID NO: 7290336 - DNA, 22 bp, Homo sapiens
cacaggcttttctgacataggc

SEQ ID NO: 7290337 - DNA, 22 bp, Homo sapiens
cacaggcttgtcagcatgaggc

SEQ ID NO: 7290338 - DNA, 22 bp, Homo sapiens
ggaggcattatggggaagactt

SEQ ID NO: 7290339 - DNA, 20 bp, Homo sapiens
cacaggccttgtgagcagac

SEQ ID NO: 7290340 - DNA, 22 bp, Homo sapiens
caagccagtttgtagttctctc

SEQ ID NO: 7290341 - DNA, 22 bp, Homo sapiens
caagccagctcctgccacagag

SEQ ID NO: 7290342 - DNA, 22 bp, Homo sapiens
caatgtcatttcactgggctta

SEQ ID NO: 7290343 - DNA, 22 bp, Homo sapiens
caatgtcatgattttccattag

SEQ ID NO: 7290344 - DNA, 22 bp, Homo sapiens
caatgtcagtcaagcagcaaat

SEQ ID NO: 7290345 - DNA, 22 bp, Homo sapiens
caatgtcagagaagctcatatc

SEQ ID NO: 7290346 - DNA, 22 bp, Homo sapiens
caatgtcagaattacagttgat

SEQ ID NO: 7290347 - DNA, 22 bp, Homo sapiens
caatgtcaaggagaccaaaacg

SEQ ID NO: 7290348 - DNA, 22 bp, Homo sapiens
caagttttagaaatatctggat

SEQ ID NO: 7290349 - DNA, 20 bp, Homo sapiens
ggcagggagggatactgagg

SEQ ID NO: 7290350 - DNA, 22 bp, Homo sapiens
cacatttacttttatcccttgg

SEQ ID NO: 7290351 - DNA, 22 bp, Homo sapiens
cacatttaggttcctatagcca

SEQ ID NO: 7290352 - DNA, 22 bp, Homo sapiens
cacagttttatcttatactgat

SEQ ID NO: 7290353 - DNA, 19 bp, Homo sapiens
cacagggagaccacatgtc

SEQ ID NO: 7290354 - DNA, 22 bp, Homo sapiens
cacagggaaccaaggctgggcc

SEQ ID NO: 7290355 - DNA, 22 bp, Homo sapiens
cacataaatggtgccatgtttt

SEQ ID NO: 7290356 - DNA, 22 bp, Homo sapiens
cacagttttgtcttggtttcca

SEQ ID NO: 7290357 - DNA, 22 bp, Homo sapiens
cacagttttgcccagggcttct

SEQ ID NO: 7290358 - DNA, 22 bp, Homo sapiens
ggccgctctccggtgtggatct

SEQ ID NO: 7290359 - DNA, 22 bp, Homo sapiens
ggcagggagtggagactcccta

SEQ ID NO: 7290360 - DNA, 22 bp, Homo sapiens
ggcagggcaggaaagtcaggaa

SEQ ID NO: 7290361 - DNA, 22 bp, Homo sapiens
ggcctgtgggaggacagctggg

SEQ ID NO: 7290362 - DNA, 23 bp, Homo sapiens
cagaaagccctttccccacagta

SEQ ID NO: 7290363 - DNA, 22 bp, Homo sapiens
cagaaagccaactccaactgtc

SEQ ID NO: 7290364 - DNA, 22 bp, Homo sapiens
cagaaagcaaaatggatctctg

SEQ ID NO: 7290365 - DNA, 21 bp, Homo sapiens
ggctggtgtttagctgtgata

SEQ ID NO: 7290366 - DNA, 22 bp, Homo sapiens
cagaaagctctttcaatcttgc

SEQ ID NO: 7290367 - DNA, 22 bp, Homo sapiens
cagaaagctctttcaatcttgc

SEQ ID NO: 7290368 - DNA, 18 bp, Homo sapiens
cagaaagttatttactct

SEQ ID NO: 7290369 - DNA, 22 bp, Homo sapiens
atgacagatgctgtggggaggt

SEQ ID NO: 7290370 - DNA, 21 bp, Homo sapiens
atgacagatgctgcagatcgt

SEQ ID NO: 7290371 - DNA, 22 bp, Homo sapiens
gaaaatgttagcttcatagtca

SEQ ID NO: 7290372 - DNA, 22 bp, Homo sapiens
gaaaggtttggcttttcagtag

SEQ ID NO: 7290373 - DNA, 22 bp, Homo sapiens
atgatcagggcagaagcagaag

SEQ ID NO: 7290374 - DNA, 22 bp, Homo sapiens
gaaatttattatctacatcatt

SEQ ID NO: 7290375 - DNA, 22 bp, Homo sapiens
atgatgaaattttctatcatgt

SEQ ID NO: 7290376 - DNA, 22 bp, Homo sapiens
atgatgaattttaaaagcacca

SEQ ID NO: 7290377 - DNA, 22 bp, Homo sapiens
atgatcagcagttttcagtgtt

SEQ ID NO: 7290378 - DNA, 22 bp, Homo sapiens
atgatattttagtaaagtgata

SEQ ID NO: 7290379 - DNA, 22 bp, Homo sapiens
ctttctgatccctgcaaccctc

SEQ ID NO: 7290380 - DNA, 22 bp, Homo sapiens
ctttctgattttaagctctaat

SEQ ID NO: 7290381 - DNA, 22 bp, Homo sapiens
ctttctgaaagacattttaact

SEQ ID NO: 7290382 - DNA, 22 bp, Homo sapiens
ctttctgaagtttaagttctaa

SEQ ID NO: 7290383 - DNA, 22 bp, Homo sapiens
atgaagacaaactgggtagaaa

SEQ ID NO: 7290384 - DNA, 22 bp, Homo sapiens
atgaacagtacaaagcacagac

SEQ ID NO: 7290385 - DNA, 22 bp, Homo sapiens
atgaacagtatgcaacatgatt

SEQ ID NO: 7290386 - DNA, 22 bp, Homo sapiens
atgcacaggtgctgatgcacgc

SEQ ID NO: 7290387 - DNA, 22 bp, Homo sapiens
atgcacaggaccacacataatg

SEQ ID NO: 7290388 - DNA, 22 bp, Homo sapiens
atgcacagatccccaggaccct

SEQ ID NO: 7290389 - DNA, 22 bp, Homo sapiens
atgcacagctgaacactctaaa

SEQ ID NO: 7290390 - DNA, 22 bp, Homo sapiens
gaccctggagccgtctgaggca

SEQ ID NO: 7290391 - DNA, 22 bp, Homo sapiens
gaccctggagttagtcctgtgt

SEQ ID NO: 7290392 - DNA, 22 bp, Homo sapiens
atgttgttccctctacacaggt

SEQ ID NO: 7290393 - DNA, 22 bp, Homo sapiens
gataattttagtctgaaaattg

SEQ ID NO: 7290394 - DNA, 22 bp, Homo sapiens
gataattttggttccaggttgg

SEQ ID NO: 7290395 - DNA, 22 bp, Homo sapiens
gataatttgatacctcaatcag

SEQ ID NO: 7290396 - DNA, 22 bp, Homo sapiens
gataatttctccatctcaaggt

SEQ ID NO: 7290397 - DNA, 22 bp, Homo sapiens
gataatttaagtcttgggggct

SEQ ID NO: 7290398 - DNA, 22 bp, Homo sapiens
atgtgacagtgtttgacagatg

SEQ ID NO: 7290399 - DNA, 22 bp, Homo sapiens
atgtgagggaaatcagtcagaa

SEQ ID NO: 7290400 - DNA, 22 bp, Homo sapiens
atgtgagcatcaccaggaggac

SEQ ID NO: 7290401 - DNA, 22 bp, Homo sapiens
atgtgagcagggagatgctgcc

SEQ ID NO: 7290402 - DNA, 22 bp, Homo sapiens
atgtgagcaggtgctggctgct

SEQ ID NO: 7290403 - DNA, 22 bp, Homo sapiens
atgtgaggcagcacggagatta

SEQ ID NO: 7290404 - DNA, 22 bp, Homo sapiens
atgtgagctggggcccggccag

SEQ ID NO: 7290405 - DNA, 22 bp, Homo sapiens
atgtgagctctcttctgattgg

SEQ ID NO: 7290406 - DNA, 22 bp, Homo sapiens
atgtgagctccggcaggtggaa

SEQ ID NO: 7290407 - DNA, 22 bp, Homo sapiens
gagggcagaaaattatgcggtg

SEQ ID NO: 7290408 - DNA, 19 bp, Homo sapiens
gagggctcatttgaacaat

SEQ ID NO: 7290409 - DNA, 22 bp, Homo sapiens
atgtcctgggctgggttatgtt

SEQ ID NO: 7290410 - DNA, 22 bp, Homo sapiens
atggagggaaaagtggagagcc

SEQ ID NO: 7290411 - DNA, 22 bp, Homo sapiens
atggttatgcaaacatgatgca

SEQ ID NO: 7290412 - DNA, 22 bp, Homo sapiens
atggtggacgggagacaggact

SEQ ID NO: 7290413 - DNA, 22 bp, Homo sapiens
gcagggctgagtcatgtgtgcc

SEQ ID NO: 7290414 - DNA, 18 bp, Homo sapiens
gcagggctgcacacgcat

SEQ ID NO: 7290415 - DNA, 22 bp, Homo sapiens
gcagggctgctgaaacttgttt

SEQ ID NO: 7290416 - DNA, 22 bp, Homo sapiens
attgatatattatttctaactg

SEQ ID NO: 7290417 - DNA, 22 bp, Homo sapiens
gcaggcctgcccagcaggatgg

SEQ ID NO: 7290418 - DNA, 22 bp, Homo sapiens
gcaggcctgtcttgctcgccct

SEQ ID NO: 7290419 - DNA, 22 bp, Homo sapiens
attctttagccagcaggtatat

SEQ ID NO: 7290420 - DNA, 22 bp, Homo sapiens
gccaagaagggccatgtggatt

SEQ ID NO: 7290421 - DNA, 22 bp, Homo sapiens
gccaagaagtatggttggggct

SEQ ID NO: 7290422 - DNA, 22 bp, Homo sapiens
attgtctgaatccaaagctctg

SEQ ID NO: 7290423 - DNA, 22 bp, Homo sapiens
attgtctctttcaataacttgt

SEQ ID NO: 7290424 - DNA, 23 bp, Homo sapiens
gcagtgcttggcacagctgggtc

SEQ ID NO: 7290425 - DNA, 22 bp, Homo sapiens
attgtcattccagtcattgtta

SEQ ID NO: 7290426 - DNA, 22 bp, Homo sapiens
attgtcattggcttctatgtct

SEQ ID NO: 7290427 - DNA, 22 bp, Homo sapiens
gcatattttcacaagctcttgg

SEQ ID NO: 7290428 - DNA, 22 bp, Homo sapiens
attcacattttatttcactgga

SEQ ID NO: 7290429 - DNA, 22 bp, Homo sapiens
attcacattgagcttcactgtg

SEQ ID NO: 7290430 - DNA, 22 bp, Homo sapiens
gcacgagtgtctcacggagtca

SEQ ID NO: 7290431 - DNA, 22 bp, Homo sapiens
attaggcagtgccattgtacgg

SEQ ID NO: 7290432 - DNA, 22 bp, Homo sapiens
gatatttaactctcacaggtcc

SEQ ID NO: 7290433 - DNA, 22 bp, Homo sapiens
attactgaggcaaagtagtttt

SEQ ID NO: 7290434 - DNA, 22 bp, Homo sapiens
atttccaggctgttttgtgaat

SEQ ID NO: 7290435 - DNA, 17 bp, Homo sapiens
gcccccagaaatctcag

SEQ ID NO: 7290436 - DNA, 22 bp, Homo sapiens
gcccccagaagggccacagatt

SEQ ID NO: 7290437 - DNA, 22 bp, Homo sapiens
gcccccaggcactacatgtgaa

SEQ ID NO: 7290438 - DNA, 22 bp, Homo sapiens
gcccccagctctcaagctcaaa

SEQ ID NO: 7290439 - DNA, 22 bp, Homo sapiens
gcccccaggctctggagaacct

SEQ ID NO: 7290440 - DNA, 22 bp, Homo sapiens
gcctcacagactgactgaaagc

SEQ ID NO: 7290441 - DNA, 22 bp, Homo sapiens
caaaagcagttctatctgagtt

SEQ ID NO: 7290442 - DNA, 22 bp, Homo sapiens
attttgtttcctttggagtaga

SEQ ID NO: 7290443 - DNA, 22 bp, Homo sapiens
attttgctgtggtacattagga

SEQ ID NO: 7290444 - DNA, 22 bp, Homo sapiens
attttgctttatgtaaatatgt

SEQ ID NO: 7290445 - DNA, 21 bp, Homo sapiens
caaaggactgtagctcactga

SEQ ID NO: 7290446 - DNA, 22 bp, Homo sapiens
caaagcgcagaggagcctccgg

SEQ ID NO: 7290447 - DNA, 22 bp, Homo sapiens
gctgacaggctctgtgtatgct

SEQ ID NO: 7290448 - DNA, 22 bp, Homo sapiens
ctggagaattctatgaaatatt

SEQ ID NO: 7290449 - DNA, 22 bp, Homo sapiens
atagatttgaatttaagacttg

SEQ ID NO: 7290450 - DNA, 22 bp, Homo sapiens
atagcaatcagtgtatttgaaa

SEQ ID NO: 7290451 - DNA, 22 bp, Homo sapiens
atagcaatgatcaagacagaca

SEQ ID NO: 7290452 - DNA, 22 bp, Homo sapiens
ctgcctctcaggtccctgagat

SEQ ID NO: 7290453 - DNA, 22 bp, Homo sapiens
ctgcctctattcactgaggcag

SEQ ID NO: 7290454 - DNA, 23 bp, Homo sapiens
ctgcattgtctcctgggagcatg

SEQ ID NO: 7290455 - DNA, 22 bp, Homo sapiens
ataaatgcctcagaatcatccc

SEQ ID NO: 7290456 - DNA, 22 bp, Homo sapiens
agttatttaaaatgattgtcct

SEQ ID NO: 7290457 - DNA, 22 bp, Homo sapiens
ctgatcattgttgttgctgtaa

SEQ ID NO: 7290458 - DNA, 22 bp, Homo sapiens
agttatttactcctttgtctct

SEQ ID NO: 7290459 - DNA, 22 bp, Homo sapiens
ctgcaagctacccctagcatca

SEQ ID NO: 7290460 - DNA, 22 bp, Homo sapiens
ctgcatgtgatgtggttagcta

SEQ ID NO: 7290461 - DNA, 22 bp, Homo sapiens
ctgcagggttttaacaatggac

SEQ ID NO: 7290462 - DNA, 22 bp, Homo sapiens
ctgcagagagtaactgaaatat

SEQ ID NO: 7290463 - DNA, 22 bp, Homo sapiens
ctgcagagatgaagaaggtggc

SEQ ID NO: 7290464 - DNA, 22 bp, Homo sapiens
ctgcagagcaagtaacatcctc

SEQ ID NO: 7290465 - DNA, 22 bp, Homo sapiens
ctgtggctaggattattcctga

SEQ ID NO: 7290466 - DNA, 22 bp, Homo sapiens
ctgtgtgtcatttgtcaatcct

SEQ ID NO: 7290467 - DNA, 22 bp, Homo sapiens
ctgtgtgtcatttgtcaatcct

SEQ ID NO: 7290468 - DNA, 22 bp, Homo sapiens
ctgtgtgtcctcggacgagttt

SEQ ID NO: 7290469 - DNA, 22 bp, Homo sapiens
cttcctcctccatctcgaaggc

SEQ ID NO: 7290470 - DNA, 22 bp, Homo sapiens
atctgagtctctgacagcatgt

SEQ ID NO: 7290471 - DNA, 22 bp, Homo sapiens
atcaacttaaagaaaagatact

SEQ ID NO: 7290472 - DNA, 22 bp, Homo sapiens
atcaaatcattgcattaatgtt

SEQ ID NO: 7290473 - DNA, 21 bp, Homo sapiens
atcagaaaatgtaatggagca

SEQ ID NO: 7290474 - DNA, 22 bp, Homo sapiens
atattatggccccatctaagct

SEQ ID NO: 7290475 - DNA, 22 bp, Homo sapiens
atattacataaacatgagtgaa

SEQ ID NO: 7290476 - DNA, 22 bp, Homo sapiens
atattataagttatttcaagtt

SEQ ID NO: 7290477 - DNA, 22 bp, Homo sapiens
atatgctaattagagggcatta

SEQ ID NO: 7290478 - DNA, 22 bp, Homo sapiens
ctcctggggcacttagaagcaa

SEQ ID NO: 7290479 - DNA, 22 bp, Homo sapiens
agtggcagagtgcactcaggca

SEQ ID NO: 7290480 - DNA, 22 bp, Homo sapiens
agtggcagaggttgactgcagt

SEQ ID NO: 7290481 - DNA, 18 bp, Homo sapiens
ctcatgtgtggtcccagc

SEQ ID NO: 7290482 - DNA, 22 bp, Homo sapiens
ctcatgcattctttttgtgtgt

SEQ ID NO: 7290483 - DNA, 22 bp, Homo sapiens
agtccggggtctggacacctgg

SEQ ID NO: 7290484 - DNA, 22 bp, Homo sapiens
agtcctcccttggggccacctt

SEQ ID NO: 7290485 - DNA, 22 bp, Homo sapiens
ctctgctgagccagagtcccca

SEQ ID NO: 7290486 - DNA, 22 bp, Homo sapiens
ctctcatgtagtatctgtatgg

SEQ ID NO: 7290487 - DNA, 22 bp, Homo sapiens
ctctcatgcaaaatttagttct

SEQ ID NO: 7290488 - DNA, 17 bp, Homo sapiens
ctctgcagtgcatggct

SEQ ID NO: 7290489 - DNA, 22 bp, Homo sapiens
ctgagaaacaatgaattgtgat

SEQ ID NO: 7290490 - DNA, 22 bp, Homo sapiens
ctgacagaatcattaagaccat

SEQ ID NO: 7290491 - DNA, 20 bp, Homo sapiens
ctgacagaaaatatttcatc

SEQ ID NO: 7290492 - DNA, 22 bp, Homo sapiens
agtacacagaattctacttgtt

SEQ ID NO: 7290493 - DNA, 22 bp, Homo sapiens
agtacactggcaaatgtggtgg

SEQ ID NO: 7290494 - DNA, 22 bp, Homo sapiens
agtacacagtatatggtgagat

SEQ ID NO: 7290495 - DNA, 22 bp, Homo sapiens
ctaagcaagaatgagtgcaaca

SEQ ID NO: 7290496 - DNA, 17 bp, Homo sapiens
cgggcatggagggcagg

SEQ ID NO: 7290497 - DNA, 22 bp, Homo sapiens
cgggcagtgtggctccagagtc

SEQ ID NO: 7290498 - DNA, 22 bp, Homo sapiens
cctgtgtttctgttggaattaa

SEQ ID NO: 7290499 - DNA, 19 bp, Homo sapiens
cgcaggcttcgggtcgctc

SEQ ID NO: 7290500 - DNA, 22 bp, Homo sapiens
agtatgttgacttattcttgga

SEQ ID NO: 7290501 - DNA, 22 bp, Homo sapiens
agtatttcctggcttatctgct

SEQ ID NO: 7290502 - DNA, 22 bp, Homo sapiens
agtatttcctggcttatctgct

SEQ ID NO: 7290503 - DNA, 20 bp, Homo sapiens
ctaagcactttgataaactg

SEQ ID NO: 7290504 - DNA, 22 bp, Homo sapiens
ctacccagcacctaggctgcct

SEQ ID NO: 7290505 - DNA, 22 bp, Homo sapiens
ctacccagatccaggatggcta

SEQ ID NO: 7290506 - DNA, 22 bp, Homo sapiens
agtccagggcttagtcagcggg

SEQ ID NO: 7290507 - DNA, 22 bp, Homo sapiens
aggtaggatgggtggagatgat

SEQ ID NO: 7290508 - DNA, 22 bp, Homo sapiens
aggtaggatagataggaagacc

SEQ ID NO: 7290509 - DNA, 22 bp, Homo sapiens
aggtagggttaatggagatata

SEQ ID NO: 7290510 - DNA, 20 bp, Homo sapiens
cctgtcatcccagcattttg

SEQ ID NO: 7290511 - DNA, 22 bp, Homo sapiens
cctgtcatttttatcaatgtct

SEQ ID NO: 7290512 - DNA, 18 bp, Homo sapiens
cctgtgacagaggcatca

SEQ ID NO: 7290513 - DNA, 22 bp, Homo sapiens
cctgtgaggtcttgcatgtgaa

SEQ ID NO: 7290514 - DNA, 22 bp, Homo sapiens
cctgtgcatccggtggtcattg

SEQ ID NO: 7290515 - DNA, 22 bp, Homo sapiens
ccctggcagagggggcaggtgc

SEQ ID NO: 7290516 - DNA, 19 bp, Homo sapiens
ccctggcaggcaagcctgg

SEQ ID NO: 7290517 - DNA, 22 bp, Homo sapiens
ccctggcactagcgacggccat

SEQ ID NO: 7290518 - DNA, 22 bp, Homo sapiens
agggctgagcccaggcatgtag

SEQ ID NO: 7290519 - DNA, 22 bp, Homo sapiens
cctacagttatattcttgattg

SEQ ID NO: 7290520 - DNA, 22 bp, Homo sapiens
aggggctgcctggcttggcact

SEQ ID NO: 7290521 - DNA, 22 bp, Homo sapiens
aggggcgtgctcttccccgacg

SEQ ID NO: 7290522 - DNA, 22 bp, Homo sapiens
aggggcgtgctcttccccgacg

SEQ ID NO: 7290523 - DNA, 22 bp, Homo sapiens
cctcgacctccccaggctcagg

SEQ ID NO: 7290524 - DNA, 20 bp, Homo sapiens
cctctgtgtcctgtgtcata

SEQ ID NO: 7290525 - DNA, 22 bp, Homo sapiens
cctctgtgtctccaagaggcct

SEQ ID NO: 7290526 - DNA, 22 bp, Homo sapiens
cctctgtgtcttggtttcaaga

SEQ ID NO: 7290527 - DNA, 22 bp, Homo sapiens
cctctgtgtgatgcgcaaagta

SEQ ID NO: 7290528 - DNA, 22 bp, Homo sapiens
cctctgtgtgtgcatgcatgcg

SEQ ID NO: 7290529 - DNA, 22 bp, Homo sapiens
cctctgtgggccgggcctgctg

SEQ ID NO: 7290530 - DNA, 22 bp, Homo sapiens
cctctgtggtctgtctaatgca

SEQ ID NO: 7290531 - DNA, 22 bp, Homo sapiens
cctctgtgtcagggaagagact

SEQ ID NO: 7290532 - DNA, 22 bp, Homo sapiens
cctctgtgtcctggtcattgaa

SEQ ID NO: 7290533 - DNA, 22 bp, Homo sapiens
aggcttggctctcctatgagaa

SEQ ID NO: 7290534 - DNA, 22 bp, Homo sapiens
cccaggaagttgagactgcagt

SEQ ID NO: 7290535 - DNA, 22 bp, Homo sapiens
cccaggtgctgcgtgaagcctc

SEQ ID NO: 7290536 - DNA, 20 bp, Homo sapiens
cccaggtgtctgaagctctg

SEQ ID NO: 7290537 - DNA, 22 bp, Homo sapiens
cccaggtgggttggcctctgtc

SEQ ID NO: 7290538 - DNA, 23 bp, Homo sapiens
cccaggtgtggaggcggtggcag

SEQ ID NO: 7290539 - DNA, 19 bp, Homo sapiens
cccaggtgtttgaggctgc

SEQ ID NO: 7290540 - DNA, 22 bp, Homo sapiens
agggcatgtgggagaggagcct

SEQ ID NO: 7290541 - DNA, 22 bp, Homo sapiens
agggcatgctggaggagagaca

SEQ ID NO: 7290542 - DNA, 22 bp, Homo sapiens
agggccacagtaatgctgagta

SEQ ID NO: 7290543 - DNA, 22 bp, Homo sapiens
aggcctgggacgggagccgtga

SEQ ID NO: 7290544 - DNA, 22 bp, Homo sapiens
ccagctccctgaagcctggtct

SEQ ID NO: 7290545 - DNA, 23 bp, Homo sapiens
ccagccctccaccagctctaggc

SEQ ID NO: 7290546 - DNA, 22 bp, Homo sapiens
ccactcccttccggtccagggc

SEQ ID NO: 7290547 - DNA, 22 bp, Homo sapiens
ccaggtggtgaaagtgggccct

SEQ ID NO: 7290548 - DNA, 22 bp, Homo sapiens
ccagggcagaaaaagagggaat

SEQ ID NO: 7290549 - DNA, 22 bp, Homo sapiens
ccaggtggttcaggtcaccata

SEQ ID NO: 7290550 - DNA, 22 bp, Homo sapiens
ccaggtgtttggcctgcatgat

SEQ ID NO: 7290551 - DNA, 22 bp, Homo sapiens
ccagtgtatttttgggacctgc

SEQ ID NO: 7290552 - DNA, 22 bp, Homo sapiens
ccattttctgcagctgccgcgg

SEQ ID NO: 7290553 - DNA, 22 bp, Homo sapiens
ccagtgggtaggccatggtgag

SEQ ID NO: 7290554 - DNA, 22 bp, Homo sapiens
cccacgtcgaacttgctccaga

SEQ ID NO: 7290555 - DNA, 22 bp, Homo sapiens
aggctgtggccctggtctagca

SEQ ID NO: 7290556 - DNA, 20 bp, Homo sapiens
cccagaggttgcggcaggag

SEQ ID NO: 7290557 - DNA, 22 bp, Homo sapiens
catgagactgccttttcaaacc

SEQ ID NO: 7290558 - DNA, 22 bp, Homo sapiens
catgagaatgaagaagacttaa

SEQ ID NO: 7290559 - DNA, 22 bp, Homo sapiens
catgaggatccaggtgacaggc

SEQ ID NO: 7290560 - DNA, 20 bp, Homo sapiens
catctcctgcctccatgttc

SEQ ID NO: 7290561 - DNA, 22 bp, Homo sapiens
catctcctttggtctacttcca

SEQ ID NO: 7290562 - DNA, 22 bp, Homo sapiens
aggagccagcgttcctcaggat

SEQ ID NO: 7290563 - DNA, 22 bp, Homo sapiens
aggagccagattctctcacttt

SEQ ID NO: 7290564 - DNA, 22 bp, Homo sapiens
aggagccaggccccatggggct

SEQ ID NO: 7290565 - DNA, 22 bp, Homo sapiens
cagtatttgttccctatcaatg

SEQ ID NO: 7290566 - DNA, 22 bp, Homo sapiens
catttcaaacagttacagctgc

SEQ ID NO: 7290567 - DNA, 22 bp, Homo sapiens
catttcaatacagtttgtaaat

SEQ ID NO: 7290568 - DNA, 22 bp, Homo sapiens
ccacccagcagaggaggcaaga

SEQ ID NO: 7290569 - DNA, 22 bp, Homo sapiens
ccactattactgtgtggcagtc

SEQ ID NO: 7290570 - DNA, 22 bp, Homo sapiens
ccacagttcatgcactggggct

SEQ ID NO: 7290571 - DNA, 23 bp, Homo sapiens
ccacagttcatcgttcactcacc

SEQ ID NO: 7290572 - DNA, 22 bp, Homo sapiens
ccacagttattcatttgtgaca

SEQ ID NO: 7290573 - DNA, 22 bp, Homo sapiens
ccacagtttaggaagtcactct

SEQ ID NO: 7290574 - DNA, 22 bp, Homo sapiens
ccacagttgctgaaatcgctta

SEQ ID NO: 7290575 - DNA, 21 bp, Homo sapiens
ccacagttctggcaagggctg

SEQ ID NO: 7290576 - DNA, 22 bp, Homo sapiens
ccacagtttgccaacacctact

SEQ ID NO: 7290577 - DNA, 22 bp, Homo sapiens
ccacagtttcttcatctataaa

SEQ ID NO: 7290578 - DNA, 22 bp, Homo sapiens
ccacagtttgccagccaggaat

SEQ ID NO: 7290579 - DNA, 22 bp, Homo sapiens
cagggctgttagctgctgctct

SEQ ID NO: 7290580 - DNA, 23 bp, Homo sapiens
cagggctgggcttggtgttaggc

SEQ ID NO: 7290581 - DNA, 22 bp, Homo sapiens
cagggctggcttccaagttgtt

SEQ ID NO: 7290582 - DNA, 21 bp, Homo sapiens
aggaaaggccagcacgtaggg

SEQ ID NO: 7290583 - DNA, 22 bp, Homo sapiens
aggaagaaacctactagagttt

SEQ ID NO: 7290584 - DNA, 22 bp, Homo sapiens
cagtatttgttacagcattagc

SEQ ID NO: 7290585 - DNA, 22 bp, Homo sapiens
cagtatttcctcttcttaactt

SEQ ID NO: 7290586 - DNA, 22 bp, Homo sapiens
cagtatttggaatatagctaag

SEQ ID NO: 7290587 - DNA, 22 bp, Homo sapiens
caggcagcctgcggtctgcaca

SEQ ID NO: 7290588 - DNA, 22 bp, Homo sapiens
caggcaggtcagtgaagaagga

SEQ ID NO: 7290589 - DNA, 22 bp, Homo sapiens
agctggtggagaagcagacctc

SEQ ID NO: 7290590 - DNA, 22 bp, Homo sapiens
agctggtggaagggagcccaaa

SEQ ID NO: 7290591 - DNA, 22 bp, Homo sapiens
agcttctagcccatccagcagg

SEQ ID NO: 7290592 - DNA, 22 bp, Homo sapiens
caggagcagagggtggtcagca

SEQ ID NO: 7290593 - DNA, 22 bp, Homo sapiens
cagctggtgtcaggcactgcag

SEQ ID NO: 7290594 - DNA, 22 bp, Homo sapiens
cagctggtggctgatgaccgtc

SEQ ID NO: 7290595 - DNA, 22 bp, Homo sapiens
cagctggtcaactgaatgaaca

SEQ ID NO: 7290596 - DNA, 22 bp, Homo sapiens
cagctggtaggtagcagatttg

SEQ ID NO: 7290597 - DNA, 22 bp, Homo sapiens
cagctggttatcagagaggcct

SEQ ID NO: 7290598 - DNA, 22 bp, Homo sapiens
cagctggttgaagaggagctgg

SEQ ID NO: 7290599 - DNA, 22 bp, Homo sapiens
cagctggttcagtgtctggtga

SEQ ID NO: 7290600 - DNA, 22 bp, Homo sapiens
cagctggttttagcacagttag

SEQ ID NO: 7290601 - DNA, 22 bp, Homo sapiens
agggccagcactcctggcagga

SEQ ID NO: 7290602 - DNA, 22 bp, Homo sapiens
agggccagcagcttggccaacc

SEQ ID NO: 7290603 - DNA, 22 bp, Homo sapiens
agggcacaagactctgagcccc

SEQ ID NO: 7290604 - DNA, 22 bp, Homo sapiens
agggctgaagttatggctgagc

SEQ ID NO: 7290605 - DNA, 22 bp, Homo sapiens
agggctgaagggaggtgctcat

SEQ ID NO: 7290606 - DNA, 22 bp, Homo sapiens
acctcatctggtttgtaaggca

SEQ ID NO: 7290607 - DNA, 22 bp, Homo sapiens
aggcagtgtgtagctggaagag

SEQ ID NO: 7290608 - DNA, 22 bp, Homo sapiens
acagtgagatccaagggcaggc

SEQ ID NO: 7290609 - DNA, 22 bp, Homo sapiens
acagtgagcccactccaggaga

SEQ ID NO: 7290610 - DNA, 22 bp, Homo sapiens
acagtgaggaagcagctgtgct

SEQ ID NO: 7290611 - DNA, 21 bp, Homo sapiens
acagtgagaaataaatggaaa

SEQ ID NO: 7290612 - DNA, 22 bp, Homo sapiens
acagtgttacttgatagtgtat

SEQ ID NO: 7290613 - DNA, 22 bp, Homo sapiens
aggaaaggtagcgtgccagcag

SEQ ID NO: 7290614 - DNA, 22 bp, Homo sapiens
acagggctatattcctcagagt

SEQ ID NO: 7290615 - DNA, 22 bp, Homo sapiens
aggacacaggtaagccagtgga

SEQ ID NO: 7290616 - DNA, 23 bp, Homo sapiens
acagggctagctgacagtggtat

SEQ ID NO: 7290617 - DNA, 22 bp, Homo sapiens
acagggctatattcctcagagc

SEQ ID NO: 7290618 - DNA, 22 bp, Homo sapiens
aggacaggtgtagtgggctctg

SEQ ID NO: 7290619 - DNA, 23 bp, Homo sapiens
acaggaatttgtgcaccatgaag

SEQ ID NO: 7290620 - DNA, 22 bp, Homo sapiens
acaggacaatttataatgggca

SEQ ID NO: 7290621 - DNA, 22 bp, Homo sapiens
acaggacaaaaatctggatggc

SEQ ID NO: 7290622 - DNA, 22 bp, Homo sapiens
acaggacatgtaccaggtggtc

SEQ ID NO: 7290623 - DNA, 22 bp, Homo sapiens
acaggacatggcttctgtgacg

SEQ ID NO: 7290624 - DNA, 22 bp, Homo sapiens
ataggacaagactgaccctggt

SEQ ID NO: 7290625 - DNA, 22 bp, Homo sapiens
atagctgttgccaatttccatg

SEQ ID NO: 7290626 - DNA, 22 bp, Homo sapiens
atagctactgatgacacacaca

SEQ ID NO: 7290627 - DNA, 22 bp, Homo sapiens
atagctaccatgttggacagta

SEQ ID NO: 7290628 - DNA, 17 bp, Homo sapiens
agaaaagagaccagcag

SEQ ID NO: 7290629 - DNA, 22 bp, Homo sapiens
atacaagttgtgataatgtaaa

SEQ ID NO: 7290630 - DNA, 22 bp, Homo sapiens
agttcagcaaataaaacatagt

SEQ ID NO: 7290631 - DNA, 20 bp, Homo sapiens
agttcacaggccaaatttct

SEQ ID NO: 7290632 - DNA, 22 bp, Homo sapiens
agttgcagacgcagagatgttg

SEQ ID NO: 7290633 - DNA, 22 bp, Homo sapiens
agaaagaacgttggttatctta

SEQ ID NO: 7290634 - DNA, 22 bp, Homo sapiens
agaaagaacgcacttgtgctgc

SEQ ID NO: 7290635 - DNA, 22 bp, Homo sapiens
atattaattatttacacatgag

SEQ ID NO: 7290636 - DNA, 22 bp, Homo sapiens
agaaatcaatatctatatgttg

SEQ ID NO: 7290637 - DNA, 22 bp, Homo sapiens
agaaatcagaaccctgaagttc

SEQ ID NO: 7290638 - DNA, 20 bp, Homo sapiens
agaaatcagaccacacacta

SEQ ID NO: 7290639 - DNA, 20 bp, Homo sapiens
agaaatcagaccacacacta

SEQ ID NO: 7290640 - DNA, 22 bp, Homo sapiens
atcaagagtattgacaagacca

SEQ ID NO: 7290641 - DNA, 22 bp, Homo sapiens
agaagccaaatgccagtgacct

SEQ ID NO: 7290642 - DNA, 22 bp, Homo sapiens
agaagccaaaggggccagatat

SEQ ID NO: 7290643 - DNA, 22 bp, Homo sapiens
agaagcagttattttttgcaca

SEQ ID NO: 7290644 - DNA, 18 bp, Homo sapiens
agaagcaggtaaaattct

SEQ ID NO: 7290645 - DNA, 18 bp, Homo sapiens
agaagcaggttctcccag

SEQ ID NO: 7290646 - DNA, 22 bp, Homo sapiens
agaagcaggcctcacagatctg

SEQ ID NO: 7290647 - DNA, 22 bp, Homo sapiens
agaagcagggcagggaaaagca

SEQ ID NO: 7290648 - DNA, 22 bp, Homo sapiens
agaagcaggcagatttcagctc

SEQ ID NO: 7290649 - DNA, 19 bp, Homo sapiens
agttatttctaaatttacc

SEQ ID NO: 7290650 - DNA, 22 bp, Homo sapiens
agtgtgtgaccttttaatttaa

SEQ ID NO: 7290651 - DNA, 22 bp, Homo sapiens
agtgattttatcaatttactca

SEQ ID NO: 7290652 - DNA, 22 bp, Homo sapiens
agtgaattagcctatttgtaaa

SEQ ID NO: 7290653 - DNA, 22 bp, Homo sapiens
agtgagcaacagaagcgtgggt

SEQ ID NO: 7290654 - DNA, 22 bp, Homo sapiens
agtgagcaagacttcgttgtcc

SEQ ID NO: 7290655 - DNA, 21 bp, Homo sapiens
agtgagcatccagagaggtgg

SEQ ID NO: 7290656 - DNA, 22 bp, Homo sapiens
agtgagcatcttcaggagccaa

SEQ ID NO: 7290657 - DNA, 22 bp, Homo sapiens
agtgagcatccagagaggtggg

SEQ ID NO: 7290658 - DNA, 22 bp, Homo sapiens
agtgaggctaataggcaatggt

SEQ ID NO: 7290659 - DNA, 20 bp, Homo sapiens
agtgaggcagttcagtgggc

SEQ ID NO: 7290660 - DNA, 22 bp, Homo sapiens
agtgagccataagggctgccac

SEQ ID NO: 7290661 - DNA, 22 bp, Homo sapiens
agtaagacccagtcacttgaga

SEQ ID NO: 7290662 - DNA, 22 bp, Homo sapiens
aggtgaggataggtggccaagg

SEQ ID NO: 7290663 - DNA, 22 bp, Homo sapiens
agggtcagtgatgagggagccc

SEQ ID NO: 7290664 - DNA, 20 bp, Homo sapiens
aggtgtccacgtggcagggt

SEQ ID NO: 7290665 - DNA, 22 bp, Homo sapiens
aggtggagaagagatgggcagt

SEQ ID NO: 7290666 - DNA, 22 bp, Homo sapiens
cacaggctcttctcacttgatt

SEQ ID NO: 7290667 - DNA, 23 bp, Homo sapiens
cacatggattaaatgagaccaca

SEQ ID NO: 7290668 - DNA, 22 bp, Homo sapiens
agcaggtggccacgaggaggag

SEQ ID NO: 7290669 - DNA, 22 bp, Homo sapiens
agcaggtggccacgaggaggag

SEQ ID NO: 7290670 - DNA, 22 bp, Homo sapiens
cacattgtaggtctcagctctt

SEQ ID NO: 7290671 - DNA, 22 bp, Homo sapiens
cacgttttatgacagaagaagc

SEQ ID NO: 7290672 - DNA, 22 bp, Homo sapiens
cactggtcagtcggtcagtctc

SEQ ID NO: 7290673 - DNA, 22 bp, Homo sapiens
cagaaagacctgattggcagtt

SEQ ID NO: 7290674 - DNA, 22 bp, Homo sapiens
cactgcacttcagcctgggtga

SEQ ID NO: 7290675 - DNA, 22 bp, Homo sapiens
cactgcactccagcccgggcaa

SEQ ID NO: 7290676 - DNA, 22 bp, Homo sapiens
cacaggaaatattaggagggat

SEQ ID NO: 7290677 - DNA, 22 bp, Homo sapiens
caatttttgtacttatagtact

SEQ ID NO: 7290678 - DNA, 20 bp, Homo sapiens
agcaattgtgaacttattca

SEQ ID NO: 7290679 - DNA, 22 bp, Homo sapiens
agcaattggaatttagacaaga

SEQ ID NO: 7290680 - DNA, 22 bp, Homo sapiens
cagcatcaccaacttgagcaat

SEQ ID NO: 7290681 - DNA, 22 bp, Homo sapiens
cagcactttagcggaggcatca

SEQ ID NO: 7290682 - DNA, 22 bp, Homo sapiens
cagcactgggaccactagaaca

SEQ ID NO: 7290683 - DNA, 22 bp, Homo sapiens
cagcactgtgataactgagcca

SEQ ID NO: 7290684 - DNA, 22 bp, Homo sapiens
cagcactggggccactggagtt

SEQ ID NO: 7290685 - DNA, 22 bp, Homo sapiens
agcgagggaggtctgaggacag

SEQ ID NO: 7290686 - DNA, 22 bp, Homo sapiens
agcgccactgcactccagcctg

SEQ ID NO: 7290687 - DNA, 22 bp, Homo sapiens
cagcctcctgggacactcaccg

SEQ ID NO: 7290688 - DNA, 22 bp, Homo sapiens
cagcccagtgcacgcccgtttc

SEQ ID NO: 7290689 - DNA, 22 bp, Homo sapiens
cagccagtgtgaccgaggagga

SEQ ID NO: 7290690 - DNA, 22 bp, Homo sapiens
cagcccagagaaggggcccgtg

SEQ ID NO: 7290691 - DNA, 19 bp, Homo sapiens
cagcccagggtgctaccaa

SEQ ID NO: 7290692 - DNA, 21 bp, Homo sapiens
cagcccagagcagtggggcca

SEQ ID NO: 7290693 - DNA, 22 bp, Homo sapiens
cagcgctggggtaggagcacct

SEQ ID NO: 7290694 - DNA, 22 bp, Homo sapiens
cagagccaggtctaggagtctc

SEQ ID NO: 7290695 - DNA, 22 bp, Homo sapiens
cagagccagtcagtcagaaact

SEQ ID NO: 7290696 - DNA, 22 bp, Homo sapiens
cagagctgttgcggggcttggc

SEQ ID NO: 7290697 - DNA, 20 bp, Homo sapiens
cagagctgttatggatgatg

SEQ ID NO: 7290698 - DNA, 22 bp, Homo sapiens
agcctgagtgcttaggactgtt

SEQ ID NO: 7290699 - DNA, 22 bp, Homo sapiens
agcccttagtacatttctcaag

SEQ ID NO: 7290700 - DNA, 22 bp, Homo sapiens
atttgaaatctgggttactctg

SEQ ID NO: 7290701 - DNA, 22 bp, Homo sapiens
atttgaaatcccttctactgta

SEQ ID NO: 7290702 - DNA, 22 bp, Homo sapiens
agattctaccagagctagtttg

SEQ ID NO: 7290703 - DNA, 22 bp, Homo sapiens
agatttagtggtggaattttgg

SEQ ID NO: 7290704 - DNA, 22 bp, Homo sapiens
agatttcaatgtgagcattagt

SEQ ID NO: 7290705 - DNA, 22 bp, Homo sapiens
agatttatgtggtcacactcag

SEQ ID NO: 7290706 - DNA, 22 bp, Homo sapiens
attttgttgatggtggagtagc

SEQ ID NO: 7290707 - DNA, 22 bp, Homo sapiens
attttgttgaggtaattgtcaa

SEQ ID NO: 7290708 - DNA, 22 bp, Homo sapiens
caaagtttaaagtagatttcag

SEQ ID NO: 7290709 - DNA, 22 bp, Homo sapiens
caaagttttagtaaacatatat

SEQ ID NO: 7290710 - DNA, 22 bp, Homo sapiens
agaggaagccattgcttactga

SEQ ID NO: 7290711 - DNA, 22 bp, Homo sapiens
attgagaagaaaatctaatata

SEQ ID NO: 7290712 - DNA, 22 bp, Homo sapiens
attgtataacagcatgtatttt

SEQ ID NO: 7290713 - DNA, 22 bp, Homo sapiens
attgagcagcttctctgccatc

SEQ ID NO: 7290714 - DNA, 22 bp, Homo sapiens
attgagcacctactttgtgcca

SEQ ID NO: 7290715 - DNA, 22 bp, Homo sapiens
attgagcacaaacgttactaga

SEQ ID NO: 7290716 - DNA, 23 bp, Homo sapiens
attgagcaagcttttgcctaagt

SEQ ID NO: 7290717 - DNA, 19 bp, Homo sapiens
attgagcattacaaataga

SEQ ID NO: 7290718 - DNA, 22 bp, Homo sapiens
attgagagtgtatagctgatct

SEQ ID NO: 7290719 - DNA, 22 bp, Homo sapiens
agatacaaaggcctacagagca

SEQ ID NO: 7290720 - DNA, 22 bp, Homo sapiens
agatacaactgtttaaacatta

SEQ ID NO: 7290721 - DNA, 22 bp, Homo sapiens
attgtgtggtgaatgatcagct

SEQ ID NO: 7290722 - DNA, 22 bp, Homo sapiens
agagaacattagcaaaaacagc

SEQ ID NO: 7290723 - DNA, 22 bp, Homo sapiens
agagaacagtgttttgaaggag

SEQ ID NO: 7290724 - DNA, 22 bp, Homo sapiens
atggacaggtggataggtggat

SEQ ID NO: 7290725 - DNA, 22 bp, Homo sapiens
atggacaggtactgcagtgggt

SEQ ID NO: 7290726 - DNA, 22 bp, Homo sapiens
agagagaagcaatcagtggcca

SEQ ID NO: 7290727 - DNA, 22 bp, Homo sapiens
atgtagttgaagtgctataaag

SEQ ID NO: 7290728 - DNA, 22 bp, Homo sapiens
atgtatatgaagctagtatttt

SEQ ID NO: 7290729 - DNA, 21 bp, Homo sapiens
atgttcactgggtcaattaga

SEQ ID NO: 7290730 - DNA, 22 bp, Homo sapiens
atgttacagaaagcaaagatga

SEQ ID NO: 7290731 - DNA, 22 bp, Homo sapiens
agagaacagcattgcagctttg

SEQ ID NO: 7290732 - DNA, 22 bp, Homo sapiens
agagaacaaattaaaggtggtt

SEQ ID NO: 7290733 - DNA, 22 bp, Homo sapiens
agagaaaagccatcccagccaa

SEQ ID NO: 7290734 - DNA, 22 bp, Homo sapiens
atgctgacttctctctgcagtg

SEQ ID NO: 7290735 - DNA, 22 bp, Homo sapiens
atgctaaaaacttgatcattat

SEQ ID NO: 7290736 - DNA, 22 bp, Homo sapiens
atgctaaactatgatcattttc

SEQ ID NO: 7290737 - DNA, 22 bp, Homo sapiens
agacataattaattagttctac

SEQ ID NO: 7290738 - DNA, 22 bp, Homo sapiens
atgccacataattacaaataga

SEQ ID NO: 7290739 - DNA, 22 bp, Homo sapiens
atgactgttatgggactggaac

SEQ ID NO: 7290740 - DNA, 22 bp, Homo sapiens
atgaccagccgagataaacaga

SEQ ID NO: 7290741 - DNA, 22 bp, Homo sapiens
atgagaaaattgaggcccatag

SEQ ID NO: 7290742 - DNA, 22 bp, Homo sapiens
atgacttctgcaaggtcatttg

SEQ ID NO: 7290743 - DNA, 22 bp, Homo sapiens
atgatttccagttgttgctaag

SEQ ID NO: 7290744 - DNA, 22 bp, Homo sapiens
atgattttctgataaagaactg

SEQ ID NO: 7290745 - DNA, 20 bp, Homo sapiens
atgattcatgatgatgtctc

SEQ ID NO: 7290746 - DNA, 22 bp, Homo sapiens
atgattgaccatctgctgggct

SEQ ID NO: 7290747 - DNA, 22 bp, Homo sapiens
atgattgaaaatgacattgcca

SEQ ID NO: 7290748 - DNA, 22 bp, Homo sapiens
aagcccagcatccctgcaccag

SEQ ID NO: 7290749 - DNA, 22 bp, Homo sapiens
aagcccagtttcacactgagac

SEQ ID NO: 7290750 - DNA, 22 bp, Homo sapiens
aagcccaggtaagtggctcatg

SEQ ID NO: 7290751 - DNA, 22 bp, Homo sapiens
acagcaggaagctggagggaaa

SEQ ID NO: 7290752 - DNA, 22 bp, Homo sapiens
aagcataaaacgttacaacatg

SEQ ID NO: 7290753 - DNA, 18 bp, Homo sapiens
acagaaatagctgtgcct

SEQ ID NO: 7290754 - DNA, 22 bp, Homo sapiens
acagacatttaataaatgctga

SEQ ID NO: 7290755 - DNA, 22 bp, Homo sapiens
acagacctgggcacagaaagga

SEQ ID NO: 7290756 - DNA, 22 bp, Homo sapiens
acaatatagtccatgagcatgc

SEQ ID NO: 7290757 - DNA, 22 bp, Homo sapiens
acacagcaacttgcagtatgga

SEQ ID NO: 7290758 - DNA, 20 bp, Homo sapiens
acacagactcagcttggatg

SEQ ID NO: 7290759 - DNA, 22 bp, Homo sapiens
acacagccgtgaatctgcttct

SEQ ID NO: 7290760 - DNA, 22 bp, Homo sapiens
aagaagatggttaactttcagt

SEQ ID NO: 7290761 - DNA, 22 bp, Homo sapiens
aatgtacaataagacaaagagg

SEQ ID NO: 7290762 - DNA, 22 bp, Homo sapiens
aagaatcatctgaactttgagg

SEQ ID NO: 7290763 - DNA, 17 bp, Homo sapiens
aagaatcattagagaag

SEQ ID NO: 7290764 - DNA, 22 bp, Homo sapiens
aagaatcatagagccactgata

SEQ ID NO: 7290765 - DNA, 22 bp, Homo sapiens
aaggccaggtccctgcagtgca

SEQ ID NO: 7290766 - DNA, 22 bp, Homo sapiens
aagtaatctggaatttggtttt

SEQ ID NO: 7290767 - DNA, 22 bp, Homo sapiens
aagtacaacgcatacagagaaa

SEQ ID NO: 7290768 - DNA, 22 bp, Homo sapiens
aacagtttatcaagtttttaca

SEQ ID NO: 7290769 - DNA, 22 bp, Homo sapiens
aacagtttatgagatatgctat

SEQ ID NO: 7290770 - DNA, 22 bp, Homo sapiens
aacagtttatgataaattctta

SEQ ID NO: 7290771 - DNA, 22 bp, Homo sapiens
aatatttcgttgcgtggctaga

SEQ ID NO: 7290772 - DNA, 22 bp, Homo sapiens
aatctcatgagcttcttgtccc

SEQ ID NO: 7290773 - DNA, 22 bp, Homo sapiens
aatgaaatgtagcttatccata

SEQ ID NO: 7290774 - DNA, 21 bp, Homo sapiens
aatgatgaaagatgacagagt

SEQ ID NO: 7290775 - DNA, 22 bp, Homo sapiens
aatgcacatgttgtaataaata

SEQ ID NO: 7290776 - DNA, 22 bp, Homo sapiens
aatgcacatatatgtgtataca

SEQ ID NO: 7290777 - DNA, 22 bp, Homo sapiens
aacatgatgacaaaggtatatt

SEQ ID NO: 7290778 - DNA, 22 bp, Homo sapiens
aacttctgcttttacaggcagt

SEQ ID NO: 7290779 - DNA, 22 bp, Homo sapiens
aacttctgcagaaaagtgcatg

SEQ ID NO: 7290780 - DNA, 22 bp, Homo sapiens
aacttctgacctcaagaactgt

SEQ ID NO: 7290781 - DNA, 22 bp, Homo sapiens
aaagcaggttgcaattacagtg

SEQ ID NO: 7290782 - DNA, 22 bp, Homo sapiens
aaattgtataatgttccagctg

SEQ ID NO: 7290783 - DNA, 22 bp, Homo sapiens
aaattgtcagaattcagaaagt

SEQ ID NO: 7290784 - DNA, 22 bp, Homo sapiens
aaattagatatgtgtgagactc

SEQ ID NO: 7290785 - DNA, 22 bp, Homo sapiens
aaagacatgacacattggagag

SEQ ID NO: 7290786 - DNA, 22 bp, Homo sapiens
aaattcagatggctttcttttc

SEQ ID NO: 7290787 - DNA, 22 bp, Homo sapiens
aaagcatcagatctgacacttc

SEQ ID NO: 7290788 - DNA, 21 bp, Homo sapiens
aaagcatcacgaacatttggg

SEQ ID NO: 7290789 - DNA, 22 bp, Homo sapiens
aaatacagtggcagcagataat

SEQ ID NO: 7290790 - DNA, 22 bp, Homo sapiens
aaatacagtgtgtgttctttga

SEQ ID NO: 7290791 - DNA, 22 bp, Homo sapiens
aaatacagattcttgtgtctat

SEQ ID NO: 7290792 - DNA, 22 bp, Homo sapiens
aaatacagattctgactcagag

SEQ ID NO: 7290793 - DNA, 19 bp, Homo sapiens
aaatacagcagctgtttcc

SEQ ID NO: 7290794 - DNA, 22 bp, Homo sapiens
aaatacaggagtttggacttct

SEQ ID NO: 7290795 - DNA, 22 bp, Homo sapiens
aagaagcatggctgtagattcc

SEQ ID NO: 7290796 - DNA, 22 bp, Homo sapiens
aagagagagtgcgctcacagaa

SEQ ID NO: 7290797 - DNA, 22 bp, Homo sapiens
aaatcacagggtctctaagtat

SEQ ID NO: 7290798 - DNA, 22 bp, Homo sapiens
aaagacagatggcaaggatgat

SEQ ID NO: 7290799 - DNA, 22 bp, Homo sapiens
aaagacagtggattcaaaatcc

SEQ ID NO: 7290800 - DNA, 22 bp, Homo sapiens
aaagacagatggcaaggatgat

SEQ ID NO: 7290801 - DNA, 22 bp, Homo sapiens
aaacttagtagagttcatatta

SEQ ID NO: 7290802 - DNA, 22 bp, Homo sapiens
aaatggtgtttctaatgctaga

SEQ ID NO: 7290803 - DNA, 22 bp, Homo sapiens
aaatggtgttgtatttagtctc

SEQ ID NO: 7290804 - DNA, 22 bp, Homo sapiens
aaatggtggctcttttaaattg

SEQ ID NO: 7290805 - DNA, 22 bp, Homo sapiens
aaatgacactcattcagtgtca

SEQ ID NO: 7290806 - DNA, 22 bp, Homo sapiens
aaatgacagttctctctgagta

SEQ ID NO: 7290807 - DNA, 22 bp, Homo sapiens
aaactgttcctttttcagcaac

SEQ ID NO: 7290808 - DNA, 22 bp, Homo sapiens
aaatgacaataaaagtccatgc

SEQ ID NO: 7290809 - DNA, 22 bp, Homo sapiens
aaatgacactaggctttttgca

SEQ ID NO: 7290810 - DNA, 22 bp, Homo sapiens
aaatccagtttgtcatttccca

SEQ ID NO: 7290811 - DNA, 21 bp, Homo sapiens
aaatacagaaacttgttttca

SEQ ID NO: 7290812 - DNA, 22 bp, Homo sapiens
aaagtacacacagagccaagaa

SEQ ID NO: 7290813 - DNA, 22 bp, Homo sapiens
aaagttttattcaagcattagt

SEQ ID NO: 7290814 - DNA, 22 bp, Homo sapiens
aaagcagccactctctctgcct

SEQ ID NO: 7290815 - DNA, 22 bp, Homo sapiens
aaagcagcagcacctgcatttc

SEQ ID NO: 7290816 - DNA, 22 bp, Homo sapiens
aaagcagcctgctcatcctgga

SEQ ID NO: 7290817 - DNA, 22 bp, Homo sapiens
aaaattgtaggaactgaatcaa

SEQ ID NO: 7290818 - DNA, 22 bp, Homo sapiens
aaaatgcaaacctacctacata

SEQ ID NO: 7290819 - DNA, 22 bp, Homo sapiens
aaaatacacatactaggggaaa

SEQ ID NO: 7290820 - DNA, 22 bp, Homo sapiens
aaaagcatctcaaaggagcttc

SEQ ID NO: 7290821 - DNA, 22 bp, Homo sapiens
agaggacaaaatgagaagtgct

SEQ ID NO: 7290822 - DNA, 22 bp, Homo sapiens
aatgtgtagcatttaatgcagt

SEQ ID NO: 7290823 - DNA, 18 bp, Homo sapiens
aatttctttgacaactta

SEQ ID NO: 7290824 - DNA, 22 bp, Homo sapiens
aatttggacttgggtgctagag

SEQ ID NO: 7290825 - DNA, 22 bp, Homo sapiens
acaacattatacatagaaagct

SEQ ID NO: 7290826 - DNA, 22 bp, Homo sapiens
acaacagtgtggtggaaggagc

SEQ ID NO: 7290827 - DNA, 22 bp, Homo sapiens
acaatactagccaaggttatta

SEQ ID NO: 7290828 - DNA, 22 bp, Homo sapiens
acaatactcatgctctttttct

SEQ ID NO: 7290829 - DNA, 22 bp, Homo sapiens
acaatactattttcagtatcct

SEQ ID NO: 7290830 - DNA, 21 bp, Homo sapiens
acaatactatttgggggaagt

SEQ ID NO: 7290831 - DNA, 19 bp, Homo sapiens
acaatagaaaagtcttttg

SEQ ID NO: 7290832 - DNA, 22 bp, Homo sapiens
acaatacttaccaatgtttttg

SEQ ID NO: 7290833 - DNA, 22 bp, Homo sapiens
agcacagaatgaggtggaagtg

SEQ ID NO: 7290834 - DNA, 22 bp, Homo sapiens
agcacaaaagcagccacagatg

SEQ ID NO: 7290835 - DNA, 23 bp, Homo sapiens
agcacaaagtgttttccttgtag

SEQ ID NO: 7290836 - DNA, 22 bp, Homo sapiens
agcacaaatataaaaatgtctg

SEQ ID NO: 7290837 - DNA, 22 bp, Homo sapiens
agcacaaatataaaaatgtctg

SEQ ID NO: 7290838 - DNA, 22 bp, Homo sapiens
agcacacaggacttgattcatg

SEQ ID NO: 7290839 - DNA, 22 bp, Homo sapiens
agcacacagtattagccattgt

SEQ ID NO: 7290840 - DNA, 21 bp, Homo sapiens
agcaggtgtaaaggaggaaat

SEQ ID NO: 7290841 - DNA, 22 bp, Homo sapiens
agcaggtgagcacagccaggct

SEQ ID NO: 7290842 - DNA, 22 bp, Homo sapiens
agcagggaagcctccagaacct

SEQ ID NO: 7290843 - DNA, 22 bp, Homo sapiens
acacagtttttcagacagagat

SEQ ID NO: 7290844 - DNA, 16 bp, Homo sapiens
acacagttttaaggca

SEQ ID NO: 7290845 - DNA, 22 bp, Homo sapiens
agcagggaagcctccagaacct

SEQ ID NO: 7290846 - DNA, 22 bp, Homo sapiens
acacagttcatgcatgaggtct

SEQ ID NO: 7290847 - DNA, 22 bp, Homo sapiens
acacagttcgtgcttttctatt

SEQ ID NO: 7290848 - DNA, 22 bp, Homo sapiens
acacagttcgttgttttctact

SEQ ID NO: 7290849 - DNA, 22 bp, Homo sapiens
acacagttctcttcttgtaact

SEQ ID NO: 7290850 - DNA, 22 bp, Homo sapiens
acacagttcttagcaggtgtct

SEQ ID NO: 7290851 - DNA, 22 bp, Homo sapiens
acacagttctttcactgttggt

SEQ ID NO: 7290852 - DNA, 22 bp, Homo sapiens
acacagttgattgtcactcagg

SEQ ID NO: 7290853 - DNA, 22 bp, Homo sapiens
acacagttggtggctcagtctg

SEQ ID NO: 7290854 - DNA, 22 bp, Homo sapiens
acacagtttaaacgattagtac

SEQ ID NO: 7290855 - DNA, 22 bp, Homo sapiens
acacagtttatggtattctgtt

SEQ ID NO: 7290856 - DNA, 22 bp, Homo sapiens
acacaagaataatgatgaaggt

SEQ ID NO: 7290857 - DNA, 22 bp, Homo sapiens
acacagtgtgtgcagtcggacg

SEQ ID NO: 7290858 - DNA, 22 bp, Homo sapiens
acacagttcaggatcaaatagc

SEQ ID NO: 7290859 - DNA, 22 bp, Homo sapiens
acacagtgtcagggcaggggcc

SEQ ID NO: 7290860 - DNA, 22 bp, Homo sapiens
acacagtattgtgactataact

SEQ ID NO: 7290861 - DNA, 22 bp, Homo sapiens
agcgtggatgtggggcgcggct

SEQ ID NO: 7290862 - DNA, 22 bp, Homo sapiens
agcgggtgctgtgtcagccctc

SEQ ID NO: 7290863 - DNA, 23 bp, Homo sapiens
acagaagccaggagccgctgggc

SEQ ID NO: 7290864 - DNA, 21 bp, Homo sapiens
acagaagcggcgagtggcccc

SEQ ID NO: 7290865 - DNA, 22 bp, Homo sapiens
acagaagctcaagagagcagtg

SEQ ID NO: 7290866 - DNA, 22 bp, Homo sapiens
acagaaggacttgagaaagaca

SEQ ID NO: 7290867 - DNA, 22 bp, Homo sapiens
acagaaggcggggacaaggcgg

SEQ ID NO: 7290868 - DNA, 22 bp, Homo sapiens
acagaaggcggggacaaggcgg

SEQ ID NO: 7290869 - DNA, 22 bp, Homo sapiens
acagaagtgtctttttcattca

SEQ ID NO: 7290870 - DNA, 22 bp, Homo sapiens
acagaagtgttgaagttttcat

SEQ ID NO: 7290871 - DNA, 22 bp, Homo sapiens
acagaatactcataagaagggg

SEQ ID NO: 7290872 - DNA, 22 bp, Homo sapiens
acagaataactcttgcttgagt

SEQ ID NO: 7290873 - DNA, 22 bp, Homo sapiens
acagaataaggtttatctctcc

SEQ ID NO: 7290874 - DNA, 22 bp, Homo sapiens
acagaatatttggcatgcgtct

SEQ ID NO: 7290875 - DNA, 22 bp, Homo sapiens
acagaataggtacagtcagtca

SEQ ID NO: 7290876 - DNA, 22 bp, Homo sapiens
acagaatagtagcttaaagtca

SEQ ID NO: 7290877 - DNA, 22 bp, Homo sapiens
acagaatagtcagctgtaggcc

SEQ ID NO: 7290878 - DNA, 22 bp, Homo sapiens
acagaatattggttactgttgc

SEQ ID NO: 7290879 - DNA, 20 bp, Homo sapiens
acagaatatgctggttgtgg

SEQ ID NO: 7290880 - DNA, 22 bp, Homo sapiens
aaggacacggggctggctctgg

SEQ ID NO: 7290881 - DNA, 18 bp, Homo sapiens
aaggacacagtccctgct

SEQ ID NO: 7290882 - DNA, 22 bp, Homo sapiens
aaggacacctgcagagggacca

SEQ ID NO: 7290883 - DNA, 19 bp, Homo sapiens
aaggacacaacagagatag

SEQ ID NO: 7290884 - DNA, 22 bp, Homo sapiens
aaggacacaaaacagcagcagt

SEQ ID NO: 7290885 - DNA, 22 bp, Homo sapiens
acatcctcccgatctactggct

SEQ ID NO: 7290886 - DNA, 22 bp, Homo sapiens
acatgaagtggtcagatcaaac

SEQ ID NO: 7290887 - DNA, 22 bp, Homo sapiens
acatgaagcaagaaagatgcta

SEQ ID NO: 7290888 - DNA, 21 bp, Homo sapiens
acatgcatagagagatttctg

SEQ ID NO: 7290889 - DNA, 22 bp, Homo sapiens
acatgcatggacatgtatatat

SEQ ID NO: 7290890 - DNA, 22 bp, Homo sapiens
acatgcatggggtaatggtatt

SEQ ID NO: 7290891 - DNA, 22 bp, Homo sapiens
aagtatatttagctgagcttgt

SEQ ID NO: 7290892 - DNA, 22 bp, Homo sapiens
aagggcagaaagggacgctttg

SEQ ID NO: 7290893 - DNA, 22 bp, Homo sapiens
aatctacatgcaatatttttag

SEQ ID NO: 7290894 - DNA, 22 bp, Homo sapiens
agaagccagccttgcctccttt

SEQ ID NO: 7290895 - DNA, 22 bp, Homo sapiens
aatgcatgtttcctctcagcag

SEQ ID NO: 7290896 - DNA, 22 bp, Homo sapiens
aatgcataccatgtcatctttg

SEQ ID NO: 7290897 - DNA, 22 bp, Homo sapiens
aatgcctggcgattagtgtagc

SEQ ID NO: 7290898 - DNA, 22 bp, Homo sapiens
aatgcctaagtaattattttga

SEQ ID NO: 7290899 - DNA, 22 bp, Homo sapiens
agaacaattgccccaaagcttg

SEQ ID NO: 7290900 - DNA, 22 bp, Homo sapiens
aatgaagattatggtgattaag

SEQ ID NO: 7290901 - DNA, 22 bp, Homo sapiens
agaagcagctttcaaggtgatt

SEQ ID NO: 7290902 - DNA, 22 bp, Homo sapiens
agaagccactgctcccagtgag

SEQ ID NO: 7290903 - DNA, 22 bp, Homo sapiens
agaagccaccagctgaggaaga

SEQ ID NO: 7290904 - DNA, 22 bp, Homo sapiens
agaagccactggaggttgagat

SEQ ID NO: 7290905 - DNA, 22 bp, Homo sapiens
actgtaattggattgtctgact

SEQ ID NO: 7290906 - DNA, 22 bp, Homo sapiens
actgtaattatctgaacgtgca

SEQ ID NO: 7290907 - DNA, 22 bp, Homo sapiens
actgtaatattttaagatgtct

SEQ ID NO: 7290908 - DNA, 22 bp, Homo sapiens
aatagcacacttgtgagcatta

SEQ ID NO: 7290909 - DNA, 22 bp, Homo sapiens
tagacacatcttcatccacaat

SEQ ID NO: 7290910 - DNA, 20 bp, Homo sapiens
tagaaatcttataaaagact

SEQ ID NO: 7290911 - DNA, 22 bp, Homo sapiens
tagaaaggaagctacttagggg

SEQ ID NO: 7290912 - DNA, 22 bp, Homo sapiens
tagagtaaatagtatgagaaag

SEQ ID NO: 7290913 - DNA, 20 bp, Homo sapiens
taggcaattagtagataaca

SEQ ID NO: 7290914 - DNA, 22 bp, Homo sapiens
taggagggttagagggaaatat

SEQ ID NO: 7290915 - DNA, 22 bp, Homo sapiens
taggacagtagctggtgcacag

SEQ ID NO: 7290916 - DNA, 22 bp, Homo sapiens
tatgtacacatacacttgtaat

SEQ ID NO: 7290917 - DNA, 22 bp, Homo sapiens
tatgtacagtccttaacttaaa

SEQ ID NO: 7290918 - DNA, 22 bp, Homo sapiens
tatgtacaagcacacatgtgac

SEQ ID NO: 7290919 - DNA, 22 bp, Homo sapiens
tattacatccacttttattgca

SEQ ID NO: 7290920 - DNA, 22 bp, Homo sapiens
tattctcagtgctataagtaga

SEQ ID NO: 7290921 - DNA, 22 bp, Homo sapiens
tatttaatttgctcattgtgat

SEQ ID NO: 7290922 - DNA, 22 bp, Homo sapiens
tattgacatttttatagcttga

SEQ ID NO: 7290923 - DNA, 21 bp, Homo sapiens
tatttatctcaggctatcttt

SEQ ID NO: 7290924 - DNA, 22 bp, Homo sapiens
tatttatcgagtgtctactatg

SEQ ID NO: 7290925 - DNA, 22 bp, Homo sapiens
tatttattctttgtactgcctt

SEQ ID NO: 7290926 - DNA, 22 bp, Homo sapiens
tatttattggacagtgttgctg

SEQ ID NO: 7290927 - DNA, 22 bp, Homo sapiens
tatttattcattcagcaagcat

SEQ ID NO: 7290928 - DNA, 22 bp, Homo sapiens
tatacaatggctgaatcatcca

SEQ ID NO: 7290929 - DNA, 22 bp, Homo sapiens
tataatttggggaaagtggtgt

SEQ ID NO: 7290930 - DNA, 22 bp, Homo sapiens
tataattttaagtggtaaatta

SEQ ID NO: 7290931 - DNA, 22 bp, Homo sapiens
tataattttagaagagatggaa

SEQ ID NO: 7290932 - DNA, 22 bp, Homo sapiens
tataatttttctgtggccagtt

SEQ ID NO: 7290933 - DNA, 22 bp, Homo sapiens
taggtgagtttggggaagatag

SEQ ID NO: 7290934 - DNA, 22 bp, Homo sapiens
taggtgagggagcattgtgaga

SEQ ID NO: 7290935 - DNA, 20 bp, Homo sapiens
taggtgagggcagatagagg

SEQ ID NO: 7290936 - DNA, 22 bp, Homo sapiens
taggtgaggttacaagagttca

SEQ ID NO: 7290937 - DNA, 22 bp, Homo sapiens
tataatttatcatgtcacagtt

SEQ ID NO: 7290938 - DNA, 23 bp, Homo sapiens
tatccagtagggcccagagctga

SEQ ID NO: 7290939 - DNA, 22 bp, Homo sapiens
tatctacagttaatatgtcatc

SEQ ID NO: 7290940 - DNA, 21 bp, Homo sapiens
tatctacagtgtccattcagt

SEQ ID NO: 7290941 - DNA, 22 bp, Homo sapiens
tacagatatttctcttcaacaa

SEQ ID NO: 7290942 - DNA, 22 bp, Homo sapiens
tacagcaatgcctgaaatagta

SEQ ID NO: 7290943 - DNA, 22 bp, Homo sapiens
tacagaagctgagacactgaga

SEQ ID NO: 7290944 - DNA, 22 bp, Homo sapiens
tacagagtgttattacagaatc

SEQ ID NO: 7290945 - DNA, 22 bp, Homo sapiens
tacagagttttcctgccaagaa

SEQ ID NO: 7290946 - DNA, 22 bp, Homo sapiens
tacagataaaaatgctgttctt

SEQ ID NO: 7290947 - DNA, 22 bp, Homo sapiens
tacatagcaaggaaatgacaga

SEQ ID NO: 7290948 - DNA, 22 bp, Homo sapiens
taaggcaaaggggaagttatca

SEQ ID NO: 7290949 - DNA, 22 bp, Homo sapiens
taaggtgagctgtataacaggg

SEQ ID NO: 7290950 - DNA, 22 bp, Homo sapiens
taagtgagaactaaaccttctg

SEQ ID NO: 7290951 - DNA, 22 bp, Homo sapiens
taagtgagaaagacattaactg

SEQ ID NO: 7290952 - DNA, 17 bp, Homo sapiens
taagtgattatctcata

SEQ ID NO: 7290953 - DNA, 22 bp, Homo sapiens
taagtgcaatgttttacttaaa

SEQ ID NO: 7290954 - DNA, 22 bp, Homo sapiens
taatactgaaagggaaatgtcc

SEQ ID NO: 7290955 - DNA, 22 bp, Homo sapiens
taatactgaaaggagtatcagc

SEQ ID NO: 7290956 - DNA, 22 bp, Homo sapiens
taatactgagccaccaggtagg

SEQ ID NO: 7290957 - DNA, 22 bp, Homo sapiens
taatactgactaaagatatcaa

SEQ ID NO: 7290958 - DNA, 22 bp, Homo sapiens
taatactgaaggtaaaatttct

SEQ ID NO: 7290959 - DNA, 21 bp, Homo sapiens
taatactgaaagtgacatctg

SEQ ID NO: 7290960 - DNA, 22 bp, Homo sapiens
taattatagccgctattttgct

SEQ ID NO: 7290961 - DNA, 22 bp, Homo sapiens
taatactgtgcttcattttcct

SEQ ID NO: 7290962 - DNA, 22 bp, Homo sapiens
taatactgtatactgcaaattt

SEQ ID NO: 7290963 - DNA, 22 bp, Homo sapiens
taatactgtaacttggtgggtc

SEQ ID NO: 7290964 - DNA, 22 bp, Homo sapiens
taatactgggaaatacttgggt

SEQ ID NO: 7290965 - DNA, 19 bp, Homo sapiens
taatactggctgtagctgg

SEQ ID NO: 7290966 - DNA, 23 bp, Homo sapiens
taatactgcttcagaggcttaga

SEQ ID NO: 7290967 - DNA, 22 bp, Homo sapiens
taatactgctgtgcttgagttg

SEQ ID NO: 7290968 - DNA, 22 bp, Homo sapiens
taatactgatgtctgagcccca

SEQ ID NO: 7290969 - DNA, 22 bp, Homo sapiens
taatggtgtttttctgtaattt

SEQ ID NO: 7290970 - DNA, 22 bp, Homo sapiens
taatggtgcttctgtgagataa

SEQ ID NO: 7290971 - DNA, 22 bp, Homo sapiens
taatggtgcagtgggtgtaact

SEQ ID NO: 7290972 - DNA, 21 bp, Homo sapiens
taatggtgatggttatgttct

SEQ ID NO: 7290973 - DNA, 18 bp, Homo sapiens
gttttgtggctagtagtg

SEQ ID NO: 7290974 - DNA, 22 bp, Homo sapiens
gttttgatatatgcatacatta

SEQ ID NO: 7290975 - DNA, 22 bp, Homo sapiens
gttttgcttctcatgttaagtg

SEQ ID NO: 7290976 - DNA, 21 bp, Homo sapiens
gttttgctggtatctggggat

SEQ ID NO: 7290977 - DNA, 22 bp, Homo sapiens
gttttgctgactcccacaggaa

SEQ ID NO: 7290978 - DNA, 22 bp, Homo sapiens
gttttgctcatttggtccaagg

SEQ ID NO: 7290979 - DNA, 22 bp, Homo sapiens
gtttttattgtgtaaatgtggg

SEQ ID NO: 7290980 - DNA, 22 bp, Homo sapiens
taaagggtaggttttactgtaa

SEQ ID NO: 7290981 - DNA, 22 bp, Homo sapiens
taaacaagctgtctgatattct

SEQ ID NO: 7290982 - DNA, 22 bp, Homo sapiens
taaattcagtgagtaatttctg

SEQ ID NO: 7290983 - DNA, 20 bp, Homo sapiens
taaattagccttgaagatta

SEQ ID NO: 7290984 - DNA, 22 bp, Homo sapiens
taaattaaagattggagaagga

SEQ ID NO: 7290985 - DNA, 22 bp, Homo sapiens
gttgggaagtgtagctccacct

SEQ ID NO: 7290986 - DNA, 22 bp, Homo sapiens
gttgggaaggtgaacatgatgc

SEQ ID NO: 7290987 - DNA, 22 bp, Homo sapiens
gttgggaagtatccccaaagtt

SEQ ID NO: 7290988 - DNA, 22 bp, Homo sapiens
gttgggaaggcaagaagtagaa

SEQ ID NO: 7290989 - DNA, 22 bp, Homo sapiens
gtttcattcggcagctcataag

SEQ ID NO: 7290990 - DNA, 22 bp, Homo sapiens
gttcagagtgggaatgatcact

SEQ ID NO: 7290991 - DNA, 22 bp, Homo sapiens
gttaagtaaactatgatttatc

SEQ ID NO: 7290992 - DNA, 22 bp, Homo sapiens
gttaagtaccagattgtctgaa

SEQ ID NO: 7290993 - DNA, 22 bp, Homo sapiens
gtgctcctggccacatgaagct

SEQ ID NO: 7290994 - DNA, 22 bp, Homo sapiens
gtgctccctccttcctcaagga

SEQ ID NO: 7290995 - DNA, 22 bp, Homo sapiens
tcagggacccctctgagtggag

SEQ ID NO: 7290996 - DNA, 20 bp, Homo sapiens
tcatggaatctcactctagt

SEQ ID NO: 7290997 - DNA, 22 bp, Homo sapiens
tcatggaagaaaggtttgtttc

SEQ ID NO: 7290998 - DNA, 22 bp, Homo sapiens
tcatggaagaggtattttttgt

SEQ ID NO: 7290999 - DNA, 22 bp, Homo sapiens
tcatggcagtttaataagtggt

SEQ ID NO: 7291000 - DNA, 22 bp, Homo sapiens
tcattatttgctttagttatgt

SEQ ID NO: 7291001 - DNA, 22 bp, Homo sapiens
tcatgctatttcgaatgtaata

SEQ ID NO: 7291002 - DNA, 21 bp, Homo sapiens
tcatatttctcttgctattgt

SEQ ID NO: 7291003 - DNA, 21 bp, Homo sapiens
tcatgcatgagtttatatata

SEQ ID NO: 7291004 - DNA, 21 bp, Homo sapiens
tcatatttctcttgctattgt

SEQ ID NO: 7291005 - DNA, 22 bp, Homo sapiens
tcatatttaggcctttaattca

SEQ ID NO: 7291006 - DNA, 22 bp, Homo sapiens
tcagcagaaaggcactagatga

SEQ ID NO: 7291007 - DNA, 22 bp, Homo sapiens
tcagcactttgaagcagaagga

SEQ ID NO: 7291008 - DNA, 22 bp, Homo sapiens
tcagctctaagttttatgcaaa

SEQ ID NO: 7291009 - DNA, 22 bp, Homo sapiens
tcagctctcacagatctcaacc

SEQ ID NO: 7291010 - DNA, 22 bp, Homo sapiens
tcaggaagctactgccagcagc

SEQ ID NO: 7291011 - DNA, 22 bp, Homo sapiens
tcaggaagaagacggggcagga

SEQ ID NO: 7291012 - DNA, 22 bp, Homo sapiens
tcaggaaggagctggcctgcca

SEQ ID NO: 7291013 - DNA, 17 bp, Homo sapiens
tcaggaggtgtttctag

SEQ ID NO: 7291014 - DNA, 22 bp, Homo sapiens
tcaggcctgctgtatgatggat

SEQ ID NO: 7291015 - DNA, 22 bp, Homo sapiens
tcaggccacggctcactgagac

SEQ ID NO: 7291016 - DNA, 22 bp, Homo sapiens
tcaggccacttcacaggtgatt

SEQ ID NO: 7291017 - DNA, 22 bp, Homo sapiens
tcaggccaaggtagacatgact

SEQ ID NO: 7291018 - DNA, 22 bp, Homo sapiens
tcaggccaaagaaacagcatga

SEQ ID NO: 7291019 - DNA, 22 bp, Homo sapiens
tcaggcattcccatgcataaga

SEQ ID NO: 7291020 - DNA, 22 bp, Homo sapiens
tcaggcctgtgctggaggagat

SEQ ID NO: 7291021 - DNA, 22 bp, Homo sapiens
tcaggctggaatgcagtggggc

SEQ ID NO: 7291022 - DNA, 22 bp, Homo sapiens
tatttcttcgggattcaagcta

SEQ ID NO: 7291023 - DNA, 22 bp, Homo sapiens
tatttcttcgggattcaagcta

SEQ ID NO: 7291024 - DNA, 22 bp, Homo sapiens
tatttcttgagactcgtcttcc

SEQ ID NO: 7291025 - DNA, 22 bp, Homo sapiens
tatttcttgagtggtcagtttc

SEQ ID NO: 7291026 - DNA, 20 bp, Homo sapiens
tatttctgggcaaccattta

SEQ ID NO: 7291027 - DNA, 22 bp, Homo sapiens
tcaagtttctctcagattatgg

SEQ ID NO: 7291028 - DNA, 22 bp, Homo sapiens
tcacaggctctagggattaaga

SEQ ID NO: 7291029 - DNA, 22 bp, Homo sapiens
tcacaggctctccaccatgagg

SEQ ID NO: 7291030 - DNA, 22 bp, Homo sapiens
tcacaagtttctcttgcatgcg

SEQ ID NO: 7291031 - DNA, 20 bp, Homo sapiens
tcacacatggtaagctatga

SEQ ID NO: 7291032 - DNA, 22 bp, Homo sapiens
tcacagtagccatttcatgagt

SEQ ID NO: 7291033 - DNA, 22 bp, Homo sapiens
tcacattttcatattctctgag

SEQ ID NO: 7291034 - DNA, 23 bp, Homo sapiens
tcaccagaaggggtcaataaaga

SEQ ID NO: 7291035 - DNA, 22 bp, Homo sapiens
tcaccagatctctctgtaatgg

SEQ ID NO: 7291036 - DNA, 22 bp, Homo sapiens
tcactagtcatcatatattttt

SEQ ID NO: 7291037 - DNA, 22 bp, Homo sapiens
tcactctgacttggcctccaac

SEQ ID NO: 7291038 - DNA, 22 bp, Homo sapiens
tcacccaggctggagtgcagtg

SEQ ID NO: 7291039 - DNA, 23 bp, Homo sapiens
tcactgtgcccattgaggtagag

SEQ ID NO: 7291040 - DNA, 19 bp, Homo sapiens
tcactgaggctttgttggc

SEQ ID NO: 7291041 - DNA, 22 bp, Homo sapiens
tcactttgacagagaaatgaat

SEQ ID NO: 7291042 - DNA, 22 bp, Homo sapiens
tcactgttaataaatagcaaag

SEQ ID NO: 7291043 - DNA, 22 bp, Homo sapiens
tcacttttgatccctatgcagt

SEQ ID NO: 7291044 - DNA, 23 bp, Homo sapiens
tcagagaggccccctgcagagat

SEQ ID NO: 7291045 - DNA, 22 bp, Homo sapiens
tcagagaggttggtgataagaa

SEQ ID NO: 7291046 - DNA, 22 bp, Homo sapiens
tccatgagggacactggatgct

SEQ ID NO: 7291047 - DNA, 22 bp, Homo sapiens
tccatgaggcagggaggctggc

SEQ ID NO: 7291048 - DNA, 20 bp, Homo sapiens
tccatgagttagagactata

SEQ ID NO: 7291049 - DNA, 22 bp, Homo sapiens
tccatgagtttgaggaaaagag

SEQ ID NO: 7291050 - DNA, 22 bp, Homo sapiens
tccatgagaggtaactttacaa

SEQ ID NO: 7291051 - DNA, 17 bp, Homo sapiens
tccatgagacatgaaga

SEQ ID NO: 7291052 - DNA, 22 bp, Homo sapiens
tccatgagacagatactgtaag

SEQ ID NO: 7291053 - DNA, 22 bp, Homo sapiens
tccatgagaacccttggagata

SEQ ID NO: 7291054 - DNA, 23 bp, Homo sapiens
tccatgagatgtgggcttctagt

SEQ ID NO: 7291055 - DNA, 22 bp, Homo sapiens
tccatgagctagctttccaaag

SEQ ID NO: 7291056 - DNA, 22 bp, Homo sapiens
tccatgaggaccaaattcgtag

SEQ ID NO: 7291057 - DNA, 22 bp, Homo sapiens
tccatgagctagggattcatca

SEQ ID NO: 7291058 - DNA, 22 bp, Homo sapiens
tccagttgtttgtattaactct

SEQ ID NO: 7291059 - DNA, 22 bp, Homo sapiens
tccagttgcctgtctctgatta

SEQ ID NO: 7291060 - DNA, 22 bp, Homo sapiens
tccaggccaatgtagcaggccc

SEQ ID NO: 7291061 - DNA, 22 bp, Homo sapiens
tccaggccacatggatggcgat

SEQ ID NO: 7291062 - DNA, 17 bp, Homo sapiens
tccaggcatatctccta

SEQ ID NO: 7291063 - DNA, 22 bp, Homo sapiens
tccaggagtgataaggccactg

SEQ ID NO: 7291064 - DNA, 22 bp, Homo sapiens
tccaggagtggggcagaggtct

SEQ ID NO: 7291065 - DNA, 22 bp, Homo sapiens
tccaggagtcagacagatggtg

SEQ ID NO: 7291066 - DNA, 22 bp, Homo sapiens
tccaggagtcctgggtggcccc

SEQ ID NO: 7291067 - DNA, 22 bp, Homo sapiens
tccaggagtctagcctcaggcc

SEQ ID NO: 7291068 - DNA, 22 bp, Homo sapiens
gctggctggcgggtgcgtcctc

SEQ ID NO: 7291069 - DNA, 22 bp, Homo sapiens
gcttctgtggtgcatctttgct

SEQ ID NO: 7291070 - DNA, 22 bp, Homo sapiens
ggagagaactgacctgaaagga

SEQ ID NO: 7291071 - DNA, 22 bp, Homo sapiens
ggagagaaattgaggtagcaag

SEQ ID NO: 7291072 - DNA, 22 bp, Homo sapiens
gctttcctggccctgtccctgc

SEQ ID NO: 7291073 - DNA, 18 bp, Homo sapiens
ggaatgtggacaggctgg

SEQ ID NO: 7291074 - DNA, 22 bp, Homo sapiens
ggaagagtgcaggtttgtttca

SEQ ID NO: 7291075 - DNA, 22 bp, Homo sapiens
gcgtctcaaggcccccaggcca

SEQ ID NO: 7291076 - DNA, 23 bp, Homo sapiens
gcgtccggcctctctcgctcccg

SEQ ID NO: 7291077 - DNA, 22 bp, Homo sapiens
gcctctgtaggagtgagagcat

SEQ ID NO: 7291078 - DNA, 22 bp, Homo sapiens
gctcccagaaccaaggctgggg

SEQ ID NO: 7291079 - DNA, 23 bp, Homo sapiens
gctcagatgccctaggaggtggc

SEQ ID NO: 7291080 - DNA, 22 bp, Homo sapiens
gctactgtgaaggagtctttct

SEQ ID NO: 7291081 - DNA, 19 bp, Homo sapiens
gctactgaggcccaggacc

SEQ ID NO: 7291082 - DNA, 22 bp, Homo sapiens
gctgagaatcaagatggagagg

SEQ ID NO: 7291083 - DNA, 17 bp, Homo sapiens
gctgagaaggggaagag

SEQ ID NO: 7291084 - DNA, 22 bp, Homo sapiens
gctgagaatgttcctactggta

SEQ ID NO: 7291085 - DNA, 22 bp, Homo sapiens
gcatgcagagaatacctgtgat

SEQ ID NO: 7291086 - DNA, 22 bp, Homo sapiens
gcaggggagtggatgatggatt

SEQ ID NO: 7291087 - DNA, 22 bp, Homo sapiens
gcagtggatggccagcaggggc

SEQ ID NO: 7291088 - DNA, 22 bp, Homo sapiens
gccctggatgctcatggcatca

SEQ ID NO: 7291089 - DNA, 22 bp, Homo sapiens
gccctggatgctcatggcatca

SEQ ID NO: 7291090 - DNA, 22 bp, Homo sapiens
gccctggatggcaggagccatc

SEQ ID NO: 7291091 - DNA, 22 bp, Homo sapiens
gccctggatgtacaggcatgtt

SEQ ID NO: 7291092 - DNA, 22 bp, Homo sapiens
gccctggatgtacaggcatgtt

SEQ ID NO: 7291093 - DNA, 22 bp, Homo sapiens
gccctggagagggatatggcat

SEQ ID NO: 7291094 - DNA, 17 bp, Homo sapiens
gccctggagccaggcta

SEQ ID NO: 7291095 - DNA, 22 bp, Homo sapiens
gccctggagctagactaggaca

SEQ ID NO: 7291096 - DNA, 20 bp, Homo sapiens
gccctggagccttgtcctgg

SEQ ID NO: 7291097 - DNA, 22 bp, Homo sapiens
gccctggagggccagcgactgg

SEQ ID NO: 7291098 - DNA, 22 bp, Homo sapiens
gccccagacataagtagggggt

SEQ ID NO: 7291099 - DNA, 22 bp, Homo sapiens
gcccagcactaaaagctttgct

SEQ ID NO: 7291100 - DNA, 22 bp, Homo sapiens
gcccagcagctggtggagaagg

SEQ ID NO: 7291101 - DNA, 21 bp, Homo sapiens
gcccagcaaggtgagaaggcc

SEQ ID NO: 7291102 - DNA, 22 bp, Homo sapiens
gcccagcacagctggaagagtc

SEQ ID NO: 7291103 - DNA, 22 bp, Homo sapiens
gcccagcacattgctgaggacc

SEQ ID NO: 7291104 - DNA, 22 bp, Homo sapiens
gcagcccagcagggcccggagc

SEQ ID NO: 7291105 - DNA, 22 bp, Homo sapiens
gcagcccaggaccctggacaga

SEQ ID NO: 7291106 - DNA, 22 bp, Homo sapiens
gcagcccagagcgcaggacccc

SEQ ID NO: 7291107 - DNA, 22 bp, Homo sapiens
gcagcccagagcgcaggacccc

SEQ ID NO: 7291108 - DNA, 22 bp, Homo sapiens
gcagcccaggaccctggacaga

SEQ ID NO: 7291109 - DNA, 22 bp, Homo sapiens
gcagcccaggaggcgggagccc

SEQ ID NO: 7291110 - DNA, 22 bp, Homo sapiens
gcagcccaggaggcgggagccc

SEQ ID NO: 7291111 - DNA, 22 bp, Homo sapiens
gcagcctctgatgatggccgta

SEQ ID NO: 7291112 - DNA, 20 bp, Homo sapiens
gcagcctcaacaggcacagc

SEQ ID NO: 7291113 - DNA, 22 bp, Homo sapiens
gcagcctcaaactccccagctc

SEQ ID NO: 7291114 - DNA, 22 bp, Homo sapiens
gcaggaagccttaccaagccca

SEQ ID NO: 7291115 - DNA, 22 bp, Homo sapiens
gcaggaatctaacccaaggaga

SEQ ID NO: 7291116 - DNA, 22 bp, Homo sapiens
gcagggaccaaaagaggcagta

SEQ ID NO: 7291117 - DNA, 22 bp, Homo sapiens
gcagggacctatgacgatggaa

SEQ ID NO: 7291118 - DNA, 22 bp, Homo sapiens
gcagggcttgcagcagctagac

SEQ ID NO: 7291119 - DNA, 22 bp, Homo sapiens
gcagggctttttgaaacatggt

SEQ ID NO: 7291120 - DNA, 22 bp, Homo sapiens
gcagggcttagaaatggtggct

SEQ ID NO: 7291121 - DNA, 22 bp, Homo sapiens
gcacagttctctcagtctccag

SEQ ID NO: 7291122 - DNA, 22 bp, Homo sapiens
gcacagttgagacttcacagct

SEQ ID NO: 7291123 - DNA, 22 bp, Homo sapiens
gcacagttgacaatgattaaga

SEQ ID NO: 7291124 - DNA, 22 bp, Homo sapiens
gcacagttaaagggtcatgtga

SEQ ID NO: 7291125 - DNA, 20 bp, Homo sapiens
gcacagtttgggaaccatgg

SEQ ID NO: 7291126 - DNA, 22 bp, Homo sapiens
gcacagttgtgacaaccatcgc

SEQ ID NO: 7291127 - DNA, 22 bp, Homo sapiens
gcacagttgccattagccacat

SEQ ID NO: 7291128 - DNA, 22 bp, Homo sapiens
gcacagttgatttatgctggtg

SEQ ID NO: 7291129 - DNA, 22 bp, Homo sapiens
gcagaggatcaggctctggaaa

SEQ ID NO: 7291130 - DNA, 22 bp, Homo sapiens
gcagaggtcctagccaggagtc

SEQ ID NO: 7291131 - DNA, 22 bp, Homo sapiens
gcacagaacactggtgagtccc

SEQ ID NO: 7291132 - DNA, 22 bp, Homo sapiens
gcacacatgcatgtgtgcatcc

SEQ ID NO: 7291133 - DNA, 20 bp, Homo sapiens
gcacacatagaaatgcatat

SEQ ID NO: 7291134 - DNA, 22 bp, Homo sapiens
gcacacatatatatgagcatgt

SEQ ID NO: 7291135 - DNA, 22 bp, Homo sapiens
gaggcccagcagcgcaggtctt

SEQ ID NO: 7291136 - DNA, 22 bp, Homo sapiens
gcaaagaaatgtcagtgagagg

SEQ ID NO: 7291137 - DNA, 22 bp, Homo sapiens
gtgaaattgtatttggcattga

SEQ ID NO: 7291138 - DNA, 22 bp, Homo sapiens
gtgaaatatttaacgtccaggt

SEQ ID NO: 7291139 - DNA, 22 bp, Homo sapiens
gtctgccctcacatgcactctt

SEQ ID NO: 7291140 - DNA, 22 bp, Homo sapiens
gtgcagagaaggagcagtagtt

SEQ ID NO: 7291141 - DNA, 22 bp, Homo sapiens
gtgagcagggcaggactgggga

SEQ ID NO: 7291142 - DNA, 22 bp, Homo sapiens
gtgcacagattcagaggttttg

SEQ ID NO: 7291143 - DNA, 22 bp, Homo sapiens
gtgcagagtgtctgtggactga

SEQ ID NO: 7291144 - DNA, 20 bp, Homo sapiens
gtgcagaggcagcctgtggg

SEQ ID NO: 7291145 - DNA, 22 bp, Homo sapiens
gtgcaggtttaggaagcagctc

SEQ ID NO: 7291146 - DNA, 22 bp, Homo sapiens
gtgcattgtaggatgttatgca

SEQ ID NO: 7291147 - DNA, 22 bp, Homo sapiens
ggtttgcatgtgatgttgggca

SEQ ID NO: 7291148 - DNA, 22 bp, Homo sapiens
gtatttaattccattaagttag

SEQ ID NO: 7291149 - DNA, 22 bp, Homo sapiens
gtccccgacgtttggcttgatg

SEQ ID NO: 7291150 - DNA, 22 bp, Homo sapiens
gtccccctgaaagcagccgcag

SEQ ID NO: 7291151 - DNA, 22 bp, Homo sapiens
gtccacttcaggactggccgct

SEQ ID NO: 7291152 - DNA, 22 bp, Homo sapiens
gtcattttgctgcatatttaga

SEQ ID NO: 7291153 - DNA, 23 bp, Homo sapiens
gtatttcagcattctcagttaaa

SEQ ID NO: 7291154 - DNA, 22 bp, Homo sapiens
ggggaagaggcgtgatggatcc

SEQ ID NO: 7291155 - DNA, 22 bp, Homo sapiens
ggtctggacagaatgtgacact

SEQ ID NO: 7291156 - DNA, 22 bp, Homo sapiens
ggtctctttgcttcagctacag

SEQ ID NO: 7291157 - DNA, 22 bp, Homo sapiens
ggtggccctaaccgcagcctcc

SEQ ID NO: 7291158 - DNA, 22 bp, Homo sapiens
ggtgtccttcgtccgctggcat

SEQ ID NO: 7291159 - DNA, 22 bp, Homo sapiens
ggtgtccttgctccttcagctt

SEQ ID NO: 7291160 - DNA, 20 bp, Homo sapiens
ggtgtgttggttcagcatgg

SEQ ID NO: 7291161 - DNA, 22 bp, Homo sapiens
ggtttaatgggtgaaggcatga

SEQ ID NO: 7291162 - DNA, 22 bp, Homo sapiens
ggtttaattggtccaggatggg

SEQ ID NO: 7291163 - DNA, 22 bp, Homo sapiens
ggtttaattacctgcatctcaa

SEQ ID NO: 7291164 - DNA, 22 bp, Homo sapiens
ggtcagaagtgcaaaatcagtt

SEQ ID NO: 7291165 - DNA, 22 bp, Homo sapiens
ggtcagagaaaagtagggtgtt

SEQ ID NO: 7291166 - DNA, 22 bp, Homo sapiens
ggtcagagctggagagataggg

SEQ ID NO: 7291167 - DNA, 22 bp, Homo sapiens
ggtcagagccgttagcattcag

SEQ ID NO: 7291168 - DNA, 22 bp, Homo sapiens
ggtcgctgtgtaggttcagcta

SEQ ID NO: 7291169 - DNA, 22 bp, Homo sapiens
ggtctctctgctttcccccaga

SEQ ID NO: 7291170 - DNA, 22 bp, Homo sapiens
ggagtgcagtggtgggatctca

SEQ ID NO: 7291171 - DNA, 22 bp, Homo sapiens
ggagtgcagtggcgtgagctcg

SEQ ID NO: 7291172 - DNA, 22 bp, Homo sapiens
ggagtcagactttgattagtag

SEQ ID NO: 7291173 - DNA, 22 bp, Homo sapiens
ggagtgagtactggagtagctg

SEQ ID NO: 7291174 - DNA, 22 bp, Homo sapiens
ggcacatttataagtggacata

SEQ ID NO: 7291175 - DNA, 22 bp, Homo sapiens
ggcaggaggtgagtggcgggtg

SEQ ID NO: 7291176 - DNA, 22 bp, Homo sapiens
ggcaggaggtgagtggcgggtg

SEQ ID NO: 7291177 - DNA, 22 bp, Homo sapiens
ggcagtgaacagaaatgcagaa

SEQ ID NO: 7291178 - DNA, 22 bp, Homo sapiens
ggccacactctggtagaggtga

SEQ ID NO: 7291179 - DNA, 22 bp, Homo sapiens
ggccttgggcgagtccctcagt

SEQ ID NO: 7291180 - DNA, 22 bp, Homo sapiens
ggccttgggcagacacgtcaca

SEQ ID NO: 7291181 - DNA, 22 bp, Homo sapiens
ggctctggagatgtccgacctg

SEQ ID NO: 7291182 - DNA, 22 bp, Homo sapiens
gggacaggcccctcgctagctt

SEQ ID NO: 7291183 - DNA, 22 bp, Homo sapiens
gggacattgtcaatggtggtag

SEQ ID NO: 7291184 - DNA, 22 bp, Homo sapiens
ggcttggcttgggctcagaggc

SEQ ID NO: 7291185 - DNA, 22 bp, Homo sapiens
gggagagcgggaggtgccacag

SEQ ID NO: 7291186 - DNA, 22 bp, Homo sapiens
gggagagcgcgctagggccgag

SEQ ID NO: 7291187 - DNA, 16 bp, Homo sapiens
gggcaggaatcagggt

SEQ ID NO: 7291188 - DNA, 22 bp, Homo sapiens
gggcaggagagaacagtcatgg

SEQ ID NO: 7291189 - DNA, 23 bp, Homo sapiens
gggcatggagtgtaggtggaagg

SEQ ID NO: 7291190 - DNA, 22 bp, Homo sapiens
gggcacaggaatttgggatgtg

SEQ ID NO: 7291191 - DNA, 22 bp, Homo sapiens
gggcacagcctaactatggaga

SEQ ID NO: 7291192 - DNA, 22 bp, Homo sapiens
gggatggggtcgggaccctgct

SEQ ID NO: 7291193 - DNA, 19 bp, Homo sapiens
gaggaggaaaactagtgta

SEQ ID NO: 7291194 - DNA, 22 bp, Homo sapiens
gaggcaatgggctatagcattg

SEQ ID NO: 7291195 - DNA, 22 bp, Homo sapiens
gagcctggagctggaacgaagc

SEQ ID NO: 7291196 - DNA, 22 bp, Homo sapiens
gagcctggacatctcaggccca

SEQ ID NO: 7291197 - DNA, 22 bp, Homo sapiens
gagcctggagctggaacgaagc

SEQ ID NO: 7291198 - DNA, 22 bp, Homo sapiens
gagcctcctcctggtgtgccga

SEQ ID NO: 7291199 - DNA, 22 bp, Homo sapiens
gagaattagggcgtaattcaga

SEQ ID NO: 7291200 - DNA, 22 bp, Homo sapiens
gagacacaaacacatttagagg

SEQ ID NO: 7291201 - DNA, 22 bp, Homo sapiens
gagccagattttatgcaagaca

SEQ ID NO: 7291202 - DNA, 22 bp, Homo sapiens
gagccacagtggtggcccacgt

SEQ ID NO: 7291203 - DNA, 22 bp, Homo sapiens
gagccacagtggattgattcca

SEQ ID NO: 7291204 - DNA, 22 bp, Homo sapiens
gagccacagtggtggcccacgt

SEQ ID NO: 7291205 - DNA, 22 bp, Homo sapiens
gagccacagcaacctcaaagga

SEQ ID NO: 7291206 - DNA, 22 bp, Homo sapiens
gagcagcaaagggagggtaaat

SEQ ID NO: 7291207 - DNA, 22 bp, Homo sapiens
gaagaggctttcctagggcaag

SEQ ID NO: 7291208 - DNA, 22 bp, Homo sapiens
gaagcccatttgtacagcacat

SEQ ID NO: 7291209 - DNA, 22 bp, Homo sapiens
gaagcctcaacatctctgcgtc

SEQ ID NO: 7291210 - DNA, 22 bp, Homo sapiens
ctttcacagtcctgactgagcg

SEQ ID NO: 7291211 - DNA, 22 bp, Homo sapiens
ctttcacaagatttgagatgct

SEQ ID NO: 7291212 - DNA, 22 bp, Homo sapiens
gaaatcacttttttcatagttg

SEQ ID NO: 7291213 - DNA, 22 bp, Homo sapiens
gaaatcaaacccttttctgata

SEQ ID NO: 7291214 - DNA, 18 bp, Homo sapiens
gacacacttgcagtagtc

SEQ ID NO: 7291215 - DNA, 22 bp, Homo sapiens
gacacagagacttgcagttgta

SEQ ID NO: 7291216 - DNA, 22 bp, Homo sapiens
gacaggtaaagatggtggcagg

SEQ ID NO: 7291217 - DNA, 23 bp, Homo sapiens
gacaggtaagggttgggagaatc

SEQ ID NO: 7291218 - DNA, 22 bp, Homo sapiens
gaatactggaaaactcatttta

SEQ ID NO: 7291219 - DNA, 22 bp, Homo sapiens
gaatactgatgctcagccccct

SEQ ID NO: 7291220 - DNA, 18 bp, Homo sapiens
gaatactgagagcacaaa

SEQ ID NO: 7291221 - DNA, 22 bp, Homo sapiens
gaatactgacactcaggtggga

SEQ ID NO: 7291222 - DNA, 21 bp, Homo sapiens
gaataggaacctgatcatggg

SEQ ID NO: 7291223 - DNA, 19 bp, Homo sapiens
gaatacagataataagcag

SEQ ID NO: 7291224 - DNA, 22 bp, Homo sapiens
gaatacaggcaggtggctgtgc

SEQ ID NO: 7291225 - DNA, 22 bp, Homo sapiens
gaagcctcaacatctctgcgtc

SEQ ID NO: 7291226 - DNA, 22 bp, Homo sapiens
gaagttgatagagtacatgatt

SEQ ID NO: 7291227 - DNA, 22 bp, Homo sapiens
ctgggtgagttgatgaaggaga

SEQ ID NO: 7291228 - DNA, 22 bp, Homo sapiens
ctgggtgattcctgtccaggca

SEQ ID NO: 7291229 - DNA, 22 bp, Homo sapiens
ctgggtgacagagtgagatggt

SEQ ID NO: 7291230 - DNA, 22 bp, Homo sapiens
ctgtgcagtaggtcagggctgg

SEQ ID NO: 7291231 - DNA, 22 bp, Homo sapiens
ctgtgcagtggggctctgggtt

SEQ ID NO: 7291232 - DNA, 22 bp, Homo sapiens
ctgtgcagtggcagcgtgtggg

SEQ ID NO: 7291233 - DNA, 22 bp, Homo sapiens
ctgtgcattgttgagtgtttag

SEQ ID NO: 7291234 - DNA, 22 bp, Homo sapiens
ctgtgcattgtcttgtctgtag

SEQ ID NO: 7291235 - DNA, 22 bp, Homo sapiens
ctgtggctgtctctttcccatg

SEQ ID NO: 7291236 - DNA, 22 bp, Homo sapiens
ctgtggctggccttattgctgc

SEQ ID NO: 7291237 - DNA, 22 bp, Homo sapiens
ctgtggctggcctgtctgacat

SEQ ID NO: 7291238 - DNA, 22 bp, Homo sapiens
cttgtagaattgaaatggtctc

SEQ ID NO: 7291239 - DNA, 22 bp, Homo sapiens
cttgacagtcccaggaaaatag

SEQ ID NO: 7291240 - DNA, 22 bp, Homo sapiens
cttgacagaaggttttatccta

SEQ ID NO: 7291241 - DNA, 22 bp, Homo sapiens
cttgatctacatagtgaaaccc

SEQ ID NO: 7291242 - DNA, 22 bp, Homo sapiens
ctgttgtctatataagtttttc

SEQ ID NO: 7291243 - DNA, 22 bp, Homo sapiens
cttcctctgtgtcctgggcttg

SEQ ID NO: 7291244 - DNA, 22 bp, Homo sapiens
cttcctctgtgtcctgggcttc

SEQ ID NO: 7291245 - DNA, 22 bp, Homo sapiens
ctgccacaagctggccctgtgt

SEQ ID NO: 7291246 - DNA, 22 bp, Homo sapiens
ctggggtgtgctcagagcaggg

SEQ ID NO: 7291247 - DNA, 19 bp, Homo sapiens
ctgggccagagctgtcctc

SEQ ID NO: 7291248 - DNA, 22 bp, Homo sapiens
ctgggaggcagaggttgcagtg

SEQ ID NO: 7291249 - DNA, 22 bp, Homo sapiens
ctattacagggaagccttggga

SEQ ID NO: 7291250 - DNA, 22 bp, Homo sapiens
ctatggtctggaccgaggtcct

SEQ ID NO: 7291251 - DNA, 22 bp, Homo sapiens
ctagatttctagttcattatcc

SEQ ID NO: 7291252 - DNA, 22 bp, Homo sapiens
ctattatttcctcatctataaa

SEQ ID NO: 7291253 - DNA, 22 bp, Homo sapiens
ctattattatcctaatttctgt

SEQ ID NO: 7291254 - DNA, 22 bp, Homo sapiens
ctcacaggcatctcatcaggct

SEQ ID NO: 7291255 - DNA, 22 bp, Homo sapiens
ctcacagagctcatactgggag

SEQ ID NO: 7291256 - DNA, 21 bp, Homo sapiens
ctactgtgagacacaaagtgc

SEQ ID NO: 7291257 - DNA, 22 bp, Homo sapiens
ctacttctaagtacatggtgat

SEQ ID NO: 7291258 - DNA, 22 bp, Homo sapiens
ctacttcttgatctgtcgacct

SEQ ID NO: 7291259 - DNA, 22 bp, Homo sapiens
ctacttctgtggctctaagaga

SEQ ID NO: 7291260 - DNA, 17 bp, Homo sapiens
ctacttcttctattctt

SEQ ID NO: 7291261 - DNA, 22 bp, Homo sapiens
ttctctaagagatgcagaagtt

SEQ ID NO: 7291262 - DNA, 22 bp, Homo sapiens
ttcatgaatgttccatgtgagt

SEQ ID NO: 7291263 - DNA, 22 bp, Homo sapiens
ttcacagaattgtcttgactgg

SEQ ID NO: 7291264 - DNA, 22 bp, Homo sapiens
ttcagcaaaatatctcagatag

SEQ ID NO: 7291265 - DNA, 22 bp, Homo sapiens
ttcagcaaacacgatgcttgtt

SEQ ID NO: 7291266 - DNA, 22 bp, Homo sapiens
ttcaggattatactctcttccc

SEQ ID NO: 7291267 - DNA, 22 bp, Homo sapiens
ttcaaatttggtatgcaagcca

SEQ ID NO: 7291268 - DNA, 19 bp, Homo sapiens
ttcacaattatgaaattag

SEQ ID NO: 7291269 - DNA, 20 bp, Homo sapiens
ttcaagttgggtctctggct

SEQ ID NO: 7291270 - DNA, 22 bp, Homo sapiens
ttcaagttctgtggagagctgt

SEQ ID NO: 7291271 - DNA, 22 bp, Homo sapiens
ttcaagttctagtgttcacttc

SEQ ID NO: 7291272 - DNA, 22 bp, Homo sapiens
ttcaagttaatgattctggttt

SEQ ID NO: 7291273 - DNA, 22 bp, Homo sapiens
ttcaagttagagatatatttag

SEQ ID NO: 7291274 - DNA, 22 bp, Homo sapiens
ttcaagttttatattgaagcaa

SEQ ID NO: 7291275 - DNA, 22 bp, Homo sapiens
ttcaagtttactttgaagttta

SEQ ID NO: 7291276 - DNA, 22 bp, Homo sapiens
ttcaagtttgtatttctgtatt

SEQ ID NO: 7291277 - DNA, 22 bp, Homo sapiens
cctttctctatcgacccatcgc

SEQ ID NO: 7291278 - DNA, 22 bp, Homo sapiens
ttaggacatggacagctttggt

SEQ ID NO: 7291279 - DNA, 21 bp, Homo sapiens
cctgtgctccacacagggtcc

SEQ ID NO: 7291280 - DNA, 19 bp, Homo sapiens
cctgtgctaggagctgacc

SEQ ID NO: 7291281 - DNA, 22 bp, Homo sapiens
cctgtgtccttggcagatatcc

SEQ ID NO: 7291282 - DNA, 23 bp, Homo sapiens
tgtgtctgaggatatatgtgcat

SEQ ID NO: 7291283 - DNA, 22 bp, Homo sapiens
tgtgtctgaacatgctttgtaa

SEQ ID NO: 7291284 - DNA, 22 bp, Homo sapiens
tgttacaggaaatagaattacc

SEQ ID NO: 7291285 - DNA, 22 bp, Homo sapiens
cctggtgtggccctgtgacatg

SEQ ID NO: 7291286 - DNA, 22 bp, Homo sapiens
cctggtgtggctgtcacagagg

SEQ ID NO: 7291287 - DNA, 22 bp, Homo sapiens
ttgaaagtctctgcatgtagga

SEQ ID NO: 7291288 - DNA, 22 bp, Homo sapiens
ttgtacaacgttttaaatttga

SEQ ID NO: 7291289 - DNA, 22 bp, Homo sapiens
ttgtaattaatggcagcaatta

SEQ ID NO: 7291290 - DNA, 22 bp, Homo sapiens
ctcccaggcagggctgcccact

SEQ ID NO: 7291291 - DNA, 22 bp, Homo sapiens
ctcccaggcacagggaggagcc

SEQ ID NO: 7291292 - DNA, 22 bp, Homo sapiens
tttaacagatgctatgtctacc

SEQ ID NO: 7291293 - DNA, 22 bp, Homo sapiens
ctcccagacatgtgcctccttg

SEQ ID NO: 7291294 - DNA, 22 bp, Homo sapiens
ctccattgaacatcctctcaga

SEQ ID NO: 7291295 - DNA, 22 bp, Homo sapiens
ctcccaggactcagaggagaag

SEQ ID NO: 7291296 - DNA, 22 bp, Homo sapiens
ctcccagagaccaagctgagaa

SEQ ID NO: 7291297 - DNA, 19 bp, Homo sapiens
ttgtcttagctgcataaga

SEQ ID NO: 7291298 - DNA, 22 bp, Homo sapiens
ttgtcttaaatggatggacaat

SEQ ID NO: 7291299 - DNA, 22 bp, Homo sapiens
ttgtcttattttatcataagca

SEQ ID NO: 7291300 - DNA, 22 bp, Homo sapiens
ttgtggttaaccgcacattttt

SEQ ID NO: 7291301 - DNA, 22 bp, Homo sapiens
ttgtgtaaaacctgtgatcttt

SEQ ID NO: 7291302 - DNA, 22 bp, Homo sapiens
ttgtgtaattagcaaacaaatc

SEQ ID NO: 7291303 - DNA, 22 bp, Homo sapiens
tttattgttgggtcttaagctg

SEQ ID NO: 7291304 - DNA, 22 bp, Homo sapiens
tttattgtgttgaaactgaatt

SEQ ID NO: 7291305 - DNA, 22 bp, Homo sapiens
tttagtagtgacagattctggg

SEQ ID NO: 7291306 - DNA, 22 bp, Homo sapiens
tttaatcaggcaaagcataata

SEQ ID NO: 7291307 - DNA, 22 bp, Homo sapiens
tttaatcataagaaggaaaata

SEQ ID NO: 7291308 - DNA, 22 bp, Homo sapiens
tttcacataaatattatgccta

SEQ ID NO: 7291309 - DNA, 22 bp, Homo sapiens
tttcacatagaaagtgatttac

SEQ ID NO: 7291310 - DNA, 22 bp, Homo sapiens
tttcacagttagcatgaggact

SEQ ID NO: 7291311 - DNA, 22 bp, Homo sapiens
tttcacagtcaatttggagtca

SEQ ID NO: 7291312 - DNA, 21 bp, Homo sapiens
tttcaatttgccttgagtcat

SEQ ID NO: 7291313 - DNA, 22 bp, Homo sapiens
tttcaatttccaggctagaatt

SEQ ID NO: 7291314 - DNA, 22 bp, Homo sapiens
tttcaattgactttggaagaaa

SEQ ID NO: 7291315 - DNA, 22 bp, Homo sapiens
tttcacaaagcatagcacttta

SEQ ID NO: 7291316 - DNA, 21 bp, Homo sapiens
tttcacaaaagtatgtgacaa

SEQ ID NO: 7291317 - DNA, 22 bp, Homo sapiens
tttcacaaactcagggtgtgtg

SEQ ID NO: 7291318 - DNA, 22 bp, Homo sapiens
tttcacaaactgaggagacaat

SEQ ID NO: 7291319 - DNA, 22 bp, Homo sapiens
ctctccaggagctcagagtcta

SEQ ID NO: 7291320 - DNA, 22 bp, Homo sapiens
ttttagttactgcagtagcaaa

SEQ ID NO: 7291321 - DNA, 20 bp, Homo sapiens
ctcttcaaatattttattct

SEQ ID NO: 7291322 - DNA, 22 bp, Homo sapiens
ctctttagtggtgatgatgcta

SEQ ID NO: 7291323 - DNA, 22 bp, Homo sapiens
ttttaatactgctattgtagga

SEQ ID NO: 7291324 - DNA, 22 bp, Homo sapiens
ttttaagttggattgctaagta

SEQ ID NO: 7291325 - DNA, 19 bp, Homo sapiens
ttttaagtgccctttcttc

SEQ ID NO: 7291326 - DNA, 19 bp, Homo sapiens
ttttaagtcctctctattc

SEQ ID NO: 7291327 - DNA, 22 bp, Homo sapiens
ttttaagtgcaatctgaatgcg

SEQ ID NO: 7291328 - DNA, 22 bp, Homo sapiens
ttttagatagtttaactgcact

SEQ ID NO: 7291329 - DNA, 22 bp, Homo sapiens
tttgggaagtgggagcaaggtg

SEQ ID NO: 7291330 - DNA, 23 bp, Homo sapiens
tttgggaagggagagagtaagca

SEQ ID NO: 7291331 - DNA, 19 bp, Homo sapiens
tttgggaagcccagagtgt

SEQ ID NO: 7291332 - DNA, 22 bp, Homo sapiens
tttgggaactctatcatggaaa

SEQ ID NO: 7291333 - DNA, 22 bp, Homo sapiens
tttgggaacttggttcagggaa

SEQ ID NO: 7291334 - DNA, 22 bp, Homo sapiens
tttgggaatagcagggactgag

SEQ ID NO: 7291335 - DNA, 22 bp, Homo sapiens
tttgggaataattgcacagatt

SEQ ID NO: 7291336 - DNA, 22 bp, Homo sapiens
tttgggaagtttaaaataagta

SEQ ID NO: 7291337 - DNA, 22 bp, Homo sapiens
tttgggaaataaacctagagga

SEQ ID NO: 7291338 - DNA, 20 bp, Homo sapiens
ctgagcccttcctgtgaacc

SEQ ID NO: 7291339 - DNA, 22 bp, Homo sapiens
ctgagccctgcctcttgtcact

SEQ ID NO: 7291340 - DNA, 22 bp, Homo sapiens
ctgagccctggctcgcctggag

SEQ ID NO: 7291341 - DNA, 22 bp, Homo sapiens
ctgagcccttgtcttcctggtc

SEQ ID NO: 7291342 - DNA, 17 bp, Homo sapiens
ctgagccccgggcagct

SEQ ID NO: 7291343 - DNA, 22 bp, Homo sapiens
ctgagcccctctgacctcagag

SEQ ID NO: 7291344 - DNA, 22 bp, Homo sapiens
ctgagccctcctgcttgctgag

SEQ ID NO: 7291345 - DNA, 22 bp, Homo sapiens
ctgagcccattgggtgctgtta

SEQ ID NO: 7291346 - DNA, 22 bp, Homo sapiens
ctgagccccatctgaggtgccc

SEQ ID NO: 7291347 - DNA, 20 bp, Homo sapiens
ctgagcccccagcctgcagg

SEQ ID NO: 7291348 - DNA, 20 bp, Homo sapiens
ctgagcccagatcccaggtc

SEQ ID NO: 7291349 - DNA, 22 bp, Homo sapiens
ctgagcccaggcgggagctgag

SEQ ID NO: 7291350 - DNA, 22 bp, Homo sapiens
ctgacagatctggatctgaact

SEQ ID NO: 7291351 - DNA, 22 bp, Homo sapiens
ctgacagatacttatgacataa

SEQ ID NO: 7291352 - DNA, 22 bp, Homo sapiens
ctgacagattagatgtgcatat

SEQ ID NO: 7291353 - DNA, 22 bp, Homo sapiens
ctgacagatgctgctggcagta

SEQ ID NO: 7291354 - DNA, 22 bp, Homo sapiens
ctgcagggatgtgaggcccgtt

SEQ ID NO: 7291355 - DNA, 22 bp, Homo sapiens
ctgcacagaggtcggtctgcca

SEQ ID NO: 7291356 - DNA, 22 bp, Homo sapiens
ctgcacagggatatggggagct

SEQ ID NO: 7291357 - DNA, 22 bp, Homo sapiens
ctgcacagcctgtctgggggcc

SEQ ID NO: 7291358 - DNA, 22 bp, Homo sapiens
ctgcacagtgttggaagctgcc

SEQ ID NO: 7291359 - DNA, 22 bp, Homo sapiens
ctgcacagtggacagtgaagat

SEQ ID NO: 7291360 - DNA, 22 bp, Homo sapiens
ccaggccagcaggcacacctgc

SEQ ID NO: 7291361 - DNA, 22 bp, Homo sapiens
ccaggccagagtgcagtggcac

SEQ ID NO: 7291362 - DNA, 22 bp, Homo sapiens
ccaggccagcctggagcatggc

SEQ ID NO: 7291363 - DNA, 22 bp, Homo sapiens
ccaggccagcgctggctggagg

SEQ ID NO: 7291364 - DNA, 22 bp, Homo sapiens
ccaggctggagtgcaatggcgt

SEQ ID NO: 7291365 - DNA, 22 bp, Homo sapiens
ccaggctggagtgcaatggtgc

SEQ ID NO: 7291366 - DNA, 22 bp, Homo sapiens
ccaggctgctgttggtgtccgc

SEQ ID NO: 7291367 - DNA, 22 bp, Homo sapiens
ccaggctgagcatgattggagc

SEQ ID NO: 7291368 - DNA, 22 bp, Homo sapiens
ccaggctgaatatgttccaggg

SEQ ID NO: 7291369 - DNA, 22 bp, Homo sapiens
ccaggcctggaccatgccaggg

SEQ ID NO: 7291370 - DNA, 22 bp, Homo sapiens
ccaggccagggctgcagcgagc

SEQ ID NO: 7291371 - DNA, 22 bp, Homo sapiens
ccaggccaggagagcgaggttt

SEQ ID NO: 7291372 - DNA, 21 bp, Homo sapiens
ccaggccaggcctacggggat

SEQ ID NO: 7291373 - DNA, 19 bp, Homo sapiens
ccaggccatcccagttccc

SEQ ID NO: 7291374 - DNA, 22 bp, Homo sapiens
ccaggccagtgtttggtccagg

SEQ ID NO: 7291375 - DNA, 18 bp, Homo sapiens
ccaggccatgaacctctg

SEQ ID NO: 7291376 - DNA, 22 bp, Homo sapiens
ccaggccattcccagagttgct

SEQ ID NO: 7291377 - DNA, 22 bp, Homo sapiens
ccagagagaaaatggagggcca

SEQ ID NO: 7291378 - DNA, 22 bp, Homo sapiens
ccaggacagggagacgggagcc

SEQ ID NO: 7291379 - DNA, 22 bp, Homo sapiens
ccaggaccacacgacaggagag

SEQ ID NO: 7291380 - DNA, 22 bp, Homo sapiens
ccaggaccctgcaaaccctgtt

SEQ ID NO: 7291381 - DNA, 22 bp, Homo sapiens
tgcacagaatcattttcagctg

SEQ ID NO: 7291382 - DNA, 22 bp, Homo sapiens
tgcacagaataatatatgttct

SEQ ID NO: 7291383 - DNA, 20 bp, Homo sapiens
cccagaagcttaacagagca

SEQ ID NO: 7291384 - DNA, 21 bp, Homo sapiens
cccagaagttccatggggggc

SEQ ID NO: 7291385 - DNA, 23 bp, Homo sapiens
tgattttaaaaagtaagttatca

SEQ ID NO: 7291386 - DNA, 21 bp, Homo sapiens
ccattgagaccatggaggagt

SEQ ID NO: 7291387 - DNA, 22 bp, Homo sapiens
ccatgtggtctgtgtagcaact

SEQ ID NO: 7291388 - DNA, 22 bp, Homo sapiens
tgagggctgtggaaggctaacc

SEQ ID NO: 7291389 - DNA, 22 bp, Homo sapiens
tgagggctgacaggaggacagc

SEQ ID NO: 7291390 - DNA, 22 bp, Homo sapiens
tgagggctaaattgtggcaggt

SEQ ID NO: 7291391 - DNA, 22 bp, Homo sapiens
ccaggggaaacagggagcactc

SEQ ID NO: 7291392 - DNA, 22 bp, Homo sapiens
tgacaatagcgatttatcttgc

SEQ ID NO: 7291393 - DNA, 22 bp, Homo sapiens
tgacagttaaggtatacattca

SEQ ID NO: 7291394 - DNA, 22 bp, Homo sapiens
ccaggggaaacagggagcactc

SEQ ID NO: 7291395 - DNA, 22 bp, Homo sapiens
tgagaaaaggttgagatgataa

SEQ ID NO: 7291396 - DNA, 22 bp, Homo sapiens
tgagaaaagtacatggagaagc

SEQ ID NO: 7291397 - DNA, 22 bp, Homo sapiens
ccaggctggagtgcagtggcac

SEQ ID NO: 7291398 - DNA, 22 bp, Homo sapiens
ccaggctggagtgcagtagtgt

SEQ ID NO: 7291399 - DNA, 22 bp, Homo sapiens
ccaggctggagtgtagtcgcat

SEQ ID NO: 7291400 - DNA, 22 bp, Homo sapiens
ccaggctggattttgcagttca

SEQ ID NO: 7291401 - DNA, 21 bp, Homo sapiens
ccaggctggccatggtattga

SEQ ID NO: 7291402 - DNA, 20 bp, Homo sapiens
ccaggctggcaaatgggggc

SEQ ID NO: 7291403 - DNA, 22 bp, Homo sapiens
tgaatgcaagaaggaacatgaa

SEQ ID NO: 7291404 - DNA, 22 bp, Homo sapiens
ccaggtgtgccagcagggactg

SEQ ID NO: 7291405 - DNA, 22 bp, Homo sapiens
ccaggtgtgctctgcagtggat

SEQ ID NO: 7291406 - DNA, 22 bp, Homo sapiens
tgaggacatttatcttggcgca

SEQ ID NO: 7291407 - DNA, 22 bp, Homo sapiens
ccaggtgtaggacaccaaggga

SEQ ID NO: 7291408 - DNA, 20 bp, Homo sapiens
tgagacccgctgacaagttc

SEQ ID NO: 7291409 - DNA, 17 bp, Homo sapiens
ccaggtggaatcgtgga

SEQ ID NO: 7291410 - DNA, 22 bp, Homo sapiens
tgagaaggcctgtgtgacaggg

SEQ ID NO: 7291411 - DNA, 20 bp, Homo sapiens
tgccagtgtgtcaatttata

SEQ ID NO: 7291412 - DNA, 22 bp, Homo sapiens
tgccagtgtagtagctggttta

SEQ ID NO: 7291413 - DNA, 22 bp, Homo sapiens
tgccagtgggtgtgcagagact

SEQ ID NO: 7291414 - DNA, 22 bp, Homo sapiens
tgccagtgtctgctatctgaga

SEQ ID NO: 7291415 - DNA, 22 bp, Homo sapiens
tgccagtgtgagtggagttctt

SEQ ID NO: 7291416 - DNA, 20 bp, Homo sapiens
tgcacagacaatgagcccag

SEQ ID NO: 7291417 - DNA, 22 bp, Homo sapiens
tgcacagacatacacatatatg

SEQ ID NO: 7291418 - DNA, 22 bp, Homo sapiens
tgcacagagagatgagacacgt

SEQ ID NO: 7291419 - DNA, 22 bp, Homo sapiens
tgcacagagcaggcaccagcgg

SEQ ID NO: 7291420 - DNA, 22 bp, Homo sapiens
tgcacagagcaggcaccagcgg

SEQ ID NO: 7291421 - DNA, 22 bp, Homo sapiens
tgccaggaggcggcttgggaaa

SEQ ID NO: 7291422 - DNA, 22 bp, Homo sapiens
tgccaggacaaggaccacatgg

SEQ ID NO: 7291423 - DNA, 22 bp, Homo sapiens
tgccaggagtgtagagtggttt

SEQ ID NO: 7291424 - DNA, 22 bp, Homo sapiens
tgccagtgcttgtgtctgagca

SEQ ID NO: 7291425 - DNA, 22 bp, Homo sapiens
cccaggagagaggccagttggc

SEQ ID NO: 7291426 - DNA, 22 bp, Homo sapiens
tgcctgtgttgattactttgtc

SEQ ID NO: 7291427 - DNA, 22 bp, Homo sapiens
tgcctgttaagggtgtagatat

SEQ ID NO: 7291428 - DNA, 22 bp, Homo sapiens
tgcctgtgtggggtctgccgcc

SEQ ID NO: 7291429 - DNA, 22 bp, Homo sapiens
tgcctgtgtggtctgcgcatta

SEQ ID NO: 7291430 - DNA, 22 bp, Homo sapiens
tgcctgtgtgaccacgggcaag

SEQ ID NO: 7291431 - DNA, 22 bp, Homo sapiens
tgctgtgtaaaaggtgattgaa

SEQ ID NO: 7291432 - DNA, 22 bp, Homo sapiens
tggaagggagctggaatttgga

SEQ ID NO: 7291433 - DNA, 22 bp, Homo sapiens
tgctgtgttcaccaatatgtgt

SEQ ID NO: 7291434 - DNA, 22 bp, Homo sapiens
tgctgtgttctcctgactcacc

SEQ ID NO: 7291435 - DNA, 22 bp, Homo sapiens
tggaatgtgttctattttacag

SEQ ID NO: 7291436 - DNA, 22 bp, Homo sapiens
tggaatgtcagctacaagaggg

SEQ ID NO: 7291437 - DNA, 22 bp, Homo sapiens
tggaatgtgaacatacaaggta

SEQ ID NO: 7291438 - DNA, 16 bp, Homo sapiens
tggagcaggcaggatg

SEQ ID NO: 7291439 - DNA, 22 bp, Homo sapiens
ccctctctcaggctgacagcct

SEQ ID NO: 7291440 - DNA, 22 bp, Homo sapiens
cctgagctccagtagcagccag

SEQ ID NO: 7291441 - DNA, 22 bp, Homo sapiens
tgggcccaggtcctgggagaag

SEQ ID NO: 7291442 - DNA, 22 bp, Homo sapiens
tgggctgctgtctgcacatgct

SEQ ID NO: 7291443 - DNA, 17 bp, Homo sapiens
cctcttcctctcagctg

SEQ ID NO: 7291444 - DNA, 17 bp, Homo sapiens
cctcttcctctcagctg

SEQ ID NO: 7291445 - DNA, 22 bp, Homo sapiens
tgggaaggaactgcctttagct

SEQ ID NO: 7291446 - DNA, 22 bp, Homo sapiens
tgggaaggacgtgtcagtggca

SEQ ID NO: 7291447 - DNA, 22 bp, Homo sapiens
tgggaagctgcattttaacaag

SEQ ID NO: 7291448 - DNA, 22 bp, Homo sapiens
cctctgtggccctgactctctt

SEQ ID NO: 7291449 - DNA, 22 bp, Homo sapiens
cctctgtggccttggaccagct

SEQ ID NO: 7291450 - DNA, 22 bp, Homo sapiens
tgggaaggcagtcactgtccta

SEQ ID NO: 7291451 - DNA, 22 bp, Homo sapiens
cctcttcctcaccatctacaac

SEQ ID NO: 7291452 - DNA, 19 bp, Homo sapiens
cctctgtgggagtcagtga

SEQ ID NO: 7291453 - DNA, 19 bp, Homo sapiens
cctctgtgggagtcagtga

SEQ ID NO: 7291454 - DNA, 22 bp, Homo sapiens
tgggaaggataccttggaacat

SEQ ID NO: 7291455 - DNA, 20 bp, Homo sapiens
tggcccagcacgacgaggac

SEQ ID NO: 7291456 - DNA, 22 bp, Homo sapiens
tggcccagcactccaagtaggg

SEQ ID NO: 7291457 - DNA, 22 bp, Homo sapiens
cctcagttttctcatctgtaaa

SEQ ID NO: 7291458 - DNA, 22 bp, Homo sapiens
cctcagtgtgcagcagcatctg

SEQ ID NO: 7291459 - DNA, 22 bp, Homo sapiens
cccttcctcccaggcttctgtg

SEQ ID NO: 7291460 - DNA, 19 bp, Homo sapiens
tccaggagcaaagccagtt

SEQ ID NO: 7291461 - DNA, 22 bp, Homo sapiens
catgggaggtctgcaaggtgct

SEQ ID NO: 7291462 - DNA, 17 bp, Homo sapiens
tccaggagaggcaatgg

SEQ ID NO: 7291463 - DNA, 22 bp, Homo sapiens
cattacatttcaaaatgtttcc

SEQ ID NO: 7291464 - DNA, 22 bp, Homo sapiens
cattgttaattggtatcttaca

SEQ ID NO: 7291465 - DNA, 22 bp, Homo sapiens
cattgttggtaatgctcagagg

SEQ ID NO: 7291466 - DNA, 22 bp, Homo sapiens
cattgttggcagagggacagag

SEQ ID NO: 7291467 - DNA, 22 bp, Homo sapiens
cattgttgctgcttcaagatat

SEQ ID NO: 7291468 - DNA, 22 bp, Homo sapiens
cattgttgaacacctgctggat

SEQ ID NO: 7291469 - DNA, 22 bp, Homo sapiens
cattgttgttaaacatagtaat

SEQ ID NO: 7291470 - DNA, 22 bp, Homo sapiens
cattgttgtgagatcaagcagt

SEQ ID NO: 7291471 - DNA, 22 bp, Homo sapiens
cattgttggtcattgtcggttg

SEQ ID NO: 7291472 - DNA, 22 bp, Homo sapiens
ccactgtgagcatgaacaggac

SEQ ID NO: 7291473 - DNA, 22 bp, Homo sapiens
ccactgtgtccaccaggaatgc

SEQ ID NO: 7291474 - DNA, 22 bp, Homo sapiens
tcctggcagggtggcagcgggt

SEQ ID NO: 7291475 - DNA, 22 bp, Homo sapiens
tcctggcaggtcagcaggagca

SEQ ID NO: 7291476 - DNA, 22 bp, Homo sapiens
tcctgggcttaagtgatcctcc

SEQ ID NO: 7291477 - DNA, 18 bp, Homo sapiens
cataattttctttcttta

SEQ ID NO: 7291478 - DNA, 18 bp, Homo sapiens
cataattttctttcttta

SEQ ID NO: 7291479 - DNA, 22 bp, Homo sapiens
cataatttgatatgcttgatgg

SEQ ID NO: 7291480 - DNA, 22 bp, Homo sapiens
cataatttctgtatcagcacca

SEQ ID NO: 7291481 - DNA, 22 bp, Homo sapiens
cataattttccatggtttgcta

SEQ ID NO: 7291482 - DNA, 22 bp, Homo sapiens
cataatttgtggtagtggggga

SEQ ID NO: 7291483 - DNA, 22 bp, Homo sapiens
cataatttcccaagagattgaa

SEQ ID NO: 7291484 - DNA, 22 bp, Homo sapiens
cataatttcactgtcgtatggc

SEQ ID NO: 7291485 - DNA, 22 bp, Homo sapiens
cataatttctaccagggccata

SEQ ID NO: 7291486 - DNA, 17 bp, Homo sapiens
tcaggctgtgcctggta

SEQ ID NO: 7291487 - DNA, 22 bp, Homo sapiens
tcagagagttagtgtcttagct

SEQ ID NO: 7291488 - DNA, 22 bp, Homo sapiens
cagttgcctactacatggcagg

SEQ ID NO: 7291489 - DNA, 21 bp, Homo sapiens
tcagagagtcacagtgaactg

SEQ ID NO: 7291490 - DNA, 22 bp, Homo sapiens
tcagatgagtgctttcagctgc

SEQ ID NO: 7291491 - DNA, 22 bp, Homo sapiens
cagttttctaaagtctctttaa

SEQ ID NO: 7291492 - DNA, 22 bp, Homo sapiens
cagtttttcaaaattacatgat

SEQ ID NO: 7291493 - DNA, 22 bp, Homo sapiens
tcagatatgaattcatatctct

SEQ ID NO: 7291494 - DNA, 22 bp, Homo sapiens
tcagatatagtcatttaaataa

SEQ ID NO: 7291495 - DNA, 23 bp, Homo sapiens
tccaggagaattccagggcccgg

SEQ ID NO: 7291496 - DNA, 22 bp, Homo sapiens
tccaggagaaggccatccagcg

SEQ ID NO: 7291497 - DNA, 22 bp, Homo sapiens
catgaattttaagactgttttt

SEQ ID NO: 7291498 - DNA, 22 bp, Homo sapiens
catgaattagcaatggtgtgca

SEQ ID NO: 7291499 - DNA, 22 bp, Homo sapiens
catgcaggcctatggagcagtg

SEQ ID NO: 7291500 - DNA, 22 bp, Homo sapiens
catgcagtttctctatgcgtag

SEQ ID NO: 7291501 - DNA, 22 bp, Homo sapiens
catgcaggtctggagcttgggg

SEQ ID NO: 7291502 - DNA, 22 bp, Homo sapiens
catgaacatttgtttacatctg

SEQ ID NO: 7291503 - DNA, 22 bp, Homo sapiens
catgaagatcctgtatgttttt

SEQ ID NO: 7291504 - DNA, 22 bp, Homo sapiens
catgaaattgctcctttggtgc

SEQ ID NO: 7291505 - DNA, 21 bp, Homo sapiens
catctcagtgggttggtggat

SEQ ID NO: 7291506 - DNA, 22 bp, Homo sapiens
catctcacttccctgcagcatc

SEQ ID NO: 7291507 - DNA, 22 bp, Homo sapiens
catctcactgaggggtttacaa

SEQ ID NO: 7291508 - DNA, 22 bp, Homo sapiens
cagtatttttaagctgctttgt

SEQ ID NO: 7291509 - DNA, 21 bp, Homo sapiens
cagtattttaagcagtgagtt

SEQ ID NO: 7291510 - DNA, 22 bp, Homo sapiens
tatttgaagattcttctgatgt

SEQ ID NO: 7291511 - DNA, 22 bp, Homo sapiens
cagtcaggggtgggatcaaggc

SEQ ID NO: 7291512 - DNA, 22 bp, Homo sapiens
tcaaaacactattacctttaat

SEQ ID NO: 7291513 - DNA, 22 bp, Homo sapiens
tcaagcaagtgtttggtgtaaa

SEQ ID NO: 7291514 - DNA, 22 bp, Homo sapiens
tcaatagataaagctacataaa

SEQ ID NO: 7291515 - DNA, 23 bp, Homo sapiens
tcaagcaataattggtaatagtg

SEQ ID NO: 7291516 - DNA, 22 bp, Homo sapiens
tcaagcaagttgcatattgcta

SEQ ID NO: 7291517 - DNA, 22 bp, Homo sapiens
caggtgggtacatcacagagac

SEQ ID NO: 7291518 - DNA, 22 bp, Homo sapiens
caggtaagaccgtttaggcagt

SEQ ID NO: 7291519 - DNA, 22 bp, Homo sapiens
cagggagcagcccctagaagta

SEQ ID NO: 7291520 - DNA, 22 bp, Homo sapiens
taggagggccctgaaaatggca

SEQ ID NO: 7291521 - DNA, 22 bp, Homo sapiens
taggcatgcaaataaatgtgca

SEQ ID NO: 7291522 - DNA, 22 bp, Homo sapiens
taggcatgtggcatacctatgg

SEQ ID NO: 7291523 - DNA, 22 bp, Homo sapiens
cagggctgaaatcaaggtgtag

SEQ ID NO: 7291524 - DNA, 22 bp, Homo sapiens
cagggtagacagtaggtgtctg

SEQ ID NO: 7291525 - DNA, 22 bp, Homo sapiens
cagggtagggcaagggaacctg

SEQ ID NO: 7291526 - DNA, 22 bp, Homo sapiens
caggcaccccaggtgagcactg

SEQ ID NO: 7291527 - DNA, 22 bp, Homo sapiens
caggcacctttgtgcatgggca

SEQ ID NO: 7291528 - DNA, 22 bp, Homo sapiens
taagtattggcctatagctaga

SEQ ID NO: 7291529 - DNA, 22 bp, Homo sapiens
caggccagtgtgcttcccaggc

SEQ ID NO: 7291530 - DNA, 22 bp, Homo sapiens
caggccagttttgatttaagcc

SEQ ID NO: 7291531 - DNA, 19 bp, Homo sapiens
caggccagtgtcagggggc

SEQ ID NO: 7291532 - DNA, 22 bp, Homo sapiens
caggccagggttgagaagagaa

SEQ ID NO: 7291533 - DNA, 22 bp, Homo sapiens
caggccaggtgctctagaatca

SEQ ID NO: 7291534 - DNA, 22 bp, Homo sapiens
caggccaggtggcaggcaaaac

SEQ ID NO: 7291535 - DNA, 22 bp, Homo sapiens
caggccagtgggaaatagggat

SEQ ID NO: 7291536 - DNA, 22 bp, Homo sapiens
tacaaaccagcagaataggtcc

SEQ ID NO: 7291537 - DNA, 22 bp, Homo sapiens
tacaaaccaaggaacagtgatc

SEQ ID NO: 7291538 - DNA, 22 bp, Homo sapiens
caggccagggagaatatgaagc

SEQ ID NO: 7291539 - DNA, 22 bp, Homo sapiens
caggccagagcgcgtggttggg

SEQ ID NO: 7291540 - DNA, 22 bp, Homo sapiens
taatgtcaaggtcattctagag

SEQ ID NO: 7291541 - DNA, 20 bp, Homo sapiens
taatgtcaaagtcacaaggt

SEQ ID NO: 7291542 - DNA, 22 bp, Homo sapiens
taatgtcaaggtgatagatttg

SEQ ID NO: 7291543 - DNA, 22 bp, Homo sapiens
taatgtcagcatagtttatttt

SEQ ID NO: 7291544 - DNA, 22 bp, Homo sapiens
taatgtcagtgacctggtttaa

SEQ ID NO: 7291545 - DNA, 22 bp, Homo sapiens
caggcctgcttcttacccttca

SEQ ID NO: 7291546 - DNA, 22 bp, Homo sapiens
caggcctgatacactgaactct

SEQ ID NO: 7291547 - DNA, 22 bp, Homo sapiens
caggcctgagtgtggaagtctt

SEQ ID NO: 7291548 - DNA, 22 bp, Homo sapiens
caggcctcttccatgcagcagc

SEQ ID NO: 7291549 - DNA, 22 bp, Homo sapiens
caggcctgaccctgagcttcac

SEQ ID NO: 7291550 - DNA, 22 bp, Homo sapiens
caggcctgagacatctgagata

SEQ ID NO: 7291551 - DNA, 22 bp, Homo sapiens
tactgtggttactgctattaga

SEQ ID NO: 7291552 - DNA, 22 bp, Homo sapiens
tactgtggtaacattttaaatt

SEQ ID NO: 7291553 - DNA, 22 bp, Homo sapiens
caggctgggaacgccacccgct

SEQ ID NO: 7291554 - DNA, 22 bp, Homo sapiens
caggctgggactgacccctgct

SEQ ID NO: 7291555 - DNA, 22 bp, Homo sapiens
caggctgggactgacccctgct

SEQ ID NO: 7291556 - DNA, 22 bp, Homo sapiens
tagaaaagctctaaggcctctc

SEQ ID NO: 7291557 - DNA, 22 bp, Homo sapiens
caggctggagttcagtggtgtg

SEQ ID NO: 7291558 - DNA, 22 bp, Homo sapiens
caggctggagttcagtggtgtg

SEQ ID NO: 7291559 - DNA, 22 bp, Homo sapiens
caggctggagtgcagtggtgcc

SEQ ID NO: 7291560 - DNA, 22 bp, Homo sapiens
caggctggagtgcagtggtgcc

SEQ ID NO: 7291561 - DNA, 22 bp, Homo sapiens
caggctgtctgaatggaggccc

SEQ ID NO: 7291562 - DNA, 22 bp, Homo sapiens
cagggacaatggcagagcctga

SEQ ID NO: 7291563 - DNA, 20 bp, Homo sapiens
cagggacagcagtgggtttt

SEQ ID NO: 7291564 - DNA, 22 bp, Homo sapiens
cagggacagagactgcaccttg

SEQ ID NO: 7291565 - DNA, 22 bp, Homo sapiens
ttttatagctgaatagtattcc

SEQ ID NO: 7291566 - DNA, 22 bp, Homo sapiens
ttttataaagagagtcagttgg

SEQ ID NO: 7291567 - DNA, 22 bp, Homo sapiens
ttttagtttggatttctaaagc

SEQ ID NO: 7291568 - DNA, 22 bp, Homo sapiens
tttgtttctgcaatacctatag

SEQ ID NO: 7291569 - DNA, 22 bp, Homo sapiens
tttgtttagatggtaaatcagt

SEQ ID NO: 7291570 - DNA, 22 bp, Homo sapiens
tttgttttgaactagctcagaa

SEQ ID NO: 7291571 - DNA, 22 bp, Homo sapiens
tttgttctgaagcaagtaggga

SEQ ID NO: 7291572 - DNA, 22 bp, Homo sapiens
tttgttgtgataatggtctgca

SEQ ID NO: 7291573 - DNA, 22 bp, Homo sapiens
tttgttgttagagtatgtgaaa

SEQ ID NO: 7291574 - DNA, 22 bp, Homo sapiens
tttgttgtcatcagtgatgagt

SEQ ID NO: 7291575 - DNA, 22 bp, Homo sapiens
tttggagatggagagagggcat

SEQ ID NO: 7291576 - DNA, 22 bp, Homo sapiens
tttggaagggaaagaaagtact

SEQ ID NO: 7291577 - DNA, 22 bp, Homo sapiens
ttttgaagaagatgggaattta

SEQ ID NO: 7291578 - DNA, 22 bp, Homo sapiens
ttttgaataattcagaaacagc

SEQ ID NO: 7291579 - DNA, 22 bp, Homo sapiens
tttttgctaatccccagccact

SEQ ID NO: 7291580 - DNA, 22 bp, Homo sapiens
tttttgctccacaactttgaag

SEQ ID NO: 7291581 - DNA, 22 bp, Homo sapiens
tttttgctgataagcagaattc

SEQ ID NO: 7291582 - DNA, 22 bp, Homo sapiens
ttttttgtcttgaagaaatggt

SEQ ID NO: 7291583 - DNA, 22 bp, Homo sapiens
tttttgatctgagcagttggag

SEQ ID NO: 7291584 - DNA, 23 bp, Homo sapiens
ttttttgtcttgctaggctgccc

SEQ ID NO: 7291585 - DNA, 22 bp, Homo sapiens
tttcattttggttatgccataa

SEQ ID NO: 7291586 - DNA, 22 bp, Homo sapiens
tttcattgtcatctatcttaga

SEQ ID NO: 7291587 - DNA, 22 bp, Homo sapiens
tttcagagttgtcttcttgacc

SEQ ID NO: 7291588 - DNA, 22 bp, Homo sapiens
tttcaaagagttgtaaattact

SEQ ID NO: 7291589 - DNA, 22 bp, Homo sapiens
tttcaaagaccattaactatca

SEQ ID NO: 7291590 - DNA, 22 bp, Homo sapiens
tttcaaagacagccatatttgt

SEQ ID NO: 7291591 - DNA, 21 bp, Homo sapiens
tttctcataaaatactcatta

SEQ ID NO: 7291592 - DNA, 22 bp, Homo sapiens
tttctagaaacattatctctat

SEQ ID NO: 7291593 - DNA, 18 bp, Homo sapiens
tttctcagactctctttc

SEQ ID NO: 7291594 - DNA, 22 bp, Homo sapiens
tttctcatggacccttcatgat

SEQ ID NO: 7291595 - DNA, 22 bp, Homo sapiens
tttctcatagtcatgcctctta

SEQ ID NO: 7291596 - DNA, 22 bp, Homo sapiens
tttctcctcatgactggttgtg

SEQ ID NO: 7291597 - DNA, 22 bp, Homo sapiens
tttctaagtaaacacagcatac

SEQ ID NO: 7291598 - DNA, 22 bp, Homo sapiens
tttctcttgcgatatgctacac

SEQ ID NO: 7291599 - DNA, 22 bp, Homo sapiens
tttctgaagggcagcagactct

SEQ ID NO: 7291600 - DNA, 21 bp, Homo sapiens
tttctgaaggcaacatctatc

SEQ ID NO: 7291601 - DNA, 22 bp, Homo sapiens
tttctgaaaactgaagtagtgc

SEQ ID NO: 7291602 - DNA, 22 bp, Homo sapiens
tttctcctgagttccacgctac

SEQ ID NO: 7291603 - DNA, 17 bp, Homo sapiens
tttctccttccatctca

SEQ ID NO: 7291604 - DNA, 22 bp, Homo sapiens
tttctccttgtgtctcctttga

SEQ ID NO: 7291605 - DNA, 23 bp, Homo sapiens
tttctgaagttgagatggacttt

SEQ ID NO: 7291606 - DNA, 22 bp, Homo sapiens
tttcttatgagcaagactctat

SEQ ID NO: 7291607 - DNA, 22 bp, Homo sapiens
tttcttgtttcatggtgtctca

SEQ ID NO: 7291608 - DNA, 22 bp, Homo sapiens
tttcttgtctttagtatctggc

SEQ ID NO: 7291609 - DNA, 22 bp, Homo sapiens
tttatacttcataatgtctatt

SEQ ID NO: 7291610 - DNA, 22 bp, Homo sapiens
tttatagatgtctgtattataa

SEQ ID NO: 7291611 - DNA, 22 bp, Homo sapiens
tttatagtcgtctcagtaataa

SEQ ID NO: 7291612 - DNA, 23 bp, Homo sapiens
tttatagcagcatgatttatagt

SEQ ID NO: 7291613 - DNA, 23 bp, Homo sapiens
tttatagcagcatgatttataat

SEQ ID NO: 7291614 - DNA, 22 bp, Homo sapiens
tttatataacagagactgctat

SEQ ID NO: 7291615 - DNA, 22 bp, Homo sapiens
tttacaaggcagaactgattaa

SEQ ID NO: 7291616 - DNA, 22 bp, Homo sapiens
tttacgtgaaggtgttatgtgt

SEQ ID NO: 7291617 - DNA, 22 bp, Homo sapiens
tttaattctggcataatagctc

SEQ ID NO: 7291618 - DNA, 22 bp, Homo sapiens
tttaattttcctcttcctggag

SEQ ID NO: 7291619 - DNA, 22 bp, Homo sapiens
ttggttcagtaggcatgcctgg

SEQ ID NO: 7291620 - DNA, 22 bp, Homo sapiens
ttgtctaatgagctccacttca

SEQ ID NO: 7291621 - DNA, 22 bp, Homo sapiens
ttgtctaaggaggtagaggact

SEQ ID NO: 7291622 - DNA, 22 bp, Homo sapiens
ttgcaagaaataatcgaataga

SEQ ID NO: 7291623 - DNA, 22 bp, Homo sapiens
ttgtgtgtttgtagaaaatcca

SEQ ID NO: 7291624 - DNA, 22 bp, Homo sapiens
ttgtgtgtgtaactttatgaga

SEQ ID NO: 7291625 - DNA, 19 bp, Homo sapiens
ttgtgtgtcagtcagagtt

SEQ ID NO: 7291626 - DNA, 22 bp, Homo sapiens
ttgtgtgtcttcttcactgccc

SEQ ID NO: 7291627 - DNA, 22 bp, Homo sapiens
ttgtgtgtgagccttcaccaca

SEQ ID NO: 7291628 - DNA, 19 bp, Homo sapiens
ttgtgtgtcagtcagagtt

SEQ ID NO: 7291629 - DNA, 20 bp, Homo sapiens
ttgtttaaaggtgaagaggc

SEQ ID NO: 7291630 - DNA, 20 bp, Homo sapiens
ttgtttaaaggtgaagaggc

SEQ ID NO: 7291631 - DNA, 22 bp, Homo sapiens
ttgtttcattttggctaaactg

SEQ ID NO: 7291632 - DNA, 22 bp, Homo sapiens
ttgtttcttcaggcttttagga

SEQ ID NO: 7291633 - DNA, 17 bp, Homo sapiens
ttgtttgttcttgcccc

SEQ ID NO: 7291634 - DNA, 22 bp, Homo sapiens
ttgtttgtgctatttaatgtag

SEQ ID NO: 7291635 - DNA, 22 bp, Homo sapiens
ttgttttattctgcaatttccc

SEQ ID NO: 7291636 - DNA, 22 bp, Homo sapiens
ttcacaatagctggcatcatct

SEQ ID NO: 7291637 - DNA, 22 bp, Homo sapiens
ttcacaggttctttttaaggct

SEQ ID NO: 7291638 - DNA, 22 bp, Homo sapiens
ttcacagtaacagggggatatg

SEQ ID NO: 7291639 - DNA, 22 bp, Homo sapiens
ttcacagtaatgtgcccaggta

SEQ ID NO: 7291640 - DNA, 22 bp, Homo sapiens
ttcacagtaagtaggatagttg

SEQ ID NO: 7291641 - DNA, 22 bp, Homo sapiens
ttcacagtataggtttccagcg

SEQ ID NO: 7291642 - DNA, 22 bp, Homo sapiens
ttcacagtcacccttctccatg

SEQ ID NO: 7291643 - DNA, 22 bp, Homo sapiens
ttcacagtgctcacagttcagt

SEQ ID NO: 7291644 - DNA, 22 bp, Homo sapiens
ttcacagtgctcacagttcagt

SEQ ID NO: 7291645 - DNA, 22 bp, Homo sapiens
ttcacagtgccagggggcaggc

SEQ ID NO: 7291646 - DNA, 22 bp, Homo sapiens
ttcacagtctatcttggttttt

SEQ ID NO: 7291647 - DNA, 22 bp, Homo sapiens
ttcacagtgagctatgtcttgt

SEQ ID NO: 7291648 - DNA, 22 bp, Homo sapiens
ttcaactttatgcatatgtatt

SEQ ID NO: 7291649 - DNA, 22 bp, Homo sapiens
ttcaactttggagatttaataa

SEQ ID NO: 7291650 - DNA, 22 bp, Homo sapiens
ttcaacaattaagtatcagcct

SEQ ID NO: 7291651 - DNA, 22 bp, Homo sapiens
ttcaacaagtcttttttcactg

SEQ ID NO: 7291652 - DNA, 22 bp, Homo sapiens
ttcatggagttgagaaggctaa

SEQ ID NO: 7291653 - DNA, 18 bp, Homo sapiens
ttcatcatgactctgtgg

SEQ ID NO: 7291654 - DNA, 22 bp, Homo sapiens
ttccaatttgtggtgagttaat

SEQ ID NO: 7291655 - DNA, 22 bp, Homo sapiens
ttcacattccgcggctattttc

SEQ ID NO: 7291656 - DNA, 22 bp, Homo sapiens
ttcacagtggcttaggctatgg

SEQ ID NO: 7291657 - DNA, 22 bp, Homo sapiens
ttcacagtggctgtgccatttg

SEQ ID NO: 7291658 - DNA, 22 bp, Homo sapiens
ttcacagtggctgacaggctgg

SEQ ID NO: 7291659 - DNA, 22 bp, Homo sapiens
ttcacagtggctaagttctgca

SEQ ID NO: 7291660 - DNA, 22 bp, Homo sapiens
ttcacagtggccctctctgagt

SEQ ID NO: 7291661 - DNA, 21 bp, Homo sapiens
ttcacagtggataactttctg

SEQ ID NO: 7291662 - DNA, 22 bp, Homo sapiens
ttcacagtgctgcacctggctt

SEQ ID NO: 7291663 - DNA, 22 bp, Homo sapiens
ttccttctattcagctccaaga

SEQ ID NO: 7291664 - DNA, 22 bp, Homo sapiens
ttctagaaccatgacttcaggg

SEQ ID NO: 7291665 - DNA, 22 bp, Homo sapiens
ttctagaaactggagcaaacag

SEQ ID NO: 7291666 - DNA, 22 bp, Homo sapiens
ttctagaaacacatgcaaacag

SEQ ID NO: 7291667 - DNA, 22 bp, Homo sapiens
ttctacaatatgaataatgaag

SEQ ID NO: 7291668 - DNA, 22 bp, Homo sapiens
ttctaatacacggtatgacttt

SEQ ID NO: 7291669 - DNA, 22 bp, Homo sapiens
ttctaatagctgcctatgtatt

SEQ ID NO: 7291670 - DNA, 20 bp, Homo sapiens
ttccacatctttgcacatgc

SEQ ID NO: 7291671 - DNA, 22 bp, Homo sapiens
ttgaagagtttgatagagttga

SEQ ID NO: 7291672 - DNA, 22 bp, Homo sapiens
ttgaagagaatcagaaggttga

SEQ ID NO: 7291673 - DNA, 22 bp, Homo sapiens
ttctttatgcttctgtttaggc

SEQ ID NO: 7291674 - DNA, 22 bp, Homo sapiens
ttgagcatcttatagaaagagc

SEQ ID NO: 7291675 - DNA, 22 bp, Homo sapiens
ttgagcatctgaggattttcct

SEQ ID NO: 7291676 - DNA, 22 bp, Homo sapiens
ttgagcatcaattaagtgagtt

SEQ ID NO: 7291677 - DNA, 22 bp, Homo sapiens
ttgagcatatgcatttccaatt

SEQ ID NO: 7291678 - DNA, 22 bp, Homo sapiens
ttgagccctacctcagactttc

SEQ ID NO: 7291679 - DNA, 22 bp, Homo sapiens
ttgagcatttgttttgaaagag

SEQ ID NO: 7291680 - DNA, 23 bp, Homo sapiens
ttgagcatttgtggatactgaaa

SEQ ID NO: 7291681 - DNA, 21 bp, Homo sapiens
ttgagcatgtactttgtgctt

SEQ ID NO: 7291682 - DNA, 21 bp, Homo sapiens
ttgagcatgtaccctttgcct

SEQ ID NO: 7291683 - DNA, 22 bp, Homo sapiens
ttgagcatgtaactacacaggg

SEQ ID NO: 7291684 - DNA, 22 bp, Homo sapiens
ttgagatattcagttccattga

SEQ ID NO: 7291685 - DNA, 22 bp, Homo sapiens
ttgattttaaaatagtgacact

SEQ ID NO: 7291686 - DNA, 21 bp, Homo sapiens
ttgatttagcagatctagctg

SEQ ID NO: 7291687 - DNA, 22 bp, Homo sapiens
ttgattctacttaaaacatatg

SEQ ID NO: 7291688 - DNA, 22 bp, Homo sapiens
ttgattaaaatgagacatcatt

SEQ ID NO: 7291689 - DNA, 22 bp, Homo sapiens
ttcttgatttcatgcagttaag

SEQ ID NO: 7291690 - DNA, 22 bp, Homo sapiens
ttcttgattcttccttgaagga

SEQ ID NO: 7291691 - DNA, 22 bp, Homo sapiens
ttcttgatgaatgctaagaact

SEQ ID NO: 7291692 - DNA, 20 bp, Homo sapiens
ttctatacatatcactgaaa

SEQ ID NO: 7291693 - DNA, 22 bp, Homo sapiens
ttctagttttgccacaggatac

SEQ ID NO: 7291694 - DNA, 22 bp, Homo sapiens
ttctagttactcttaaatgctg

SEQ ID NO: 7291695 - DNA, 22 bp, Homo sapiens
ttctagttaatgtagcatcttg

SEQ ID NO: 7291696 - DNA, 22 bp, Homo sapiens
ttaattttctcatctgtgaaat

SEQ ID NO: 7291697 - DNA, 22 bp, Homo sapiens
ttaatttttatgtatagtgtgt

SEQ ID NO: 7291698 - DNA, 20 bp, Homo sapiens
ttagaagggccagatgaagg

SEQ ID NO: 7291699 - DNA, 22 bp, Homo sapiens
ttagagagaaccatcaggatct

SEQ ID NO: 7291700 - DNA, 22 bp, Homo sapiens
ttaaagcatcctgtcagtctgt

SEQ ID NO: 7291701 - DNA, 22 bp, Homo sapiens
tgttttgtagctaatagctatt

SEQ ID NO: 7291702 - DNA, 22 bp, Homo sapiens
tgttttgtgcacttctatagca

SEQ ID NO: 7291703 - DNA, 22 bp, Homo sapiens
tgttttgttcactgcattgtcc

SEQ ID NO: 7291704 - DNA, 22 bp, Homo sapiens
ttaaatggggatgagtagatgg

SEQ ID NO: 7291705 - DNA, 22 bp, Homo sapiens
ttaaatgatgcatatcatttag

SEQ ID NO: 7291706 - DNA, 22 bp, Homo sapiens
ttaaatgaacgagatatgcaac

SEQ ID NO: 7291707 - DNA, 22 bp, Homo sapiens
ttaagtcacttatctaaagaca

SEQ ID NO: 7291708 - DNA, 22 bp, Homo sapiens
ttaagtcacttatctaaagaca

SEQ ID NO: 7291709 - DNA, 22 bp, Homo sapiens
ttaagtaagaccttatgtcttg

SEQ ID NO: 7291710 - DNA, 22 bp, Homo sapiens
ttaattcagtcaaagaaaccat

SEQ ID NO: 7291711 - DNA, 22 bp, Homo sapiens
ttaacttgtcagaaaatacagt

SEQ ID NO: 7291712 - DNA, 22 bp, Homo sapiens
ttaacttttatttctgctcgcc

SEQ ID NO: 7291713 - DNA, 22 bp, Homo sapiens
ttaacacttgaactctacatgt

SEQ ID NO: 7291714 - DNA, 22 bp, Homo sapiens
tgtttaatttttcatgagccaa

SEQ ID NO: 7291715 - DNA, 22 bp, Homo sapiens
tgtttaattcaccatcatgttc

SEQ ID NO: 7291716 - DNA, 22 bp, Homo sapiens
tgtttaatgcattgaccttggg

SEQ ID NO: 7291717 - DNA, 22 bp, Homo sapiens
tgtttaatgaagatggtttttc

SEQ ID NO: 7291718 - DNA, 22 bp, Homo sapiens
tgtttaatttcacaaagttgac

SEQ ID NO: 7291719 - DNA, 22 bp, Homo sapiens
tgtttaattgggccaacagcgg

SEQ ID NO: 7291720 - DNA, 22 bp, Homo sapiens
tgtttaatctataaaatggaga

SEQ ID NO: 7291721 - DNA, 22 bp, Homo sapiens
tgtttaatcttcaggacagtct

SEQ ID NO: 7291722 - DNA, 22 bp, Homo sapiens
tgtttaataattctatgatagt

SEQ ID NO: 7291723 - DNA, 21 bp, Homo sapiens
tgtttaatacatatttgtgga

SEQ ID NO: 7291724 - DNA, 22 bp, Homo sapiens
tgtttaataattctatgatagt

SEQ ID NO: 7291725 - DNA, 22 bp, Homo sapiens
tgtttccccaaccccacaagta

SEQ ID NO: 7291726 - DNA, 22 bp, Homo sapiens
tgtttgcaaccccttgtgagaa

SEQ ID NO: 7291727 - DNA, 22 bp, Homo sapiens
tgttcaaatcttttgcttattt

SEQ ID NO: 7291728 - DNA, 22 bp, Homo sapiens
tgttatatctaaatagccacat

SEQ ID NO: 7291729 - DNA, 21 bp, Homo sapiens
tgttatgtgcttcaagaagtg

SEQ ID NO: 7291730 - DNA, 22 bp, Homo sapiens
tgtgttatctatctcgatgctt

SEQ ID NO: 7291731 - DNA, 22 bp, Homo sapiens
tgtgttcttaaaagcagtgata

SEQ ID NO: 7291732 - DNA, 22 bp, Homo sapiens
tgtgtgcacatgatttgaaatg

SEQ ID NO: 7291733 - DNA, 20 bp, Homo sapiens
tgtgtgcatctgtatgtatt

SEQ ID NO: 7291734 - DNA, 22 bp, Homo sapiens
tgtgtgcatacacacggtaaca

SEQ ID NO: 7291735 - DNA, 22 bp, Homo sapiens
tgtgtgcaggcactgtgccaga

SEQ ID NO: 7291736 - DNA, 22 bp, Homo sapiens
tgtgtgcaggcactgtgccaga

SEQ ID NO: 7291737 - DNA, 22 bp, Homo sapiens
tgtgtgcagacagatattactt

SEQ ID NO: 7291738 - DNA, 22 bp, Homo sapiens
tgtgtgcacttaatgcaatcat

SEQ ID NO: 7291739 - DNA, 22 bp, Homo sapiens
tgtgtgcagcggcaggtgaagt

SEQ ID NO: 7291740 - DNA, 22 bp, Homo sapiens
tgtgttgttttaagctgctgca

SEQ ID NO: 7291741 - DNA, 21 bp, Homo sapiens
tgtgtttgagactatgtttcc

SEQ ID NO: 7291742 - DNA, 22 bp, Homo sapiens
tgtggtatcaccatccactagt

SEQ ID NO: 7291743 - DNA, 23 bp, Homo sapiens
tgtgtccttaactgtatatacta

SEQ ID NO: 7291744 - DNA, 19 bp, Homo sapiens
tgtgtgcaaatggaagcca

SEQ ID NO: 7291745 - DNA, 22 bp, Homo sapiens
tgtgtgagtaaggctgagagag

SEQ ID NO: 7291746 - DNA, 22 bp, Homo sapiens
tgtgtgaggtggttctgagaag

SEQ ID NO: 7291747 - DNA, 22 bp, Homo sapiens
tgtgtgaggattcctggttctt

SEQ ID NO: 7291748 - DNA, 22 bp, Homo sapiens
tgtgtgagacaattggctgtgg

SEQ ID NO: 7291749 - DNA, 22 bp, Homo sapiens
tgtgtgaggactcagtgaaaca

SEQ ID NO: 7291750 - DNA, 22 bp, Homo sapiens
tgtggagcctcaaggccatctc

SEQ ID NO: 7291751 - DNA, 22 bp, Homo sapiens
tgtggagctggcaatatgggca

SEQ ID NO: 7291752 - DNA, 22 bp, Homo sapiens
tgtggcccgatcttgggagaca

SEQ ID NO: 7291753 - DNA, 22 bp, Homo sapiens
ggggccttggatctgtgccccg

SEQ ID NO: 7291754 - DNA, 22 bp, Homo sapiens
cagatgaccgtcttccagccag

SEQ ID NO: 7291755 - DNA, 22 bp, Homo sapiens
ggtatttatagtggtgcttagt

SEQ ID NO: 7291756 - DNA, 22 bp, Homo sapiens
cagatgcagcaaaatgacaggc

SEQ ID NO: 7291757 - DNA, 22 bp, Homo sapiens
gggttcctggctcctgtgtggt

SEQ ID NO: 7291758 - DNA, 22 bp, Homo sapiens
gggtccctggaattacttgaca

SEQ ID NO: 7291759 - DNA, 20 bp, Homo sapiens
cagagccaagagcagcatct

SEQ ID NO: 7291760 - DNA, 22 bp, Homo sapiens
cagagcagaagcggtcctcaca

SEQ ID NO: 7291761 - DNA, 22 bp, Homo sapiens
cagacacagatatgcatatggc

SEQ ID NO: 7291762 - DNA, 22 bp, Homo sapiens
cagaaacacttgtagagaagtt

SEQ ID NO: 7291763 - DNA, 22 bp, Homo sapiens
cagaataagctgtgttgtcaag

SEQ ID NO: 7291764 - DNA, 22 bp, Homo sapiens
cagacaaagcggaaactgttta

SEQ ID NO: 7291765 - DNA, 22 bp, Homo sapiens
cagccctcatctcagcttcttt

SEQ ID NO: 7291766 - DNA, 22 bp, Homo sapiens
cagccctggccccaggtggtct

SEQ ID NO: 7291767 - DNA, 22 bp, Homo sapiens
gtcagcaattcaagagctctta

SEQ ID NO: 7291768 - DNA, 22 bp, Homo sapiens
gtcagcaattcaagagctctta

SEQ ID NO: 7291769 - DNA, 22 bp, Homo sapiens
gtcagcaatagttagtttacaa

SEQ ID NO: 7291770 - DNA, 22 bp, Homo sapiens
gtcagcaaggtgcaagcggctg

SEQ ID NO: 7291771 - DNA, 22 bp, Homo sapiens
gtcagcaaggaaaatgtgtcac

SEQ ID NO: 7291772 - DNA, 22 bp, Homo sapiens
gtcagcaagatgaatcagcagg

SEQ ID NO: 7291773 - DNA, 22 bp, Homo sapiens
gtcagcaaaaaatttatgtgag

SEQ ID NO: 7291774 - DNA, 22 bp, Homo sapiens
gtcagagttccaaattaatcaa

SEQ ID NO: 7291775 - DNA, 22 bp, Homo sapiens
gtcacagaggctgccagggttg

SEQ ID NO: 7291776 - DNA, 21 bp, Homo sapiens
gtacacagtggttctgaggga

SEQ ID NO: 7291777 - DNA, 22 bp, Homo sapiens
gtacacaggcagcccagtgctg

SEQ ID NO: 7291778 - DNA, 22 bp, Homo sapiens
gtacactccccctgtgaagttg

SEQ ID NO: 7291779 - DNA, 22 bp, Homo sapiens
cagattaagtgctcaacagtgt

SEQ ID NO: 7291780 - DNA, 22 bp, Homo sapiens
cagcagccactagagggctcac

SEQ ID NO: 7291781 - DNA, 22 bp, Homo sapiens
cagcaaaggtagaagcacagga

SEQ ID NO: 7291782 - DNA, 22 bp, Homo sapiens
ggacatggagctccatggaggc

SEQ ID NO: 7291783 - DNA, 22 bp, Homo sapiens
ggaccacagtgcatggcctgta

SEQ ID NO: 7291784 - DNA, 22 bp, Homo sapiens
ggaagctgaatccagagacagg

SEQ ID NO: 7291785 - DNA, 21 bp, Homo sapiens
cacacagtgatctatccacat

SEQ ID NO: 7291786 - DNA, 22 bp, Homo sapiens
cacacaggatgaagcagcagaa

SEQ ID NO: 7291787 - DNA, 22 bp, Homo sapiens
cacacagggagaaagaaagcct

SEQ ID NO: 7291788 - DNA, 20 bp, Homo sapiens
ggagagcagggaagacagta

SEQ ID NO: 7291789 - DNA, 22 bp, Homo sapiens
caaggctgtctccagcttccaa

SEQ ID NO: 7291790 - DNA, 22 bp, Homo sapiens
caatactgggcaggagagtaca

SEQ ID NO: 7291791 - DNA, 22 bp, Homo sapiens
caatactgcatctttgcccttt

SEQ ID NO: 7291792 - DNA, 22 bp, Homo sapiens
caaggctgcactgttgccatag

SEQ ID NO: 7291793 - DNA, 22 bp, Homo sapiens
caatatataggaacaacttagg

SEQ ID NO: 7291794 - DNA, 22 bp, Homo sapiens
caatagaaggcacagataggta

SEQ ID NO: 7291795 - DNA, 22 bp, Homo sapiens
caatagaaaactcaatacttaa

SEQ ID NO: 7291796 - DNA, 22 bp, Homo sapiens
caatgttttgttgaatgaatag

SEQ ID NO: 7291797 - DNA, 22 bp, Homo sapiens
caatcactgggatattggtgtg

SEQ ID NO: 7291798 - DNA, 22 bp, Homo sapiens
caatcactgacctgcagatgca

SEQ ID NO: 7291799 - DNA, 22 bp, Homo sapiens
caattctgaggcctgctttgtt

SEQ ID NO: 7291800 - DNA, 17 bp, Homo sapiens
gctggctgacccatgcc

SEQ ID NO: 7291801 - DNA, 22 bp, Homo sapiens
gctggacaggccacatggagga

SEQ ID NO: 7291802 - DNA, 22 bp, Homo sapiens
gctggactcaggggactcaggg

SEQ ID NO: 7291803 - DNA, 22 bp, Homo sapiens
caagaagaggtgattggtaagt

SEQ ID NO: 7291804 - DNA, 22 bp, Homo sapiens
caagaagaggtgattggtaagt

SEQ ID NO: 7291805 - DNA, 22 bp, Homo sapiens
caagaacagtttgccaaattgg

SEQ ID NO: 7291806 - DNA, 22 bp, Homo sapiens
cacttgcagactttgcctggtt

SEQ ID NO: 7291807 - DNA, 22 bp, Homo sapiens
ggctctgcttgaggccagcctg

SEQ ID NO: 7291808 - DNA, 22 bp, Homo sapiens
cactgtggagcaaatttattta

SEQ ID NO: 7291809 - DNA, 22 bp, Homo sapiens
cactgcactccagcctgggtca

SEQ ID NO: 7291810 - DNA, 22 bp, Homo sapiens
cactgcactccagcctgggtga

SEQ ID NO: 7291811 - DNA, 22 bp, Homo sapiens
caccaggctgaaccagagggga

SEQ ID NO: 7291812 - DNA, 21 bp, Homo sapiens
cactatttatatatgccagct

SEQ ID NO: 7291813 - DNA, 22 bp, Homo sapiens
cactatttcctggattttgacg

SEQ ID NO: 7291814 - DNA, 21 bp, Homo sapiens
cactccacttagaacagggtt

SEQ ID NO: 7291815 - DNA, 22 bp, Homo sapiens
cactcagggtacaatggagggc

SEQ ID NO: 7291816 - DNA, 22 bp, Homo sapiens
cactcagcccacccatgtttgt

SEQ ID NO: 7291817 - DNA, 22 bp, Homo sapiens
cactattttctcttcagatggc

SEQ ID NO: 7291818 - DNA, 22 bp, Homo sapiens
cactgcactccagcctgggaga

SEQ ID NO: 7291819 - DNA, 22 bp, Homo sapiens
cacatgcaggagccaatgtaca

SEQ ID NO: 7291820 - DNA, 22 bp, Homo sapiens
cacatgaattgatgccaagtgc

SEQ ID NO: 7291821 - DNA, 22 bp, Homo sapiens
ggcacaaaggaataaagagaac

SEQ ID NO: 7291822 - DNA, 21 bp, Homo sapiens
cacaggtgggtcagtgaggcc

SEQ ID NO: 7291823 - DNA, 22 bp, Homo sapiens
cacagtgaagcatgcagacatc

SEQ ID NO: 7291824 - DNA, 22 bp, Homo sapiens
cacagtgacagctatacagaga

SEQ ID NO: 7291825 - DNA, 22 bp, Homo sapiens
cacagtgcatgatgggcagaag

SEQ ID NO: 7291826 - DNA, 22 bp, Homo sapiens
cacaggcacccctgactgctca

SEQ ID NO: 7291827 - DNA, 20 bp, Homo sapiens
cacaggccccaagacctgta

SEQ ID NO: 7291828 - DNA, 22 bp, Homo sapiens
cacagggcaggtactctcagag

SEQ ID NO: 7291829 - DNA, 22 bp, Homo sapiens
cacaggtgctcctcggggagct

SEQ ID NO: 7291830 - DNA, 22 bp, Homo sapiens
cacaggtagatgccatgcagca

SEQ ID NO: 7291831 - DNA, 22 bp, Homo sapiens
atgctctgggcttttgaagtgg

SEQ ID NO: 7291832 - DNA, 22 bp, Homo sapiens
atgctacatagatacaaaaatg

SEQ ID NO: 7291833 - DNA, 22 bp, Homo sapiens
atgctactcattaagtttgtca

SEQ ID NO: 7291834 - DNA, 22 bp, Homo sapiens
atgagctagaaaaccatgtgga

SEQ ID NO: 7291835 - DNA, 22 bp, Homo sapiens
atgagcccagaaatctcccttt

SEQ ID NO: 7291836 - DNA, 23 bp, Homo sapiens
atgagcatttttaatttctgtgg

SEQ ID NO: 7291837 - DNA, 22 bp, Homo sapiens
atgagcatgtgactcaaaccaa

SEQ ID NO: 7291838 - DNA, 22 bp, Homo sapiens
atgagcatctgagccagtgact

SEQ ID NO: 7291839 - DNA, 22 bp, Homo sapiens
atgagcatctgacatttaaaac

SEQ ID NO: 7291840 - DNA, 22 bp, Homo sapiens
atgagcatccagaacagtgcct

SEQ ID NO: 7291841 - DNA, 22 bp, Homo sapiens
atgagcatatgggaggagtact

SEQ ID NO: 7291842 - DNA, 22 bp, Homo sapiens
gaagagagcagcaaactggagt

SEQ ID NO: 7291843 - DNA, 22 bp, Homo sapiens
atgattactcccatttgataga

SEQ ID NO: 7291844 - DNA, 22 bp, Homo sapiens
gaagctgggtcgctgggatcct

SEQ ID NO: 7291845 - DNA, 22 bp, Homo sapiens
gaagccttgaactgcaaacccc

SEQ ID NO: 7291846 - DNA, 22 bp, Homo sapiens
ctttattgtccttcttaggtgg

SEQ ID NO: 7291847 - DNA, 22 bp, Homo sapiens
atgaatttttctaagcttttgt

SEQ ID NO: 7291848 - DNA, 22 bp, Homo sapiens
atgacacaagagcagaagccat

SEQ ID NO: 7291849 - DNA, 22 bp, Homo sapiens
atgacacataaaacaaggactg

SEQ ID NO: 7291850 - DNA, 23 bp, Homo sapiens
atgacactcctgtgcgcaccctg

SEQ ID NO: 7291851 - DNA, 22 bp, Homo sapiens
atgacagacagaagggattttt

SEQ ID NO: 7291852 - DNA, 22 bp, Homo sapiens
atgacagaaggcctccctgaca

SEQ ID NO: 7291853 - DNA, 22 bp, Homo sapiens
ctttggaaaagcataccaagga

SEQ ID NO: 7291854 - DNA, 22 bp, Homo sapiens
atgacagaggagtgcaggtgat

SEQ ID NO: 7291855 - DNA, 22 bp, Homo sapiens
atgacagaccctctaaagacaa

SEQ ID NO: 7291856 - DNA, 22 bp, Homo sapiens
atgacagaggattgtaaagagg

SEQ ID NO: 7291857 - DNA, 19 bp, Homo sapiens
atgacagagttgataagtg

SEQ ID NO: 7291858 - DNA, 22 bp, Homo sapiens
atgacagatagtcttcatttgc

SEQ ID NO: 7291859 - DNA, 22 bp, Homo sapiens
atgagagacaggaacgagctgg

SEQ ID NO: 7291860 - DNA, 23 bp, Homo sapiens
atgtatttaaatttcagtgatga

SEQ ID NO: 7291861 - DNA, 22 bp, Homo sapiens
gaggagggcctggtgtcccttc

SEQ ID NO: 7291862 - DNA, 22 bp, Homo sapiens
atgtggaatgaacaaaggaggc

SEQ ID NO: 7291863 - DNA, 22 bp, Homo sapiens
atgtggcagtgggaggtgaatt

SEQ ID NO: 7291864 - DNA, 22 bp, Homo sapiens
atgtcataaatatactgttcct

SEQ ID NO: 7291865 - DNA, 22 bp, Homo sapiens
atgtgaggtagataggatgcag

SEQ ID NO: 7291866 - DNA, 22 bp, Homo sapiens
atgtcagagcttccacaatagt

SEQ ID NO: 7291867 - DNA, 22 bp, Homo sapiens
atgtcagaagctggatgacagc

SEQ ID NO: 7291868 - DNA, 22 bp, Homo sapiens
gaggttgggaagtccaagctgg

SEQ ID NO: 7291869 - DNA, 22 bp, Homo sapiens
gaggttgggatgagggatacag

SEQ ID NO: 7291870 - DNA, 22 bp, Homo sapiens
atgctgtctctgctatccaaag

SEQ ID NO: 7291871 - DNA, 22 bp, Homo sapiens
atgctgtttgcttttagtctgc

SEQ ID NO: 7291872 - DNA, 22 bp, Homo sapiens
gagaatcatttacagaatgatt

SEQ ID NO: 7291873 - DNA, 22 bp, Homo sapiens
atggataatgtctctgtttccc

SEQ ID NO: 7291874 - DNA, 22 bp, Homo sapiens
gagcacaggctttggtggacac

SEQ ID NO: 7291875 - DNA, 22 bp, Homo sapiens
gagcacaggctgctgtgaactg

SEQ ID NO: 7291876 - DNA, 22 bp, Homo sapiens
gagcccgagcgcgtacccggcg

SEQ ID NO: 7291877 - DNA, 23 bp, Homo sapiens
gccatgagttccctttcacttgt

SEQ ID NO: 7291878 - DNA, 22 bp, Homo sapiens
gccatgagtaaactggaaagcc

SEQ ID NO: 7291879 - DNA, 20 bp, Homo sapiens
gccatgaggggaggtgactg

SEQ ID NO: 7291880 - DNA, 22 bp, Homo sapiens
gccatgaggctccgagaagtca

SEQ ID NO: 7291881 - DNA, 22 bp, Homo sapiens
gccatgaggaactgtaagacaa

SEQ ID NO: 7291882 - DNA, 22 bp, Homo sapiens
gccatgagatgttttatttgca

SEQ ID NO: 7291883 - DNA, 22 bp, Homo sapiens
gccatgagaagaaatgaagggc

SEQ ID NO: 7291884 - DNA, 22 bp, Homo sapiens
gccatgcatttcgctgggaggg

SEQ ID NO: 7291885 - DNA, 22 bp, Homo sapiens
gccatgcatccttggacttggc

SEQ ID NO: 7291886 - DNA, 22 bp, Homo sapiens
attgtactcacaaaacatgagt

SEQ ID NO: 7291887 - DNA, 22 bp, Homo sapiens
gccagatattcagaggtgaaag

SEQ ID NO: 7291888 - DNA, 22 bp, Homo sapiens
gccagccagggaagggagagac

SEQ ID NO: 7291889 - DNA, 22 bp, Homo sapiens
atttatcatcagaccttttaaa

SEQ ID NO: 7291890 - DNA, 22 bp, Homo sapiens
atttatcaacatgtaccattgg

SEQ ID NO: 7291891 - DNA, 22 bp, Homo sapiens
atttgtcagtggaagtgattca

SEQ ID NO: 7291892 - DNA, 22 bp, Homo sapiens
atttgtcaacaggcatttaggt

SEQ ID NO: 7291893 - DNA, 22 bp, Homo sapiens
gccttccttacacctgctcagc

SEQ ID NO: 7291894 - DNA, 22 bp, Homo sapiens
attttcagttgaaaaagttggt

SEQ ID NO: 7291895 - DNA, 21 bp, Homo sapiens
attttcattaattcagtgtgg

SEQ ID NO: 7291896 - DNA, 20 bp, Homo sapiens
caaagacatgctaggggtgg

SEQ ID NO: 7291897 - DNA, 20 bp, Homo sapiens
caaagacatgctaggggtgg

SEQ ID NO: 7291898 - DNA, 22 bp, Homo sapiens
caaagacacgggaaacaacgtt

SEQ ID NO: 7291899 - DNA, 22 bp, Homo sapiens
gctcccagggcagcgcagaaga

SEQ ID NO: 7291900 - DNA, 22 bp, Homo sapiens
attttgatgctatctaatgaat

SEQ ID NO: 7291901 - DNA, 22 bp, Homo sapiens
attttgctggtctgaattactt

SEQ ID NO: 7291902 - DNA, 22 bp, Homo sapiens
attttgctgctatgccttgcaa

SEQ ID NO: 7291903 - DNA, 22 bp, Homo sapiens
attttgctacagttggtggaaa

SEQ ID NO: 7291904 - DNA, 22 bp, Homo sapiens
attttgataatcatgttagaga

SEQ ID NO: 7291905 - DNA, 22 bp, Homo sapiens
gcaggtgtgggtggctgccagg

SEQ ID NO: 7291906 - DNA, 20 bp, Homo sapiens
gcaggcagggaatgggggtg

SEQ ID NO: 7291907 - DNA, 22 bp, Homo sapiens
attcttttaaatggcagtagta

SEQ ID NO: 7291908 - DNA, 22 bp, Homo sapiens
attcacaaatgctgccccattc

SEQ ID NO: 7291909 - DNA, 22 bp, Homo sapiens
attctgatcattcaagatgtca

SEQ ID NO: 7291910 - DNA, 22 bp, Homo sapiens
gcagagaaggattgaaaccaga

SEQ ID NO: 7291911 - DNA, 22 bp, Homo sapiens
gcacacagattaggaaacagaa

SEQ ID NO: 7291912 - DNA, 22 bp, Homo sapiens
gatgtgaggactcatgtggagg

SEQ ID NO: 7291913 - DNA, 22 bp, Homo sapiens
gattcactcatattttacgttt

SEQ ID NO: 7291914 - DNA, 22 bp, Homo sapiens
gattccacagcttcgaggtctt

SEQ ID NO: 7291915 - DNA, 22 bp, Homo sapiens
atgttattaaagtacagattct

SEQ ID NO: 7291916 - DNA, 22 bp, Homo sapiens
atgttatgtctgggaaggggta

SEQ ID NO: 7291917 - DNA, 20 bp, Homo sapiens
cctggagcctggaaggagtc

SEQ ID NO: 7291918 - DNA, 22 bp, Homo sapiens
cctggagcccaaggcagtgaga

SEQ ID NO: 7291919 - DNA, 22 bp, Homo sapiens
cctggagcccctctggccagcc

SEQ ID NO: 7291920 - DNA, 22 bp, Homo sapiens
cctggagcgcgggtcaagctgg

SEQ ID NO: 7291921 - DNA, 22 bp, Homo sapiens
cctggagctcactgggagccgg

SEQ ID NO: 7291922 - DNA, 22 bp, Homo sapiens
cctggacctgcagcatcagcat

SEQ ID NO: 7291923 - DNA, 22 bp, Homo sapiens
cctggagcaggagctgcagagg

SEQ ID NO: 7291924 - DNA, 22 bp, Homo sapiens
cctggagcatcaggaggaaggg

SEQ ID NO: 7291925 - DNA, 22 bp, Homo sapiens
aggtgagggtgccagtgcatgg

SEQ ID NO: 7291926 - DNA, 19 bp, Homo sapiens
aggtgaggggcaccatgtc

SEQ ID NO: 7291927 - DNA, 22 bp, Homo sapiens
aggtgagggtgccagtgcatgg

SEQ ID NO: 7291928 - DNA, 22 bp, Homo sapiens
aggtctgtgaattcctgagaaa

SEQ ID NO: 7291929 - DNA, 22 bp, Homo sapiens
aggtggagatcagggactaagg

SEQ ID NO: 7291930 - DNA, 22 bp, Homo sapiens
aggtggagtgtgcagggagagc

SEQ ID NO: 7291931 - DNA, 22 bp, Homo sapiens
agtcagaatctgcattttaacc

SEQ ID NO: 7291932 - DNA, 22 bp, Homo sapiens
agtcagaattcgatcccaggtc

SEQ ID NO: 7291933 - DNA, 22 bp, Homo sapiens
ctaaacatgcaagagcttctgg

SEQ ID NO: 7291934 - DNA, 22 bp, Homo sapiens
ctaaacatgtagcttttgtggt

SEQ ID NO: 7291935 - DNA, 22 bp, Homo sapiens
ctaaactagcagttctgcaaca

SEQ ID NO: 7291936 - DNA, 22 bp, Homo sapiens
agtaatgacaatttttatctgt

SEQ ID NO: 7291937 - DNA, 22 bp, Homo sapiens
agtaatcaatttttcggtggat

SEQ ID NO: 7291938 - DNA, 21 bp, Homo sapiens
aggtttatttcaacttcagga

SEQ ID NO: 7291939 - DNA, 22 bp, Homo sapiens
aggtgtgaagagttgacacatt

SEQ ID NO: 7291940 - DNA, 22 bp, Homo sapiens
cctggtgaatgttcatggactg

SEQ ID NO: 7291941 - DNA, 22 bp, Homo sapiens
aggttgggatgagtgggtgagc

SEQ ID NO: 7291942 - DNA, 22 bp, Homo sapiens
agtcattttgccagtcttcagg

SEQ ID NO: 7291943 - DNA, 18 bp, Homo sapiens
agtcatttacttttgtga

SEQ ID NO: 7291944 - DNA, 22 bp, Homo sapiens
ctcctcctggacacaggctgtg

SEQ ID NO: 7291945 - DNA, 23 bp, Homo sapiens
ctcctcgtaactctgtggtgggt

SEQ ID NO: 7291946 - DNA, 22 bp, Homo sapiens
ctcctccctgggaggctggcat

SEQ ID NO: 7291947 - DNA, 22 bp, Homo sapiens
ctcctccccttgagtctgggat

SEQ ID NO: 7291948 - DNA, 22 bp, Homo sapiens
ctcctcccacggtctcaggaag

SEQ ID NO: 7291949 - DNA, 22 bp, Homo sapiens
ctcctccctctttgccacacat

SEQ ID NO: 7291950 - DNA, 22 bp, Homo sapiens
agtgatttgcagtatttactaa

SEQ ID NO: 7291951 - DNA, 22 bp, Homo sapiens
agtgatttgactcttttattgt

SEQ ID NO: 7291952 - DNA, 22 bp, Homo sapiens
ctcaggcagttgtttgcatagt

SEQ ID NO: 7291953 - DNA, 22 bp, Homo sapiens
agtgcaggccccaggccaggcc

SEQ ID NO: 7291954 - DNA, 22 bp, Homo sapiens
agtggcagccgagcaggagatg

SEQ ID NO: 7291955 - DNA, 22 bp, Homo sapiens
ctgagaaagtgagggttaaaca

SEQ ID NO: 7291956 - DNA, 21 bp, Homo sapiens
agtgtgttcttggcattacct

SEQ ID NO: 7291957 - DNA, 22 bp, Homo sapiens
agtgtgttctggtctaccttgg

SEQ ID NO: 7291958 - DNA, 22 bp, Homo sapiens
agtgtgttctcaatgaaaagaa

SEQ ID NO: 7291959 - DNA, 22 bp, Homo sapiens
agtgtgtttggagcgagggagg

SEQ ID NO: 7291960 - DNA, 22 bp, Homo sapiens
agtgtgtttaggctgcgggttg

SEQ ID NO: 7291961 - DNA, 22 bp, Homo sapiens
agtgtgttgtaggctcaaatgg

SEQ ID NO: 7291962 - DNA, 20 bp, Homo sapiens
agtgtgttcctcttactgtg

SEQ ID NO: 7291963 - DNA, 22 bp, Homo sapiens
agtgtgtgtttgggcggtttat

SEQ ID NO: 7291964 - DNA, 18 bp, Homo sapiens
agtgtgtgccctttcagg

SEQ ID NO: 7291965 - DNA, 22 bp, Homo sapiens
ctctgtttggcgctgctccttc

SEQ ID NO: 7291966 - DNA, 22 bp, Homo sapiens
agttttgatactttctcttcat

SEQ ID NO: 7291967 - DNA, 22 bp, Homo sapiens
agtttatttctccatttaccta

SEQ ID NO: 7291968 - DNA, 22 bp, Homo sapiens
ctgataatacagcagtttgtct

SEQ ID NO: 7291969 - DNA, 22 bp, Homo sapiens
ctgataatttcaaaaatcttca

SEQ ID NO: 7291970 - DNA, 21 bp, Homo sapiens
ctgataattgttaaattattt

SEQ ID NO: 7291971 - DNA, 22 bp, Homo sapiens
ctgatagacaatcaccatggga

SEQ ID NO: 7291972 - DNA, 22 bp, Homo sapiens
agttttcaatatatgatagtga

SEQ ID NO: 7291973 - DNA, 22 bp, Homo sapiens
atagtacacatcctacaatgtt

SEQ ID NO: 7291974 - DNA, 22 bp, Homo sapiens
atagtacacatcctacaatgtt

SEQ ID NO: 7291975 - DNA, 22 bp, Homo sapiens
ctggccaggcttgggacagaca

SEQ ID NO: 7291976 - DNA, 22 bp, Homo sapiens
ataattatctcagacacttgtt

SEQ ID NO: 7291977 - DNA, 22 bp, Homo sapiens
ataatttacaactgcttttaat

SEQ ID NO: 7291978 - DNA, 22 bp, Homo sapiens
atacatgactcacacattctgc

SEQ ID NO: 7291979 - DNA, 19 bp, Homo sapiens
ctggaaagttggcagtgag

SEQ ID NO: 7291980 - DNA, 22 bp, Homo sapiens
ctggaaagttcaagataaagct

SEQ ID NO: 7291981 - DNA, 19 bp, Homo sapiens
atcaggaacaaggctgatc

SEQ ID NO: 7291982 - DNA, 22 bp, Homo sapiens
atcaggaagaattggatgctac

SEQ ID NO: 7291983 - DNA, 22 bp, Homo sapiens
atcaggaacgttcatggactgt

SEQ ID NO: 7291984 - DNA, 22 bp, Homo sapiens
atcaggaagtctgccacaaggc

SEQ ID NO: 7291985 - DNA, 22 bp, Homo sapiens
atcaggaagcctgcactgagct

SEQ ID NO: 7291986 - DNA, 22 bp, Homo sapiens
ctgtccagggtgtgcaggggct

SEQ ID NO: 7291987 - DNA, 22 bp, Homo sapiens
atcattcatcttattgccagtc

SEQ ID NO: 7291988 - DNA, 22 bp, Homo sapiens
atcattcagtctctgggacagt

SEQ ID NO: 7291989 - DNA, 23 bp, Homo sapiens
ctgttatgtaaatatgtttagtg

SEQ ID NO: 7291990 - DNA, 22 bp, Homo sapiens
ctgttatgcatggtcattgcct

SEQ ID NO: 7291991 - DNA, 22 bp, Homo sapiens
cttcagcagcctcttgcataaa

SEQ ID NO: 7291992 - DNA, 22 bp, Homo sapiens
cttcagcagatgtgctagagat

SEQ ID NO: 7291993 - DNA, 22 bp, Homo sapiens
atctccagctggctgtgataaa

SEQ ID NO: 7291994 - DNA, 22 bp, Homo sapiens
atctcatcagatctgtataagc

SEQ ID NO: 7291995 - DNA, 22 bp, Homo sapiens
atagtatttccagaaatagtct

SEQ ID NO: 7291996 - DNA, 22 bp, Homo sapiens
atatattttttgagacagagtc

SEQ ID NO: 7291997 - DNA, 22 bp, Homo sapiens
atatattttgcggtcacgtggc

SEQ ID NO: 7291998 - DNA, 22 bp, Homo sapiens
atatcacaaacaagtctgtact

SEQ ID NO: 7291999 - DNA, 22 bp, Homo sapiens
atatcacagtagttgtttagtt

SEQ ID NO: 7292000 - DNA, 22 bp, Homo sapiens
atatcacagctctttcattgct

SEQ ID NO: 7292001 - DNA, 20 bp, Homo sapiens
ctggggaggaggatgtgttc

SEQ ID NO: 7292002 - DNA, 22 bp, Homo sapiens
ctgtaatgaactctttgtcagt

SEQ ID NO: 7292003 - DNA, 22 bp, Homo sapiens
ctgtccagaaagggggcaacaa

SEQ ID NO: 7292004 - DNA, 22 bp, Homo sapiens
ctgtccagcttggctcctgggg

SEQ ID NO: 7292005 - DNA, 22 bp, Homo sapiens
ctgtccagctgaccagagcagc

SEQ ID NO: 7292006 - DNA, 22 bp, Homo sapiens
ctgtatgttccgttttgtcact

SEQ ID NO: 7292007 - DNA, 22 bp, Homo sapiens
aggcttctctgcaagatgttaa

SEQ ID NO: 7292008 - DNA, 21 bp, Homo sapiens
aggcttggatctagacaggcc

SEQ ID NO: 7292009 - DNA, 19 bp, Homo sapiens
aggcttggattgtggccaa

SEQ ID NO: 7292010 - DNA, 20 bp, Homo sapiens
ccctggactcctgagcaaac

SEQ ID NO: 7292011 - DNA, 22 bp, Homo sapiens
ccctggacggggaatatgactt

SEQ ID NO: 7292012 - DNA, 22 bp, Homo sapiens
ccctggaggaccccaatgtggc

SEQ ID NO: 7292013 - DNA, 22 bp, Homo sapiens
agggatgggtctaacccagaac

SEQ ID NO: 7292014 - DNA, 22 bp, Homo sapiens
agggatggagcccagctgttct

SEQ ID NO: 7292015 - DNA, 22 bp, Homo sapiens
ccctttctgggacccctgtctc

SEQ ID NO: 7292016 - DNA, 22 bp, Homo sapiens
ccctggaggctggaggcagtag

SEQ ID NO: 7292017 - DNA, 22 bp, Homo sapiens
agggccctaaggaaggcacaca

SEQ ID NO: 7292018 - DNA, 22 bp, Homo sapiens
agggccctccccgctcagggca

SEQ ID NO: 7292019 - DNA, 22 bp, Homo sapiens
agggccctctgggcactgtggc

SEQ ID NO: 7292020 - DNA, 19 bp, Homo sapiens
agggctaggcacatagggc

SEQ ID NO: 7292021 - DNA, 22 bp, Homo sapiens
agggctatgattaatgatggtg

SEQ ID NO: 7292022 - DNA, 22 bp, Homo sapiens
aggcatggacatttcggcagct

SEQ ID NO: 7292023 - DNA, 22 bp, Homo sapiens
aggccagaacagctctgcacca

SEQ ID NO: 7292024 - DNA, 22 bp, Homo sapiens
aggccagaagccagaaatgctt

SEQ ID NO: 7292025 - DNA, 22 bp, Homo sapiens
aggccagaagtcaaaaactcta

SEQ ID NO: 7292026 - DNA, 22 bp, Homo sapiens
aggccagacagctagaaacagg

SEQ ID NO: 7292027 - DNA, 22 bp, Homo sapiens
aggcagggtgatgataatgatt

SEQ ID NO: 7292028 - DNA, 22 bp, Homo sapiens
ccagcctcatcgcctgcctgtc

SEQ ID NO: 7292029 - DNA, 22 bp, Homo sapiens
ccagcctccatgtagatagctg

SEQ ID NO: 7292030 - DNA, 22 bp, Homo sapiens
ccaggacaagtgtggccatggc

SEQ ID NO: 7292031 - DNA, 22 bp, Homo sapiens
cccagagccgctcccctacttc

SEQ ID NO: 7292032 - DNA, 22 bp, Homo sapiens
cccagagccggtggtgctcaca

SEQ ID NO: 7292033 - DNA, 22 bp, Homo sapiens
aggctcagttcacgtcaacttt

SEQ ID NO: 7292034 - DNA, 22 bp, Homo sapiens
ccaggctgtaagagtgatgttg

SEQ ID NO: 7292035 - DNA, 22 bp, Homo sapiens
ccaggaggaaagaccagcccat

SEQ ID NO: 7292036 - DNA, 22 bp, Homo sapiens
caggaaggcgcggctgtgcctg

SEQ ID NO: 7292037 - DNA, 22 bp, Homo sapiens
caggaggaggtgaggtagaact

SEQ ID NO: 7292038 - DNA, 22 bp, Homo sapiens
caggccagaggctgttgttgcg

SEQ ID NO: 7292039 - DNA, 22 bp, Homo sapiens
caggccaggctgcatttgcccc

SEQ ID NO: 7292040 - DNA, 22 bp, Homo sapiens
caggccagcagggcctccgtgg

SEQ ID NO: 7292041 - DNA, 22 bp, Homo sapiens
caggccagagtccaactccaga

SEQ ID NO: 7292042 - DNA, 20 bp, Homo sapiens
caggccagaggtttgatggc

SEQ ID NO: 7292043 - DNA, 22 bp, Homo sapiens
caggccagcttcctgacatcct

SEQ ID NO: 7292044 - DNA, 22 bp, Homo sapiens
caggccagcgtccagaacaagc

SEQ ID NO: 7292045 - DNA, 22 bp, Homo sapiens
caggccagcggcccgcgcgttc

SEQ ID NO: 7292046 - DNA, 22 bp, Homo sapiens
caggcctggttgagccctgaga

SEQ ID NO: 7292047 - DNA, 22 bp, Homo sapiens
caggctgcctggaagaggactg

SEQ ID NO: 7292048 - DNA, 22 bp, Homo sapiens
caggctgcggtcggctctggtc

SEQ ID NO: 7292049 - DNA, 22 bp, Homo sapiens
cagggagctattagggttagtg

SEQ ID NO: 7292050 - DNA, 22 bp, Homo sapiens
cagggatgggatggagtcagtt

SEQ ID NO: 7292051 - DNA, 22 bp, Homo sapiens
caggctggagtacaattgtgtg

SEQ ID NO: 7292052 - DNA, 22 bp, Homo sapiens
caggctggagtgcagttgtgca

SEQ ID NO: 7292053 - DNA, 22 bp, Homo sapiens
caggctggagtgcagttgtgca

SEQ ID NO: 7292054 - DNA, 22 bp, Homo sapiens
cagggatgtgatgagctgagcc

SEQ ID NO: 7292055 - DNA, 22 bp, Homo sapiens
caggggctgagaaggaacgtcc

SEQ ID NO: 7292056 - DNA, 22 bp, Homo sapiens
caggtgaccctcagtgtggact

SEQ ID NO: 7292057 - DNA, 20 bp, Homo sapiens
caggtgagcagatctgggtg

SEQ ID NO: 7292058 - DNA, 22 bp, Homo sapiens
caggtgagctctatctagggag

SEQ ID NO: 7292059 - DNA, 22 bp, Homo sapiens
caggtgaggctgaacagatgaa

SEQ ID NO: 7292060 - DNA, 22 bp, Homo sapiens
caggtgagaggcggtcctgcat

SEQ ID NO: 7292061 - DNA, 22 bp, Homo sapiens
caggtgagttttcctccttggt

SEQ ID NO: 7292062 - DNA, 22 bp, Homo sapiens
caggtgagtttgctattgtaca

SEQ ID NO: 7292063 - DNA, 22 bp, Homo sapiens
caggtgagtaacaatgggtgat

SEQ ID NO: 7292064 - DNA, 22 bp, Homo sapiens
caggtgaggctgaacagatgaa

SEQ ID NO: 7292065 - DNA, 22 bp, Homo sapiens
catggacagtgggacagtgtgt

SEQ ID NO: 7292066 - DNA, 22 bp, Homo sapiens
catggacaacctccattcgagt

SEQ ID NO: 7292067 - DNA, 22 bp, Homo sapiens
catggaatgtgagttgtttagt

SEQ ID NO: 7292068 - DNA, 22 bp, Homo sapiens
catggaggaccctcagggagct

SEQ ID NO: 7292069 - DNA, 22 bp, Homo sapiens
catggacatatgagacctttcc

SEQ ID NO: 7292070 - DNA, 22 bp, Homo sapiens
catggatatattgtacagtagc

SEQ ID NO: 7292071 - DNA, 22 bp, Homo sapiens
catggatagatgaatgcttaaa

SEQ ID NO: 7292072 - DNA, 22 bp, Homo sapiens
catggatatattgtacagtagc

SEQ ID NO: 7292073 - DNA, 22 bp, Homo sapiens
catggaggagttaggtgtgagt

SEQ ID NO: 7292074 - DNA, 22 bp, Homo sapiens
aggagggcaggctggctgccta

SEQ ID NO: 7292075 - DNA, 22 bp, Homo sapiens
aggaggggcaatgatagtctgg

SEQ ID NO: 7292076 - DNA, 22 bp, Homo sapiens
ccaatacttagattaaaatagt

SEQ ID NO: 7292077 - DNA, 22 bp, Homo sapiens
ccaatactgttgattcatagtg

SEQ ID NO: 7292078 - DNA, 22 bp, Homo sapiens
ccaatactgaacttaaaagtat

SEQ ID NO: 7292079 - DNA, 22 bp, Homo sapiens
ccaatactctttctccctgtgt

SEQ ID NO: 7292080 - DNA, 22 bp, Homo sapiens
catgttttgtgtacagaatatt

SEQ ID NO: 7292081 - DNA, 22 bp, Homo sapiens
aggagaagtaaggctagatgat

SEQ ID NO: 7292082 - DNA, 22 bp, Homo sapiens
aggactaaagggagcctagact

SEQ ID NO: 7292083 - DNA, 22 bp, Homo sapiens
caggtgggagccacagcgtaca

SEQ ID NO: 7292084 - DNA, 22 bp, Homo sapiens
aggacattcatttcaaggagga

SEQ ID NO: 7292085 - DNA, 22 bp, Homo sapiens
aggaccatcctaaggtaggcaa

SEQ ID NO: 7292086 - DNA, 22 bp, Homo sapiens
aggaccataagtagggcatgtg

SEQ ID NO: 7292087 - DNA, 22 bp, Homo sapiens
aggaccagtatgagagcatctg

SEQ ID NO: 7292088 - DNA, 22 bp, Homo sapiens
aggaccctgagcgggcatgccg

SEQ ID NO: 7292089 - DNA, 22 bp, Homo sapiens
acatttgtatatatgcagcata

SEQ ID NO: 7292090 - DNA, 22 bp, Homo sapiens
acatttgtatgcgtttttactg

SEQ ID NO: 7292091 - DNA, 22 bp, Homo sapiens
acatttgtatttggtgagtggt

SEQ ID NO: 7292092 - DNA, 22 bp, Homo sapiens
aggcttggctggcagccctggg

SEQ ID NO: 7292093 - DNA, 20 bp, Homo sapiens
aggcttggcttggcaggaac

SEQ ID NO: 7292094 - DNA, 22 bp, Homo sapiens
aggcttggtgccaaggagcctg

SEQ ID NO: 7292095 - DNA, 18 bp, Homo sapiens
aggcttgggcccagcagc

SEQ ID NO: 7292096 - DNA, 22 bp, Homo sapiens
accagctagggtagcacatctc

SEQ ID NO: 7292097 - DNA, 19 bp, Homo sapiens
agggctgctctggcctggg

SEQ ID NO: 7292098 - DNA, 19 bp, Homo sapiens
accaggcctcagaggccct

SEQ ID NO: 7292099 - DNA, 22 bp, Homo sapiens
acccaggagacggaggtgcagt

SEQ ID NO: 7292100 - DNA, 22 bp, Homo sapiens
agggctgacagtgaggagtcaa

SEQ ID NO: 7292101 - DNA, 22 bp, Homo sapiens
agggctgcccagtgtgagagct

SEQ ID NO: 7292102 - DNA, 22 bp, Homo sapiens
acatttggtaacacttgagcat

SEQ ID NO: 7292103 - DNA, 22 bp, Homo sapiens
acatttggacaatagtagacaa

SEQ ID NO: 7292104 - DNA, 22 bp, Homo sapiens
acatttgattgatgaatcaaat

SEQ ID NO: 7292105 - DNA, 22 bp, Homo sapiens
acatttggcaagaaagagaaac

SEQ ID NO: 7292106 - DNA, 19 bp, Homo sapiens
acatgttttgcagaacagc

SEQ ID NO: 7292107 - DNA, 22 bp, Homo sapiens
acatgctcattaaatattagct

SEQ ID NO: 7292108 - DNA, 19 bp, Homo sapiens
acagtcagggaataaagac

SEQ ID NO: 7292109 - DNA, 22 bp, Homo sapiens
acagtcaggaatttgtaaaacg

SEQ ID NO: 7292110 - DNA, 22 bp, Homo sapiens
acatagctcagtatcacttact

SEQ ID NO: 7292111 - DNA, 22 bp, Homo sapiens
acatagctcagcataatcgtgg

SEQ ID NO: 7292112 - DNA, 20 bp, Homo sapiens
acatagctatagaaagtcga

SEQ ID NO: 7292113 - DNA, 22 bp, Homo sapiens
aggatgagattccagggtcaat

SEQ ID NO: 7292114 - DNA, 19 bp, Homo sapiens
aggatggagcaggcggtga

SEQ ID NO: 7292115 - DNA, 22 bp, Homo sapiens
acagtttaggatgagagaacac

SEQ ID NO: 7292116 - DNA, 22 bp, Homo sapiens
acagtttgagaaccactagcct

SEQ ID NO: 7292117 - DNA, 22 bp, Homo sapiens
acaggagtttctgacagagaca

SEQ ID NO: 7292118 - DNA, 22 bp, Homo sapiens
agctggtgtcacctccagtcca

SEQ ID NO: 7292119 - DNA, 22 bp, Homo sapiens
agctggtgtgccagttccagtt

SEQ ID NO: 7292120 - DNA, 22 bp, Homo sapiens
agctggtgtcctcctggagctg

SEQ ID NO: 7292121 - DNA, 22 bp, Homo sapiens
agctggattccagtgcagtcac

SEQ ID NO: 7292122 - DNA, 22 bp, Homo sapiens
agctgactgatgaagaggcctt

SEQ ID NO: 7292123 - DNA, 17 bp, Homo sapiens
agctgacatcaaaactt

SEQ ID NO: 7292124 - DNA, 22 bp, Homo sapiens
acagggaagctcaggggctctg

SEQ ID NO: 7292125 - DNA, 19 bp, Homo sapiens
acagggaatttccacagaa

SEQ ID NO: 7292126 - DNA, 22 bp, Homo sapiens
acagggaagttctgcaacagga

SEQ ID NO: 7292127 - DNA, 21 bp, Homo sapiens
aggaagaaaggttggaggttg

SEQ ID NO: 7292128 - DNA, 18 bp, Homo sapiens
acagggagggcgctgggg

SEQ ID NO: 7292129 - DNA, 22 bp, Homo sapiens
aggaagaaactgagctctgaca

SEQ ID NO: 7292130 - DNA, 22 bp, Homo sapiens
acagggctcccagcaggtctgt

SEQ ID NO: 7292131 - DNA, 22 bp, Homo sapiens
acaggggattgattggaagtct

SEQ ID NO: 7292132 - DNA, 22 bp, Homo sapiens
aggacacactgttctcacgtaa

SEQ ID NO: 7292133 - DNA, 22 bp, Homo sapiens
actttatcaggaatcacacagc

SEQ ID NO: 7292134 - DNA, 22 bp, Homo sapiens
actttagtctgtttcattatct

SEQ ID NO: 7292135 - DNA, 19 bp, Homo sapiens
acttctgaggaactgcaca

SEQ ID NO: 7292136 - DNA, 22 bp, Homo sapiens
atacaggttctctagggaacag

SEQ ID NO: 7292137 - DNA, 22 bp, Homo sapiens
ataatcttgtatttcctaaagt

SEQ ID NO: 7292138 - DNA, 22 bp, Homo sapiens
ataaaatttgctactgttaaat

SEQ ID NO: 7292139 - DNA, 22 bp, Homo sapiens
atatttcatggggttccatact

SEQ ID NO: 7292140 - DNA, 22 bp, Homo sapiens
atatttcatggggttccatact

SEQ ID NO: 7292141 - DNA, 22 bp, Homo sapiens
agaaagctccccatgagatgat

SEQ ID NO: 7292142 - DNA, 22 bp, Homo sapiens
atatttcagctttacttaggaa

SEQ ID NO: 7292143 - DNA, 22 bp, Homo sapiens
atatttcacgtaggttgttttc

SEQ ID NO: 7292144 - DNA, 22 bp, Homo sapiens
agaaattaggaaagtaacactt

SEQ ID NO: 7292145 - DNA, 22 bp, Homo sapiens
agaaagtgaccttgaaaactgg

SEQ ID NO: 7292146 - DNA, 20 bp, Homo sapiens
atcggcttgcctggaaacaa

SEQ ID NO: 7292147 - DNA, 22 bp, Homo sapiens
atctcacatcctcagtagtgca

SEQ ID NO: 7292148 - DNA, 22 bp, Homo sapiens
atctcacactgggtttgagggt

SEQ ID NO: 7292149 - DNA, 22 bp, Homo sapiens
atctatttctgctaataacaat

SEQ ID NO: 7292150 - DNA, 22 bp, Homo sapiens
atctaattttcactcatttgct

SEQ ID NO: 7292151 - DNA, 22 bp, Homo sapiens
atctaagctcacaggcttgttg

SEQ ID NO: 7292152 - DNA, 22 bp, Homo sapiens
atctaaaatgtggttagttggt

SEQ ID NO: 7292153 - DNA, 22 bp, Homo sapiens
atctaaagtgtcataagtagct

SEQ ID NO: 7292154 - DNA, 20 bp, Homo sapiens
agtgcatggagggagagggc

SEQ ID NO: 7292155 - DNA, 22 bp, Homo sapiens
agtgcatagggggatgcacagc

SEQ ID NO: 7292156 - DNA, 22 bp, Homo sapiens
agtgcatgccttcctgtggatg

SEQ ID NO: 7292157 - DNA, 22 bp, Homo sapiens
agtgcatgcgcttgggaggggt

SEQ ID NO: 7292158 - DNA, 22 bp, Homo sapiens
actctgtgggtgagcctggaca

SEQ ID NO: 7292159 - DNA, 22 bp, Homo sapiens
actctgtgctggggacctcatc

SEQ ID NO: 7292160 - DNA, 22 bp, Homo sapiens
actctgtgaagtcttattatgc

SEQ ID NO: 7292161 - DNA, 22 bp, Homo sapiens
actctgtgccaggcactttggg

SEQ ID NO: 7292162 - DNA, 22 bp, Homo sapiens
actctgtgtgagtagagcctgt

SEQ ID NO: 7292163 - DNA, 22 bp, Homo sapiens
actctgtgtttagtgctgccat

SEQ ID NO: 7292164 - DNA, 22 bp, Homo sapiens
actctgtgttttggtggcagca

SEQ ID NO: 7292165 - DNA, 22 bp, Homo sapiens
actctgtgaactctatcagata

SEQ ID NO: 7292166 - DNA, 22 bp, Homo sapiens
actctgtgaagatgcaggcttg

SEQ ID NO: 7292167 - DNA, 22 bp, Homo sapiens
actggaaaggctctgaatggga

SEQ ID NO: 7292168 - DNA, 22 bp, Homo sapiens
actggaaaaccactgaaatgag

SEQ ID NO: 7292169 - DNA, 22 bp, Homo sapiens
agtaaaattaatggatcagaag

SEQ ID NO: 7292170 - DNA, 22 bp, Homo sapiens
acgcagcacaaaggaaaggatc

SEQ ID NO: 7292171 - DNA, 22 bp, Homo sapiens
actagtctgcattacaaaatag

SEQ ID NO: 7292172 - DNA, 22 bp, Homo sapiens
agtatttcttcatatgattact

SEQ ID NO: 7292173 - DNA, 22 bp, Homo sapiens
agtatttcttcatatgattact

SEQ ID NO: 7292174 - DNA, 22 bp, Homo sapiens
agtccaggcgggtatagaggct

SEQ ID NO: 7292175 - DNA, 19 bp, Homo sapiens
acctggcctcttgagcaag

SEQ ID NO: 7292176 - DNA, 22 bp, Homo sapiens
acctggagtcatttgaggagta

SEQ ID NO: 7292177 - DNA, 22 bp, Homo sapiens
accctctgccttgagcagtgcc

SEQ ID NO: 7292178 - DNA, 22 bp, Homo sapiens
acctgcatgatggaacatgagg

SEQ ID NO: 7292179 - DNA, 22 bp, Homo sapiens
acctgcatgatgtctgaagcaa

SEQ ID NO: 7292180 - DNA, 22 bp, Homo sapiens
agacagcatgatacatgatgct

SEQ ID NO: 7292181 - DNA, 22 bp, Homo sapiens
agacagcatgatacatgatgct

SEQ ID NO: 7292182 - DNA, 22 bp, Homo sapiens
agacagcagggagcaggattca

SEQ ID NO: 7292183 - DNA, 22 bp, Homo sapiens
agacagcagggagcaggattca

SEQ ID NO: 7292184 - DNA, 22 bp, Homo sapiens
atgacaaattcagaccatagca

SEQ ID NO: 7292185 - DNA, 22 bp, Homo sapiens
atgcacatgaggcaagcaaaat

SEQ ID NO: 7292186 - DNA, 22 bp, Homo sapiens
atgcactgttggatatatttgt

SEQ ID NO: 7292187 - DNA, 22 bp, Homo sapiens
atctcagacatgttgtccatga

SEQ ID NO: 7292188 - DNA, 22 bp, Homo sapiens
atctcagaaagtttaatttttc

SEQ ID NO: 7292189 - DNA, 22 bp, Homo sapiens
agaagttatccaccttagatgc

SEQ ID NO: 7292190 - DNA, 22 bp, Homo sapiens
agacaaaggattaatgatgatg

SEQ ID NO: 7292191 - DNA, 22 bp, Homo sapiens
agacaaaccttgttttatgatg

SEQ ID NO: 7292192 - DNA, 22 bp, Homo sapiens
atgaacaataaaatagatcaca

SEQ ID NO: 7292193 - DNA, 22 bp, Homo sapiens
atgaaatttgctgctaagttcc

SEQ ID NO: 7292194 - DNA, 20 bp, Homo sapiens
atgaaattcctgttttctga

SEQ ID NO: 7292195 - DNA, 22 bp, Homo sapiens
atgaaattgatcttgaactttt

SEQ ID NO: 7292196 - DNA, 22 bp, Homo sapiens
atgaaatttgaccaattattta

SEQ ID NO: 7292197 - DNA, 22 bp, Homo sapiens
atggggggatgaaggagtccaa

SEQ ID NO: 7292198 - DNA, 22 bp, Homo sapiens
atgtcaaatcagttttatcaga

SEQ ID NO: 7292199 - DNA, 22 bp, Homo sapiens
agagaccaagggaatagtctca

SEQ ID NO: 7292200 - DNA, 22 bp, Homo sapiens
atggccagcaagttcagaattt

SEQ ID NO: 7292201 - DNA, 22 bp, Homo sapiens
atggccagggtggcactgtggt

SEQ ID NO: 7292202 - DNA, 22 bp, Homo sapiens
agaccacaggcatgcacagagc

SEQ ID NO: 7292203 - DNA, 22 bp, Homo sapiens
agaggcctgtgtgctccagtgg

SEQ ID NO: 7292204 - DNA, 22 bp, Homo sapiens
attcatttgctattgtgtatgg

SEQ ID NO: 7292205 - DNA, 22 bp, Homo sapiens
agaggcctttctgttgagtgaa

SEQ ID NO: 7292206 - DNA, 22 bp, Homo sapiens
attgcatatgcagcacatcagg

SEQ ID NO: 7292207 - DNA, 22 bp, Homo sapiens
attgcaggccagtgtcctgggc

SEQ ID NO: 7292208 - DNA, 22 bp, Homo sapiens
attgcaggctctgacaccaggc

SEQ ID NO: 7292209 - DNA, 22 bp, Homo sapiens
agagctggtgcatattcagaaa

SEQ ID NO: 7292210 - DNA, 22 bp, Homo sapiens
agagctgggacttggactcaat

SEQ ID NO: 7292211 - DNA, 22 bp, Homo sapiens
agagctgtttattgatgtcaca

SEQ ID NO: 7292212 - DNA, 22 bp, Homo sapiens
agaggagaatccgtttccttgc

SEQ ID NO: 7292213 - DNA, 22 bp, Homo sapiens
attgctaggaacaggttgcacc

SEQ ID NO: 7292214 - DNA, 22 bp, Homo sapiens
attgctcagcacaagcagcaga

SEQ ID NO: 7292215 - DNA, 22 bp, Homo sapiens
atttcacaggccagtggtgggg

SEQ ID NO: 7292216 - DNA, 22 bp, Homo sapiens
atttcacattaatttgatgctc

SEQ ID NO: 7292217 - DNA, 20 bp, Homo sapiens
agatacagtttaattactct

SEQ ID NO: 7292218 - DNA, 22 bp, Homo sapiens
atttcacagctgctgttcaggt

SEQ ID NO: 7292219 - DNA, 22 bp, Homo sapiens
atttcacagcgtggttgactgc

SEQ ID NO: 7292220 - DNA, 22 bp, Homo sapiens
cagcagtttcctatggttcagc

SEQ ID NO: 7292221 - DNA, 22 bp, Homo sapiens
cagcagtgtgcaggtgtgctgg

SEQ ID NO: 7292222 - DNA, 22 bp, Homo sapiens
cagcatcaccaacttgagcaat

SEQ ID NO: 7292223 - DNA, 22 bp, Homo sapiens
cagcatcaacattctcagctct

SEQ ID NO: 7292224 - DNA, 22 bp, Homo sapiens
agcctggagttcccaggagaag

SEQ ID NO: 7292225 - DNA, 22 bp, Homo sapiens
agcctggagttcccaggagaag

SEQ ID NO: 7292226 - DNA, 22 bp, Homo sapiens
agcctcttccagctcctttcta

SEQ ID NO: 7292227 - DNA, 18 bp, Homo sapiens
agcctctggcagagagaa

SEQ ID NO: 7292228 - DNA, 22 bp, Homo sapiens
agcctctgtagaaagcagtgtg

SEQ ID NO: 7292229 - DNA, 22 bp, Homo sapiens
agcctctggccctagactgctt

SEQ ID NO: 7292230 - DNA, 22 bp, Homo sapiens
cagagggagccctccaggagca

SEQ ID NO: 7292231 - DNA, 22 bp, Homo sapiens
agcccaggctggagtgcagtgg

SEQ ID NO: 7292232 - DNA, 20 bp, Homo sapiens
agcccaggcctgtgtgagtc

SEQ ID NO: 7292233 - DNA, 22 bp, Homo sapiens
agcccaagcataggagggaggc

SEQ ID NO: 7292234 - DNA, 22 bp, Homo sapiens
agcccagagggtagcagaagaa

SEQ ID NO: 7292235 - DNA, 22 bp, Homo sapiens
agcccagagggtagcagaagaa

SEQ ID NO: 7292236 - DNA, 22 bp, Homo sapiens
agcccagaggggtttgaggact

SEQ ID NO: 7292237 - DNA, 22 bp, Homo sapiens
agcccagaaatgaaaggatgat

SEQ ID NO: 7292238 - DNA, 22 bp, Homo sapiens
agcccagagacaatgctcagta

SEQ ID NO: 7292239 - DNA, 22 bp, Homo sapiens
agcccagagacaatgctcagta

SEQ ID NO: 7292240 - DNA, 22 bp, Homo sapiens
agcccagagccccggccatgtt

SEQ ID NO: 7292241 - DNA, 22 bp, Homo sapiens
agcccagaaatgaaaggatgat

SEQ ID NO: 7292242 - DNA, 22 bp, Homo sapiens
agcccaaggccacacagttagt

SEQ ID NO: 7292243 - DNA, 22 bp, Homo sapiens
cagacaggtagggacagaacat

SEQ ID NO: 7292244 - DNA, 22 bp, Homo sapiens
cagacaggttgcaaaacttcaa

SEQ ID NO: 7292245 - DNA, 22 bp, Homo sapiens
agccactccttcagcgtctgct

SEQ ID NO: 7292246 - DNA, 22 bp, Homo sapiens
cagaataagctgtgttgtcaag

SEQ ID NO: 7292247 - DNA, 22 bp, Homo sapiens
cagaataatattggtctcatag

SEQ ID NO: 7292248 - DNA, 22 bp, Homo sapiens
agcatacaccctaaactgctta

SEQ ID NO: 7292249 - DNA, 22 bp, Homo sapiens
agcatacagtaggtgctcagtt

SEQ ID NO: 7292250 - DNA, 22 bp, Homo sapiens
cacccaggctggagtgcagggg

SEQ ID NO: 7292251 - DNA, 22 bp, Homo sapiens
agcaggcacgctccctgcgcga

SEQ ID NO: 7292252 - DNA, 22 bp, Homo sapiens
cacacacagttttgtattctgt

SEQ ID NO: 7292253 - DNA, 22 bp, Homo sapiens
cacagtttgcataggaaaaaca

SEQ ID NO: 7292254 - DNA, 22 bp, Homo sapiens
cacagtttctgaacactttgca

SEQ ID NO: 7292255 - DNA, 22 bp, Homo sapiens
cacagtttggtatagaagtgat

SEQ ID NO: 7292256 - DNA, 22 bp, Homo sapiens
cacagtttgggtctccggggca

SEQ ID NO: 7292257 - DNA, 22 bp, Homo sapiens
cacagtttcaataattattctt

SEQ ID NO: 7292258 - DNA, 22 bp, Homo sapiens
cacagtttctataggtcagaat

SEQ ID NO: 7292259 - DNA, 22 bp, Homo sapiens
cacagtttatgatctcagtgaa

SEQ ID NO: 7292260 - DNA, 22 bp, Homo sapiens
cacagttgtttgttcataagaa

SEQ ID NO: 7292261 - DNA, 22 bp, Homo sapiens
cacagtttggttttgctgtaat

SEQ ID NO: 7292262 - DNA, 22 bp, Homo sapiens
agcagcaggctagggaactgct

SEQ ID NO: 7292263 - DNA, 22 bp, Homo sapiens
caagagagatgcagctcactca

SEQ ID NO: 7292264 - DNA, 22 bp, Homo sapiens
agcagcaggcttaaggaaaagt

SEQ ID NO: 7292265 - DNA, 22 bp, Homo sapiens
agcagcagggacaaaggaacag

SEQ ID NO: 7292266 - DNA, 22 bp, Homo sapiens
agcaaagcatcactccaatctg

SEQ ID NO: 7292267 - DNA, 22 bp, Homo sapiens
agcaaagccgagacagccagtg

SEQ ID NO: 7292268 - DNA, 20 bp, Homo sapiens
agcacattaaacatactcct

SEQ ID NO: 7292269 - DNA, 22 bp, Homo sapiens
caaattaatgtgtctcaaaata

SEQ ID NO: 7292270 - DNA, 22 bp, Homo sapiens
agcacattagtatctaagaaca

SEQ ID NO: 7292271 - DNA, 22 bp, Homo sapiens
agcacattaagtgagttcatgt

SEQ ID NO: 7292272 - DNA, 22 bp, Homo sapiens
agcacattttctcaaagctcat

SEQ ID NO: 7292273 - DNA, 22 bp, Homo sapiens
agcacattttatttaagaaaat

SEQ ID NO: 7292274 - DNA, 22 bp, Homo sapiens
agcacatttaagtatgaaatat

SEQ ID NO: 7292275 - DNA, 22 bp, Homo sapiens
agcacattgatttattttggag

SEQ ID NO: 7292276 - DNA, 22 bp, Homo sapiens
agcacattcttgccttaacctc

SEQ ID NO: 7292277 - DNA, 22 bp, Homo sapiens
agcacattctgccttgctttgc

SEQ ID NO: 7292278 - DNA, 22 bp, Homo sapiens
agcacattcccacctgtacttc

SEQ ID NO: 7292279 - DNA, 22 bp, Homo sapiens
aagaaatcagaaaagcattcgt

SEQ ID NO: 7292280 - DNA, 22 bp, Homo sapiens
aattgtcttgaaagcaacactt

SEQ ID NO: 7292281 - DNA, 22 bp, Homo sapiens
aattgttgtacagaataaatga

SEQ ID NO: 7292282 - DNA, 22 bp, Homo sapiens
aattgttgggtattcctgtgac

SEQ ID NO: 7292283 - DNA, 22 bp, Homo sapiens
aattgttgggccctaccccaga

SEQ ID NO: 7292284 - DNA, 22 bp, Homo sapiens
aattgttgagcataaattatcg

SEQ ID NO: 7292285 - DNA, 20 bp, Homo sapiens
aattgttgactccccagaga

SEQ ID NO: 7292286 - DNA, 22 bp, Homo sapiens
aagacactaagctttcaggata

SEQ ID NO: 7292287 - DNA, 20 bp, Homo sapiens
acaaagactggaaaagcaag

SEQ ID NO: 7292288 - DNA, 22 bp, Homo sapiens
aagagaggggttgcatggaaat

SEQ ID NO: 7292289 - DNA, 17 bp, Homo sapiens
aagagaggctgagctgg

SEQ ID NO: 7292290 - DNA, 22 bp, Homo sapiens
aagagaggacatggtgaacctg

SEQ ID NO: 7292291 - DNA, 22 bp, Homo sapiens
acaaggacgtcacttccacggt

SEQ ID NO: 7292292 - DNA, 22 bp, Homo sapiens
acacaggggctcggctgggtgc

SEQ ID NO: 7292293 - DNA, 22 bp, Homo sapiens
acacaggggaaagtggagctga

SEQ ID NO: 7292294 - DNA, 22 bp, Homo sapiens
aagcacagtgggcagagcagcc

SEQ ID NO: 7292295 - DNA, 22 bp, Homo sapiens
aagcacaggagacgcacagcca

SEQ ID NO: 7292296 - DNA, 22 bp, Homo sapiens
aagcacagaaaaggagcatgga

SEQ ID NO: 7292297 - DNA, 22 bp, Homo sapiens
aagcattgtaagcagaagatgc

SEQ ID NO: 7292298 - DNA, 22 bp, Homo sapiens
acagagtagctcaagaagattg

SEQ ID NO: 7292299 - DNA, 22 bp, Homo sapiens
acagagtacattcagagactat

SEQ ID NO: 7292300 - DNA, 20 bp, Homo sapiens
acagagtagaacatatgcca

SEQ ID NO: 7292301 - DNA, 22 bp, Homo sapiens
acagagtaaatccaagaacgct

SEQ ID NO: 7292302 - DNA, 22 bp, Homo sapiens
acagagtaggtgctcagtaaat

SEQ ID NO: 7292303 - DNA, 22 bp, Homo sapiens
acagagtatctatcaggagtat

SEQ ID NO: 7292304 - DNA, 22 bp, Homo sapiens
aagcagcatgattgtaatacta

SEQ ID NO: 7292305 - DNA, 22 bp, Homo sapiens
aacatgctctgtttcttggatg

SEQ ID NO: 7292306 - DNA, 22 bp, Homo sapiens
aacatgctctggattgctgtga

SEQ ID NO: 7292307 - DNA, 22 bp, Homo sapiens
aacatgctcttcctggctagtc

SEQ ID NO: 7292308 - DNA, 22 bp, Homo sapiens
aacaggctaaattgtccatttc

SEQ ID NO: 7292309 - DNA, 22 bp, Homo sapiens
aacaggaggccttccagtccag

SEQ ID NO: 7292310 - DNA, 22 bp, Homo sapiens
aaccaaagaaaactgtggtgag

SEQ ID NO: 7292311 - DNA, 22 bp, Homo sapiens
aatgatatgcaaattatcatca

SEQ ID NO: 7292312 - DNA, 22 bp, Homo sapiens
aactgtttatgtaagtatgcag

SEQ ID NO: 7292313 - DNA, 22 bp, Homo sapiens
aacaaaccttccctatacgtct

SEQ ID NO: 7292314 - DNA, 22 bp, Homo sapiens
aacaaacctgggtggagaaagg

SEQ ID NO: 7292315 - DNA, 22 bp, Homo sapiens
aaatgttaggttgtactgagtc

SEQ ID NO: 7292316 - DNA, 22 bp, Homo sapiens
aacaaatcttaaagtaattcaa

SEQ ID NO: 7292317 - DNA, 22 bp, Homo sapiens
aacaaatggaacacaaatcttt

SEQ ID NO: 7292318 - DNA, 22 bp, Homo sapiens
aacactaaaggtcagttagaag

SEQ ID NO: 7292319 - DNA, 23 bp, Homo sapiens
aacagccacactgctgagattca

SEQ ID NO: 7292320 - DNA, 22 bp, Homo sapiens
aacagagctgaccagtgagggc

SEQ ID NO: 7292321 - DNA, 22 bp, Homo sapiens
aacagagcttgggtcatctcat

SEQ ID NO: 7292322 - DNA, 22 bp, Homo sapiens
aacagagctggtgactccaggt

SEQ ID NO: 7292323 - DNA, 22 bp, Homo sapiens
aacagcaatagcactattcatt

SEQ ID NO: 7292324 - DNA, 22 bp, Homo sapiens
aaagctgctatgaacattctat

SEQ ID NO: 7292325 - DNA, 22 bp, Homo sapiens
aaagctgctttaaacatctatg

SEQ ID NO: 7292326 - DNA, 22 bp, Homo sapiens
aaagctggcttttacaggggct

SEQ ID NO: 7292327 - DNA, 22 bp, Homo sapiens
aaagatatgtctccaaagagat

SEQ ID NO: 7292328 - DNA, 23 bp, Homo sapiens
aaagatcaaagtggcaggcctgt

SEQ ID NO: 7292329 - DNA, 22 bp, Homo sapiens
aaaggtttccgagctttaattt

SEQ ID NO: 7292330 - DNA, 22 bp, Homo sapiens
aaagtcacatagcatcacttct

SEQ ID NO: 7292331 - DNA, 22 bp, Homo sapiens
aaatagatttctctgggtttgt

SEQ ID NO: 7292332 - DNA, 22 bp, Homo sapiens
aaatactgtagataatagagtt

SEQ ID NO: 7292333 - DNA, 22 bp, Homo sapiens
aaatccatcaaatcttctagaa

SEQ ID NO: 7292334 - DNA, 22 bp, Homo sapiens
aaatagctgaaagttcctagat

SEQ ID NO: 7292335 - DNA, 22 bp, Homo sapiens
aaatagctgtatttaccctgta

SEQ ID NO: 7292336 - DNA, 22 bp, Homo sapiens
aagcacagctggaacagcagga

SEQ ID NO: 7292337 - DNA, 22 bp, Homo sapiens
aagcacagattgctgcatccat

SEQ ID NO: 7292338 - DNA, 22 bp, Homo sapiens
aaatgcatcagctcataagaga

SEQ ID NO: 7292339 - DNA, 22 bp, Homo sapiens
aaatgcatatcaaagacttgaa

SEQ ID NO: 7292340 - DNA, 22 bp, Homo sapiens
aagcacagataaaacaggattc

SEQ ID NO: 7292341 - DNA, 22 bp, Homo sapiens
aaatgtcaaagacgtgtttttg

SEQ ID NO: 7292342 - DNA, 22 bp, Homo sapiens
aagcatgcagactacccctagg

SEQ ID NO: 7292343 - DNA, 22 bp, Homo sapiens
aaagaccatgtttacagctagg

SEQ ID NO: 7292344 - DNA, 22 bp, Homo sapiens
aaacaagcaagcacataatttt

SEQ ID NO: 7292345 - DNA, 23 bp, Homo sapiens
aaacaagccctaatgaagagtcc

SEQ ID NO: 7292346 - DNA, 20 bp, Homo sapiens
aaaaacagtaatgctgaaga

SEQ ID NO: 7292347 - DNA, 22 bp, Homo sapiens
aaaaatcacttttataggcagc

SEQ ID NO: 7292348 - DNA, 22 bp, Homo sapiens
aaaagacatctatttcaggcag

SEQ ID NO: 7292349 - DNA, 22 bp, Homo sapiens
aaaagacatatgtgggcattct

SEQ ID NO: 7292350 - DNA, 22 bp, Homo sapiens
aaaagacaggtgtctgcggccc

SEQ ID NO: 7292351 - DNA, 22 bp, Homo sapiens
aaattaagggtgagaagagttg

SEQ ID NO: 7292352 - DNA, 22 bp, Homo sapiens
aaattaagagtaactctgtaga

SEQ ID NO: 7292353 - DNA, 22 bp, Homo sapiens
aaagagttgttgtataacagga

SEQ ID NO: 7292354 - DNA, 22 bp, Homo sapiens
aaagagttgaaaactaacagtg

SEQ ID NO: 7292355 - DNA, 22 bp, Homo sapiens
aaagagttctgtttgagctgaa

SEQ ID NO: 7292356 - DNA, 22 bp, Homo sapiens
aaagacacaaatgtagaccaaa

SEQ ID NO: 7292357 - DNA, 22 bp, Homo sapiens
aaagaactaatgtgcaaggttt

SEQ ID NO: 7292358 - DNA, 21 bp, Homo sapiens
aaactgaccttgcctgagaca

SEQ ID NO: 7292359 - DNA, 17 bp, Homo sapiens
aaacaatgcagacaagc

SEQ ID NO: 7292360 - DNA, 22 bp, Homo sapiens
acttcttttcaaatcatgcaaa

SEQ ID NO: 7292361 - DNA, 22 bp, Homo sapiens
aatcataattgtatacattcat

SEQ ID NO: 7292362 - DNA, 22 bp, Homo sapiens
aatgagaaaacacagaggaggt

SEQ ID NO: 7292363 - DNA, 19 bp, Homo sapiens
aatgactgagtacattgtc

SEQ ID NO: 7292364 - DNA, 22 bp, Homo sapiens
aatgaccagcgcctgcagaggg

SEQ ID NO: 7292365 - DNA, 22 bp, Homo sapiens
aatgaacatataaagagatctt

SEQ ID NO: 7292366 - DNA, 22 bp, Homo sapiens
aatgaacagtgggtgaggtacc

SEQ ID NO: 7292367 - DNA, 22 bp, Homo sapiens
aatgaacatataaagagatctt

SEQ ID NO: 7292368 - DNA, 22 bp, Homo sapiens
agaaaacataggagacaggaaa

SEQ ID NO: 7292369 - DNA, 22 bp, Homo sapiens
aatgaacaagagagagaacttt

SEQ ID NO: 7292370 - DNA, 22 bp, Homo sapiens
aatgaacaagaaagactttgag

SEQ ID NO: 7292371 - DNA, 22 bp, Homo sapiens
aataattttagctcagagttgt

SEQ ID NO: 7292372 - DNA, 22 bp, Homo sapiens
aataattttgagagcctggaaa

SEQ ID NO: 7292373 - DNA, 22 bp, Homo sapiens
aataatttccagccaactggaa

SEQ ID NO: 7292374 - DNA, 22 bp, Homo sapiens
aagtttatgttggtaagatatc

SEQ ID NO: 7292375 - DNA, 22 bp, Homo sapiens
aagtcacagctaaatagctaag

SEQ ID NO: 7292376 - DNA, 22 bp, Homo sapiens
aagtggagctataggctcagat

SEQ ID NO: 7292377 - DNA, 22 bp, Homo sapiens
aagtggagccagggaaactgaa

SEQ ID NO: 7292378 - DNA, 21 bp, Homo sapiens
aagtggagaagaaaagctgga

SEQ ID NO: 7292379 - DNA, 22 bp, Homo sapiens
actcccagctcagggctttccc

SEQ ID NO: 7292380 - DNA, 22 bp, Homo sapiens
actcccagaacatgctcttctt

SEQ ID NO: 7292381 - DNA, 22 bp, Homo sapiens
acagttgttttccagatatgtt

SEQ ID NO: 7292382 - DNA, 23 bp, Homo sapiens
acagggctgtccagggctaggtc

SEQ ID NO: 7292383 - DNA, 19 bp, Homo sapiens
acagggctctggacgccat

SEQ ID NO: 7292384 - DNA, 22 bp, Homo sapiens
acagggctctgacaccaaggta

SEQ ID NO: 7292385 - DNA, 22 bp, Homo sapiens
acagggctcctaggtggtgtgc

SEQ ID NO: 7292386 - DNA, 22 bp, Homo sapiens
aagggcccttctgttagtggca

SEQ ID NO: 7292387 - DNA, 22 bp, Homo sapiens
aagggcccattctctcagaaaa

SEQ ID NO: 7292388 - DNA, 22 bp, Homo sapiens
aagggcccggctgtgggcagag

SEQ ID NO: 7292389 - DNA, 22 bp, Homo sapiens
aagggcccagccaagctatgct

SEQ ID NO: 7292390 - DNA, 22 bp, Homo sapiens
accatgagttatttgacaggcc

SEQ ID NO: 7292391 - DNA, 22 bp, Homo sapiens
accatgaggaaatacatttgtg

SEQ ID NO: 7292392 - DNA, 17 bp, Homo sapiens
aaggtgagagctgttct

SEQ ID NO: 7292393 - DNA, 22 bp, Homo sapiens
aaggtgagagggaaattttcca

SEQ ID NO: 7292394 - DNA, 22 bp, Homo sapiens
aaggtgaggattttgttctgct

SEQ ID NO: 7292395 - DNA, 22 bp, Homo sapiens
aaggtagggatgtattcagctt

SEQ ID NO: 7292396 - DNA, 22 bp, Homo sapiens
agctatttctcttattatatcc

SEQ ID NO: 7292397 - DNA, 22 bp, Homo sapiens
agcctgcaggatgggcagcacc

SEQ ID NO: 7292398 - DNA, 22 bp, Homo sapiens
acagcaaaggacgaacactctg

SEQ ID NO: 7292399 - DNA, 22 bp, Homo sapiens
acagcaatctgagagacatagt

SEQ ID NO: 7292400 - DNA, 22 bp, Homo sapiens
acagcaatcaatatggcattct

SEQ ID NO: 7292401 - DNA, 22 bp, Homo sapiens
acagcaatctgagagacatagt

SEQ ID NO: 7292402 - DNA, 23 bp, Homo sapiens
acagcaagaggaccagatgtgag

SEQ ID NO: 7292403 - DNA, 22 bp, Homo sapiens
agctatgctgcagttgtggagt

SEQ ID NO: 7292404 - DNA, 19 bp, Homo sapiens
agcccccagacagcaggcc

SEQ ID NO: 7292405 - DNA, 22 bp, Homo sapiens
agcccccagtctaaactgttgg

SEQ ID NO: 7292406 - DNA, 22 bp, Homo sapiens
agcccccaggatgcaaaatgac

SEQ ID NO: 7292407 - DNA, 22 bp, Homo sapiens
agcccccaggagtctccacgcc

SEQ ID NO: 7292408 - DNA, 22 bp, Homo sapiens
acagataaggcagttaagagtt

SEQ ID NO: 7292409 - DNA, 22 bp, Homo sapiens
acagataaaagttgtttaaaat

SEQ ID NO: 7292410 - DNA, 22 bp, Homo sapiens
agcccagctcctccacagaata

SEQ ID NO: 7292411 - DNA, 22 bp, Homo sapiens
agcagcagtgacagccgaaagc

SEQ ID NO: 7292412 - DNA, 22 bp, Homo sapiens
agcagcagtacatataagacta

SEQ ID NO: 7292413 - DNA, 21 bp, Homo sapiens
acacaggcagtgtcccgaggt

SEQ ID NO: 7292414 - DNA, 22 bp, Homo sapiens
acacaggcaagagtgcaggtct

SEQ ID NO: 7292415 - DNA, 22 bp, Homo sapiens
acacatatatttgcatatacac

SEQ ID NO: 7292416 - DNA, 22 bp, Homo sapiens
acagaaattgctaatagctcat

SEQ ID NO: 7292417 - DNA, 22 bp, Homo sapiens
agcagtggtgtgaggagggctc

SEQ ID NO: 7292418 - DNA, 22 bp, Homo sapiens
aattttattagaaggcaagggg

SEQ ID NO: 7292419 - DNA, 22 bp, Homo sapiens
aattttattaactggatgtagc

SEQ ID NO: 7292420 - DNA, 22 bp, Homo sapiens
agagctgggtggtggtgactca

SEQ ID NO: 7292421 - DNA, 22 bp, Homo sapiens
acaaatgattatcacagaggag

SEQ ID NO: 7292422 - DNA, 22 bp, Homo sapiens
acaaatgactatttggtacagg

SEQ ID NO: 7292423 - DNA, 22 bp, Homo sapiens
acaagttaggttttaatccaaa

SEQ ID NO: 7292424 - DNA, 22 bp, Homo sapiens
agcaagcagaattctgtcctct

SEQ ID NO: 7292425 - DNA, 22 bp, Homo sapiens
aatgtgttcagttaaatgaact

SEQ ID NO: 7292426 - DNA, 22 bp, Homo sapiens
aatgtcatttaaagacaaagaa

SEQ ID NO: 7292427 - DNA, 22 bp, Homo sapiens
aatgtcattggtaaagattagg

SEQ ID NO: 7292428 - DNA, 22 bp, Homo sapiens
aatgtcatgagcctgctcttgt

SEQ ID NO: 7292429 - DNA, 22 bp, Homo sapiens
aatgtcaattaccagaacagaa

SEQ ID NO: 7292430 - DNA, 22 bp, Homo sapiens
aatgtcaatctcagagaacaca

SEQ ID NO: 7292431 - DNA, 22 bp, Homo sapiens
agacagcagaaactagagcact

SEQ ID NO: 7292432 - DNA, 21 bp, Homo sapiens
agacagagtgcagtctacata

SEQ ID NO: 7292433 - DNA, 22 bp, Homo sapiens
agaagggctacacgggctctcc

SEQ ID NO: 7292434 - DNA, 22 bp, Homo sapiens
agaagggccagctggacacctg

SEQ ID NO: 7292435 - DNA, 23 bp, Homo sapiens
agaaggtgggcctgctgagttat

SEQ ID NO: 7292436 - DNA, 22 bp, Homo sapiens
agaaggtggctactcagtcatc

SEQ ID NO: 7292437 - DNA, 23 bp, Homo sapiens
aatttagtttgagacattagcct

SEQ ID NO: 7292438 - DNA, 22 bp, Homo sapiens
aatttagtgtaaagctactgga

SEQ ID NO: 7292439 - DNA, 22 bp, Homo sapiens
aatttagtccttacagtgcaga

SEQ ID NO: 7292440 - DNA, 22 bp, Homo sapiens
aattatatgttaatcttcaatt

SEQ ID NO: 7292441 - DNA, 22 bp, Homo sapiens
aattaggcaaattaatttctct

SEQ ID NO: 7292442 - DNA, 22 bp, Homo sapiens
aatgttcaaacagatcacttag

SEQ ID NO: 7292443 - DNA, 18 bp, Homo sapiens
tccaggcctgaagtgtcc

SEQ ID NO: 7292444 - DNA, 22 bp, Homo sapiens
tccaggtgggctgcacccaggc

SEQ ID NO: 7292445 - DNA, 22 bp, Homo sapiens
tccaggtgagtgcaggtgcaga

SEQ ID NO: 7292446 - DNA, 22 bp, Homo sapiens
tcccagagcagtactccaggag

SEQ ID NO: 7292447 - DNA, 22 bp, Homo sapiens
tcccaagagctactcaatggaa

SEQ ID NO: 7292448 - DNA, 22 bp, Homo sapiens
tcccaaatataatgcaagagac

SEQ ID NO: 7292449 - DNA, 22 bp, Homo sapiens
tcccagagaagagctggatgga

SEQ ID NO: 7292450 - DNA, 22 bp, Homo sapiens
tccattctttttacctctcaga

SEQ ID NO: 7292451 - DNA, 22 bp, Homo sapiens
tccatggagtttttatttggta

SEQ ID NO: 7292452 - DNA, 22 bp, Homo sapiens
tcccaggctggggccaggtgac

SEQ ID NO: 7292453 - DNA, 22 bp, Homo sapiens
tccctggagataacttctggga

SEQ ID NO: 7292454 - DNA, 22 bp, Homo sapiens
tcctcagatataaatgagggtg

SEQ ID NO: 7292455 - DNA, 22 bp, Homo sapiens
tcctctggttatacttgcaccc

SEQ ID NO: 7292456 - DNA, 23 bp, Homo sapiens
tcataaatattagcacagtagga

SEQ ID NO: 7292457 - DNA, 22 bp, Homo sapiens
tcagtatgatgagagggaaatt

SEQ ID NO: 7292458 - DNA, 17 bp, Homo sapiens
tcaggctgggtgcagtg

SEQ ID NO: 7292459 - DNA, 22 bp, Homo sapiens
tcatttgttctcattctctact

SEQ ID NO: 7292460 - DNA, 22 bp, Homo sapiens
tcatttgtctggcacagggaat

SEQ ID NO: 7292461 - DNA, 22 bp, Homo sapiens
tcatttgtaccattttttaaga

SEQ ID NO: 7292462 - DNA, 22 bp, Homo sapiens
tcatttgtaccattttttaaga

SEQ ID NO: 7292463 - DNA, 22 bp, Homo sapiens
tccaaagaatagaggtgacatt

SEQ ID NO: 7292464 - DNA, 23 bp, Homo sapiens
tcatttcaggttgcatggtacca

SEQ ID NO: 7292465 - DNA, 22 bp, Homo sapiens
tcatttcaatgatactactaag

SEQ ID NO: 7292466 - DNA, 22 bp, Homo sapiens
tcatttcagatgcatttagaat

SEQ ID NO: 7292467 - DNA, 22 bp, Homo sapiens
tcatttcagccatttttaaatg

SEQ ID NO: 7292468 - DNA, 22 bp, Homo sapiens
tcacattttagtaccatgattt

SEQ ID NO: 7292469 - DNA, 22 bp, Homo sapiens
tcacatttgtgttttattagag

SEQ ID NO: 7292470 - DNA, 22 bp, Homo sapiens
tcacatttggagaaagcctgcc

SEQ ID NO: 7292471 - DNA, 22 bp, Homo sapiens
tcacatttgcaattgcattgtt

SEQ ID NO: 7292472 - DNA, 22 bp, Homo sapiens
tcacattttatatctctggttt

SEQ ID NO: 7292473 - DNA, 22 bp, Homo sapiens
tcacattttatctattttaagt

SEQ ID NO: 7292474 - DNA, 22 bp, Homo sapiens
tcaacatacatacatggtcagg

SEQ ID NO: 7292475 - DNA, 22 bp, Homo sapiens
tcaacagtggcaaagaggcacg

SEQ ID NO: 7292476 - DNA, 22 bp, Homo sapiens
tcaacaataggatatagcaggt

SEQ ID NO: 7292477 - DNA, 22 bp, Homo sapiens
tcacagttttagctgttaaata

SEQ ID NO: 7292478 - DNA, 22 bp, Homo sapiens
tcacagtttccataggtcagca

SEQ ID NO: 7292479 - DNA, 22 bp, Homo sapiens
tcacagtttcttttctgataaa

SEQ ID NO: 7292480 - DNA, 22 bp, Homo sapiens
tcacagtttcttttctgataaa

SEQ ID NO: 7292481 - DNA, 22 bp, Homo sapiens
tcacagttttagaaaatagata

SEQ ID NO: 7292482 - DNA, 22 bp, Homo sapiens
tcacagttttaagtgtgatcca

SEQ ID NO: 7292483 - DNA, 22 bp, Homo sapiens
tcacagttttagaaaatagata

SEQ ID NO: 7292484 - DNA, 22 bp, Homo sapiens
tcacatttgataatgcccattg

SEQ ID NO: 7292485 - DNA, 22 bp, Homo sapiens
tcacatttctgattataccaaa

SEQ ID NO: 7292486 - DNA, 22 bp, Homo sapiens
tcacatttctcagcactgatga

SEQ ID NO: 7292487 - DNA, 22 bp, Homo sapiens
tcacatgctactgagccagacc

SEQ ID NO: 7292488 - DNA, 22 bp, Homo sapiens
tcacatgctgtgggatctgtat

SEQ ID NO: 7292489 - DNA, 22 bp, Homo sapiens
tcacattgccattagttcagtt

SEQ ID NO: 7292490 - DNA, 23 bp, Homo sapiens
tcacatttaacccctcagacctc

SEQ ID NO: 7292491 - DNA, 22 bp, Homo sapiens
tcacattgttcttagtttacct

SEQ ID NO: 7292492 - DNA, 22 bp, Homo sapiens
tcacattgttatgtaaatgttt

SEQ ID NO: 7292493 - DNA, 22 bp, Homo sapiens
tcacattgtaggtcatttgcaa

SEQ ID NO: 7292494 - DNA, 22 bp, Homo sapiens
tcacattgtaggatagcagaga

SEQ ID NO: 7292495 - DNA, 22 bp, Homo sapiens
tcacattggaccttcctgacaa

SEQ ID NO: 7292496 - DNA, 22 bp, Homo sapiens
tcacattgctcccatagtggat

SEQ ID NO: 7292497 - DNA, 22 bp, Homo sapiens
tcacattgccgtctgtgcactt

SEQ ID NO: 7292498 - DNA, 22 bp, Homo sapiens
tcagcagtgtagtttatcattc

SEQ ID NO: 7292499 - DNA, 22 bp, Homo sapiens
tcagcaaatacttattgagcgc

SEQ ID NO: 7292500 - DNA, 17 bp, Homo sapiens
tcagcaaagacaaagga

SEQ ID NO: 7292501 - DNA, 22 bp, Homo sapiens
tcagcaaaggaccagcacaggc

SEQ ID NO: 7292502 - DNA, 21 bp, Homo sapiens
tcagcaaaataagcaaatgga

SEQ ID NO: 7292503 - DNA, 22 bp, Homo sapiens
tcaggactagacatgaggaagg

SEQ ID NO: 7292504 - DNA, 22 bp, Homo sapiens
tcaggacagaaggctgccaggg

SEQ ID NO: 7292505 - DNA, 22 bp, Homo sapiens
tcagcattttttgggtgtaact

SEQ ID NO: 7292506 - DNA, 22 bp, Homo sapiens
tagttttttcaacaaatggtgc

SEQ ID NO: 7292507 - DNA, 22 bp, Homo sapiens
tagtctctatgagtgaatcaca

SEQ ID NO: 7292508 - DNA, 22 bp, Homo sapiens
tagtgctatagaagtgcttgcg

SEQ ID NO: 7292509 - DNA, 22 bp, Homo sapiens
tagcaacatggttatcacatta

SEQ ID NO: 7292510 - DNA, 22 bp, Homo sapiens
tagctgacgctaaataaatgtt

SEQ ID NO: 7292511 - DNA, 22 bp, Homo sapiens
tagatacctgctggacctcatt

SEQ ID NO: 7292512 - DNA, 22 bp, Homo sapiens
tattttgtatttatgcaagaaa

SEQ ID NO: 7292513 - DNA, 22 bp, Homo sapiens
tcaaagatagatgttgagaaat

SEQ ID NO: 7292514 - DNA, 21 bp, Homo sapiens
tcaaatcaggtatcactattg

SEQ ID NO: 7292515 - DNA, 22 bp, Homo sapiens
tcaaataccagcaatttcatgt

SEQ ID NO: 7292516 - DNA, 22 bp, Homo sapiens
tatttaagatgtgtcataaaga

SEQ ID NO: 7292517 - DNA, 22 bp, Homo sapiens
tattgttgttgtgagggggatg

SEQ ID NO: 7292518 - DNA, 22 bp, Homo sapiens
tattgtcaagaagtttatagtg

SEQ ID NO: 7292519 - DNA, 22 bp, Homo sapiens
tattgtcacgtcttaattctag

SEQ ID NO: 7292520 - DNA, 22 bp, Homo sapiens
tattgtctgtttgaatgactat

SEQ ID NO: 7292521 - DNA, 22 bp, Homo sapiens
tattacaaattataatgggaga

SEQ ID NO: 7292522 - DNA, 23 bp, Homo sapiens
tattacaattggtcttattaaga

SEQ ID NO: 7292523 - DNA, 22 bp, Homo sapiens
tatttaattagtgattgtagag

SEQ ID NO: 7292524 - DNA, 22 bp, Homo sapiens
tatttcttgttattctcgttga

SEQ ID NO: 7292525 - DNA, 22 bp, Homo sapiens
tatttgcaggcttttgtcatgg

SEQ ID NO: 7292526 - DNA, 22 bp, Homo sapiens
tatttgcaggacatagatatgg

SEQ ID NO: 7292527 - DNA, 22 bp, Homo sapiens
tatcattttactgtgacatttt

SEQ ID NO: 7292528 - DNA, 22 bp, Homo sapiens
tatcatttagagtatttcttca

SEQ ID NO: 7292529 - DNA, 20 bp, Homo sapiens
tatgacaacgcagcaaggca

SEQ ID NO: 7292530 - DNA, 22 bp, Homo sapiens
tatgacaagaaatacagaggta

SEQ ID NO: 7292531 - DNA, 22 bp, Homo sapiens
tatgacaaggtggagtatgagt

SEQ ID NO: 7292532 - DNA, 22 bp, Homo sapiens
tatgaaatttaaacacagatca

SEQ ID NO: 7292533 - DNA, 22 bp, Homo sapiens
tatcacaggtgtgatttacatt

SEQ ID NO: 7292534 - DNA, 22 bp, Homo sapiens
tatcagataatcttttacaagc

SEQ ID NO: 7292535 - DNA, 22 bp, Homo sapiens
tatcacttgcgttttggcagag

SEQ ID NO: 7292536 - DNA, 22 bp, Homo sapiens
tatgtagtacttagtgcataca

SEQ ID NO: 7292537 - DNA, 21 bp, Homo sapiens
tattaatatgtctaagctgat

SEQ ID NO: 7292538 - DNA, 22 bp, Homo sapiens
tatggaaataattagacaagtg

SEQ ID NO: 7292539 - DNA, 22 bp, Homo sapiens
tatggaatggctattttctagg

SEQ ID NO: 7292540 - DNA, 22 bp, Homo sapiens
gtttatcattattattagcaac

SEQ ID NO: 7292541 - DNA, 22 bp, Homo sapiens
gtttatcacaataaataattct

SEQ ID NO: 7292542 - DNA, 22 bp, Homo sapiens
gtttatgaatgtgtcagacata

SEQ ID NO: 7292543 - DNA, 22 bp, Homo sapiens
gtttatgaatgttactatagag

SEQ ID NO: 7292544 - DNA, 22 bp, Homo sapiens
gttgacagtgaccctgaaagca

SEQ ID NO: 7292545 - DNA, 22 bp, Homo sapiens
gttgacaggaaggcgttcccag

SEQ ID NO: 7292546 - DNA, 22 bp, Homo sapiens
gttgacagctggtgagctgcta

SEQ ID NO: 7292547 - DNA, 22 bp, Homo sapiens
gttgacagagcgcctttgaatt

SEQ ID NO: 7292548 - DNA, 22 bp, Homo sapiens
gttgacagaattgtgtggctgg

SEQ ID NO: 7292549 - DNA, 22 bp, Homo sapiens
gttgacagaaaaataacatagc

SEQ ID NO: 7292550 - DNA, 22 bp, Homo sapiens
gtttcacacatcctgcacatag

SEQ ID NO: 7292551 - DNA, 22 bp, Homo sapiens
gtttcacagtctgcagaatttt

SEQ ID NO: 7292552 - DNA, 22 bp, Homo sapiens
gtttgcataaagtggatgcagg

SEQ ID NO: 7292553 - DNA, 22 bp, Homo sapiens
gtttgcatatttgcacaggaat

SEQ ID NO: 7292554 - DNA, 21 bp, Homo sapiens
gtttgcatgaacaagtcagcc

SEQ ID NO: 7292555 - DNA, 22 bp, Homo sapiens
gtttgtgtaacatgatgatgat

SEQ ID NO: 7292556 - DNA, 22 bp, Homo sapiens
gtttgcattccaatttagggga

SEQ ID NO: 7292557 - DNA, 22 bp, Homo sapiens
gttattgtccatttatttagca

SEQ ID NO: 7292558 - DNA, 22 bp, Homo sapiens
gttattgtccagcacagttggg

SEQ ID NO: 7292559 - DNA, 21 bp, Homo sapiens
taagagcctaacacagaaagg

SEQ ID NO: 7292560 - DNA, 22 bp, Homo sapiens
taagacaaatactatttcaaga

SEQ ID NO: 7292561 - DNA, 22 bp, Homo sapiens
taaagacatggtgtaggtgaac

SEQ ID NO: 7292562 - DNA, 17 bp, Homo sapiens
taaagatcagccatgta

SEQ ID NO: 7292563 - DNA, 23 bp, Homo sapiens
taaagacagccttcaggattctg

SEQ ID NO: 7292564 - DNA, 22 bp, Homo sapiens
taaagacagatggaccagccat

SEQ ID NO: 7292565 - DNA, 22 bp, Homo sapiens
taaagacatgcaaagtctaatt

SEQ ID NO: 7292566 - DNA, 20 bp, Homo sapiens
taaagacataagctactatc

SEQ ID NO: 7292567 - DNA, 22 bp, Homo sapiens
taaagacataggatcagggaga

SEQ ID NO: 7292568 - DNA, 22 bp, Homo sapiens
taatttcaaatttcttagcgtg

SEQ ID NO: 7292569 - DNA, 22 bp, Homo sapiens
tacagacaaagagcatgcggta

SEQ ID NO: 7292570 - DNA, 23 bp, Homo sapiens
taattcacatatacattgcttca

SEQ ID NO: 7292571 - DNA, 22 bp, Homo sapiens
taattgcagggtgtcagaatac

SEQ ID NO: 7292572 - DNA, 22 bp, Homo sapiens
tacagagtaatttgcatgggga

SEQ ID NO: 7292573 - DNA, 22 bp, Homo sapiens
taccagggaacagggatattaa

SEQ ID NO: 7292574 - DNA, 22 bp, Homo sapiens
taccagggaacagggatattaa

SEQ ID NO: 7292575 - DNA, 22 bp, Homo sapiens
ggtggcagagaggaggtagttt

SEQ ID NO: 7292576 - DNA, 22 bp, Homo sapiens
ggttgttgtgaaggtgaagaga

SEQ ID NO: 7292577 - DNA, 17 bp, Homo sapiens
ggtttaatccttacctg

SEQ ID NO: 7292578 - DNA, 22 bp, Homo sapiens
ggtttaatggagatatttcaga

SEQ ID NO: 7292579 - DNA, 22 bp, Homo sapiens
ggttcacactttcatgatttca

SEQ ID NO: 7292580 - DNA, 22 bp, Homo sapiens
ggtgaggaaagatggtgacagt

SEQ ID NO: 7292581 - DNA, 22 bp, Homo sapiens
ggtgagaggcagtgctgtggaa

SEQ ID NO: 7292582 - DNA, 22 bp, Homo sapiens
ggtgacagcgggtcaagaggag

SEQ ID NO: 7292583 - DNA, 22 bp, Homo sapiens
ggtgaggcccagtgatctgtgt

SEQ ID NO: 7292584 - DNA, 23 bp, Homo sapiens
gggtttccttctggctcctcctt

SEQ ID NO: 7292585 - DNA, 23 bp, Homo sapiens
gggtttccttctggctcctcctt

SEQ ID NO: 7292586 - DNA, 22 bp, Homo sapiens
ggggccagagaggacccaggtg

SEQ ID NO: 7292587 - DNA, 22 bp, Homo sapiens
ggggaggacctttccaaggctt

SEQ ID NO: 7292588 - DNA, 22 bp, Homo sapiens
gggtgcagagcttaactgtagg

SEQ ID NO: 7292589 - DNA, 22 bp, Homo sapiens
gtgcaggatttatagcccagct

SEQ ID NO: 7292590 - DNA, 22 bp, Homo sapiens
gtgcaggaggtaacatagcaaa

SEQ ID NO: 7292591 - DNA, 22 bp, Homo sapiens
gtgcaggatctcagaacaagtg

SEQ ID NO: 7292592 - DNA, 22 bp, Homo sapiens
gtgcaggatgttgggaatcagg

SEQ ID NO: 7292593 - DNA, 22 bp, Homo sapiens
gtgcaggagtaggagagggctt

SEQ ID NO: 7292594 - DNA, 22 bp, Homo sapiens
gtgaggatgtactgagataaat

SEQ ID NO: 7292595 - DNA, 22 bp, Homo sapiens
gtgaggatcaaatgaaatagca

SEQ ID NO: 7292596 - DNA, 17 bp, Homo sapiens
gtgcagggatgaaggat

SEQ ID NO: 7292597 - DNA, 22 bp, Homo sapiens
gtgctgacaggagcctggcggt

SEQ ID NO: 7292598 - DNA, 22 bp, Homo sapiens
gtgagccgagtatagttcatag

SEQ ID NO: 7292599 - DNA, 22 bp, Homo sapiens
gtgagcataacaacagagttta

SEQ ID NO: 7292600 - DNA, 22 bp, Homo sapiens
gtgagcatagtaccaggtagta

SEQ ID NO: 7292601 - DNA, 22 bp, Homo sapiens
gtgagcatgccgtccaagtcac

SEQ ID NO: 7292602 - DNA, 22 bp, Homo sapiens
gtgagcatcttggcagatatga

SEQ ID NO: 7292603 - DNA, 22 bp, Homo sapiens
gtgagcatcccttaccggaagt

SEQ ID NO: 7292604 - DNA, 22 bp, Homo sapiens
gtgagcatcaaaaacgtgtatg

SEQ ID NO: 7292605 - DNA, 22 bp, Homo sapiens
gtgagcatatatgtaatcgttt

SEQ ID NO: 7292606 - DNA, 22 bp, Homo sapiens
gtgagcatgtagtaatctggag

SEQ ID NO: 7292607 - DNA, 22 bp, Homo sapiens
gtctaattcctgctcttactca

SEQ ID NO: 7292608 - DNA, 22 bp, Homo sapiens
gtctatatattgcttgaataat

SEQ ID NO: 7292609 - DNA, 19 bp, Homo sapiens
gtccaggcattgggttggt

SEQ ID NO: 7292610 - DNA, 22 bp, Homo sapiens
gtcagaaaacttccctttgagt

SEQ ID NO: 7292611 - DNA, 22 bp, Homo sapiens
gtatttttcattccaagtgaga

SEQ ID NO: 7292612 - DNA, 22 bp, Homo sapiens
gtatttttaggtaaggaaagta

SEQ ID NO: 7292613 - DNA, 22 bp, Homo sapiens
gtatttttagtagagtcggggt

SEQ ID NO: 7292614 - DNA, 22 bp, Homo sapiens
gtatttttcagttaggagctta

SEQ ID NO: 7292615 - DNA, 22 bp, Homo sapiens
gtagtcccagctaccccggagg

SEQ ID NO: 7292616 - DNA, 22 bp, Homo sapiens
gggaagccatgctcagaggtac

SEQ ID NO: 7292617 - DNA, 22 bp, Homo sapiens
gggaaggcaggattctctggtg

SEQ ID NO: 7292618 - DNA, 22 bp, Homo sapiens
gggaaggccggtccagtcaggt

SEQ ID NO: 7292619 - DNA, 22 bp, Homo sapiens
gggagccacagtagcagctact

SEQ ID NO: 7292620 - DNA, 22 bp, Homo sapiens
gggagccactcagctgagagtt

SEQ ID NO: 7292621 - DNA, 22 bp, Homo sapiens
gggagccagcagggcatggagc

SEQ ID NO: 7292622 - DNA, 18 bp, Homo sapiens
ggctgtgcgtggaggctg

SEQ ID NO: 7292623 - DNA, 19 bp, Homo sapiens
gggatcagcccagggctct

SEQ ID NO: 7292624 - DNA, 20 bp, Homo sapiens
gggatcaggaaaggaggcta

SEQ ID NO: 7292625 - DNA, 19 bp, Homo sapiens
gggatcagcccagggctct

SEQ ID NO: 7292626 - DNA, 22 bp, Homo sapiens
gggaggttgaggctgcagtgag

SEQ ID NO: 7292627 - DNA, 22 bp, Homo sapiens
ggcagccctttctggccagctc

SEQ ID NO: 7292628 - DNA, 22 bp, Homo sapiens
ggcagccatgtgggcagcgagt

SEQ ID NO: 7292629 - DNA, 22 bp, Homo sapiens
ggcaggggtcctggtgttgact

SEQ ID NO: 7292630 - DNA, 18 bp, Homo sapiens
ggcagggaaaagataggg

SEQ ID NO: 7292631 - DNA, 22 bp, Homo sapiens
ggcagggaagctggcatcacgg

SEQ ID NO: 7292632 - DNA, 22 bp, Homo sapiens
ggcagggactttgcaaatcttt

SEQ ID NO: 7292633 - DNA, 22 bp, Homo sapiens
ggcagcactgcagcttgttggg

SEQ ID NO: 7292634 - DNA, 22 bp, Homo sapiens
ggcagatgttgcagtgagcaga

SEQ ID NO: 7292635 - DNA, 22 bp, Homo sapiens
ggaggaggggtttacattggaa

SEQ ID NO: 7292636 - DNA, 22 bp, Homo sapiens
ggcccaggctggagtgcggtgg

SEQ ID NO: 7292637 - DNA, 22 bp, Homo sapiens
ggccagcatatagagtgaagta

SEQ ID NO: 7292638 - DNA, 21 bp, Homo sapiens
ggccagcagcgtccactgtgg

SEQ ID NO: 7292639 - DNA, 21 bp, Homo sapiens
ggccagctgcatatgtcactg

SEQ ID NO: 7292640 - DNA, 22 bp, Homo sapiens
ggccagctgctcagtgtctctg

SEQ ID NO: 7292641 - DNA, 22 bp, Homo sapiens
ggctcactgcaacttccgcctc

SEQ ID NO: 7292642 - DNA, 22 bp, Homo sapiens
ggctctgccacttcttggctgt

SEQ ID NO: 7292643 - DNA, 22 bp, Homo sapiens
gctcccagcaattgaggcagcc

SEQ ID NO: 7292644 - DNA, 22 bp, Homo sapiens
gctcccaggatgaggagccagg

SEQ ID NO: 7292645 - DNA, 20 bp, Homo sapiens
gctcccagcctgcagtcccc

SEQ ID NO: 7292646 - DNA, 21 bp, Homo sapiens
gctctgtgaaatttcaccagg

SEQ ID NO: 7292647 - DNA, 22 bp, Homo sapiens
gctctgtgaagggtgttgctca

SEQ ID NO: 7292648 - DNA, 22 bp, Homo sapiens
gctctgtgaccttaggcaagtt

SEQ ID NO: 7292649 - DNA, 22 bp, Homo sapiens
gctctgtgagtattggccctgg

SEQ ID NO: 7292650 - DNA, 22 bp, Homo sapiens
gctctgtgagccacttgatgta

SEQ ID NO: 7292651 - DNA, 18 bp, Homo sapiens
gctctgtgaccttgagca

SEQ ID NO: 7292652 - DNA, 22 bp, Homo sapiens
gctctgtggcaggaggtcttgt

SEQ ID NO: 7292653 - DNA, 20 bp, Homo sapiens
gctctgtgctggcggaggct

SEQ ID NO: 7292654 - DNA, 22 bp, Homo sapiens
gctctgtgctagaactaagaat

SEQ ID NO: 7292655 - DNA, 22 bp, Homo sapiens
gctctgtgccagggctgggcca

SEQ ID NO: 7292656 - DNA, 22 bp, Homo sapiens
gctctgtgctactttgaactct

SEQ ID NO: 7292657 - DNA, 22 bp, Homo sapiens
gctctgtgcccctgccgtggac

SEQ ID NO: 7292658 - DNA, 22 bp, Homo sapiens
gctctgtgcaaatagcacccct

SEQ ID NO: 7292659 - DNA, 19 bp, Homo sapiens
gctctgtgatgctgagggg

SEQ ID NO: 7292660 - DNA, 22 bp, Homo sapiens
gctctgtgcagttcagggacac

SEQ ID NO: 7292661 - DNA, 22 bp, Homo sapiens
gctctgtgccacatgcagtgtt

SEQ ID NO: 7292662 - DNA, 22 bp, Homo sapiens
gctggagtgatgcctgtgtctc

SEQ ID NO: 7292663 - DNA, 22 bp, Homo sapiens
gctggagtgcagttgcacagtc

SEQ ID NO: 7292664 - DNA, 22 bp, Homo sapiens
gctctgtggcattcatgggcag

SEQ ID NO: 7292665 - DNA, 22 bp, Homo sapiens
gctctgtggcattcatgggcag

SEQ ID NO: 7292666 - DNA, 22 bp, Homo sapiens
gctctgtgggggaaatcctggg

SEQ ID NO: 7292667 - DNA, 22 bp, Homo sapiens
gctctgtgggtgagtagaatct

SEQ ID NO: 7292668 - DNA, 22 bp, Homo sapiens
gctctgtggtggggcagagttt

SEQ ID NO: 7292669 - DNA, 20 bp, Homo sapiens
gctctgtggtttgagtctcc

SEQ ID NO: 7292670 - DNA, 22 bp, Homo sapiens
gctctgtgtaaatgtagggtcc

SEQ ID NO: 7292671 - DNA, 22 bp, Homo sapiens
gctctgtgtatgtggcaggtgc

SEQ ID NO: 7292672 - DNA, 22 bp, Homo sapiens
gctgagtcttgagcactgagca

SEQ ID NO: 7292673 - DNA, 22 bp, Homo sapiens
ggagcccaagtctgcactcggc

SEQ ID NO: 7292674 - DNA, 22 bp, Homo sapiens
ggagcccaagtctgcactcggc

SEQ ID NO: 7292675 - DNA, 22 bp, Homo sapiens
ggagccatgttttcagcatgat

SEQ ID NO: 7292676 - DNA, 22 bp, Homo sapiens
ggagctgggaactatgtagtat

SEQ ID NO: 7292677 - DNA, 22 bp, Homo sapiens
ggactgtctactaacaagaagc

SEQ ID NO: 7292678 - DNA, 22 bp, Homo sapiens
ggagaaaattgatgaagttggc

SEQ ID NO: 7292679 - DNA, 19 bp, Homo sapiens
ggaaggccacggcaggctt

SEQ ID NO: 7292680 - DNA, 22 bp, Homo sapiens
gctgtccatccacttcccagcg

SEQ ID NO: 7292681 - DNA, 22 bp, Homo sapiens
gccctgctaatttcgtactttt

SEQ ID NO: 7292682 - DNA, 23 bp, Homo sapiens
gccctgctgggacctcctgctac

SEQ ID NO: 7292683 - DNA, 22 bp, Homo sapiens
gccctggaaaggaacctgggct

SEQ ID NO: 7292684 - DNA, 22 bp, Homo sapiens
gccctggacagtgacggtgacc

SEQ ID NO: 7292685 - DNA, 22 bp, Homo sapiens
gccctggaatctctccatggga

SEQ ID NO: 7292686 - DNA, 20 bp, Homo sapiens
gccctggacgtggcctcggc

SEQ ID NO: 7292687 - DNA, 22 bp, Homo sapiens
gccctggagagggatatggcat

SEQ ID NO: 7292688 - DNA, 22 bp, Homo sapiens
gcccaaggtcccatggcagcac

SEQ ID NO: 7292689 - DNA, 22 bp, Homo sapiens
gcctgcacccacaggcatggcc

SEQ ID NO: 7292690 - DNA, 22 bp, Homo sapiens
gcccaaggtcacacacaggaag

SEQ ID NO: 7292691 - DNA, 20 bp, Homo sapiens
gcccaaggtccagaaggggg

SEQ ID NO: 7292692 - DNA, 22 bp, Homo sapiens
gcagttgctcttgaggcacttt

SEQ ID NO: 7292693 - DNA, 17 bp, Homo sapiens
gcagttaaattaagatg

SEQ ID NO: 7292694 - DNA, 21 bp, Homo sapiens
gcagttaatagcagagcacac

SEQ ID NO: 7292695 - DNA, 22 bp, Homo sapiens
gcagcccaatggactgagacag

SEQ ID NO: 7292696 - DNA, 22 bp, Homo sapiens
gcagcccacagctggaggccta

SEQ ID NO: 7292697 - DNA, 22 bp, Homo sapiens
gcaggccaagccctcgcagaga

SEQ ID NO: 7292698 - DNA, 22 bp, Homo sapiens
gcaggccagctgtgcagatggg

SEQ ID NO: 7292699 - DNA, 22 bp, Homo sapiens
gcaggccattcaggagatgtgc

SEQ ID NO: 7292700 - DNA, 22 bp, Homo sapiens
gcaggcctcccctgctggagct

SEQ ID NO: 7292701 - DNA, 19 bp, Homo sapiens
gagtattttccaacttggt

SEQ ID NO: 7292702 - DNA, 18 bp, Homo sapiens
gagtagcattgaggaaac

SEQ ID NO: 7292703 - DNA, 22 bp, Homo sapiens
gcaataaaatgtaatgattggg

SEQ ID NO: 7292704 - DNA, 22 bp, Homo sapiens
gcaataaagtagcagctcatca

SEQ ID NO: 7292705 - DNA, 22 bp, Homo sapiens
gcacattgttactcttactgtg

SEQ ID NO: 7292706 - DNA, 22 bp, Homo sapiens
gcacattgcttgcccattgtaa

SEQ ID NO: 7292707 - DNA, 22 bp, Homo sapiens
gcacagaaccagacatgaggca

SEQ ID NO: 7292708 - DNA, 22 bp, Homo sapiens
gcaatactcaacacttttgctt

SEQ ID NO: 7292709 - DNA, 22 bp, Homo sapiens
gcaatactaagtgacttttggg

SEQ ID NO: 7292710 - DNA, 22 bp, Homo sapiens
gcaatactgagattattgtact

SEQ ID NO: 7292711 - DNA, 22 bp, Homo sapiens
gcacagacagaatccctactcc

SEQ ID NO: 7292712 - DNA, 22 bp, Homo sapiens
gcacagaataacactctgggct

SEQ ID NO: 7292713 - DNA, 22 bp, Homo sapiens
gcacagagggcagtgagcctct

SEQ ID NO: 7292714 - DNA, 22 bp, Homo sapiens
gcacagagagtcccgggtgccc

SEQ ID NO: 7292715 - DNA, 22 bp, Homo sapiens
gcagagtgagccgaggctgctc

SEQ ID NO: 7292716 - DNA, 22 bp, Homo sapiens
gcagagtgccgagatggaagcg

SEQ ID NO: 7292717 - DNA, 22 bp, Homo sapiens
gcagaggtgtgggaggggccac

SEQ ID NO: 7292718 - DNA, 22 bp, Homo sapiens
gcacatttgccactgagctcct

SEQ ID NO: 7292719 - DNA, 22 bp, Homo sapiens
gcacatttctcaaagaattgtc

SEQ ID NO: 7292720 - DNA, 22 bp, Homo sapiens
gcagaaggcctcttggttaata

SEQ ID NO: 7292721 - DNA, 22 bp, Homo sapiens
ctgggtgtagcccagtatgagg

SEQ ID NO: 7292722 - DNA, 22 bp, Homo sapiens
ctgggaggcggaggttgcagtg

SEQ ID NO: 7292723 - DNA, 22 bp, Homo sapiens
ctgtgtgtgaacacagcccagc

SEQ ID NO: 7292724 - DNA, 22 bp, Homo sapiens
ctgtgtgtttatatcatttcct

SEQ ID NO: 7292725 - DNA, 22 bp, Homo sapiens
ctgtgtgtgagaagcaggttga

SEQ ID NO: 7292726 - DNA, 23 bp, Homo sapiens
ctgtgtgtgccgagggtggccac

SEQ ID NO: 7292727 - DNA, 22 bp, Homo sapiens
ctgtgtgtgctacaggcttcca

SEQ ID NO: 7292728 - DNA, 22 bp, Homo sapiens
ctgtgtgtgtctgcagcatact

SEQ ID NO: 7292729 - DNA, 22 bp, Homo sapiens
ctgtggctttctctgcctcctt

SEQ ID NO: 7292730 - DNA, 20 bp, Homo sapiens
ctgtggcatcttgaaggagg

SEQ ID NO: 7292731 - DNA, 22 bp, Homo sapiens
ctgtggatttacttgagaagct

SEQ ID NO: 7292732 - DNA, 23 bp, Homo sapiens
ctgtggcaagtcctgcacctgcc

SEQ ID NO: 7292733 - DNA, 22 bp, Homo sapiens
ctgtgaatttaaagcacacatc

SEQ ID NO: 7292734 - DNA, 22 bp, Homo sapiens
ctgtgagctaggaggtaattta

SEQ ID NO: 7292735 - DNA, 22 bp, Homo sapiens
ctgtgagctgggtggccaggac

SEQ ID NO: 7292736 - DNA, 22 bp, Homo sapiens
ctgtcatggtttgaatgctcgc

SEQ ID NO: 7292737 - DNA, 22 bp, Homo sapiens
ctgtcatggtcagattgtcatc

SEQ ID NO: 7292738 - DNA, 21 bp, Homo sapiens
ctgtcatgcaaccattctcca

SEQ ID NO: 7292739 - DNA, 20 bp, Homo sapiens
cttcttcagtagtttgttct

SEQ ID NO: 7292740 - DNA, 22 bp, Homo sapiens
ctttggaacaagaagaaatggc

SEQ ID NO: 7292741 - DNA, 22 bp, Homo sapiens
ctttgcattttgcccaactgtg

SEQ ID NO: 7292742 - DNA, 22 bp, Homo sapiens
ctttgcattctcagcacagagc

SEQ ID NO: 7292743 - DNA, 22 bp, Homo sapiens
ctttgcatgtggtagaaggttc

SEQ ID NO: 7292744 - DNA, 21 bp, Homo sapiens
ctttgcatctatatgttctca

SEQ ID NO: 7292745 - DNA, 22 bp, Homo sapiens
ctttgcatgggtctgaaggctt

SEQ ID NO: 7292746 - DNA, 21 bp, Homo sapiens
ctttgcatctatatgttctca

SEQ ID NO: 7292747 - DNA, 22 bp, Homo sapiens
ctttgcatacaatttttagaaa

SEQ ID NO: 7292748 - DNA, 21 bp, Homo sapiens
ctttgcatacagatgccaatt

SEQ ID NO: 7292749 - DNA, 22 bp, Homo sapiens
ctttgcataatgaatgatcata

SEQ ID NO: 7292750 - DNA, 22 bp, Homo sapiens
ctttctccctgtcccaaactgg

SEQ ID NO: 7292751 - DNA, 22 bp, Homo sapiens
gaaagacatagttgcaagatgg

SEQ ID NO: 7292752 - DNA, 22 bp, Homo sapiens
gaaatgtctttgacaagagagg

SEQ ID NO: 7292753 - DNA, 22 bp, Homo sapiens
gaagaactaactgaccatgaat

SEQ ID NO: 7292754 - DNA, 22 bp, Homo sapiens
gaagaagacatggaacaatagt

SEQ ID NO: 7292755 - DNA, 22 bp, Homo sapiens
gaagaactttagggcagaattt

SEQ ID NO: 7292756 - DNA, 22 bp, Homo sapiens
gaagaactgtgacagaagcagt

SEQ ID NO: 7292757 - DNA, 22 bp, Homo sapiens
gaaattaagcaggggtctgtgg

SEQ ID NO: 7292758 - DNA, 22 bp, Homo sapiens
gaaattaaccacctttggcttt

SEQ ID NO: 7292759 - DNA, 22 bp, Homo sapiens
cttttgttctacagctggggaa

SEQ ID NO: 7292760 - DNA, 22 bp, Homo sapiens
ctttttgtctctgtcctgatga

SEQ ID NO: 7292761 - DNA, 22 bp, Homo sapiens
ctttggaggtcatagccaagag

SEQ ID NO: 7292762 - DNA, 22 bp, Homo sapiens
ctttggaagtaaagtcagcagg

SEQ ID NO: 7292763 - DNA, 22 bp, Homo sapiens
ctttttgttgtataagcccttt

SEQ ID NO: 7292764 - DNA, 22 bp, Homo sapiens
gaaagaatgctgggagccatct

SEQ ID NO: 7292765 - DNA, 22 bp, Homo sapiens
gaaagaatgctatagtgacttc

SEQ ID NO: 7292766 - DNA, 22 bp, Homo sapiens
gaaagaatcaactatgtctctg

SEQ ID NO: 7292767 - DNA, 22 bp, Homo sapiens
gaaacttgataattgaaacaga

SEQ ID NO: 7292768 - DNA, 22 bp, Homo sapiens
gacctggaagaactgaggcctt

SEQ ID NO: 7292769 - DNA, 22 bp, Homo sapiens
gacctggcatattcattggcac

SEQ ID NO: 7292770 - DNA, 22 bp, Homo sapiens
gacctggttgactgtgagcagg

SEQ ID NO: 7292771 - DNA, 22 bp, Homo sapiens
gaccttgtaaattttcactcca

SEQ ID NO: 7292772 - DNA, 22 bp, Homo sapiens
gacatcatagggtgggaggaaa

SEQ ID NO: 7292773 - DNA, 21 bp, Homo sapiens
gacaaacatttcatagcttta

SEQ ID NO: 7292774 - DNA, 22 bp, Homo sapiens
gacaaaagtgttttgaacaagg

SEQ ID NO: 7292775 - DNA, 22 bp, Homo sapiens
gacaacacatgtatgccactct

SEQ ID NO: 7292776 - DNA, 22 bp, Homo sapiens
gacaacaataatgtggagctga

SEQ ID NO: 7292777 - DNA, 22 bp, Homo sapiens
gagcacatgtggagagtctggg

SEQ ID NO: 7292778 - DNA, 22 bp, Homo sapiens
gagcacatgagaggaaatcaaa

SEQ ID NO: 7292779 - DNA, 22 bp, Homo sapiens
gagcacgttgaagcgcactgtc

SEQ ID NO: 7292780 - DNA, 22 bp, Homo sapiens
gagcaacacattgaatgaggat

SEQ ID NO: 7292781 - DNA, 22 bp, Homo sapiens
gagcaatagcaccaattaactc

SEQ ID NO: 7292782 - DNA, 22 bp, Homo sapiens
gagcacagatcctggagccaca

SEQ ID NO: 7292783 - DNA, 22 bp, Homo sapiens
gagagccatggtggagatgggg

SEQ ID NO: 7292784 - DNA, 22 bp, Homo sapiens
gagagccagcagtaaagacatt

SEQ ID NO: 7292785 - DNA, 22 bp, Homo sapiens
gagaagcaggtttagcagacaa

SEQ ID NO: 7292786 - DNA, 22 bp, Homo sapiens
gagaagcaggtttagcagacaa

SEQ ID NO: 7292787 - DNA, 22 bp, Homo sapiens
gagaagcaggtttagcagacaa

SEQ ID NO: 7292788 - DNA, 22 bp, Homo sapiens
gagaagcaatttccaactgtgc

SEQ ID NO: 7292789 - DNA, 22 bp, Homo sapiens
gagaagcaatcagtggccaccc

SEQ ID NO: 7292790 - DNA, 22 bp, Homo sapiens
gagaagcaatcgtgacatctcc

SEQ ID NO: 7292791 - DNA, 22 bp, Homo sapiens
gagaagcaatcagcagccaccc

SEQ ID NO: 7292792 - DNA, 22 bp, Homo sapiens
gagaaagggaacttacagagtg

SEQ ID NO: 7292793 - DNA, 22 bp, Homo sapiens
gagaagaacttgggcaaagtca

SEQ ID NO: 7292794 - DNA, 22 bp, Homo sapiens
gaggctcaaacctggacagagc

SEQ ID NO: 7292795 - DNA, 22 bp, Homo sapiens
gaggctgtaacttgggcactgg

SEQ ID NO: 7292796 - DNA, 22 bp, Homo sapiens
gagggacagctaaagagaaatt

SEQ ID NO: 7292797 - DNA, 22 bp, Homo sapiens
gagggctgataacaggaataca

SEQ ID NO: 7292798 - DNA, 22 bp, Homo sapiens
gaggtgagaagggggtcagatg

SEQ ID NO: 7292799 - DNA, 22 bp, Homo sapiens
gaggtgagtggatcacgaggtc

SEQ ID NO: 7292800 - DNA, 22 bp, Homo sapiens
gaggtggatgttgcagtgagct

SEQ ID NO: 7292801 - DNA, 22 bp, Homo sapiens
gaggtctgcttatctctcacag

SEQ ID NO: 7292802 - DNA, 22 bp, Homo sapiens
gagggtgcaggcaagagcaaaa

SEQ ID NO: 7292803 - DNA, 22 bp, Homo sapiens
gagggctgatgcttacttattt

SEQ ID NO: 7292804 - DNA, 22 bp, Homo sapiens
gaggaggttccgggtggagaag

SEQ ID NO: 7292805 - DNA, 22 bp, Homo sapiens
gaggagactgacagcagattct

SEQ ID NO: 7292806 - DNA, 22 bp, Homo sapiens
gagctgtcctaccaggagtcct

SEQ ID NO: 7292807 - DNA, 22 bp, Homo sapiens
ttcaaattaccacatttgctta

SEQ ID NO: 7292808 - DNA, 22 bp, Homo sapiens
cggggccctggggctgaaggtc

SEQ ID NO: 7292809 - DNA, 22 bp, Homo sapiens
cggggacacactggcagctcct

SEQ ID NO: 7292810 - DNA, 22 bp, Homo sapiens
cctttttcagcttctagaggct

SEQ ID NO: 7292811 - DNA, 22 bp, Homo sapiens
ttatttcatataatgttatcaa

SEQ ID NO: 7292812 - DNA, 22 bp, Homo sapiens
ttatttcatgtaaaatttatgt

SEQ ID NO: 7292813 - DNA, 22 bp, Homo sapiens
cgctccttgagcgtgtcggcct

SEQ ID NO: 7292814 - DNA, 22 bp, Homo sapiens
ttatttattgtgtacctactgt

SEQ ID NO: 7292815 - DNA, 22 bp, Homo sapiens
ttatttatgttaacagtcgaga

SEQ ID NO: 7292816 - DNA, 20 bp, Homo sapiens
ttatttcagttgctagattg

SEQ ID NO: 7292817 - DNA, 22 bp, Homo sapiens
ccttgcaggggaacaggcagtg

SEQ ID NO: 7292818 - DNA, 22 bp, Homo sapiens
ttatatttctggtagccttcag

SEQ ID NO: 7292819 - DNA, 22 bp, Homo sapiens
tgtcaatatgtaataactgaat

SEQ ID NO: 7292820 - DNA, 22 bp, Homo sapiens
tgtcaataactggagtcattat

SEQ ID NO: 7292821 - DNA, 21 bp, Homo sapiens
tgtcagagcttgtaggacatt

SEQ ID NO: 7292822 - DNA, 20 bp, Homo sapiens
tgtcagcaattaggagaaaa

SEQ ID NO: 7292823 - DNA, 22 bp, Homo sapiens
ctataattatgctcaaaatgta

SEQ ID NO: 7292824 - DNA, 22 bp, Homo sapiens
ctatacatcccaatttcagaga

SEQ ID NO: 7292825 - DNA, 22 bp, Homo sapiens
ctcagagccagttagcaggtgc

SEQ ID NO: 7292826 - DNA, 22 bp, Homo sapiens
ctcagagcccagggtacacccg

SEQ ID NO: 7292827 - DNA, 22 bp, Homo sapiens
cgttttcatgggtagaggttct

SEQ ID NO: 7292828 - DNA, 22 bp, Homo sapiens
cgttggtctgtcccctggcacc

SEQ ID NO: 7292829 - DNA, 22 bp, Homo sapiens
cgttggtctgtcccctggcacc

SEQ ID NO: 7292830 - DNA, 22 bp, Homo sapiens
cgtgtgttgaaagatgtacatc

SEQ ID NO: 7292831 - DNA, 22 bp, Homo sapiens
ttgcatgcaaggcctccgtggc

SEQ ID NO: 7292832 - DNA, 22 bp, Homo sapiens
ctcaggaaggaagcagggagcc

SEQ ID NO: 7292833 - DNA, 22 bp, Homo sapiens
ctcaggaaccgcggcagcagcc

SEQ ID NO: 7292834 - DNA, 22 bp, Homo sapiens
ctcaggaagcacaggccctaca

SEQ ID NO: 7292835 - DNA, 22 bp, Homo sapiens
ttggatccatctcaggcatagg

SEQ ID NO: 7292836 - DNA, 22 bp, Homo sapiens
ctgagcatttgtgcagcttctc

SEQ ID NO: 7292837 - DNA, 22 bp, Homo sapiens
ctgagcatttgcctttttaaca

SEQ ID NO: 7292838 - DNA, 22 bp, Homo sapiens
ctgagcatttgccggagcgtca

SEQ ID NO: 7292839 - DNA, 22 bp, Homo sapiens
ctgagcatccagcaggtactgc

SEQ ID NO: 7292840 - DNA, 17 bp, Homo sapiens
ctgagcatccgtgctct

SEQ ID NO: 7292841 - DNA, 22 bp, Homo sapiens
ctgagcatcatggcagaatctt

SEQ ID NO: 7292842 - DNA, 22 bp, Homo sapiens
ctgagcattatcttggattttg

SEQ ID NO: 7292843 - DNA, 22 bp, Homo sapiens
ctgagcatggccggtccatggt

SEQ ID NO: 7292844 - DNA, 22 bp, Homo sapiens
ctgagcatgctcctcttttcca

SEQ ID NO: 7292845 - DNA, 22 bp, Homo sapiens
ctgagcatgctacatgcagcac

SEQ ID NO: 7292846 - DNA, 22 bp, Homo sapiens
ctgagcagtctagccaggtgtt

SEQ ID NO: 7292847 - DNA, 22 bp, Homo sapiens
ctgcagcctcaacctcctgagc

SEQ ID NO: 7292848 - DNA, 22 bp, Homo sapiens
ctgcagcctaggtgcagctggg

SEQ ID NO: 7292849 - DNA, 20 bp, Homo sapiens
ctgcccagccactgagggat

SEQ ID NO: 7292850 - DNA, 22 bp, Homo sapiens
ctgcccaggctgaaggaacatc

SEQ ID NO: 7292851 - DNA, 22 bp, Homo sapiens
ctgcccaggggagtgctgtcgg

SEQ ID NO: 7292852 - DNA, 22 bp, Homo sapiens
ctgccttggtttctagcagggc

SEQ ID NO: 7292853 - DNA, 22 bp, Homo sapiens
ctgcctgtgtgtgcctgcagaa

SEQ ID NO: 7292854 - DNA, 22 bp, Homo sapiens
ctgcctgtgggtacaagtggaa

SEQ ID NO: 7292855 - DNA, 22 bp, Homo sapiens
ctgcctgtggacaccctggagg

SEQ ID NO: 7292856 - DNA, 18 bp, Homo sapiens
ctgcctgttgctgagagg

SEQ ID NO: 7292857 - DNA, 19 bp, Homo sapiens
ctgcctgttatggagagaa

SEQ ID NO: 7292858 - DNA, 22 bp, Homo sapiens
ctgcctgttcctgatcattcta

SEQ ID NO: 7292859 - DNA, 22 bp, Homo sapiens
ctggaaagtcaggtcagaaact

SEQ ID NO: 7292860 - DNA, 22 bp, Homo sapiens
ctggaaagtgaggagagttcca

SEQ ID NO: 7292861 - DNA, 22 bp, Homo sapiens
ctggaaagtgcttttctgagag

SEQ ID NO: 7292862 - DNA, 22 bp, Homo sapiens
ctggaaagtgctgagacaattg

SEQ ID NO: 7292863 - DNA, 22 bp, Homo sapiens
ctggaaagtgcatgtaatgagg

SEQ ID NO: 7292864 - DNA, 22 bp, Homo sapiens
ctggaaagtgtctccatcctgg

SEQ ID NO: 7292865 - DNA, 22 bp, Homo sapiens
ctggaaagtgtctccatcctgg

SEQ ID NO: 7292866 - DNA, 22 bp, Homo sapiens
ctggagaaacatcaggcatagg

SEQ ID NO: 7292867 - DNA, 22 bp, Homo sapiens
ctggagaagaggtagtatgtag

SEQ ID NO: 7292868 - DNA, 22 bp, Homo sapiens
ctggagccccaggctgtgcaga

SEQ ID NO: 7292869 - DNA, 17 bp, Homo sapiens
ctggagcctccaactcc

SEQ ID NO: 7292870 - DNA, 22 bp, Homo sapiens
ctggagccggcgagccccagcc

SEQ ID NO: 7292871 - DNA, 22 bp, Homo sapiens
ctctgtgttcagcctagcagaa

SEQ ID NO: 7292872 - DNA, 22 bp, Homo sapiens
ctctgtgtatccaagttcaggt

SEQ ID NO: 7292873 - DNA, 21 bp, Homo sapiens
ttttgctgttttagaatgaga

SEQ ID NO: 7292874 - DNA, 22 bp, Homo sapiens
ttttgctgttatatgctattat

SEQ ID NO: 7292875 - DNA, 22 bp, Homo sapiens
ttttgctggtttatctctatta

SEQ ID NO: 7292876 - DNA, 22 bp, Homo sapiens
ctctgtgggggagaggcagctg

SEQ ID NO: 7292877 - DNA, 22 bp, Homo sapiens
ctctgtggtaaaatagcagtat

SEQ ID NO: 7292878 - DNA, 22 bp, Homo sapiens
ctctgtgggccagagaggcccc

SEQ ID NO: 7292879 - DNA, 22 bp, Homo sapiens
ctctgtgcttatgctccatggg

SEQ ID NO: 7292880 - DNA, 22 bp, Homo sapiens
tttggaatgtagtttaatcatc

SEQ ID NO: 7292881 - DNA, 19 bp, Homo sapiens
tttgaaagagttttattgg

SEQ ID NO: 7292882 - DNA, 22 bp, Homo sapiens
ctctgcagagcctccagcccag

SEQ ID NO: 7292883 - DNA, 21 bp, Homo sapiens
tttgaatagaaatagtgctta

SEQ ID NO: 7292884 - DNA, 22 bp, Homo sapiens
tttgaaagacagaatatttttg

SEQ ID NO: 7292885 - DNA, 22 bp, Homo sapiens
tttcattatacagcttcataaa

SEQ ID NO: 7292886 - DNA, 22 bp, Homo sapiens
ctccttagtgcctctgcacgag

SEQ ID NO: 7292887 - DNA, 22 bp, Homo sapiens
ctccttcccctactcagcatcc

SEQ ID NO: 7292888 - DNA, 22 bp, Homo sapiens
tttcagaaattgttattattct

SEQ ID NO: 7292889 - DNA, 22 bp, Homo sapiens
cagggcagaacatatagatagt

SEQ ID NO: 7292890 - DNA, 21 bp, Homo sapiens
tagcaatacgtggaccatggg

SEQ ID NO: 7292891 - DNA, 22 bp, Homo sapiens
tagcaagatcgtgtctctaaaa

SEQ ID NO: 7292892 - DNA, 22 bp, Homo sapiens
caggctgggcagcctccccggc

SEQ ID NO: 7292893 - DNA, 22 bp, Homo sapiens
caggctgggctccggagataaa

SEQ ID NO: 7292894 - DNA, 22 bp, Homo sapiens
caggctgggctggtgttagagt

SEQ ID NO: 7292895 - DNA, 22 bp, Homo sapiens
caggctgggctggtgttagagt

SEQ ID NO: 7292896 - DNA, 22 bp, Homo sapiens
caggctggtcccagagcattgc

SEQ ID NO: 7292897 - DNA, 22 bp, Homo sapiens
tagagtgtcataacagtgccca

SEQ ID NO: 7292898 - DNA, 22 bp, Homo sapiens
caggctggagtgagtgtagtgg

SEQ ID NO: 7292899 - DNA, 22 bp, Homo sapiens
caggctggagtgagtgtagtgg

SEQ ID NO: 7292900 - DNA, 22 bp, Homo sapiens
tactgtgcagctgtgctttggg

SEQ ID NO: 7292901 - DNA, 17 bp, Homo sapiens
gtgagggcagaggatgg

SEQ ID NO: 7292902 - DNA, 22 bp, Homo sapiens
cagggctagggagccctcctgg

SEQ ID NO: 7292903 - DNA, 19 bp, Homo sapiens
taggaccctggtggccccc

SEQ ID NO: 7292904 - DNA, 22 bp, Homo sapiens
tagctagaaagtttcagctgtg

SEQ ID NO: 7292905 - DNA, 22 bp, Homo sapiens
tagctactgatgcaagagtttg

SEQ ID NO: 7292906 - DNA, 22 bp, Homo sapiens
tagggacaaagagctgaggcct

SEQ ID NO: 7292907 - DNA, 22 bp, Homo sapiens
caggggacagtatggtggatga

SEQ ID NO: 7292908 - DNA, 22 bp, Homo sapiens
caggggagtgagtccctctctg

SEQ ID NO: 7292909 - DNA, 22 bp, Homo sapiens
caggggagttttatgcaacaga

SEQ ID NO: 7292910 - DNA, 22 bp, Homo sapiens
caggggagttttatgcaacaga

SEQ ID NO: 7292911 - DNA, 22 bp, Homo sapiens
tagtgaatgttggctattaata

SEQ ID NO: 7292912 - DNA, 22 bp, Homo sapiens
tatatttaaatccaggttgaaa

SEQ ID NO: 7292913 - DNA, 22 bp, Homo sapiens
tatcagtatggattcatggatt

SEQ ID NO: 7292914 - DNA, 22 bp, Homo sapiens
tatcatgcttaccattttcaaa

SEQ ID NO: 7292915 - DNA, 22 bp, Homo sapiens
tatcatttaacagaatcattgc

SEQ ID NO: 7292916 - DNA, 22 bp, Homo sapiens
tatttccaaaagcctattatga

SEQ ID NO: 7292917 - DNA, 22 bp, Homo sapiens
tatttccacaccttttgaatct

SEQ ID NO: 7292918 - DNA, 22 bp, Homo sapiens
tatttccacctattattttctg

SEQ ID NO: 7292919 - DNA, 22 bp, Homo sapiens
tatttccagaggagtatagaag

SEQ ID NO: 7292920 - DNA, 22 bp, Homo sapiens
tatttcttgttccctccaagtt

SEQ ID NO: 7292921 - DNA, 21 bp, Homo sapiens
tatttctttgactctctccct

SEQ ID NO: 7292922 - DNA, 22 bp, Homo sapiens
caggtgttggaagggcagtggg

SEQ ID NO: 7292923 - DNA, 22 bp, Homo sapiens
caggtgttgggagaagagataa

SEQ ID NO: 7292924 - DNA, 22 bp, Homo sapiens
caggtgttgtctaaagcttcag

SEQ ID NO: 7292925 - DNA, 22 bp, Homo sapiens
caggtgtttaggtttcatggat

SEQ ID NO: 7292926 - DNA, 22 bp, Homo sapiens
caggtgtttcctgaagttgatg

SEQ ID NO: 7292927 - DNA, 22 bp, Homo sapiens
tatttcagtcacttcttctctg

SEQ ID NO: 7292928 - DNA, 21 bp, Homo sapiens
tatttagttttacaaatgtgg

SEQ ID NO: 7292929 - DNA, 22 bp, Homo sapiens
tatttcattctttatcaggagc

SEQ ID NO: 7292930 - DNA, 22 bp, Homo sapiens
cagtgaggaagctgtctggacc

SEQ ID NO: 7292931 - DNA, 22 bp, Homo sapiens
tcacactttatttatttcatgc

SEQ ID NO: 7292932 - DNA, 22 bp, Homo sapiens
tcacagacctggtgggaggtgg

SEQ ID NO: 7292933 - DNA, 22 bp, Homo sapiens
tcacagactcaagggcatagga

SEQ ID NO: 7292934 - DNA, 22 bp, Homo sapiens
tcacaacgcctctgcaaatcct

SEQ ID NO: 7292935 - DNA, 22 bp, Homo sapiens
tatttcttttcgtgacttattg

SEQ ID NO: 7292936 - DNA, 22 bp, Homo sapiens
tcacagttgattgaaacacagc

SEQ ID NO: 7292937 - DNA, 22 bp, Homo sapiens
tcacagttgagcaggttgtgca

SEQ ID NO: 7292938 - DNA, 21 bp, Homo sapiens
tcacagttggccaggcattta

SEQ ID NO: 7292939 - DNA, 17 bp, Homo sapiens
tcacagttggtctcagt

SEQ ID NO: 7292940 - DNA, 22 bp, Homo sapiens
tcacagttcaaaccccatatct

SEQ ID NO: 7292941 - DNA, 22 bp, Homo sapiens
tcacagttatgggccttggtca

SEQ ID NO: 7292942 - DNA, 22 bp, Homo sapiens
tcacagttatagtctgtagaat

SEQ ID NO: 7292943 - DNA, 23 bp, Homo sapiens
tcacagttacttttgcatcaacc

SEQ ID NO: 7292944 - DNA, 22 bp, Homo sapiens
tcacagttctagaggtaagcag

SEQ ID NO: 7292945 - DNA, 22 bp, Homo sapiens
tcacagttcatctgataaacta

SEQ ID NO: 7292946 - DNA, 22 bp, Homo sapiens
tcacagttcatctgataaacta

SEQ ID NO: 7292947 - DNA, 21 bp, Homo sapiens
tcacagttcaagatgaacccc

SEQ ID NO: 7292948 - DNA, 21 bp, Homo sapiens
tcacagttcaagatgaacccc

SEQ ID NO: 7292949 - DNA, 22 bp, Homo sapiens
tcacagttcaactagttcagat

SEQ ID NO: 7292950 - DNA, 22 bp, Homo sapiens
tcacagttactccttcagatga

SEQ ID NO: 7292951 - DNA, 23 bp, Homo sapiens
tcacagttacttttgcatcaacc

SEQ ID NO: 7292952 - DNA, 22 bp, Homo sapiens
tcacagttactccttcagatga

SEQ ID NO: 7292953 - DNA, 22 bp, Homo sapiens
tcacagttaattgttggaatgt

SEQ ID NO: 7292954 - DNA, 22 bp, Homo sapiens
tcacagttaattgttggaatgt

SEQ ID NO: 7292955 - DNA, 21 bp, Homo sapiens
tcacagactggtcagtgaggc

SEQ ID NO: 7292956 - DNA, 22 bp, Homo sapiens
tcacagacttgtctccagggat

SEQ ID NO: 7292957 - DNA, 18 bp, Homo sapiens
tcacagacttactgggcc

SEQ ID NO: 7292958 - DNA, 22 bp, Homo sapiens
cagtgggatatgggggcagcat

SEQ ID NO: 7292959 - DNA, 22 bp, Homo sapiens
cagtggggggactgaggcctga

SEQ ID NO: 7292960 - DNA, 22 bp, Homo sapiens
cagtgggggtgaggccgaggta

SEQ ID NO: 7292961 - DNA, 22 bp, Homo sapiens
cagtgtttgtggaattcaggtg

SEQ ID NO: 7292962 - DNA, 22 bp, Homo sapiens
cagtgtgacttctgagctgcca

SEQ ID NO: 7292963 - DNA, 21 bp, Homo sapiens
tcaggaaacacctcttaagga

SEQ ID NO: 7292964 - DNA, 19 bp, Homo sapiens
cataaatgtacaagataca

SEQ ID NO: 7292965 - DNA, 22 bp, Homo sapiens
cataaagtagcagagcatgact

SEQ ID NO: 7292966 - DNA, 22 bp, Homo sapiens
tcatttatcgctgccttttaaa

SEQ ID NO: 7292967 - DNA, 22 bp, Homo sapiens
tccacagtctatttttagtcta

SEQ ID NO: 7292968 - DNA, 22 bp, Homo sapiens
tccacaggtatgaggccccacc

SEQ ID NO: 7292969 - DNA, 22 bp, Homo sapiens
tcatgaagtccaaactaaagca

SEQ ID NO: 7292970 - DNA, 22 bp, Homo sapiens
tccaggccccactgaagcccct

SEQ ID NO: 7292971 - DNA, 22 bp, Homo sapiens
tccagcctcatttctcctgctt

SEQ ID NO: 7292972 - DNA, 17 bp, Homo sapiens
tccagcctcctctgctg

SEQ ID NO: 7292973 - DNA, 22 bp, Homo sapiens
cattcacaaaaccacatgccat

SEQ ID NO: 7292974 - DNA, 22 bp, Homo sapiens
tccccagcattgagggtctctc

SEQ ID NO: 7292975 - DNA, 19 bp, Homo sapiens
tccccagcacctctgagtc

SEQ ID NO: 7292976 - DNA, 22 bp, Homo sapiens
tccccactctctcctggagctt

SEQ ID NO: 7292977 - DNA, 18 bp, Homo sapiens
cattgacagtatatcttt

SEQ ID NO: 7292978 - DNA, 22 bp, Homo sapiens
tcctctccatgtctcacgccac

SEQ ID NO: 7292979 - DNA, 22 bp, Homo sapiens
tcctcccctcagggcaacggat

SEQ ID NO: 7292980 - DNA, 22 bp, Homo sapiens
catttggattttgaagagagta

SEQ ID NO: 7292981 - DNA, 22 bp, Homo sapiens
catttggaccaaaatagccaac

SEQ ID NO: 7292982 - DNA, 22 bp, Homo sapiens
tccctataattgcacatccatt

SEQ ID NO: 7292983 - DNA, 23 bp, Homo sapiens
tctctgtgtgcctcagtttcttc

SEQ ID NO: 7292984 - DNA, 22 bp, Homo sapiens
tctctgtgtgccttcatctgcc

SEQ ID NO: 7292985 - DNA, 22 bp, Homo sapiens
tctctgtgtgtgtgacagcatt

SEQ ID NO: 7292986 - DNA, 22 bp, Homo sapiens
tctctgtgtgggagatcttttt

SEQ ID NO: 7292987 - DNA, 22 bp, Homo sapiens
tctctgtgtgttggctgtatat

SEQ ID NO: 7292988 - DNA, 22 bp, Homo sapiens
tctctgtgttccctgttttctc

SEQ ID NO: 7292989 - DNA, 21 bp, Homo sapiens
tctctgtgttcaaggtgccag

SEQ ID NO: 7292990 - DNA, 22 bp, Homo sapiens
tctctgtgttgcaggaaaatct

SEQ ID NO: 7292991 - DNA, 18 bp, Homo sapiens
ccagcatgccagaggctg

SEQ ID NO: 7292992 - DNA, 22 bp, Homo sapiens
ccagccacgaagctcccttcat

SEQ ID NO: 7292993 - DNA, 22 bp, Homo sapiens
ccagagaggccaaggtcgtggt

SEQ ID NO: 7292994 - DNA, 22 bp, Homo sapiens
ccagagagagtactgggctctg

SEQ ID NO: 7292995 - DNA, 22 bp, Homo sapiens
ccacttttcactaagatgaatt

SEQ ID NO: 7292996 - DNA, 22 bp, Homo sapiens
tctcaacaccacttgctgaaga

SEQ ID NO: 7292997 - DNA, 22 bp, Homo sapiens
tctcaacagtgaaatgtgtttg

SEQ ID NO: 7292998 - DNA, 22 bp, Homo sapiens
tcggagctcagtttttgcttca

SEQ ID NO: 7292999 - DNA, 22 bp, Homo sapiens
ccaccgccatggcgttgtacag

SEQ ID NO: 7293000 - DNA, 22 bp, Homo sapiens
ccacattgactgtctgtagatt

SEQ ID NO: 7293001 - DNA, 22 bp, Homo sapiens
ccacattggcctcagaggttag

SEQ ID NO: 7293002 - DNA, 18 bp, Homo sapiens
tcctctctttccccaggg

SEQ ID NO: 7293003 - DNA, 22 bp, Homo sapiens
tcctctgagctcaaaatccagc

SEQ ID NO: 7293004 - DNA, 22 bp, Homo sapiens
tggaagaataggatagaagaac

SEQ ID NO: 7293005 - DNA, 22 bp, Homo sapiens
tggaagaatgtttgccttataa

SEQ ID NO: 7293006 - DNA, 22 bp, Homo sapiens
tggaagaatgctccacagggaa

SEQ ID NO: 7293007 - DNA, 22 bp, Homo sapiens
tggaagaatttggggataaatt

SEQ ID NO: 7293008 - DNA, 22 bp, Homo sapiens
tggacagtgcagatacagaatg

SEQ ID NO: 7293009 - DNA, 23 bp, Homo sapiens
tggacagtagggtagacagtgcc

SEQ ID NO: 7293010 - DNA, 22 bp, Homo sapiens
tggcctcagatttcaggggtgg

SEQ ID NO: 7293011 - DNA, 22 bp, Homo sapiens
tggcctcaccactagctgggtg

SEQ ID NO: 7293012 - DNA, 22 bp, Homo sapiens
cctcagaagactttagggaaga

SEQ ID NO: 7293013 - DNA, 17 bp, Homo sapiens
cctcacagggaccagac

SEQ ID NO: 7293014 - DNA, 20 bp, Homo sapiens
cctcacagggcagagagggg

SEQ ID NO: 7293015 - DNA, 22 bp, Homo sapiens
ccgtggtcacctgagctccttg

SEQ ID NO: 7293016 - DNA, 22 bp, Homo sapiens
ccgtggtcacctgagctccttg

SEQ ID NO: 7293017 - DNA, 22 bp, Homo sapiens
ccctgtgagcggctggatgcct

SEQ ID NO: 7293018 - DNA, 22 bp, Homo sapiens
ccctgtgcagatggcagctggg

SEQ ID NO: 7293019 - DNA, 22 bp, Homo sapiens
tgggagcctggcaggccagagg

SEQ ID NO: 7293020 - DNA, 22 bp, Homo sapiens
cctggagcacatggcaggaggc

SEQ ID NO: 7293021 - DNA, 22 bp, Homo sapiens
cctggagcttttccagttgaca

SEQ ID NO: 7293022 - DNA, 22 bp, Homo sapiens
ccaggctgccgaggaaagaaag

SEQ ID NO: 7293023 - DNA, 22 bp, Homo sapiens
ccaggctgctcacaagctgccc

SEQ ID NO: 7293024 - DNA, 22 bp, Homo sapiens
ccaggctgcagtcaaggggcat

SEQ ID NO: 7293025 - DNA, 22 bp, Homo sapiens
tgaaagcatatgctaaagacca

SEQ ID NO: 7293026 - DNA, 22 bp, Homo sapiens
tgaacagatggcccagcagagg

SEQ ID NO: 7293027 - DNA, 22 bp, Homo sapiens
tgaagagatagaagtacatgct

SEQ ID NO: 7293028 - DNA, 22 bp, Homo sapiens
ccagcccttgctgaagggtggc

SEQ ID NO: 7293029 - DNA, 22 bp, Homo sapiens
tgagaaaactcaaagacagatc

SEQ ID NO: 7293030 - DNA, 22 bp, Homo sapiens
tgagaaaacagtttgtaataat

SEQ ID NO: 7293031 - DNA, 22 bp, Homo sapiens
tgaccatttgatctacattcca

SEQ ID NO: 7293032 - DNA, 22 bp, Homo sapiens
tgacaatgggtggacaagatag

SEQ ID NO: 7293033 - DNA, 22 bp, Homo sapiens
tgaaggagaattaataggcatt

SEQ ID NO: 7293034 - DNA, 22 bp, Homo sapiens
tgacagagtccagaagtagtgt

SEQ ID NO: 7293035 - DNA, 22 bp, Homo sapiens
tgacagagcatgtagtgacagc

SEQ ID NO: 7293036 - DNA, 22 bp, Homo sapiens
tgacagaggcacccacaactat

SEQ ID NO: 7293037 - DNA, 22 bp, Homo sapiens
cccaggaattggaggctgcagt

SEQ ID NO: 7293038 - DNA, 22 bp, Homo sapiens
cccagctcatcaggagccgccc

SEQ ID NO: 7293039 - DNA, 22 bp, Homo sapiens
tgcagtctggatgtcctcagat

SEQ ID NO: 7293040 - DNA, 22 bp, Homo sapiens
tgccctctgcctcctctgcaga

SEQ ID NO: 7293041 - DNA, 22 bp, Homo sapiens
cccaggaggcagaggttggagc

SEQ ID NO: 7293042 - DNA, 22 bp, Homo sapiens
cccaggagacagaaacagaggt

SEQ ID NO: 7293043 - DNA, 22 bp, Homo sapiens
cccaggagatctggatctcgtc

SEQ ID NO: 7293044 - DNA, 22 bp, Homo sapiens
ccatttttcataaactatccaa

SEQ ID NO: 7293045 - DNA, 22 bp, Homo sapiens
ccatggaagaactgatgtgcca

SEQ ID NO: 7293046 - DNA, 23 bp, Homo sapiens
ccagtgtggtaggtccacaggtg

SEQ ID NO: 7293047 - DNA, 22 bp, Homo sapiens
ccagtgtggtttaggataggga

SEQ ID NO: 7293048 - DNA, 22 bp, Homo sapiens
cccacaggcaggtgcatgggct

SEQ ID NO: 7293049 - DNA, 22 bp, Homo sapiens
cccagcagaatctgatgagggc

SEQ ID NO: 7293050 - DNA, 21 bp, Homo sapiens
ttctctccatatgcccagccc

SEQ ID NO: 7293051 - DNA, 22 bp, Homo sapiens
ttctctaagctggctgaggtct

SEQ ID NO: 7293052 - DNA, 22 bp, Homo sapiens
ttctctcttccagttcccactt

SEQ ID NO: 7293053 - DNA, 22 bp, Homo sapiens
ttctcctctgttggccttccct

SEQ ID NO: 7293054 - DNA, 22 bp, Homo sapiens
ttccttcttccagaggctgccc

SEQ ID NO: 7293055 - DNA, 22 bp, Homo sapiens
ttccttctggaggctccagggg

SEQ ID NO: 7293056 - DNA, 17 bp, Homo sapiens
ttccagtttagtattgt

SEQ ID NO: 7293057 - DNA, 22 bp, Homo sapiens
ttccagtttgcagttgacacta

SEQ ID NO: 7293058 - DNA, 22 bp, Homo sapiens
ttccagttggcactgcaattta

SEQ ID NO: 7293059 - DNA, 22 bp, Homo sapiens
ttccagttcttctgtaagcact

SEQ ID NO: 7293060 - DNA, 19 bp, Homo sapiens
ttccagttctaatctcttc

SEQ ID NO: 7293061 - DNA, 22 bp, Homo sapiens
ttgaaatcaccactagcatttg

SEQ ID NO: 7293062 - DNA, 20 bp, Homo sapiens
ttgaaattggatggtagcta

SEQ ID NO: 7293063 - DNA, 22 bp, Homo sapiens
ttctttgtttgataagtatgct

SEQ ID NO: 7293064 - DNA, 22 bp, Homo sapiens
ttctttgttgagcaagtaggac

SEQ ID NO: 7293065 - DNA, 22 bp, Homo sapiens
ttctgtgtcttcttgttctgtg

SEQ ID NO: 7293066 - DNA, 22 bp, Homo sapiens
ttctgtggtctcccatgtctgt

SEQ ID NO: 7293067 - DNA, 22 bp, Homo sapiens
ttattacaatgcagaaaataga

SEQ ID NO: 7293068 - DNA, 22 bp, Homo sapiens
ttagctctggattaagcagaaa

SEQ ID NO: 7293069 - DNA, 22 bp, Homo sapiens
ttagctttggattgcatttagt

SEQ ID NO: 7293070 - DNA, 22 bp, Homo sapiens
ttagctttcttggagaattaca

SEQ ID NO: 7293071 - DNA, 22 bp, Homo sapiens
ttcaaagagaaattgtattttc

SEQ ID NO: 7293072 - DNA, 22 bp, Homo sapiens
ttcaaagataatgtagcatttt

SEQ ID NO: 7293073 - DNA, 22 bp, Homo sapiens
ttcacagagagaactcaaacca

SEQ ID NO: 7293074 - DNA, 19 bp, Homo sapiens
ttcacagctctgtgtcagt

SEQ ID NO: 7293075 - DNA, 22 bp, Homo sapiens
ttcacagctccttttactcaac

SEQ ID NO: 7293076 - DNA, 22 bp, Homo sapiens
ttcacagctccttttactcaac

SEQ ID NO: 7293077 - DNA, 22 bp, Homo sapiens
ttcacagctaagagctaagtaa

SEQ ID NO: 7293078 - DNA, 22 bp, Homo sapiens
ttcacagattgactggattcct

SEQ ID NO: 7293079 - DNA, 22 bp, Homo sapiens
ttcacagggcagcagctgagcc

SEQ ID NO: 7293080 - DNA, 22 bp, Homo sapiens
ttcagcaagaccaccatgtacc

SEQ ID NO: 7293081 - DNA, 22 bp, Homo sapiens
ttcagcaagaatttactgagct

SEQ ID NO: 7293082 - DNA, 22 bp, Homo sapiens
ttcagcaactgagtgtctttta

SEQ ID NO: 7293083 - DNA, 22 bp, Homo sapiens
ttcagcaactcaaacctattag

SEQ ID NO: 7293084 - DNA, 22 bp, Homo sapiens
ttcagcaacctataaatcccag

SEQ ID NO: 7293085 - DNA, 22 bp, Homo sapiens
ttcagcaatgggatggtgcagg

SEQ ID NO: 7293086 - DNA, 22 bp, Homo sapiens
ttcagcaatgacagcctatata

SEQ ID NO: 7293087 - DNA, 22 bp, Homo sapiens
ttcagcaagtgtctctactgtc

SEQ ID NO: 7293088 - DNA, 21 bp, Homo sapiens
ttcagcaagcactctggacac

SEQ ID NO: 7293089 - DNA, 22 bp, Homo sapiens
ttcagcaaggcatgtgcaggag

SEQ ID NO: 7293090 - DNA, 22 bp, Homo sapiens
ttcagcaaccagaaaggctggg

SEQ ID NO: 7293091 - DNA, 22 bp, Homo sapiens
ttcagcaacatttgttgagtgc

SEQ ID NO: 7293092 - DNA, 22 bp, Homo sapiens
ttcagcaaatggcttgagataa

SEQ ID NO: 7293093 - DNA, 22 bp, Homo sapiens
ttcagcaaatggactgttcagg

SEQ ID NO: 7293094 - DNA, 22 bp, Homo sapiens
ttcagcaattttttaagctaat

SEQ ID NO: 7293095 - DNA, 22 bp, Homo sapiens
ttccagtgaccatagagtatgg

SEQ ID NO: 7293096 - DNA, 22 bp, Homo sapiens
ttccagttaaggaagctattct

SEQ ID NO: 7293097 - DNA, 22 bp, Homo sapiens
ttccagttcccatgaggattaa

SEQ ID NO: 7293098 - DNA, 22 bp, Homo sapiens
ttccagttcactccatttctgg

SEQ ID NO: 7293099 - DNA, 22 bp, Homo sapiens
ttccagttcagatgcaacaggg

SEQ ID NO: 7293100 - DNA, 23 bp, Homo sapiens
ttcatttaggagttcataagagc

SEQ ID NO: 7293101 - DNA, 22 bp, Homo sapiens
ttcatttagcatgctaaacctg

SEQ ID NO: 7293102 - DNA, 22 bp, Homo sapiens
ttcatttattcagcaggtattt

SEQ ID NO: 7293103 - DNA, 22 bp, Homo sapiens
ttcagttttattgtactgctat

SEQ ID NO: 7293104 - DNA, 21 bp, Homo sapiens
ttcataaaccattctcatgca

SEQ ID NO: 7293105 - DNA, 22 bp, Homo sapiens
tttattgacccaaagcgagagt

SEQ ID NO: 7293106 - DNA, 22 bp, Homo sapiens
tttcaagactcattgagtattg

SEQ ID NO: 7293107 - DNA, 22 bp, Homo sapiens
tttcaagactcattgagtattg

SEQ ID NO: 7293108 - DNA, 23 bp, Homo sapiens
tttcacaatgagcattacagaat

SEQ ID NO: 7293109 - DNA, 22 bp, Homo sapiens
tttcacagagaaatataacagg

SEQ ID NO: 7293110 - DNA, 22 bp, Homo sapiens
tttcacagatgttttggagtct

SEQ ID NO: 7293111 - DNA, 22 bp, Homo sapiens
tttcacagatataagatttcac

SEQ ID NO: 7293112 - DNA, 22 bp, Homo sapiens
tttcacagaactcactaaggag

SEQ ID NO: 7293113 - DNA, 18 bp, Homo sapiens
tttcacagattcatgact

SEQ ID NO: 7293114 - DNA, 22 bp, Homo sapiens
tttcacagcagaatttctgagg

SEQ ID NO: 7293115 - DNA, 22 bp, Homo sapiens
tttcacatttgttttaagaagt

SEQ ID NO: 7293116 - DNA, 22 bp, Homo sapiens
tttcagagcctttatctctcta

SEQ ID NO: 7293117 - DNA, 22 bp, Homo sapiens
tttagaagttcacacatttaaa

SEQ ID NO: 7293118 - DNA, 22 bp, Homo sapiens
tttagcaagtatttactgacta

SEQ ID NO: 7293119 - DNA, 22 bp, Homo sapiens
tttagagacacactggcatttg

SEQ ID NO: 7293120 - DNA, 22 bp, Homo sapiens
tttagagaccctctgctatttt

SEQ ID NO: 7293121 - DNA, 21 bp, Homo sapiens
tttagagaatactcactattt

SEQ ID NO: 7293122 - DNA, 22 bp, Homo sapiens
tttatccaagcacaatttctaa

SEQ ID NO: 7293123 - DNA, 23 bp, Homo sapiens
tttatccaactctgtaatctctc

SEQ ID NO: 7293124 - DNA, 22 bp, Homo sapiens
tttatcatcttgtttttaaagc

SEQ ID NO: 7293125 - DNA, 20 bp, Homo sapiens
tttatcaggcacttactatt

SEQ ID NO: 7293126 - DNA, 20 bp, Homo sapiens
tttatcaggcacttactatt

SEQ ID NO: 7293127 - DNA, 22 bp, Homo sapiens
tttatcagaggctatgtttcat

SEQ ID NO: 7293128 - DNA, 22 bp, Homo sapiens
tttatccagcagctattcaaaa

SEQ ID NO: 7293129 - DNA, 22 bp, Homo sapiens
tttaaagaaattcctcatcttt

SEQ ID NO: 7293130 - DNA, 21 bp, Homo sapiens
tttaaagaataggaagggagg

SEQ ID NO: 7293131 - DNA, 22 bp, Homo sapiens
tttaaagagaatgtgaaggagt

SEQ ID NO: 7293132 - DNA, 17 bp, Homo sapiens
tttaaactactacaagg

SEQ ID NO: 7293133 - DNA, 22 bp, Homo sapiens
ttgtgtgtactggttatgggca

SEQ ID NO: 7293134 - DNA, 22 bp, Homo sapiens
ttgtgtgcataaattctgatgt

SEQ ID NO: 7293135 - DNA, 17 bp, Homo sapiens
ttgtgtgtagttctgat

SEQ ID NO: 7293136 - DNA, 22 bp, Homo sapiens
ttgtgtgtagactcagccattg

SEQ ID NO: 7293137 - DNA, 22 bp, Homo sapiens
tttaatgatagtcttacgaaaa

SEQ ID NO: 7293138 - DNA, 22 bp, Homo sapiens
tttaatgaggtctctcgctggc

SEQ ID NO: 7293139 - DNA, 22 bp, Homo sapiens
tttaatcttcaaaatagtctta

SEQ ID NO: 7293140 - DNA, 22 bp, Homo sapiens
tttaatctattccctaaacacc

SEQ ID NO: 7293141 - DNA, 22 bp, Homo sapiens
ttgcagggttgaccaataggct

SEQ ID NO: 7293142 - DNA, 22 bp, Homo sapiens
ttgcagggttgacactgcctgc

SEQ ID NO: 7293143 - DNA, 22 bp, Homo sapiens
ttgcagggcatctatgtctggt

SEQ ID NO: 7293144 - DNA, 22 bp, Homo sapiens
ttgcagggcaggaccatggaca

SEQ ID NO: 7293145 - DNA, 22 bp, Homo sapiens
ttgacaatccctgttagaagtg

SEQ ID NO: 7293146 - DNA, 22 bp, Homo sapiens
ttgacaattgggagatataaag

SEQ ID NO: 7293147 - DNA, 22 bp, Homo sapiens
ttgacaatgcactgtgctaagt

SEQ ID NO: 7293148 - DNA, 22 bp, Homo sapiens
ttgacagaaatgtatttgcatg

SEQ ID NO: 7293149 - DNA, 22 bp, Homo sapiens
ttgacagatgtgaaagtgagca

SEQ ID NO: 7293150 - DNA, 22 bp, Homo sapiens
ttgacagagctaggtcaactct

SEQ ID NO: 7293151 - DNA, 22 bp, Homo sapiens
ttgacagagaaaagtgtgactt

SEQ ID NO: 7293152 - DNA, 22 bp, Homo sapiens
ttgacagaatgttacatataga

SEQ ID NO: 7293153 - DNA, 22 bp, Homo sapiens
ttgcaattgctatggagagcgt

SEQ ID NO: 7293154 - DNA, 22 bp, Homo sapiens
ttgacaggatataaagacataa

SEQ ID NO: 7293155 - DNA, 22 bp, Homo sapiens
ttgctgtttaatgatgtcttat

SEQ ID NO: 7293156 - DNA, 22 bp, Homo sapiens
ttgctgtttctctgtgtctggt

SEQ ID NO: 7293157 - DNA, 22 bp, Homo sapiens
ttgctgttttacatctggtggg

SEQ ID NO: 7293158 - DNA, 22 bp, Homo sapiens
ttgctctccagaggctcacagc

SEQ ID NO: 7293159 - DNA, 22 bp, Homo sapiens
ttggaaagaagggctgagcaag

SEQ ID NO: 7293160 - DNA, 22 bp, Homo sapiens
ttggaaagattattattatgaa

SEQ ID NO: 7293161 - DNA, 22 bp, Homo sapiens
ttggaaagaccgaattcctgtt

SEQ ID NO: 7293162 - DNA, 22 bp, Homo sapiens
ttggaaagcaagctggacatac

SEQ ID NO: 7293163 - DNA, 22 bp, Homo sapiens
ttggaaagcaacttttgagagt

SEQ ID NO: 7293164 - DNA, 22 bp, Homo sapiens
ttggaaagggatatctgtactt

SEQ ID NO: 7293165 - DNA, 22 bp, Homo sapiens
ttggaaaggtgcttttgtctgt

SEQ ID NO: 7293166 - DNA, 22 bp, Homo sapiens
ttggaaagtgacgttcaactgt

SEQ ID NO: 7293167 - DNA, 22 bp, Homo sapiens
ttggaaagtctcacccagttga

SEQ ID NO: 7293168 - DNA, 22 bp, Homo sapiens
ttggaaagtttttactgaagac

SEQ ID NO: 7293169 - DNA, 22 bp, Homo sapiens
ttggaaaggagattctattgtg

SEQ ID NO: 7293170 - DNA, 22 bp, Homo sapiens
ttggaaagcccattatttggac

SEQ ID NO: 7293171 - DNA, 22 bp, Homo sapiens
ttggaaagcagccgcagccaat

SEQ ID NO: 7293172 - DNA, 22 bp, Homo sapiens
ttggaaagggaggaatgtagac

SEQ ID NO: 7293173 - DNA, 22 bp, Homo sapiens
ttggaaaggagtttttagctat

SEQ ID NO: 7293174 - DNA, 22 bp, Homo sapiens
ttgggaagtttaatgacagact

SEQ ID NO: 7293175 - DNA, 22 bp, Homo sapiens
ttggccatctaagcccagccac

SEQ ID NO: 7293176 - DNA, 22 bp, Homo sapiens
ttgggaaggcgtggaagcagaa

SEQ ID NO: 7293177 - DNA, 22 bp, Homo sapiens
ttgggaaggcgtggaagcagaa

SEQ ID NO: 7293178 - DNA, 22 bp, Homo sapiens
ttgtcatggatggaagggatat

SEQ ID NO: 7293179 - DNA, 22 bp, Homo sapiens
ttgtcatgagtcacaaaaataa

SEQ ID NO: 7293180 - DNA, 23 bp, Homo sapiens
tttttagttacacctctgccacc

SEQ ID NO: 7293181 - DNA, 22 bp, Homo sapiens
tttttataccacctctcactta

SEQ ID NO: 7293182 - DNA, 22 bp, Homo sapiens
tttgtgttttcactagcagtgt

SEQ ID NO: 7293183 - DNA, 22 bp, Homo sapiens
tttgttaaaatgcagattctgt

SEQ ID NO: 7293184 - DNA, 22 bp, Homo sapiens
tttgttaaggagtattgcttct

SEQ ID NO: 7293185 - DNA, 22 bp, Homo sapiens
tttgttaattcttatgttagag

SEQ ID NO: 7293186 - DNA, 22 bp, Homo sapiens
tttgtgtgtgctcacatagatg

SEQ ID NO: 7293187 - DNA, 22 bp, Homo sapiens
tttgtgtgtatatgtatataga

SEQ ID NO: 7293188 - DNA, 22 bp, Homo sapiens
ttttaatgggcgactattatgg

SEQ ID NO: 7293189 - DNA, 22 bp, Homo sapiens
ttttatgtaatccttactgtcg

SEQ ID NO: 7293190 - DNA, 22 bp, Homo sapiens
ttttaaaggctgtatgaccaag

SEQ ID NO: 7293191 - DNA, 22 bp, Homo sapiens
ttttaacactcagcactatctc

SEQ ID NO: 7293192 - DNA, 22 bp, Homo sapiens
ttttaaaggatagctctggttg

SEQ ID NO: 7293193 - DNA, 22 bp, Homo sapiens
ttttaaaggatactcttgtcta

SEQ ID NO: 7293194 - DNA, 22 bp, Homo sapiens
ttttaaaggcagattatggctt

SEQ ID NO: 7293195 - DNA, 22 bp, Homo sapiens
ttttaaagagatgctgtgcata

SEQ ID NO: 7293196 - DNA, 22 bp, Homo sapiens
ttttctgaagtttaagacattt

SEQ ID NO: 7293197 - DNA, 22 bp, Homo sapiens
ttttcattgtaaatcaggaaac

SEQ ID NO: 7293198 - DNA, 22 bp, Homo sapiens
ttttatgtgtcaaagcagtggt

SEQ ID NO: 7293199 - DNA, 22 bp, Homo sapiens
tttgattctaagttctgtcaac

SEQ ID NO: 7293200 - DNA, 22 bp, Homo sapiens
tttgatttactggatattctca

SEQ ID NO: 7293201 - DNA, 22 bp, Homo sapiens
tttgacagcagataaaataaaa

SEQ ID NO: 7293202 - DNA, 22 bp, Homo sapiens
tttgacagatctcagagcattt

SEQ ID NO: 7293203 - DNA, 22 bp, Homo sapiens
tttgacagatccttaactcagc

SEQ ID NO: 7293204 - DNA, 22 bp, Homo sapiens
tttgacagatagatgttatgtt

SEQ ID NO: 7293205 - DNA, 19 bp, Homo sapiens
tttgacagagtttgagcat

SEQ ID NO: 7293206 - DNA, 22 bp, Homo sapiens
tttgacagagttgtgaggattt

SEQ ID NO: 7293207 - DNA, 22 bp, Homo sapiens
tttgacagaggttgtggtgtat

SEQ ID NO: 7293208 - DNA, 22 bp, Homo sapiens
tttgacagagctcttagtctct

SEQ ID NO: 7293209 - DNA, 22 bp, Homo sapiens
tttgacagacatttactacatt

SEQ ID NO: 7293210 - DNA, 22 bp, Homo sapiens
tttgacagacagtgctgggaca

SEQ ID NO: 7293211 - DNA, 22 bp, Homo sapiens
tttgacagaaagttattatttt

SEQ ID NO: 7293212 - DNA, 22 bp, Homo sapiens
tttgaatctgatatggcagcat

SEQ ID NO: 7293213 - DNA, 22 bp, Homo sapiens
tttgaaagcctggcttttctct

SEQ ID NO: 7293214 - DNA, 21 bp, Homo sapiens
tttgaaagccctatgttttca

SEQ ID NO: 7293215 - DNA, 19 bp, Homo sapiens
tttgaaaggattgttattt

SEQ ID NO: 7293216 - DNA, 22 bp, Homo sapiens
tttcctctgactgctcccctgc

SEQ ID NO: 7293217 - DNA, 22 bp, Homo sapiens
tttcctctccggggcctccagg

SEQ ID NO: 7293218 - DNA, 22 bp, Homo sapiens
tttcctcctagcctccagccgc

SEQ ID NO: 7293219 - DNA, 22 bp, Homo sapiens
gtgcagcctgtcgccagtggat

SEQ ID NO: 7293220 - DNA, 22 bp, Homo sapiens
gtgcaggagcaggagccatgtc

SEQ ID NO: 7293221 - DNA, 22 bp, Homo sapiens
gtctctgtgtctgagagagccc

SEQ ID NO: 7293222 - DNA, 22 bp, Homo sapiens
gtctctgtcttaggccaggcct

SEQ ID NO: 7293223 - DNA, 22 bp, Homo sapiens
gtcctctgtgtaggctgcagac

SEQ ID NO: 7293224 - DNA, 22 bp, Homo sapiens
gtcctctgtgtaggctgcagac

SEQ ID NO: 7293225 - DNA, 22 bp, Homo sapiens
cagcagtggctgcaggcagctg

SEQ ID NO: 7293226 - DNA, 22 bp, Homo sapiens
cagcatgatttatcacaaccct

SEQ ID NO: 7293227 - DNA, 22 bp, Homo sapiens
cagcatgcagcccctggcagct

SEQ ID NO: 7293228 - DNA, 22 bp, Homo sapiens
cagcatgcattttctctctttg

SEQ ID NO: 7293229 - DNA, 22 bp, Homo sapiens
gtctatttgggatcatgatatg

SEQ ID NO: 7293230 - DNA, 22 bp, Homo sapiens
gtctcacacagagtagattttg

SEQ ID NO: 7293231 - DNA, 22 bp, Homo sapiens
cagcagggaagctgtgctgttt

SEQ ID NO: 7293232 - DNA, 22 bp, Homo sapiens
gtgcatgctgcagtatgatttc

SEQ ID NO: 7293233 - DNA, 21 bp, Homo sapiens
gtgcatggagaaaggcttgct

SEQ ID NO: 7293234 - DNA, 22 bp, Homo sapiens
gtgcaggagccaggggtaggaa

SEQ ID NO: 7293235 - DNA, 22 bp, Homo sapiens
gtgctgagcacaaggcccagag

SEQ ID NO: 7293236 - DNA, 22 bp, Homo sapiens
cagctccctatggtgaggcgac

SEQ ID NO: 7293237 - DNA, 22 bp, Homo sapiens
cagctcctgaggactgctggga

SEQ ID NO: 7293238 - DNA, 22 bp, Homo sapiens
cagatgcttcgtgggtgagcac

SEQ ID NO: 7293239 - DNA, 22 bp, Homo sapiens
ggtgagaggcagaggacagctt

SEQ ID NO: 7293240 - DNA, 22 bp, Homo sapiens
cagatatattttccttattagg

SEQ ID NO: 7293241 - DNA, 22 bp, Homo sapiens
cagatatattttatttggtcaa

SEQ ID NO: 7293242 - DNA, 22 bp, Homo sapiens
cagaggctgctctgggtggcat

SEQ ID NO: 7293243 - DNA, 22 bp, Homo sapiens
cagaggctgatggctgtagcca

SEQ ID NO: 7293244 - DNA, 22 bp, Homo sapiens
cagatggagtcccgtggagttc

SEQ ID NO: 7293245 - DNA, 22 bp, Homo sapiens
cagatggaacacagaaaggaga

SEQ ID NO: 7293246 - DNA, 22 bp, Homo sapiens
cagcagactggagtaggcagtg

SEQ ID NO: 7293247 - DNA, 22 bp, Homo sapiens
ggtgtgcatggcacagggcttg

SEQ ID NO: 7293248 - DNA, 22 bp, Homo sapiens
cagaagcagtgagagatgtgca

SEQ ID NO: 7293249 - DNA, 22 bp, Homo sapiens
cagaagcacatgtttacatgta

SEQ ID NO: 7293250 - DNA, 22 bp, Homo sapiens
cacccaggcaggtggctgagaa

SEQ ID NO: 7293251 - DNA, 22 bp, Homo sapiens
caccaagaatcttcacttttta

SEQ ID NO: 7293252 - DNA, 22 bp, Homo sapiens
cacatttgaaggaattagcatt

SEQ ID NO: 7293253 - DNA, 21 bp, Homo sapiens
cacatttgaacctcacagcaa

SEQ ID NO: 7293254 - DNA, 22 bp, Homo sapiens
cacatttgggacaggagataaa

SEQ ID NO: 7293255 - DNA, 20 bp, Homo sapiens
ggcaggaccccagtggcatc

SEQ ID NO: 7293256 - DNA, 22 bp, Homo sapiens
cacatgcatacctatgtgtata

SEQ ID NO: 7293257 - DNA, 22 bp, Homo sapiens
ggataggaattgagatgctatt

SEQ ID NO: 7293258 - DNA, 20 bp, Homo sapiens
cagaaatttgtaaaagggat

SEQ ID NO: 7293259 - DNA, 22 bp, Homo sapiens
cactgcccttacatgccctgca

SEQ ID NO: 7293260 - DNA, 22 bp, Homo sapiens
cactgagttagtacgcaaacat

SEQ ID NO: 7293261 - DNA, 22 bp, Homo sapiens
cacaggagaggttaatgggggc

SEQ ID NO: 7293262 - DNA, 22 bp, Homo sapiens
ggagggcaacttttcagtaggt

SEQ ID NO: 7293263 - DNA, 22 bp, Homo sapiens
ggaggggatttagtagatgcta

SEQ ID NO: 7293264 - DNA, 22 bp, Homo sapiens
cacagctaactttcactgagca

SEQ ID NO: 7293265 - DNA, 22 bp, Homo sapiens
ggaggagacagtaaaaagcacg

SEQ ID NO: 7293266 - DNA, 22 bp, Homo sapiens
ggaggagacagtaaaaagcacg

SEQ ID NO: 7293267 - DNA, 22 bp, Homo sapiens
ggaggagaccctgtgtcagttt

SEQ ID NO: 7293268 - DNA, 22 bp, Homo sapiens
ggaggagacggagtgattagtg

SEQ ID NO: 7293269 - DNA, 22 bp, Homo sapiens
ggaggagattcccctctcactt

SEQ ID NO: 7293270 - DNA, 22 bp, Homo sapiens
ggaggagagaggttgcaaacac

SEQ ID NO: 7293271 - DNA, 22 bp, Homo sapiens
ggaggagcacttgacggggtct

SEQ ID NO: 7293272 - DNA, 22 bp, Homo sapiens
cacagcataatgaaatatactt

SEQ ID NO: 7293273 - DNA, 22 bp, Homo sapiens
cacagcataatgaaatatactt

SEQ ID NO: 7293274 - DNA, 22 bp, Homo sapiens
ggacagcattctactgtaggca

SEQ ID NO: 7293275 - DNA, 22 bp, Homo sapiens
ggacagcgtggctggtggaggg

SEQ ID NO: 7293276 - DNA, 22 bp, Homo sapiens
ggacagcacagctcttgacaac

SEQ ID NO: 7293277 - DNA, 22 bp, Homo sapiens
ggacacacaagttatctaatga

SEQ ID NO: 7293278 - DNA, 22 bp, Homo sapiens
ggacaagcctgtgagtgggttt

SEQ ID NO: 7293279 - DNA, 22 bp, Homo sapiens
ggaagagattctttacattcat

SEQ ID NO: 7293280 - DNA, 22 bp, Homo sapiens
ggaagagaatttctctcttttt

SEQ ID NO: 7293281 - DNA, 22 bp, Homo sapiens
ggaagagagatcccatagatgt

SEQ ID NO: 7293282 - DNA, 22 bp, Homo sapiens
ggaacaggaaaggagggatgct

SEQ ID NO: 7293283 - DNA, 22 bp, Homo sapiens
ggaaatgtatgtattaagcacc

SEQ ID NO: 7293284 - DNA, 22 bp, Homo sapiens
gcttccagcaccagcagagggg

SEQ ID NO: 7293285 - DNA, 22 bp, Homo sapiens
gcttccagaccccagtccctca

SEQ ID NO: 7293286 - DNA, 22 bp, Homo sapiens
caatggttctcaaactatcatg

SEQ ID NO: 7293287 - DNA, 22 bp, Homo sapiens
caatggtggtgtcagaagagat

SEQ ID NO: 7293288 - DNA, 22 bp, Homo sapiens
caatgcatgatggaattgcctt

SEQ ID NO: 7293289 - DNA, 22 bp, Homo sapiens
gctggtgctctgggccctgagg

SEQ ID NO: 7293290 - DNA, 22 bp, Homo sapiens
caatgcatacttcgaaatttca

SEQ ID NO: 7293291 - DNA, 22 bp, Homo sapiens
atgcacaacagacgaatggaag

SEQ ID NO: 7293292 - DNA, 22 bp, Homo sapiens
gaactttgcgcagttcccgggg

SEQ ID NO: 7293293 - DNA, 22 bp, Homo sapiens
gaacataattaaatgtcctggg

SEQ ID NO: 7293294 - DNA, 22 bp, Homo sapiens
gacataaaccttgagatattaa

SEQ ID NO: 7293295 - DNA, 22 bp, Homo sapiens
gacagtttttaatcctttcatg

SEQ ID NO: 7293296 - DNA, 22 bp, Homo sapiens
gacagttttgctgaaattgagc

SEQ ID NO: 7293297 - DNA, 22 bp, Homo sapiens
gacagtttaagcacctaatatt

SEQ ID NO: 7293298 - DNA, 22 bp, Homo sapiens
gacagttttgctaaaaggttga

SEQ ID NO: 7293299 - DNA, 22 bp, Homo sapiens
gacagtttggatgggggtttgc

SEQ ID NO: 7293300 - DNA, 22 bp, Homo sapiens
gacagtttctgaatgcgtactt

SEQ ID NO: 7293301 - DNA, 22 bp, Homo sapiens
gacagtttaggttcaaatctca

SEQ ID NO: 7293302 - DNA, 18 bp, Homo sapiens
gaccccgggatctgtcga

SEQ ID NO: 7293303 - DNA, 22 bp, Homo sapiens
gaatgttactttgattttgtcc

SEQ ID NO: 7293304 - DNA, 22 bp, Homo sapiens
gaatgtcagttgcgggcatttc

SEQ ID NO: 7293305 - DNA, 22 bp, Homo sapiens
gaatgtcagggccagaagaggc

SEQ ID NO: 7293306 - DNA, 19 bp, Homo sapiens
atgcatacttgcatagttt

SEQ ID NO: 7293307 - DNA, 22 bp, Homo sapiens
atgcatacagatttaaaatttt

SEQ ID NO: 7293308 - DNA, 22 bp, Homo sapiens
gaagcacatggctatagctatt

SEQ ID NO: 7293309 - DNA, 22 bp, Homo sapiens
gaagcacagaatggttaacatg

SEQ ID NO: 7293310 - DNA, 22 bp, Homo sapiens
gaagcacagggctcgatctcag

SEQ ID NO: 7293311 - DNA, 22 bp, Homo sapiens
gaatcatagaacattaatagaa

SEQ ID NO: 7293312 - DNA, 22 bp, Homo sapiens
gagaggctgcatatgcacactg

SEQ ID NO: 7293313 - DNA, 22 bp, Homo sapiens
gagccctgaacaacagcaggaa

SEQ ID NO: 7293314 - DNA, 22 bp, Homo sapiens
gagcagggccacttctgtacct

SEQ ID NO: 7293315 - DNA, 22 bp, Homo sapiens
atgtaaattgtactgacacacg

SEQ ID NO: 7293316 - DNA, 17 bp, Homo sapiens
atgtaagaagaaagcag

SEQ ID NO: 7293317 - DNA, 22 bp, Homo sapiens
atgtacaatctatcacaagaag

SEQ ID NO: 7293318 - DNA, 22 bp, Homo sapiens
atgtacaaaatgttttgaaatg

SEQ ID NO: 7293319 - DNA, 22 bp, Homo sapiens
atgtcacagttgcaacatgaat

SEQ ID NO: 7293320 - DNA, 22 bp, Homo sapiens
atgtcacagcaggagtattctt

SEQ ID NO: 7293321 - DNA, 22 bp, Homo sapiens
atgtcacaggcaacaagattgc

SEQ ID NO: 7293322 - DNA, 22 bp, Homo sapiens
gaggctgttggctgatctgagt

SEQ ID NO: 7293323 - DNA, 22 bp, Homo sapiens
gaggctgttaggagggactctg

SEQ ID NO: 7293324 - DNA, 22 bp, Homo sapiens
atgtcacatggcctgtactttg

SEQ ID NO: 7293325 - DNA, 22 bp, Homo sapiens
atgtcacatggtcacctctagc

SEQ ID NO: 7293326 - DNA, 22 bp, Homo sapiens
gaggttggggctgcagtgagct

SEQ ID NO: 7293327 - DNA, 22 bp, Homo sapiens
gagggcaccagaagagccagat

SEQ ID NO: 7293328 - DNA, 22 bp, Homo sapiens
gagtgcaggcctgagcaccatc

SEQ ID NO: 7293329 - DNA, 22 bp, Homo sapiens
gagtgcagatgaacagaagatt

SEQ ID NO: 7293330 - DNA, 22 bp, Homo sapiens
gagtgcagatgaacagaagatt

SEQ ID NO: 7293331 - DNA, 23 bp, Homo sapiens
gagtgcagaatagacatgcagtg

SEQ ID NO: 7293332 - DNA, 22 bp, Homo sapiens
gagtccagtgtttaccaggggt

SEQ ID NO: 7293333 - DNA, 22 bp, Homo sapiens
caaatcaccacttaatgggtta

SEQ ID NO: 7293334 - DNA, 22 bp, Homo sapiens
caaatcacaatgtgagactgag

SEQ ID NO: 7293335 - DNA, 22 bp, Homo sapiens
caaattagaggtttgttttgat

SEQ ID NO: 7293336 - DNA, 22 bp, Homo sapiens
gctatttctttaaattgatctc

SEQ ID NO: 7293337 - DNA, 22 bp, Homo sapiens
gctatttctatattataaagaa

SEQ ID NO: 7293338 - DNA, 22 bp, Homo sapiens
gctattgtacatttcttgtttg

SEQ ID NO: 7293339 - DNA, 22 bp, Homo sapiens
gctattgtgacagcttttcgcc

SEQ ID NO: 7293340 - DNA, 22 bp, Homo sapiens
gctctaaagtccagtcaactag

SEQ ID NO: 7293341 - DNA, 22 bp, Homo sapiens
gctctaaagagaatctatgcgg

SEQ ID NO: 7293342 - DNA, 22 bp, Homo sapiens
gctctagattgttacaaagttc

SEQ ID NO: 7293343 - DNA, 22 bp, Homo sapiens
gcccagcaggggatggcagctc

SEQ ID NO: 7293344 - DNA, 22 bp, Homo sapiens
attttctagatagatgatgcat

SEQ ID NO: 7293345 - DNA, 22 bp, Homo sapiens
attttaataagatccatttggt

SEQ ID NO: 7293346 - DNA, 22 bp, Homo sapiens
gcactggtgtgaaacagtagat

SEQ ID NO: 7293347 - DNA, 18 bp, Homo sapiens
gcacagagcccaggctct

SEQ ID NO: 7293348 - DNA, 17 bp, Homo sapiens
gcagcctcttggtagtg

SEQ ID NO: 7293349 - DNA, 22 bp, Homo sapiens
gcagcctgggcaacagagtgag

SEQ ID NO: 7293350 - DNA, 22 bp, Homo sapiens
gcagaaggtcaaagcaagatgt

SEQ ID NO: 7293351 - DNA, 22 bp, Homo sapiens
gcagaagggaataaggagcttt

SEQ ID NO: 7293352 - DNA, 22 bp, Homo sapiens
gcagaaggttgtttgggaaagg

SEQ ID NO: 7293353 - DNA, 22 bp, Homo sapiens
gcagaaggtctggcacttcagg

SEQ ID NO: 7293354 - DNA, 22 bp, Homo sapiens
gcagaaggttgtttgggaaagg

SEQ ID NO: 7293355 - DNA, 22 bp, Homo sapiens
gcagggtcgctctaggagatca

SEQ ID NO: 7293356 - DNA, 22 bp, Homo sapiens
gcaggtggatcacctgaggtca

SEQ ID NO: 7293357 - DNA, 18 bp, Homo sapiens
gcaggagatgggtggggt

SEQ ID NO: 7293358 - DNA, 22 bp, Homo sapiens
gcaggctgtctaaagttagagt

SEQ ID NO: 7293359 - DNA, 22 bp, Homo sapiens
gcagggactgtgatctcacaga

SEQ ID NO: 7293360 - DNA, 22 bp, Homo sapiens
gcagggactttggcaacaggtg

SEQ ID NO: 7293361 - DNA, 21 bp, Homo sapiens
gccactgcactccagcctggg

SEQ ID NO: 7293362 - DNA, 22 bp, Homo sapiens
gccactgattccaagtcaattt

SEQ ID NO: 7293363 - DNA, 18 bp, Homo sapiens
gcagtgcaggaagaagag

SEQ ID NO: 7293364 - DNA, 22 bp, Homo sapiens
attgtttacactaacttcataa

SEQ ID NO: 7293365 - DNA, 22 bp, Homo sapiens
attgttgctaggattcaatgag

SEQ ID NO: 7293366 - DNA, 22 bp, Homo sapiens
agtggagtgagtggcagaagga

SEQ ID NO: 7293367 - DNA, 22 bp, Homo sapiens
agtggacattctgcacttggag

SEQ ID NO: 7293368 - DNA, 22 bp, Homo sapiens
agtggacaaccatgctgagatt

SEQ ID NO: 7293369 - DNA, 19 bp, Homo sapiens
agtctttcccactcgtctt

SEQ ID NO: 7293370 - DNA, 22 bp, Homo sapiens
ctcacagttggctcattaatga

SEQ ID NO: 7293371 - DNA, 22 bp, Homo sapiens
ctcacagttggctcattaatga

SEQ ID NO: 7293372 - DNA, 22 bp, Homo sapiens
ctcacagtgtaatattgaaccc

SEQ ID NO: 7293373 - DNA, 22 bp, Homo sapiens
ctcacagttggagaatttagat

SEQ ID NO: 7293374 - DNA, 22 bp, Homo sapiens
ctcacagtgtcaacattaacta

SEQ ID NO: 7293375 - DNA, 22 bp, Homo sapiens
ctcacagtttcacagtgtagat

SEQ ID NO: 7293376 - DNA, 22 bp, Homo sapiens
ctcacagttgtggtacctggtt

SEQ ID NO: 7293377 - DNA, 22 bp, Homo sapiens
ctcacagttttttcctgttaat

SEQ ID NO: 7293378 - DNA, 22 bp, Homo sapiens
ctcacagttttctgtagtccaa

SEQ ID NO: 7293379 - DNA, 22 bp, Homo sapiens
agtctattgcctaacagagagg

SEQ ID NO: 7293380 - DNA, 22 bp, Homo sapiens
agtctatttgctgtccgagcaa

SEQ ID NO: 7293381 - DNA, 22 bp, Homo sapiens
agtctattttcagaagcagttt

SEQ ID NO: 7293382 - DNA, 22 bp, Homo sapiens
ctcacagtctctccctaatttt

SEQ ID NO: 7293383 - DNA, 22 bp, Homo sapiens
ctcacagtctgcctttcccttg

SEQ ID NO: 7293384 - DNA, 22 bp, Homo sapiens
ctcacagtctctccctaatttt

SEQ ID NO: 7293385 - DNA, 22 bp, Homo sapiens
ctcacagtgatgtcttatgaca

SEQ ID NO: 7293386 - DNA, 21 bp, Homo sapiens
ctcacagtctgttttccttgc

SEQ ID NO: 7293387 - DNA, 20 bp, Homo sapiens
ctcacagtcaatgcagaggt

SEQ ID NO: 7293388 - DNA, 22 bp, Homo sapiens
agtgagggactagtgctgggga

SEQ ID NO: 7293389 - DNA, 22 bp, Homo sapiens
agtgagtgggttacagatggga

SEQ ID NO: 7293390 - DNA, 19 bp, Homo sapiens
agtgagtgtacagtagaat

SEQ ID NO: 7293391 - DNA, 22 bp, Homo sapiens
agtgaggggcagctgagtgggc

SEQ ID NO: 7293392 - DNA, 22 bp, Homo sapiens
agtgagggatgaagaactgcgg

SEQ ID NO: 7293393 - DNA, 22 bp, Homo sapiens
agtgaggtggggtcacagggac

SEQ ID NO: 7293394 - DNA, 22 bp, Homo sapiens
agtgagtggaccctgcaaggaa

SEQ ID NO: 7293395 - DNA, 22 bp, Homo sapiens
agtgtgggccacgcagctgagc

SEQ ID NO: 7293396 - DNA, 19 bp, Homo sapiens
agtgtgagtaattggagtt

SEQ ID NO: 7293397 - DNA, 22 bp, Homo sapiens
agtgtgagttacaaagtgtgaa

SEQ ID NO: 7293398 - DNA, 22 bp, Homo sapiens
agtgtgagtgctcatgtccatc

SEQ ID NO: 7293399 - DNA, 22 bp, Homo sapiens
agtgtgagtttggttgagactt

SEQ ID NO: 7293400 - DNA, 22 bp, Homo sapiens
agttaaatcattactgacagag

SEQ ID NO: 7293401 - DNA, 22 bp, Homo sapiens
agtgtttgtaaactacagatct

SEQ ID NO: 7293402 - DNA, 20 bp, Homo sapiens
agtgtttgctcacagtctcc

SEQ ID NO: 7293403 - DNA, 22 bp, Homo sapiens
agttatttcagtaacataatag

SEQ ID NO: 7293404 - DNA, 22 bp, Homo sapiens
agtgtcagttgccttgtcataa

SEQ ID NO: 7293405 - DNA, 22 bp, Homo sapiens
agtgtgagtaattgagtctgtc

SEQ ID NO: 7293406 - DNA, 22 bp, Homo sapiens
agtgtgagtaattcagggaggg

SEQ ID NO: 7293407 - DNA, 22 bp, Homo sapiens
agtgtgaggggttctttgatat

SEQ ID NO: 7293408 - DNA, 22 bp, Homo sapiens
agtgtgagctaatagcagagcc

SEQ ID NO: 7293409 - DNA, 22 bp, Homo sapiens
agtgtgagcctacaggccaaag

SEQ ID NO: 7293410 - DNA, 22 bp, Homo sapiens
agtgtgagattaaaccgaatca

SEQ ID NO: 7293411 - DNA, 22 bp, Homo sapiens
agtgtgagccctggagtggtgc

SEQ ID NO: 7293412 - DNA, 19 bp, Homo sapiens
agtgtgagactccatctca

SEQ ID NO: 7293413 - DNA, 22 bp, Homo sapiens
agtgtgagaacggactaataaa

SEQ ID NO: 7293414 - DNA, 22 bp, Homo sapiens
agtgtgagatgattgaggagca

SEQ ID NO: 7293415 - DNA, 20 bp, Homo sapiens
agtggtctagtttctctgca

SEQ ID NO: 7293416 - DNA, 22 bp, Homo sapiens
agtggtctatttaatagttttc

SEQ ID NO: 7293417 - DNA, 22 bp, Homo sapiens
agtggtctccccagtagaataa

SEQ ID NO: 7293418 - DNA, 22 bp, Homo sapiens
ctctggagttcttcaagctact

SEQ ID NO: 7293419 - DNA, 21 bp, Homo sapiens
ctctggagtttgaaggctggg

SEQ ID NO: 7293420 - DNA, 22 bp, Homo sapiens
aggtaagggctgcgactataag

SEQ ID NO: 7293421 - DNA, 22 bp, Homo sapiens
ccttccagggctctccagaacc

SEQ ID NO: 7293422 - DNA, 23 bp, Homo sapiens
agtagcacatcttgtgtggtttg

SEQ ID NO: 7293423 - DNA, 22 bp, Homo sapiens
agtatttctgaatattatcata

SEQ ID NO: 7293424 - DNA, 22 bp, Homo sapiens
ctagctgacgggttgataggtg

SEQ ID NO: 7293425 - DNA, 22 bp, Homo sapiens
ctatctcagagaaggacatttg

SEQ ID NO: 7293426 - DNA, 22 bp, Homo sapiens
ctatctcatgcatcaactcttc

SEQ ID NO: 7293427 - DNA, 22 bp, Homo sapiens
ctatattggtggccatttggaa

SEQ ID NO: 7293428 - DNA, 22 bp, Homo sapiens
ctatatttggtgagggatgtct

SEQ ID NO: 7293429 - DNA, 22 bp, Homo sapiens
ctatatttcttggctttaaaca

SEQ ID NO: 7293430 - DNA, 19 bp, Homo sapiens
atacacatacgtaaactga

SEQ ID NO: 7293431 - DNA, 22 bp, Homo sapiens
atacacaggtgctaggtcaata

SEQ ID NO: 7293432 - DNA, 22 bp, Homo sapiens
atacacagctacattgaacaat

SEQ ID NO: 7293433 - DNA, 22 bp, Homo sapiens
atacacatatcaggtgtataca

SEQ ID NO: 7293434 - DNA, 22 bp, Homo sapiens
atacaagttaatgagaatgaca

SEQ ID NO: 7293435 - DNA, 22 bp, Homo sapiens
ctgctgtgccttaaaatgcaag

SEQ ID NO: 7293436 - DNA, 22 bp, Homo sapiens
agttctcatcatgaagcataag

SEQ ID NO: 7293437 - DNA, 22 bp, Homo sapiens
ataaagcaagcataccattaag

SEQ ID NO: 7293438 - DNA, 22 bp, Homo sapiens
ctgcaggctgagcgcctgccgg

SEQ ID NO: 7293439 - DNA, 22 bp, Homo sapiens
atacacattactttctgtctga

SEQ ID NO: 7293440 - DNA, 22 bp, Homo sapiens
ctggcacagccactgcaggcag

SEQ ID NO: 7293441 - DNA, 22 bp, Homo sapiens
ctggcacaggatccgagacctt

SEQ ID NO: 7293442 - DNA, 22 bp, Homo sapiens
ctgggagctgtcaggagcgtgt

SEQ ID NO: 7293443 - DNA, 22 bp, Homo sapiens
ctgggagctggatgccctgccc

SEQ ID NO: 7293444 - DNA, 22 bp, Homo sapiens
ctggcgtgaaggtggccatgag

SEQ ID NO: 7293445 - DNA, 22 bp, Homo sapiens
cttctgtgttaaatgagtcttt

SEQ ID NO: 7293446 - DNA, 22 bp, Homo sapiens
atccatttcctccactataaag

SEQ ID NO: 7293447 - DNA, 22 bp, Homo sapiens
atccatttgacataatttcagc

SEQ ID NO: 7293448 - DNA, 22 bp, Homo sapiens
atcatcagggacatttctgtgc

SEQ ID NO: 7293449 - DNA, 22 bp, Homo sapiens
cttatgtatgctactttgtggt

SEQ ID NO: 7293450 - DNA, 22 bp, Homo sapiens
ctgggagcttgttaggaatgca

SEQ ID NO: 7293451 - DNA, 22 bp, Homo sapiens
ctgggagcttttagaaatgcag

SEQ ID NO: 7293452 - DNA, 22 bp, Homo sapiens
ctgggagcttgttaggaatgca

SEQ ID NO: 7293453 - DNA, 22 bp, Homo sapiens
ctgtaagatgggataagacttt

SEQ ID NO: 7293454 - DNA, 21 bp, Homo sapiens
ctgtaagaaatcagttttatc

SEQ ID NO: 7293455 - DNA, 22 bp, Homo sapiens
atcagctgaaaaacaggcagca

SEQ ID NO: 7293456 - DNA, 22 bp, Homo sapiens
atcagctgatgaatggatgaat

SEQ ID NO: 7293457 - DNA, 22 bp, Homo sapiens
atcagccaattacagaacatga

SEQ ID NO: 7293458 - DNA, 22 bp, Homo sapiens
atcacagcacacctgacatgta

SEQ ID NO: 7293459 - DNA, 22 bp, Homo sapiens
atcacagattgtgaataactat

SEQ ID NO: 7293460 - DNA, 22 bp, Homo sapiens
atcacaaaggtctcagagcaca

SEQ ID NO: 7293461 - DNA, 22 bp, Homo sapiens
atcataaaattgcaccatttct

SEQ ID NO: 7293462 - DNA, 22 bp, Homo sapiens
atcagtttctgtgaagaacaca

SEQ ID NO: 7293463 - DNA, 22 bp, Homo sapiens
atcataaaccactttgtaatct

SEQ ID NO: 7293464 - DNA, 22 bp, Homo sapiens
atcataaagtgctatctgattg

SEQ ID NO: 7293465 - DNA, 22 bp, Homo sapiens
atcagctggaacaagtgtctga

SEQ ID NO: 7293466 - DNA, 20 bp, Homo sapiens
atcagctggagaacattatg

SEQ ID NO: 7293467 - DNA, 22 bp, Homo sapiens
atcagctgctacattggcctct

SEQ ID NO: 7293468 - DNA, 22 bp, Homo sapiens
aggagccaagatggggcaagta

SEQ ID NO: 7293469 - DNA, 22 bp, Homo sapiens
cagtgagggcattcagtgctgg

SEQ ID NO: 7293470 - DNA, 22 bp, Homo sapiens
cagtgaggctctgctgagcggt

SEQ ID NO: 7293471 - DNA, 22 bp, Homo sapiens
cagtgagggaagatctcagcac

SEQ ID NO: 7293472 - DNA, 22 bp, Homo sapiens
cagtgaggagtccagggcagag

SEQ ID NO: 7293473 - DNA, 18 bp, Homo sapiens
cagtgaggatgaagggtt

SEQ ID NO: 7293474 - DNA, 22 bp, Homo sapiens
cagtgaggagtccagggcagag

SEQ ID NO: 7293475 - DNA, 22 bp, Homo sapiens
aggaatttggggttacatgatg

SEQ ID NO: 7293476 - DNA, 22 bp, Homo sapiens
aggaattaacaatatatttagg

SEQ ID NO: 7293477 - DNA, 22 bp, Homo sapiens
catcagaagaaagacaaatgat

SEQ ID NO: 7293478 - DNA, 22 bp, Homo sapiens
catcacttttaaaggtgatcga

SEQ ID NO: 7293479 - DNA, 22 bp, Homo sapiens
aggagggttgaggaggatactt

SEQ ID NO: 7293480 - DNA, 22 bp, Homo sapiens
aggagtgggggcgagaagttaa

SEQ ID NO: 7293481 - DNA, 20 bp, Homo sapiens
catcattttaaaatctctcc

SEQ ID NO: 7293482 - DNA, 22 bp, Homo sapiens
catcatttcacttagatgaagt

SEQ ID NO: 7293483 - DNA, 22 bp, Homo sapiens
catgtgtctttatggagccaca

SEQ ID NO: 7293484 - DNA, 21 bp, Homo sapiens
ccaaagaactgccatttgtca

SEQ ID NO: 7293485 - DNA, 22 bp, Homo sapiens
cagggacatgactggtctctgt

SEQ ID NO: 7293486 - DNA, 22 bp, Homo sapiens
cagggacattggtggccaggtt

SEQ ID NO: 7293487 - DNA, 22 bp, Homo sapiens
cagggacataagaggaacatgg

SEQ ID NO: 7293488 - DNA, 22 bp, Homo sapiens
aggaaacagaggtgccacaata

SEQ ID NO: 7293489 - DNA, 22 bp, Homo sapiens
aggaagggtggatagtaacgtg

SEQ ID NO: 7293490 - DNA, 22 bp, Homo sapiens
aggaatgttaagaaggtctacc

SEQ ID NO: 7293491 - DNA, 22 bp, Homo sapiens
aggaaggactgcagcatttggt

SEQ ID NO: 7293492 - DNA, 22 bp, Homo sapiens
agctgggtgcccgaagccacgt

SEQ ID NO: 7293493 - DNA, 22 bp, Homo sapiens
agctggtgaacctgaggcacag

SEQ ID NO: 7293494 - DNA, 22 bp, Homo sapiens
agctggtgatggcctaagaagg

SEQ ID NO: 7293495 - DNA, 22 bp, Homo sapiens
agctggtgatgtggtccctcac

SEQ ID NO: 7293496 - DNA, 22 bp, Homo sapiens
caggaaatcactctgattttgg

SEQ ID NO: 7293497 - DNA, 22 bp, Homo sapiens
agggcctgcatcaggagcttgg

SEQ ID NO: 7293498 - DNA, 22 bp, Homo sapiens
ccctggaacccatggccagtgt

SEQ ID NO: 7293499 - DNA, 22 bp, Homo sapiens
agggctggagccacagctggga

SEQ ID NO: 7293500 - DNA, 22 bp, Homo sapiens
agggctactgcctgccttcagg

SEQ ID NO: 7293501 - DNA, 22 bp, Homo sapiens
agggctaggaatggaactggag

SEQ ID NO: 7293502 - DNA, 22 bp, Homo sapiens
agggctagagttgagatgggga

SEQ ID NO: 7293503 - DNA, 22 bp, Homo sapiens
agggctgcatctgcctggtgaa

SEQ ID NO: 7293504 - DNA, 22 bp, Homo sapiens
agggcgggctcatcacatgctc

SEQ ID NO: 7293505 - DNA, 22 bp, Homo sapiens
aggggatggagctggaaggcag

SEQ ID NO: 7293506 - DNA, 22 bp, Homo sapiens
agggtagggtaaatgatgcatc

SEQ ID NO: 7293507 - DNA, 22 bp, Homo sapiens
agggtagggccgtagggccatg

SEQ ID NO: 7293508 - DNA, 22 bp, Homo sapiens
aggctggtgcctgcagtgaatc

SEQ ID NO: 7293509 - DNA, 20 bp, Homo sapiens
cccaggagctgtgccccatc

SEQ ID NO: 7293510 - DNA, 22 bp, Homo sapiens
cccaggagcttctctctgcctc

SEQ ID NO: 7293511 - DNA, 23 bp, Homo sapiens
cccaggagcctgagtcctctctg

SEQ ID NO: 7293512 - DNA, 22 bp, Homo sapiens
cccaggaattcagggctcaagg

SEQ ID NO: 7293513 - DNA, 22 bp, Homo sapiens
cccaggagatgcactccattgg

SEQ ID NO: 7293514 - DNA, 22 bp, Homo sapiens
cccatgagacctggtttaaggc

SEQ ID NO: 7293515 - DNA, 22 bp, Homo sapiens
cccatgagattctgaatttggc

SEQ ID NO: 7293516 - DNA, 17 bp, Homo sapiens
cccatgagcccactccc

SEQ ID NO: 7293517 - DNA, 22 bp, Homo sapiens
cccatgagtgctgctcagaggc

SEQ ID NO: 7293518 - DNA, 22 bp, Homo sapiens
cccatgaggtggaggttgcagt

SEQ ID NO: 7293519 - DNA, 22 bp, Homo sapiens
ccctccattaaaacagacctat

SEQ ID NO: 7293520 - DNA, 22 bp, Homo sapiens
ccaggctgtaaacaccttcaaa

SEQ ID NO: 7293521 - DNA, 22 bp, Homo sapiens
ccaggctggagtatagtggcgc

SEQ ID NO: 7293522 - DNA, 22 bp, Homo sapiens
ccaggctggaatcaatattctg

SEQ ID NO: 7293523 - DNA, 22 bp, Homo sapiens
ccaggctgctttattactctgt

SEQ ID NO: 7293524 - DNA, 22 bp, Homo sapiens
ccaggctggtctgaatttctag

SEQ ID NO: 7293525 - DNA, 15 bp, Homo sapiens
ccaggctgggtgagc

SEQ ID NO: 7293526 - DNA, 22 bp, Homo sapiens
ccaggctgggctacaagttgag

SEQ ID NO: 7293527 - DNA, 22 bp, Homo sapiens
ccaggctggagtgcaatggcat

SEQ ID NO: 7293528 - DNA, 22 bp, Homo sapiens
ccaggctgggcggggaacctgg

SEQ ID NO: 7293529 - DNA, 22 bp, Homo sapiens
ccaggctgcttagccttatctt

SEQ ID NO: 7293530 - DNA, 22 bp, Homo sapiens
aggctacaataattcccatgca

SEQ ID NO: 7293531 - DNA, 22 bp, Homo sapiens
aggctacagatacagaggctac

SEQ ID NO: 7293532 - DNA, 22 bp, Homo sapiens
ccatttggtatagtgaaaagga

SEQ ID NO: 7293533 - DNA, 22 bp, Homo sapiens
ccatttggcaagaaagagtcat

SEQ ID NO: 7293534 - DNA, 22 bp, Homo sapiens
aggctggagtgcaatggcgtga

SEQ ID NO: 7293535 - DNA, 22 bp, Homo sapiens
aggctggagtgcagtggtgtga

SEQ ID NO: 7293536 - DNA, 22 bp, Homo sapiens
aggctggagtgcagtggcgtga

SEQ ID NO: 7293537 - DNA, 22 bp, Homo sapiens
aggctggagtgctggagtgctg

SEQ ID NO: 7293538 - DNA, 19 bp, Homo sapiens
aggctggagacaccaggcc

SEQ ID NO: 7293539 - DNA, 22 bp, Homo sapiens
ccagcaggagactagcaacata

SEQ ID NO: 7293540 - DNA, 22 bp, Homo sapiens
aggccacatagcttgcatgtag

SEQ ID NO: 7293541 - DNA, 22 bp, Homo sapiens
aggccacaagaaaatgcttcat

SEQ ID NO: 7293542 - DNA, 22 bp, Homo sapiens
aggcctgtcccagctgaggacg

SEQ ID NO: 7293543 - DNA, 22 bp, Homo sapiens
aggcgggtttaggacaatgctt

SEQ ID NO: 7293544 - DNA, 22 bp, Homo sapiens
aggcctggcatgagacctgaga

SEQ ID NO: 7293545 - DNA, 22 bp, Homo sapiens
aggcctggcatgagacctgaga

SEQ ID NO: 7293546 - DNA, 22 bp, Homo sapiens
ccaggaaggcaggcctccccgc

SEQ ID NO: 7293547 - DNA, 22 bp, Homo sapiens
ccagctcttttggctgagtgag

SEQ ID NO: 7293548 - DNA, 22 bp, Homo sapiens
ccagctctggcttcttgctggg

SEQ ID NO: 7293549 - DNA, 17 bp, Homo sapiens
aggagggaaatagcttg

SEQ ID NO: 7293550 - DNA, 22 bp, Homo sapiens
aggaggggttctcgggtgctga

SEQ ID NO: 7293551 - DNA, 22 bp, Homo sapiens
acataaatttcactgttccgtg

SEQ ID NO: 7293552 - DNA, 22 bp, Homo sapiens
acatacatatgtttaaatgcat

SEQ ID NO: 7293553 - DNA, 23 bp, Homo sapiens
aggagcccaaggagaggtaactt

SEQ ID NO: 7293554 - DNA, 23 bp, Homo sapiens
aggagcccctaattctgggcagc

SEQ ID NO: 7293555 - DNA, 22 bp, Homo sapiens
aggagccctgcgggaggcagag

SEQ ID NO: 7293556 - DNA, 22 bp, Homo sapiens
aggagctgcttaaatggttggt

SEQ ID NO: 7293557 - DNA, 22 bp, Homo sapiens
aggagccatgagtgacatcaca

SEQ ID NO: 7293558 - DNA, 23 bp, Homo sapiens
aggaaggaggtcctaacagtatc

SEQ ID NO: 7293559 - DNA, 22 bp, Homo sapiens
aggaaggagggcagatattaag

SEQ ID NO: 7293560 - DNA, 22 bp, Homo sapiens
aggaagggatacataggatagt

SEQ ID NO: 7293561 - DNA, 22 bp, Homo sapiens
acagccccagcgcggcggggtc

SEQ ID NO: 7293562 - DNA, 21 bp, Homo sapiens
acagcctccatctcctgggct

SEQ ID NO: 7293563 - DNA, 23 bp, Homo sapiens
acagccccatgcaggtgtgtttg

SEQ ID NO: 7293564 - DNA, 22 bp, Homo sapiens
acagccccccgctcagtttcca

SEQ ID NO: 7293565 - DNA, 22 bp, Homo sapiens
agcttagcacacacaggcaggt

SEQ ID NO: 7293566 - DNA, 22 bp, Homo sapiens
accaggaagctgtgagaccttt

SEQ ID NO: 7293567 - DNA, 22 bp, Homo sapiens
accacagaggaatttgaagagg

SEQ ID NO: 7293568 - DNA, 22 bp, Homo sapiens
accagtgtcttattgaccatct

SEQ ID NO: 7293569 - DNA, 22 bp, Homo sapiens
agggcctgacacccttgccagc

SEQ ID NO: 7293570 - DNA, 22 bp, Homo sapiens
acattgagcctcacctagatgc

SEQ ID NO: 7293571 - DNA, 22 bp, Homo sapiens
acattgagtgctccataaatca

SEQ ID NO: 7293572 - DNA, 22 bp, Homo sapiens
aggccacagagagtgcatgtgc

SEQ ID NO: 7293573 - DNA, 22 bp, Homo sapiens
aggccacaggattgcacagcat

SEQ ID NO: 7293574 - DNA, 22 bp, Homo sapiens
aggcatggctttaggcaggcgt

SEQ ID NO: 7293575 - DNA, 22 bp, Homo sapiens
acttttgaagaattatgcaaaa

SEQ ID NO: 7293576 - DNA, 22 bp, Homo sapiens
atatttttccatgtgggactct

SEQ ID NO: 7293577 - DNA, 21 bp, Homo sapiens
atatttttgtttggactgtca

SEQ ID NO: 7293578 - DNA, 22 bp, Homo sapiens
atcagcaagtcctgttaattct

SEQ ID NO: 7293579 - DNA, 22 bp, Homo sapiens
atcagcaatctcgtgtattagg

SEQ ID NO: 7293580 - DNA, 22 bp, Homo sapiens
atcagcaatcaaattgcagagt

SEQ ID NO: 7293581 - DNA, 22 bp, Homo sapiens
agaaatcatgactaagagcagt

SEQ ID NO: 7293582 - DNA, 22 bp, Homo sapiens
agaaatcaggaacagtaaggag

SEQ ID NO: 7293583 - DNA, 22 bp, Homo sapiens
agaaatcattcccaaacccata

SEQ ID NO: 7293584 - DNA, 22 bp, Homo sapiens
agaagccaattctgtgtgagtc

SEQ ID NO: 7293585 - DNA, 22 bp, Homo sapiens
agaagccaatcagctctctgct

SEQ ID NO: 7293586 - DNA, 22 bp, Homo sapiens
agaaggcagatgggacggagca

SEQ ID NO: 7293587 - DNA, 21 bp, Homo sapiens
agaaggcaaaagcagacatct

SEQ ID NO: 7293588 - DNA, 22 bp, Homo sapiens
agaacattaatgcgaggtatta

SEQ ID NO: 7293589 - DNA, 22 bp, Homo sapiens
atccatttttgcaaagttgttc

SEQ ID NO: 7293590 - DNA, 19 bp, Homo sapiens
atcccaaggagctgggact

SEQ ID NO: 7293591 - DNA, 22 bp, Homo sapiens
atcccaagtagcaatcctggta

SEQ ID NO: 7293592 - DNA, 22 bp, Homo sapiens
agaaatcattgaattatttgct

SEQ ID NO: 7293593 - DNA, 21 bp, Homo sapiens
agtttttactcttaactgtgg

SEQ ID NO: 7293594 - DNA, 21 bp, Homo sapiens
agtttttactcttaactgtgg

SEQ ID NO: 7293595 - DNA, 21 bp, Homo sapiens
agtttttactcttaactgtgg

SEQ ID NO: 7293596 - DNA, 23 bp, Homo sapiens
agtttttaatggtcatagctgag

SEQ ID NO: 7293597 - DNA, 22 bp, Homo sapiens
acttccagcccctgtcagcaaa

SEQ ID NO: 7293598 - DNA, 22 bp, Homo sapiens
acttccagatggccccatctaa

SEQ ID NO: 7293599 - DNA, 23 bp, Homo sapiens
acttttcaattagctatgcttaa

SEQ ID NO: 7293600 - DNA, 22 bp, Homo sapiens
actgcacagtcccagaggatgc

SEQ ID NO: 7293601 - DNA, 22 bp, Homo sapiens
actgcactcctgcctgggtaac

SEQ ID NO: 7293602 - DNA, 22 bp, Homo sapiens
actactgatgtaaaggagcaat

SEQ ID NO: 7293603 - DNA, 22 bp, Homo sapiens
agtacttttttgatatctgagt

SEQ ID NO: 7293604 - DNA, 22 bp, Homo sapiens
agtactttttgttcaattgtgc

SEQ ID NO: 7293605 - DNA, 22 bp, Homo sapiens
agagctgggaccgtctggaagt

SEQ ID NO: 7293606 - DNA, 22 bp, Homo sapiens
attacagcttgctcagtttgca

SEQ ID NO: 7293607 - DNA, 18 bp, Homo sapiens
agaggctggacaggggat

SEQ ID NO: 7293608 - DNA, 23 bp, Homo sapiens
agaggctgcagggtattgagaat

SEQ ID NO: 7293609 - DNA, 19 bp, Homo sapiens
agaggctgtcacctgtagc

SEQ ID NO: 7293610 - DNA, 22 bp, Homo sapiens
agagggcttccctaggagtgag

SEQ ID NO: 7293611 - DNA, 22 bp, Homo sapiens
agagggctgggatgtgctgtgt

SEQ ID NO: 7293612 - DNA, 22 bp, Homo sapiens
attttagttttagcatccatgc

SEQ ID NO: 7293613 - DNA, 20 bp, Homo sapiens
agcaacaataaaatgtcctg

SEQ ID NO: 7293614 - DNA, 17 bp, Homo sapiens
caaaccagtaagactgc

SEQ ID NO: 7293615 - DNA, 22 bp, Homo sapiens
agcaagaagctttgctgtgata

SEQ ID NO: 7293616 - DNA, 22 bp, Homo sapiens
agatattttgtgtgatgtttca

SEQ ID NO: 7293617 - DNA, 22 bp, Homo sapiens
agatatttgtatcttgctattg

SEQ ID NO: 7293618 - DNA, 22 bp, Homo sapiens
agatgattatgatagcactgtt

SEQ ID NO: 7293619 - DNA, 22 bp, Homo sapiens
agacaactgcagagcaaagaat

SEQ ID NO: 7293620 - DNA, 22 bp, Homo sapiens
agacaacatcactaaagctgag

SEQ ID NO: 7293621 - DNA, 22 bp, Homo sapiens
agacaacatgatcagcagtcct

SEQ ID NO: 7293622 - DNA, 22 bp, Homo sapiens
agacaacatctagtttggtgga

SEQ ID NO: 7293623 - DNA, 22 bp, Homo sapiens
agacacattttacattaactgt

SEQ ID NO: 7293624 - DNA, 22 bp, Homo sapiens
agaatcaattcactgctgcagc

SEQ ID NO: 7293625 - DNA, 22 bp, Homo sapiens
atgcctgtaatcccagtgcttt

SEQ ID NO: 7293626 - DNA, 22 bp, Homo sapiens
atgcctgtggagatatttaagg

SEQ ID NO: 7293627 - DNA, 22 bp, Homo sapiens
atgcctgtgctatattctcaca

SEQ ID NO: 7293628 - DNA, 22 bp, Homo sapiens
atgatacattgcaaaattttaa

SEQ ID NO: 7293629 - DNA, 22 bp, Homo sapiens
atgatatacttcctagaacagt

SEQ ID NO: 7293630 - DNA, 22 bp, Homo sapiens
atgcatttgtaaaatataatcg

SEQ ID NO: 7293631 - DNA, 22 bp, Homo sapiens
agagcagcacgttgtccccaca

SEQ ID NO: 7293632 - DNA, 22 bp, Homo sapiens
agagcaccccgggaagagcaag

SEQ ID NO: 7293633 - DNA, 22 bp, Homo sapiens
agagcacaggctcaccattgtt

SEQ ID NO: 7293634 - DNA, 21 bp, Homo sapiens
agagcacaggtggacaatgct

SEQ ID NO: 7293635 - DNA, 22 bp, Homo sapiens
agagcacaggtgctggagccca

SEQ ID NO: 7293636 - DNA, 22 bp, Homo sapiens
agagctggctggtagccctgat

SEQ ID NO: 7293637 - DNA, 22 bp, Homo sapiens
agagctggctgtgggtgacttt

SEQ ID NO: 7293638 - DNA, 21 bp, Homo sapiens
agagctggcctgccaggccct

SEQ ID NO: 7293639 - DNA, 22 bp, Homo sapiens
agagctggctgctgcggtgctt

SEQ ID NO: 7293640 - DNA, 22 bp, Homo sapiens
agagctggagcagccccactgg

SEQ ID NO: 7293641 - DNA, 22 bp, Homo sapiens
agagctggacgtctgagcccta

SEQ ID NO: 7293642 - DNA, 22 bp, Homo sapiens
agagctggcactgaccctcacc

SEQ ID NO: 7293643 - DNA, 21 bp, Homo sapiens
agagagaaggccatatggtcc

SEQ ID NO: 7293644 - DNA, 21 bp, Homo sapiens
agagacagagaaagtaacatt

SEQ ID NO: 7293645 - DNA, 22 bp, Homo sapiens
agagacaatgccaatgcacacg

SEQ ID NO: 7293646 - DNA, 22 bp, Homo sapiens
agagaattggagcagtgacagg

SEQ ID NO: 7293647 - DNA, 22 bp, Homo sapiens
agagaaaactcattgaggtgtc

SEQ ID NO: 7293648 - DNA, 23 bp, Homo sapiens
agagaaaaatatctgggcacatt

SEQ ID NO: 7293649 - DNA, 22 bp, Homo sapiens
agagaaaagagttcaggctttg

SEQ ID NO: 7293650 - DNA, 22 bp, Homo sapiens
agacttctcttggctatattat

SEQ ID NO: 7293651 - DNA, 18 bp, Homo sapiens
caatactgagaggtgggg

SEQ ID NO: 7293652 - DNA, 22 bp, Homo sapiens
caatactgagtttacattcatc

SEQ ID NO: 7293653 - DNA, 22 bp, Homo sapiens
caatacaattaccagttaatca

SEQ ID NO: 7293654 - DNA, 22 bp, Homo sapiens
caatacagcacacctgtatcag

SEQ ID NO: 7293655 - DNA, 22 bp, Homo sapiens
agcagcagaggtcagaaaggta

SEQ ID NO: 7293656 - DNA, 22 bp, Homo sapiens
agcagcagaggtcagaaaggta

SEQ ID NO: 7293657 - DNA, 23 bp, Homo sapiens
agcagccctgggacctggcctgc

SEQ ID NO: 7293658 - DNA, 22 bp, Homo sapiens
agcagcccagttgtactgagtg

SEQ ID NO: 7293659 - DNA, 22 bp, Homo sapiens
agcagcccagataaagctcagg

SEQ ID NO: 7293660 - DNA, 23 bp, Homo sapiens
agcagcccagatgccttccatcc

SEQ ID NO: 7293661 - DNA, 22 bp, Homo sapiens
agcagcccaggcaaagataaaa

SEQ ID NO: 7293662 - DNA, 22 bp, Homo sapiens
agcagcccgaggatcatgtgtc

SEQ ID NO: 7293663 - DNA, 22 bp, Homo sapiens
agcagcccctcggcgggtgcgc

SEQ ID NO: 7293664 - DNA, 22 bp, Homo sapiens
agcagccctagggattgctgtt

SEQ ID NO: 7293665 - DNA, 22 bp, Homo sapiens
agcagccctatgtaattggact

SEQ ID NO: 7293666 - DNA, 23 bp, Homo sapiens
agcagcccaatggcaagctctgg

SEQ ID NO: 7293667 - DNA, 22 bp, Homo sapiens
cacagagattagaattagacta

SEQ ID NO: 7293668 - DNA, 19 bp, Homo sapiens
agcagctggaggtggagtg

SEQ ID NO: 7293669 - DNA, 21 bp, Homo sapiens
cacagagatattggtgagcct

SEQ ID NO: 7293670 - DNA, 22 bp, Homo sapiens
cacagagatcggaacagaagta

SEQ ID NO: 7293671 - DNA, 22 bp, Homo sapiens
agcactggaaagttaagagttt

SEQ ID NO: 7293672 - DNA, 22 bp, Homo sapiens
agcactggagtttagtgggatt

SEQ ID NO: 7293673 - DNA, 22 bp, Homo sapiens
caagtgagtgaccagagttggt

SEQ ID NO: 7293674 - DNA, 22 bp, Homo sapiens
caagtgagcctcctctttttaa

SEQ ID NO: 7293675 - DNA, 22 bp, Homo sapiens
cactgtgggtcccagactggag

SEQ ID NO: 7293676 - DNA, 22 bp, Homo sapiens
cactgtggttattatcactgtt

SEQ ID NO: 7293677 - DNA, 22 bp, Homo sapiens
cactgtttggctcctgtactta

SEQ ID NO: 7293678 - DNA, 22 bp, Homo sapiens
agcatggtctgatcaggtggct

SEQ ID NO: 7293679 - DNA, 22 bp, Homo sapiens
agcatgcgcttgatcagctcca

SEQ ID NO: 7293680 - DNA, 22 bp, Homo sapiens
agcatgcttggcatttgtcaga

SEQ ID NO: 7293681 - DNA, 19 bp, Homo sapiens
agcagggagtggttgtggg

SEQ ID NO: 7293682 - DNA, 22 bp, Homo sapiens
agccctggcagagccaggtagt

SEQ ID NO: 7293683 - DNA, 22 bp, Homo sapiens
agccctggcagagccaggtagt

SEQ ID NO: 7293684 - DNA, 22 bp, Homo sapiens
agcccccacgtttcctgggtcc

SEQ ID NO: 7293685 - DNA, 22 bp, Homo sapiens
agcccccaaaagtgcttatgat

SEQ ID NO: 7293686 - DNA, 22 bp, Homo sapiens
agccccagttccctggaagtct

SEQ ID NO: 7293687 - DNA, 22 bp, Homo sapiens
cagatggctgccaagatgggct

SEQ ID NO: 7293688 - DNA, 22 bp, Homo sapiens
cagatggccagaggcagctgca

SEQ ID NO: 7293689 - DNA, 22 bp, Homo sapiens
cagatggcagggcagctctgca

SEQ ID NO: 7293690 - DNA, 22 bp, Homo sapiens
agccctgggcgttactgggatg

SEQ ID NO: 7293691 - DNA, 22 bp, Homo sapiens
agccctggctcccagcagcgct

SEQ ID NO: 7293692 - DNA, 22 bp, Homo sapiens
agcccagtgggccgaggcgggg

SEQ ID NO: 7293693 - DNA, 22 bp, Homo sapiens
agccccaggatgggccgcagga

SEQ ID NO: 7293694 - DNA, 22 bp, Homo sapiens
agccccaggatgggccgcagga

SEQ ID NO: 7293695 - DNA, 22 bp, Homo sapiens
agccccagcccctctctcacaa

SEQ ID NO: 7293696 - DNA, 22 bp, Homo sapiens
agcccaggttgaggctgcagtg

SEQ ID NO: 7293697 - DNA, 19 bp, Homo sapiens
agccagttggtaagaggct

SEQ ID NO: 7293698 - DNA, 22 bp, Homo sapiens
agccagtggaattcccaggggt

SEQ ID NO: 7293699 - DNA, 22 bp, Homo sapiens
agccagtgcagctggaaattca

SEQ ID NO: 7293700 - DNA, 20 bp, Homo sapiens
cagagacccaggcttcagct

SEQ ID NO: 7293701 - DNA, 22 bp, Homo sapiens
cagagacctgcccatttacgct

SEQ ID NO: 7293702 - DNA, 19 bp, Homo sapiens
cactttatttctgttttgt

SEQ ID NO: 7293703 - DNA, 22 bp, Homo sapiens
cactttcaagtttcagaggata

SEQ ID NO: 7293704 - DNA, 22 bp, Homo sapiens
agccagcccctgactgtgtcct

SEQ ID NO: 7293705 - DNA, 22 bp, Homo sapiens
agccagcaggtgggaaactgga

SEQ ID NO: 7293706 - DNA, 22 bp, Homo sapiens
cagatgtacatgaagggcaatg

SEQ ID NO: 7293707 - DNA, 22 bp, Homo sapiens
cagcaacttggacagcagtctt

SEQ ID NO: 7293708 - DNA, 22 bp, Homo sapiens
cagcaacatatatgaaactgtg

SEQ ID NO: 7293709 - DNA, 22 bp, Homo sapiens
agctactactaccaaactaaag

SEQ ID NO: 7293710 - DNA, 22 bp, Homo sapiens
agctactatgtgaaagccaggc

SEQ ID NO: 7293711 - DNA, 22 bp, Homo sapiens
agctactagggtgccagacatg

SEQ ID NO: 7293712 - DNA, 23 bp, Homo sapiens
agctactaggattcattcaccct

SEQ ID NO: 7293713 - DNA, 22 bp, Homo sapiens
agctaattagaaatagattatt

SEQ ID NO: 7293714 - DNA, 22 bp, Homo sapiens
agctacaaatgtatgtgctgat

SEQ ID NO: 7293715 - DNA, 22 bp, Homo sapiens
agctacaatcaatgtacatcat

SEQ ID NO: 7293716 - DNA, 22 bp, Homo sapiens
agctacaagtcatcagctatca

SEQ ID NO: 7293717 - DNA, 22 bp, Homo sapiens
agcctggtttaagcattttata

SEQ ID NO: 7293718 - DNA, 22 bp, Homo sapiens
agcctggtgatatcagtggttt

SEQ ID NO: 7293719 - DNA, 22 bp, Homo sapiens
agcctggtgtggggctgcagag

SEQ ID NO: 7293720 - DNA, 22 bp, Homo sapiens
acagaagcaaagactcaggcaa

SEQ ID NO: 7293721 - DNA, 22 bp, Homo sapiens
acagaagacagagtgttcatct

SEQ ID NO: 7293722 - DNA, 22 bp, Homo sapiens
acagagcttcccagcctgagca

SEQ ID NO: 7293723 - DNA, 22 bp, Homo sapiens
acagatgagactccaggacctt

SEQ ID NO: 7293724 - DNA, 22 bp, Homo sapiens
acagatgaatttatggatggaa

SEQ ID NO: 7293725 - DNA, 22 bp, Homo sapiens
aagcacatttggaaaacatgga

SEQ ID NO: 7293726 - DNA, 22 bp, Homo sapiens
aagcacatttggaaaacatgga

SEQ ID NO: 7293727 - DNA, 22 bp, Homo sapiens
aagcacatctcctgtgcagaac

SEQ ID NO: 7293728 - DNA, 22 bp, Homo sapiens
aagcacatctcaaacttcatct

SEQ ID NO: 7293729 - DNA, 22 bp, Homo sapiens
aagcacattaaggaacattgaa

SEQ ID NO: 7293730 - DNA, 22 bp, Homo sapiens
acacacagaaggaagccccact

SEQ ID NO: 7293731 - DNA, 22 bp, Homo sapiens
aatgtcaaagtgctttgcaaac

SEQ ID NO: 7293732 - DNA, 22 bp, Homo sapiens
aactccttaatgaagtccagtt

SEQ ID NO: 7293733 - DNA, 22 bp, Homo sapiens
aactctcagaacttttggtggg

SEQ ID NO: 7293734 - DNA, 22 bp, Homo sapiens
aactcttaattttcatgaaatg

SEQ ID NO: 7293735 - DNA, 22 bp, Homo sapiens
aatgttaattcacagccaaata

SEQ ID NO: 7293736 - DNA, 22 bp, Homo sapiens
aatgttaatgtgtttgcttatg

SEQ ID NO: 7293737 - DNA, 22 bp, Homo sapiens
aatgttaagtttagattataac

SEQ ID NO: 7293738 - DNA, 22 bp, Homo sapiens
aagaattggtttcctctgtcat

SEQ ID NO: 7293739 - DNA, 22 bp, Homo sapiens
aagacacaatgtagcccagcac

SEQ ID NO: 7293740 - DNA, 22 bp, Homo sapiens
aagacacacacatatgctgagt

SEQ ID NO: 7293741 - DNA, 22 bp, Homo sapiens
aagacacacacatatgctgagt

SEQ ID NO: 7293742 - DNA, 22 bp, Homo sapiens
aagacacacacatatgctgagt

SEQ ID NO: 7293743 - DNA, 22 bp, Homo sapiens
acaagaaccaaagaaggatatt

SEQ ID NO: 7293744 - DNA, 18 bp, Homo sapiens
aacagtttccagattctc

SEQ ID NO: 7293745 - DNA, 22 bp, Homo sapiens
aacagtttcagttactgatgag

SEQ ID NO: 7293746 - DNA, 22 bp, Homo sapiens
aacagtttcctgactcctatga

SEQ ID NO: 7293747 - DNA, 22 bp, Homo sapiens
aacagtttatgtaaatgtccag

SEQ ID NO: 7293748 - DNA, 22 bp, Homo sapiens
aacagtttgcctgaaatgtatt

SEQ ID NO: 7293749 - DNA, 22 bp, Homo sapiens
aacagtttgctttaagaggcac

SEQ ID NO: 7293750 - DNA, 22 bp, Homo sapiens
aacagtttctatgttagtggtt

SEQ ID NO: 7293751 - DNA, 22 bp, Homo sapiens
aacagtttgagctttgaatttc

SEQ ID NO: 7293752 - DNA, 22 bp, Homo sapiens
aagtatttcagcggttctttgt

SEQ ID NO: 7293753 - DNA, 22 bp, Homo sapiens
aagtatttcgttctgaaaaagt

SEQ ID NO: 7293754 - DNA, 22 bp, Homo sapiens
aagtatttctggcctgtgaaag

SEQ ID NO: 7293755 - DNA, 22 bp, Homo sapiens
aagtatttggaatggcattttt

SEQ ID NO: 7293756 - DNA, 22 bp, Homo sapiens
aatcacttcagtttttggacag

SEQ ID NO: 7293757 - DNA, 22 bp, Homo sapiens
aatcacttagaacccaggaagt

SEQ ID NO: 7293758 - DNA, 22 bp, Homo sapiens
aatcacttaatagctacactgg

SEQ ID NO: 7293759 - DNA, 22 bp, Homo sapiens
aatcactttgcactcttatttg

SEQ ID NO: 7293760 - DNA, 22 bp, Homo sapiens
aatcacttgtgccatgggtacc

SEQ ID NO: 7293761 - DNA, 22 bp, Homo sapiens
aatcacttgtaaggaattcaat

SEQ ID NO: 7293762 - DNA, 23 bp, Homo sapiens
aatcacttccctccaaatggatt

SEQ ID NO: 7293763 - DNA, 22 bp, Homo sapiens
aaccagctctgcaaaatgtcat

SEQ ID NO: 7293764 - DNA, 22 bp, Homo sapiens
aatcacttttctctaatgtagc

SEQ ID NO: 7293765 - DNA, 20 bp, Homo sapiens
aatcactttgtacaggaagc

SEQ ID NO: 7293766 - DNA, 22 bp, Homo sapiens
aaccatgacaaaccatagacat

SEQ ID NO: 7293767 - DNA, 22 bp, Homo sapiens
aatcacatgtgctcaattttaa

SEQ ID NO: 7293768 - DNA, 22 bp, Homo sapiens
aacagtttgtggatagcttgta

SEQ ID NO: 7293769 - DNA, 22 bp, Homo sapiens
aacagtttgggtaggtatgtag

SEQ ID NO: 7293770 - DNA, 22 bp, Homo sapiens
aacagtttttaaagctggcttc

SEQ ID NO: 7293771 - DNA, 17 bp, Homo sapiens
aacaataggatgtgtat

SEQ ID NO: 7293772 - DNA, 22 bp, Homo sapiens
aaggggaagtagcaccagaggt

SEQ ID NO: 7293773 - DNA, 22 bp, Homo sapiens
aagcccagatgagatccctgga

SEQ ID NO: 7293774 - DNA, 22 bp, Homo sapiens
aaggacatggaaggaggagata

SEQ ID NO: 7293775 - DNA, 22 bp, Homo sapiens
aaattagatcagtggattttct

SEQ ID NO: 7293776 - DNA, 22 bp, Homo sapiens
aaattaactatcacttttgtga

SEQ ID NO: 7293777 - DNA, 22 bp, Homo sapiens
aaggagaaggcatcattcaagt

SEQ ID NO: 7293778 - DNA, 22 bp, Homo sapiens
aaggaccagttttgcagaattg

SEQ ID NO: 7293779 - DNA, 22 bp, Homo sapiens
aaacaaagcatcttgctatgca

SEQ ID NO: 7293780 - DNA, 22 bp, Homo sapiens
aaaatagctatggaatgtcact

SEQ ID NO: 7293781 - DNA, 22 bp, Homo sapiens
aaacatgaatagatattaaaca

SEQ ID NO: 7293782 - DNA, 22 bp, Homo sapiens
aaacttgttctcttgtgcctat

SEQ ID NO: 7293783 - DNA, 22 bp, Homo sapiens
aaagatgagtccggcagacata

SEQ ID NO: 7293784 - DNA, 22 bp, Homo sapiens
aaagaagatggagacctgacta

SEQ ID NO: 7293785 - DNA, 22 bp, Homo sapiens
aaatcagttgttatattaaaga

SEQ ID NO: 7293786 - DNA, 22 bp, Homo sapiens
aaatcatagcccccatccgatt

SEQ ID NO: 7293787 - DNA, 22 bp, Homo sapiens
aaatatgttttccagttgtcat

SEQ ID NO: 7293788 - DNA, 22 bp, Homo sapiens
aaatggcaggctctttgctagt

SEQ ID NO: 7293789 - DNA, 22 bp, Homo sapiens
aaatggcagtagaaaagaatcc

SEQ ID NO: 7293790 - DNA, 22 bp, Homo sapiens
aaatgccttcaaacacttaagg

SEQ ID NO: 7293791 - DNA, 22 bp, Homo sapiens
aaatgcctgtgtaaattctagc

SEQ ID NO: 7293792 - DNA, 22 bp, Homo sapiens
aaatgcctctgctgtacacaat

SEQ ID NO: 7293793 - DNA, 22 bp, Homo sapiens
aaatgcctcccattctactgac

SEQ ID NO: 7293794 - DNA, 22 bp, Homo sapiens
aaatgcctcccaaacagcacaa

SEQ ID NO: 7293795 - DNA, 22 bp, Homo sapiens
aaatgcctagaaatcacgcaga

SEQ ID NO: 7293796 - DNA, 22 bp, Homo sapiens
aaatgcctcattttctctcact

SEQ ID NO: 7293797 - DNA, 22 bp, Homo sapiens
aaatactgttgaatgaagtaag

SEQ ID NO: 7293798 - DNA, 22 bp, Homo sapiens
aaatactgttttattccatgat

SEQ ID NO: 7293799 - DNA, 21 bp, Homo sapiens
aaatactgtcaaatggtgggt

SEQ ID NO: 7293800 - DNA, 22 bp, Homo sapiens
aaatactgtgaataaaggtttt

SEQ ID NO: 7293801 - DNA, 22 bp, Homo sapiens
aaatactgtctctgagagagcc

SEQ ID NO: 7293802 - DNA, 22 bp, Homo sapiens
aaatactgtccaccatggagca

SEQ ID NO: 7293803 - DNA, 22 bp, Homo sapiens
aagcagcaacaaactggataaa

SEQ ID NO: 7293804 - DNA, 22 bp, Homo sapiens
aagcagcaagtttatttctatc

SEQ ID NO: 7293805 - DNA, 22 bp, Homo sapiens
aagcagcataattgctatttta

SEQ ID NO: 7293806 - DNA, 22 bp, Homo sapiens
aagccagatagaagaactcatt

SEQ ID NO: 7293807 - DNA, 18 bp, Homo sapiens
aagccagagaccactgcc

SEQ ID NO: 7293808 - DNA, 22 bp, Homo sapiens
aagccacaatctgcatcagcat

SEQ ID NO: 7293809 - DNA, 22 bp, Homo sapiens
aagcaacattctctgtggcatt

SEQ ID NO: 7293810 - DNA, 22 bp, Homo sapiens
aagaatgattacaaagcaacga

SEQ ID NO: 7293811 - DNA, 22 bp, Homo sapiens
aagacagagggaagcaatgatg

SEQ ID NO: 7293812 - DNA, 17 bp, Homo sapiens
aagacagaagccatgag

SEQ ID NO: 7293813 - DNA, 22 bp, Homo sapiens
aagagccagtgggaaagtcttg

SEQ ID NO: 7293814 - DNA, 22 bp, Homo sapiens
aagagccagctagtgaagaggc

SEQ ID NO: 7293815 - DNA, 22 bp, Homo sapiens
aagagccatacaagtaaaagca

SEQ ID NO: 7293816 - DNA, 22 bp, Homo sapiens
aaagcacagggtgctagagagt

SEQ ID NO: 7293817 - DNA, 22 bp, Homo sapiens
aaagcacatagtagaaggattt

SEQ ID NO: 7293818 - DNA, 22 bp, Homo sapiens
aaagcacagagctcccacagga

SEQ ID NO: 7293819 - DNA, 22 bp, Homo sapiens
aaagcacattacaagctcagtc

SEQ ID NO: 7293820 - DNA, 22 bp, Homo sapiens
aaagcacatgagtagtgtagta

SEQ ID NO: 7293821 - DNA, 22 bp, Homo sapiens
aaagcacatgagtagtgtagta

SEQ ID NO: 7293822 - DNA, 22 bp, Homo sapiens
aaatggtgctactaggagtcag

SEQ ID NO: 7293823 - DNA, 22 bp, Homo sapiens
aaatggtgagggaattgaacag

SEQ ID NO: 7293824 - DNA, 22 bp, Homo sapiens
aaatggtgaagtgtaatttagc

SEQ ID NO: 7293825 - DNA, 22 bp, Homo sapiens
aacacataggcagagcatgaca

SEQ ID NO: 7293826 - DNA, 22 bp, Homo sapiens
aacacatatttatatatgcaca

SEQ ID NO: 7293827 - DNA, 20 bp, Homo sapiens
aactatgaatagaagagatt

SEQ ID NO: 7293828 - DNA, 22 bp, Homo sapiens
aacatttgtactaaagaagttc

SEQ ID NO: 7293829 - DNA, 22 bp, Homo sapiens
aacatttgcagaggaaagctat

SEQ ID NO: 7293830 - DNA, 21 bp, Homo sapiens
aacattagtaatttgactttt

SEQ ID NO: 7293831 - DNA, 22 bp, Homo sapiens
aacattagatttgtttttctag

SEQ ID NO: 7293832 - DNA, 22 bp, Homo sapiens
aagtgaaattgccattcttata

SEQ ID NO: 7293833 - DNA, 22 bp, Homo sapiens
aagtgcaggagtggggaaagta

SEQ ID NO: 7293834 - DNA, 22 bp, Homo sapiens
aagtgattttcttcttagttat

SEQ ID NO: 7293835 - DNA, 22 bp, Homo sapiens
aagtgattttcctacttgctaa

SEQ ID NO: 7293836 - DNA, 22 bp, Homo sapiens
aagtgatgctacgactttgaca

SEQ ID NO: 7293837 - DNA, 22 bp, Homo sapiens
aagtgattctagtcatgattct

SEQ ID NO: 7293838 - DNA, 22 bp, Homo sapiens
aagtgaggtttctgctttcaga

SEQ ID NO: 7293839 - DNA, 22 bp, Homo sapiens
aagtgaggcctaggcactgggt

SEQ ID NO: 7293840 - DNA, 22 bp, Homo sapiens
aagttttattggaacatagcca

SEQ ID NO: 7293841 - DNA, 22 bp, Homo sapiens
aataacagaaacttgagcatca

SEQ ID NO: 7293842 - DNA, 22 bp, Homo sapiens
aataaagtagcgtttaaggtgc

SEQ ID NO: 7293843 - DNA, 22 bp, Homo sapiens
aataaagaatggatgagatcgt

SEQ ID NO: 7293844 - DNA, 22 bp, Homo sapiens
actcatatactgttgtttttaa

SEQ ID NO: 7293845 - DNA, 22 bp, Homo sapiens
aatcttaaagaatattctacca

SEQ ID NO: 7293846 - DNA, 22 bp, Homo sapiens
aatatggcttgttactatgttt

SEQ ID NO: 7293847 - DNA, 22 bp, Homo sapiens
acttccagctttataattcagt

SEQ ID NO: 7293848 - DNA, 22 bp, Homo sapiens
acttccaggaggtgtcactgaa

SEQ ID NO: 7293849 - DNA, 22 bp, Homo sapiens
acttatttattcattcagctca

SEQ ID NO: 7293850 - DNA, 22 bp, Homo sapiens
actgtgggcctttcctttgacc

SEQ ID NO: 7293851 - DNA, 22 bp, Homo sapiens
actgtggagaaagaaagactgc

SEQ ID NO: 7293852 - DNA, 22 bp, Homo sapiens
acatgggacagagaaagaggcc

SEQ ID NO: 7293853 - DNA, 23 bp, Homo sapiens
acatgggaaatgcaaagagaagt

SEQ ID NO: 7293854 - DNA, 22 bp, Homo sapiens
acatgcattaaaaatacttgtg

SEQ ID NO: 7293855 - DNA, 22 bp, Homo sapiens
accacaggggaggaatgatgcc

SEQ ID NO: 7293856 - DNA, 22 bp, Homo sapiens
acaggctgccacttgcatccaa

SEQ ID NO: 7293857 - DNA, 22 bp, Homo sapiens
acaggctgaaagttaagttctg

SEQ ID NO: 7293858 - DNA, 22 bp, Homo sapiens
acaggcttttacggatatcttt

SEQ ID NO: 7293859 - DNA, 22 bp, Homo sapiens
agaattgttggggtaataaaag

SEQ ID NO: 7293860 - DNA, 22 bp, Homo sapiens
aatgtataaccataggaaattt

SEQ ID NO: 7293861 - DNA, 22 bp, Homo sapiens
agacactggtgaagaaatcagg

SEQ ID NO: 7293862 - DNA, 22 bp, Homo sapiens
agagaaatagattggtccagaa

SEQ ID NO: 7293863 - DNA, 22 bp, Homo sapiens
agagggctgctgcacagtgctc

SEQ ID NO: 7293864 - DNA, 22 bp, Homo sapiens
agagggctaaggtttgggagat

SEQ ID NO: 7293865 - DNA, 22 bp, Homo sapiens
aatttcaaagctcactggcata

SEQ ID NO: 7293866 - DNA, 22 bp, Homo sapiens
agagcagctgcattcagcacct

SEQ ID NO: 7293867 - DNA, 22 bp, Homo sapiens
agagcagctcgctacctctcta

SEQ ID NO: 7293868 - DNA, 22 bp, Homo sapiens
agatatacacccatatcacata

SEQ ID NO: 7293869 - DNA, 22 bp, Homo sapiens
aattttgttttagtggaggctg

SEQ ID NO: 7293870 - DNA, 22 bp, Homo sapiens
agagtacactgtacacacaatt

SEQ ID NO: 7293871 - DNA, 22 bp, Homo sapiens
agatataataatttacaagtgt

SEQ ID NO: 7293872 - DNA, 22 bp, Homo sapiens
agcccaggtggagtgtgtgggg

SEQ ID NO: 7293873 - DNA, 22 bp, Homo sapiens
acagacatgctgtttgggtggt

SEQ ID NO: 7293874 - DNA, 22 bp, Homo sapiens
agccctgggttagggtgggagc

SEQ ID NO: 7293875 - DNA, 22 bp, Homo sapiens
agcctgtgtgctttggacaggg

SEQ ID NO: 7293876 - DNA, 22 bp, Homo sapiens
agcctgtgttgctctggcgata

SEQ ID NO: 7293877 - DNA, 22 bp, Homo sapiens
agcctgtgacattgactatgaa

SEQ ID NO: 7293878 - DNA, 22 bp, Homo sapiens
agattttatagataatttccca

SEQ ID NO: 7293879 - DNA, 22 bp, Homo sapiens
acacacatggtattgttcagaa

SEQ ID NO: 7293880 - DNA, 22 bp, Homo sapiens
agatttgaaacttgcttcataa

SEQ ID NO: 7293881 - DNA, 22 bp, Homo sapiens
agcactttcctggcaaatgtgg

SEQ ID NO: 7293882 - DNA, 22 bp, Homo sapiens
agcacttatgtgattaggacag

SEQ ID NO: 7293883 - DNA, 22 bp, Homo sapiens
agcagcagattcagcaggaatg

SEQ ID NO: 7293884 - DNA, 23 bp, Homo sapiens
agcagccatagggaagcaataca

SEQ ID NO: 7293885 - DNA, 22 bp, Homo sapiens
agcagcccaaacagactaagac

SEQ ID NO: 7293886 - DNA, 22 bp, Homo sapiens
agcaggtgacagggctgtggtg

SEQ ID NO: 7293887 - DNA, 22 bp, Homo sapiens
agcaggtgacccaagcaggctg

SEQ ID NO: 7293888 - DNA, 22 bp, Homo sapiens
agcaggtgacccaagcaggctg

SEQ ID NO: 7293889 - DNA, 22 bp, Homo sapiens
tcaggaaatggaattcttgtgt

SEQ ID NO: 7293890 - DNA, 22 bp, Homo sapiens
tcaggaaagcctagaagagaac

SEQ ID NO: 7293891 - DNA, 23 bp, Homo sapiens
tcagcctcttaggacttctcacc

SEQ ID NO: 7293892 - DNA, 22 bp, Homo sapiens
tcagcccaaccctgcacaagga

SEQ ID NO: 7293893 - DNA, 22 bp, Homo sapiens
tcagcccaccttcaggggagtt

SEQ ID NO: 7293894 - DNA, 22 bp, Homo sapiens
tcagcctcctaatttcctgtga

SEQ ID NO: 7293895 - DNA, 22 bp, Homo sapiens
tcagcctctctgagtccagacc

SEQ ID NO: 7293896 - DNA, 22 bp, Homo sapiens
tcagcctccgaaagtgctggga

SEQ ID NO: 7293897 - DNA, 22 bp, Homo sapiens
tcagcctcaggtgttcagattt

SEQ ID NO: 7293898 - DNA, 22 bp, Homo sapiens
tcagcctcattttctgctctgt

SEQ ID NO: 7293899 - DNA, 23 bp, Homo sapiens
tcagagtagcaatttttctctcc

SEQ ID NO: 7293900 - DNA, 22 bp, Homo sapiens
tcatccatctttgatttcatag

SEQ ID NO: 7293901 - DNA, 22 bp, Homo sapiens
tcatccctaaggacagctctgc

SEQ ID NO: 7293902 - DNA, 22 bp, Homo sapiens
tcatctcagggcgacatcatgt

SEQ ID NO: 7293903 - DNA, 22 bp, Homo sapiens
tcatctcagagaggtatgttag

SEQ ID NO: 7293904 - DNA, 23 bp, Homo sapiens
tcatcaaacagctgctcaagaaa

SEQ ID NO: 7293905 - DNA, 22 bp, Homo sapiens
tcatccagtaccatggaaggca

SEQ ID NO: 7293906 - DNA, 22 bp, Homo sapiens
tcagttttcatttcatgagcag

SEQ ID NO: 7293907 - DNA, 22 bp, Homo sapiens
tcagttttcaatttcatcagag

SEQ ID NO: 7293908 - DNA, 19 bp, Homo sapiens
tcagttttagtcatcagtt

SEQ ID NO: 7293909 - DNA, 22 bp, Homo sapiens
tcagtttttgtttgccagatag

SEQ ID NO: 7293910 - DNA, 22 bp, Homo sapiens
tcactggattctcttttgttcc

SEQ ID NO: 7293911 - DNA, 22 bp, Homo sapiens
tcacatgaagatccctcaattt

SEQ ID NO: 7293912 - DNA, 22 bp, Homo sapiens
tcacatgcagtcactgagcagg

SEQ ID NO: 7293913 - DNA, 22 bp, Homo sapiens
tcaccttgtgatctccctgcct

SEQ ID NO: 7293914 - DNA, 23 bp, Homo sapiens
tcagagagctgttgagagctgcc

SEQ ID NO: 7293915 - DNA, 19 bp, Homo sapiens
tcagaggatttggctatga

SEQ ID NO: 7293916 - DNA, 22 bp, Homo sapiens
tcacatcacatgagtgcaagga

SEQ ID NO: 7293917 - DNA, 22 bp, Homo sapiens
tcacatcacatgacagtaggcc

SEQ ID NO: 7293918 - DNA, 17 bp, Homo sapiens
tcacatcacacaagcaa

SEQ ID NO: 7293919 - DNA, 22 bp, Homo sapiens
tcacagcaggcagatattgttg

SEQ ID NO: 7293920 - DNA, 22 bp, Homo sapiens
tcacagcaccaggatctctcca

SEQ ID NO: 7293921 - DNA, 22 bp, Homo sapiens
tcacagcattgagtgtactaga

SEQ ID NO: 7293922 - DNA, 22 bp, Homo sapiens
tcacagcatttttagaaagatt

SEQ ID NO: 7293923 - DNA, 19 bp, Homo sapiens
tcacagcatctgtctgaac

SEQ ID NO: 7293924 - DNA, 22 bp, Homo sapiens
tcacacatactcatgtgtgagt

SEQ ID NO: 7293925 - DNA, 20 bp, Homo sapiens
tcacacataagtgaacgcac

SEQ ID NO: 7293926 - DNA, 22 bp, Homo sapiens
tcacagcaaatgctgcttctca

SEQ ID NO: 7293927 - DNA, 22 bp, Homo sapiens
tcacagcaaaagtgtgcagagc

SEQ ID NO: 7293928 - DNA, 22 bp, Homo sapiens
tcacagcaaaagtgtgcagagc

SEQ ID NO: 7293929 - DNA, 20 bp, Homo sapiens
tcacagatgaaagttcaaga

SEQ ID NO: 7293930 - DNA, 22 bp, Homo sapiens
tcacagacatggtgaggtaaca

SEQ ID NO: 7293931 - DNA, 22 bp, Homo sapiens
tcacagacacattaaacatgtg

SEQ ID NO: 7293932 - DNA, 22 bp, Homo sapiens
tcacagacagaagggatgggat

SEQ ID NO: 7293933 - DNA, 22 bp, Homo sapiens
tcaatgatagtacaatcagcct

SEQ ID NO: 7293934 - DNA, 21 bp, Homo sapiens
tcaatacaggtgcatgtgtct

SEQ ID NO: 7293935 - DNA, 22 bp, Homo sapiens
tcaatacttggcacactgcaca

SEQ ID NO: 7293936 - DNA, 22 bp, Homo sapiens
tcaatacttaagcttaattcta

SEQ ID NO: 7293937 - DNA, 22 bp, Homo sapiens
tcaatactcacaaagagatttt

SEQ ID NO: 7293938 - DNA, 22 bp, Homo sapiens
tcaatactatgattttgtacat

SEQ ID NO: 7293939 - DNA, 22 bp, Homo sapiens
tcaatactaatcttgctggaag

SEQ ID NO: 7293940 - DNA, 22 bp, Homo sapiens
tccaggccactgcagaggctct

SEQ ID NO: 7293941 - DNA, 19 bp, Homo sapiens
tccaggccattcccagagc

SEQ ID NO: 7293942 - DNA, 22 bp, Homo sapiens
tccaggcccactcagctgaaat

SEQ ID NO: 7293943 - DNA, 22 bp, Homo sapiens
tccagggacagtatagaggatc

SEQ ID NO: 7293944 - DNA, 22 bp, Homo sapiens
tccagtggcactggagactaga

SEQ ID NO: 7293945 - DNA, 22 bp, Homo sapiens
tccagtggtacatggagacact

SEQ ID NO: 7293946 - DNA, 20 bp, Homo sapiens
tccagtggcctgaatctgga

SEQ ID NO: 7293947 - DNA, 22 bp, Homo sapiens
tccagggatggtaatgagcagt

SEQ ID NO: 7293948 - DNA, 22 bp, Homo sapiens
tcccaggaaaacactcgaggac

SEQ ID NO: 7293949 - DNA, 21 bp, Homo sapiens
tccagttgagactgaagatct

SEQ ID NO: 7293950 - DNA, 20 bp, Homo sapiens
tccagtgtctctctggtgga

SEQ ID NO: 7293951 - DNA, 22 bp, Homo sapiens
tccagtgtggaggtgaccaact

SEQ ID NO: 7293952 - DNA, 22 bp, Homo sapiens
tcccagaagtccagccatgggc

SEQ ID NO: 7293953 - DNA, 22 bp, Homo sapiens
tcccagaatggcccagctgccc

SEQ ID NO: 7293954 - DNA, 22 bp, Homo sapiens
tccaggagaaggccatccagcg

SEQ ID NO: 7293955 - DNA, 20 bp, Homo sapiens
tccaggagaactgggagccg

SEQ ID NO: 7293956 - DNA, 22 bp, Homo sapiens
tccaggaggaggaaggctgcca

SEQ ID NO: 7293957 - DNA, 22 bp, Homo sapiens
tccacgtgagcttcgtgtgcag

SEQ ID NO: 7293958 - DNA, 22 bp, Homo sapiens
tccacgctgtgtgaccttgggc

SEQ ID NO: 7293959 - DNA, 22 bp, Homo sapiens
tcctcccctgcccatgaggagg

SEQ ID NO: 7293960 - DNA, 22 bp, Homo sapiens
tcccttgaacgctggggctgga

SEQ ID NO: 7293961 - DNA, 22 bp, Homo sapiens
tcccttgagagttggccaattg

SEQ ID NO: 7293962 - DNA, 23 bp, Homo sapiens
tccctgtgtacagcctgcatgag

SEQ ID NO: 7293963 - DNA, 22 bp, Homo sapiens
gtttcttaaatgtagcaggacc

SEQ ID NO: 7293964 - DNA, 22 bp, Homo sapiens
gttccacatcacactacttgat

SEQ ID NO: 7293965 - DNA, 22 bp, Homo sapiens
gttccacaaagattgtctctct

SEQ ID NO: 7293966 - DNA, 22 bp, Homo sapiens
gtttagaaaatagtgaagcaag

SEQ ID NO: 7293967 - DNA, 22 bp, Homo sapiens
gtgttagcagtggagtggacac

SEQ ID NO: 7293968 - DNA, 22 bp, Homo sapiens
gtgtgtgtatctgcctatcaca

SEQ ID NO: 7293969 - DNA, 22 bp, Homo sapiens
gtgtgtgtctccgcggccgtag

SEQ ID NO: 7293970 - DNA, 22 bp, Homo sapiens
gtgtgtgtgcatataacatata

SEQ ID NO: 7293971 - DNA, 22 bp, Homo sapiens
gtgtgtgtgcctgcacacacac

SEQ ID NO: 7293972 - DNA, 22 bp, Homo sapiens
gtgtgtgtgcatctcttttatt

SEQ ID NO: 7293973 - DNA, 22 bp, Homo sapiens
gtgtgtgtgtaaaaatccagag

SEQ ID NO: 7293974 - DNA, 22 bp, Homo sapiens
gtgtgtgttcaataaatttaag

SEQ ID NO: 7293975 - DNA, 22 bp, Homo sapiens
taacttctgaatagcaatagta

SEQ ID NO: 7293976 - DNA, 22 bp, Homo sapiens
taacttctctgctatcatagga

SEQ ID NO: 7293977 - DNA, 22 bp, Homo sapiens
taaagacaatttcgagctgtag

SEQ ID NO: 7293978 - DNA, 22 bp, Homo sapiens
taaagacactggttttaatcat

SEQ ID NO: 7293979 - DNA, 22 bp, Homo sapiens
taaagacacccagggagggact

SEQ ID NO: 7293980 - DNA, 22 bp, Homo sapiens
taaagacaaacccactagggtt

SEQ ID NO: 7293981 - DNA, 22 bp, Homo sapiens
taaagacaataggaaagttgtt

SEQ ID NO: 7293982 - DNA, 22 bp, Homo sapiens
taaagacaaatgacattacggc

SEQ ID NO: 7293983 - DNA, 22 bp, Homo sapiens
gttttatttccatgagagaccg

SEQ ID NO: 7293984 - DNA, 22 bp, Homo sapiens
gttttattggaacacagccatg

SEQ ID NO: 7293985 - DNA, 22 bp, Homo sapiens
gttttataggctgttgctatat

SEQ ID NO: 7293986 - DNA, 22 bp, Homo sapiens
gttttataattgcttcataaga

SEQ ID NO: 7293987 - DNA, 22 bp, Homo sapiens
gttttagtgtaacggagtgtga

SEQ ID NO: 7293988 - DNA, 22 bp, Homo sapiens
taaacagaattcaggcaagata

SEQ ID NO: 7293989 - DNA, 22 bp, Homo sapiens
tacaatgctgtgcatgtaatgg

SEQ ID NO: 7293990 - DNA, 22 bp, Homo sapiens
tacaatgaccatattatgtaag

SEQ ID NO: 7293991 - DNA, 22 bp, Homo sapiens
taatttcttcatctctgcagct

SEQ ID NO: 7293992 - DNA, 22 bp, Homo sapiens
taatttcaatagcttgcataat

SEQ ID NO: 7293993 - DNA, 22 bp, Homo sapiens
taatttcaccgttgctagaaat

SEQ ID NO: 7293994 - DNA, 22 bp, Homo sapiens
taatttcagtgcaagctcacgg

SEQ ID NO: 7293995 - DNA, 22 bp, Homo sapiens
taatgaatgagaatataacaga

SEQ ID NO: 7293996 - DNA, 22 bp, Homo sapiens
taatgatgctagatttatctgg

SEQ ID NO: 7293997 - DNA, 18 bp, Homo sapiens
taagcaatgacattgcaa

SEQ ID NO: 7293998 - DNA, 22 bp, Homo sapiens
taagttttctggaataacttgg

SEQ ID NO: 7293999 - DNA, 19 bp, Homo sapiens
tactaaacatgcatattgg

SEQ ID NO: 7294000 - DNA, 22 bp, Homo sapiens
tactgagtaccaagcattgtgt

SEQ ID NO: 7294001 - DNA, 22 bp, Homo sapiens
tacagcagagtgggatgcatct

SEQ ID NO: 7294002 - DNA, 22 bp, Homo sapiens
tacagtttttcactgaagatgt

SEQ ID NO: 7294003 - DNA, 22 bp, Homo sapiens
tacagtttttattcatgacaag

SEQ ID NO: 7294004 - DNA, 22 bp, Homo sapiens
tacagttttggtgatgatgatg

SEQ ID NO: 7294005 - DNA, 22 bp, Homo sapiens
tagccatgttgttaaaagacaa

SEQ ID NO: 7294006 - DNA, 22 bp, Homo sapiens
taggacacattgaagtgaaggc

SEQ ID NO: 7294007 - DNA, 22 bp, Homo sapiens
tagtatagattgaagcagatca

SEQ ID NO: 7294008 - DNA, 22 bp, Homo sapiens
tagtatatctttagtacatagt

SEQ ID NO: 7294009 - DNA, 22 bp, Homo sapiens
tagtgtaaataactgcctagac

SEQ ID NO: 7294010 - DNA, 22 bp, Homo sapiens
tagtggatgttcagagatttga

SEQ ID NO: 7294011 - DNA, 22 bp, Homo sapiens
tagccaaagaaggtatatttgt

SEQ ID NO: 7294012 - DNA, 22 bp, Homo sapiens
tagcattttagctgttttctct

SEQ ID NO: 7294013 - DNA, 22 bp, Homo sapiens
tagccatgtgtggaacacagcc

SEQ ID NO: 7294014 - DNA, 22 bp, Homo sapiens
tagcacaagaagtacacataga

SEQ ID NO: 7294015 - DNA, 22 bp, Homo sapiens
tagcacagggcatatgcggtgg

SEQ ID NO: 7294016 - DNA, 17 bp, Homo sapiens
tagcacagtgcctggta

SEQ ID NO: 7294017 - DNA, 18 bp, Homo sapiens
tagcacagagcaggatgt

SEQ ID NO: 7294018 - DNA, 22 bp, Homo sapiens
tagcacagcttcttgatgtcac

SEQ ID NO: 7294019 - DNA, 22 bp, Homo sapiens
tagattttttggagactctctg

SEQ ID NO: 7294020 - DNA, 22 bp, Homo sapiens
tagattttacttctgtcattac

SEQ ID NO: 7294021 - DNA, 22 bp, Homo sapiens
tactttcatgggttttctttat

SEQ ID NO: 7294022 - DNA, 22 bp, Homo sapiens
tagagcacagtttcagggtgta

SEQ ID NO: 7294023 - DNA, 22 bp, Homo sapiens
tagagcattaagtattgttgtt

SEQ ID NO: 7294024 - DNA, 22 bp, Homo sapiens
tatactctgagaaacgtgtcac

SEQ ID NO: 7294025 - DNA, 22 bp, Homo sapiens
tagtgtcagggagtgataaatg

SEQ ID NO: 7294026 - DNA, 23 bp, Homo sapiens
tagtgtcatcctcagcttctgtt

SEQ ID NO: 7294027 - DNA, 22 bp, Homo sapiens
tatattatcataaaaccattca

SEQ ID NO: 7294028 - DNA, 18 bp, Homo sapiens
tatatttcacacatattc

SEQ ID NO: 7294029 - DNA, 18 bp, Homo sapiens
tatatttcacacatattc

SEQ ID NO: 7294030 - DNA, 22 bp, Homo sapiens
tatatttgctaaatgtgtgcaa

SEQ ID NO: 7294031 - DNA, 19 bp, Homo sapiens
tatatttgagtgtgcatgc

SEQ ID NO: 7294032 - DNA, 22 bp, Homo sapiens
tatgcatatatcacgtgcatgc

SEQ ID NO: 7294033 - DNA, 22 bp, Homo sapiens
tatgcatatgtgttcattggag

SEQ ID NO: 7294034 - DNA, 22 bp, Homo sapiens
tatgcatataaatgtgtgaatt

SEQ ID NO: 7294035 - DNA, 22 bp, Homo sapiens
tatgcatagtggaattagcaaa

SEQ ID NO: 7294036 - DNA, 22 bp, Homo sapiens
tatgcataattggataagtaga

SEQ ID NO: 7294037 - DNA, 22 bp, Homo sapiens
tatgcacagttacaagaatatc

SEQ ID NO: 7294038 - DNA, 22 bp, Homo sapiens
tatgcacattcacacaaaaatg

SEQ ID NO: 7294039 - DNA, 22 bp, Homo sapiens
tatcttgagagacaacacagca

SEQ ID NO: 7294040 - DNA, 22 bp, Homo sapiens
tatgcctacctccaaaatatat

SEQ ID NO: 7294041 - DNA, 22 bp, Homo sapiens
tatgctagatggaaaaatattg

SEQ ID NO: 7294042 - DNA, 22 bp, Homo sapiens
tatgctactagaaataaaatgg

SEQ ID NO: 7294043 - DNA, 19 bp, Homo sapiens
tatgttatgttgtttactc

SEQ ID NO: 7294044 - DNA, 22 bp, Homo sapiens
tattcacaggcacgaaatattg

SEQ ID NO: 7294045 - DNA, 22 bp, Homo sapiens
tattgtacatttcaaagtagct

SEQ ID NO: 7294046 - DNA, 22 bp, Homo sapiens
tattgtacatttcaaaattgct

SEQ ID NO: 7294047 - DNA, 22 bp, Homo sapiens
tatttcagggagaataaatttg

SEQ ID NO: 7294048 - DNA, 22 bp, Homo sapiens
tatttcaggctatatttcttgt

SEQ ID NO: 7294049 - DNA, 22 bp, Homo sapiens
tatttcagagttgttttctgtc

SEQ ID NO: 7294050 - DNA, 22 bp, Homo sapiens
tattgtactgaggaataaagct

SEQ ID NO: 7294051 - DNA, 22 bp, Homo sapiens
tatttcaagaacttctatccat

SEQ ID NO: 7294052 - DNA, 22 bp, Homo sapiens
tatttctaagagatatctgtac

SEQ ID NO: 7294053 - DNA, 22 bp, Homo sapiens
tattttcaccttctctggatat

SEQ ID NO: 7294054 - DNA, 22 bp, Homo sapiens
tatttgttgcgggaattgctat

SEQ ID NO: 7294055 - DNA, 22 bp, Homo sapiens
tatttgttgagttgttatgtct

SEQ ID NO: 7294056 - DNA, 22 bp, Homo sapiens
gtgcctcccggggctcttcctt

SEQ ID NO: 7294057 - DNA, 22 bp, Homo sapiens
gtgcctccatcagtgcctccaa

SEQ ID NO: 7294058 - DNA, 22 bp, Homo sapiens
gtgcctcccgggaccatgcact

SEQ ID NO: 7294059 - DNA, 22 bp, Homo sapiens
gtgcaatgaaactgttttgtgg

SEQ ID NO: 7294060 - DNA, 22 bp, Homo sapiens
gtgaggtcctgagaggcttgtg

SEQ ID NO: 7294061 - DNA, 22 bp, Homo sapiens
gtgaggtgactagcaggtgggg

SEQ ID NO: 7294062 - DNA, 22 bp, Homo sapiens
gtcttctttaacctactaaagc

SEQ ID NO: 7294063 - DNA, 22 bp, Homo sapiens
gtgatgagagaaccaggacctt

SEQ ID NO: 7294064 - DNA, 22 bp, Homo sapiens
gtgagtcttaagcaccaccttt

SEQ ID NO: 7294065 - DNA, 22 bp, Homo sapiens
gtcttatttaaagagatcatac

SEQ ID NO: 7294066 - DNA, 22 bp, Homo sapiens
gtcttattatgaggttagactt

SEQ ID NO: 7294067 - DNA, 22 bp, Homo sapiens
gtcttattaaaatgcagtttct

SEQ ID NO: 7294068 - DNA, 22 bp, Homo sapiens
gtctctctgctaggcctccagt

SEQ ID NO: 7294069 - DNA, 22 bp, Homo sapiens
gtctctctgactggtccacacc

SEQ ID NO: 7294070 - DNA, 22 bp, Homo sapiens
gtctctatcatagctgaaccct

SEQ ID NO: 7294071 - DNA, 22 bp, Homo sapiens
gtctcccatgtccctgtccagt

SEQ ID NO: 7294072 - DNA, 22 bp, Homo sapiens
gtctcccactttctggcctctt

SEQ ID NO: 7294073 - DNA, 22 bp, Homo sapiens
gtcacattcatgcagaatcaaa

SEQ ID NO: 7294074 - DNA, 22 bp, Homo sapiens
gtcacagtgtcctacaggttga

SEQ ID NO: 7294075 - DNA, 22 bp, Homo sapiens
gtcacagtgtatctcttcagct

SEQ ID NO: 7294076 - DNA, 23 bp, Homo sapiens
gtcacagtgggtggtgcctacat

SEQ ID NO: 7294077 - DNA, 22 bp, Homo sapiens
gtcacagtggggtcacagtgtg

SEQ ID NO: 7294078 - DNA, 22 bp, Homo sapiens
gtcacagtgctcccaaagtttg

SEQ ID NO: 7294079 - DNA, 22 bp, Homo sapiens
gtcacagtgcctgccactcaga

SEQ ID NO: 7294080 - DNA, 22 bp, Homo sapiens
gtcacagtgcctgaagctctga

SEQ ID NO: 7294081 - DNA, 22 bp, Homo sapiens
gtcacagtgccctggtggtgtt

SEQ ID NO: 7294082 - DNA, 22 bp, Homo sapiens
gtcacagtgacagagatgttag

SEQ ID NO: 7294083 - DNA, 22 bp, Homo sapiens
gtcacagtcaaggccatgggca

SEQ ID NO: 7294084 - DNA, 22 bp, Homo sapiens
gtcacagtatcatgtttgaatg

SEQ ID NO: 7294085 - DNA, 22 bp, Homo sapiens
gtcataaaatttgtggattaga

SEQ ID NO: 7294086 - DNA, 22 bp, Homo sapiens
gtcataaaaggaccacctattg

SEQ ID NO: 7294087 - DNA, 22 bp, Homo sapiens
gtcattcaaactgtatcacttg

SEQ ID NO: 7294088 - DNA, 22 bp, Homo sapiens
gtcagtggtgcttaaagtttca

SEQ ID NO: 7294089 - DNA, 22 bp, Homo sapiens
gtaaatcagtgtcattttagaa

SEQ ID NO: 7294090 - DNA, 22 bp, Homo sapiens
gtaaattatttcaagatcatct

SEQ ID NO: 7294091 - DNA, 22 bp, Homo sapiens
gtaaatcatggtcagaataaat

SEQ ID NO: 7294092 - DNA, 22 bp, Homo sapiens
gtcaacagagacagagacactg

SEQ ID NO: 7294093 - DNA, 22 bp, Homo sapiens
gtcaacagtattaggacatttg

SEQ ID NO: 7294094 - DNA, 21 bp, Homo sapiens
gggggaagaggagttgctagt

SEQ ID NO: 7294095 - DNA, 22 bp, Homo sapiens
ggggatggattccgggtccctg

SEQ ID NO: 7294096 - DNA, 22 bp, Homo sapiens
ggtgccaggctgtagtcagggt

SEQ ID NO: 7294097 - DNA, 20 bp, Homo sapiens
ggtgcaggtaacgctgtgct

SEQ ID NO: 7294098 - DNA, 22 bp, Homo sapiens
ggtgcagggagaggcaggcccc

SEQ ID NO: 7294099 - DNA, 22 bp, Homo sapiens
ggtcagggggatctgtgaggta

SEQ ID NO: 7294100 - DNA, 22 bp, Homo sapiens
ggtccagggggtagatatgtga

SEQ ID NO: 7294101 - DNA, 22 bp, Homo sapiens
ggagttgattttggatatatta

SEQ ID NO: 7294102 - DNA, 21 bp, Homo sapiens
ggcagaagtagcatggacggg

SEQ ID NO: 7294103 - DNA, 17 bp, Homo sapiens
ggcaggtgacagacacc

SEQ ID NO: 7294104 - DNA, 18 bp, Homo sapiens
ggcaggagcaagaatagg

SEQ ID NO: 7294105 - DNA, 22 bp, Homo sapiens
ggcaggagaatggcgtgaactc

SEQ ID NO: 7294106 - DNA, 22 bp, Homo sapiens
ggcaggagctctccagtttgcc

SEQ ID NO: 7294107 - DNA, 22 bp, Homo sapiens
ggcaggggtggccttcctttgg

SEQ ID NO: 7294108 - DNA, 18 bp, Homo sapiens
ggcaggggtgaaccacag

SEQ ID NO: 7294109 - DNA, 22 bp, Homo sapiens
ggcatgcatcaccacgccacgc

SEQ ID NO: 7294110 - DNA, 22 bp, Homo sapiens
ggccaggagatggacaccacat

SEQ ID NO: 7294111 - DNA, 22 bp, Homo sapiens
gggcacagtctaaagttgggcc

SEQ ID NO: 7294112 - DNA, 22 bp, Homo sapiens
gggcagtagcttcgtaggcatc

SEQ ID NO: 7294113 - DNA, 22 bp, Homo sapiens
gggaggttctgttcgcacttga

SEQ ID NO: 7294114 - DNA, 21 bp, Homo sapiens
ggctgtgacgctgctccacag

SEQ ID NO: 7294115 - DNA, 22 bp, Homo sapiens
ggctgtgacccccacaggggtg

SEQ ID NO: 7294116 - DNA, 22 bp, Homo sapiens
ggctggtggggaaagaggacca

SEQ ID NO: 7294117 - DNA, 22 bp, Homo sapiens
ggctggactttttgcaggtcat

SEQ ID NO: 7294118 - DNA, 22 bp, Homo sapiens
ggctctggggttggcccatctc

SEQ ID NO: 7294119 - DNA, 22 bp, Homo sapiens
ggctagcttagagtcatgctag

SEQ ID NO: 7294120 - DNA, 22 bp, Homo sapiens
ggctacactggctatgctggct

SEQ ID NO: 7294121 - DNA, 22 bp, Homo sapiens
gcctggtggtgtgctcaagtgg

SEQ ID NO: 7294122 - DNA, 22 bp, Homo sapiens
gcctggtgtccagaggcgagtg

SEQ ID NO: 7294123 - DNA, 22 bp, Homo sapiens
gcctggtgataagcagtgacct

SEQ ID NO: 7294124 - DNA, 22 bp, Homo sapiens
gcctggtgaaaggcagagagcg

SEQ ID NO: 7294125 - DNA, 22 bp, Homo sapiens
gctcacagttctatttttcatg

SEQ ID NO: 7294126 - DNA, 22 bp, Homo sapiens
gctcacaggtctgtggctattg

SEQ ID NO: 7294127 - DNA, 22 bp, Homo sapiens
gcggggggaggaacatcttgca

SEQ ID NO: 7294128 - DNA, 22 bp, Homo sapiens
gccttgcaggaaggagggacag

SEQ ID NO: 7294129 - DNA, 22 bp, Homo sapiens
gcgccctccacccacagcggct

SEQ ID NO: 7294130 - DNA, 22 bp, Homo sapiens
gcgcgtcctccctcggctgctg

SEQ ID NO: 7294131 - DNA, 22 bp, Homo sapiens
gctgcacatggcagaggccttt

SEQ ID NO: 7294132 - DNA, 19 bp, Homo sapiens
gctgggtggggtccacagc

SEQ ID NO: 7294133 - DNA, 22 bp, Homo sapiens
gcttcctccctgctgctcacta

SEQ ID NO: 7294134 - DNA, 22 bp, Homo sapiens
gcttccggagccaaaaggcccc

SEQ ID NO: 7294135 - DNA, 22 bp, Homo sapiens
ggaagcaggaggctggggtaaa

SEQ ID NO: 7294136 - DNA, 19 bp, Homo sapiens
ggaagccaggtcagcccac

SEQ ID NO: 7294137 - DNA, 22 bp, Homo sapiens
ggaagccaggctgggggatctg

SEQ ID NO: 7294138 - DNA, 22 bp, Homo sapiens
ggacagagccctggtggcctaa

SEQ ID NO: 7294139 - DNA, 22 bp, Homo sapiens
ggacccaccaggccgggctcca

SEQ ID NO: 7294140 - DNA, 23 bp, Homo sapiens
ggacccacggtctttgaggctct

SEQ ID NO: 7294141 - DNA, 22 bp, Homo sapiens
gagggggaaagtccctggagtc

SEQ ID NO: 7294142 - DNA, 22 bp, Homo sapiens
gcacttaactggaaaagaattt

SEQ ID NO: 7294143 - DNA, 22 bp, Homo sapiens
gcagagctgagcggctgcccgg

SEQ ID NO: 7294144 - DNA, 22 bp, Homo sapiens
gcactgagagctttattctaga

SEQ ID NO: 7294145 - DNA, 22 bp, Homo sapiens
gcactgagtctgtcatgctgca

SEQ ID NO: 7294146 - DNA, 22 bp, Homo sapiens
gcactgagcattgttatttcca

SEQ ID NO: 7294147 - DNA, 19 bp, Homo sapiens
gcaggcctcttgggaatta

SEQ ID NO: 7294148 - DNA, 22 bp, Homo sapiens
gcaggctgagagtccaagaagg

SEQ ID NO: 7294149 - DNA, 22 bp, Homo sapiens
gcaggaggatcacttgagccca

SEQ ID NO: 7294150 - DNA, 22 bp, Homo sapiens
gcagcatgttgaaagggccaca

SEQ ID NO: 7294151 - DNA, 22 bp, Homo sapiens
gcagcatggagttgtggaatga

SEQ ID NO: 7294152 - DNA, 22 bp, Homo sapiens
gcatttttgatcccactaggat

SEQ ID NO: 7294153 - DNA, 22 bp, Homo sapiens
gccaaaactcccatattttaat

SEQ ID NO: 7294154 - DNA, 19 bp, Homo sapiens
gcagggctctcccagatgc

SEQ ID NO: 7294155 - DNA, 22 bp, Homo sapiens
gcataaaggactataaggatca

SEQ ID NO: 7294156 - DNA, 22 bp, Homo sapiens
gcatccttgggcccagctcctg

SEQ ID NO: 7294157 - DNA, 22 bp, Homo sapiens
gcatccttttttcctgccctgc

SEQ ID NO: 7294158 - DNA, 22 bp, Homo sapiens
gcatttggaattgtgtatagaa

SEQ ID NO: 7294159 - DNA, 22 bp, Homo sapiens
gcccagtgtctaggaggtgaac

SEQ ID NO: 7294160 - DNA, 22 bp, Homo sapiens
gcccagggcagggcaagagtga

SEQ ID NO: 7294161 - DNA, 22 bp, Homo sapiens
gccctgagaagaagtcggaggg

SEQ ID NO: 7294162 - DNA, 22 bp, Homo sapiens
gccaggactgagaatgggagca

SEQ ID NO: 7294163 - DNA, 22 bp, Homo sapiens
gccaggacctcagatgcagggc

SEQ ID NO: 7294164 - DNA, 22 bp, Homo sapiens
gccaggacctcccagagctttc

SEQ ID NO: 7294165 - DNA, 22 bp, Homo sapiens
gccaggactcttcctagaaggt

SEQ ID NO: 7294166 - DNA, 22 bp, Homo sapiens
gccaggactagagggaggtgag

SEQ ID NO: 7294167 - DNA, 22 bp, Homo sapiens
gccaggagaaaaggcgaatgat

SEQ ID NO: 7294168 - DNA, 22 bp, Homo sapiens
gccaggcacagttctaggtgct

SEQ ID NO: 7294169 - DNA, 22 bp, Homo sapiens
gccaggttgctgacgacgatct

SEQ ID NO: 7294170 - DNA, 22 bp, Homo sapiens
gcccagaacagtgtcacatgtc

SEQ ID NO: 7294171 - DNA, 22 bp, Homo sapiens
gcccagagagatgctgtagacc

SEQ ID NO: 7294172 - DNA, 22 bp, Homo sapiens
gcccagaagttgaggctgcagt

SEQ ID NO: 7294173 - DNA, 22 bp, Homo sapiens
gcccagagggaagaggtgtcat

SEQ ID NO: 7294174 - DNA, 22 bp, Homo sapiens
gaggcaggccctgaatgagtca

SEQ ID NO: 7294175 - DNA, 22 bp, Homo sapiens
gaggagcacatgaggctgaggg

SEQ ID NO: 7294176 - DNA, 22 bp, Homo sapiens
gaggcataagtagaagagattg

SEQ ID NO: 7294177 - DNA, 22 bp, Homo sapiens
gaggctcacgacgggacgaact

SEQ ID NO: 7294178 - DNA, 22 bp, Homo sapiens
gagggctgtggggcatgaccag

SEQ ID NO: 7294179 - DNA, 22 bp, Homo sapiens
gagggctgtgaaggagcgggtt

SEQ ID NO: 7294180 - DNA, 22 bp, Homo sapiens
gagggctggggcttaggcttag

SEQ ID NO: 7294181 - DNA, 22 bp, Homo sapiens
gagggctgctggaaaaatgcag

SEQ ID NO: 7294182 - DNA, 22 bp, Homo sapiens
gagggctgcaatgagacagaga

SEQ ID NO: 7294183 - DNA, 22 bp, Homo sapiens
gagggctgctgccagatatgcc

SEQ ID NO: 7294184 - DNA, 22 bp, Homo sapiens
gaggaagaaagcataggtgggg

SEQ ID NO: 7294185 - DNA, 18 bp, Homo sapiens
gaggaaacaaggcagagg

SEQ ID NO: 7294186 - DNA, 22 bp, Homo sapiens
gagccctgtgaggaaagagggt

SEQ ID NO: 7294187 - DNA, 22 bp, Homo sapiens
gagccctgcttccaagggggca

SEQ ID NO: 7294188 - DNA, 22 bp, Homo sapiens
gagcccagcttgcacatggagc

SEQ ID NO: 7294189 - DNA, 22 bp, Homo sapiens
gagcccagctgtccttggcaaa

SEQ ID NO: 7294190 - DNA, 22 bp, Homo sapiens
gagcatggttccataggttggt

SEQ ID NO: 7294191 - DNA, 20 bp, Homo sapiens
gagcccaagtagggagaaat

SEQ ID NO: 7294192 - DNA, 22 bp, Homo sapiens
gagccatgagatagttggttcg

SEQ ID NO: 7294193 - DNA, 22 bp, Homo sapiens
gagccctgacactgagggagtt

SEQ ID NO: 7294194 - DNA, 22 bp, Homo sapiens
gagccctgagagttgtgaggcc

SEQ ID NO: 7294195 - DNA, 22 bp, Homo sapiens
gagcagtggtcacagggaggga

SEQ ID NO: 7294196 - DNA, 22 bp, Homo sapiens
gagcagtgggaaggaacagggt

SEQ ID NO: 7294197 - DNA, 22 bp, Homo sapiens
gagcagtggttgaacagaggca

SEQ ID NO: 7294198 - DNA, 22 bp, Homo sapiens
gagcatggatcatgtgctgggt

SEQ ID NO: 7294199 - DNA, 22 bp, Homo sapiens
gagcatggatagaaggtgggat

SEQ ID NO: 7294200 - DNA, 22 bp, Homo sapiens
gagcatggcagctgagggcagg

SEQ ID NO: 7294201 - DNA, 22 bp, Homo sapiens
gagcatggcagctgagggcagg

SEQ ID NO: 7294202 - DNA, 18 bp, Homo sapiens
gagcatgggcagtgggga

SEQ ID NO: 7294203 - DNA, 20 bp, Homo sapiens
gagcagtgagccagggaaag

SEQ ID NO: 7294204 - DNA, 22 bp, Homo sapiens
gagcagtgatgggaggacgtca

SEQ ID NO: 7294205 - DNA, 22 bp, Homo sapiens
gaagccaccctccttccagccc

SEQ ID NO: 7294206 - DNA, 22 bp, Homo sapiens
gaagccactatagatattctaa

SEQ ID NO: 7294207 - DNA, 22 bp, Homo sapiens
gaaggagccgagctcttcccca

SEQ ID NO: 7294208 - DNA, 19 bp, Homo sapiens
gaaggggaaggtgggtacc

SEQ ID NO: 7294209 - DNA, 22 bp, Homo sapiens
gaagggcttggctgggaggcca

SEQ ID NO: 7294210 - DNA, 22 bp, Homo sapiens
gaagggctttctgggagaagag

SEQ ID NO: 7294211 - DNA, 22 bp, Homo sapiens
gaaggtttgatccttatttata

SEQ ID NO: 7294212 - DNA, 22 bp, Homo sapiens
gaaggtgtctggcccagagtct

SEQ ID NO: 7294213 - DNA, 22 bp, Homo sapiens
gacagacacctggggggttgct

SEQ ID NO: 7294214 - DNA, 22 bp, Homo sapiens
gacagacagagaatgggcttga

SEQ ID NO: 7294215 - DNA, 22 bp, Homo sapiens
gagagaaccctaaatgagatat

SEQ ID NO: 7294216 - DNA, 22 bp, Homo sapiens
gagaaacaacacttgatgcctt

SEQ ID NO: 7294217 - DNA, 22 bp, Homo sapiens
gacattggctgttcattgggat

SEQ ID NO: 7294218 - DNA, 22 bp, Homo sapiens
gacattgggtgtacaattggca

SEQ ID NO: 7294219 - DNA, 20 bp, Homo sapiens
gacattgtaattaatgatga

SEQ ID NO: 7294220 - DNA, 22 bp, Homo sapiens
gacagagattgaatcaggaaat

SEQ ID NO: 7294221 - DNA, 22 bp, Homo sapiens
gacagagattgaatcaggaaat

SEQ ID NO: 7294222 - DNA, 22 bp, Homo sapiens
gacagagaggctgagcagtaca

SEQ ID NO: 7294223 - DNA, 22 bp, Homo sapiens
ctgtctgccctggccagagccc

SEQ ID NO: 7294224 - DNA, 22 bp, Homo sapiens
ctgtcacactaaaacaagaagt

SEQ ID NO: 7294225 - DNA, 22 bp, Homo sapiens
ctggtctgaggttgcccttgaa

SEQ ID NO: 7294226 - DNA, 20 bp, Homo sapiens
ctggtctgccactcacagtt

SEQ ID NO: 7294227 - DNA, 22 bp, Homo sapiens
ctggtctgcgggaaggcgtggg

SEQ ID NO: 7294228 - DNA, 22 bp, Homo sapiens
ctggtctgggatgagggatgta

SEQ ID NO: 7294229 - DNA, 22 bp, Homo sapiens
ctggtctggctacccagcgaat

SEQ ID NO: 7294230 - DNA, 22 bp, Homo sapiens
ctgggagcaagtcaggaaaggt

SEQ ID NO: 7294231 - DNA, 22 bp, Homo sapiens
ctgggagcaagtcaggaaaggt

SEQ ID NO: 7294232 - DNA, 22 bp, Homo sapiens
ctgctgtgttgccagtgtcacc

SEQ ID NO: 7294233 - DNA, 22 bp, Homo sapiens
cttaaagagtatttaatataat

SEQ ID NO: 7294234 - DNA, 22 bp, Homo sapiens
ctgtggaagagggtcaccagta

SEQ ID NO: 7294235 - DNA, 22 bp, Homo sapiens
ctgtggaaaatgctttacatat

SEQ ID NO: 7294236 - DNA, 22 bp, Homo sapiens
ctgtggaagagggtcaccagta

SEQ ID NO: 7294237 - DNA, 22 bp, Homo sapiens
ctgtggaagctgacacggtggt

SEQ ID NO: 7294238 - DNA, 22 bp, Homo sapiens
ctgtttaatgcaatgaaatgag

SEQ ID NO: 7294239 - DNA, 22 bp, Homo sapiens
ctttgatctactcactaaacaa

SEQ ID NO: 7294240 - DNA, 22 bp, Homo sapiens
ctttctcttcagcacccagccc

SEQ ID NO: 7294241 - DNA, 22 bp, Homo sapiens
ctttacaaatagggagggagtg

SEQ ID NO: 7294242 - DNA, 22 bp, Homo sapiens
cttgtgcttttatgaatgcaga

SEQ ID NO: 7294243 - DNA, 22 bp, Homo sapiens
cttttgatggagttcaagaagc

SEQ ID NO: 7294244 - DNA, 22 bp, Homo sapiens
cttttgatagttgctgagcagg

SEQ ID NO: 7294245 - DNA, 22 bp, Homo sapiens
gaaagcatccgcctggaggtgg

SEQ ID NO: 7294246 - DNA, 22 bp, Homo sapiens
gaaagccatctggctgctggga

SEQ ID NO: 7294247 - DNA, 22 bp, Homo sapiens
gaaacacatgcagctccataga

SEQ ID NO: 7294248 - DNA, 22 bp, Homo sapiens
tttctgatttgacttgaagtat

SEQ ID NO: 7294249 - DNA, 22 bp, Homo sapiens
tttctgattctcactttggcat

SEQ ID NO: 7294250 - DNA, 22 bp, Homo sapiens
tttgaagggcacgacaatagtt

SEQ ID NO: 7294251 - DNA, 22 bp, Homo sapiens
tttgaataaacggttaatgttc

SEQ ID NO: 7294252 - DNA, 22 bp, Homo sapiens
ctctggagcgctgcttcccgcg

SEQ ID NO: 7294253 - DNA, 22 bp, Homo sapiens
ctctggagtcaggcagccctgg

SEQ ID NO: 7294254 - DNA, 21 bp, Homo sapiens
ctctggagtcaagagcttcca

SEQ ID NO: 7294255 - DNA, 19 bp, Homo sapiens
ctctggagtcattgctccc

SEQ ID NO: 7294256 - DNA, 22 bp, Homo sapiens
ctctggaggttgagcccagcaa

SEQ ID NO: 7294257 - DNA, 19 bp, Homo sapiens
ctctggagggaccgccgtt

SEQ ID NO: 7294258 - DNA, 22 bp, Homo sapiens
ctctggaggcagcaccagccag

SEQ ID NO: 7294259 - DNA, 22 bp, Homo sapiens
tttcaaagtcaatatcattacc

SEQ ID NO: 7294260 - DNA, 22 bp, Homo sapiens
tttcaaagtaaggattttcatc

SEQ ID NO: 7294261 - DNA, 22 bp, Homo sapiens
ctcctgtcaataggctcctggc

SEQ ID NO: 7294262 - DNA, 22 bp, Homo sapiens
ctcctgtcaataggctcctggc

SEQ ID NO: 7294263 - DNA, 22 bp, Homo sapiens
tttcaaagttgggaattgtaat

SEQ ID NO: 7294264 - DNA, 22 bp, Homo sapiens
ttgtttaatgcctcatacatct

SEQ ID NO: 7294265 - DNA, 22 bp, Homo sapiens
ttgtttaatatcgtgaagtact

SEQ ID NO: 7294266 - DNA, 22 bp, Homo sapiens
ttgtttcagctgtatgctatgt

SEQ ID NO: 7294267 - DNA, 22 bp, Homo sapiens
ctccccacatttctccctgtct

SEQ ID NO: 7294268 - DNA, 22 bp, Homo sapiens
ctccccaccttcgcggtccctg

SEQ ID NO: 7294269 - DNA, 22 bp, Homo sapiens
ctccccacacactaggcctgat

SEQ ID NO: 7294270 - DNA, 22 bp, Homo sapiens
ctgaggaagacagcagctgtgt

SEQ ID NO: 7294271 - DNA, 22 bp, Homo sapiens
ctgaggaagaggtaccatttgt

SEQ ID NO: 7294272 - DNA, 22 bp, Homo sapiens
ctgaggaaagctgcagcggtac

SEQ ID NO: 7294273 - DNA, 22 bp, Homo sapiens
ctgagctggtgtttcagggtca

SEQ ID NO: 7294274 - DNA, 22 bp, Homo sapiens
ctgagatactgtggcgaatgca

SEQ ID NO: 7294275 - DNA, 22 bp, Homo sapiens
ctgctgagccgcacccaggagc

SEQ ID NO: 7294276 - DNA, 22 bp, Homo sapiens
ctgcctctggcctcaggcccag

SEQ ID NO: 7294277 - DNA, 22 bp, Homo sapiens
ctgcaggggcctcgagcacagg

SEQ ID NO: 7294278 - DNA, 22 bp, Homo sapiens
ctaactttatttgctaagtaga

SEQ ID NO: 7294279 - DNA, 22 bp, Homo sapiens
ttctacatgagaaaatgtattt

SEQ ID NO: 7294280 - DNA, 22 bp, Homo sapiens
ttcctccttcccattcctgggg

SEQ ID NO: 7294281 - DNA, 22 bp, Homo sapiens
ttcctccttgtcctagttactg

SEQ ID NO: 7294282 - DNA, 22 bp, Homo sapiens
ttcctctcctcacatgagtcac

SEQ ID NO: 7294283 - DNA, 17 bp, Homo sapiens
ttcctctcacatttttt

SEQ ID NO: 7294284 - DNA, 22 bp, Homo sapiens
ttcctcctacgcttatcacttt

SEQ ID NO: 7294285 - DNA, 17 bp, Homo sapiens
ttcctcctcaccatgtt

SEQ ID NO: 7294286 - DNA, 21 bp, Homo sapiens
ttcctcctctggagaagaaga

SEQ ID NO: 7294287 - DNA, 22 bp, Homo sapiens
ttcctcctctgtaaaacgggca

SEQ ID NO: 7294288 - DNA, 22 bp, Homo sapiens
cgtctggcttctccacggtaaa

SEQ ID NO: 7294289 - DNA, 22 bp, Homo sapiens
cgtctggcttctccacggtaaa

SEQ ID NO: 7294290 - DNA, 22 bp, Homo sapiens
ttccacttagtggaagggcatg

SEQ ID NO: 7294291 - DNA, 22 bp, Homo sapiens
ttccacttttctctctcatgcc

SEQ ID NO: 7294292 - DNA, 21 bp, Homo sapiens
ttcagtttcttcctcatctat

SEQ ID NO: 7294293 - DNA, 22 bp, Homo sapiens
cgggagcctctgggtcacactg

SEQ ID NO: 7294294 - DNA, 22 bp, Homo sapiens
ctcagccaggagagtgttcaca

SEQ ID NO: 7294295 - DNA, 22 bp, Homo sapiens
ctcagaaacggagctgccattt

SEQ ID NO: 7294296 - DNA, 22 bp, Homo sapiens
ttgctgatttccccttgagtgt

SEQ ID NO: 7294297 - DNA, 22 bp, Homo sapiens
ttgctggtaaagtctttatcgg

SEQ ID NO: 7294298 - DNA, 22 bp, Homo sapiens
ttgctgtagttcaatatgtggt

SEQ ID NO: 7294299 - DNA, 22 bp, Homo sapiens
ttgcacagtttgaagatgactc

SEQ ID NO: 7294300 - DNA, 22 bp, Homo sapiens
ttgcacagtttgaagatgactc

SEQ ID NO: 7294301 - DNA, 23 bp, Homo sapiens
ttgcacagtttcggaaactgagg

SEQ ID NO: 7294302 - DNA, 22 bp, Homo sapiens
ctcactgtctgtactagctgat

SEQ ID NO: 7294303 - DNA, 22 bp, Homo sapiens
ttctgaaaattgggtcatactt

SEQ ID NO: 7294304 - DNA, 22 bp, Homo sapiens
ttctgaaatgagatataaggta

SEQ ID NO: 7294305 - DNA, 22 bp, Homo sapiens
ttatttttaaaagttcacacag

SEQ ID NO: 7294306 - DNA, 17 bp, Homo sapiens
ttattttttgggctgag

SEQ ID NO: 7294307 - DNA, 22 bp, Homo sapiens
cgcagaagaggttgtctagtcc

SEQ ID NO: 7294308 - DNA, 22 bp, Homo sapiens
ttatgtaatttgtttgctcttc

SEQ ID NO: 7294309 - DNA, 17 bp, Homo sapiens
cgagggcttgctggctc

SEQ ID NO: 7294310 - DNA, 22 bp, Homo sapiens
cgagggctgtgttgctctcctt

SEQ ID NO: 7294311 - DNA, 22 bp, Homo sapiens
cgcacattagaagtaactaatg

SEQ ID NO: 7294312 - DNA, 22 bp, Homo sapiens
cctgtgcttggccagagaggtt

SEQ ID NO: 7294313 - DNA, 22 bp, Homo sapiens
ttaatgatgaagtctggctgta

SEQ ID NO: 7294314 - DNA, 22 bp, Homo sapiens
ttaatgatacctatgttaattt

SEQ ID NO: 7294315 - DNA, 22 bp, Homo sapiens
ttaatagatttgattttaaagg

SEQ ID NO: 7294316 - DNA, 22 bp, Homo sapiens
tgttttcatttgatgtaacaaa

SEQ ID NO: 7294317 - DNA, 22 bp, Homo sapiens
tgttttcatttgatgtaacaaa

SEQ ID NO: 7294318 - DNA, 17 bp, Homo sapiens
tgttttcattcattgct

SEQ ID NO: 7294319 - DNA, 22 bp, Homo sapiens
tgtttcttacgtttttagaggc

SEQ ID NO: 7294320 - DNA, 23 bp, Homo sapiens
tgttgctgcctttctaggatcag

SEQ ID NO: 7294321 - DNA, 20 bp, Homo sapiens
tgttgattggtgtcatctca

SEQ ID NO: 7294322 - DNA, 22 bp, Homo sapiens
cctgcgatccgggcttggtgct

SEQ ID NO: 7294323 - DNA, 22 bp, Homo sapiens
tggttcctcaagcgctggcggc

SEQ ID NO: 7294324 - DNA, 21 bp, Homo sapiens
tggtacaccttgcctgtcaga

SEQ ID NO: 7294325 - DNA, 22 bp, Homo sapiens
cctgcatttttcccactctgtc

SEQ ID NO: 7294326 - DNA, 22 bp, Homo sapiens
cctgcattaaatcctgttctgc

SEQ ID NO: 7294327 - DNA, 22 bp, Homo sapiens
cctgcatgtggtcagcactcct

SEQ ID NO: 7294328 - DNA, 22 bp, Homo sapiens
cctcctctggtgctgccaaccc

SEQ ID NO: 7294329 - DNA, 22 bp, Homo sapiens
cctccaggtgttacatatgact

SEQ ID NO: 7294330 - DNA, 22 bp, Homo sapiens
cctctcccgggtgccgctgggc

SEQ ID NO: 7294331 - DNA, 22 bp, Homo sapiens
cctctcccaggcgcggcggcag

SEQ ID NO: 7294332 - DNA, 22 bp, Homo sapiens
tgggacaggaggcctctggaga

SEQ ID NO: 7294333 - DNA, 22 bp, Homo sapiens
cccagtggcccagcatgtggtg

SEQ ID NO: 7294334 - DNA, 19 bp, Homo sapiens
tgctctctggtgcttcatg

SEQ ID NO: 7294335 - DNA, 19 bp, Homo sapiens
cccagtctaggtcctagga

SEQ ID NO: 7294336 - DNA, 22 bp, Homo sapiens
tgctaggggtcagcaccatatc

SEQ ID NO: 7294337 - DNA, 22 bp, Homo sapiens
ccccagctgagatttgaggaga

SEQ ID NO: 7294338 - DNA, 22 bp, Homo sapiens
cccagtgtcaccaacaggacac

SEQ ID NO: 7294339 - DNA, 22 bp, Homo sapiens
cccagtgtctccaacatcagat

SEQ ID NO: 7294340 - DNA, 22 bp, Homo sapiens
cccagtgtggttctttggagaa

SEQ ID NO: 7294341 - DNA, 22 bp, Homo sapiens
tgctgttatcacattttgtaaa

SEQ ID NO: 7294342 - DNA, 22 bp, Homo sapiens
ccctggagtagcactgggtcgc

SEQ ID NO: 7294343 - DNA, 22 bp, Homo sapiens
ccctggagtcctggcagttgat

SEQ ID NO: 7294344 - DNA, 22 bp, Homo sapiens
cccttgaggtagactgaacacc

SEQ ID NO: 7294345 - DNA, 22 bp, Homo sapiens
cccttgcatcccatgtgtggcc

SEQ ID NO: 7294346 - DNA, 22 bp, Homo sapiens
cccttgcaagcaaggattagcc

SEQ ID NO: 7294347 - DNA, 21 bp, Homo sapiens
cccttgcaaagtgctttccca

SEQ ID NO: 7294348 - DNA, 22 bp, Homo sapiens
cccttgcttgcccagtcacagg

SEQ ID NO: 7294349 - DNA, 22 bp, Homo sapiens
tggagaattctatgttgagggg

SEQ ID NO: 7294350 - DNA, 22 bp, Homo sapiens
tggaaagaattcctatggttca

SEQ ID NO: 7294351 - DNA, 22 bp, Homo sapiens
tggaggagaactccctggctac

SEQ ID NO: 7294352 - DNA, 23 bp, Homo sapiens
tggaggaaacacatcagaagacc

SEQ ID NO: 7294353 - DNA, 22 bp, Homo sapiens
cccagcagccagaatgaggagc

SEQ ID NO: 7294354 - DNA, 22 bp, Homo sapiens
tgcaggacttcaggactctgag

SEQ ID NO: 7294355 - DNA, 22 bp, Homo sapiens
tgcaggactttcagtgctcaaa

SEQ ID NO: 7294356 - DNA, 20 bp, Homo sapiens
tgcaggacagagcctgtgtg

SEQ ID NO: 7294357 - DNA, 23 bp, Homo sapiens
tgcaggactcaagaaagaaaggc

SEQ ID NO: 7294358 - DNA, 23 bp, Homo sapiens
tgcaggactactcgagcactgct

SEQ ID NO: 7294359 - DNA, 22 bp, Homo sapiens
tgcaggactcaagggtagcagg

SEQ ID NO: 7294360 - DNA, 22 bp, Homo sapiens
tgcaggactggggagcggaagg

SEQ ID NO: 7294361 - DNA, 22 bp, Homo sapiens
tgcaggactgaaggagggctgg

SEQ ID NO: 7294362 - DNA, 22 bp, Homo sapiens
tgcaggacagtttggaagagag

SEQ ID NO: 7294363 - DNA, 22 bp, Homo sapiens
tgcaggacattagttatgaatt

SEQ ID NO: 7294364 - DNA, 22 bp, Homo sapiens
tgcaggacccgggctgtggtca

SEQ ID NO: 7294365 - DNA, 22 bp, Homo sapiens
tgcaggaccggaaccatgggat

SEQ ID NO: 7294366 - DNA, 22 bp, Homo sapiens
tgcaggaccttgatcctggact

SEQ ID NO: 7294367 - DNA, 22 bp, Homo sapiens
cccagaggggtcgtctgagggg

SEQ ID NO: 7294368 - DNA, 19 bp, Homo sapiens
cccagaggaatgcctggaa

SEQ ID NO: 7294369 - DNA, 23 bp, Homo sapiens
cccagaggagcagggcgtgagat

SEQ ID NO: 7294370 - DNA, 18 bp, Homo sapiens
cccagaggaatgcctgga

SEQ ID NO: 7294371 - DNA, 22 bp, Homo sapiens
tgagttttttcaacatatgaag

SEQ ID NO: 7294372 - DNA, 22 bp, Homo sapiens
tgagtctccagcgaagtaggat

SEQ ID NO: 7294373 - DNA, 22 bp, Homo sapiens
tgagtctcgaaatgcaggaaag

SEQ ID NO: 7294374 - DNA, 22 bp, Homo sapiens
tgagtccattgatggatagtga

SEQ ID NO: 7294375 - DNA, 22 bp, Homo sapiens
tgagtccatgtggaggggaggt

SEQ ID NO: 7294376 - DNA, 22 bp, Homo sapiens
tgagtccaataggggcctggaa

SEQ ID NO: 7294377 - DNA, 22 bp, Homo sapiens
tgagtccaagagccagtgggaa

SEQ ID NO: 7294378 - DNA, 22 bp, Homo sapiens
tgagtccagatgggccagcagg

SEQ ID NO: 7294379 - DNA, 18 bp, Homo sapiens
ccatcaccctaactagtg

SEQ ID NO: 7294380 - DNA, 22 bp, Homo sapiens
ccatatatgattgcctctttca

SEQ ID NO: 7294381 - DNA, 22 bp, Homo sapiens
tgagcagtaggtctgaatagtg

SEQ ID NO: 7294382 - DNA, 22 bp, Homo sapiens
ccaggtggcttctgcccgatgt

SEQ ID NO: 7294383 - DNA, 22 bp, Homo sapiens
tcttgcagaagaagctgccaag

SEQ ID NO: 7294384 - DNA, 22 bp, Homo sapiens
ccaggctgttttcaaacttggg

SEQ ID NO: 7294385 - DNA, 22 bp, Homo sapiens
ccaggctgtggtttagatagag

SEQ ID NO: 7294386 - DNA, 21 bp, Homo sapiens
ccaggctgggagggcagttcc

SEQ ID NO: 7294387 - DNA, 22 bp, Homo sapiens
ccaggctgtgcttttcataaat

SEQ ID NO: 7294388 - DNA, 22 bp, Homo sapiens
tgaaatgagagcacagaataaa

SEQ ID NO: 7294389 - DNA, 17 bp, Homo sapiens
tgaaacaccaagactgt

SEQ ID NO: 7294390 - DNA, 22 bp, Homo sapiens
ccagggcagtgggagaaggtgc

SEQ ID NO: 7294391 - DNA, 22 bp, Homo sapiens
tgaaggtgtttatacctcagat

SEQ ID NO: 7294392 - DNA, 22 bp, Homo sapiens
ccagggcacgttgggacagtac

SEQ ID NO: 7294393 - DNA, 22 bp, Homo sapiens
tgaaatgagatagataatcagg

SEQ ID NO: 7294394 - DNA, 22 bp, Homo sapiens
tcttcctcaatgtaacaacccc

SEQ ID NO: 7294395 - DNA, 22 bp, Homo sapiens
ccaggaggctcttgtccctggt

SEQ ID NO: 7294396 - DNA, 22 bp, Homo sapiens
tctgttattttcttgtgtggaa

SEQ ID NO: 7294397 - DNA, 23 bp, Homo sapiens
cagggaggagatactgtgtatct

SEQ ID NO: 7294398 - DNA, 22 bp, Homo sapiens
cagggatgaccagagggatgtg

SEQ ID NO: 7294399 - DNA, 22 bp, Homo sapiens
cagggcagtgaagaacacacgt

SEQ ID NO: 7294400 - DNA, 22 bp, Homo sapiens
tagcagcacctacacgtcagag

SEQ ID NO: 7294401 - DNA, 22 bp, Homo sapiens
tagcagcaggggaaacagctgt

SEQ ID NO: 7294402 - DNA, 22 bp, Homo sapiens
tagcatgtcagtcgccacacgt

SEQ ID NO: 7294403 - DNA, 22 bp, Homo sapiens
cagggacagccttggggtggcg

SEQ ID NO: 7294404 - DNA, 22 bp, Homo sapiens
cagggacagcgggactctgaca

SEQ ID NO: 7294405 - DNA, 22 bp, Homo sapiens
tagaaagactgtccagatttca

SEQ ID NO: 7294406 - DNA, 22 bp, Homo sapiens
tagaaagacatgggccagcagc

SEQ ID NO: 7294407 - DNA, 22 bp, Homo sapiens
tacacagaacctggtgtacagt

SEQ ID NO: 7294408 - DNA, 22 bp, Homo sapiens
tacaatagggcttttgtttatg

SEQ ID NO: 7294409 - DNA, 22 bp, Homo sapiens
tacagtttacatgagaggaagc

SEQ ID NO: 7294410 - DNA, 22 bp, Homo sapiens
tacagtttaacactttggagaa

SEQ ID NO: 7294411 - DNA, 22 bp, Homo sapiens
tacagtttctcattatgctctc

SEQ ID NO: 7294412 - DNA, 22 bp, Homo sapiens
tacagtttctgtccttgtggag

SEQ ID NO: 7294413 - DNA, 22 bp, Homo sapiens
tacagtttcccagcagatgcaa

SEQ ID NO: 7294414 - DNA, 22 bp, Homo sapiens
tacagtttccaagggcttgaag

SEQ ID NO: 7294415 - DNA, 22 bp, Homo sapiens
tacagtttagaaccatagatgg

SEQ ID NO: 7294416 - DNA, 22 bp, Homo sapiens
tacagtttgtatggtcaggaat

SEQ ID NO: 7294417 - DNA, 22 bp, Homo sapiens
caggcctgtgacaccgtgtctg

SEQ ID NO: 7294418 - DNA, 22 bp, Homo sapiens
caggcctgtgagttgaggcccc

SEQ ID NO: 7294419 - DNA, 22 bp, Homo sapiens
caggcctgtgagttgaggcccc

SEQ ID NO: 7294420 - DNA, 22 bp, Homo sapiens
tacagcagggcgctgtgatgaa

SEQ ID NO: 7294421 - DNA, 22 bp, Homo sapiens
cagtccctagtggagctcacag

SEQ ID NO: 7294422 - DNA, 22 bp, Homo sapiens
cagtctgggactgagctccacc

SEQ ID NO: 7294423 - DNA, 22 bp, Homo sapiens
tattccagttcaccttttcatc

SEQ ID NO: 7294424 - DNA, 22 bp, Homo sapiens
cagtgcagaggtgcaagcatgt

SEQ ID NO: 7294425 - DNA, 22 bp, Homo sapiens
tcacacatgtaagggctttgga

SEQ ID NO: 7294426 - DNA, 16 bp, Homo sapiens
tcacacatttgttggt

SEQ ID NO: 7294427 - DNA, 22 bp, Homo sapiens
tcacacatttctcaagtgtagg

SEQ ID NO: 7294428 - DNA, 22 bp, Homo sapiens
cagtggagaggcatgcttggca

SEQ ID NO: 7294429 - DNA, 19 bp, Homo sapiens
cagtggagattggaggagg

SEQ ID NO: 7294430 - DNA, 22 bp, Homo sapiens
cagtggaggccttgggaccttt

SEQ ID NO: 7294431 - DNA, 22 bp, Homo sapiens
cagggctgagtcatatagcctt

SEQ ID NO: 7294432 - DNA, 22 bp, Homo sapiens
cagggctgctggccgtgccctc

SEQ ID NO: 7294433 - DNA, 22 bp, Homo sapiens
tagtgtgtatggtaatgatgaa

SEQ ID NO: 7294434 - DNA, 22 bp, Homo sapiens
tatattcaatgattagtatcag

SEQ ID NO: 7294435 - DNA, 22 bp, Homo sapiens
tatattcatattgttgtctctc

SEQ ID NO: 7294436 - DNA, 22 bp, Homo sapiens
tatgtacatgatttcatttgct

SEQ ID NO: 7294437 - DNA, 22 bp, Homo sapiens
tatgattaatattcttaaaatt

SEQ ID NO: 7294438 - DNA, 22 bp, Homo sapiens
tatgatttgtagacatttgatt

SEQ ID NO: 7294439 - DNA, 22 bp, Homo sapiens
tatattgtagctgatgacaaat

SEQ ID NO: 7294440 - DNA, 22 bp, Homo sapiens
cattttcatgagtttctgttca

SEQ ID NO: 7294441 - DNA, 22 bp, Homo sapiens
tccataaaccagaaaatcaaga

SEQ ID NO: 7294442 - DNA, 21 bp, Homo sapiens
tcctgccttagtccagagcag

SEQ ID NO: 7294443 - DNA, 22 bp, Homo sapiens
ccacaggcggagtggcgggcag

SEQ ID NO: 7294444 - DNA, 22 bp, Homo sapiens
ccacaggctgctgcaggtcccg

SEQ ID NO: 7294445 - DNA, 22 bp, Homo sapiens
ccacagggataggaatggggct

SEQ ID NO: 7294446 - DNA, 21 bp, Homo sapiens
tctataatatgcaggtcatca

SEQ ID NO: 7294447 - DNA, 20 bp, Homo sapiens
catcaacaccttgtcagcct

SEQ ID NO: 7294448 - DNA, 22 bp, Homo sapiens
tcactgttttgcctgcacttcc

SEQ ID NO: 7294449 - DNA, 22 bp, Homo sapiens
tcacttcacacccactatcatg

SEQ ID NO: 7294450 - DNA, 22 bp, Homo sapiens
tcatcaaagtcaaagaatgact

SEQ ID NO: 7294451 - DNA, 22 bp, Homo sapiens
catcagctgagggtgagcagaa

SEQ ID NO: 7294452 - DNA, 22 bp, Homo sapiens
catcagctgagggtgagcagaa

SEQ ID NO: 7294453 - DNA, 22 bp, Homo sapiens
catcagctaaacttagtgaaat

SEQ ID NO: 7294454 - DNA, 22 bp, Homo sapiens
catcataaaattgagataactg

SEQ ID NO: 7294455 - DNA, 22 bp, Homo sapiens
catgtggattcctgcttagaaa

SEQ ID NO: 7294456 - DNA, 22 bp, Homo sapiens
tccaggggtaccggccaggcag

SEQ ID NO: 7294457 - DNA, 22 bp, Homo sapiens
tccaggggagtgctacgcacag

SEQ ID NO: 7294458 - DNA, 20 bp, Homo sapiens
catggtggaggagcagggcc

SEQ ID NO: 7294459 - DNA, 22 bp, Homo sapiens
ttggaagacattaaagagagtg

SEQ ID NO: 7294460 - DNA, 22 bp, Homo sapiens
ttgcctgtttgagagctgtgtt

SEQ ID NO: 7294461 - DNA, 22 bp, Homo sapiens
ttgcttcagtcagtgctgccca

SEQ ID NO: 7294462 - DNA, 22 bp, Homo sapiens
ttgggctcaggagtttgagacc

SEQ ID NO: 7294463 - DNA, 23 bp, Homo sapiens
ttgggaaatagttaagacatgag

SEQ ID NO: 7294464 - DNA, 22 bp, Homo sapiens
ttgttctatggggtgaagtcta

SEQ ID NO: 7294465 - DNA, 22 bp, Homo sapiens
ttgtggaagccctatgagagac

SEQ ID NO: 7294466 - DNA, 22 bp, Homo sapiens
ttgtgagcaccagaggttgttc

SEQ ID NO: 7294467 - DNA, 22 bp, Homo sapiens
ttgtgagcaggctgcacaaacc

SEQ ID NO: 7294468 - DNA, 22 bp, Homo sapiens
ttgtgagcatgtgcagcctctg

SEQ ID NO: 7294469 - DNA, 22 bp, Homo sapiens
ttgtgagcatgtttacttgatt

SEQ ID NO: 7294470 - DNA, 22 bp, Homo sapiens
ttgtgagcattttggtgagctt

SEQ ID NO: 7294471 - DNA, 19 bp, Homo sapiens
ttgtgagctgaagaacagg

SEQ ID NO: 7294472 - DNA, 22 bp, Homo sapiens
tttcgtttgcttatataataga

SEQ ID NO: 7294473 - DNA, 22 bp, Homo sapiens
tttccagtgggccccttgaaat

SEQ ID NO: 7294474 - DNA, 22 bp, Homo sapiens
tttccagtgaaattttgaatgt

SEQ ID NO: 7294475 - DNA, 22 bp, Homo sapiens
tttcataatactgtacatgaaa

SEQ ID NO: 7294476 - DNA, 22 bp, Homo sapiens
tttcatcaccccaaatctatgg

SEQ ID NO: 7294477 - DNA, 22 bp, Homo sapiens
tttcacatgtgctgttgtcaat

SEQ ID NO: 7294478 - DNA, 22 bp, Homo sapiens
tttcacaatcaaatggtgaaat

SEQ ID NO: 7294479 - DNA, 23 bp, Homo sapiens
tttcacagcttttattctgcatc

SEQ ID NO: 7294480 - DNA, 20 bp, Homo sapiens
tttcacaatgaacatgtctc

SEQ ID NO: 7294481 - DNA, 22 bp, Homo sapiens
tttcacaggatgctgttttata

SEQ ID NO: 7294482 - DNA, 22 bp, Homo sapiens
tttcacaggagtcctttctata

SEQ ID NO: 7294483 - DNA, 22 bp, Homo sapiens
tttcacattcagatatagactt

SEQ ID NO: 7294484 - DNA, 18 bp, Homo sapiens
tttcacaacctccagagg

SEQ ID NO: 7294485 - DNA, 22 bp, Homo sapiens
tttcacaactgcttatttgaga

SEQ ID NO: 7294486 - DNA, 22 bp, Homo sapiens
tttcacaactgcttatttgaga

SEQ ID NO: 7294487 - DNA, 22 bp, Homo sapiens
tttcacaagacagctactgttg

SEQ ID NO: 7294488 - DNA, 22 bp, Homo sapiens
tttcacaagtttcaggattctg

SEQ ID NO: 7294489 - DNA, 22 bp, Homo sapiens
tttcacaagtaaagtcctaagt

SEQ ID NO: 7294490 - DNA, 22 bp, Homo sapiens
tttcaagtggggacatttgaga

SEQ ID NO: 7294491 - DNA, 20 bp, Homo sapiens
tttcaagtcagcaattctca

SEQ ID NO: 7294492 - DNA, 22 bp, Homo sapiens
ttgtttaaaagaaatcatagaa

SEQ ID NO: 7294493 - DNA, 22 bp, Homo sapiens
ttgttgtttccaggatactgtg

SEQ ID NO: 7294494 - DNA, 22 bp, Homo sapiens
ttgttgctgctcaacctctata

SEQ ID NO: 7294495 - DNA, 22 bp, Homo sapiens
ttgttggtggaattgatgctag

SEQ ID NO: 7294496 - DNA, 22 bp, Homo sapiens
ttgttgatgtggacgtctggaa

SEQ ID NO: 7294497 - DNA, 22 bp, Homo sapiens
tttacagatctgttgatttgtt

SEQ ID NO: 7294498 - DNA, 19 bp, Homo sapiens
tttacaagttctttgtatg

SEQ ID NO: 7294499 - DNA, 22 bp, Homo sapiens
tttaagagcatttgcaatttat

SEQ ID NO: 7294500 - DNA, 22 bp, Homo sapiens
tttaagagctagtatgtcattt

SEQ ID NO: 7294501 - DNA, 22 bp, Homo sapiens
tttagcgtagctgacagctaat

SEQ ID NO: 7294502 - DNA, 22 bp, Homo sapiens
tttagcattggagtctgggcta

SEQ ID NO: 7294503 - DNA, 22 bp, Homo sapiens
tttagtgctttgctattcatgg

SEQ ID NO: 7294504 - DNA, 22 bp, Homo sapiens
tttagtgcttaggaaatgggga

SEQ ID NO: 7294505 - DNA, 22 bp, Homo sapiens
tttatctttaggactttgcaga

SEQ ID NO: 7294506 - DNA, 22 bp, Homo sapiens
tttattgtctatgaactgcttg

SEQ ID NO: 7294507 - DNA, 22 bp, Homo sapiens
tttatgtagttacggactatca

SEQ ID NO: 7294508 - DNA, 22 bp, Homo sapiens
ttcatcaggcatcatgctcaag

SEQ ID NO: 7294509 - DNA, 22 bp, Homo sapiens
ttccaaggcatgttctcaagta

SEQ ID NO: 7294510 - DNA, 22 bp, Homo sapiens
ttccaattgcagatcagataca

SEQ ID NO: 7294511 - DNA, 21 bp, Homo sapiens
ttccagttttaattaaattgt

SEQ ID NO: 7294512 - DNA, 23 bp, Homo sapiens
ttccaaggggatgtctccaagtg

SEQ ID NO: 7294513 - DNA, 22 bp, Homo sapiens
ttccaagtgttgagattagagg

SEQ ID NO: 7294514 - DNA, 22 bp, Homo sapiens
ttccaagtgtcagatcagattt

SEQ ID NO: 7294515 - DNA, 22 bp, Homo sapiens
ttcccaggaagcctctccaagc

SEQ ID NO: 7294516 - DNA, 22 bp, Homo sapiens
ttccccaggctggagtgcagtg

SEQ ID NO: 7294517 - DNA, 21 bp, Homo sapiens
ttcatcagccagaaatcaagc

SEQ ID NO: 7294518 - DNA, 22 bp, Homo sapiens
ttcaatatgatattagctgtgg

SEQ ID NO: 7294519 - DNA, 22 bp, Homo sapiens
ttcaatcattccaacactttaa

SEQ ID NO: 7294520 - DNA, 22 bp, Homo sapiens
ttcactgtgaactcatattcag

SEQ ID NO: 7294521 - DNA, 22 bp, Homo sapiens
ttatttaatgtgatctgaagag

SEQ ID NO: 7294522 - DNA, 22 bp, Homo sapiens
ttattgttagtgagactgtaga

SEQ ID NO: 7294523 - DNA, 22 bp, Homo sapiens
ttatttatatctctgcagttta

SEQ ID NO: 7294524 - DNA, 22 bp, Homo sapiens
ttcaaacaactcatttatgcaa

SEQ ID NO: 7294525 - DNA, 21 bp, Homo sapiens
ttcaaaatggtgtgtttgtct

SEQ ID NO: 7294526 - DNA, 22 bp, Homo sapiens
ttattttctcctcagaaagtgg

SEQ ID NO: 7294527 - DNA, 22 bp, Homo sapiens
ttattttgagagaatgtgtgct

SEQ ID NO: 7294528 - DNA, 22 bp, Homo sapiens
ttataattctggcataggctgt

SEQ ID NO: 7294529 - DNA, 21 bp, Homo sapiens
ttagttctaccacttgcattc

SEQ ID NO: 7294530 - DNA, 22 bp, Homo sapiens
ttatgctaaatgaatcaagtca

SEQ ID NO: 7294531 - DNA, 22 bp, Homo sapiens
ttatggaataacctttctgaaa

SEQ ID NO: 7294532 - DNA, 23 bp, Homo sapiens
tcctcgtgcctatgagcagtgcc

SEQ ID NO: 7294533 - DNA, 19 bp, Homo sapiens
tcctccttacttcctcttg

SEQ ID NO: 7294534 - DNA, 22 bp, Homo sapiens
ttagtgtacttagtgctctaag

SEQ ID NO: 7294535 - DNA, 22 bp, Homo sapiens
ttcctttagtgtcatatacttt

SEQ ID NO: 7294536 - DNA, 22 bp, Homo sapiens
ttcgtttagtccacaaatgcat

SEQ ID NO: 7294537 - DNA, 22 bp, Homo sapiens
ttctcacagtacctaacatgta

SEQ ID NO: 7294538 - DNA, 22 bp, Homo sapiens
ttctcacaggctggaatgatga

SEQ ID NO: 7294539 - DNA, 17 bp, Homo sapiens
ttctcctctgtgtcctt

SEQ ID NO: 7294540 - DNA, 22 bp, Homo sapiens
ttctcctctgttaccttgcaaa

SEQ ID NO: 7294541 - DNA, 22 bp, Homo sapiens
ttctcctcagcaaggcagcttt

SEQ ID NO: 7294542 - DNA, 22 bp, Homo sapiens
ttcttcctcacactctcaccca

SEQ ID NO: 7294543 - DNA, 22 bp, Homo sapiens
ttctttgaaatactgttttgcc

SEQ ID NO: 7294544 - DNA, 22 bp, Homo sapiens
ttgagatagatctcatcttccc

SEQ ID NO: 7294545 - DNA, 22 bp, Homo sapiens
ttgagataggtggaatctcttt

SEQ ID NO: 7294546 - DNA, 22 bp, Homo sapiens
ttgagaagcacagggcctgtgc

SEQ ID NO: 7294547 - DNA, 22 bp, Homo sapiens
ttgaaagatatgttaatctttc

SEQ ID NO: 7294548 - DNA, 22 bp, Homo sapiens
ttgagaaacctggcagtagaga

SEQ ID NO: 7294549 - DNA, 22 bp, Homo sapiens
ttgacattttgtcatattgaca

SEQ ID NO: 7294550 - DNA, 22 bp, Homo sapiens
ttgaaagacattatttatatat

SEQ ID NO: 7294551 - DNA, 22 bp, Homo sapiens
tttgcagtttgttcagctcttt

SEQ ID NO: 7294552 - DNA, 22 bp, Homo sapiens
tttgcatttctaatgagctccg

SEQ ID NO: 7294553 - DNA, 22 bp, Homo sapiens
tttgcatttataagttggtgga

SEQ ID NO: 7294554 - DNA, 22 bp, Homo sapiens
tttgctgtgggatatccatgtg

SEQ ID NO: 7294555 - DNA, 22 bp, Homo sapiens
tttgctgtgaatccattactgt

SEQ ID NO: 7294556 - DNA, 22 bp, Homo sapiens
tttgacagcataatcctacacc

SEQ ID NO: 7294557 - DNA, 22 bp, Homo sapiens
tttgaagactactgggagtgaa

SEQ ID NO: 7294558 - DNA, 23 bp, Homo sapiens
tttgacagcgtggtttctgtggg

SEQ ID NO: 7294559 - DNA, 22 bp, Homo sapiens
tttgacagcatatcctcatatt

SEQ ID NO: 7294560 - DNA, 22 bp, Homo sapiens
tttgacagtgttggggcaggct

SEQ ID NO: 7294561 - DNA, 22 bp, Homo sapiens
tttgacagtgatgatatataca

SEQ ID NO: 7294562 - DNA, 22 bp, Homo sapiens
tttgacagtgacgcctgtatga

SEQ ID NO: 7294563 - DNA, 22 bp, Homo sapiens
tttgacagtgctattaagaaac

SEQ ID NO: 7294564 - DNA, 22 bp, Homo sapiens
tttgacagtgctgctaaaatgc

SEQ ID NO: 7294565 - DNA, 22 bp, Homo sapiens
tttgacagtcccctgatgtttg

SEQ ID NO: 7294566 - DNA, 22 bp, Homo sapiens
tttgacagtactctgtaggatc

SEQ ID NO: 7294567 - DNA, 22 bp, Homo sapiens
tttgacagtaataaagcacaag

SEQ ID NO: 7294568 - DNA, 22 bp, Homo sapiens
tttgacagggtgatgaggtggt

SEQ ID NO: 7294569 - DNA, 22 bp, Homo sapiens
tttgacaggaggtggctactca

SEQ ID NO: 7294570 - DNA, 22 bp, Homo sapiens
tttgacaggactaacatatggc

SEQ ID NO: 7294571 - DNA, 22 bp, Homo sapiens
tttgacaggaattctctctagg

SEQ ID NO: 7294572 - DNA, 22 bp, Homo sapiens
tttgacagcttgcagtgagacc

SEQ ID NO: 7294573 - DNA, 21 bp, Homo sapiens
tttgacagctcagagggcatt

SEQ ID NO: 7294574 - DNA, 22 bp, Homo sapiens
tttgacagcttgttacaaagtt

SEQ ID NO: 7294575 - DNA, 21 bp, Homo sapiens
tttgaaagtgggtgattcttt

SEQ ID NO: 7294576 - DNA, 22 bp, Homo sapiens
ttttgtgttgccatgttaagca

SEQ ID NO: 7294577 - DNA, 23 bp, Homo sapiens
ttttgtgtgacttaatatctctt

SEQ ID NO: 7294578 - DNA, 22 bp, Homo sapiens
ttttggtgaatttaagtgctgt

SEQ ID NO: 7294579 - DNA, 22 bp, Homo sapiens
ttttacaagctgagtcgttaaa

SEQ ID NO: 7294580 - DNA, 22 bp, Homo sapiens
ttttacaggtcataggtatagt

SEQ ID NO: 7294581 - DNA, 22 bp, Homo sapiens
tttgtctaattgcaaggcaagt

SEQ ID NO: 7294582 - DNA, 22 bp, Homo sapiens
ttttattggtaatgataaaagt

SEQ ID NO: 7294583 - DNA, 22 bp, Homo sapiens
atgtcttttatgattacgggat

SEQ ID NO: 7294584 - DNA, 22 bp, Homo sapiens
atgtgtgtatatatagtcattt

SEQ ID NO: 7294585 - DNA, 22 bp, Homo sapiens
atgtgtgtgcatttctctccct

SEQ ID NO: 7294586 - DNA, 22 bp, Homo sapiens
atgtgtgtgatgggcgccgcca

SEQ ID NO: 7294587 - DNA, 22 bp, Homo sapiens
atgtgtgtatgtgcctatatct

SEQ ID NO: 7294588 - DNA, 22 bp, Homo sapiens
gaggggagaggcttatggatca

SEQ ID NO: 7294589 - DNA, 22 bp, Homo sapiens
atggctggatttgatccatggg

SEQ ID NO: 7294590 - DNA, 22 bp, Homo sapiens
gaggccaggagtgctgtaagtt

SEQ ID NO: 7294591 - DNA, 22 bp, Homo sapiens
atgtacatttagatcatttctg

SEQ ID NO: 7294592 - DNA, 18 bp, Homo sapiens
atgtacatttgctaaagc

SEQ ID NO: 7294593 - DNA, 20 bp, Homo sapiens
atggaggaagggcaagagaa

SEQ ID NO: 7294594 - DNA, 22 bp, Homo sapiens
atggaagaaagagacaatttga

SEQ ID NO: 7294595 - DNA, 23 bp, Homo sapiens
gacagagtgagaccttgtcttac

SEQ ID NO: 7294596 - DNA, 22 bp, Homo sapiens
gacagatgtgggtgacagcagc

SEQ ID NO: 7294597 - DNA, 22 bp, Homo sapiens
gagcagtgactggagcatgaga

SEQ ID NO: 7294598 - DNA, 22 bp, Homo sapiens
atggccagtctattcatggtta

SEQ ID NO: 7294599 - DNA, 22 bp, Homo sapiens
atgcattatcaattgatgtagg

SEQ ID NO: 7294600 - DNA, 23 bp, Homo sapiens
atgcatcatgaaaactagagagc

SEQ ID NO: 7294601 - DNA, 22 bp, Homo sapiens
atgcaggaagtcggggagcggg

SEQ ID NO: 7294602 - DNA, 20 bp, Homo sapiens
gaaagattgtaagaggcaga

SEQ ID NO: 7294603 - DNA, 19 bp, Homo sapiens
atgaggaactgaggctcag

SEQ ID NO: 7294604 - DNA, 20 bp, Homo sapiens
atgattttgcactaacttca

SEQ ID NO: 7294605 - DNA, 22 bp, Homo sapiens
atgattttttctaacacagtcg

SEQ ID NO: 7294606 - DNA, 22 bp, Homo sapiens
atgagttgaagctacaagaggc

SEQ ID NO: 7294607 - DNA, 22 bp, Homo sapiens
cttgttgctaacatatgcttct

SEQ ID NO: 7294608 - DNA, 22 bp, Homo sapiens
cttgttgcaaacattcactcca

SEQ ID NO: 7294609 - DNA, 22 bp, Homo sapiens
cttttattttgaattaagggct

SEQ ID NO: 7294610 - DNA, 22 bp, Homo sapiens
atgaaattaatcaacacataca

SEQ ID NO: 7294611 - DNA, 22 bp, Homo sapiens
cttggtacctgccctgggcctt

SEQ ID NO: 7294612 - DNA, 22 bp, Homo sapiens
gcctcactgcagccccaggaag

SEQ ID NO: 7294613 - DNA, 22 bp, Homo sapiens
gcctggagctactggacactga

SEQ ID NO: 7294614 - DNA, 22 bp, Homo sapiens
caaaccattaagcatgttgagt

SEQ ID NO: 7294615 - DNA, 22 bp, Homo sapiens
gcctgtgactcgtcttgggcca

SEQ ID NO: 7294616 - DNA, 22 bp, Homo sapiens
atttactgagcagctaccatgt

SEQ ID NO: 7294617 - DNA, 22 bp, Homo sapiens
atttactggaaaaactatgagc

SEQ ID NO: 7294618 - DNA, 22 bp, Homo sapiens
attggaaaatatggtttctgga

SEQ ID NO: 7294619 - DNA, 22 bp, Homo sapiens
atttaattttctcaacagtgct

SEQ ID NO: 7294620 - DNA, 22 bp, Homo sapiens
atttaattttctcaacagtgct

SEQ ID NO: 7294621 - DNA, 22 bp, Homo sapiens
atttaatttggagagagaaacc

SEQ ID NO: 7294622 - DNA, 21 bp, Homo sapiens
atttcagaaatattggtggga

SEQ ID NO: 7294623 - DNA, 22 bp, Homo sapiens
atttcagtgttggttagcaagc

SEQ ID NO: 7294624 - DNA, 22 bp, Homo sapiens
atttcagcagcccatgtttgga

SEQ ID NO: 7294625 - DNA, 22 bp, Homo sapiens
atgtgtgtgtttaatcctcaaa

SEQ ID NO: 7294626 - DNA, 22 bp, Homo sapiens
atgtgtgtgtatatacacacat

SEQ ID NO: 7294627 - DNA, 22 bp, Homo sapiens
atgtgtgtgtgcgcgcgcagga

SEQ ID NO: 7294628 - DNA, 22 bp, Homo sapiens
atgttttatattttgcagcagt

SEQ ID NO: 7294629 - DNA, 22 bp, Homo sapiens
gatgagtgaggacagggtggca

SEQ ID NO: 7294630 - DNA, 22 bp, Homo sapiens
attacaataaggtttatttgta

SEQ ID NO: 7294631 - DNA, 22 bp, Homo sapiens
attaattttacctttgtaaaca

SEQ ID NO: 7294632 - DNA, 22 bp, Homo sapiens
attagaagcgtgaatcctttca

SEQ ID NO: 7294633 - DNA, 22 bp, Homo sapiens
attagaagatagtgatttctgc

SEQ ID NO: 7294634 - DNA, 20 bp, Homo sapiens
attagagctacatggctaca

SEQ ID NO: 7294635 - DNA, 22 bp, Homo sapiens
attagagcagtaattgtggcag

SEQ ID NO: 7294636 - DNA, 22 bp, Homo sapiens
attgaagggcattagtcatcag

SEQ ID NO: 7294637 - DNA, 22 bp, Homo sapiens
attgacaggtctttgggagtat

SEQ ID NO: 7294638 - DNA, 22 bp, Homo sapiens
attgacaggagagcttggagtg

SEQ ID NO: 7294639 - DNA, 22 bp, Homo sapiens
attgacagtggtgttctgggga

SEQ ID NO: 7294640 - DNA, 22 bp, Homo sapiens
attgacagtggctagtgcccag

SEQ ID NO: 7294641 - DNA, 22 bp, Homo sapiens
attgacagtgttaaagttgcct

SEQ ID NO: 7294642 - DNA, 22 bp, Homo sapiens
attgctggatgagctcttggat

SEQ ID NO: 7294643 - DNA, 22 bp, Homo sapiens
attgacagaaaagatgttggat

SEQ ID NO: 7294644 - DNA, 22 bp, Homo sapiens
attgacagaaaattggatggca

SEQ ID NO: 7294645 - DNA, 20 bp, Homo sapiens
attgacagaaagtgttcacc

SEQ ID NO: 7294646 - DNA, 22 bp, Homo sapiens
attgacagcaggggctgtcact

SEQ ID NO: 7294647 - DNA, 22 bp, Homo sapiens
attgacagagctttcaccatga

SEQ ID NO: 7294648 - DNA, 22 bp, Homo sapiens
attctgtgtgtactgagatggg

SEQ ID NO: 7294649 - DNA, 20 bp, Homo sapiens
attctcacatggctccgggc

SEQ ID NO: 7294650 - DNA, 22 bp, Homo sapiens
attcctgactgttagagtttgc

SEQ ID NO: 7294651 - DNA, 22 bp, Homo sapiens
attcctgactgctagtcattca

SEQ ID NO: 7294652 - DNA, 22 bp, Homo sapiens
attcctgagacttatctgtttc

SEQ ID NO: 7294653 - DNA, 23 bp, Homo sapiens
attcctgaggctccttatgcacc

SEQ ID NO: 7294654 - DNA, 22 bp, Homo sapiens
attcctgattaacgacctttca

SEQ ID NO: 7294655 - DNA, 22 bp, Homo sapiens
gcagagctggaactggtactca

SEQ ID NO: 7294656 - DNA, 18 bp, Homo sapiens
gcagagctgggattccca

SEQ ID NO: 7294657 - DNA, 22 bp, Homo sapiens
gcagagctgtctaagtcacttc

SEQ ID NO: 7294658 - DNA, 22 bp, Homo sapiens
gcagagctgttaatggagctga

SEQ ID NO: 7294659 - DNA, 22 bp, Homo sapiens
cactggaatgttgaggagacaa

SEQ ID NO: 7294660 - DNA, 22 bp, Homo sapiens
cactggcatctaagggtggtag

SEQ ID NO: 7294661 - DNA, 22 bp, Homo sapiens
cactggaaccatccacatagtg

SEQ ID NO: 7294662 - DNA, 20 bp, Homo sapiens
cactggaaagcaggcgactc

SEQ ID NO: 7294663 - DNA, 22 bp, Homo sapiens
cactggaaccaagacccagggc

SEQ ID NO: 7294664 - DNA, 22 bp, Homo sapiens
ggcctcgcggcttctggtggct

SEQ ID NO: 7294665 - DNA, 22 bp, Homo sapiens
cactgcactccatcctgggaaa

SEQ ID NO: 7294666 - DNA, 22 bp, Homo sapiens
cacccagagcctgagagggata

SEQ ID NO: 7294667 - DNA, 22 bp, Homo sapiens
cacagctgtcagctgacctagg

SEQ ID NO: 7294668 - DNA, 22 bp, Homo sapiens
ggaggcggacacaggtagtgtt

SEQ ID NO: 7294669 - DNA, 18 bp, Homo sapiens
ggatgtgaaccagagata

SEQ ID NO: 7294670 - DNA, 22 bp, Homo sapiens
ggatgtctgtcattatgctttc

SEQ ID NO: 7294671 - DNA, 22 bp, Homo sapiens
ggatgggcagacaggacggcac

SEQ ID NO: 7294672 - DNA, 22 bp, Homo sapiens
cacagggcagagggtccgtggc

SEQ ID NO: 7294673 - DNA, 22 bp, Homo sapiens
cacagggcaggccccaggcctc

SEQ ID NO: 7294674 - DNA, 22 bp, Homo sapiens
cacagtgtggcaaatttcaact

SEQ ID NO: 7294675 - DNA, 22 bp, Homo sapiens
cacagtgtagactaataataga

SEQ ID NO: 7294676 - DNA, 22 bp, Homo sapiens
caaggacactccctgctgggca

SEQ ID NO: 7294677 - DNA, 21 bp, Homo sapiens
caaggacaggttgcagggcaa

SEQ ID NO: 7294678 - DNA, 22 bp, Homo sapiens
caaggacccaaatcttgttctt

SEQ ID NO: 7294679 - DNA, 22 bp, Homo sapiens
caaggacagcgtcaggtgcaac

SEQ ID NO: 7294680 - DNA, 22 bp, Homo sapiens
caacatttgtgatgagcaaact

SEQ ID NO: 7294681 - DNA, 22 bp, Homo sapiens
gctgcatgacagacaggcctgg

SEQ ID NO: 7294682 - DNA, 22 bp, Homo sapiens
caaagtatatttcatagtctca

SEQ ID NO: 7294683 - DNA, 22 bp, Homo sapiens
cacaccagatggcagcgtggga

SEQ ID NO: 7294684 - DNA, 18 bp, Homo sapiens
cacaatttacagatgaca

SEQ ID NO: 7294685 - DNA, 22 bp, Homo sapiens
cacaatttgtattttgcatcca

SEQ ID NO: 7294686 - DNA, 22 bp, Homo sapiens
cacaatttgttttatcagtatt

SEQ ID NO: 7294687 - DNA, 22 bp, Homo sapiens
cacaaaccttctgcagcctgta

SEQ ID NO: 7294688 - DNA, 22 bp, Homo sapiens
cacaaacctgccagccctgccc

SEQ ID NO: 7294689 - DNA, 22 bp, Homo sapiens
gcttggccagcagccgggatgc

SEQ ID NO: 7294690 - DNA, 22 bp, Homo sapiens
gctgtctcgcctgacactggct

SEQ ID NO: 7294691 - DNA, 22 bp, Homo sapiens
caaggattaatagaatgaatca

SEQ ID NO: 7294692 - DNA, 21 bp, Homo sapiens
gctgtctctggctcctgggaa

SEQ ID NO: 7294693 - DNA, 22 bp, Homo sapiens
cagcagcctggagggggccacg

SEQ ID NO: 7294694 - DNA, 22 bp, Homo sapiens
cagcagcaaatctagaagagga

SEQ ID NO: 7294695 - DNA, 22 bp, Homo sapiens
gtatattttgatcaccctctat

SEQ ID NO: 7294696 - DNA, 19 bp, Homo sapiens
gtatatttatatggctgta

SEQ ID NO: 7294697 - DNA, 22 bp, Homo sapiens
cagcaataaggtaagcttctcc

SEQ ID NO: 7294698 - DNA, 22 bp, Homo sapiens
cagccacagctgggtgcctgac

SEQ ID NO: 7294699 - DNA, 22 bp, Homo sapiens
cagccaaatgagtcataaatgt

SEQ ID NO: 7294700 - DNA, 22 bp, Homo sapiens
cagcattgatcccaggctgtgg

SEQ ID NO: 7294701 - DNA, 22 bp, Homo sapiens
cagcattctactttgtgaactg

SEQ ID NO: 7294702 - DNA, 22 bp, Homo sapiens
cagcatgcctgggctgcctgcc

SEQ ID NO: 7294703 - DNA, 22 bp, Homo sapiens
cagcatttatcttgtagcagga

SEQ ID NO: 7294704 - DNA, 22 bp, Homo sapiens
cagcatttggaggagaggcttt

SEQ ID NO: 7294705 - DNA, 22 bp, Homo sapiens
cagcccagcagtcttagcctgc

SEQ ID NO: 7294706 - DNA, 22 bp, Homo sapiens
cagcccagcagactgttaccac

SEQ ID NO: 7294707 - DNA, 22 bp, Homo sapiens
cagcccagagccagttcccgct

SEQ ID NO: 7294708 - DNA, 22 bp, Homo sapiens
cagaaggtgaaggcagaacctt

SEQ ID NO: 7294709 - DNA, 22 bp, Homo sapiens
gggaaagaccctgagtcttatt

SEQ ID NO: 7294710 - DNA, 22 bp, Homo sapiens
gggaaagacttattttgacttc

SEQ ID NO: 7294711 - DNA, 22 bp, Homo sapiens
cagaaggcctgaatctttgttc

SEQ ID NO: 7294712 - DNA, 22 bp, Homo sapiens
gggcacaccttgtctgagcaca

SEQ ID NO: 7294713 - DNA, 22 bp, Homo sapiens
gggagcaggagcctgcctgcca

SEQ ID NO: 7294714 - DNA, 22 bp, Homo sapiens
cagaataaaaactcctatgtct

SEQ ID NO: 7294715 - DNA, 21 bp, Homo sapiens
cagagctgaagggtgtagtgt

SEQ ID NO: 7294716 - DNA, 22 bp, Homo sapiens
cagagctgacccaaggattgaa

SEQ ID NO: 7294717 - DNA, 23 bp, Homo sapiens
cagagctgattaaacttaatctc

SEQ ID NO: 7294718 - DNA, 22 bp, Homo sapiens
cagagctgcagattgaaggcat

SEQ ID NO: 7294719 - DNA, 19 bp, Homo sapiens
cagagctgctggcctcgtc

SEQ ID NO: 7294720 - DNA, 22 bp, Homo sapiens
cagagctgcgctttttcctggt

SEQ ID NO: 7294721 - DNA, 22 bp, Homo sapiens
gggtgcctacatgtcctccatg

SEQ ID NO: 7294722 - DNA, 22 bp, Homo sapiens
gggtgcagggtctccagcagct

SEQ ID NO: 7294723 - DNA, 22 bp, Homo sapiens
gggtgcaggggaccctagggac

SEQ ID NO: 7294724 - DNA, 22 bp, Homo sapiens
cagagctggtgttacaagtcca

SEQ ID NO: 7294725 - DNA, 22 bp, Homo sapiens
cagagctgtcatttgccagtga

SEQ ID NO: 7294726 - DNA, 22 bp, Homo sapiens
cagagctggtgtgtcctggcat

SEQ ID NO: 7294727 - DNA, 22 bp, Homo sapiens
cagagctggtaagtggtagagg

SEQ ID NO: 7294728 - DNA, 22 bp, Homo sapiens
agtggtcttcaattccctttgt

SEQ ID NO: 7294729 - DNA, 21 bp, Homo sapiens
agtggtctttttcacccagtg

SEQ ID NO: 7294730 - DNA, 22 bp, Homo sapiens
ctctgtccttgcacagttccta

SEQ ID NO: 7294731 - DNA, 22 bp, Homo sapiens
ctctgtagaaagagcccaggtg

SEQ ID NO: 7294732 - DNA, 22 bp, Homo sapiens
ctctggagaggttcccatggga

SEQ ID NO: 7294733 - DNA, 22 bp, Homo sapiens
ctctggagatggttctcaattg

SEQ ID NO: 7294734 - DNA, 22 bp, Homo sapiens
ctctggagcaccgggctatcca

SEQ ID NO: 7294735 - DNA, 22 bp, Homo sapiens
ctctgctgccaccagaaccact

SEQ ID NO: 7294736 - DNA, 22 bp, Homo sapiens
ctctctccttagctgcagacca

SEQ ID NO: 7294737 - DNA, 22 bp, Homo sapiens
ctctccccacaccctctgcatg

SEQ ID NO: 7294738 - DNA, 22 bp, Homo sapiens
ctctcccagtcaggctcaggat

SEQ ID NO: 7294739 - DNA, 20 bp, Homo sapiens
ctctcccagcacagcttcct

SEQ ID NO: 7294740 - DNA, 19 bp, Homo sapiens
ctctctccagtggctggct

SEQ ID NO: 7294741 - DNA, 22 bp, Homo sapiens
agtgctggagggaggcaggttc

SEQ ID NO: 7294742 - DNA, 22 bp, Homo sapiens
agtgctggattacaggcgtgag

SEQ ID NO: 7294743 - DNA, 22 bp, Homo sapiens
ctcagtggtcggcacagtttgt

SEQ ID NO: 7294744 - DNA, 22 bp, Homo sapiens
ctcagcacattcctaagggatg

SEQ ID NO: 7294745 - DNA, 22 bp, Homo sapiens
ctcagctagtaacgtacatgtc

SEQ ID NO: 7294746 - DNA, 22 bp, Homo sapiens
ctcaacatatgactttggtggg

SEQ ID NO: 7294747 - DNA, 22 bp, Homo sapiens
ctatttatgtccaagtgtttta

SEQ ID NO: 7294748 - DNA, 22 bp, Homo sapiens
ctatttatgtgctattttgtat

SEQ ID NO: 7294749 - DNA, 22 bp, Homo sapiens
ctcagcaaccctagaacatttg

SEQ ID NO: 7294750 - DNA, 22 bp, Homo sapiens
ctcagcaagacccccaccgtgt

SEQ ID NO: 7294751 - DNA, 22 bp, Homo sapiens
ctcagcaattacctgtgtctct

SEQ ID NO: 7294752 - DNA, 22 bp, Homo sapiens
ctcagcaagattaagcagcttg

SEQ ID NO: 7294753 - DNA, 19 bp, Homo sapiens
ctcagcaagatagaaatgg

SEQ ID NO: 7294754 - DNA, 22 bp, Homo sapiens
ctcagcaacccacacacggtct

SEQ ID NO: 7294755 - DNA, 22 bp, Homo sapiens
ctcagcaacagcgacttaaggg

SEQ ID NO: 7294756 - DNA, 22 bp, Homo sapiens
ctcagcaacacggcctattaag

SEQ ID NO: 7294757 - DNA, 22 bp, Homo sapiens
ctcagaaattacaaaagggaca

SEQ ID NO: 7294758 - DNA, 22 bp, Homo sapiens
agggtctctacgcactagaggg

SEQ ID NO: 7294759 - DNA, 22 bp, Homo sapiens
agggtctcagagcctgagaacc

SEQ ID NO: 7294760 - DNA, 22 bp, Homo sapiens
agggtcagctggctgtcagggg

SEQ ID NO: 7294761 - DNA, 22 bp, Homo sapiens
agggtctctgggagtagggcac

SEQ ID NO: 7294762 - DNA, 22 bp, Homo sapiens
agggtctctggagagctgagga

SEQ ID NO: 7294763 - DNA, 22 bp, Homo sapiens
agggtctcttgccatgcctcag

SEQ ID NO: 7294764 - DNA, 22 bp, Homo sapiens
agggtctgaccaccagtaggga

SEQ ID NO: 7294765 - DNA, 20 bp, Homo sapiens
agggtctgctgggtaggaca

SEQ ID NO: 7294766 - DNA, 22 bp, Homo sapiens
agggtctgactgaatggaaaag

SEQ ID NO: 7294767 - DNA, 22 bp, Homo sapiens
agggtctgtggatgcatctggg

SEQ ID NO: 7294768 - DNA, 22 bp, Homo sapiens
agggtctgtgcaagaacacgcc

SEQ ID NO: 7294769 - DNA, 22 bp, Homo sapiens
cctctctcttgtagtccctgcc

SEQ ID NO: 7294770 - DNA, 22 bp, Homo sapiens
cctctgcatgtgcagtaccgag

SEQ ID NO: 7294771 - DNA, 22 bp, Homo sapiens
cctctgagttggcctgtcttgt

SEQ ID NO: 7294772 - DNA, 22 bp, Homo sapiens
cctttgtaagatgtgaagactg

SEQ ID NO: 7294773 - DNA, 22 bp, Homo sapiens
agtatatttgttaagattattc

SEQ ID NO: 7294774 - DNA, 22 bp, Homo sapiens
cggagcgctgggggactctgca

SEQ ID NO: 7294775 - DNA, 22 bp, Homo sapiens
cggagctgcgccgggacacggg

SEQ ID NO: 7294776 - DNA, 22 bp, Homo sapiens
aggtgggaacccagcagggccc

SEQ ID NO: 7294777 - DNA, 22 bp, Homo sapiens
ccttggccctagcctcaggcaa

SEQ ID NO: 7294778 - DNA, 22 bp, Homo sapiens
ctgcagcctccaccttttgggt

SEQ ID NO: 7294779 - DNA, 22 bp, Homo sapiens
agtttaattggaggcgtggctc

SEQ ID NO: 7294780 - DNA, 22 bp, Homo sapiens
agtttaatcctccagcccaact

SEQ ID NO: 7294781 - DNA, 22 bp, Homo sapiens
agtttaatatccttcaactttc

SEQ ID NO: 7294782 - DNA, 22 bp, Homo sapiens
atacaagactcagcacagacgg

SEQ ID NO: 7294783 - DNA, 22 bp, Homo sapiens
ctggagccccaggctgtgcaga

SEQ ID NO: 7294784 - DNA, 22 bp, Homo sapiens
ctggcagcggtttgcagcctgg

SEQ ID NO: 7294785 - DNA, 22 bp, Homo sapiens
atacttctctgaggtaggtaaa

SEQ ID NO: 7294786 - DNA, 22 bp, Homo sapiens
atacttctttagcatattgaac

SEQ ID NO: 7294787 - DNA, 22 bp, Homo sapiens
atacttctcatgggctctgagc

SEQ ID NO: 7294788 - DNA, 22 bp, Homo sapiens
atccaccctgtggtggctttct

SEQ ID NO: 7294789 - DNA, 22 bp, Homo sapiens
atcccttgtgctcagcctcttg

SEQ ID NO: 7294790 - DNA, 22 bp, Homo sapiens
atcctaaagaaatatttattaa

SEQ ID NO: 7294791 - DNA, 22 bp, Homo sapiens
atcctaaaattgttcaatttct

SEQ ID NO: 7294792 - DNA, 22 bp, Homo sapiens
atcctaaattgagagctctaat

SEQ ID NO: 7294793 - DNA, 22 bp, Homo sapiens
atcctcacatttgggcaggtga

SEQ ID NO: 7294794 - DNA, 22 bp, Homo sapiens
atcattttgtgacaatgcctgt

SEQ ID NO: 7294795 - DNA, 22 bp, Homo sapiens
atcacagtgctaggctgaggga

SEQ ID NO: 7294796 - DNA, 22 bp, Homo sapiens
atcacagtgccttcgtaaattt

SEQ ID NO: 7294797 - DNA, 22 bp, Homo sapiens
atcacagtctttttcttaagta

SEQ ID NO: 7294798 - DNA, 22 bp, Homo sapiens
atcacagttactcaaataatga

SEQ ID NO: 7294799 - DNA, 22 bp, Homo sapiens
atcacagtgtagaccttttaaa

SEQ ID NO: 7294800 - DNA, 22 bp, Homo sapiens
atcacagtggctacctctggat

SEQ ID NO: 7294801 - DNA, 22 bp, Homo sapiens
atcacagtggcagggatttggg

SEQ ID NO: 7294802 - DNA, 22 bp, Homo sapiens
atcacatctcaccactgcaacc

SEQ ID NO: 7294803 - DNA, 22 bp, Homo sapiens
atcacagttttgtgccttgtgg

SEQ ID NO: 7294804 - DNA, 22 bp, Homo sapiens
atcacagttttaccatttggta

SEQ ID NO: 7294805 - DNA, 22 bp, Homo sapiens
atcacagtttacaaacctgctg

SEQ ID NO: 7294806 - DNA, 22 bp, Homo sapiens
ctgtccagtctttagcaagctg

SEQ ID NO: 7294807 - DNA, 22 bp, Homo sapiens
ctgtctttggtcctgtctgtta

SEQ ID NO: 7294808 - DNA, 22 bp, Homo sapiens
ctgtgcagctggcttcctggaa

SEQ ID NO: 7294809 - DNA, 22 bp, Homo sapiens
ctgtgcagcttggcttcaggcc

SEQ ID NO: 7294810 - DNA, 22 bp, Homo sapiens
ctgtgatgatggaaactttctt

SEQ ID NO: 7294811 - DNA, 18 bp, Homo sapiens
atcatgctgaattaaaga

SEQ ID NO: 7294812 - DNA, 22 bp, Homo sapiens
atataactcttgttcttatagt

SEQ ID NO: 7294813 - DNA, 22 bp, Homo sapiens
atatatatgctgatggctgcca

SEQ ID NO: 7294814 - DNA, 22 bp, Homo sapiens
atatatattgcccaggctggtt

SEQ ID NO: 7294815 - DNA, 22 bp, Homo sapiens
atatggctgttgcacatctaag

SEQ ID NO: 7294816 - DNA, 22 bp, Homo sapiens
atatgttgagcaagcatgatta

SEQ ID NO: 7294817 - DNA, 22 bp, Homo sapiens
atatttctccaaatgttttcaa

SEQ ID NO: 7294818 - DNA, 20 bp, Homo sapiens
atatttcttaagaactttca

SEQ ID NO: 7294819 - DNA, 22 bp, Homo sapiens
atatttctgggggtgtgtttct

SEQ ID NO: 7294820 - DNA, 22 bp, Homo sapiens
cccagctccttgtttgcatctc

SEQ ID NO: 7294821 - DNA, 22 bp, Homo sapiens
cccagcactcagcaggctcata

SEQ ID NO: 7294822 - DNA, 22 bp, Homo sapiens
ccatgagacagcaactgaaagt

SEQ ID NO: 7294823 - DNA, 22 bp, Homo sapiens
ccatgagaagttagactagcca

SEQ ID NO: 7294824 - DNA, 22 bp, Homo sapiens
agggagcagcagccacaggatg

SEQ ID NO: 7294825 - DNA, 22 bp, Homo sapiens
ccccattctggccagcccagct

SEQ ID NO: 7294826 - DNA, 22 bp, Homo sapiens
ccccaggtggatggctcgcata

SEQ ID NO: 7294827 - DNA, 22 bp, Homo sapiens
cctccaggaggaaatggaacac

SEQ ID NO: 7294828 - DNA, 22 bp, Homo sapiens
cctcccagtgcctccagagcag

SEQ ID NO: 7294829 - DNA, 22 bp, Homo sapiens
cctcccagtgcctccagagcag

SEQ ID NO: 7294830 - DNA, 22 bp, Homo sapiens
cctccccacagcccaggagact

SEQ ID NO: 7294831 - DNA, 22 bp, Homo sapiens
ccctgggatggattggcaggaa

SEQ ID NO: 7294832 - DNA, 22 bp, Homo sapiens
agggccaggctcccatgtcagg

SEQ ID NO: 7294833 - DNA, 22 bp, Homo sapiens
agggccagctgatgagaatgag

SEQ ID NO: 7294834 - DNA, 19 bp, Homo sapiens
agggccaggattctggaac

SEQ ID NO: 7294835 - DNA, 22 bp, Homo sapiens
ccaggccaaattcagtcagcag

SEQ ID NO: 7294836 - DNA, 23 bp, Homo sapiens
ccagtgattgcctggaaggaggt

SEQ ID NO: 7294837 - DNA, 22 bp, Homo sapiens
aggcagtggagctggaataggc

SEQ ID NO: 7294838 - DNA, 22 bp, Homo sapiens
ccactggagatgtcagacaggt

SEQ ID NO: 7294839 - DNA, 22 bp, Homo sapiens
catgcacactgcaacaaggact

SEQ ID NO: 7294840 - DNA, 22 bp, Homo sapiens
catgcacagtgatatctgaaga

SEQ ID NO: 7294841 - DNA, 22 bp, Homo sapiens
catgcacttacctgaaattcaa

SEQ ID NO: 7294842 - DNA, 22 bp, Homo sapiens
catgaaatattagtaactgttt

SEQ ID NO: 7294843 - DNA, 22 bp, Homo sapiens
catgaaatgttagaattagaca

SEQ ID NO: 7294844 - DNA, 22 bp, Homo sapiens
catgaaatgtgttaatctcttg

SEQ ID NO: 7294845 - DNA, 22 bp, Homo sapiens
cattatgaatggagtttgaggt

SEQ ID NO: 7294846 - DNA, 22 bp, Homo sapiens
catggcggtcaggatgtaggtg

SEQ ID NO: 7294847 - DNA, 22 bp, Homo sapiens
catttacagtgagagtttttac

SEQ ID NO: 7294848 - DNA, 22 bp, Homo sapiens
aggagccatgagcaggaggcaa

SEQ ID NO: 7294849 - DNA, 22 bp, Homo sapiens
aggagctgataaaagggggtca

SEQ ID NO: 7294850 - DNA, 20 bp, Homo sapiens
aggagaaattcgggacacct

SEQ ID NO: 7294851 - DNA, 22 bp, Homo sapiens
aggaaggaagagacaccatttg

SEQ ID NO: 7294852 - DNA, 20 bp, Homo sapiens
aggaaggaagtttgcatgga

SEQ ID NO: 7294853 - DNA, 22 bp, Homo sapiens
aggaaatgggaatagatggtat

SEQ ID NO: 7294854 - DNA, 22 bp, Homo sapiens
aggaaattgtctttttccttgt

SEQ ID NO: 7294855 - DNA, 22 bp, Homo sapiens
aggaagctcagagaagtctttt

SEQ ID NO: 7294856 - DNA, 22 bp, Homo sapiens
caggcctgggttcaaatccctt

SEQ ID NO: 7294857 - DNA, 22 bp, Homo sapiens
agcttgtcacttaaggtctttg

SEQ ID NO: 7294858 - DNA, 22 bp, Homo sapiens
agcttacagttcaatgacaaag

SEQ ID NO: 7294859 - DNA, 22 bp, Homo sapiens
cagctctactgggcaccattcg

SEQ ID NO: 7294860 - DNA, 22 bp, Homo sapiens
caggacacttgttcttctctgc

SEQ ID NO: 7294861 - DNA, 22 bp, Homo sapiens
atggacagtactgagtggacta

SEQ ID NO: 7294862 - DNA, 22 bp, Homo sapiens
atggaaagccagtgttccatca

SEQ ID NO: 7294863 - DNA, 22 bp, Homo sapiens
atggaaaggctgtggaaactta

SEQ ID NO: 7294864 - DNA, 22 bp, Homo sapiens
atggaaagctaagccatttacc

SEQ ID NO: 7294865 - DNA, 22 bp, Homo sapiens
atggaaagggaagcaaggaaca

SEQ ID NO: 7294866 - DNA, 22 bp, Homo sapiens
atggaaagtgcatggaagtcat

SEQ ID NO: 7294867 - DNA, 22 bp, Homo sapiens
atggaaatacagccagagcaga

SEQ ID NO: 7294868 - DNA, 22 bp, Homo sapiens
atgcagggattaaatgactgcc

SEQ ID NO: 7294869 - DNA, 22 bp, Homo sapiens
atgcaggggcagcagagcctgg

SEQ ID NO: 7294870 - DNA, 21 bp, Homo sapiens
atggctggtggctcagcctcc

SEQ ID NO: 7294871 - DNA, 22 bp, Homo sapiens
atggataacccagttcatttct

SEQ ID NO: 7294872 - DNA, 22 bp, Homo sapiens
atgtcaaatgctgcaaactcat

SEQ ID NO: 7294873 - DNA, 22 bp, Homo sapiens
atgtccaatttcagagtctcat

SEQ ID NO: 7294874 - DNA, 22 bp, Homo sapiens
atgtacataaaatgtataatga

SEQ ID NO: 7294875 - DNA, 22 bp, Homo sapiens
atgtacagccacttcacagtta

SEQ ID NO: 7294876 - DNA, 22 bp, Homo sapiens
atgggaggcagcagagcccagc

SEQ ID NO: 7294877 - DNA, 22 bp, Homo sapiens
atgtacacacaagtttgcacgc

SEQ ID NO: 7294878 - DNA, 22 bp, Homo sapiens
agaagagaactgccaaacactt

SEQ ID NO: 7294879 - DNA, 22 bp, Homo sapiens
agaagcacaccagtagacaggg

SEQ ID NO: 7294880 - DNA, 22 bp, Homo sapiens
agacacagaacacaaaagcata

SEQ ID NO: 7294881 - DNA, 22 bp, Homo sapiens
agacacagtttgggatgggttg

SEQ ID NO: 7294882 - DNA, 22 bp, Homo sapiens
agacacagtgttgaaggctagt

SEQ ID NO: 7294883 - DNA, 23 bp, Homo sapiens
agacacataggagcagctattgg

SEQ ID NO: 7294884 - DNA, 22 bp, Homo sapiens
agagtggcttctttgacatgct

SEQ ID NO: 7294885 - DNA, 22 bp, Homo sapiens
atttagtgaaacccataaagca

SEQ ID NO: 7294886 - DNA, 22 bp, Homo sapiens
atttagtgtgtattgctattat

SEQ ID NO: 7294887 - DNA, 22 bp, Homo sapiens
atttagtgtattctaatatgtg

SEQ ID NO: 7294888 - DNA, 22 bp, Homo sapiens
atttagtgtatcaatgtgatat

SEQ ID NO: 7294889 - DNA, 22 bp, Homo sapiens
atttagtgaccagcactagaaa

SEQ ID NO: 7294890 - DNA, 22 bp, Homo sapiens
attgttaataactattacattg

SEQ ID NO: 7294891 - DNA, 22 bp, Homo sapiens
atttaataccacttggtgcttt

SEQ ID NO: 7294892 - DNA, 22 bp, Homo sapiens
atttaagggatttggagaccaa

SEQ ID NO: 7294893 - DNA, 22 bp, Homo sapiens
atttcattgaagttaattcttc

SEQ ID NO: 7294894 - DNA, 22 bp, Homo sapiens
agatgaaagatttttatagaga

SEQ ID NO: 7294895 - DNA, 22 bp, Homo sapiens
agcaaacagtgtgctaagaaat

SEQ ID NO: 7294896 - DNA, 22 bp, Homo sapiens
atttgctggtgaatgtatagct

SEQ ID NO: 7294897 - DNA, 22 bp, Homo sapiens
attcacaattagaagtagataa

SEQ ID NO: 7294898 - DNA, 22 bp, Homo sapiens
attcacacatactcatgtgtga

SEQ ID NO: 7294899 - DNA, 22 bp, Homo sapiens
attcagcacatctttgtacagc

SEQ ID NO: 7294900 - DNA, 22 bp, Homo sapiens
attcagcaagctatgggacagg

SEQ ID NO: 7294901 - DNA, 22 bp, Homo sapiens
attcagcaaacatttattgtgt

SEQ ID NO: 7294902 - DNA, 19 bp, Homo sapiens
attcagcattctgcacttc

SEQ ID NO: 7294903 - DNA, 22 bp, Homo sapiens
attcagcattcatttccaactt

SEQ ID NO: 7294904 - DNA, 22 bp, Homo sapiens
attcagcatgcaattaggtaat

SEQ ID NO: 7294905 - DNA, 17 bp, Homo sapiens
atgttaatttcacattt

SEQ ID NO: 7294906 - DNA, 23 bp, Homo sapiens
atgtttgcagtaacccatcctgg

SEQ ID NO: 7294907 - DNA, 22 bp, Homo sapiens
atgtgtgtacacacgtgactct

SEQ ID NO: 7294908 - DNA, 22 bp, Homo sapiens
atgtgtgtaaacaagtataatt

SEQ ID NO: 7294909 - DNA, 22 bp, Homo sapiens
attaaacaatgtaaagttcttg

SEQ ID NO: 7294910 - DNA, 22 bp, Homo sapiens
atgtttgtcaggattgtaatta

SEQ ID NO: 7294911 - DNA, 22 bp, Homo sapiens
cactctgtgattgcagcattcc

SEQ ID NO: 7294912 - DNA, 22 bp, Homo sapiens
agccacagagagggagctgcaa

SEQ ID NO: 7294913 - DNA, 19 bp, Homo sapiens
agccacagaacttgcagga

SEQ ID NO: 7294914 - DNA, 17 bp, Homo sapiens
cagaaggaagcatggca

SEQ ID NO: 7294915 - DNA, 22 bp, Homo sapiens
agccaggatggtctcgatcggc

SEQ ID NO: 7294916 - DNA, 22 bp, Homo sapiens
cagacagaggctgtatgagggc

SEQ ID NO: 7294917 - DNA, 18 bp, Homo sapiens
agccaggtggaatggaac

SEQ ID NO: 7294918 - DNA, 17 bp, Homo sapiens
agcccccactcccaagt

SEQ ID NO: 7294919 - DNA, 22 bp, Homo sapiens
agcccggcttccccggttgcta

SEQ ID NO: 7294920 - DNA, 22 bp, Homo sapiens
cagcagcagtggctgcagaaca

SEQ ID NO: 7294921 - DNA, 22 bp, Homo sapiens
agcctccatcccatgcacaaag

SEQ ID NO: 7294922 - DNA, 22 bp, Homo sapiens
cagaggctaagatgagtgggtg

SEQ ID NO: 7294923 - DNA, 22 bp, Homo sapiens
agccctcctcacatcagcgtcc

SEQ ID NO: 7294924 - DNA, 18 bp, Homo sapiens
agccctccaggtgattct

SEQ ID NO: 7294925 - DNA, 22 bp, Homo sapiens
cacagggcttctcatggggtgc

SEQ ID NO: 7294926 - DNA, 22 bp, Homo sapiens
cacagggctttgatggctgagt

SEQ ID NO: 7294927 - DNA, 22 bp, Homo sapiens
cacaggctgcccgcagctggga

SEQ ID NO: 7294928 - DNA, 22 bp, Homo sapiens
cacagggcagtgctgcccactc

SEQ ID NO: 7294929 - DNA, 22 bp, Homo sapiens
cacagggccttgtgtgactgca

SEQ ID NO: 7294930 - DNA, 22 bp, Homo sapiens
cacagggccactttcccagtaa

SEQ ID NO: 7294931 - DNA, 22 bp, Homo sapiens
cacaggaggttaggaagtggtc

SEQ ID NO: 7294932 - DNA, 22 bp, Homo sapiens
agcataaactcagggacacaca

SEQ ID NO: 7294933 - DNA, 22 bp, Homo sapiens
agcataaaggcactagaaagag

SEQ ID NO: 7294934 - DNA, 22 bp, Homo sapiens
agcaggtgccaggtgtacccgc

SEQ ID NO: 7294935 - DNA, 22 bp, Homo sapiens
cacagtcacatatctatgtgtg

SEQ ID NO: 7294936 - DNA, 22 bp, Homo sapiens
cacagtcaatgtagaaatatga

SEQ ID NO: 7294937 - DNA, 22 bp, Homo sapiens
cacatcagggctgcttgggggt

SEQ ID NO: 7294938 - DNA, 22 bp, Homo sapiens
caactcctggctgttaggcaca

SEQ ID NO: 7294939 - DNA, 22 bp, Homo sapiens
caactcctccccagcatgccaa

SEQ ID NO: 7294940 - DNA, 22 bp, Homo sapiens
agcacaaaaacattcccagagt

SEQ ID NO: 7294941 - DNA, 22 bp, Homo sapiens
attttctatgttgtaattgtta

SEQ ID NO: 7294942 - DNA, 22 bp, Homo sapiens
agcacagagaagatttcaatta

SEQ ID NO: 7294943 - DNA, 22 bp, Homo sapiens
agcacagagctaggagtggagg

SEQ ID NO: 7294944 - DNA, 22 bp, Homo sapiens
agcacagatttgtcaacataga

SEQ ID NO: 7294945 - DNA, 22 bp, Homo sapiens
caaatgttaagacaggatcaag

SEQ ID NO: 7294946 - DNA, 22 bp, Homo sapiens
caaatgcaaaatataaccctgt

SEQ ID NO: 7294947 - DNA, 22 bp, Homo sapiens
actcatttgacactttaaactg

SEQ ID NO: 7294948 - DNA, 22 bp, Homo sapiens
actggcagaggatagcactaat

SEQ ID NO: 7294949 - DNA, 22 bp, Homo sapiens
actgcaacctccacctcctggg

SEQ ID NO: 7294950 - DNA, 22 bp, Homo sapiens
actgcaacctccgcctgccagg

SEQ ID NO: 7294951 - DNA, 22 bp, Homo sapiens
actgattgcattcatagggttt

SEQ ID NO: 7294952 - DNA, 23 bp, Homo sapiens
actgattaacatgtgtgatattc

SEQ ID NO: 7294953 - DNA, 22 bp, Homo sapiens
acctggacacctgctgtcatct

SEQ ID NO: 7294954 - DNA, 22 bp, Homo sapiens
acctggacctgccacctatgag

SEQ ID NO: 7294955 - DNA, 22 bp, Homo sapiens
acctggacttgaatcctgactt

SEQ ID NO: 7294956 - DNA, 22 bp, Homo sapiens
agggctgtcagactgaggaggc

SEQ ID NO: 7294957 - DNA, 22 bp, Homo sapiens
agggctgtgtccctaggggagc

SEQ ID NO: 7294958 - DNA, 22 bp, Homo sapiens
actaaaacatagccagtcagtg

SEQ ID NO: 7294959 - DNA, 22 bp, Homo sapiens
actcattaaataggatgatttt

SEQ ID NO: 7294960 - DNA, 18 bp, Homo sapiens
actatgctgaataaatgg

SEQ ID NO: 7294961 - DNA, 22 bp, Homo sapiens
actgtgactgtgtcttctgggc

SEQ ID NO: 7294962 - DNA, 22 bp, Homo sapiens
actgtgactgagcattcacatg

SEQ ID NO: 7294963 - DNA, 22 bp, Homo sapiens
actgtgaacggactgaagccca

SEQ ID NO: 7294964 - DNA, 22 bp, Homo sapiens
actgtgaacggactgaagccca

SEQ ID NO: 7294965 - DNA, 22 bp, Homo sapiens
acttgccccagaattgctgctg

SEQ ID NO: 7294966 - DNA, 22 bp, Homo sapiens
acttccagaattagaatttaag

SEQ ID NO: 7294967 - DNA, 22 bp, Homo sapiens
acttgcaggtgtctggagttag

SEQ ID NO: 7294968 - DNA, 22 bp, Homo sapiens
acttgcaggatcctctgcctga

SEQ ID NO: 7294969 - DNA, 22 bp, Homo sapiens
acttgcagaaacttcaattctg

SEQ ID NO: 7294970 - DNA, 22 bp, Homo sapiens
acttgcagatggtatggaatgt

SEQ ID NO: 7294971 - DNA, 22 bp, Homo sapiens
actgttatgatttacacagtcc

SEQ ID NO: 7294972 - DNA, 22 bp, Homo sapiens
actgttatagttcacttttccc

SEQ ID NO: 7294973 - DNA, 18 bp, Homo sapiens
actgttatctgataaggc

SEQ ID NO: 7294974 - DNA, 22 bp, Homo sapiens
atataatttagaaggggaaaca

SEQ ID NO: 7294975 - DNA, 22 bp, Homo sapiens
atataattgttctgaagtgttt

SEQ ID NO: 7294976 - DNA, 22 bp, Homo sapiens
atataatttttggttagctcaa

SEQ ID NO: 7294977 - DNA, 22 bp, Homo sapiens
agaaaatttattcatgttagtt

SEQ ID NO: 7294978 - DNA, 22 bp, Homo sapiens
agaaacaaggtgtaggttgacc

SEQ ID NO: 7294979 - DNA, 22 bp, Homo sapiens
atatatttgagaatattcatga

SEQ ID NO: 7294980 - DNA, 22 bp, Homo sapiens
atatatttactctcctgttgca

SEQ ID NO: 7294981 - DNA, 22 bp, Homo sapiens
atatcttctttattttgtgagg

SEQ ID NO: 7294982 - DNA, 22 bp, Homo sapiens
atatctcaatacagctgtttta

SEQ ID NO: 7294983 - DNA, 22 bp, Homo sapiens
atatctcattaccttgctgttc

SEQ ID NO: 7294984 - DNA, 22 bp, Homo sapiens
atatccatagtaaaagtcatta

SEQ ID NO: 7294985 - DNA, 22 bp, Homo sapiens
atatattttgaatagcctctgt

SEQ ID NO: 7294986 - DNA, 22 bp, Homo sapiens
atcagatatttaagttatcaac

SEQ ID NO: 7294987 - DNA, 22 bp, Homo sapiens
atcactgttatctagaagcaca

SEQ ID NO: 7294988 - DNA, 22 bp, Homo sapiens
atcagcaaggcaatcactgcag

SEQ ID NO: 7294989 - DNA, 19 bp, Homo sapiens
atcagcaaggtaggatgtg

SEQ ID NO: 7294990 - DNA, 22 bp, Homo sapiens
atcagcaagtcctgttaattct

SEQ ID NO: 7294991 - DNA, 22 bp, Homo sapiens
atcagcaagcatggttaggtgt

SEQ ID NO: 7294992 - DNA, 22 bp, Homo sapiens
atcagcaagcatttattgagtg

SEQ ID NO: 7294993 - DNA, 22 bp, Homo sapiens
atcagcaagattgtgtcttgta

SEQ ID NO: 7294994 - DNA, 22 bp, Homo sapiens
atcagcaagatgtaatttctat

SEQ ID NO: 7294995 - DNA, 22 bp, Homo sapiens
atcagcaagactaggggaatac

SEQ ID NO: 7294996 - DNA, 20 bp, Homo sapiens
atcagcaactgccactcagt

SEQ ID NO: 7294997 - DNA, 21 bp, Homo sapiens
atcagcaaatgcctgtctccc

SEQ ID NO: 7294998 - DNA, 22 bp, Homo sapiens
atcagcaaaaatgccttcagaa

SEQ ID NO: 7294999 - DNA, 22 bp, Homo sapiens
atcattgaatataagtgctatt

SEQ ID NO: 7295000 - DNA, 22 bp, Homo sapiens
atcatttaaaacaagtctctat

SEQ ID NO: 7295001 - DNA, 22 bp, Homo sapiens
atcatttacaaactcagcattg

SEQ ID NO: 7295002 - DNA, 22 bp, Homo sapiens
aggctagctaatgagtactgtg

SEQ ID NO: 7295003 - DNA, 22 bp, Homo sapiens
aggctagctgtttcagggctag

SEQ ID NO: 7295004 - DNA, 22 bp, Homo sapiens
aggctagctttggctcagtaaa

SEQ ID NO: 7295005 - DNA, 22 bp, Homo sapiens
acattgtgcctgtgatattaca

SEQ ID NO: 7295006 - DNA, 22 bp, Homo sapiens
acatttattactcaggttgttg

SEQ ID NO: 7295007 - DNA, 22 bp, Homo sapiens
acatttatataactcactagga

SEQ ID NO: 7295008 - DNA, 21 bp, Homo sapiens
acatggactgtgaatggggac

SEQ ID NO: 7295009 - DNA, 22 bp, Homo sapiens
acatgcacccagggcattgctt

SEQ ID NO: 7295010 - DNA, 22 bp, Homo sapiens
accaggcccaccgcatgctcct

SEQ ID NO: 7295011 - DNA, 21 bp, Homo sapiens
agggacacacaggatggggct

SEQ ID NO: 7295012 - DNA, 22 bp, Homo sapiens
agggacacgaggtcctgctggg

SEQ ID NO: 7295013 - DNA, 22 bp, Homo sapiens
acccaggcctgagagacaggag

SEQ ID NO: 7295014 - DNA, 22 bp, Homo sapiens
acccgatgttggtgctctagta

SEQ ID NO: 7295015 - DNA, 22 bp, Homo sapiens
acccgggaggcaggagtcatag

SEQ ID NO: 7295016 - DNA, 22 bp, Homo sapiens
agggcatgaagcagtggacagc

SEQ ID NO: 7295017 - DNA, 23 bp, Homo sapiens
agggcatgaagcagaggacgtgg

SEQ ID NO: 7295018 - DNA, 22 bp, Homo sapiens
agggcatgaaatgggcagaagc

SEQ ID NO: 7295019 - DNA, 20 bp, Homo sapiens
agggcagcttgaggagccgg

SEQ ID NO: 7295020 - DNA, 22 bp, Homo sapiens
acagcacaggagttgaatgggc

SEQ ID NO: 7295021 - DNA, 22 bp, Homo sapiens
agctgctatgacaacaccagcc

SEQ ID NO: 7295022 - DNA, 22 bp, Homo sapiens
agctgctatgaacattcacata

SEQ ID NO: 7295023 - DNA, 22 bp, Homo sapiens
acagctacatggaatttcattt

SEQ ID NO: 7295024 - DNA, 22 bp, Homo sapiens
acagtgaggacagggactgtgt

SEQ ID NO: 7295025 - DNA, 22 bp, Homo sapiens
acagtttggttgctacagtaaa

SEQ ID NO: 7295026 - DNA, 22 bp, Homo sapiens
acagtttgccctgacattctcc

SEQ ID NO: 7295027 - DNA, 22 bp, Homo sapiens
acagtttgttccttttcattgc

SEQ ID NO: 7295028 - DNA, 21 bp, Homo sapiens
acagttttaaggagcacatgg

SEQ ID NO: 7295029 - DNA, 22 bp, Homo sapiens
agcctctctgatgtgacagcta

SEQ ID NO: 7295030 - DNA, 22 bp, Homo sapiens
agcctctcagagtgctgggatt

SEQ ID NO: 7295031 - DNA, 22 bp, Homo sapiens
agcctctgactgtcagcaaggt

SEQ ID NO: 7295032 - DNA, 21 bp, Homo sapiens
acagagccgggcacaaagctg

SEQ ID NO: 7295033 - DNA, 17 bp, Homo sapiens
acagatgctgataagaa

SEQ ID NO: 7295034 - DNA, 22 bp, Homo sapiens
acagatgagttaaagcagagtg

SEQ ID NO: 7295035 - DNA, 22 bp, Homo sapiens
acagcaattgtatgcatagcat

SEQ ID NO: 7295036 - DNA, 22 bp, Homo sapiens
acagaaagataggcacaaggtc

SEQ ID NO: 7295037 - DNA, 20 bp, Homo sapiens
acagaaagagagaatgtcag

SEQ ID NO: 7295038 - DNA, 22 bp, Homo sapiens
acagagagaaacaatcagcagc

SEQ ID NO: 7295039 - DNA, 22 bp, Homo sapiens
acagactgtgagtatgcatagt

SEQ ID NO: 7295040 - DNA, 22 bp, Homo sapiens
acagactgtcatgacactatat

SEQ ID NO: 7295041 - DNA, 22 bp, Homo sapiens
agcagattggttaagcacatta

SEQ ID NO: 7295042 - DNA, 21 bp, Homo sapiens
acaatgcatggaactcatggc

SEQ ID NO: 7295043 - DNA, 22 bp, Homo sapiens
acactgagctgagcattcttgt

SEQ ID NO: 7295044 - DNA, 22 bp, Homo sapiens
acactgaatgctgtttagaaat

SEQ ID NO: 7295045 - DNA, 21 bp, Homo sapiens
acactgagtgaattagcacat

SEQ ID NO: 7295046 - DNA, 22 bp, Homo sapiens
acacagggcagagagctggctc

SEQ ID NO: 7295047 - DNA, 19 bp, Homo sapiens
acacagggatcagagggtt

SEQ ID NO: 7295048 - DNA, 17 bp, Homo sapiens
acacagggagagggagc

SEQ ID NO: 7295049 - DNA, 22 bp, Homo sapiens
acacagggaggaggtgctgtgc

SEQ ID NO: 7295050 - DNA, 22 bp, Homo sapiens
acacatgtacagattagtattt

SEQ ID NO: 7295051 - DNA, 22 bp, Homo sapiens
acacatgtgattctaagacagc

SEQ ID NO: 7295052 - DNA, 22 bp, Homo sapiens
agataactggtttacattattg

SEQ ID NO: 7295053 - DNA, 22 bp, Homo sapiens
acaagagattatctacagatga

SEQ ID NO: 7295054 - DNA, 22 bp, Homo sapiens
acaagagattatctacagatga

SEQ ID NO: 7295055 - DNA, 17 bp, Homo sapiens
acaacagaaatgtattc

SEQ ID NO: 7295056 - DNA, 22 bp, Homo sapiens
agataaattcctaagatttcag

SEQ ID NO: 7295057 - DNA, 22 bp, Homo sapiens
acaatgaaaggtattctgaact

SEQ ID NO: 7295058 - DNA, 22 bp, Homo sapiens
acaatgaacacacaaggaattc

SEQ ID NO: 7295059 - DNA, 22 bp, Homo sapiens
acaatgaacgctttttaactgt

SEQ ID NO: 7295060 - DNA, 22 bp, Homo sapiens
acaatgaaccaaatttaccaat

SEQ ID NO: 7295061 - DNA, 22 bp, Homo sapiens
acaatgcaataggagctagaaa

SEQ ID NO: 7295062 - DNA, 22 bp, Homo sapiens
acaatgaatatcatgaagtact

SEQ ID NO: 7295063 - DNA, 18 bp, Homo sapiens
acaaaggatcatgaggga

SEQ ID NO: 7295064 - DNA, 22 bp, Homo sapiens
agagggggtgttccagaagcat

SEQ ID NO: 7295065 - DNA, 22 bp, Homo sapiens
agagggggtgtcagcactgcag

SEQ ID NO: 7295066 - DNA, 22 bp, Homo sapiens
agagggggaaaatagaggtgtt

SEQ ID NO: 7295067 - DNA, 22 bp, Homo sapiens
agagggggcagcggaccagtga

SEQ ID NO: 7295068 - DNA, 22 bp, Homo sapiens
aatgtgaggccttggtagttat

SEQ ID NO: 7295069 - DNA, 22 bp, Homo sapiens
aatggagaccctaaggaagagg

SEQ ID NO: 7295070 - DNA, 22 bp, Homo sapiens
aatggaggtgtctggcctggta

SEQ ID NO: 7295071 - DNA, 22 bp, Homo sapiens
agacaatatgtatattaagaat

SEQ ID NO: 7295072 - DNA, 22 bp, Homo sapiens
agaagcagactctgaggcaagg

SEQ ID NO: 7295073 - DNA, 22 bp, Homo sapiens
agaagcagaaggaagcagggcc

SEQ ID NO: 7295074 - DNA, 22 bp, Homo sapiens
agaagcagcaagcccttcaaag

SEQ ID NO: 7295075 - DNA, 23 bp, Homo sapiens
agaagcagcttctggagtatcgg

SEQ ID NO: 7295076 - DNA, 21 bp, Homo sapiens
aatgtggtacattacatgcat

SEQ ID NO: 7295077 - DNA, 22 bp, Homo sapiens
agagccagttaagcacttacag

SEQ ID NO: 7295078 - DNA, 17 bp, Homo sapiens
acagtgtctatgaaatg

SEQ ID NO: 7295079 - DNA, 22 bp, Homo sapiens
acagtctttctacattctgtgc

SEQ ID NO: 7295080 - DNA, 22 bp, Homo sapiens
aaggagacatttgcagagcacc

SEQ ID NO: 7295081 - DNA, 22 bp, Homo sapiens
aagcattttagtaatgaacttg

SEQ ID NO: 7295082 - DNA, 22 bp, Homo sapiens
acagggaaagggacagcagcag

SEQ ID NO: 7295083 - DNA, 22 bp, Homo sapiens
acagggaacaggaatatacaaa

SEQ ID NO: 7295084 - DNA, 22 bp, Homo sapiens
acatttgtttctctagagtagg

SEQ ID NO: 7295085 - DNA, 22 bp, Homo sapiens
acatttgttgccattcatggag

SEQ ID NO: 7295086 - DNA, 22 bp, Homo sapiens
acatttgttcagggctgaggaa

SEQ ID NO: 7295087 - DNA, 22 bp, Homo sapiens
acatttgttgccattcatggag

SEQ ID NO: 7295088 - DNA, 20 bp, Homo sapiens
acatttgtggatctgagaga

SEQ ID NO: 7295089 - DNA, 20 bp, Homo sapiens
acatttgtggatctgagaga

SEQ ID NO: 7295090 - DNA, 22 bp, Homo sapiens
acatttgtgcacatgtgcatgg

SEQ ID NO: 7295091 - DNA, 22 bp, Homo sapiens
acccaggaggtggaggctgcag

SEQ ID NO: 7295092 - DNA, 22 bp, Homo sapiens
acccaggatagagtgctgcagt

SEQ ID NO: 7295093 - DNA, 22 bp, Homo sapiens
acccaggaggcaaggttgcagt

SEQ ID NO: 7295094 - DNA, 22 bp, Homo sapiens
acccaggaggcagaggttgcag

SEQ ID NO: 7295095 - DNA, 22 bp, Homo sapiens
aaggcctttgccccgatacagg

SEQ ID NO: 7295096 - DNA, 22 bp, Homo sapiens
acattgttgtgcaattatagtt

SEQ ID NO: 7295097 - DNA, 22 bp, Homo sapiens
acattgttgtttgcagcacagg

SEQ ID NO: 7295098 - DNA, 22 bp, Homo sapiens
aatactgaattagttgagacaa

SEQ ID NO: 7295099 - DNA, 22 bp, Homo sapiens
aatcaggcgtcaggaaagatag

SEQ ID NO: 7295100 - DNA, 22 bp, Homo sapiens
aatcaggccatggagaagagat

SEQ ID NO: 7295101 - DNA, 19 bp, Homo sapiens
aatcaggctgaagtgtgtt

SEQ ID NO: 7295102 - DNA, 22 bp, Homo sapiens
aatcataattcaaataagctta

SEQ ID NO: 7295103 - DNA, 22 bp, Homo sapiens
aatcagaaattctacatcacaa

SEQ ID NO: 7295104 - DNA, 22 bp, Homo sapiens
agaaatgacacacatgagacat

SEQ ID NO: 7295105 - DNA, 22 bp, Homo sapiens
agaaatgacacacatgagacat

SEQ ID NO: 7295106 - DNA, 22 bp, Homo sapiens
agaaattatgcagtagttttat

SEQ ID NO: 7295107 - DNA, 22 bp, Homo sapiens
agaaattattagtgaatagtct

SEQ ID NO: 7295108 - DNA, 22 bp, Homo sapiens
aatgatttcccctacacagaag

SEQ ID NO: 7295109 - DNA, 22 bp, Homo sapiens
agaagcagaaactgggcttgtg

SEQ ID NO: 7295110 - DNA, 22 bp, Homo sapiens
agaagcagaaaagggcactttt

SEQ ID NO: 7295111 - DNA, 22 bp, Homo sapiens
aatgattactgatcgcatagga

SEQ ID NO: 7295112 - DNA, 22 bp, Homo sapiens
actgcactccagcctgggtaac

SEQ ID NO: 7295113 - DNA, 22 bp, Homo sapiens
actggagcttctaaggaggagt

SEQ ID NO: 7295114 - DNA, 22 bp, Homo sapiens
acgtagcactgagagatgcagg

SEQ ID NO: 7295115 - DNA, 22 bp, Homo sapiens
acctactaattgagataatagg

SEQ ID NO: 7295116 - DNA, 22 bp, Homo sapiens
aacagagcattctgcactacaa

SEQ ID NO: 7295117 - DNA, 22 bp, Homo sapiens
aacagagctctgctctcagatt

SEQ ID NO: 7295118 - DNA, 22 bp, Homo sapiens
aacagactccattacctggctt

SEQ ID NO: 7295119 - DNA, 22 bp, Homo sapiens
aacagacagaaaaatgtgatct

SEQ ID NO: 7295120 - DNA, 22 bp, Homo sapiens
aaatttgtcaacttcatatgtt

SEQ ID NO: 7295121 - DNA, 22 bp, Homo sapiens
aaatgtcagaagctttacttct

SEQ ID NO: 7295122 - DNA, 22 bp, Homo sapiens
aaatgtcagagctggaaggggc

SEQ ID NO: 7295123 - DNA, 22 bp, Homo sapiens
aaatgtcagaaaacatggagtg

SEQ ID NO: 7295124 - DNA, 22 bp, Homo sapiens
aaatgtcatatttaagtaggaa

SEQ ID NO: 7295125 - DNA, 22 bp, Homo sapiens
aaatgtcaggtggtggatggct

SEQ ID NO: 7295126 - DNA, 22 bp, Homo sapiens
aaatgtcagaggaacatattga

SEQ ID NO: 7295127 - DNA, 22 bp, Homo sapiens
aaatgtcaaggtgatagatgca

SEQ ID NO: 7295128 - DNA, 22 bp, Homo sapiens
aaatgcattaagtcagaacaat

SEQ ID NO: 7295129 - DNA, 22 bp, Homo sapiens
aaatgcattaagtcagaacaat

SEQ ID NO: 7295130 - DNA, 22 bp, Homo sapiens
aaatgcatgtatgtaatatgct

SEQ ID NO: 7295131 - DNA, 22 bp, Homo sapiens
aaatgcatttttaattagaccc

SEQ ID NO: 7295132 - DNA, 22 bp, Homo sapiens
aaatgcatttcactaatgtttc

SEQ ID NO: 7295133 - DNA, 22 bp, Homo sapiens
aaatgcattggtttctacttgt

SEQ ID NO: 7295134 - DNA, 22 bp, Homo sapiens
aacatcacaatttcatttatgc

SEQ ID NO: 7295135 - DNA, 22 bp, Homo sapiens
aacataaatttgaagtggcaaa

SEQ ID NO: 7295136 - DNA, 22 bp, Homo sapiens
aatgggaaaagagtatgattta

SEQ ID NO: 7295137 - DNA, 22 bp, Homo sapiens
aagaaactgttgcgtgacagcg

SEQ ID NO: 7295138 - DNA, 22 bp, Homo sapiens
aatttcactgtggagcacattt

SEQ ID NO: 7295139 - DNA, 22 bp, Homo sapiens
aagaacaactgctttaaaagca

SEQ ID NO: 7295140 - DNA, 22 bp, Homo sapiens
aattcacaatgtgtagtcatgc

SEQ ID NO: 7295141 - DNA, 20 bp, Homo sapiens
acacaaagcaatggagtaca

SEQ ID NO: 7295142 - DNA, 21 bp, Homo sapiens
aagagacatttctcatcagca

SEQ ID NO: 7295143 - DNA, 22 bp, Homo sapiens
aagagacaatgtcttttggata

SEQ ID NO: 7295144 - DNA, 22 bp, Homo sapiens
aagagacaatgacacttgggag

SEQ ID NO: 7295145 - DNA, 22 bp, Homo sapiens
aagagaagaaagtgtctacaca

SEQ ID NO: 7295146 - DNA, 22 bp, Homo sapiens
aagcacaatttaggactgaaat

SEQ ID NO: 7295147 - DNA, 22 bp, Homo sapiens
aagcaatagggtaatctactca

SEQ ID NO: 7295148 - DNA, 21 bp, Homo sapiens
aagcagacctgagcacagaac

SEQ ID NO: 7295149 - DNA, 18 bp, Homo sapiens
aagcagacagcagacagt

SEQ ID NO: 7295150 - DNA, 22 bp, Homo sapiens
acagcaaaagacaagaacttaa

SEQ ID NO: 7295151 - DNA, 22 bp, Homo sapiens
acacatgataagaaagtttaaa

SEQ ID NO: 7295152 - DNA, 22 bp, Homo sapiens
acacatgagaaacatcagttgt

SEQ ID NO: 7295153 - DNA, 22 bp, Homo sapiens
acacatgaaataatattatgca

SEQ ID NO: 7295154 - DNA, 19 bp, Homo sapiens
aagagcagggaaagaattg

SEQ ID NO: 7295155 - DNA, 22 bp, Homo sapiens
acacattgtcatttccatacta

SEQ ID NO: 7295156 - DNA, 22 bp, Homo sapiens
acacattgcagacatctcatta

SEQ ID NO: 7295157 - DNA, 22 bp, Homo sapiens
aagcaagagttggagtgatgtt

SEQ ID NO: 7295158 - DNA, 22 bp, Homo sapiens
aagcaagaggaaatgtggacct

SEQ ID NO: 7295159 - DNA, 22 bp, Homo sapiens
aagcaagacagaagttactgcc

SEQ ID NO: 7295160 - DNA, 22 bp, Homo sapiens
aagcaatagcaacaactttaca

SEQ ID NO: 7295161 - DNA, 22 bp, Homo sapiens
aagcaagttctcatcatttata

SEQ ID NO: 7295162 - DNA, 22 bp, Homo sapiens
aagcaagagttggagtgatgtt

SEQ ID NO: 7295163 - DNA, 22 bp, Homo sapiens
aagatgactatttatctgtaag

SEQ ID NO: 7295164 - DNA, 22 bp, Homo sapiens
aagatgacagatgcttagagtc

SEQ ID NO: 7295165 - DNA, 22 bp, Homo sapiens
aagatcaagatttaggttgagg

SEQ ID NO: 7295166 - DNA, 22 bp, Homo sapiens
aagcctccttattaaaggatat

SEQ ID NO: 7295167 - DNA, 22 bp, Homo sapiens
aaatgcatgtagaataatagag

SEQ ID NO: 7295168 - DNA, 22 bp, Homo sapiens
aaatgcatggctgttttaaagc

SEQ ID NO: 7295169 - DNA, 22 bp, Homo sapiens
aaatactgctgctattcctttt

SEQ ID NO: 7295170 - DNA, 19 bp, Homo sapiens
aaatactgaagttgttcat

SEQ ID NO: 7295171 - DNA, 22 bp, Homo sapiens
aaatactggcaagtgctaattc

SEQ ID NO: 7295172 - DNA, 22 bp, Homo sapiens
aaatactggttttggagatgct

SEQ ID NO: 7295173 - DNA, 22 bp, Homo sapiens
aaatactgggctcaaaagggtt

SEQ ID NO: 7295174 - DNA, 21 bp, Homo sapiens
aaatactgggcagtgacttga

SEQ ID NO: 7295175 - DNA, 22 bp, Homo sapiens
aaagttttagaactaggaagca

SEQ ID NO: 7295176 - DNA, 23 bp, Homo sapiens
aaagtgacttttataccactaac

SEQ ID NO: 7295177 - DNA, 22 bp, Homo sapiens
aaagatttgagttctgcttata

SEQ ID NO: 7295178 - DNA, 22 bp, Homo sapiens
aacatagctttactcaaatgac

SEQ ID NO: 7295179 - DNA, 22 bp, Homo sapiens
aagaacagttgggaggtgagcc

SEQ ID NO: 7295180 - DNA, 22 bp, Homo sapiens
aactgtcatctttcaaggaaga

SEQ ID NO: 7295181 - DNA, 22 bp, Homo sapiens
aaagcctgggttcctcactatc

SEQ ID NO: 7295182 - DNA, 22 bp, Homo sapiens
aaagagaacttttacccaagaa

SEQ ID NO: 7295183 - DNA, 22 bp, Homo sapiens
aaagagacaccaaagactctag

SEQ ID NO: 7295184 - DNA, 22 bp, Homo sapiens
aaagagatgtgccaaatagcct

SEQ ID NO: 7295185 - DNA, 22 bp, Homo sapiens
aaagatcagtctgaagcaacat

SEQ ID NO: 7295186 - DNA, 22 bp, Homo sapiens
aaagaacagatgtgtggtgcat

SEQ ID NO: 7295187 - DNA, 22 bp, Homo sapiens
aaagaaacctatcagccacatg

SEQ ID NO: 7295188 - DNA, 20 bp, Homo sapiens
aaagccactggcaagagact

SEQ ID NO: 7295189 - DNA, 21 bp, Homo sapiens
aaacatctctgcttttgtgtc

SEQ ID NO: 7295190 - DNA, 22 bp, Homo sapiens
aaacagctgcagtacacggcct

SEQ ID NO: 7295191 - DNA, 22 bp, Homo sapiens
aaaattaagtgtctgggaagcc

SEQ ID NO: 7295192 - DNA, 22 bp, Homo sapiens
aaaactgaggtttcctgaagaa

SEQ ID NO: 7295193 - DNA, 22 bp, Homo sapiens
aaaactgaaatacgatccaatg

SEQ ID NO: 7295194 - DNA, 22 bp, Homo sapiens
aaacacattttaggaaaatcta

SEQ ID NO: 7295195 - DNA, 22 bp, Homo sapiens
aaacacaagaggcagggtacag

SEQ ID NO: 7295196 - DNA, 20 bp, Homo sapiens
aaaatatgtataactcttct

SEQ ID NO: 7295197 - DNA, 22 bp, Homo sapiens
gtgacagagattaatagcttgg

SEQ ID NO: 7295198 - DNA, 16 bp, Homo sapiens
gtgacagacaataggc

SEQ ID NO: 7295199 - DNA, 22 bp, Homo sapiens
gtgacagaaacagggctagaat

SEQ ID NO: 7295200 - DNA, 22 bp, Homo sapiens
gtgacagagtgagaccttgtct

SEQ ID NO: 7295201 - DNA, 22 bp, Homo sapiens
gtgacagagttttagatctcat

SEQ ID NO: 7295202 - DNA, 22 bp, Homo sapiens
gtgacagagtgagaccctgtct

SEQ ID NO: 7295203 - DNA, 22 bp, Homo sapiens
gtgacagagctgggatttgaag

SEQ ID NO: 7295204 - DNA, 22 bp, Homo sapiens
gtgacagattatagggagcgtt

SEQ ID NO: 7295205 - DNA, 22 bp, Homo sapiens
gtgacagatttgctgcgcatgg

SEQ ID NO: 7295206 - DNA, 22 bp, Homo sapiens
gtggaaagaacacaaaattagg

SEQ ID NO: 7295207 - DNA, 22 bp, Homo sapiens
gtggaggaaaagaagttgggtg

SEQ ID NO: 7295208 - DNA, 22 bp, Homo sapiens
gtggacaggcaggctgtcgggg

SEQ ID NO: 7295209 - DNA, 22 bp, Homo sapiens
gtggcacacaggagagagctca

SEQ ID NO: 7295210 - DNA, 22 bp, Homo sapiens
gtggcagcggcccaggccgtct

SEQ ID NO: 7295211 - DNA, 22 bp, Homo sapiens
gtggcagttgctgtggcaataa

SEQ ID NO: 7295212 - DNA, 22 bp, Homo sapiens
gtggcatgaaagcatctgtgat

SEQ ID NO: 7295213 - DNA, 22 bp, Homo sapiens
gtggcccaggttggagtgcagt

SEQ ID NO: 7295214 - DNA, 22 bp, Homo sapiens
gtggcccaggctggagtgcagt

SEQ ID NO: 7295215 - DNA, 22 bp, Homo sapiens
gtggcccagccctacagaggac

SEQ ID NO: 7295216 - DNA, 21 bp, Homo sapiens
gtggccctgccgcagtgtcca

SEQ ID NO: 7295217 - DNA, 22 bp, Homo sapiens
gtggccctaacaccgtttctca

SEQ ID NO: 7295218 - DNA, 22 bp, Homo sapiens
gtgggagcttcatcaagcagtt

SEQ ID NO: 7295219 - DNA, 22 bp, Homo sapiens
gtgggagcatggtcccagtgcc

SEQ ID NO: 7295220 - DNA, 22 bp, Homo sapiens
gtgggagccatttccagtatgc

SEQ ID NO: 7295221 - DNA, 22 bp, Homo sapiens
gtggcccttgaagcagcttcat

SEQ ID NO: 7295222 - DNA, 22 bp, Homo sapiens
gtggccctgtgaacagcgcagt

SEQ ID NO: 7295223 - DNA, 22 bp, Homo sapiens
gtccagggaaatagcgacaggg

SEQ ID NO: 7295224 - DNA, 22 bp, Homo sapiens
gtatgtctgagtaataatgtgt

SEQ ID NO: 7295225 - DNA, 22 bp, Homo sapiens
gtcccagggaagaaggcagcac

SEQ ID NO: 7295226 - DNA, 22 bp, Homo sapiens
gtccagggccccgagcaccagg

SEQ ID NO: 7295227 - DNA, 21 bp, Homo sapiens
gtccagtggaggaggacagga

SEQ ID NO: 7295228 - DNA, 22 bp, Homo sapiens
gtccagtgcttatagaatcagt

SEQ ID NO: 7295229 - DNA, 22 bp, Homo sapiens
gtcccagggatgcagacatgag

SEQ ID NO: 7295230 - DNA, 22 bp, Homo sapiens
gtccttgagtaagtcatggtgg

SEQ ID NO: 7295231 - DNA, 22 bp, Homo sapiens
gtccttgaagccatttcagggc

SEQ ID NO: 7295232 - DNA, 22 bp, Homo sapiens
gtccttggctgggcttgcctcg

SEQ ID NO: 7295233 - DNA, 22 bp, Homo sapiens
ggtgcaggacgaagtgggggtt

SEQ ID NO: 7295234 - DNA, 22 bp, Homo sapiens
ggtgcaggaatctgcaattgaa

SEQ ID NO: 7295235 - DNA, 22 bp, Homo sapiens
ggtgagtcctcagctgacacgg

SEQ ID NO: 7295236 - DNA, 22 bp, Homo sapiens
ggtgagtcatttggctcaagag

SEQ ID NO: 7295237 - DNA, 22 bp, Homo sapiens
ggtggcaggccctgagcatccc

SEQ ID NO: 7295238 - DNA, 22 bp, Homo sapiens
ggtgtccgcgctgtagaaggtc

SEQ ID NO: 7295239 - DNA, 22 bp, Homo sapiens
ggtgtcagtgagagcacagtac

SEQ ID NO: 7295240 - DNA, 22 bp, Homo sapiens
ggtgtcagtctgggatgagact

SEQ ID NO: 7295241 - DNA, 21 bp, Homo sapiens
gtatatcagcagtgaattcaa

SEQ ID NO: 7295242 - DNA, 22 bp, Homo sapiens
taacagaatagcagaaacagaa

SEQ ID NO: 7295243 - DNA, 22 bp, Homo sapiens
gtttaaagtcttggaaggagga

SEQ ID NO: 7295244 - DNA, 22 bp, Homo sapiens
gtttaaagtagcttccttttgg

SEQ ID NO: 7295245 - DNA, 22 bp, Homo sapiens
gttgttttcagcagtttatgac

SEQ ID NO: 7295246 - DNA, 22 bp, Homo sapiens
gtttaataatgttgaattacta

SEQ ID NO: 7295247 - DNA, 22 bp, Homo sapiens
gtttaagtttcagaagctaaga

SEQ ID NO: 7295248 - DNA, 22 bp, Homo sapiens
taaaacagcagggcagagaagt

SEQ ID NO: 7295249 - DNA, 22 bp, Homo sapiens
gtgtgggctgcagaggcacagc

SEQ ID NO: 7295250 - DNA, 22 bp, Homo sapiens
gtgtgcaggggcttggtggagc

SEQ ID NO: 7295251 - DNA, 22 bp, Homo sapiens
gtgtgcagggggccagcgcagc

SEQ ID NO: 7295252 - DNA, 22 bp, Homo sapiens
gtgtgcaggccacaggccaggg

SEQ ID NO: 7295253 - DNA, 22 bp, Homo sapiens
gtgtgagctccctctcctcctg

SEQ ID NO: 7295254 - DNA, 22 bp, Homo sapiens
gtgtgcagcagagacaggactc

SEQ ID NO: 7295255 - DNA, 22 bp, Homo sapiens
gtgtgcagatgtgatgctgggc

SEQ ID NO: 7295256 - DNA, 22 bp, Homo sapiens
gtgtgcagaagacacaagacat

SEQ ID NO: 7295257 - DNA, 22 bp, Homo sapiens
gtgtgagccatgatgtgtccag

SEQ ID NO: 7295258 - DNA, 22 bp, Homo sapiens
gtgtgagctcagccttgggaga

SEQ ID NO: 7295259 - DNA, 22 bp, Homo sapiens
gtgtcagctaatttgggagctc

SEQ ID NO: 7295260 - DNA, 22 bp, Homo sapiens
gtgtccagcctgcacagggtgc

SEQ ID NO: 7295261 - DNA, 22 bp, Homo sapiens
gttgttgctatgttattgttat

SEQ ID NO: 7295262 - DNA, 22 bp, Homo sapiens
gtggggtagatctttctcagga

SEQ ID NO: 7295263 - DNA, 22 bp, Homo sapiens
gtggtgagattgctggatcaaa

SEQ ID NO: 7295264 - DNA, 22 bp, Homo sapiens
gtgtcacatggtttactgcagc

SEQ ID NO: 7295265 - DNA, 22 bp, Homo sapiens
ggagggtccatcttgtgaaaag

SEQ ID NO: 7295266 - DNA, 22 bp, Homo sapiens
ggagggtccactgtgaggcaga

SEQ ID NO: 7295267 - DNA, 20 bp, Homo sapiens
ggagggcagctgagagttgg

SEQ ID NO: 7295268 - DNA, 22 bp, Homo sapiens
ggagggcagagtcccctgctga

SEQ ID NO: 7295269 - DNA, 21 bp, Homo sapiens
ggagggcagcccagactggct

SEQ ID NO: 7295270 - DNA, 22 bp, Homo sapiens
ggagggcatcaatcaggcctgg

SEQ ID NO: 7295271 - DNA, 22 bp, Homo sapiens
ggagggcacaggaccagaaatc

SEQ ID NO: 7295272 - DNA, 22 bp, Homo sapiens
ggagggctgccaggtggagcgg

SEQ ID NO: 7295273 - DNA, 22 bp, Homo sapiens
ggagggctgtagaggagacctg

SEQ ID NO: 7295274 - DNA, 18 bp, Homo sapiens
ggagggctttggggactg

SEQ ID NO: 7295275 - DNA, 22 bp, Homo sapiens
ggagggctccctgggagtggat

SEQ ID NO: 7295276 - DNA, 22 bp, Homo sapiens
ggagggctcaattgactcctga

SEQ ID NO: 7295277 - DNA, 22 bp, Homo sapiens
ggagggctgagactggggtctg

SEQ ID NO: 7295278 - DNA, 22 bp, Homo sapiens
ggcacacagcttggcaggagat

SEQ ID NO: 7295279 - DNA, 22 bp, Homo sapiens
ggagaaggaatattggagtagg

SEQ ID NO: 7295280 - DNA, 22 bp, Homo sapiens
ggaagtctcagcaacagagtta

SEQ ID NO: 7295281 - DNA, 22 bp, Homo sapiens
ggaaggtgctccctggacagag

SEQ ID NO: 7295282 - DNA, 23 bp, Homo sapiens
ggaagtcagcggagaggtggctg

SEQ ID NO: 7295283 - DNA, 22 bp, Homo sapiens
ggagatctttgttatcttttga

SEQ ID NO: 7295284 - DNA, 22 bp, Homo sapiens
ggaggaggcggcagaagttcct

SEQ ID NO: 7295285 - DNA, 22 bp, Homo sapiens
ggagctcaggcccagcaaggcc

SEQ ID NO: 7295286 - DNA, 22 bp, Homo sapiens
gcttattaggttatttcaagga

SEQ ID NO: 7295287 - DNA, 18 bp, Homo sapiens
ggaaggtgattcagtttt

SEQ ID NO: 7295288 - DNA, 22 bp, Homo sapiens
ggaaagaaagtgtgaacaactt

SEQ ID NO: 7295289 - DNA, 22 bp, Homo sapiens
ggaaagaatagagactttatca

SEQ ID NO: 7295290 - DNA, 21 bp, Homo sapiens
ggaaagaaggcaaggctcagg

SEQ ID NO: 7295291 - DNA, 22 bp, Homo sapiens
ggaaagaaccctggatggctgg

SEQ ID NO: 7295292 - DNA, 22 bp, Homo sapiens
ggaaagaatcaagtgatcctgt

SEQ ID NO: 7295293 - DNA, 22 bp, Homo sapiens
ggccatggtcatgggtgagctt

SEQ ID NO: 7295294 - DNA, 22 bp, Homo sapiens
ggccatggtgaggtcttctcag

SEQ ID NO: 7295295 - DNA, 22 bp, Homo sapiens
ggctccaccctgcttccagaag

SEQ ID NO: 7295296 - DNA, 22 bp, Homo sapiens
ggctcagccccgtaacacagca

SEQ ID NO: 7295297 - DNA, 22 bp, Homo sapiens
ggccttggcctagccctccagg

SEQ ID NO: 7295298 - DNA, 22 bp, Homo sapiens
ggccttgcggaacgctcaggcg

SEQ ID NO: 7295299 - DNA, 22 bp, Homo sapiens
ggccttcacgtgacctggcgtg

SEQ ID NO: 7295300 - DNA, 22 bp, Homo sapiens
ggccctccctgagccaggtggg

SEQ ID NO: 7295301 - DNA, 22 bp, Homo sapiens
gggaacagggcctgagctgggg

SEQ ID NO: 7295302 - DNA, 22 bp, Homo sapiens
gggaaaggatttacagtttgat

SEQ ID NO: 7295303 - DNA, 22 bp, Homo sapiens
gggaaaggatcagtgggaggct

SEQ ID NO: 7295304 - DNA, 22 bp, Homo sapiens
gggagaaggaggactgtgctgt

SEQ ID NO: 7295305 - DNA, 22 bp, Homo sapiens
gggaggcgccgagggtagctaa

SEQ ID NO: 7295306 - DNA, 22 bp, Homo sapiens
gggacccacgaaaggctttgga

SEQ ID NO: 7295307 - DNA, 22 bp, Homo sapiens
gggatcgtcatggaaagtgcta

SEQ ID NO: 7295308 - DNA, 22 bp, Homo sapiens
gggcccagcactggctgggatc

SEQ ID NO: 7295309 - DNA, 22 bp, Homo sapiens
gggctagggcctgctatggttt

SEQ ID NO: 7295310 - DNA, 22 bp, Homo sapiens
ggggaagtcggagcctgagcac

SEQ ID NO: 7295311 - DNA, 22 bp, Homo sapiens
ggggacagttaaagaccaagac

SEQ ID NO: 7295312 - DNA, 23 bp, Homo sapiens
ggggacagttcccactggggtct

SEQ ID NO: 7295313 - DNA, 22 bp, Homo sapiens
ggggacagtcgatctagtgatt

SEQ ID NO: 7295314 - DNA, 22 bp, Homo sapiens
gggctggagacaagtgagccgc

SEQ ID NO: 7295315 - DNA, 22 bp, Homo sapiens
gggtctggagggcagcccttct

SEQ ID NO: 7295316 - DNA, 22 bp, Homo sapiens
gggtctcctgagagaagatgct

SEQ ID NO: 7295317 - DNA, 22 bp, Homo sapiens
gggtctcctaatggaggatgac

SEQ ID NO: 7295318 - DNA, 22 bp, Homo sapiens
ggggaccctcaggactgcgtct

SEQ ID NO: 7295319 - DNA, 21 bp, Homo sapiens
gctctgtgttacaagttgggg

SEQ ID NO: 7295320 - DNA, 22 bp, Homo sapiens
gctctgtgtccacagctggaaa

SEQ ID NO: 7295321 - DNA, 22 bp, Homo sapiens
gctctgtgtccacagctggaaa

SEQ ID NO: 7295322 - DNA, 22 bp, Homo sapiens
gctctgtgttttgcccaggaga

SEQ ID NO: 7295323 - DNA, 22 bp, Homo sapiens
gctctgtgttgtcagaggcacc

SEQ ID NO: 7295324 - DNA, 22 bp, Homo sapiens
gctctgtgttccctccaggctc

SEQ ID NO: 7295325 - DNA, 22 bp, Homo sapiens
gctctgtgttcctctggattgc

SEQ ID NO: 7295326 - DNA, 22 bp, Homo sapiens
gctgagccacaggcagtgcact

SEQ ID NO: 7295327 - DNA, 22 bp, Homo sapiens
gctgagctagaaaaggaccaca

SEQ ID NO: 7295328 - DNA, 22 bp, Homo sapiens
gcctggagggatagaatgcaag

SEQ ID NO: 7295329 - DNA, 22 bp, Homo sapiens
gcctggtgtctccccaaggaag

SEQ ID NO: 7295330 - DNA, 22 bp, Homo sapiens
gcctggtgtgcgccgcgcagct

SEQ ID NO: 7295331 - DNA, 22 bp, Homo sapiens
gcctgtggttgctttgggatcc

SEQ ID NO: 7295332 - DNA, 22 bp, Homo sapiens
gccatcatatcccctgtgacct

SEQ ID NO: 7295333 - DNA, 22 bp, Homo sapiens
gccataatagagtgtgaggaat

SEQ ID NO: 7295334 - DNA, 22 bp, Homo sapiens
gccagtgttattcctggggctg

SEQ ID NO: 7295335 - DNA, 22 bp, Homo sapiens
gccagtgtgtcttgcaggctcc

SEQ ID NO: 7295336 - DNA, 19 bp, Homo sapiens
gccagtgtgtggtacagtg

SEQ ID NO: 7295337 - DNA, 22 bp, Homo sapiens
gccagtgttcttcaccccctct

SEQ ID NO: 7295338 - DNA, 22 bp, Homo sapiens
gccagtgttgaactttccctgg

SEQ ID NO: 7295339 - DNA, 22 bp, Homo sapiens
gccagtgttggtgataagctct

SEQ ID NO: 7295340 - DNA, 22 bp, Homo sapiens
gccagtgtttatagcagtgagg

SEQ ID NO: 7295341 - DNA, 22 bp, Homo sapiens
gccagtgtgtcctctcagtttc

SEQ ID NO: 7295342 - DNA, 22 bp, Homo sapiens
gccagtgtgtcatccggctgca

SEQ ID NO: 7295343 - DNA, 22 bp, Homo sapiens
gccagtgtggtgtagtcatgaa

SEQ ID NO: 7295344 - DNA, 22 bp, Homo sapiens
gccagtgtcttcctgttaatcg

SEQ ID NO: 7295345 - DNA, 22 bp, Homo sapiens
gccagtgtgcaagaaaacagaa

SEQ ID NO: 7295346 - DNA, 22 bp, Homo sapiens
gccagtgtgcaagaggccacca

SEQ ID NO: 7295347 - DNA, 22 bp, Homo sapiens
gccgggaccaaggccacggagc

SEQ ID NO: 7295348 - DNA, 22 bp, Homo sapiens
gccgatgaaaagaccaaagact

SEQ ID NO: 7295349 - DNA, 19 bp, Homo sapiens
gcctctgctggggacaggc

SEQ ID NO: 7295350 - DNA, 22 bp, Homo sapiens
gcaggtggcagaggtgggatct

SEQ ID NO: 7295351 - DNA, 22 bp, Homo sapiens
gcagtagcagtatccagaagca

SEQ ID NO: 7295352 - DNA, 22 bp, Homo sapiens
gcatggtggccttagggtagcc

SEQ ID NO: 7295353 - DNA, 22 bp, Homo sapiens
gcatggtggagtctgagcaggg

SEQ ID NO: 7295354 - DNA, 22 bp, Homo sapiens
gccacagacagagagtctagtg

SEQ ID NO: 7295355 - DNA, 16 bp, Homo sapiens
gccacagcccctgtct

SEQ ID NO: 7295356 - DNA, 22 bp, Homo sapiens
gccacagcccgagcaccatgag

SEQ ID NO: 7295357 - DNA, 22 bp, Homo sapiens
gccacagcagggccctctcagg

SEQ ID NO: 7295358 - DNA, 20 bp, Homo sapiens
gccagcacagggagcagttc

SEQ ID NO: 7295359 - DNA, 19 bp, Homo sapiens
gccagcacccagctgtgtc

SEQ ID NO: 7295360 - DNA, 22 bp, Homo sapiens
gccagatgtagatagcaaggta

SEQ ID NO: 7295361 - DNA, 22 bp, Homo sapiens
gccacagctcacgttccccatt

SEQ ID NO: 7295362 - DNA, 22 bp, Homo sapiens
gccacagcggggccgctagagc

SEQ ID NO: 7295363 - DNA, 22 bp, Homo sapiens
gccacagcttttaacctcgggg

SEQ ID NO: 7295364 - DNA, 22 bp, Homo sapiens
gcagagctcatgcctgcacctc

SEQ ID NO: 7295365 - DNA, 22 bp, Homo sapiens
gcagcctctgcagttcaggagg

SEQ ID NO: 7295366 - DNA, 22 bp, Homo sapiens
gcaggacctggcagatggggca

SEQ ID NO: 7295367 - DNA, 22 bp, Homo sapiens
gcaggaccaggcacgagggcca

SEQ ID NO: 7295368 - DNA, 22 bp, Homo sapiens
gcaggacctctggatgcaatgc

SEQ ID NO: 7295369 - DNA, 21 bp, Homo sapiens
gcaggggatagaaatggtctg

SEQ ID NO: 7295370 - DNA, 22 bp, Homo sapiens
gcagggacctgccactgctgtc

SEQ ID NO: 7295371 - DNA, 22 bp, Homo sapiens
gcaatagattatgatctacagt

SEQ ID NO: 7295372 - DNA, 22 bp, Homo sapiens
gcaattgctttagggaaaggta

SEQ ID NO: 7295373 - DNA, 22 bp, Homo sapiens
gcacaaagatgaatacagaatg

SEQ ID NO: 7295374 - DNA, 20 bp, Homo sapiens
gcaattaatttttggttaca

SEQ ID NO: 7295375 - DNA, 22 bp, Homo sapiens
gattttatagtcaggaaaaaga

SEQ ID NO: 7295376 - DNA, 22 bp, Homo sapiens
gcagaaatatgatgcataaagg

SEQ ID NO: 7295377 - DNA, 23 bp, Homo sapiens
gcacttttataggtggggaaaca

SEQ ID NO: 7295378 - DNA, 22 bp, Homo sapiens
gcagaaggatccgcaggtgcaa

SEQ ID NO: 7295379 - DNA, 22 bp, Homo sapiens
gatgtgtgctgcatagtatatt

SEQ ID NO: 7295380 - DNA, 22 bp, Homo sapiens
gatgcctggcacccagcaagga

SEQ ID NO: 7295381 - DNA, 22 bp, Homo sapiens
gatgcctgtggtgagcacacat

SEQ ID NO: 7295382 - DNA, 22 bp, Homo sapiens
gatgcgggcccgctccactgcc

SEQ ID NO: 7295383 - DNA, 22 bp, Homo sapiens
gatttacaaagctctctagtgt

SEQ ID NO: 7295384 - DNA, 22 bp, Homo sapiens
gattgttgcctggctttgacct

SEQ ID NO: 7295385 - DNA, 22 bp, Homo sapiens
gattgtctgtgatcatgagcaa

SEQ ID NO: 7295386 - DNA, 22 bp, Homo sapiens
gattgagtctgaggatgctgca

SEQ ID NO: 7295387 - DNA, 22 bp, Homo sapiens
gagctggaggaccaggactggg

SEQ ID NO: 7295388 - DNA, 23 bp, Homo sapiens
gaggacacagcccagacagccgt

SEQ ID NO: 7295389 - DNA, 22 bp, Homo sapiens
gaggacacaaagtggctgagat

SEQ ID NO: 7295390 - DNA, 22 bp, Homo sapiens
gaggacacatgactccagcagg

SEQ ID NO: 7295391 - DNA, 22 bp, Homo sapiens
gaggacacctcacagcctcaca

SEQ ID NO: 7295392 - DNA, 22 bp, Homo sapiens
gaggacacggccttttggaaaa

SEQ ID NO: 7295393 - DNA, 22 bp, Homo sapiens
gaggcccaggtcaagcagccac

SEQ ID NO: 7295394 - DNA, 16 bp, Homo sapiens
gagggcagaggcggaa

SEQ ID NO: 7295395 - DNA, 22 bp, Homo sapiens
gagggcagagacagtgattcac

SEQ ID NO: 7295396 - DNA, 22 bp, Homo sapiens
gagggcagtgaattttgaagct

SEQ ID NO: 7295397 - DNA, 22 bp, Homo sapiens
gagggcatagttaaataggagg

SEQ ID NO: 7295398 - DNA, 20 bp, Homo sapiens
gagggcaggcacccatttca

SEQ ID NO: 7295399 - DNA, 22 bp, Homo sapiens
gagggcagagtctaatgatgca

SEQ ID NO: 7295400 - DNA, 22 bp, Homo sapiens
gagggcagtagcctcgtaccct

SEQ ID NO: 7295401 - DNA, 22 bp, Homo sapiens
gagggcaggggtcttgcacggt

SEQ ID NO: 7295402 - DNA, 22 bp, Homo sapiens
gaggggcagaatgtgatcaggg

SEQ ID NO: 7295403 - DNA, 22 bp, Homo sapiens
gatcatcaagcaagaacctgat

SEQ ID NO: 7295404 - DNA, 22 bp, Homo sapiens
gatcatcatctttcaggcaagt

SEQ ID NO: 7295405 - DNA, 22 bp, Homo sapiens
gatatatgtaaaagtagacaga

SEQ ID NO: 7295406 - DNA, 22 bp, Homo sapiens
gatatttacattaagcacattg

SEQ ID NO: 7295407 - DNA, 21 bp, Homo sapiens
gatatttatgactcattcctt

SEQ ID NO: 7295408 - DNA, 22 bp, Homo sapiens
gatactgtaggtgaaagtgttt

SEQ ID NO: 7295409 - DNA, 21 bp, Homo sapiens
gatacagagggccactgattg

SEQ ID NO: 7295410 - DNA, 22 bp, Homo sapiens
gatacacaagtggaaggagacg

SEQ ID NO: 7295411 - DNA, 22 bp, Homo sapiens
gatgcacagtgaccctgccagt

SEQ ID NO: 7295412 - DNA, 22 bp, Homo sapiens
gatgcacaggtgagcaggtgca

SEQ ID NO: 7295413 - DNA, 22 bp, Homo sapiens
gatgcacagccatgttaatgtg

SEQ ID NO: 7295414 - DNA, 22 bp, Homo sapiens
gatgcacattgaacaatcacaa

SEQ ID NO: 7295415 - DNA, 22 bp, Homo sapiens
gatgcacatgtgagtatagaag

SEQ ID NO: 7295416 - DNA, 22 bp, Homo sapiens
gatgcacaaagcagagggaatc

SEQ ID NO: 7295417 - DNA, 21 bp, Homo sapiens
gatgcacaatgggtaagtaca

SEQ ID NO: 7295418 - DNA, 22 bp, Homo sapiens
gatgcacagagggcctggaact

SEQ ID NO: 7295419 - DNA, 22 bp, Homo sapiens
gatgcagggctggcaggagctt

SEQ ID NO: 7295420 - DNA, 20 bp, Homo sapiens
gatgattatctgaagccctt

SEQ ID NO: 7295421 - DNA, 22 bp, Homo sapiens
gatgattacacttttaaaacag

SEQ ID NO: 7295422 - DNA, 22 bp, Homo sapiens
gagtgtgtgcatgatctcttat

SEQ ID NO: 7295423 - DNA, 22 bp, Homo sapiens
gagtgtgttctttatgctgtga

SEQ ID NO: 7295424 - DNA, 22 bp, Homo sapiens
gagtgcagttggggtgagggga

SEQ ID NO: 7295425 - DNA, 22 bp, Homo sapiens
gagtgagggcagcaggggctgc

SEQ ID NO: 7295426 - DNA, 22 bp, Homo sapiens
ctttgtgatagtgttaagacca

SEQ ID NO: 7295427 - DNA, 22 bp, Homo sapiens
gaaagggagtgaagatggtata

SEQ ID NO: 7295428 - DNA, 22 bp, Homo sapiens
gaaagggataccatgttacttg

SEQ ID NO: 7295429 - DNA, 22 bp, Homo sapiens
gaacagactttgccaattacag

SEQ ID NO: 7295430 - DNA, 17 bp, Homo sapiens
gaacagcagaggggaca

SEQ ID NO: 7295431 - DNA, 22 bp, Homo sapiens
gaaagtttcttcattaagatgt

SEQ ID NO: 7295432 - DNA, 22 bp, Homo sapiens
gaaatttacaactttctcatgg

SEQ ID NO: 7295433 - DNA, 22 bp, Homo sapiens
cttcttgaagtcctccagaagt

SEQ ID NO: 7295434 - DNA, 22 bp, Homo sapiens
cttctctggcatagcaagcagg

SEQ ID NO: 7295435 - DNA, 22 bp, Homo sapiens
cttgggaatgctaacagatgac

SEQ ID NO: 7295436 - DNA, 20 bp, Homo sapiens
ctttatcaaagggctactag

SEQ ID NO: 7295437 - DNA, 22 bp, Homo sapiens
gaaggagaccctgaagatgctg

SEQ ID NO: 7295438 - DNA, 22 bp, Homo sapiens
gaaggacccacgaagtcactgg

SEQ ID NO: 7295439 - DNA, 22 bp, Homo sapiens
gaacttaacggcaactatttaa

SEQ ID NO: 7295440 - DNA, 22 bp, Homo sapiens
gacacagatgatcaggtgtgga

SEQ ID NO: 7295441 - DNA, 22 bp, Homo sapiens
gacaggacttcactgtgttgcc

SEQ ID NO: 7295442 - DNA, 22 bp, Homo sapiens
gacccaggaagctacttctggt

SEQ ID NO: 7295443 - DNA, 22 bp, Homo sapiens
gacccaggcaatgaacttactt

SEQ ID NO: 7295444 - DNA, 22 bp, Homo sapiens
gacccaggggtccatttctcct

SEQ ID NO: 7295445 - DNA, 22 bp, Homo sapiens
gactgtgggaagactgtaggtt

SEQ ID NO: 7295446 - DNA, 22 bp, Homo sapiens
gagacacaatctcatttacatt

SEQ ID NO: 7295447 - DNA, 22 bp, Homo sapiens
gagacacaatttccccatccta

SEQ ID NO: 7295448 - DNA, 22 bp, Homo sapiens
gagacacaagacgcaactctgt

SEQ ID NO: 7295449 - DNA, 22 bp, Homo sapiens
gagacacagcagatattcaatc

SEQ ID NO: 7295450 - DNA, 22 bp, Homo sapiens
gagacacaggcacagaagaggc

SEQ ID NO: 7295451 - DNA, 22 bp, Homo sapiens
gagacacagttatcaggcatac

SEQ ID NO: 7295452 - DNA, 22 bp, Homo sapiens
gagacacaagaagacatgcaca

SEQ ID NO: 7295453 - DNA, 22 bp, Homo sapiens
cctggagcacagcccagtccca

SEQ ID NO: 7295454 - DNA, 22 bp, Homo sapiens
cctggagcaaaaatctaaggag

SEQ ID NO: 7295455 - DNA, 22 bp, Homo sapiens
cctggcacatagtgggcatgca

SEQ ID NO: 7295456 - DNA, 22 bp, Homo sapiens
tgtcatgtgagggaacttgttc

SEQ ID NO: 7295457 - DNA, 22 bp, Homo sapiens
tgtcatggggttgttttgtaca

SEQ ID NO: 7295458 - DNA, 22 bp, Homo sapiens
tgtcatgccatttaaaatgttt

SEQ ID NO: 7295459 - DNA, 22 bp, Homo sapiens
tgtcatgccaggaaatagtccc

SEQ ID NO: 7295460 - DNA, 22 bp, Homo sapiens
cctggagagagaggccaactgc

SEQ ID NO: 7295461 - DNA, 22 bp, Homo sapiens
tggtgctggtgccacgcccctt

SEQ ID NO: 7295462 - DNA, 22 bp, Homo sapiens
cctgccatgccagcatgcccgt

SEQ ID NO: 7295463 - DNA, 22 bp, Homo sapiens
tggtgctgataatggcaggatt

SEQ ID NO: 7295464 - DNA, 22 bp, Homo sapiens
cctctgtgcctcgtgtcctctg

SEQ ID NO: 7295465 - DNA, 22 bp, Homo sapiens
cctctgtgcctcagtttcatgt

SEQ ID NO: 7295466 - DNA, 22 bp, Homo sapiens
cctctgtgctttgtccagcctc

SEQ ID NO: 7295467 - DNA, 21 bp, Homo sapiens
cctctgtgctaaagggctccc

SEQ ID NO: 7295468 - DNA, 22 bp, Homo sapiens
cctggcatgtcctcctggcatg

SEQ ID NO: 7295469 - DNA, 22 bp, Homo sapiens
cctggcatccggaacctggaaa

SEQ ID NO: 7295470 - DNA, 22 bp, Homo sapiens
cctggcaggtggaggttgcagt

SEQ ID NO: 7295471 - DNA, 22 bp, Homo sapiens
cctggcaggctggggacagtgc

SEQ ID NO: 7295472 - DNA, 22 bp, Homo sapiens
cctggcagctgtttggcttggc

SEQ ID NO: 7295473 - DNA, 23 bp, Homo sapiens
cctggcagcaaacgaggaggtta

SEQ ID NO: 7295474 - DNA, 23 bp, Homo sapiens
cctggcagcaaacgaggaggtta

SEQ ID NO: 7295475 - DNA, 22 bp, Homo sapiens
tgtctatgtatacatgtgtata

SEQ ID NO: 7295476 - DNA, 21 bp, Homo sapiens
tgtctcaatcagaagtcatta

SEQ ID NO: 7295477 - DNA, 22 bp, Homo sapiens
tgtgaggctggcaggggccagg

SEQ ID NO: 7295478 - DNA, 22 bp, Homo sapiens
tgtgaggctacctgccagggtc

SEQ ID NO: 7295479 - DNA, 22 bp, Homo sapiens
tgtgaggcgaggccagtgagct

SEQ ID NO: 7295480 - DNA, 22 bp, Homo sapiens
tgtgaggataaaaaggaaggag

SEQ ID NO: 7295481 - DNA, 22 bp, Homo sapiens
tgtgaggcctctgcaggagcag

SEQ ID NO: 7295482 - DNA, 22 bp, Homo sapiens
tgtgaggcctagacagcctggg

SEQ ID NO: 7295483 - DNA, 22 bp, Homo sapiens
tgtgagcatatgttttcagctc

SEQ ID NO: 7295484 - DNA, 22 bp, Homo sapiens
tgtgagctgaagtgacaggctg

SEQ ID NO: 7295485 - DNA, 22 bp, Homo sapiens
tgtgagcagctctgtggactca

SEQ ID NO: 7295486 - DNA, 21 bp, Homo sapiens
tgtgagctttgtgaaagcagg

SEQ ID NO: 7295487 - DNA, 22 bp, Homo sapiens
tgtgagcttaggacagggctat

SEQ ID NO: 7295488 - DNA, 22 bp, Homo sapiens
tgtgaaccttggtgagtcagta

SEQ ID NO: 7295489 - DNA, 22 bp, Homo sapiens
tgtgaagcattttggacagcgc

SEQ ID NO: 7295490 - DNA, 22 bp, Homo sapiens
tgtgcccattacacagaggcat

SEQ ID NO: 7295491 - DNA, 22 bp, Homo sapiens
cctgggaagagctgacaggagg

SEQ ID NO: 7295492 - DNA, 23 bp, Homo sapiens
tgtgttctcacacagatgcagta

SEQ ID NO: 7295493 - DNA, 22 bp, Homo sapiens
tgtgtgtcagtcttgtttaggg

SEQ ID NO: 7295494 - DNA, 22 bp, Homo sapiens
tgtgtgtctgcacatgtataat

SEQ ID NO: 7295495 - DNA, 21 bp, Homo sapiens
tgtgtgggcatatctgctgca

SEQ ID NO: 7295496 - DNA, 22 bp, Homo sapiens
cctctgtgacaaacagtcctgg

SEQ ID NO: 7295497 - DNA, 22 bp, Homo sapiens
cctctgtcctggggagtggagc

SEQ ID NO: 7295498 - DNA, 22 bp, Homo sapiens
cctctgtgacttctaccttcac

SEQ ID NO: 7295499 - DNA, 22 bp, Homo sapiens
cctctgtgatttctgagccaat

SEQ ID NO: 7295500 - DNA, 22 bp, Homo sapiens
cctctgtgcaggaaatacatgt

SEQ ID NO: 7295501 - DNA, 22 bp, Homo sapiens
cctctgagaggccatctctcct

SEQ ID NO: 7295502 - DNA, 22 bp, Homo sapiens
cctctgagaccagctctgcacc

SEQ ID NO: 7295503 - DNA, 22 bp, Homo sapiens
cctcgtggtgtcagacctgtgc

SEQ ID NO: 7295504 - DNA, 22 bp, Homo sapiens
cctccctggccagagcagcagc

SEQ ID NO: 7295505 - DNA, 22 bp, Homo sapiens
tggccctgctgtatcatctgct

SEQ ID NO: 7295506 - DNA, 20 bp, Homo sapiens
tggcccagtggggcagggtg

SEQ ID NO: 7295507 - DNA, 19 bp, Homo sapiens
ccctggagaataccctgga

SEQ ID NO: 7295508 - DNA, 22 bp, Homo sapiens
ccctggagctagtctgagcaga

SEQ ID NO: 7295509 - DNA, 22 bp, Homo sapiens
ccctggcctacaggcccagaga

SEQ ID NO: 7295510 - DNA, 22 bp, Homo sapiens
ccctggcaaaatccctggtaca

SEQ ID NO: 7295511 - DNA, 22 bp, Homo sapiens
cctatattacaggcttgctcta

SEQ ID NO: 7295512 - DNA, 22 bp, Homo sapiens
cctatattcagggaactgaccc

SEQ ID NO: 7295513 - DNA, 22 bp, Homo sapiens
tggcagcaccagcagtgtcctt

SEQ ID NO: 7295514 - DNA, 22 bp, Homo sapiens
cccaggaggtgtgcccaactcg

SEQ ID NO: 7295515 - DNA, 22 bp, Homo sapiens
cccaggagggtggcctctgccc

SEQ ID NO: 7295516 - DNA, 22 bp, Homo sapiens
tgcagggaatctgtggctggac

SEQ ID NO: 7295517 - DNA, 22 bp, Homo sapiens
tgcagggagctctggggtgcag

SEQ ID NO: 7295518 - DNA, 22 bp, Homo sapiens
tgcagggaccccgaggctctct

SEQ ID NO: 7295519 - DNA, 22 bp, Homo sapiens
tgcagggacaggctctggggat

SEQ ID NO: 7295520 - DNA, 22 bp, Homo sapiens
tgcagggaggccccgcagccct

SEQ ID NO: 7295521 - DNA, 22 bp, Homo sapiens
tgcagggagggcccagcaatct

SEQ ID NO: 7295522 - DNA, 23 bp, Homo sapiens
cccagctgcagacaagggagggt

SEQ ID NO: 7295523 - DNA, 22 bp, Homo sapiens
cccagctgtggcagaggccggg

SEQ ID NO: 7295524 - DNA, 22 bp, Homo sapiens
cccccactaagttgagggccct

SEQ ID NO: 7295525 - DNA, 22 bp, Homo sapiens
cccctcgcctgcagagcacagc

SEQ ID NO: 7295526 - DNA, 22 bp, Homo sapiens
ctggcatgcccagggtatgtgg

SEQ ID NO: 7295527 - DNA, 22 bp, Homo sapiens
ctggcatgccttgggtgcctct

SEQ ID NO: 7295528 - DNA, 22 bp, Homo sapiens
ctggcatgtgtttggctcctgt

SEQ ID NO: 7295529 - DNA, 22 bp, Homo sapiens
ctggcatggtgtatttgttcaa

SEQ ID NO: 7295530 - DNA, 21 bp, Homo sapiens
ctggcatgaggagctttgttt

SEQ ID NO: 7295531 - DNA, 22 bp, Homo sapiens
ctggatttactgagttttatca

SEQ ID NO: 7295532 - DNA, 22 bp, Homo sapiens
ctggataaatgctttagttgga

SEQ ID NO: 7295533 - DNA, 22 bp, Homo sapiens
ctggataatcacagaggagcat

SEQ ID NO: 7295534 - DNA, 22 bp, Homo sapiens
ctggagaaaatccatgtgtatg

SEQ ID NO: 7295535 - DNA, 22 bp, Homo sapiens
ctggaggaataatggcatcttg

SEQ ID NO: 7295536 - DNA, 22 bp, Homo sapiens
ctggaggagcatggactggagt

SEQ ID NO: 7295537 - DNA, 22 bp, Homo sapiens
ctggaggacccctgcctggaag

SEQ ID NO: 7295538 - DNA, 22 bp, Homo sapiens
ctggagtagccggacgggtctg

SEQ ID NO: 7295539 - DNA, 22 bp, Homo sapiens
ctggaaaatgaagaagcagagg

SEQ ID NO: 7295540 - DNA, 22 bp, Homo sapiens
ctggaaagatttacacggggaa

SEQ ID NO: 7295541 - DNA, 22 bp, Homo sapiens
ctggaaagagatggcagggttt

SEQ ID NO: 7295542 - DNA, 22 bp, Homo sapiens
ctggaaagacctgcttgctttt

SEQ ID NO: 7295543 - DNA, 22 bp, Homo sapiens
ctggaaagacagagggcatggg

SEQ ID NO: 7295544 - DNA, 22 bp, Homo sapiens
ctggaaagggtcctcattctgt

SEQ ID NO: 7295545 - DNA, 16 bp, Homo sapiens
ctggaaaggctagctc

SEQ ID NO: 7295546 - DNA, 22 bp, Homo sapiens
ctggaaagctgcaggacccaga

SEQ ID NO: 7295547 - DNA, 22 bp, Homo sapiens
ctggaaagatttctttggagtc

SEQ ID NO: 7295548 - DNA, 22 bp, Homo sapiens
ctggaaagtagatgtactaagg

SEQ ID NO: 7295549 - DNA, 22 bp, Homo sapiens
ctggaaagtagacaatctaaaa

SEQ ID NO: 7295550 - DNA, 22 bp, Homo sapiens
ctggaaagtacagtgtgtcaca

SEQ ID NO: 7295551 - DNA, 22 bp, Homo sapiens
ctgatcctcctttaagtagctg

SEQ ID NO: 7295552 - DNA, 22 bp, Homo sapiens
ctgcagagcatgaggaggtctg

SEQ ID NO: 7295553 - DNA, 21 bp, Homo sapiens
ctgcagagcatgcaaaatgtt

SEQ ID NO: 7295554 - DNA, 22 bp, Homo sapiens
ctgattttcaaaatgtgttaaa

SEQ ID NO: 7295555 - DNA, 22 bp, Homo sapiens
ctgagagatcaagccacaggat

SEQ ID NO: 7295556 - DNA, 22 bp, Homo sapiens
ctgagagaaacatgactcagga

SEQ ID NO: 7295557 - DNA, 22 bp, Homo sapiens
ctgcagaggtcttgctgatggt

SEQ ID NO: 7295558 - DNA, 22 bp, Homo sapiens
ctgcagagctaggctgagtgaa

SEQ ID NO: 7295559 - DNA, 22 bp, Homo sapiens
ctgcagagcttgtctggatgtg

SEQ ID NO: 7295560 - DNA, 22 bp, Homo sapiens
ctgcagaggggttgaagggtcc

SEQ ID NO: 7295561 - DNA, 22 bp, Homo sapiens
ctctttttcagccttaccaaag

SEQ ID NO: 7295562 - DNA, 22 bp, Homo sapiens
ctgaagactgctgagaagttac

SEQ ID NO: 7295563 - DNA, 22 bp, Homo sapiens
ctgaaattctgcctctgcacaa

SEQ ID NO: 7295564 - DNA, 22 bp, Homo sapiens
ttttagttgctcaggtattctc

SEQ ID NO: 7295565 - DNA, 22 bp, Homo sapiens
tttgtcttggcctcagttttct

SEQ ID NO: 7295566 - DNA, 22 bp, Homo sapiens
ctaatttaatgaatgagtctta

SEQ ID NO: 7295567 - DNA, 22 bp, Homo sapiens
ctaattttcccaaggccttcta

SEQ ID NO: 7295568 - DNA, 22 bp, Homo sapiens
ctaatttttgttctgcattgaa

SEQ ID NO: 7295569 - DNA, 22 bp, Homo sapiens
ttccgagggctcggcggccgcc

SEQ ID NO: 7295570 - DNA, 22 bp, Homo sapiens
ttccatttattcttgtccagat

SEQ ID NO: 7295571 - DNA, 22 bp, Homo sapiens
ttccatttggcacttcactgag

SEQ ID NO: 7295572 - DNA, 22 bp, Homo sapiens
ttcacagtttgctgggacagga

SEQ ID NO: 7295573 - DNA, 22 bp, Homo sapiens
ttcacagtttaatggcaaggat

SEQ ID NO: 7295574 - DNA, 22 bp, Homo sapiens
ttcacagttgggcaggttgtgt

SEQ ID NO: 7295575 - DNA, 22 bp, Homo sapiens
ttcacagttcctgggaaaacag

SEQ ID NO: 7295576 - DNA, 22 bp, Homo sapiens
ttcacagtgtttctcacggtta

SEQ ID NO: 7295577 - DNA, 22 bp, Homo sapiens
ttcacagtgttgtgccttttgt

SEQ ID NO: 7295578 - DNA, 22 bp, Homo sapiens
ttcacagtgtgatctatgggca

SEQ ID NO: 7295579 - DNA, 22 bp, Homo sapiens
ttcacagtggtagtgcatttag

SEQ ID NO: 7295580 - DNA, 22 bp, Homo sapiens
ttcacagtggtaagggttgtga

SEQ ID NO: 7295581 - DNA, 22 bp, Homo sapiens
ttcactgttgttagcagaggcg

SEQ ID NO: 7295582 - DNA, 22 bp, Homo sapiens
ttcctttctctggactgcagcc

SEQ ID NO: 7295583 - DNA, 22 bp, Homo sapiens
ctatttatgtgctattttgtat

SEQ ID NO: 7295584 - DNA, 22 bp, Homo sapiens
ctattcaattttgctattgtag

SEQ ID NO: 7295585 - DNA, 22 bp, Homo sapiens
ctatttcattgtgctgagtctg

SEQ ID NO: 7295586 - DNA, 22 bp, Homo sapiens
ctatttcaaggcccagatatga

SEQ ID NO: 7295587 - DNA, 22 bp, Homo sapiens
ctatttcagcagaagccggaga

SEQ ID NO: 7295588 - DNA, 22 bp, Homo sapiens
ttcttgttttgcccaagttgta

SEQ ID NO: 7295589 - DNA, 22 bp, Homo sapiens
ctcagcaggtaccacatgatct

SEQ ID NO: 7295590 - DNA, 22 bp, Homo sapiens
ctcagcagaggcagtattcagt

SEQ ID NO: 7295591 - DNA, 22 bp, Homo sapiens
ctatttttctgtaccctaattt

SEQ ID NO: 7295592 - DNA, 22 bp, Homo sapiens
ttgagaaaacattgagggccat

SEQ ID NO: 7295593 - DNA, 22 bp, Homo sapiens
ctctccaggactttggcccaat

SEQ ID NO: 7295594 - DNA, 22 bp, Homo sapiens
tttcagttgtcctgttaatagc

SEQ ID NO: 7295595 - DNA, 22 bp, Homo sapiens
tttcagttcatgtattccgagt

SEQ ID NO: 7295596 - DNA, 22 bp, Homo sapiens
ctctccagcctttagcccacgc

SEQ ID NO: 7295597 - DNA, 19 bp, Homo sapiens
ctctccagctccagtagct

SEQ ID NO: 7295598 - DNA, 22 bp, Homo sapiens
tttacatgagtagcagatgttc

SEQ ID NO: 7295599 - DNA, 22 bp, Homo sapiens
tttacatgtcaagactggcagt

SEQ ID NO: 7295600 - DNA, 22 bp, Homo sapiens
tttacatgtccttcaagagcag

SEQ ID NO: 7295601 - DNA, 22 bp, Homo sapiens
ctcctctggaaattcctctgcc

SEQ ID NO: 7295602 - DNA, 22 bp, Homo sapiens
ctcctctctggagttatgcaga

SEQ ID NO: 7295603 - DNA, 17 bp, Homo sapiens
ctcctctctgggttact

SEQ ID NO: 7295604 - DNA, 22 bp, Homo sapiens
ctcctctggcttcctggaggca

SEQ ID NO: 7295605 - DNA, 22 bp, Homo sapiens
ttgttaaaaatagatttccagg

SEQ ID NO: 7295606 - DNA, 22 bp, Homo sapiens
ttgttaaaatattggagaaagg

SEQ ID NO: 7295607 - DNA, 22 bp, Homo sapiens
ctccagggatgagacagagtag

SEQ ID NO: 7295608 - DNA, 20 bp, Homo sapiens
ttggtaaggatgaagagcaa

SEQ ID NO: 7295609 - DNA, 22 bp, Homo sapiens
gttcacagtctacatagtaaag

SEQ ID NO: 7295610 - DNA, 20 bp, Homo sapiens
gttggaaagttcactctgct

SEQ ID NO: 7295611 - DNA, 22 bp, Homo sapiens
gttgggaacatgacctaatggt

SEQ ID NO: 7295612 - DNA, 22 bp, Homo sapiens
gttgggaagcagatggatgagc

SEQ ID NO: 7295613 - DNA, 22 bp, Homo sapiens
caggaaagggatgggctgccac

SEQ ID NO: 7295614 - DNA, 22 bp, Homo sapiens
caggaaaggtagtcacaatgta

SEQ ID NO: 7295615 - DNA, 22 bp, Homo sapiens
gtttacatgcatgcaagaatga

SEQ ID NO: 7295616 - DNA, 22 bp, Homo sapiens
gtttcaaaagtcaggctattct

SEQ ID NO: 7295617 - DNA, 22 bp, Homo sapiens
caggaacagcaccaggagctag

SEQ ID NO: 7295618 - DNA, 22 bp, Homo sapiens
gtgttttggccattagtgtgat

SEQ ID NO: 7295619 - DNA, 22 bp, Homo sapiens
gtgtgtgcaagaggtttattga

SEQ ID NO: 7295620 - DNA, 22 bp, Homo sapiens
gtgtgtgctccccaggagagct

SEQ ID NO: 7295621 - DNA, 22 bp, Homo sapiens
gtgtgtgctccccaggagagct

SEQ ID NO: 7295622 - DNA, 22 bp, Homo sapiens
gtgtgtgtactctgtatataaa

SEQ ID NO: 7295623 - DNA, 22 bp, Homo sapiens
gtgtttgtttgggtagctagac

SEQ ID NO: 7295624 - DNA, 22 bp, Homo sapiens
gtgtgtgtatatatacacacac

SEQ ID NO: 7295625 - DNA, 22 bp, Homo sapiens
gttattctacagtcattgaagt

SEQ ID NO: 7295626 - DNA, 22 bp, Homo sapiens
gtggcagtctcatctgtggctc

SEQ ID NO: 7295627 - DNA, 22 bp, Homo sapiens
gtggcccacacagacagcatct

SEQ ID NO: 7295628 - DNA, 22 bp, Homo sapiens
cagcccaggactgcaggtgttt

SEQ ID NO: 7295629 - DNA, 22 bp, Homo sapiens
cagcccagccgagggcctggct

SEQ ID NO: 7295630 - DNA, 17 bp, Homo sapiens
gtgtgctactatcattt

SEQ ID NO: 7295631 - DNA, 22 bp, Homo sapiens
gtgtgagcatcaaagcctgtca

SEQ ID NO: 7295632 - DNA, 22 bp, Homo sapiens
gtgtgagcaggtttgacctaag

SEQ ID NO: 7295633 - DNA, 22 bp, Homo sapiens
gtgtgagcacactcgggccagc

SEQ ID NO: 7295634 - DNA, 22 bp, Homo sapiens
gtgtgagcagaaaccatgagta

SEQ ID NO: 7295635 - DNA, 22 bp, Homo sapiens
gtttggaatgagtcctgccatt

SEQ ID NO: 7295636 - DNA, 22 bp, Homo sapiens
caggaagcatctggctagctaa

SEQ ID NO: 7295637 - DNA, 22 bp, Homo sapiens
caggaatgactgcagatggggc

SEQ ID NO: 7295638 - DNA, 22 bp, Homo sapiens
caggaatagggcgtgagcatat

SEQ ID NO: 7295639 - DNA, 22 bp, Homo sapiens
caggaagtgtgcctgagcacct

SEQ ID NO: 7295640 - DNA, 22 bp, Homo sapiens
caggacacagaataaggcagtt

SEQ ID NO: 7295641 - DNA, 22 bp, Homo sapiens
caggacactaaaaagccaagct

SEQ ID NO: 7295642 - DNA, 22 bp, Homo sapiens
caggacacatttcttgttcagg

SEQ ID NO: 7295643 - DNA, 22 bp, Homo sapiens
caggacaccttagctaaaattc

SEQ ID NO: 7295644 - DNA, 22 bp, Homo sapiens
caggacacagggtgtggctgat

SEQ ID NO: 7295645 - DNA, 22 bp, Homo sapiens
caggaatgtatgatacagtggt

SEQ ID NO: 7295646 - DNA, 22 bp, Homo sapiens
caggaatgggtgacagtcagct

SEQ ID NO: 7295647 - DNA, 18 bp, Homo sapiens
caggaatggatgggattt

SEQ ID NO: 7295648 - DNA, 22 bp, Homo sapiens
caggaatgatattcgaggagat

SEQ ID NO: 7295649 - DNA, 22 bp, Homo sapiens
caggaatgagttctggtgctct

SEQ ID NO: 7295650 - DNA, 22 bp, Homo sapiens
caggacactacagatgggaggg

SEQ ID NO: 7295651 - DNA, 22 bp, Homo sapiens
caggacaggccctgtggggtct

SEQ ID NO: 7295652 - DNA, 22 bp, Homo sapiens
taaactgaagctcaactcaaat

SEQ ID NO: 7295653 - DNA, 22 bp, Homo sapiens
caggaccaagcaaagtttcttt

SEQ ID NO: 7295654 - DNA, 22 bp, Homo sapiens
caggaccaagcaaagtttcttt

SEQ ID NO: 7295655 - DNA, 22 bp, Homo sapiens
caggaccattgcaactgcccct

SEQ ID NO: 7295656 - DNA, 22 bp, Homo sapiens
caggaccaggcgttctgggctg

SEQ ID NO: 7295657 - DNA, 22 bp, Homo sapiens
caggaccattgcaactgcccct

SEQ ID NO: 7295658 - DNA, 22 bp, Homo sapiens
caggaggcatcatggagcggac

SEQ ID NO: 7295659 - DNA, 22 bp, Homo sapiens
caggaggccaactgtgggactt

SEQ ID NO: 7295660 - DNA, 22 bp, Homo sapiens
caggaggctcctagggctctgt

SEQ ID NO: 7295661 - DNA, 20 bp, Homo sapiens
caggagggacatttcagcat

SEQ ID NO: 7295662 - DNA, 22 bp, Homo sapiens
caggagggcccgagactcttcc

SEQ ID NO: 7295663 - DNA, 22 bp, Homo sapiens
caggagggtgtggaaaactggg

SEQ ID NO: 7295664 - DNA, 22 bp, Homo sapiens
caggagctgggtctggaagcag

SEQ ID NO: 7295665 - DNA, 22 bp, Homo sapiens
taaatggttccgtgattcatga

SEQ ID NO: 7295666 - DNA, 20 bp, Homo sapiens
taaatggtgcatttcttata

SEQ ID NO: 7295667 - DNA, 22 bp, Homo sapiens
taaagcatttttgaaattatga

SEQ ID NO: 7295668 - DNA, 22 bp, Homo sapiens
caggagctactcaggttgggtt

SEQ ID NO: 7295669 - DNA, 22 bp, Homo sapiens
caggagctcttaaggatgtgat

SEQ ID NO: 7295670 - DNA, 22 bp, Homo sapiens
caggagctctcatcgtcagggc

SEQ ID NO: 7295671 - DNA, 22 bp, Homo sapiens
taagcaaaagtcgagtgtgagc

SEQ ID NO: 7295672 - DNA, 22 bp, Homo sapiens
caggcacagttccaagcatttt

SEQ ID NO: 7295673 - DNA, 22 bp, Homo sapiens
caggcacagagttattcattta

SEQ ID NO: 7295674 - DNA, 22 bp, Homo sapiens
taacattgtcagttcaactgct

SEQ ID NO: 7295675 - DNA, 22 bp, Homo sapiens
taacagaaatagaaatgagagt

SEQ ID NO: 7295676 - DNA, 21 bp, Homo sapiens
caggatgatgataattcatgg

SEQ ID NO: 7295677 - DNA, 22 bp, Homo sapiens
caggcagggagctggaaaggat

SEQ ID NO: 7295678 - DNA, 20 bp, Homo sapiens
tacaaacctccacactggtg

SEQ ID NO: 7295679 - DNA, 22 bp, Homo sapiens
tacagtttgtgtggagctggag

SEQ ID NO: 7295680 - DNA, 21 bp, Homo sapiens
tacatcagttttcttggctca

SEQ ID NO: 7295681 - DNA, 22 bp, Homo sapiens
tacagtttgttacattgttagt

SEQ ID NO: 7295682 - DNA, 22 bp, Homo sapiens
caggcaggagaggaggatttct

SEQ ID NO: 7295683 - DNA, 23 bp, Homo sapiens
caggcaggatgaggactacactc

SEQ ID NO: 7295684 - DNA, 22 bp, Homo sapiens
taattgtatggagaaggctgca

SEQ ID NO: 7295685 - DNA, 22 bp, Homo sapiens
catttagtctgatatggatgaa

SEQ ID NO: 7295686 - DNA, 22 bp, Homo sapiens
catttagtacaacttttacagt

SEQ ID NO: 7295687 - DNA, 22 bp, Homo sapiens
catttagaaactgtttttaaca

SEQ ID NO: 7295688 - DNA, 22 bp, Homo sapiens
catttggaaagagactagagaa

SEQ ID NO: 7295689 - DNA, 22 bp, Homo sapiens
ccacagccattccagggaggct

SEQ ID NO: 7295690 - DNA, 18 bp, Homo sapiens
ccacagcagagttcttac

SEQ ID NO: 7295691 - DNA, 22 bp, Homo sapiens
ccacagagttacaaaacagtca

SEQ ID NO: 7295692 - DNA, 22 bp, Homo sapiens
ccacagagttgatgcaataaga

SEQ ID NO: 7295693 - DNA, 22 bp, Homo sapiens
ccacagagttacaaaacagtca

SEQ ID NO: 7295694 - DNA, 17 bp, Homo sapiens
tcctccccgcagttgca

SEQ ID NO: 7295695 - DNA, 20 bp, Homo sapiens
tcctcccccacctttgcagc

SEQ ID NO: 7295696 - DNA, 22 bp, Homo sapiens
tcctccccaaagcccagcctgg

SEQ ID NO: 7295697 - DNA, 22 bp, Homo sapiens
ccacaaggcctgtggggctgct

SEQ ID NO: 7295698 - DNA, 22 bp, Homo sapiens
ccacaaaactgtgtgtcaaaga

SEQ ID NO: 7295699 - DNA, 22 bp, Homo sapiens
ccagatatcactgccgtgttgt

SEQ ID NO: 7295700 - DNA, 21 bp, Homo sapiens
ccagatgcaaatgcagacatt

SEQ ID NO: 7295701 - DNA, 22 bp, Homo sapiens
ccactgccagccgcccggaggc

SEQ ID NO: 7295702 - DNA, 22 bp, Homo sapiens
ccactgatcctgactttggagc

SEQ ID NO: 7295703 - DNA, 22 bp, Homo sapiens
ccactgagtgagcagagcaggg

SEQ ID NO: 7295704 - DNA, 22 bp, Homo sapiens
ccacagtgagttctgtactctg

SEQ ID NO: 7295705 - DNA, 22 bp, Homo sapiens
ccacagtgagttagattgacca

SEQ ID NO: 7295706 - DNA, 22 bp, Homo sapiens
ccacagtccgggctggcaggac

SEQ ID NO: 7295707 - DNA, 21 bp, Homo sapiens
ccagctccaggaccttggatc

SEQ ID NO: 7295708 - DNA, 22 bp, Homo sapiens
ccagcctcatcatattcctgct

SEQ ID NO: 7295709 - DNA, 22 bp, Homo sapiens
ccagctccagcatagccaccat

SEQ ID NO: 7295710 - DNA, 22 bp, Homo sapiens
tctgaaataggaaagcaaatgg

SEQ ID NO: 7295711 - DNA, 22 bp, Homo sapiens
tctgaaatattggtaatacttt

SEQ ID NO: 7295712 - DNA, 22 bp, Homo sapiens
tctgaaataggcttcttttggt

SEQ ID NO: 7295713 - DNA, 22 bp, Homo sapiens
tctgaaataggagccatgtaga

SEQ ID NO: 7295714 - DNA, 22 bp, Homo sapiens
tctcttgagctcagttctgatg

SEQ ID NO: 7295715 - DNA, 22 bp, Homo sapiens
tctctcttcatgcttttagaat

SEQ ID NO: 7295716 - DNA, 22 bp, Homo sapiens
ccaggaagctctgctccacggg

SEQ ID NO: 7295717 - DNA, 22 bp, Homo sapiens
ccaggaggatgaggggcataga

SEQ ID NO: 7295718 - DNA, 22 bp, Homo sapiens
ccaggaggcggaaggtacagtg

SEQ ID NO: 7295719 - DNA, 22 bp, Homo sapiens
tcacattgaagaaattttaagt

SEQ ID NO: 7295720 - DNA, 22 bp, Homo sapiens
tcacattgattacattccatgt

SEQ ID NO: 7295721 - DNA, 22 bp, Homo sapiens
tcacattgaatggaagaataga

SEQ ID NO: 7295722 - DNA, 22 bp, Homo sapiens
cagtgctgttgggcccagagag

SEQ ID NO: 7295723 - DNA, 22 bp, Homo sapiens
cagtgctgttgggcccagagag

SEQ ID NO: 7295724 - DNA, 19 bp, Homo sapiens
cagtgctgttcattcagtg

SEQ ID NO: 7295725 - DNA, 22 bp, Homo sapiens
cagtgctgtgctggaagctgtt

SEQ ID NO: 7295726 - DNA, 22 bp, Homo sapiens
cagtgctgagagcctggccagg

SEQ ID NO: 7295727 - DNA, 22 bp, Homo sapiens
cagtgctgagagcctggccagg

SEQ ID NO: 7295728 - DNA, 22 bp, Homo sapiens
cagtgctgcatctccatgccag

SEQ ID NO: 7295729 - DNA, 22 bp, Homo sapiens
cagtgctggtgtaggctgacca

SEQ ID NO: 7295730 - DNA, 22 bp, Homo sapiens
cagtgctggaggggtgcttgca

SEQ ID NO: 7295731 - DNA, 22 bp, Homo sapiens
cagtgctggagatgggtggaac

SEQ ID NO: 7295732 - DNA, 22 bp, Homo sapiens
tcactcagaaatagaatgaacc

SEQ ID NO: 7295733 - DNA, 22 bp, Homo sapiens
tcactcagatgttaaagggctt

SEQ ID NO: 7295734 - DNA, 22 bp, Homo sapiens
tcactcagcattcactgggcct

SEQ ID NO: 7295735 - DNA, 22 bp, Homo sapiens
tcactcagcattcactgggcct

SEQ ID NO: 7295736 - DNA, 22 bp, Homo sapiens
tcactcaggctggagtgcagtg

SEQ ID NO: 7295737 - DNA, 22 bp, Homo sapiens
cagtgcagacgtggagggggca

SEQ ID NO: 7295738 - DNA, 22 bp, Homo sapiens
cagtgatttttacagtaaggaa

SEQ ID NO: 7295739 - DNA, 22 bp, Homo sapiens
cagtgattaaaacatgacagcc

SEQ ID NO: 7295740 - DNA, 22 bp, Homo sapiens
cagtgaggtggatggatggcct

SEQ ID NO: 7295741 - DNA, 22 bp, Homo sapiens
cagtgaggtgcccagcctgccc

SEQ ID NO: 7295742 - DNA, 22 bp, Homo sapiens
tatttagaacagacaatagaaa

SEQ ID NO: 7295743 - DNA, 22 bp, Homo sapiens
tatttagttatctttcataaaa

SEQ ID NO: 7295744 - DNA, 22 bp, Homo sapiens
tatctcttgtctgttttgcaaa

SEQ ID NO: 7295745 - DNA, 22 bp, Homo sapiens
tatctctttcattttagagtca

SEQ ID NO: 7295746 - DNA, 23 bp, Homo sapiens
tatctcagaggaatgtagttact

SEQ ID NO: 7295747 - DNA, 22 bp, Homo sapiens
tatgcacacattagcacagggt

SEQ ID NO: 7295748 - DNA, 22 bp, Homo sapiens
catgattatattaatggcttca

SEQ ID NO: 7295749 - DNA, 22 bp, Homo sapiens
catgatacttgaatttggaagg

SEQ ID NO: 7295750 - DNA, 22 bp, Homo sapiens
catgatcaccacttgacagccc

SEQ ID NO: 7295751 - DNA, 22 bp, Homo sapiens
catgatcagaaagagaagctag

SEQ ID NO: 7295752 - DNA, 22 bp, Homo sapiens
tcatttgttgaactttagtgcg

SEQ ID NO: 7295753 - DNA, 22 bp, Homo sapiens
tcatttgtttaggtagcaccat

SEQ ID NO: 7295754 - DNA, 22 bp, Homo sapiens
tcatttgtttctgtttggggct

SEQ ID NO: 7295755 - DNA, 22 bp, Homo sapiens
catgattatgtgttagagtttg

SEQ ID NO: 7295756 - DNA, 22 bp, Homo sapiens
tcatgtaagagcttttgtgtca

SEQ ID NO: 7295757 - DNA, 22 bp, Homo sapiens
catccattaactcatttgtttc

SEQ ID NO: 7295758 - DNA, 22 bp, Homo sapiens
catgggagctatctccatcact

SEQ ID NO: 7295759 - DNA, 22 bp, Homo sapiens
catgcacaagggatgatgaaat

SEQ ID NO: 7295760 - DNA, 22 bp, Homo sapiens
catgcacaaaggtaagatgcgt

SEQ ID NO: 7295761 - DNA, 23 bp, Homo sapiens
catgcaaacactattgcatttgg

SEQ ID NO: 7295762 - DNA, 22 bp, Homo sapiens
tcattttcaagtttgaacagga

SEQ ID NO: 7295763 - DNA, 22 bp, Homo sapiens
tcattttcacacataaatagca

SEQ ID NO: 7295764 - DNA, 22 bp, Homo sapiens
tcattttcacacataaatagca

SEQ ID NO: 7295765 - DNA, 22 bp, Homo sapiens
tcattttcccactgaagctgtc

SEQ ID NO: 7295766 - DNA, 21 bp, Homo sapiens
catcacaggatgattttttca

SEQ ID NO: 7295767 - DNA, 22 bp, Homo sapiens
catcacatcagtgtgaacagtt

SEQ ID NO: 7295768 - DNA, 22 bp, Homo sapiens
catatattctggttttcactgg

SEQ ID NO: 7295769 - DNA, 22 bp, Homo sapiens
cataatttttttaagtcagaac

SEQ ID NO: 7295770 - DNA, 22 bp, Homo sapiens
tcagcagtgagaattaatgttg

SEQ ID NO: 7295771 - DNA, 22 bp, Homo sapiens
tcagaagggaaacacaagtgac

SEQ ID NO: 7295772 - DNA, 18 bp, Homo sapiens
tgttactgagttatgttc

SEQ ID NO: 7295773 - DNA, 22 bp, Homo sapiens
tgttactgagtaatgtatagat

SEQ ID NO: 7295774 - DNA, 22 bp, Homo sapiens
tgttactgggcatctagtgggt

SEQ ID NO: 7295775 - DNA, 22 bp, Homo sapiens
tgtttattgcagtgctgggctg

SEQ ID NO: 7295776 - DNA, 22 bp, Homo sapiens
tgttgtttctactaataggcca

SEQ ID NO: 7295777 - DNA, 21 bp, Homo sapiens
tgttgttttatggctatgaat

SEQ ID NO: 7295778 - DNA, 22 bp, Homo sapiens
tgtttttgttcaatgctaggtc

SEQ ID NO: 7295779 - DNA, 22 bp, Homo sapiens
tgtttttgtctccttgtctgct

SEQ ID NO: 7295780 - DNA, 22 bp, Homo sapiens
tgtttgcttacttgtatgctgc

SEQ ID NO: 7295781 - DNA, 22 bp, Homo sapiens
tgtttgctctgactatcttgcg

SEQ ID NO: 7295782 - DNA, 22 bp, Homo sapiens
tgtttgctagggttggtattta

SEQ ID NO: 7295783 - DNA, 18 bp, Homo sapiens
tgtttatttttctcttac

SEQ ID NO: 7295784 - DNA, 22 bp, Homo sapiens
tgtttcaaaacagtgataattt

SEQ ID NO: 7295785 - DNA, 22 bp, Homo sapiens
tgtgtgccagggcatgcacagg

SEQ ID NO: 7295786 - DNA, 22 bp, Homo sapiens
tgtgtgcattagcattctaggg

SEQ ID NO: 7295787 - DNA, 22 bp, Homo sapiens
tgtgtgtgagtcctggctttcc

SEQ ID NO: 7295788 - DNA, 22 bp, Homo sapiens
tgtgtgtgactcatactagaac

SEQ ID NO: 7295789 - DNA, 22 bp, Homo sapiens
tgtgtgtgacaacctagttcag

SEQ ID NO: 7295790 - DNA, 22 bp, Homo sapiens
tgtgttaaggtgcatctagtgc

SEQ ID NO: 7295791 - DNA, 19 bp, Homo sapiens
tgtgtgtttatatatgtat

SEQ ID NO: 7295792 - DNA, 22 bp, Homo sapiens
tgtgtgttatcttagttcatct

SEQ ID NO: 7295793 - DNA, 22 bp, Homo sapiens
tgtgtgttagtctcaaagccgt

SEQ ID NO: 7295794 - DNA, 22 bp, Homo sapiens
tgtgtgttaacttatttaatgt

SEQ ID NO: 7295795 - DNA, 22 bp, Homo sapiens
tgtgtgttggctggagagggct

SEQ ID NO: 7295796 - DNA, 22 bp, Homo sapiens
tgtgtgttctcaattattgatg

SEQ ID NO: 7295797 - DNA, 22 bp, Homo sapiens
tgtgtgttcagagatagatata

SEQ ID NO: 7295798 - DNA, 22 bp, Homo sapiens
tgtgtgttattttcagccatta

SEQ ID NO: 7295799 - DNA, 22 bp, Homo sapiens
tgtgtgtgtttctgctcataca

SEQ ID NO: 7295800 - DNA, 22 bp, Homo sapiens
tgtgtgtgtttataaatctaaa

SEQ ID NO: 7295801 - DNA, 22 bp, Homo sapiens
tgtgtgtgttcctcctcagcta

SEQ ID NO: 7295802 - DNA, 20 bp, Homo sapiens
tgtgtgtgtacttctaaata

SEQ ID NO: 7295803 - DNA, 22 bp, Homo sapiens
tgtggaagtcgcctctccttgg

SEQ ID NO: 7295804 - DNA, 22 bp, Homo sapiens
tgtggaagaacttcttgcttgg

SEQ ID NO: 7295805 - DNA, 22 bp, Homo sapiens
tgtctaagggaagatgcaatgt

SEQ ID NO: 7295806 - DNA, 22 bp, Homo sapiens
tgtctaagagtgcaatgcatga

SEQ ID NO: 7295807 - DNA, 22 bp, Homo sapiens
tgtctccatagagtagcttgat

SEQ ID NO: 7295808 - DNA, 22 bp, Homo sapiens
tgtctcccaggtgtgcccagtg

SEQ ID NO: 7295809 - DNA, 22 bp, Homo sapiens
tgtctcctcaactcatgctcga

SEQ ID NO: 7295810 - DNA, 22 bp, Homo sapiens
tgtctcctctgtcctgtcagga

SEQ ID NO: 7295811 - DNA, 22 bp, Homo sapiens
tgtctccttgcttttccctgta

SEQ ID NO: 7295812 - DNA, 22 bp, Homo sapiens
tgtcttaacataaaaggaaatc

SEQ ID NO: 7295813 - DNA, 22 bp, Homo sapiens
tgtctttttactatgttcaatc

SEQ ID NO: 7295814 - DNA, 21 bp, Homo sapiens
tgtgaaatagctatgctacat

SEQ ID NO: 7295815 - DNA, 22 bp, Homo sapiens
tgtgacagccagtaaagtaagc

SEQ ID NO: 7295816 - DNA, 22 bp, Homo sapiens
tgtgacagatctttaaataatg

SEQ ID NO: 7295817 - DNA, 19 bp, Homo sapiens
tgtgaccccagacaagctg

SEQ ID NO: 7295818 - DNA, 22 bp, Homo sapiens
tgtgacccccgtcacggctgct

SEQ ID NO: 7295819 - DNA, 22 bp, Homo sapiens
tgtgacctcatcttaactggaa

SEQ ID NO: 7295820 - DNA, 21 bp, Homo sapiens
tgtgacctgatgtagtacatt

SEQ ID NO: 7295821 - DNA, 22 bp, Homo sapiens
tgtgactgagctgcagagtgtc

SEQ ID NO: 7295822 - DNA, 22 bp, Homo sapiens
tgtgactgaggctccaagctag

SEQ ID NO: 7295823 - DNA, 22 bp, Homo sapiens
tgtgactgcatttggagctggg

SEQ ID NO: 7295824 - DNA, 22 bp, Homo sapiens
tgtgactggcttatttcactta

SEQ ID NO: 7295825 - DNA, 22 bp, Homo sapiens
tgtgactgtggtgagatttaag

SEQ ID NO: 7295826 - DNA, 22 bp, Homo sapiens
tgtgactgtggacttttgtggg

SEQ ID NO: 7295827 - DNA, 21 bp, Homo sapiens
tgtgactgttgcatttgtcgt

SEQ ID NO: 7295828 - DNA, 22 bp, Homo sapiens
tgtgagacaattgcatcagggc

SEQ ID NO: 7295829 - DNA, 22 bp, Homo sapiens
tgtgagacgtgttagaacagtg

SEQ ID NO: 7295830 - DNA, 22 bp, Homo sapiens
tgtgagcactgtgatgctgttc

SEQ ID NO: 7295831 - DNA, 22 bp, Homo sapiens
tgtgagcaagattcagagattc

SEQ ID NO: 7295832 - DNA, 22 bp, Homo sapiens
tgtgagcaagtttatgtgtaca

SEQ ID NO: 7295833 - DNA, 22 bp, Homo sapiens
tgtgagcaagtgactggtgaga

SEQ ID NO: 7295834 - DNA, 22 bp, Homo sapiens
tgtgcagctagtcctggacttg

SEQ ID NO: 7295835 - DNA, 22 bp, Homo sapiens
tgtgcagagtaaggcagctgtt

SEQ ID NO: 7295836 - DNA, 22 bp, Homo sapiens
tgtgcaatttcaatttacacag

SEQ ID NO: 7295837 - DNA, 18 bp, Homo sapiens
tgtgcaatattaaccacc

SEQ ID NO: 7295838 - DNA, 22 bp, Homo sapiens
tgtgcaatcatattttaaaatg

SEQ ID NO: 7295839 - DNA, 22 bp, Homo sapiens
tgtgcatattactacctactcc

SEQ ID NO: 7295840 - DNA, 22 bp, Homo sapiens
tgtgcatgcacatatatgttgc

SEQ ID NO: 7295841 - DNA, 22 bp, Homo sapiens
tgtgcatgcatatgtatttttg

SEQ ID NO: 7295842 - DNA, 22 bp, Homo sapiens
tgtgcatgtattgatttgtacc

SEQ ID NO: 7295843 - DNA, 22 bp, Homo sapiens
tgtgcatgtaccttattctgga

SEQ ID NO: 7295844 - DNA, 22 bp, Homo sapiens
ttacattagacccactttcatg

SEQ ID NO: 7295845 - DNA, 22 bp, Homo sapiens
ttacattaagccaatggattct

SEQ ID NO: 7295846 - DNA, 22 bp, Homo sapiens
ttacatgcaggtcagactgcat

SEQ ID NO: 7295847 - DNA, 22 bp, Homo sapiens
ttacagatggggttgcaataaa

SEQ ID NO: 7295848 - DNA, 22 bp, Homo sapiens
ttacagatggatctagcaaaat

SEQ ID NO: 7295849 - DNA, 22 bp, Homo sapiens
ttacagatactttgtaggcaag

SEQ ID NO: 7295850 - DNA, 22 bp, Homo sapiens
ttacagagataaactgtaagtg

SEQ ID NO: 7295851 - DNA, 22 bp, Homo sapiens
ttacagagggcttctctgaact

SEQ ID NO: 7295852 - DNA, 22 bp, Homo sapiens
ttaaagagtaatcataggtcaa

SEQ ID NO: 7295853 - DNA, 22 bp, Homo sapiens
ttaaagcagtttgtatacatgg

SEQ ID NO: 7295854 - DNA, 22 bp, Homo sapiens
ttaaagcaaccatcaatttgga

SEQ ID NO: 7295855 - DNA, 22 bp, Homo sapiens
ttattcagtgcatatattaaaa

SEQ ID NO: 7295856 - DNA, 22 bp, Homo sapiens
ttatttcattgatttctaagac

SEQ ID NO: 7295857 - DNA, 22 bp, Homo sapiens
ttagaagcactaattactcaca

SEQ ID NO: 7295858 - DNA, 22 bp, Homo sapiens
ttcattgatagttttatgtatg

SEQ ID NO: 7295859 - DNA, 21 bp, Homo sapiens
ttcattcatggcataatatag

SEQ ID NO: 7295860 - DNA, 22 bp, Homo sapiens
ttcattcatctctaaaatgcct

SEQ ID NO: 7295861 - DNA, 22 bp, Homo sapiens
ttcattcagcacatatttattg

SEQ ID NO: 7295862 - DNA, 22 bp, Homo sapiens
ttatttcttgtctatgtagcca

SEQ ID NO: 7295863 - DNA, 20 bp, Homo sapiens
ttatttctcattctcctact

SEQ ID NO: 7295864 - DNA, 22 bp, Homo sapiens
ttcagcctgtctgcagacccct

SEQ ID NO: 7295865 - DNA, 21 bp, Homo sapiens
ttcagcagtcctctagagata

SEQ ID NO: 7295866 - DNA, 22 bp, Homo sapiens
tgtccctcattgacgctgtgcc

SEQ ID NO: 7295867 - DNA, 18 bp, Homo sapiens
tgtccctgcaaataacat

SEQ ID NO: 7295868 - DNA, 22 bp, Homo sapiens
tgtccctggactccaggagcca

SEQ ID NO: 7295869 - DNA, 18 bp, Homo sapiens
tgtcataatatatcacct

SEQ ID NO: 7295870 - DNA, 22 bp, Homo sapiens
tgtcataacttagtgacaaatc

SEQ ID NO: 7295871 - DNA, 22 bp, Homo sapiens
tgtcataatgctgctagaaatt

SEQ ID NO: 7295872 - DNA, 22 bp, Homo sapiens
tgtcatagtgtggtagcagtgg

SEQ ID NO: 7295873 - DNA, 22 bp, Homo sapiens
tgtcagtgtatacatacagtat

SEQ ID NO: 7295874 - DNA, 22 bp, Homo sapiens
tgtccaggaccctattctcact

SEQ ID NO: 7295875 - DNA, 22 bp, Homo sapiens
tgtcatgcaggtttgttataga

SEQ ID NO: 7295876 - DNA, 22 bp, Homo sapiens
tgtatttaattgtatcatcaca

SEQ ID NO: 7295877 - DNA, 22 bp, Homo sapiens
tgtatgctttggttgtttctct

SEQ ID NO: 7295878 - DNA, 22 bp, Homo sapiens
tgtatgctttccttctttctgg

SEQ ID NO: 7295879 - DNA, 22 bp, Homo sapiens
tgtatgcttgagtgtgtatact

SEQ ID NO: 7295880 - DNA, 22 bp, Homo sapiens
tgtcaatgggaatttgttttag

SEQ ID NO: 7295881 - DNA, 22 bp, Homo sapiens
tgtcaatgaaaatgtataaggt

SEQ ID NO: 7295882 - DNA, 22 bp, Homo sapiens
tgtcacagagcaactatttctt

SEQ ID NO: 7295883 - DNA, 22 bp, Homo sapiens
tgtcacaacagaggaactgaat

SEQ ID NO: 7295884 - DNA, 22 bp, Homo sapiens
tgtagcatgtaaattggttatt

SEQ ID NO: 7295885 - DNA, 22 bp, Homo sapiens
tggtcgtggggcttcccaggat

SEQ ID NO: 7295886 - DNA, 22 bp, Homo sapiens
tggtgagcgatgctgcatgttc

SEQ ID NO: 7295887 - DNA, 22 bp, Homo sapiens
tggtgaggccaaagccatgaca

SEQ ID NO: 7295888 - DNA, 22 bp, Homo sapiens
tggtgaggtcatagagaactgt

SEQ ID NO: 7295889 - DNA, 22 bp, Homo sapiens
tggtcctcaggttctctgtgcg

SEQ ID NO: 7295890 - DNA, 22 bp, Homo sapiens
tggtcaggtacctctggctgtc

SEQ ID NO: 7295891 - DNA, 22 bp, Homo sapiens
tggtcaggctgctctgcggcgt

SEQ ID NO: 7295892 - DNA, 22 bp, Homo sapiens
tggtgcccttgtgggtgagatg

SEQ ID NO: 7295893 - DNA, 22 bp, Homo sapiens
tgtaaatcactgaactaaatga

SEQ ID NO: 7295894 - DNA, 23 bp, Homo sapiens
tggttctaggcctataattatat

SEQ ID NO: 7295895 - DNA, 22 bp, Homo sapiens
tggttctaaaggactatacaga

SEQ ID NO: 7295896 - DNA, 18 bp, Homo sapiens
tggtttctggaggaataa

SEQ ID NO: 7295897 - DNA, 22 bp, Homo sapiens
tggttgtgtcacttagattaga

SEQ ID NO: 7295898 - DNA, 20 bp, Homo sapiens
tggtgttagaccagagagtg

SEQ ID NO: 7295899 - DNA, 22 bp, Homo sapiens
tgtacaatctgatgatgtatgg

SEQ ID NO: 7295900 - DNA, 22 bp, Homo sapiens
tgtacagaggtgtacatatgat

SEQ ID NO: 7295901 - DNA, 22 bp, Homo sapiens
tgtaagaataatgatttctaag

SEQ ID NO: 7295902 - DNA, 19 bp, Homo sapiens
tgggtgtgaccatctctgc

SEQ ID NO: 7295903 - DNA, 22 bp, Homo sapiens
tgggggcatggaccagcctggc

SEQ ID NO: 7295904 - DNA, 22 bp, Homo sapiens
tgggagcagcagggagatgcgg

SEQ ID NO: 7295905 - DNA, 22 bp, Homo sapiens
tgggaagggagtttcttggagt

SEQ ID NO: 7295906 - DNA, 22 bp, Homo sapiens
tgggaagggccgatggagcctc

SEQ ID NO: 7295907 - DNA, 22 bp, Homo sapiens
tgggaaggcgtggaagtagaag

SEQ ID NO: 7295908 - DNA, 22 bp, Homo sapiens
tgggaagggagagtgtcctgga

SEQ ID NO: 7295909 - DNA, 22 bp, Homo sapiens
tgggaagcattaatgatagggg

SEQ ID NO: 7295910 - DNA, 22 bp, Homo sapiens
tgggaagagttagagacagctg

SEQ ID NO: 7295911 - DNA, 22 bp, Homo sapiens
tgggaagatatgagtgaccaac

SEQ ID NO: 7295912 - DNA, 22 bp, Homo sapiens
tgggaaggtacacgggaaagag

SEQ ID NO: 7295913 - DNA, 22 bp, Homo sapiens
tgggaagggtcaacagctggaa

SEQ ID NO: 7295914 - DNA, 22 bp, Homo sapiens
tgggaaggggagctggaaagga

SEQ ID NO: 7295915 - DNA, 22 bp, Homo sapiens
tgggaagggcctgcccttcctc

SEQ ID NO: 7295916 - DNA, 22 bp, Homo sapiens
tgggaagactcctcaggaggcg

SEQ ID NO: 7295917 - DNA, 18 bp, Homo sapiens
tggcgatggtcatttttc

SEQ ID NO: 7295918 - DNA, 23 bp, Homo sapiens
tggccctgtgcatgctgcttccc

SEQ ID NO: 7295919 - DNA, 22 bp, Homo sapiens
tggccctgtggaggtcagtgag

SEQ ID NO: 7295920 - DNA, 22 bp, Homo sapiens
tggccctgggcatctttcgtga

SEQ ID NO: 7295921 - DNA, 22 bp, Homo sapiens
tggccctgccgcactatcctca

SEQ ID NO: 7295922 - DNA, 22 bp, Homo sapiens
tggcccaggaggccagagggca

SEQ ID NO: 7295923 - DNA, 22 bp, Homo sapiens
tggcccagggcacagcagggag

SEQ ID NO: 7295924 - DNA, 22 bp, Homo sapiens
tggccctgacacgtggtactgg

SEQ ID NO: 7295925 - DNA, 22 bp, Homo sapiens
tggccctgaggggctgtgcccc

SEQ ID NO: 7295926 - DNA, 22 bp, Homo sapiens
tggccctgaggacccagtgtgg

SEQ ID NO: 7295927 - DNA, 22 bp, Homo sapiens
tggccctgcagaactagcctgg

SEQ ID NO: 7295928 - DNA, 22 bp, Homo sapiens
tggccctgaaggccttgagcat

SEQ ID NO: 7295929 - DNA, 22 bp, Homo sapiens
tggcccaggtgcaagagacaga

SEQ ID NO: 7295930 - DNA, 22 bp, Homo sapiens
tggcatgcatctgttgtcctag

SEQ ID NO: 7295931 - DNA, 21 bp, Homo sapiens
tggcatgcagtgttcctgtgc

SEQ ID NO: 7295932 - DNA, 18 bp, Homo sapiens
tggcatgctttgatacat

SEQ ID NO: 7295933 - DNA, 22 bp, Homo sapiens
tggccagccttgtcatcgcttt

SEQ ID NO: 7295934 - DNA, 21 bp, Homo sapiens
tggccagctgctcgtctcctc

SEQ ID NO: 7295935 - DNA, 22 bp, Homo sapiens
tggccagcagagttcactctct

SEQ ID NO: 7295936 - DNA, 22 bp, Homo sapiens
tggccagcccttcagccatgcc

SEQ ID NO: 7295937 - DNA, 22 bp, Homo sapiens
tggcaggatctttgagagtgaa

SEQ ID NO: 7295938 - DNA, 22 bp, Homo sapiens
tggcaggaaccaggaggctctc

SEQ ID NO: 7295939 - DNA, 22 bp, Homo sapiens
tggcaggagcctgcggggaggt

SEQ ID NO: 7295940 - DNA, 22 bp, Homo sapiens
tggcaggagcctgcggggaggt

SEQ ID NO: 7295941 - DNA, 20 bp, Homo sapiens
tggcaggagccactggaagc

SEQ ID NO: 7295942 - DNA, 20 bp, Homo sapiens
tggcaggaatagggccagag

SEQ ID NO: 7295943 - DNA, 22 bp, Homo sapiens
tggcaggaagacgtggggcacc

SEQ ID NO: 7295944 - DNA, 20 bp, Homo sapiens
tggcaggaatagggccagag

SEQ ID NO: 7295945 - DNA, 22 bp, Homo sapiens
tggcaaagatggttctcaccat

SEQ ID NO: 7295946 - DNA, 17 bp, Homo sapiens
tgcctgtgataagcaca

SEQ ID NO: 7295947 - DNA, 22 bp, Homo sapiens
tgcctgtgaaaaccctggggtt

SEQ ID NO: 7295948 - DNA, 22 bp, Homo sapiens
tgcctgtgacccaaggatgcga

SEQ ID NO: 7295949 - DNA, 22 bp, Homo sapiens
tgcctgtgctgggattgcatgt

SEQ ID NO: 7295950 - DNA, 22 bp, Homo sapiens
tgcctgtgccctttgctgggag

SEQ ID NO: 7295951 - DNA, 22 bp, Homo sapiens
tgcctgtggaaaggctggtgct

SEQ ID NO: 7295952 - DNA, 22 bp, Homo sapiens
tgcctgtggagccactagtttt

SEQ ID NO: 7295953 - DNA, 22 bp, Homo sapiens
tgcctgtgcccttcttggcatt

SEQ ID NO: 7295954 - DNA, 22 bp, Homo sapiens
tgcctgtgatcagctgagttca

SEQ ID NO: 7295955 - DNA, 22 bp, Homo sapiens
tgcctgtgggtgccaccaccct

SEQ ID NO: 7295956 - DNA, 22 bp, Homo sapiens
tgcctgtgggtgatgatttgat

SEQ ID NO: 7295957 - DNA, 22 bp, Homo sapiens
tgcctgtggttccagttttttc

SEQ ID NO: 7295958 - DNA, 19 bp, Homo sapiens
tgcctgtggcgagcatctt

SEQ ID NO: 7295959 - DNA, 22 bp, Homo sapiens
tgcctgtgggcagagggccaga

SEQ ID NO: 7295960 - DNA, 22 bp, Homo sapiens
tgcctgtgtcagcaggtggaag

SEQ ID NO: 7295961 - DNA, 22 bp, Homo sapiens
tgcctgtgtcacagtgatgttt

SEQ ID NO: 7295962 - DNA, 22 bp, Homo sapiens
tgcctgtgtccccttcttggca

SEQ ID NO: 7295963 - DNA, 22 bp, Homo sapiens
tgcctgtgtatgtgcatgcaca

SEQ ID NO: 7295964 - DNA, 22 bp, Homo sapiens
tgcctgtgtatttccggcctgc

SEQ ID NO: 7295965 - DNA, 22 bp, Homo sapiens
tgccttgaacatagtggacagt

SEQ ID NO: 7295966 - DNA, 22 bp, Homo sapiens
tgcgatggcgtagacaaatccc

SEQ ID NO: 7295967 - DNA, 22 bp, Homo sapiens
tgcgatgcaacagcttggcgga

SEQ ID NO: 7295968 - DNA, 22 bp, Homo sapiens
tgctcacagcccagaacataat

SEQ ID NO: 7295969 - DNA, 22 bp, Homo sapiens
tgctcacactcatgtccacgct

SEQ ID NO: 7295970 - DNA, 22 bp, Homo sapiens
tgctcacattaggcatccatgg

SEQ ID NO: 7295971 - DNA, 22 bp, Homo sapiens
tgcgccatgtgctctcggccct

SEQ ID NO: 7295972 - DNA, 22 bp, Homo sapiens
tgctataagaattatattactc

SEQ ID NO: 7295973 - DNA, 22 bp, Homo sapiens
tgctataagagtcacttttcct

SEQ ID NO: 7295974 - DNA, 22 bp, Homo sapiens
tgctatttggaaaagcatttgg

SEQ ID NO: 7295975 - DNA, 19 bp, Homo sapiens
tgctatttgaagaagtgta

SEQ ID NO: 7295976 - DNA, 16 bp, Homo sapiens
tgctattttagagagg

SEQ ID NO: 7295977 - DNA, 22 bp, Homo sapiens
tgctgcagggccttccctgcat

SEQ ID NO: 7295978 - DNA, 20 bp, Homo sapiens
tgctctgtctaaaacttccc

SEQ ID NO: 7295979 - DNA, 22 bp, Homo sapiens
tgctctgtaacaaattgacatg

SEQ ID NO: 7295980 - DNA, 22 bp, Homo sapiens
tgctctgttcagtgtatcttgt

SEQ ID NO: 7295981 - DNA, 22 bp, Homo sapiens
tgctctgtgtgtggttatttcc

SEQ ID NO: 7295982 - DNA, 22 bp, Homo sapiens
tgctggcacgtggaccaggaga

SEQ ID NO: 7295983 - DNA, 22 bp, Homo sapiens
tgctggaataatttcatgttaa

SEQ ID NO: 7295984 - DNA, 22 bp, Homo sapiens
tgctggaagggtagtattaact

SEQ ID NO: 7295985 - DNA, 22 bp, Homo sapiens
tgctggaaataggcattgtagc

SEQ ID NO: 7295986 - DNA, 22 bp, Homo sapiens
tgctggaaagttaaattttgga

SEQ ID NO: 7295987 - DNA, 22 bp, Homo sapiens
tgctggaagaaaattctttaac

SEQ ID NO: 7295988 - DNA, 22 bp, Homo sapiens
tgctggaactcagtgaatcatt

SEQ ID NO: 7295989 - DNA, 22 bp, Homo sapiens
tgctggaaccaggaatttgaag

SEQ ID NO: 7295990 - DNA, 22 bp, Homo sapiens
tgctgggtcagtgagagcaggg

SEQ ID NO: 7295991 - DNA, 22 bp, Homo sapiens
tgctggttgtattttctctgtg

SEQ ID NO: 7295992 - DNA, 22 bp, Homo sapiens
tgctgtatatattttgaagtga

SEQ ID NO: 7295993 - DNA, 21 bp, Homo sapiens
tgctggtgagctcatgtggct

SEQ ID NO: 7295994 - DNA, 22 bp, Homo sapiens
tgctggtggagaaagtggaggt

SEQ ID NO: 7295995 - DNA, 22 bp, Homo sapiens
tgctgggtcccttgagagctca

SEQ ID NO: 7295996 - DNA, 22 bp, Homo sapiens
tgctgtgcaaaggtgatgtgag

SEQ ID NO: 7295997 - DNA, 22 bp, Homo sapiens
tgcttctgacatgttcttggtt

SEQ ID NO: 7295998 - DNA, 22 bp, Homo sapiens
tgcttctgactgggtcagttga

SEQ ID NO: 7295999 - DNA, 22 bp, Homo sapiens
tgcttctgcaacttgaatgtac

SEQ ID NO: 7296000 - DNA, 22 bp, Homo sapiens
tgcttctgcattcaatgttgga

SEQ ID NO: 7296001 - DNA, 22 bp, Homo sapiens
tgcttctccattgatgctaagt

SEQ ID NO: 7296002 - DNA, 18 bp, Homo sapiens
tggagggcttgctgcagc

SEQ ID NO: 7296003 - DNA, 22 bp, Homo sapiens
tggagggctctttcacctggta

SEQ ID NO: 7296004 - DNA, 18 bp, Homo sapiens
tggagggcttgctgcagc

SEQ ID NO: 7296005 - DNA, 22 bp, Homo sapiens
tggagggctaagctgagggata

SEQ ID NO: 7296006 - DNA, 22 bp, Homo sapiens
tggagggcgcttagatggaggg

SEQ ID NO: 7296007 - DNA, 22 bp, Homo sapiens
tggagggctaagctgagggata

SEQ ID NO: 7296008 - DNA, 22 bp, Homo sapiens
tggagggctctttcacctggta

SEQ ID NO: 7296009 - DNA, 22 bp, Homo sapiens
tggagggcgcttagatggaggg

SEQ ID NO: 7296010 - DNA, 22 bp, Homo sapiens
tggagggcatgctgtccatggg

SEQ ID NO: 7296011 - DNA, 22 bp, Homo sapiens
tggagggcatgctgtccatggg

SEQ ID NO: 7296012 - DNA, 22 bp, Homo sapiens
tggagggcatctgtggtcaggc

SEQ ID NO: 7296013 - DNA, 22 bp, Homo sapiens
tggagggcatagctgttctttc

SEQ ID NO: 7296014 - DNA, 22 bp, Homo sapiens
tggagggcatagctgttctttc

SEQ ID NO: 7296015 - DNA, 23 bp, Homo sapiens
tggagggcagaataacagactac

SEQ ID NO: 7296016 - DNA, 22 bp, Homo sapiens
tggaggcaggtggaggagtgaa

SEQ ID NO: 7296017 - DNA, 22 bp, Homo sapiens
tggaggagtgtgattgtctgcc

SEQ ID NO: 7296018 - DNA, 22 bp, Homo sapiens
tggaggagggctggtgtctgta

SEQ ID NO: 7296019 - DNA, 22 bp, Homo sapiens
tggaggaggaacttcttatctc

SEQ ID NO: 7296020 - DNA, 22 bp, Homo sapiens
tggaggagaatttatggtcgaa

SEQ ID NO: 7296021 - DNA, 22 bp, Homo sapiens
tggaggagaccattccactcag

SEQ ID NO: 7296022 - DNA, 22 bp, Homo sapiens
tggagagcgcgacgggaggaag

SEQ ID NO: 7296023 - DNA, 22 bp, Homo sapiens
tggagagcaagtcgcagacatg

SEQ ID NO: 7296024 - DNA, 22 bp, Homo sapiens
tggagaaggccggccaggagtg

SEQ ID NO: 7296025 - DNA, 22 bp, Homo sapiens
tggagaagctgtaggtggactc

SEQ ID NO: 7296026 - DNA, 22 bp, Homo sapiens
tggagaaggacagcctgagaaa

SEQ ID NO: 7296027 - DNA, 22 bp, Homo sapiens
tggagaaagctgcatatggaaa

SEQ ID NO: 7296028 - DNA, 22 bp, Homo sapiens
tggagaaggggcagggtctcca

SEQ ID NO: 7296029 - DNA, 22 bp, Homo sapiens
tggagcagaggctgaggttggg

SEQ ID NO: 7296030 - DNA, 22 bp, Homo sapiens
tggagcagaggaagaaggcttt

SEQ ID NO: 7296031 - DNA, 22 bp, Homo sapiens
tggagcaggtgccaggtgtgtg

SEQ ID NO: 7296032 - DNA, 22 bp, Homo sapiens
tggagcaggtgctcagggtaat

SEQ ID NO: 7296033 - DNA, 22 bp, Homo sapiens
tggagcaggacggggagtggta

SEQ ID NO: 7296034 - DNA, 22 bp, Homo sapiens
tggagccaaaaagggaaggaga

SEQ ID NO: 7296035 - DNA, 22 bp, Homo sapiens
tggagcaggtgctcagggtaat

SEQ ID NO: 7296036 - DNA, 22 bp, Homo sapiens
tggagccaggagcctgggagtc

SEQ ID NO: 7296037 - DNA, 22 bp, Homo sapiens
tggaagaggtggaagtggcttc

SEQ ID NO: 7296038 - DNA, 20 bp, Homo sapiens
tggaagaagaactcaggctt

SEQ ID NO: 7296039 - DNA, 22 bp, Homo sapiens
tggaatctgtgctgttttagtg

SEQ ID NO: 7296040 - DNA, 22 bp, Homo sapiens
tggaaggggagctggaaagggg

SEQ ID NO: 7296041 - DNA, 22 bp, Homo sapiens
tggaattatctgaagtgatttg

SEQ ID NO: 7296042 - DNA, 22 bp, Homo sapiens
tggaatgttgggatttaagtgt

SEQ ID NO: 7296043 - DNA, 21 bp, Homo sapiens
tggaatgaggctgagcagtgc

SEQ ID NO: 7296044 - DNA, 22 bp, Homo sapiens
tggacagagaggaaggccattt

SEQ ID NO: 7296045 - DNA, 20 bp, Homo sapiens
tggacagaattagacacttt

SEQ ID NO: 7296046 - DNA, 22 bp, Homo sapiens
tggacccatattgtctgcattc

SEQ ID NO: 7296047 - DNA, 22 bp, Homo sapiens
tggacattccacccatatcaga

SEQ ID NO: 7296048 - DNA, 21 bp, Homo sapiens
tggaccaggaaggtggtggtg

SEQ ID NO: 7296049 - DNA, 22 bp, Homo sapiens
tgctttaacataagatatcttt

SEQ ID NO: 7296050 - DNA, 22 bp, Homo sapiens
tgcttctgctgatattttgtga

SEQ ID NO: 7296051 - DNA, 22 bp, Homo sapiens
tggaagaaaattcaatcgagtt

SEQ ID NO: 7296052 - DNA, 22 bp, Homo sapiens
tggaaattactaacacttagag

SEQ ID NO: 7296053 - DNA, 22 bp, Homo sapiens
tggaaatggatctgatgagtct

SEQ ID NO: 7296054 - DNA, 19 bp, Homo sapiens
tggaaatggaagctcagcc

SEQ ID NO: 7296055 - DNA, 22 bp, Homo sapiens
tggaaaaactgagacttagaca

SEQ ID NO: 7296056 - DNA, 22 bp, Homo sapiens
tgctttgtgatatgctgtgtct

SEQ ID NO: 7296057 - DNA, 22 bp, Homo sapiens
tggaaaatgtgactattctaaa

SEQ ID NO: 7296058 - DNA, 22 bp, Homo sapiens
tggaaagatgaagatgtttaag

SEQ ID NO: 7296059 - DNA, 22 bp, Homo sapiens
tgaggccacagtatcagaacag

SEQ ID NO: 7296060 - DNA, 22 bp, Homo sapiens
tgaggccacttccccacagccc

SEQ ID NO: 7296061 - DNA, 22 bp, Homo sapiens
tgaggccagcttcagcagtgga

SEQ ID NO: 7296062 - DNA, 22 bp, Homo sapiens
tgaggccaggacccccagcagg

SEQ ID NO: 7296063 - DNA, 19 bp, Homo sapiens
tgaggccaaggtcacagat

SEQ ID NO: 7296064 - DNA, 22 bp, Homo sapiens
tgaggaggtcagagtctggctg

SEQ ID NO: 7296065 - DNA, 22 bp, Homo sapiens
tgaggaggtgggcacacagagt

SEQ ID NO: 7296066 - DNA, 22 bp, Homo sapiens
tgaggaggcccaggttggggct

SEQ ID NO: 7296067 - DNA, 22 bp, Homo sapiens
tgaggagcgggcagggatgcag

SEQ ID NO: 7296068 - DNA, 22 bp, Homo sapiens
tgaggatatagtggtaaacagt

SEQ ID NO: 7296069 - DNA, 21 bp, Homo sapiens
tgaggataagtaaagctgaag

SEQ ID NO: 7296070 - DNA, 22 bp, Homo sapiens
tgaggataacccaggcaaactg

SEQ ID NO: 7296071 - DNA, 22 bp, Homo sapiens
tgaggagaaatgctcagagcca

SEQ ID NO: 7296072 - DNA, 22 bp, Homo sapiens
tgaggaagggtgtgacggcacc

SEQ ID NO: 7296073 - DNA, 22 bp, Homo sapiens
tgagggtcatttggaagtggaa

SEQ ID NO: 7296074 - DNA, 22 bp, Homo sapiens
tgaggtggctggatctcagcct

SEQ ID NO: 7296075 - DNA, 22 bp, Homo sapiens
tgagtagcggctatgtgtaact

SEQ ID NO: 7296076 - DNA, 22 bp, Homo sapiens
tgagagcctgtgttcaaatgcc

SEQ ID NO: 7296077 - DNA, 22 bp, Homo sapiens
tgagaagcccacactctttcct

SEQ ID NO: 7296078 - DNA, 22 bp, Homo sapiens
tgagaagcccaagccgggtggt

SEQ ID NO: 7296079 - DNA, 23 bp, Homo sapiens
tgagaagccattagagcaggtgg

SEQ ID NO: 7296080 - DNA, 22 bp, Homo sapiens
tgagaagcagtttcagtaagaa

SEQ ID NO: 7296081 - DNA, 22 bp, Homo sapiens
tgagaagcattaggaagaacat

SEQ ID NO: 7296082 - DNA, 23 bp, Homo sapiens
tgagaagccaggggagcgtgagg

SEQ ID NO: 7296083 - DNA, 22 bp, Homo sapiens
tgagaagcacagctcactcacg

SEQ ID NO: 7296084 - DNA, 22 bp, Homo sapiens
tgagaagcagcttacaggtgtc

SEQ ID NO: 7296085 - DNA, 22 bp, Homo sapiens
tgagaacattgggaaagctatg

SEQ ID NO: 7296086 - DNA, 22 bp, Homo sapiens
tgagaacagttggaagcagtca

SEQ ID NO: 7296087 - DNA, 22 bp, Homo sapiens
tgagaacatacaaacagagaaa

SEQ ID NO: 7296088 - DNA, 22 bp, Homo sapiens
tgagaaaagtgtggaggtcaat

SEQ ID NO: 7296089 - DNA, 22 bp, Homo sapiens
tgagaaaattactataattgtc

SEQ ID NO: 7296090 - DNA, 22 bp, Homo sapiens
tgagaaaatccagaggctagtt

SEQ ID NO: 7296091 - DNA, 23 bp, Homo sapiens
tgagaagccgccgggcagcctgg

SEQ ID NO: 7296092 - DNA, 20 bp, Homo sapiens
tgagaagctcctgtctcctc

SEQ ID NO: 7296093 - DNA, 22 bp, Homo sapiens
tgagaagctctgaaacagtatc

SEQ ID NO: 7296094 - DNA, 22 bp, Homo sapiens
tgagaagctgcttgtgctgtat

SEQ ID NO: 7296095 - DNA, 22 bp, Homo sapiens
tgagaagctgctgacttagcct

SEQ ID NO: 7296096 - DNA, 22 bp, Homo sapiens
tgagaagctgctgacttagcct

SEQ ID NO: 7296097 - DNA, 22 bp, Homo sapiens
tgagcccgtaggggccaaggct

SEQ ID NO: 7296098 - DNA, 22 bp, Homo sapiens
tgagcaggcgcagcaggaggtc

SEQ ID NO: 7296099 - DNA, 22 bp, Homo sapiens
tgacaggattggttgcttctga

SEQ ID NO: 7296100 - DNA, 22 bp, Homo sapiens
tgacaggatagtaggaagatct

SEQ ID NO: 7296101 - DNA, 22 bp, Homo sapiens
tgacaggatgatgagcaggggg

SEQ ID NO: 7296102 - DNA, 22 bp, Homo sapiens
tgacaggaaacatgcagtgatt

SEQ ID NO: 7296103 - DNA, 22 bp, Homo sapiens
tgacaggacagagaaatgacct

SEQ ID NO: 7296104 - DNA, 22 bp, Homo sapiens
tgacagcagcatagtgagcaat

SEQ ID NO: 7296105 - DNA, 22 bp, Homo sapiens
tgacagcatgaccacagggtct

SEQ ID NO: 7296106 - DNA, 21 bp, Homo sapiens
tgacagcatagagcagggagg

SEQ ID NO: 7296107 - DNA, 22 bp, Homo sapiens
tgacagtagtgttagaactgat

SEQ ID NO: 7296108 - DNA, 22 bp, Homo sapiens
tgacaggtgattgtgaactaag

SEQ ID NO: 7296109 - DNA, 22 bp, Homo sapiens
tgacagtaattcactgggaccc

SEQ ID NO: 7296110 - DNA, 22 bp, Homo sapiens
tgacacagttgtcgactctaca

SEQ ID NO: 7296111 - DNA, 22 bp, Homo sapiens
tgacacagtgggggatcctttt

SEQ ID NO: 7296112 - DNA, 22 bp, Homo sapiens
tgacacagtatcaaacatgatt

SEQ ID NO: 7296113 - DNA, 22 bp, Homo sapiens
tgacacagtatcaaacatgatt

SEQ ID NO: 7296114 - DNA, 22 bp, Homo sapiens
tgacacagggcatgcagcagaa

SEQ ID NO: 7296115 - DNA, 22 bp, Homo sapiens
tgacacagattagagacatacc

SEQ ID NO: 7296116 - DNA, 22 bp, Homo sapiens
tgacacagattagagacatacc

SEQ ID NO: 7296117 - DNA, 22 bp, Homo sapiens
tgacagattttttctgagctaa

SEQ ID NO: 7296118 - DNA, 22 bp, Homo sapiens
tgacactgccgaaactgtagag

SEQ ID NO: 7296119 - DNA, 22 bp, Homo sapiens
tgacttcctgcactcaggtgat

SEQ ID NO: 7296120 - DNA, 22 bp, Homo sapiens
tgactgtgcctgttgaatgaat

SEQ ID NO: 7296121 - DNA, 22 bp, Homo sapiens
tgactggagacctcagtagggt

SEQ ID NO: 7296122 - DNA, 22 bp, Homo sapiens
tgactctgataagacatatggc

SEQ ID NO: 7296123 - DNA, 22 bp, Homo sapiens
tgaaggagctgatgtaaggggt

SEQ ID NO: 7296124 - DNA, 22 bp, Homo sapiens
tgaagcccttcatgcacagtca

SEQ ID NO: 7296125 - DNA, 22 bp, Homo sapiens
tgaaggctgtcacctgcacctt

SEQ ID NO: 7296126 - DNA, 22 bp, Homo sapiens
tgaaggcttttagctctgaaaa

SEQ ID NO: 7296127 - DNA, 22 bp, Homo sapiens
tgaagggcaaccccaggcccag

SEQ ID NO: 7296128 - DNA, 21 bp, Homo sapiens
tgaagggcagcctcaggctcc

SEQ ID NO: 7296129 - DNA, 22 bp, Homo sapiens
tgaaggtgacctgacagtggct

SEQ ID NO: 7296130 - DNA, 22 bp, Homo sapiens
tgaaggtgggaattcaccaggt

SEQ ID NO: 7296131 - DNA, 22 bp, Homo sapiens
tctttgttattgtgaatagggt

SEQ ID NO: 7296132 - DNA, 22 bp, Homo sapiens
tcttttagagcatttctgattc

SEQ ID NO: 7296133 - DNA, 22 bp, Homo sapiens
tctttggaaggagcagtttttg

SEQ ID NO: 7296134 - DNA, 22 bp, Homo sapiens
tctttgattttgttactaagac

SEQ ID NO: 7296135 - DNA, 22 bp, Homo sapiens
tgaaaagactgcaagagagcat

SEQ ID NO: 7296136 - DNA, 22 bp, Homo sapiens
tgaaagaagggtggaaaatgta

SEQ ID NO: 7296137 - DNA, 21 bp, Homo sapiens
tgaaagaaggtgcagtctgaa

SEQ ID NO: 7296138 - DNA, 22 bp, Homo sapiens
tgaaagaagccttcgaggctcg

SEQ ID NO: 7296139 - DNA, 22 bp, Homo sapiens
tgaaagaagcctccctttggag

SEQ ID NO: 7296140 - DNA, 22 bp, Homo sapiens
tgaaagaactagcatcttcaag

SEQ ID NO: 7296141 - DNA, 17 bp, Homo sapiens
tgaaagaatcagggaga

SEQ ID NO: 7296142 - DNA, 22 bp, Homo sapiens
tgaaagaagtgtcacattgcca

SEQ ID NO: 7296143 - DNA, 22 bp, Homo sapiens
tgaaagaaacaggtatattggg

SEQ ID NO: 7296144 - DNA, 22 bp, Homo sapiens
tgaaattagtgaagttacagtt

SEQ ID NO: 7296145 - DNA, 22 bp, Homo sapiens
tgaaattagaaatatgtatggg

SEQ ID NO: 7296146 - DNA, 22 bp, Homo sapiens
tgaaattatgcattgttgtacc

SEQ ID NO: 7296147 - DNA, 22 bp, Homo sapiens
tgaaattattcttaccaaggtg

SEQ ID NO: 7296148 - DNA, 22 bp, Homo sapiens
tgaactttgtagtaatggagat

SEQ ID NO: 7296149 - DNA, 22 bp, Homo sapiens
tgaacatgctgttgatggcctg

SEQ ID NO: 7296150 - DNA, 22 bp, Homo sapiens
tgaagcaaatttttctcagagt

SEQ ID NO: 7296151 - DNA, 22 bp, Homo sapiens
tgaaatcaattgcaatgtttat

SEQ ID NO: 7296152 - DNA, 22 bp, Homo sapiens
tgaaatcagtatgtctttctca

SEQ ID NO: 7296153 - DNA, 22 bp, Homo sapiens
tgaaatcatgtagttattgcaa

SEQ ID NO: 7296154 - DNA, 22 bp, Homo sapiens
tgaaatcatgtagttattgcaa

SEQ ID NO: 7296155 - DNA, 22 bp, Homo sapiens
tgaaatcatgagatagtgtcac

SEQ ID NO: 7296156 - DNA, 22 bp, Homo sapiens
tgaaatcattgccaagtattga

SEQ ID NO: 7296157 - DNA, 22 bp, Homo sapiens
tgaaatgcctatgaagtcagga

SEQ ID NO: 7296158 - DNA, 22 bp, Homo sapiens
tgaaatgcttctctgaaaatac

SEQ ID NO: 7296159 - DNA, 19 bp, Homo sapiens
tgcccaggcctcccaaaag

SEQ ID NO: 7296160 - DNA, 22 bp, Homo sapiens
tgcagggatgctagaggtaaga

SEQ ID NO: 7296161 - DNA, 22 bp, Homo sapiens
tgcagggattagaggccgggga

SEQ ID NO: 7296162 - DNA, 21 bp, Homo sapiens
tgcagggatctttctgcctga

SEQ ID NO: 7296163 - DNA, 22 bp, Homo sapiens
tgcagggattatgtaggggttg

SEQ ID NO: 7296164 - DNA, 22 bp, Homo sapiens
tgcagggattgttggcatccat

SEQ ID NO: 7296165 - DNA, 22 bp, Homo sapiens
tgcagggaaaacccaggatgct

SEQ ID NO: 7296166 - DNA, 22 bp, Homo sapiens
tgcagggaagcaagggtggctc

SEQ ID NO: 7296167 - DNA, 22 bp, Homo sapiens
tgcagggaatccagtctagggt

SEQ ID NO: 7296168 - DNA, 22 bp, Homo sapiens
tgcagggaagtcccagctcctg

SEQ ID NO: 7296169 - DNA, 22 bp, Homo sapiens
tgcagggaacttggacagctag

SEQ ID NO: 7296170 - DNA, 22 bp, Homo sapiens
tgcagggaaagggcactgggct

SEQ ID NO: 7296171 - DNA, 20 bp, Homo sapiens
tgcaggtgtgtccaagcact

SEQ ID NO: 7296172 - DNA, 22 bp, Homo sapiens
tgcatggagctgtctgcatggt

SEQ ID NO: 7296173 - DNA, 22 bp, Homo sapiens
tgcatggaacggtctcctggtc

SEQ ID NO: 7296174 - DNA, 22 bp, Homo sapiens
tgcataaaaaccacatacaagg

SEQ ID NO: 7296175 - DNA, 22 bp, Homo sapiens
tgcataaagtgccatagtatta

SEQ ID NO: 7296176 - DNA, 21 bp, Homo sapiens
tgcataaagaaatacaaatac

SEQ ID NO: 7296177 - DNA, 23 bp, Homo sapiens
tgcatcctcatttttcacacgag

SEQ ID NO: 7296178 - DNA, 22 bp, Homo sapiens
tgcacagttcgccttctccaag

SEQ ID NO: 7296179 - DNA, 22 bp, Homo sapiens
tgcacattagtgtttgagatgc

SEQ ID NO: 7296180 - DNA, 22 bp, Homo sapiens
tgcacattcacttaggtattgt

SEQ ID NO: 7296181 - DNA, 22 bp, Homo sapiens
tgcacatttgttattttgaggt

SEQ ID NO: 7296182 - DNA, 22 bp, Homo sapiens
tgcacattgaatgagcaaactg

SEQ ID NO: 7296183 - DNA, 22 bp, Homo sapiens
tgcacattgaaatgaccagctg

SEQ ID NO: 7296184 - DNA, 22 bp, Homo sapiens
tgcagagaaaccagtggaggac

SEQ ID NO: 7296185 - DNA, 22 bp, Homo sapiens
tgcagccttggcaaccagggac

SEQ ID NO: 7296186 - DNA, 22 bp, Homo sapiens
tgcagcctagacattctggtca

SEQ ID NO: 7296187 - DNA, 22 bp, Homo sapiens
tgcagcctctctgcttcaggaa

SEQ ID NO: 7296188 - DNA, 21 bp, Homo sapiens
tgcagcctctgcccagcagtg

SEQ ID NO: 7296189 - DNA, 22 bp, Homo sapiens
tgcagcctggcttcgcgcctcc

SEQ ID NO: 7296190 - DNA, 22 bp, Homo sapiens
tgcagcctggtggtcactggag

SEQ ID NO: 7296191 - DNA, 18 bp, Homo sapiens
tgcagcctgtagtcttgt

SEQ ID NO: 7296192 - DNA, 20 bp, Homo sapiens
tgcagctggtttcacaggga

SEQ ID NO: 7296193 - DNA, 22 bp, Homo sapiens
tgcaggagaaagtacggagcgt

SEQ ID NO: 7296194 - DNA, 22 bp, Homo sapiens
tgcaggagataatggtgcttag

SEQ ID NO: 7296195 - DNA, 22 bp, Homo sapiens
tgcaggagcagagatggctgga

SEQ ID NO: 7296196 - DNA, 18 bp, Homo sapiens
tgcaggagtgaccccggc

SEQ ID NO: 7296197 - DNA, 22 bp, Homo sapiens
tgcaggagtccaatcaggagac

SEQ ID NO: 7296198 - DNA, 22 bp, Homo sapiens
tgcaggaggattttgtggagct

SEQ ID NO: 7296199 - DNA, 22 bp, Homo sapiens
tgcaggagctgtgcggtgaggg

SEQ ID NO: 7296200 - DNA, 22 bp, Homo sapiens
tgatttcctaggtctggagaag

SEQ ID NO: 7296201 - DNA, 22 bp, Homo sapiens
tgattttattggtgaggaaatt

SEQ ID NO: 7296202 - DNA, 22 bp, Homo sapiens
tgatttccaataaggagaatgt

SEQ ID NO: 7296203 - DNA, 22 bp, Homo sapiens
tgatttccagttgctgggtgct

SEQ ID NO: 7296204 - DNA, 22 bp, Homo sapiens
tgatttccatgaagctgaaggc

SEQ ID NO: 7296205 - DNA, 22 bp, Homo sapiens
tgcacaaacacagagaatagat

SEQ ID NO: 7296206 - DNA, 22 bp, Homo sapiens
tgcacaaacttgtgtcccaggg

SEQ ID NO: 7296207 - DNA, 21 bp, Homo sapiens
tgcacaaactttctgtggctt

SEQ ID NO: 7296208 - DNA, 22 bp, Homo sapiens
tgcacaaagcattctagacgca

SEQ ID NO: 7296209 - DNA, 22 bp, Homo sapiens
tgcacaaaggctccctgctgag

SEQ ID NO: 7296210 - DNA, 22 bp, Homo sapiens
tgcacaaatttgtgtatgctca

SEQ ID NO: 7296211 - DNA, 21 bp, Homo sapiens
tgcaagaatcaggaagctgcc

SEQ ID NO: 7296212 - DNA, 22 bp, Homo sapiens
tgcaactggaagggttatgtgg

SEQ ID NO: 7296213 - DNA, 22 bp, Homo sapiens
tgatgcatcattttcataaatt

SEQ ID NO: 7296214 - DNA, 22 bp, Homo sapiens
tgatgatttgaaaccagtttct

SEQ ID NO: 7296215 - DNA, 22 bp, Homo sapiens
tgatggaaatattgacaccaca

SEQ ID NO: 7296216 - DNA, 22 bp, Homo sapiens
tgatgtgtgattcattctcaaa

SEQ ID NO: 7296217 - DNA, 22 bp, Homo sapiens
tgattctttctccaccaattca

SEQ ID NO: 7296218 - DNA, 22 bp, Homo sapiens
tgatatgtgaagctattagttc

SEQ ID NO: 7296219 - DNA, 22 bp, Homo sapiens
tgatatttgctgactgcattgt

SEQ ID NO: 7296220 - DNA, 22 bp, Homo sapiens
tgatatcagctggcagcagtgg

SEQ ID NO: 7296221 - DNA, 23 bp, Homo sapiens
tgagtgtgttccctgtgagattt

SEQ ID NO: 7296222 - DNA, 22 bp, Homo sapiens
tgagtgtgtattatgtatcagg

SEQ ID NO: 7296223 - DNA, 22 bp, Homo sapiens
tgagtgtggggaatgtcatgag

SEQ ID NO: 7296224 - DNA, 22 bp, Homo sapiens
tgagtgtgctaggtgtctcggt

SEQ ID NO: 7296225 - DNA, 22 bp, Homo sapiens
tcctggagtggagtctgttgtt

SEQ ID NO: 7296226 - DNA, 22 bp, Homo sapiens
tcctggagtatttctgtggtgt

SEQ ID NO: 7296227 - DNA, 22 bp, Homo sapiens
tcctggaggggacagcatgggc

SEQ ID NO: 7296228 - DNA, 22 bp, Homo sapiens
tcctggaggcactcgctggggc

SEQ ID NO: 7296229 - DNA, 22 bp, Homo sapiens
tcctgtctaaagacctgcaggc

SEQ ID NO: 7296230 - DNA, 22 bp, Homo sapiens
tcctgtgcctccacctgctccg

SEQ ID NO: 7296231 - DNA, 17 bp, Homo sapiens
tcctgtgggtgcagcag

SEQ ID NO: 7296232 - DNA, 22 bp, Homo sapiens
tcctttgttcgggtgtgctgtc

SEQ ID NO: 7296233 - DNA, 22 bp, Homo sapiens
tctaaagatttggattcatttg

SEQ ID NO: 7296234 - DNA, 22 bp, Homo sapiens
tcgtgaggctctgcatcgcaca

SEQ ID NO: 7296235 - DNA, 22 bp, Homo sapiens
tcgcagaggcacgagtgcagaa

SEQ ID NO: 7296236 - DNA, 22 bp, Homo sapiens
tcgcccaggctggaagtgcagt

SEQ ID NO: 7296237 - DNA, 19 bp, Homo sapiens
tccttctccggccaccccg

SEQ ID NO: 7296238 - DNA, 22 bp, Homo sapiens
tccttggatctttcctatgatt

SEQ ID NO: 7296239 - DNA, 22 bp, Homo sapiens
tccttacatagtgctgaaatat

SEQ ID NO: 7296240 - DNA, 22 bp, Homo sapiens
tctataaagggccagatagtag

SEQ ID NO: 7296241 - DNA, 22 bp, Homo sapiens
tctattatggtacttatcatga

SEQ ID NO: 7296242 - DNA, 21 bp, Homo sapiens
tctatgtacgcatctatgcct

SEQ ID NO: 7296243 - DNA, 22 bp, Homo sapiens
tctatgtatatctttccattca

SEQ ID NO: 7296244 - DNA, 22 bp, Homo sapiens
tctatattttgaaaggtattta

SEQ ID NO: 7296245 - DNA, 22 bp, Homo sapiens
tctattttgtttccagctctac

SEQ ID NO: 7296246 - DNA, 22 bp, Homo sapiens
tctattttatactcaaatcttc

SEQ ID NO: 7296247 - DNA, 19 bp, Homo sapiens
tctcacagctctactatgt

SEQ ID NO: 7296248 - DNA, 19 bp, Homo sapiens
tctaacagctttcattcta

SEQ ID NO: 7296249 - DNA, 22 bp, Homo sapiens
tctacaaactaaggagggtaat

SEQ ID NO: 7296250 - DNA, 22 bp, Homo sapiens
tctacaaaggttgaggtgccct

SEQ ID NO: 7296251 - DNA, 22 bp, Homo sapiens
tctcagcacgttgttttcattg

SEQ ID NO: 7296252 - DNA, 22 bp, Homo sapiens
tctcagcagccagatccagagc

SEQ ID NO: 7296253 - DNA, 22 bp, Homo sapiens
tctcagcagggccatcctgagc

SEQ ID NO: 7296254 - DNA, 22 bp, Homo sapiens
tctcatgctgtagtgcactaac

SEQ ID NO: 7296255 - DNA, 22 bp, Homo sapiens
tctcatgccctgtttttggttg

SEQ ID NO: 7296256 - DNA, 22 bp, Homo sapiens
tctcatggcttgtaggaggtga

SEQ ID NO: 7296257 - DNA, 22 bp, Homo sapiens
tctcatgatgcctatgcagggt

SEQ ID NO: 7296258 - DNA, 22 bp, Homo sapiens
tctcatcattccttcaaagccc

SEQ ID NO: 7296259 - DNA, 22 bp, Homo sapiens
tctcatttgtgtgcaattcaga

SEQ ID NO: 7296260 - DNA, 23 bp, Homo sapiens
tctcatttcccttgatctatctt

SEQ ID NO: 7296261 - DNA, 22 bp, Homo sapiens
tctcatttgcctcatctataaa

SEQ ID NO: 7296262 - DNA, 22 bp, Homo sapiens
tctcatttgcctcatctataaa

SEQ ID NO: 7296263 - DNA, 22 bp, Homo sapiens
tctcatttggctttgttttaaa

SEQ ID NO: 7296264 - DNA, 22 bp, Homo sapiens
tctcattcatccaaggatttat

SEQ ID NO: 7296265 - DNA, 22 bp, Homo sapiens
tctcattcataccctacatgct

SEQ ID NO: 7296266 - DNA, 22 bp, Homo sapiens
tctcatggttctaaaggtcgca

SEQ ID NO: 7296267 - DNA, 22 bp, Homo sapiens
tctccttgacaggcaggcagac

SEQ ID NO: 7296268 - DNA, 22 bp, Homo sapiens
tctccttgtgctgggtccttcc

SEQ ID NO: 7296269 - DNA, 22 bp, Homo sapiens
tctccttgtaagtaaattttac

SEQ ID NO: 7296270 - DNA, 22 bp, Homo sapiens
tctccttgctacccagtatgtc

SEQ ID NO: 7296271 - DNA, 22 bp, Homo sapiens
tctcctcccaggctcttccagg

SEQ ID NO: 7296272 - DNA, 22 bp, Homo sapiens
tctcctgccactgcttcccatt

SEQ ID NO: 7296273 - DNA, 22 bp, Homo sapiens
tctcccagtgtctggcagtcag

SEQ ID NO: 7296274 - DNA, 22 bp, Homo sapiens
tctccccagctgagctgccctt

SEQ ID NO: 7296275 - DNA, 22 bp, Homo sapiens
tctcccaggcaggagtgcagtg

SEQ ID NO: 7296276 - DNA, 22 bp, Homo sapiens
tctcccaggcaggagtgcagtg

SEQ ID NO: 7296277 - DNA, 20 bp, Homo sapiens
tctcccaggctcagggaaga

SEQ ID NO: 7296278 - DNA, 22 bp, Homo sapiens
tctcccaggctggagtgcagtg

SEQ ID NO: 7296279 - DNA, 22 bp, Homo sapiens
tctcccaggctggagtgcagtg

SEQ ID NO: 7296280 - DNA, 22 bp, Homo sapiens
tctccaggtaaatggcatcctg

SEQ ID NO: 7296281 - DNA, 22 bp, Homo sapiens
tctcccagaggatcccagtgga

SEQ ID NO: 7296282 - DNA, 22 bp, Homo sapiens
tctctgtgtcttagtgaaggga

SEQ ID NO: 7296283 - DNA, 21 bp, Homo sapiens
tctctgtgtctttaagctgga

SEQ ID NO: 7296284 - DNA, 21 bp, Homo sapiens
tctctgtggtccaatcccagc

SEQ ID NO: 7296285 - DNA, 22 bp, Homo sapiens
tctctgtggtatgtcatagcaa

SEQ ID NO: 7296286 - DNA, 22 bp, Homo sapiens
tctctgtggtactgagagtcta

SEQ ID NO: 7296287 - DNA, 22 bp, Homo sapiens
tctctgtgggtttcaccagcgc

SEQ ID NO: 7296288 - DNA, 22 bp, Homo sapiens
tctctgtgggctttggacttga

SEQ ID NO: 7296289 - DNA, 22 bp, Homo sapiens
tctctgtggtgggaggctgagt

SEQ ID NO: 7296290 - DNA, 22 bp, Homo sapiens
tctctgtggtttgagagccggg

SEQ ID NO: 7296291 - DNA, 21 bp, Homo sapiens
tctctgtgtacagtctcaccc

SEQ ID NO: 7296292 - DNA, 22 bp, Homo sapiens
tctctgtgtcctgaaatgaagg

SEQ ID NO: 7296293 - DNA, 19 bp, Homo sapiens
tctctgtgtctctgtttat

SEQ ID NO: 7296294 - DNA, 22 bp, Homo sapiens
tctctgtgtctcatgttcctat

SEQ ID NO: 7296295 - DNA, 22 bp, Homo sapiens
tctctgtgcccagtagttctct

SEQ ID NO: 7296296 - DNA, 22 bp, Homo sapiens
tctctgtgcaggatgctgagtt

SEQ ID NO: 7296297 - DNA, 22 bp, Homo sapiens
tctctgtgcttgactttcccat

SEQ ID NO: 7296298 - DNA, 22 bp, Homo sapiens
tctctgtggagcagtgtgttca

SEQ ID NO: 7296299 - DNA, 22 bp, Homo sapiens
tctctgtggcaacaattcacta

SEQ ID NO: 7296300 - DNA, 22 bp, Homo sapiens
tctctgtggcaactacttagct

SEQ ID NO: 7296301 - DNA, 22 bp, Homo sapiens
tctctgtggcaagcatgctgct

SEQ ID NO: 7296302 - DNA, 22 bp, Homo sapiens
tctctgtggcatccactcaact

SEQ ID NO: 7296303 - DNA, 21 bp, Homo sapiens
tctctgtggcctaccctctac

SEQ ID NO: 7296304 - DNA, 22 bp, Homo sapiens
tctctgtgaagctcccgttagg

SEQ ID NO: 7296305 - DNA, 22 bp, Homo sapiens
tctctgtgaatggcgtcacctg

SEQ ID NO: 7296306 - DNA, 22 bp, Homo sapiens
tctctgtgacagctgggtatgt

SEQ ID NO: 7296307 - DNA, 22 bp, Homo sapiens
tctctgtgactgcagctttgca

SEQ ID NO: 7296308 - DNA, 22 bp, Homo sapiens
tctctgtgacatttctgagcct

SEQ ID NO: 7296309 - DNA, 22 bp, Homo sapiens
tctctgtgagatgccttcctga

SEQ ID NO: 7296310 - DNA, 22 bp, Homo sapiens
tctctgtgagatttgtattaag

SEQ ID NO: 7296311 - DNA, 22 bp, Homo sapiens
tctctgtgagccaggtcctagt

SEQ ID NO: 7296312 - DNA, 22 bp, Homo sapiens
tctctgtgagtggaaggcaccc

SEQ ID NO: 7296313 - DNA, 22 bp, Homo sapiens
tctgaaataaatgcactgttag

SEQ ID NO: 7296314 - DNA, 22 bp, Homo sapiens
tctgaaatagaagtgtctttct

SEQ ID NO: 7296315 - DNA, 22 bp, Homo sapiens
tctgaaatgcaggcaatttgct

SEQ ID NO: 7296316 - DNA, 21 bp, Homo sapiens
tctctcctcaagctcgacccc

SEQ ID NO: 7296317 - DNA, 18 bp, Homo sapiens
tctctctgaagagttccc

SEQ ID NO: 7296318 - DNA, 22 bp, Homo sapiens
tctctgctcaggcaccagccct

SEQ ID NO: 7296319 - DNA, 22 bp, Homo sapiens
tctggagagtcctgctcacgtc

SEQ ID NO: 7296320 - DNA, 22 bp, Homo sapiens
tctggagacctagccctgttgt

SEQ ID NO: 7296321 - DNA, 22 bp, Homo sapiens
tctggacatcctggagaatgac

SEQ ID NO: 7296322 - DNA, 22 bp, Homo sapiens
tctggacaggggcgctttgggg

SEQ ID NO: 7296323 - DNA, 22 bp, Homo sapiens
tctggacagtagagcaatgatt

SEQ ID NO: 7296324 - DNA, 22 bp, Homo sapiens
tctggccaggggtccctgaagg

SEQ ID NO: 7296325 - DNA, 22 bp, Homo sapiens
tctggccacccgaggcccctgc

SEQ ID NO: 7296326 - DNA, 22 bp, Homo sapiens
tctgacagggccaaacatgaca

SEQ ID NO: 7296327 - DNA, 22 bp, Homo sapiens
tctgacagtgtgaatattgact

SEQ ID NO: 7296328 - DNA, 22 bp, Homo sapiens
tctgacaggtcattttctatag

SEQ ID NO: 7296329 - DNA, 22 bp, Homo sapiens
tctgagctgcccctttactttg

SEQ ID NO: 7296330 - DNA, 22 bp, Homo sapiens
tctgagctgtggccattcttcc

SEQ ID NO: 7296331 - DNA, 22 bp, Homo sapiens
tctgagcagctttgttttgtgt

SEQ ID NO: 7296332 - DNA, 22 bp, Homo sapiens
tctgagccataagagtacagga

SEQ ID NO: 7296333 - DNA, 22 bp, Homo sapiens
tctgagcagggcagtgtccatg

SEQ ID NO: 7296334 - DNA, 22 bp, Homo sapiens
tctgctcagccgatctgctccg

SEQ ID NO: 7296335 - DNA, 22 bp, Homo sapiens
tctgcagggtcccagcctcagc

SEQ ID NO: 7296336 - DNA, 22 bp, Homo sapiens
tctgcaggcctcgacaaggcca

SEQ ID NO: 7296337 - DNA, 22 bp, Homo sapiens
tctgcagctttcccctgattta

SEQ ID NO: 7296338 - DNA, 22 bp, Homo sapiens
tcttaaagcttacttcaattgt

SEQ ID NO: 7296339 - DNA, 22 bp, Homo sapiens
tctgtttttgaggctatcttct

SEQ ID NO: 7296340 - DNA, 22 bp, Homo sapiens
tctgtttatgcatatttaaaac

SEQ ID NO: 7296341 - DNA, 22 bp, Homo sapiens
tctgttgtctgcaattctggga

SEQ ID NO: 7296342 - DNA, 22 bp, Homo sapiens
tctgtttaatgggaatgatact

SEQ ID NO: 7296343 - DNA, 22 bp, Homo sapiens
tctgttgcaatgtgcatggtga

SEQ ID NO: 7296344 - DNA, 22 bp, Homo sapiens
tctgttgcaatgtgcatggtga

SEQ ID NO: 7296345 - DNA, 20 bp, Homo sapiens
tctgtgtgccatcacctaac

SEQ ID NO: 7296346 - DNA, 19 bp, Homo sapiens
tctgtggagctcagagtag

SEQ ID NO: 7296347 - DNA, 22 bp, Homo sapiens
tctgtgacattgaacatctaca

SEQ ID NO: 7296348 - DNA, 20 bp, Homo sapiens
tctgtgcattgcctgctggt

SEQ ID NO: 7296349 - DNA, 22 bp, Homo sapiens
tctgtgccatcagtctccagag

SEQ ID NO: 7296350 - DNA, 22 bp, Homo sapiens
tctgtccctgagagctcaggag

SEQ ID NO: 7296351 - DNA, 22 bp, Homo sapiens
tcttgacattgttgttagcagg

SEQ ID NO: 7296352 - DNA, 22 bp, Homo sapiens
tcttgacattgcaatcttcaga

SEQ ID NO: 7296353 - DNA, 22 bp, Homo sapiens
tctttaattgtggaagagcagc

SEQ ID NO: 7296354 - DNA, 22 bp, Homo sapiens
tctttcctagaggctgatgagt

SEQ ID NO: 7296355 - DNA, 22 bp, Homo sapiens
tctttgatgcttctgaaggtgt

SEQ ID NO: 7296356 - DNA, 22 bp, Homo sapiens
tctttgatacagatgtaagctg

SEQ ID NO: 7296357 - DNA, 22 bp, Homo sapiens
tctttgatgggagatctgagag

SEQ ID NO: 7296358 - DNA, 22 bp, Homo sapiens
tcttccagaagtgttttcagaa

SEQ ID NO: 7296359 - DNA, 22 bp, Homo sapiens
tcttcacaaagctgttgttaaa

SEQ ID NO: 7296360 - DNA, 22 bp, Homo sapiens
tcttcacatgaccttcatgtct

SEQ ID NO: 7296361 - DNA, 22 bp, Homo sapiens
tcttcacagctttgtccagaag

SEQ ID NO: 7296362 - DNA, 22 bp, Homo sapiens
tcttcacagatgcatatacttc

SEQ ID NO: 7296363 - DNA, 22 bp, Homo sapiens
tcttcacatcatgttttttaat

SEQ ID NO: 7296364 - DNA, 22 bp, Homo sapiens
tcttccagcttctagaggatgc

SEQ ID NO: 7296365 - DNA, 22 bp, Homo sapiens
tcttctctacaccagcagcccc

SEQ ID NO: 7296366 - DNA, 20 bp, Homo sapiens
aaaatatgtataactcttct

SEQ ID NO: 7296367 - DNA, 20 bp, Homo sapiens
aaaatatgtataactcttct

SEQ ID NO: 7296368 - DNA, 22 bp, Homo sapiens
aaaatatgtataactcttctgc

SEQ ID NO: 7296369 - DNA, 22 bp, Homo sapiens
aaaatattttagggccaggaga

SEQ ID NO: 7296370 - DNA, 22 bp, Homo sapiens
aaaatatggggtgagcccagag

SEQ ID NO: 7296371 - DNA, 20 bp, Homo sapiens
aaaatatgtataactcttct

SEQ ID NO: 7296372 - DNA, 22 bp, Homo sapiens
aaaatatgactgtgctccttaa

SEQ ID NO: 7296373 - DNA, 22 bp, Homo sapiens
aaaatatgaagttgtcagtatg

SEQ ID NO: 7296374 - DNA, 22 bp, Homo sapiens
aaaatatgaagttgtcagtatg

SEQ ID NO: 7296375 - DNA, 22 bp, Homo sapiens
aaacacaagaggcagggtacag

SEQ ID NO: 7296376 - DNA, 22 bp, Homo sapiens
aaacacattttaggaaaatcta

SEQ ID NO: 7296377 - DNA, 22 bp, Homo sapiens
aaacaccagtcccagtatacac

SEQ ID NO: 7296378 - DNA, 22 bp, Homo sapiens
aaaattgaggctcatgttaaat

SEQ ID NO: 7296379 - DNA, 22 bp, Homo sapiens
aaagagcatggaaagttcagga

SEQ ID NO: 7296380 - DNA, 22 bp, Homo sapiens
aaaatgtgatctacaaatgcaa

SEQ ID NO: 7296381 - DNA, 22 bp, Homo sapiens
aaaattctgtcattaaattgtg

SEQ ID NO: 7296382 - DNA, 17 bp, Homo sapiens
aaaattctgtaaagagg

SEQ ID NO: 7296383 - DNA, 17 bp, Homo sapiens
aaaattctgtaaagagg

SEQ ID NO: 7296384 - DNA, 22 bp, Homo sapiens
aaaactgaaatacgatccaatg

SEQ ID NO: 7296385 - DNA, 22 bp, Homo sapiens
aaaactgaaccttgagatcttt

SEQ ID NO: 7296386 - DNA, 22 bp, Homo sapiens
aaaactgaaatacgatccaatg

SEQ ID NO: 7296387 - DNA, 22 bp, Homo sapiens
aaaacataaactgacagcccat

SEQ ID NO: 7296388 - DNA, 22 bp, Homo sapiens
aaaaggatgttttcatgaaaca

SEQ ID NO: 7296389 - DNA, 22 bp, Homo sapiens
aaaaagtttcaactgccaactc

SEQ ID NO: 7296390 - DNA, 21 bp, Homo sapiens
aaaaggaggcaggtgaacagc

SEQ ID NO: 7296391 - DNA, 22 bp, Homo sapiens
aaaaagtattggccatggttga

SEQ ID NO: 7296392 - DNA, 22 bp, Homo sapiens
aaaaagtattggccatggttga

SEQ ID NO: 7296393 - DNA, 22 bp, Homo sapiens
aaaactgaggtttcctgaagaa

SEQ ID NO: 7296394 - DNA, 22 bp, Homo sapiens
aaaactgaggtttcctgaagaa

SEQ ID NO: 7296395 - DNA, 22 bp, Homo sapiens
aaaactttcagggatacagaaa

SEQ ID NO: 7296396 - DNA, 22 bp, Homo sapiens
aaaatgttcaagcatgctggtt

SEQ ID NO: 7296397 - DNA, 18 bp, Homo sapiens
aaaatgttcccccattaa

SEQ ID NO: 7296398 - DNA, 21 bp, Homo sapiens
aaaatgtttccttgttggtta

SEQ ID NO: 7296399 - DNA, 22 bp, Homo sapiens
aaaattaagtgtctgggaagcc

SEQ ID NO: 7296400 - DNA, 22 bp, Homo sapiens
aaaagaacctagctcctcagtc

SEQ ID NO: 7296401 - DNA, 22 bp, Homo sapiens
aaaattaagtgtctgggaagcc

SEQ ID NO: 7296402 - DNA, 22 bp, Homo sapiens
aaaattatggagtatcccaaag

SEQ ID NO: 7296403 - DNA, 22 bp, Homo sapiens
aaaagtaattgatgcaatcgta

SEQ ID NO: 7296404 - DNA, 22 bp, Homo sapiens
aaaagtaattgcaattttgtag

SEQ ID NO: 7296405 - DNA, 19 bp, Homo sapiens
aaaaggagagatcagagtt

SEQ ID NO: 7296406 - DNA, 22 bp, Homo sapiens
aaacagctgcagtacacggcct

SEQ ID NO: 7296407 - DNA, 22 bp, Homo sapiens
aaacagctgggaggtagaggcg

SEQ ID NO: 7296408 - DNA, 22 bp, Homo sapiens
aaacatgatgtcatatatgcca

SEQ ID NO: 7296409 - DNA, 22 bp, Homo sapiens
aaacagcaggaacatcttgcca

SEQ ID NO: 7296410 - DNA, 22 bp, Homo sapiens
aaacactgatggatatttttcc

SEQ ID NO: 7296411 - DNA, 22 bp, Homo sapiens
aaacactgaaaattttggtcat

SEQ ID NO: 7296412 - DNA, 22 bp, Homo sapiens
aaacactgtgggacatcttact

SEQ ID NO: 7296413 - DNA, 22 bp, Homo sapiens
aaacactgtgggacatcttact

SEQ ID NO: 7296414 - DNA, 22 bp, Homo sapiens
aaacagataagggacaatttca

SEQ ID NO: 7296415 - DNA, 22 bp, Homo sapiens
aaacagagtttggtaaatagcc

SEQ ID NO: 7296416 - DNA, 23 bp, Homo sapiens
aaacatgcagcacatgaatgcta

SEQ ID NO: 7296417 - DNA, 22 bp, Homo sapiens
aaacatgctggatttagaatat

SEQ ID NO: 7296418 - DNA, 22 bp, Homo sapiens
aaacattagacaccatatgctc

SEQ ID NO: 7296419 - DNA, 22 bp, Homo sapiens
aaactgtcattggatgcatttg

SEQ ID NO: 7296420 - DNA, 22 bp, Homo sapiens
aaactgtaagagaataaactac

SEQ ID NO: 7296421 - DNA, 22 bp, Homo sapiens
aaactgcaattatttttgcaat

SEQ ID NO: 7296422 - DNA, 22 bp, Homo sapiens
aaactgcaattacttttgcacc

SEQ ID NO: 7296423 - DNA, 22 bp, Homo sapiens
aaactgcaattacttttgcagc

SEQ ID NO: 7296424 - DNA, 22 bp, Homo sapiens
aaactgtaaatactagtaagtg

SEQ ID NO: 7296425 - DNA, 22 bp, Homo sapiens
aaacattctcagccctgcttgc

SEQ ID NO: 7296426 - DNA, 22 bp, Homo sapiens
aaagaaacctatcagccacatg

SEQ ID NO: 7296427 - DNA, 22 bp, Homo sapiens
aaagaaatacctttctcagctt

SEQ ID NO: 7296428 - DNA, 22 bp, Homo sapiens
aaactttttattctaatgtcta

SEQ ID NO: 7296429 - DNA, 22 bp, Homo sapiens
aaagaaatagatggcatttaaa

SEQ ID NO: 7296430 - DNA, 22 bp, Homo sapiens
aaagaaatagatggcatttaaa

SEQ ID NO: 7296431 - DNA, 22 bp, Homo sapiens
aaagaacaaatgatatatggtt

SEQ ID NO: 7296432 - DNA, 22 bp, Homo sapiens
aaatagtttagctctcatttca

SEQ ID NO: 7296433 - DNA, 22 bp, Homo sapiens
aaacttttcctgctcttgtcct

SEQ ID NO: 7296434 - DNA, 22 bp, Homo sapiens
aaatagttacttctgctgtctt

SEQ ID NO: 7296435 - DNA, 22 bp, Homo sapiens
aaagaacagatgtgtggtgcat

SEQ ID NO: 7296436 - DNA, 21 bp, Homo sapiens
aaagaacaggcagatgttctt

SEQ ID NO: 7296437 - DNA, 22 bp, Homo sapiens
aaagaacaatgtggaatctcct

SEQ ID NO: 7296438 - DNA, 22 bp, Homo sapiens
aaagactagcatttatatgtac

SEQ ID NO: 7296439 - DNA, 22 bp, Homo sapiens
aaagactaagaagagtattatt

SEQ ID NO: 7296440 - DNA, 22 bp, Homo sapiens
aaagacatgacacattggagag

SEQ ID NO: 7296441 - DNA, 22 bp, Homo sapiens
aaagacttggcttatgatttgc

SEQ ID NO: 7296442 - DNA, 22 bp, Homo sapiens
aaagacttgggtgaagtaattt

SEQ ID NO: 7296443 - DNA, 22 bp, Homo sapiens
aaagactttcacctagcaaaga

SEQ ID NO: 7296444 - DNA, 22 bp, Homo sapiens
aaagactggtgtgttacatata

SEQ ID NO: 7296445 - DNA, 22 bp, Homo sapiens
aaagatcagtctgaagcaacat

SEQ ID NO: 7296446 - DNA, 22 bp, Homo sapiens
aaagagatgtgccaaatagcct

SEQ ID NO: 7296447 - DNA, 22 bp, Homo sapiens
aaagagcaagctgagatttgaa

SEQ ID NO: 7296448 - DNA, 22 bp, Homo sapiens
aaagagcaagctgagatttgaa

SEQ ID NO: 7296449 - DNA, 22 bp, Homo sapiens
aaagagactggtggcattttgc

SEQ ID NO: 7296450 - DNA, 22 bp, Homo sapiens
aaagagaacttttacccaagaa

SEQ ID NO: 7296451 - DNA, 21 bp, Homo sapiens
aaagagacaaatggcatatac

SEQ ID NO: 7296452 - DNA, 22 bp, Homo sapiens
aaagagaaacttagaagcctga

SEQ ID NO: 7296453 - DNA, 22 bp, Homo sapiens
aaagagaaaatgatctgtacat

SEQ ID NO: 7296454 - DNA, 22 bp, Homo sapiens
aaagagaaaatgatctgtacat

SEQ ID NO: 7296455 - DNA, 22 bp, Homo sapiens
aacccagagctggaggagagta

SEQ ID NO: 7296456 - DNA, 22 bp, Homo sapiens
aacccagaaacgcaggcggtca

SEQ ID NO: 7296457 - DNA, 15 bp, Homo sapiens
aacccagagccttcc

SEQ ID NO: 7296458 - DNA, 22 bp, Homo sapiens
aacccaggaggcagaggctgca

SEQ ID NO: 7296459 - DNA, 22 bp, Homo sapiens
aacccaggagttggaggctgtg

SEQ ID NO: 7296460 - DNA, 22 bp, Homo sapiens
aaaggcagtgtgatactgtggt

SEQ ID NO: 7296461 - DNA, 22 bp, Homo sapiens
aacccgagggccccaggctcgg

SEQ ID NO: 7296462 - DNA, 22 bp, Homo sapiens
aactgtggcatgttgaatttgt

SEQ ID NO: 7296463 - DNA, 22 bp, Homo sapiens
aagaacagttgggaggtgagcc

SEQ ID NO: 7296464 - DNA, 22 bp, Homo sapiens
aagaacatgaacctcttctaac

SEQ ID NO: 7296465 - DNA, 22 bp, Homo sapiens
aagaacatgaacctcttctaac

SEQ ID NO: 7296466 - DNA, 22 bp, Homo sapiens
aagaacatgaacacaatgttta

SEQ ID NO: 7296467 - DNA, 22 bp, Homo sapiens
aaaggttttgttcatcgatttt

SEQ ID NO: 7296468 - DNA, 22 bp, Homo sapiens
aacatagctttactcaaatgac

SEQ ID NO: 7296469 - DNA, 22 bp, Homo sapiens
aacatataaactcttaagttca

SEQ ID NO: 7296470 - DNA, 22 bp, Homo sapiens
aacatagaataaatgagttagg

SEQ ID NO: 7296471 - DNA, 22 bp, Homo sapiens
aacatagaattgttatattttc

SEQ ID NO: 7296472 - DNA, 22 bp, Homo sapiens
aacatagaattgttatattttc

SEQ ID NO: 7296473 - DNA, 22 bp, Homo sapiens
aacatacatatttcagtgtcca

SEQ ID NO: 7296474 - DNA, 22 bp, Homo sapiens
aacatacagtgagcagtggact

SEQ ID NO: 7296475 - DNA, 22 bp, Homo sapiens
aacactttcctgcctttctgat

SEQ ID NO: 7296476 - DNA, 22 bp, Homo sapiens
aaagatttgagttctgcttata

SEQ ID NO: 7296477 - DNA, 22 bp, Homo sapiens
aaagatttgaaattaggcatca

SEQ ID NO: 7296478 - DNA, 22 bp, Homo sapiens
aaagcaaacagaaccccaagct

SEQ ID NO: 7296479 - DNA, 22 bp, Homo sapiens
aaagatttaagaataatttgtg

SEQ ID NO: 7296480 - DNA, 22 bp, Homo sapiens
aaagatttatgaagttcaatta

SEQ ID NO: 7296481 - DNA, 22 bp, Homo sapiens
aaagatttatgaagttcaatta

SEQ ID NO: 7296482 - DNA, 22 bp, Homo sapiens
aaagattatggaacacacatga

SEQ ID NO: 7296483 - DNA, 23 bp, Homo sapiens
aaagcaaggaattggcaacagag

SEQ ID NO: 7296484 - DNA, 22 bp, Homo sapiens
aacactgtggtcttttcagtaa

SEQ ID NO: 7296485 - DNA, 22 bp, Homo sapiens
aacactgtgaggtaatgaccta

SEQ ID NO: 7296486 - DNA, 23 bp, Homo sapiens
aaagtgacttttataccactaac

SEQ ID NO: 7296487 - DNA, 22 bp, Homo sapiens
aaagtgacaaccatttattaag

SEQ ID NO: 7296488 - DNA, 22 bp, Homo sapiens
aaagtgcagaactgttctcact

SEQ ID NO: 7296489 - DNA, 22 bp, Homo sapiens
aagactgtatgagacaatataa

SEQ ID NO: 7296490 - DNA, 22 bp, Homo sapiens
aagactgtatattgagaaaaga

SEQ ID NO: 7296491 - DNA, 22 bp, Homo sapiens
aagactgtatgagacaatataa

SEQ ID NO: 7296492 - DNA, 22 bp, Homo sapiens
aaagtttacagtgcacatgggt

SEQ ID NO: 7296493 - DNA, 22 bp, Homo sapiens
aagactcaaggaacaacacagt

SEQ ID NO: 7296494 - DNA, 22 bp, Homo sapiens
aagactagaccagtgaatagga

SEQ ID NO: 7296495 - DNA, 22 bp, Homo sapiens
aagacctattttaggatatgaa

SEQ ID NO: 7296496 - DNA, 22 bp, Homo sapiens
aaagtttggattagcagttaga

SEQ ID NO: 7296497 - DNA, 22 bp, Homo sapiens
aaagtttgaatgatatattagt

SEQ ID NO: 7296498 - DNA, 22 bp, Homo sapiens
aagagggctgcaatcttattgc

SEQ ID NO: 7296499 - DNA, 22 bp, Homo sapiens
aagaggaggattgatgtgggag

SEQ ID NO: 7296500 - DNA, 21 bp, Homo sapiens
aaatactgggcagtgacttga

SEQ ID NO: 7296501 - DNA, 22 bp, Homo sapiens
aaatactgggctcaaaagggtt

SEQ ID NO: 7296502 - DNA, 21 bp, Homo sapiens
aaatactgggcagtgacttga

SEQ ID NO: 7296503 - DNA, 22 bp, Homo sapiens
aaatactggttttggagatgct

SEQ ID NO: 7296504 - DNA, 22 bp, Homo sapiens
aagataaactcttgatttctga

SEQ ID NO: 7296505 - DNA, 22 bp, Homo sapiens
aaatactgggctcaaaagggtt

SEQ ID NO: 7296506 - DNA, 22 bp, Homo sapiens
aagataaactcttgatttctga

SEQ ID NO: 7296507 - DNA, 22 bp, Homo sapiens
aaatactggcaagtgctaattc

SEQ ID NO: 7296508 - DNA, 22 bp, Homo sapiens
aaatactggcaagtgctaattc

SEQ ID NO: 7296509 - DNA, 22 bp, Homo sapiens
aaatactgctgctattcctttt

SEQ ID NO: 7296510 - DNA, 22 bp, Homo sapiens
aaatactgctgctattcctttt

SEQ ID NO: 7296511 - DNA, 19 bp, Homo sapiens
aaatactgaagttgttcat

SEQ ID NO: 7296512 - DNA, 19 bp, Homo sapiens
aaatactgaagttgttcat

SEQ ID NO: 7296513 - DNA, 22 bp, Homo sapiens
aaatactgctgctattcctttt

SEQ ID NO: 7296514 - DNA, 22 bp, Homo sapiens
aaatactagaattcagagttga

SEQ ID NO: 7296515 - DNA, 22 bp, Homo sapiens
aaatgcatggctgttttaaagc

SEQ ID NO: 7296516 - DNA, 22 bp, Homo sapiens
aaatgcatggtaaatgattgcc

SEQ ID NO: 7296517 - DNA, 22 bp, Homo sapiens
aaatgcatggtaaatgattgcc

SEQ ID NO: 7296518 - DNA, 22 bp, Homo sapiens
aagcctccttattaaaggatat

SEQ ID NO: 7296519 - DNA, 22 bp, Homo sapiens
aagcctcaccttttagaagcta

SEQ ID NO: 7296520 - DNA, 22 bp, Homo sapiens
aagccttatggggacagttttg

SEQ ID NO: 7296521 - DNA, 21 bp, Homo sapiens
aagcctcaagcagaagacaga

SEQ ID NO: 7296522 - DNA, 22 bp, Homo sapiens
aaatctcaatttgaattgtagc

SEQ ID NO: 7296523 - DNA, 22 bp, Homo sapiens
aaatctgttgtaatgtttttta

SEQ ID NO: 7296524 - DNA, 22 bp, Homo sapiens
aaatctctgcaggcaaatgtga

SEQ ID NO: 7296525 - DNA, 22 bp, Homo sapiens
aagatcaagtgtactttatgta

SEQ ID NO: 7296526 - DNA, 22 bp, Homo sapiens
aagatattcaaagatttattag

SEQ ID NO: 7296527 - DNA, 22 bp, Homo sapiens
aagatcaagatcagagaacagc

SEQ ID NO: 7296528 - DNA, 22 bp, Homo sapiens
aagatattttagaacattcact

SEQ ID NO: 7296529 - DNA, 22 bp, Homo sapiens
aagatgttgcattagaatacct

SEQ ID NO: 7296530 - DNA, 22 bp, Homo sapiens
aagattactacggaacatgacc

SEQ ID NO: 7296531 - DNA, 22 bp, Homo sapiens
aagatgtttaggtaaaaagttt

SEQ ID NO: 7296532 - DNA, 22 bp, Homo sapiens
aagatgtttagatttatacaat

SEQ ID NO: 7296533 - DNA, 18 bp, Homo sapiens
aagatgtttaatgggaag

SEQ ID NO: 7296534 - DNA, 22 bp, Homo sapiens
aagcaggagatgcaggaatgta

SEQ ID NO: 7296535 - DNA, 22 bp, Homo sapiens
aagatgcagcaaactacttttt

SEQ ID NO: 7296536 - DNA, 22 bp, Homo sapiens
aagatggcaggaatcataagct

SEQ ID NO: 7296537 - DNA, 22 bp, Homo sapiens
aagatggagcacgagcagaagc

SEQ ID NO: 7296538 - DNA, 22 bp, Homo sapiens
aagatgtatcagttaagtcttc

SEQ ID NO: 7296539 - DNA, 22 bp, Homo sapiens
aagcaagagttggagtgatgtt

SEQ ID NO: 7296540 - DNA, 22 bp, Homo sapiens
aagcaaggcccagagcatcagc

SEQ ID NO: 7296541 - DNA, 22 bp, Homo sapiens
aagcaaggccggaaggaaactc

SEQ ID NO: 7296542 - DNA, 22 bp, Homo sapiens
aagcaagttctcatcatttata

SEQ ID NO: 7296543 - DNA, 22 bp, Homo sapiens
aagcaatagcaacaactttaca

SEQ ID NO: 7296544 - DNA, 22 bp, Homo sapiens
aagcaagagttggagtgatgtt

SEQ ID NO: 7296545 - DNA, 22 bp, Homo sapiens
aagatgttaaatctgtagaatt

SEQ ID NO: 7296546 - DNA, 22 bp, Homo sapiens
aagatgttagattatggggaca

SEQ ID NO: 7296547 - DNA, 22 bp, Homo sapiens
aagatgttagaggtcatgcaga

SEQ ID NO: 7296548 - DNA, 22 bp, Homo sapiens
acacatttacatgtttacgtat

SEQ ID NO: 7296549 - DNA, 22 bp, Homo sapiens
acacatttacatgtttacgtat

SEQ ID NO: 7296550 - DNA, 22 bp, Homo sapiens
acacatttagcaccaggtttat

SEQ ID NO: 7296551 - DNA, 22 bp, Homo sapiens
acacattatgagcagttgtctt

SEQ ID NO: 7296552 - DNA, 22 bp, Homo sapiens
acacattatctcattaaatact

SEQ ID NO: 7296553 - DNA, 22 bp, Homo sapiens
acacattatctcattaaatact

SEQ ID NO: 7296554 - DNA, 22 bp, Homo sapiens
acacatttatggatcgcagaaa

SEQ ID NO: 7296555 - DNA, 22 bp, Homo sapiens
acacatttagcaccaggtttat

SEQ ID NO: 7296556 - DNA, 22 bp, Homo sapiens
acacatttctaaatttttaccg

SEQ ID NO: 7296557 - DNA, 22 bp, Homo sapiens
acacatttattacatgcatgtg

SEQ ID NO: 7296558 - DNA, 22 bp, Homo sapiens
acacatttctaaatttttaccg

SEQ ID NO: 7296559 - DNA, 22 bp, Homo sapiens
aagagcaggctgtcaatggggc

SEQ ID NO: 7296560 - DNA, 22 bp, Homo sapiens
aagagcaggctgtcaatggggc

SEQ ID NO: 7296561 - DNA, 22 bp, Homo sapiens
aagagcaggctgctgtggagta

SEQ ID NO: 7296562 - DNA, 22 bp, Homo sapiens
aagagcaggacagaatcagaac

SEQ ID NO: 7296563 - DNA, 22 bp, Homo sapiens
acacatgaaataatattatgca

SEQ ID NO: 7296564 - DNA, 22 bp, Homo sapiens
acacatgaaagacattaaggtg

SEQ ID NO: 7296565 - DNA, 19 bp, Homo sapiens
aagagcagggaaagaattg

SEQ ID NO: 7296566 - DNA, 22 bp, Homo sapiens
acacatatatacatatttgtgc

SEQ ID NO: 7296567 - DNA, 22 bp, Homo sapiens
acacatgagaaacatcagttgt

SEQ ID NO: 7296568 - DNA, 22 bp, Homo sapiens
acacatgagaaacatcagttgt

SEQ ID NO: 7296569 - DNA, 22 bp, Homo sapiens
acacatgagttctcatcttgtg

SEQ ID NO: 7296570 - DNA, 22 bp, Homo sapiens
acacatgataagaaagtttaaa

SEQ ID NO: 7296571 - DNA, 22 bp, Homo sapiens
aagcagaggtagggtgtgcagt

SEQ ID NO: 7296572 - DNA, 22 bp, Homo sapiens
aagcagaggccacagagtgggc

SEQ ID NO: 7296573 - DNA, 22 bp, Homo sapiens
aagcagaggaccgacggaggga

SEQ ID NO: 7296574 - DNA, 22 bp, Homo sapiens
aagcagagggtatggccaggtt

SEQ ID NO: 7296575 - DNA, 22 bp, Homo sapiens
acagcagagccagtggctctag

SEQ ID NO: 7296576 - DNA, 21 bp, Homo sapiens
aagcaggaacttcaaagggac

SEQ ID NO: 7296577 - DNA, 22 bp, Homo sapiens
aagcagacatcccatacttttg

SEQ ID NO: 7296578 - DNA, 18 bp, Homo sapiens
aagcagacagcagacagt

SEQ ID NO: 7296579 - DNA, 22 bp, Homo sapiens
aagcagaatttaatagaaaggt

SEQ ID NO: 7296580 - DNA, 22 bp, Homo sapiens
aagcagagcctgagacagggat

SEQ ID NO: 7296581 - DNA, 22 bp, Homo sapiens
aagcagagcaagcgtatttatt

SEQ ID NO: 7296582 - DNA, 22 bp, Homo sapiens
aagcagagccaccagctttgga

SEQ ID NO: 7296583 - DNA, 22 bp, Homo sapiens
aagcagagcctgagacagggat

SEQ ID NO: 7296584 - DNA, 22 bp, Homo sapiens
aagcagagagcagaattaagtt

SEQ ID NO: 7296585 - DNA, 22 bp, Homo sapiens
aagcagagaccggctaatggag

SEQ ID NO: 7296586 - DNA, 22 bp, Homo sapiens
aagcagagaatctgggagcgag

SEQ ID NO: 7296587 - DNA, 22 bp, Homo sapiens
aagcagagaaaagcttaggttc

SEQ ID NO: 7296588 - DNA, 22 bp, Homo sapiens
aagcaatagggtaatctactca

SEQ ID NO: 7296589 - DNA, 22 bp, Homo sapiens
aagcacaatttaggactgaaat

SEQ ID NO: 7296590 - DNA, 22 bp, Homo sapiens
aagagaagaaagtgtctacaca

SEQ ID NO: 7296591 - DNA, 22 bp, Homo sapiens
aagagaaggattctgagcctgg

SEQ ID NO: 7296592 - DNA, 22 bp, Homo sapiens
aagagaaggattctgagcctgg

SEQ ID NO: 7296593 - DNA, 22 bp, Homo sapiens
aagactttctggggtgtaaagg

SEQ ID NO: 7296594 - DNA, 22 bp, Homo sapiens
aagactttctcccaaatcctca

SEQ ID NO: 7296595 - DNA, 20 bp, Homo sapiens
aattttatctccatcctttg

SEQ ID NO: 7296596 - DNA, 20 bp, Homo sapiens
aattttatctccatcctttg

SEQ ID NO: 7296597 - DNA, 22 bp, Homo sapiens
aagacttgaccaggttgaaggc

SEQ ID NO: 7296598 - DNA, 22 bp, Homo sapiens
aagaccatcacagagacacttg

SEQ ID NO: 7296599 - DNA, 22 bp, Homo sapiens
aagactttccctcatcagaacg

SEQ ID NO: 7296600 - DNA, 22 bp, Homo sapiens
aagactttcaagtatgcatgca

SEQ ID NO: 7296601 - DNA, 22 bp, Homo sapiens
aattttaatcagtggtgctgag

SEQ ID NO: 7296602 - DNA, 22 bp, Homo sapiens
aatttgttacacagcaatataa

SEQ ID NO: 7296603 - DNA, 22 bp, Homo sapiens
aattttaagcatatgactggtt

SEQ ID NO: 7296604 - DNA, 22 bp, Homo sapiens
aatttcagatgtcataaatata

SEQ ID NO: 7296605 - DNA, 22 bp, Homo sapiens
aatttcagtatgaagtttcaca

SEQ ID NO: 7296606 - DNA, 22 bp, Homo sapiens
aatttcagttgctaataagttc

SEQ ID NO: 7296607 - DNA, 22 bp, Homo sapiens
aatttcagaccatttgcaatta

SEQ ID NO: 7296608 - DNA, 22 bp, Homo sapiens
aatttcagaacccaaattagcg

SEQ ID NO: 7296609 - DNA, 22 bp, Homo sapiens
aatttcagatattaaagaatga

SEQ ID NO: 7296610 - DNA, 21 bp, Homo sapiens
aatttcagacccattttgcct

SEQ ID NO: 7296611 - DNA, 22 bp, Homo sapiens
aagagacaatgtcttttggata

SEQ ID NO: 7296612 - DNA, 22 bp, Homo sapiens
aagagacagagccatgtttcta

SEQ ID NO: 7296613 - DNA, 22 bp, Homo sapiens
aagagaaggtgaggaagccggt

SEQ ID NO: 7296614 - DNA, 22 bp, Homo sapiens
aagagaaggccctgacccaccc

SEQ ID NO: 7296615 - DNA, 21 bp, Homo sapiens
aagagacatttctcatcagca

SEQ ID NO: 7296616 - DNA, 22 bp, Homo sapiens
acacaaaatcaaagtcctaggc

SEQ ID NO: 7296617 - DNA, 22 bp, Homo sapiens
aagagagaacacagcttgggca

SEQ ID NO: 7296618 - DNA, 22 bp, Homo sapiens
aagagagaacacagcttgggca

SEQ ID NO: 7296619 - DNA, 22 bp, Homo sapiens
aagagcagattcctagtggagc

SEQ ID NO: 7296620 - DNA, 22 bp, Homo sapiens
aagagcagattcctagtggagc

SEQ ID NO: 7296621 - DNA, 22 bp, Homo sapiens
aagagcagaagtccttggatcc

SEQ ID NO: 7296622 - DNA, 22 bp, Homo sapiens
aagagcagcctccaggggtgga

SEQ ID NO: 7296623 - DNA, 22 bp, Homo sapiens
aagagcaagtgggtagtgaagc

SEQ ID NO: 7296624 - DNA, 22 bp, Homo sapiens
aattcacaatgtgtagtcatgc

SEQ ID NO: 7296625 - DNA, 22 bp, Homo sapiens
aattcacaatgtgtagtcatgc

SEQ ID NO: 7296626 - DNA, 22 bp, Homo sapiens
aattctatgttcttgagtaaga

SEQ ID NO: 7296627 - DNA, 22 bp, Homo sapiens
aattctataggcaagctatttt

SEQ ID NO: 7296628 - DNA, 22 bp, Homo sapiens
aattcctctatctttcttcaag

SEQ ID NO: 7296629 - DNA, 22 bp, Homo sapiens
aagaaattaaggaatgcaacga

SEQ ID NO: 7296630 - DNA, 22 bp, Homo sapiens
aatttcactgtggagcacattt

SEQ ID NO: 7296631 - DNA, 22 bp, Homo sapiens
aatttcactgtggagcacattt

SEQ ID NO: 7296632 - DNA, 22 bp, Homo sapiens
aatttcactggaaaagataatt

SEQ ID NO: 7296633 - DNA, 22 bp, Homo sapiens
aatttcacataaggctcattgg

SEQ ID NO: 7296634 - DNA, 22 bp, Homo sapiens
aatttcacctgcactacatcgc

SEQ ID NO: 7296635 - DNA, 22 bp, Homo sapiens
aatttcacctatcacttaagcc

SEQ ID NO: 7296636 - DNA, 22 bp, Homo sapiens
aatttaaggaggccttcactct

SEQ ID NO: 7296637 - DNA, 17 bp, Homo sapiens
aagaacactcaatagca

SEQ ID NO: 7296638 - DNA, 22 bp, Homo sapiens
aagaaactgttgcgtgacagcg

SEQ ID NO: 7296639 - DNA, 22 bp, Homo sapiens
aatgggaagccagaagacaagg

SEQ ID NO: 7296640 - DNA, 22 bp, Homo sapiens
aactgcttgagatatgtttgtc

SEQ ID NO: 7296641 - DNA, 22 bp, Homo sapiens
aactggaagagtgaatataact

SEQ ID NO: 7296642 - DNA, 22 bp, Homo sapiens
aactggaactggtagtgttggt

SEQ ID NO: 7296643 - DNA, 22 bp, Homo sapiens
aactggaaagatcagtaggaag

SEQ ID NO: 7296644 - DNA, 22 bp, Homo sapiens
aactggaatagcacaggaaaag

SEQ ID NO: 7296645 - DNA, 22 bp, Homo sapiens
aactttctgtctgagctgcaga

SEQ ID NO: 7296646 - DNA, 22 bp, Homo sapiens
aactggtcctcaaattttgatg

SEQ ID NO: 7296647 - DNA, 22 bp, Homo sapiens
aactggtatctcttcagtgtaa

SEQ ID NO: 7296648 - DNA, 22 bp, Homo sapiens
aacatatcataggatgtcattg

SEQ ID NO: 7296649 - DNA, 22 bp, Homo sapiens
aacatatctacggatacgatta

SEQ ID NO: 7296650 - DNA, 22 bp, Homo sapiens
aacagcttagaaatgttgctaa

SEQ ID NO: 7296651 - DNA, 22 bp, Homo sapiens
aacatcagaagtagaagactca

SEQ ID NO: 7296652 - DNA, 22 bp, Homo sapiens
aacatcaggatcttgttacagt

SEQ ID NO: 7296653 - DNA, 22 bp, Homo sapiens
aacatcagcacacaatagcaag

SEQ ID NO: 7296654 - DNA, 22 bp, Homo sapiens
aacatcagcacacaatagcaag

SEQ ID NO: 7296655 - DNA, 22 bp, Homo sapiens
aacatcattatgtccattaatg

SEQ ID NO: 7296656 - DNA, 22 bp, Homo sapiens
aacatctacagtgagatgttag

SEQ ID NO: 7296657 - DNA, 22 bp, Homo sapiens
aacatcatcctttgagtattta

SEQ ID NO: 7296658 - DNA, 22 bp, Homo sapiens
aagtgtattaagcaacgttatt

SEQ ID NO: 7296659 - DNA, 20 bp, Homo sapiens
aacagctctcgacttatctt

SEQ ID NO: 7296660 - DNA, 22 bp, Homo sapiens
aagtggtagacaaagataattg

SEQ ID NO: 7296661 - DNA, 22 bp, Homo sapiens
aagtggtagagagagcataagc

SEQ ID NO: 7296662 - DNA, 22 bp, Homo sapiens
aatagagtcagttctacattct

SEQ ID NO: 7296663 - DNA, 19 bp, Homo sapiens
aacatctgtaactattttc

SEQ ID NO: 7296664 - DNA, 22 bp, Homo sapiens
aacatcttgtccttagattaaa

SEQ ID NO: 7296665 - DNA, 22 bp, Homo sapiens
aacatctttacaacagacctag

SEQ ID NO: 7296666 - DNA, 22 bp, Homo sapiens
aacatcttgtactgcacatttt

SEQ ID NO: 7296667 - DNA, 22 bp, Homo sapiens
aacatcttgaagattgggaaag

SEQ ID NO: 7296668 - DNA, 22 bp, Homo sapiens
aacatcttatctgcatgatccc

SEQ ID NO: 7296669 - DNA, 22 bp, Homo sapiens
aacatcttcagagaagctaagt

SEQ ID NO: 7296670 - DNA, 22 bp, Homo sapiens
aacatctttttgtttgctgaaa

SEQ ID NO: 7296671 - DNA, 22 bp, Homo sapiens
aacatctttttgtttgctgaaa

SEQ ID NO: 7296672 - DNA, 22 bp, Homo sapiens
aacatctttgataaacttagtg

SEQ ID NO: 7296673 - DNA, 19 bp, Homo sapiens
aacatctttccagtagagg

SEQ ID NO: 7296674 - DNA, 22 bp, Homo sapiens
aacatctttgccaaattgctat

SEQ ID NO: 7296675 - DNA, 22 bp, Homo sapiens
aacatctttgtagtgttctcct

SEQ ID NO: 7296676 - DNA, 22 bp, Homo sapiens
aatagaatttgtactgtgtttt

SEQ ID NO: 7296677 - DNA, 22 bp, Homo sapiens
aatgacaaccacaatggtgctg

SEQ ID NO: 7296678 - DNA, 22 bp, Homo sapiens
aatgacaataatcattaacttt

SEQ ID NO: 7296679 - DNA, 22 bp, Homo sapiens
aatgacagccctctagtctggg

SEQ ID NO: 7296680 - DNA, 22 bp, Homo sapiens
aatgacagagatagaagggatg

SEQ ID NO: 7296681 - DNA, 22 bp, Homo sapiens
aatgacaatattaatttggagg

SEQ ID NO: 7296682 - DNA, 22 bp, Homo sapiens
aatgacatgctttttaattata

SEQ ID NO: 7296683 - DNA, 22 bp, Homo sapiens
aatgacatgctttttaattata

SEQ ID NO: 7296684 - DNA, 22 bp, Homo sapiens
aatgacagtgttgggccagatg

SEQ ID NO: 7296685 - DNA, 22 bp, Homo sapiens
aactagaaatcactacaggtat

SEQ ID NO: 7296686 - DNA, 19 bp, Homo sapiens
aactagaaaggttttgaga

SEQ ID NO: 7296687 - DNA, 22 bp, Homo sapiens
aatgctttctcagagtccttca

SEQ ID NO: 7296688 - DNA, 22 bp, Homo sapiens
aactataatggggttaggaaat

SEQ ID NO: 7296689 - DNA, 22 bp, Homo sapiens
aactagaacgagaaagctgaac

SEQ ID NO: 7296690 - DNA, 22 bp, Homo sapiens
aatggctctgatgttgttgtga

SEQ ID NO: 7296691 - DNA, 22 bp, Homo sapiens
aatggctctgatgttgttgtga

SEQ ID NO: 7296692 - DNA, 22 bp, Homo sapiens
aacatgttgctttaataatatt

SEQ ID NO: 7296693 - DNA, 22 bp, Homo sapiens
aacctcaaactcttgggcttaa

SEQ ID NO: 7296694 - DNA, 23 bp, Homo sapiens
aacgacagctacaggcatcccac

SEQ ID NO: 7296695 - DNA, 22 bp, Homo sapiens
aatgaacaacttgatttttgcc

SEQ ID NO: 7296696 - DNA, 22 bp, Homo sapiens
aatgaacaacttgatttttgcc

SEQ ID NO: 7296697 - DNA, 22 bp, Homo sapiens
aaatgcatttcactaatgtttc

SEQ ID NO: 7296698 - DNA, 22 bp, Homo sapiens
aaatgcatgtatgtaatatgct

SEQ ID NO: 7296699 - DNA, 22 bp, Homo sapiens
aaatgcattaagtcagaacaat

SEQ ID NO: 7296700 - DNA, 22 bp, Homo sapiens
aaatgcattaagtcagaacaat

SEQ ID NO: 7296701 - DNA, 22 bp, Homo sapiens
aaggaagactcgcaggtctatg

SEQ ID NO: 7296702 - DNA, 22 bp, Homo sapiens
aaggaagactcgcaggtctatg

SEQ ID NO: 7296703 - DNA, 22 bp, Homo sapiens
aaggaagactcgcaggtctatg

SEQ ID NO: 7296704 - DNA, 22 bp, Homo sapiens
aaggaagacacagatgaagtga

SEQ ID NO: 7296705 - DNA, 22 bp, Homo sapiens
aaggaagacacagatgaagtga

SEQ ID NO: 7296706 - DNA, 22 bp, Homo sapiens
aaggaagagaatccttctcaga

SEQ ID NO: 7296707 - DNA, 22 bp, Homo sapiens
aaggaagagaatccttctcaga

SEQ ID NO: 7296708 - DNA, 22 bp, Homo sapiens
aaggaagacttgagaaggttcc

SEQ ID NO: 7296709 - DNA, 22 bp, Homo sapiens
aaggaagacttgagaaggttcc

SEQ ID NO: 7296710 - DNA, 22 bp, Homo sapiens
aaggaagagcaaagaattatgt

SEQ ID NO: 7296711 - DNA, 22 bp, Homo sapiens
aaggaagagcaaagaattatgt

SEQ ID NO: 7296712 - DNA, 22 bp, Homo sapiens
aaatgtcaaggtgatagatgca

SEQ ID NO: 7296713 - DNA, 22 bp, Homo sapiens
aaatgtcaaagacgtgtttttg

SEQ ID NO: 7296714 - DNA, 22 bp, Homo sapiens
aaggaagatgaggtgctgctta

SEQ ID NO: 7296715 - DNA, 22 bp, Homo sapiens
aaggaagatgaggtgctgctta

SEQ ID NO: 7296716 - DNA, 22 bp, Homo sapiens
aaggaagatgaaagtactgcta

SEQ ID NO: 7296717 - DNA, 22 bp, Homo sapiens
aaggaagatgaaagtactgcta

SEQ ID NO: 7296718 - DNA, 22 bp, Homo sapiens
aaggaagagtctagaacaggca

SEQ ID NO: 7296719 - DNA, 22 bp, Homo sapiens
aaggaagagtctagaacaggca

SEQ ID NO: 7296720 - DNA, 22 bp, Homo sapiens
aaggaagaggcaggttttgctg

SEQ ID NO: 7296721 - DNA, 22 bp, Homo sapiens
aaggaagaggcaggttttgctg

SEQ ID NO: 7296722 - DNA, 22 bp, Homo sapiens
aaggaagatatatcaagcttaa

SEQ ID NO: 7296723 - DNA, 22 bp, Homo sapiens
aaggaagatatatcaagcttaa

SEQ ID NO: 7296724 - DNA, 22 bp, Homo sapiens
aaatgtcagaggaacatattga

SEQ ID NO: 7296725 - DNA, 22 bp, Homo sapiens
aaatgtcagaggaacatattga

SEQ ID NO: 7296726 - DNA, 22 bp, Homo sapiens
aaatgtcaggtggtggatggct

SEQ ID NO: 7296727 - DNA, 22 bp, Homo sapiens
aaatgtcaggtggtggatggct

SEQ ID NO: 7296728 - DNA, 22 bp, Homo sapiens
aaatgtcatatttaagtaggaa

SEQ ID NO: 7296729 - DNA, 22 bp, Homo sapiens
aaatgtccttagagaaaagtca

SEQ ID NO: 7296730 - DNA, 22 bp, Homo sapiens
aaatgtcagaaaacatggagtg

SEQ ID NO: 7296731 - DNA, 22 bp, Homo sapiens
aaatgtcagagctggaaggggc

SEQ ID NO: 7296732 - DNA, 22 bp, Homo sapiens
aaatgtcagaagctttacttct

SEQ ID NO: 7296733 - DNA, 22 bp, Homo sapiens
aaggcagcagtgcacgactgat

SEQ ID NO: 7296734 - DNA, 22 bp, Homo sapiens
aaatttgtcaacttcatatgtt

SEQ ID NO: 7296735 - DNA, 22 bp, Homo sapiens
aaatttgtcaacttcatatgtt

SEQ ID NO: 7296736 - DNA, 22 bp, Homo sapiens
aaattttagaccaggcaaaact

SEQ ID NO: 7296737 - DNA, 22 bp, Homo sapiens
aaattttaaggctggaacttaa

SEQ ID NO: 7296738 - DNA, 22 bp, Homo sapiens
aaattttaaggctggaacttaa

SEQ ID NO: 7296739 - DNA, 22 bp, Homo sapiens
aacaatgtcctgtgagatgata

SEQ ID NO: 7296740 - DNA, 22 bp, Homo sapiens
aacacaatcttccagtttgctg

SEQ ID NO: 7296741 - DNA, 22 bp, Homo sapiens
aacacaatcttccagtttgctg

SEQ ID NO: 7296742 - DNA, 22 bp, Homo sapiens
aacacaatcttccagtttgctg

SEQ ID NO: 7296743 - DNA, 22 bp, Homo sapiens
aacacagagtatttgaagcatt

SEQ ID NO: 7296744 - DNA, 22 bp, Homo sapiens
aacagacatatttttaatatgc

SEQ ID NO: 7296745 - DNA, 22 bp, Homo sapiens
aacagaaaaggtaggtggcttt

SEQ ID NO: 7296746 - DNA, 22 bp, Homo sapiens
aacacagttttccaaaatagag

SEQ ID NO: 7296747 - DNA, 22 bp, Homo sapiens
aacactttttagtaaagattga

SEQ ID NO: 7296748 - DNA, 22 bp, Homo sapiens
aacactttttcctcctgtctgg

SEQ ID NO: 7296749 - DNA, 22 bp, Homo sapiens
aacactttttatatattgtatc

SEQ ID NO: 7296750 - DNA, 22 bp, Homo sapiens
aacactttgttgcctatgaacg

SEQ ID NO: 7296751 - DNA, 22 bp, Homo sapiens
aacactttgggcatggccttcc

SEQ ID NO: 7296752 - DNA, 22 bp, Homo sapiens
aacactttcttccttgctcagg

SEQ ID NO: 7296753 - DNA, 22 bp, Homo sapiens
accgggctaatttttgtatctt

SEQ ID NO: 7296754 - DNA, 22 bp, Homo sapiens
acgtagcactgagagatgcagg

SEQ ID NO: 7296755 - DNA, 22 bp, Homo sapiens
acgtatattgaaatatcatgag

SEQ ID NO: 7296756 - DNA, 22 bp, Homo sapiens
acgtgaactgtttttggagatt

SEQ ID NO: 7296757 - DNA, 22 bp, Homo sapiens
aagtcctttctcatggaggaat

SEQ ID NO: 7296758 - DNA, 22 bp, Homo sapiens
acgtgcgtgtgcgcacacatac

SEQ ID NO: 7296759 - DNA, 20 bp, Homo sapiens
acgtggccaccagtggctta

SEQ ID NO: 7296760 - DNA, 20 bp, Homo sapiens
actctaactctttacaacag

SEQ ID NO: 7296761 - DNA, 22 bp, Homo sapiens
actctacagaatgaatacctgt

SEQ ID NO: 7296762 - DNA, 22 bp, Homo sapiens
actataacccatggaatataag

SEQ ID NO: 7296763 - DNA, 22 bp, Homo sapiens
actataacctgttagaatagat

SEQ ID NO: 7296764 - DNA, 22 bp, Homo sapiens
actatacaccaaaatattaagg

SEQ ID NO: 7296765 - DNA, 22 bp, Homo sapiens
actagttttccataatatagga

SEQ ID NO: 7296766 - DNA, 22 bp, Homo sapiens
actataaaaggataaaccagaa

SEQ ID NO: 7296767 - DNA, 22 bp, Homo sapiens
actggagctgagagcatgggta

SEQ ID NO: 7296768 - DNA, 22 bp, Homo sapiens
actggacatttctagaaagcag

SEQ ID NO: 7296769 - DNA, 23 bp, Homo sapiens
actggacagagtggacgaggctg

SEQ ID NO: 7296770 - DNA, 22 bp, Homo sapiens
actggagcccgtggaggcgcag

SEQ ID NO: 7296771 - DNA, 22 bp, Homo sapiens
aatacagaggaaacatttaata

SEQ ID NO: 7296772 - DNA, 21 bp, Homo sapiens
actgatattaaccttataaca

SEQ ID NO: 7296773 - DNA, 22 bp, Homo sapiens
actgatattaaacacaatttaa

SEQ ID NO: 7296774 - DNA, 22 bp, Homo sapiens
aatgattggcactagatacaca

SEQ ID NO: 7296775 - DNA, 22 bp, Homo sapiens
aatgatgagttctaatagaccc

SEQ ID NO: 7296776 - DNA, 22 bp, Homo sapiens
agaagcagaaaagggcactttt

SEQ ID NO: 7296777 - DNA, 22 bp, Homo sapiens
agaagcagaaactgggcttgtg

SEQ ID NO: 7296778 - DNA, 22 bp, Homo sapiens
agaagcagaaactgggcttgtg

SEQ ID NO: 7296779 - DNA, 22 bp, Homo sapiens
agaagcagaaactgggcttgtg

SEQ ID NO: 7296780 - DNA, 22 bp, Homo sapiens
agaagcagaaggaagcagggcc

SEQ ID NO: 7296781 - DNA, 22 bp, Homo sapiens
agaagcagaaggaagcagggcc

SEQ ID NO: 7296782 - DNA, 22 bp, Homo sapiens
agaaattattagtgaatagtct

SEQ ID NO: 7296783 - DNA, 22 bp, Homo sapiens
agaaattatgcagtagttttat

SEQ ID NO: 7296784 - DNA, 22 bp, Homo sapiens
agaaatgacacacatgagacat

SEQ ID NO: 7296785 - DNA, 22 bp, Homo sapiens
agaaatgacacacatgagacat

SEQ ID NO: 7296786 - DNA, 22 bp, Homo sapiens
aatcagcaggcttctaaatttt

SEQ ID NO: 7296787 - DNA, 22 bp, Homo sapiens
agaaatgacaagactgatcagg

SEQ ID NO: 7296788 - DNA, 22 bp, Homo sapiens
agaaatgaagcaggagttatta

SEQ ID NO: 7296789 - DNA, 22 bp, Homo sapiens
aatactctagggcagtgcttct

SEQ ID NO: 7296790 - DNA, 22 bp, Homo sapiens
aatactatgtagccaaaataat

SEQ ID NO: 7296791 - DNA, 22 bp, Homo sapiens
aatactatgtagccaaaataat

SEQ ID NO: 7296792 - DNA, 22 bp, Homo sapiens
aatactagttaaatgaatgaat

SEQ ID NO: 7296793 - DNA, 20 bp, Homo sapiens
aatactaaacacaaagcagt

SEQ ID NO: 7296794 - DNA, 22 bp, Homo sapiens
aatactagctgcatttaaaggt

SEQ ID NO: 7296795 - DNA, 22 bp, Homo sapiens
aatatagcattgtatgactgtg

SEQ ID NO: 7296796 - DNA, 22 bp, Homo sapiens
aatatagatttactcaagagaa

SEQ ID NO: 7296797 - DNA, 22 bp, Homo sapiens
aatataattttattcctagagt

SEQ ID NO: 7296798 - DNA, 22 bp, Homo sapiens
aatatagctcactataccatgg

SEQ ID NO: 7296799 - DNA, 19 bp, Homo sapiens
actgttctgtatgttgatt

SEQ ID NO: 7296800 - DNA, 22 bp, Homo sapiens
actgttctgccaagatcaacgt

SEQ ID NO: 7296801 - DNA, 23 bp, Homo sapiens
actttattgaccccaggtcagtt

SEQ ID NO: 7296802 - DNA, 22 bp, Homo sapiens
actttatttcctattgcatcca

SEQ ID NO: 7296803 - DNA, 22 bp, Homo sapiens
actttgaaatgtgtaagagaga

SEQ ID NO: 7296804 - DNA, 22 bp, Homo sapiens
actttgaaactaaaattcatta

SEQ ID NO: 7296805 - DNA, 22 bp, Homo sapiens
actttcttctactacttggaga

SEQ ID NO: 7296806 - DNA, 22 bp, Homo sapiens
actttcttcttatgcattaagg

SEQ ID NO: 7296807 - DNA, 22 bp, Homo sapiens
actttcttggtcccatgtttga

SEQ ID NO: 7296808 - DNA, 22 bp, Homo sapiens
actttcttaggctgtataaatg

SEQ ID NO: 7296809 - DNA, 22 bp, Homo sapiens
actttatttcctattgcatcca

SEQ ID NO: 7296810 - DNA, 22 bp, Homo sapiens
acatttaaatacctatgtttct

SEQ ID NO: 7296811 - DNA, 22 bp, Homo sapiens
acatttaaatacctatgtttct

SEQ ID NO: 7296812 - DNA, 22 bp, Homo sapiens
acatttaaatatgccttatatt

SEQ ID NO: 7296813 - DNA, 19 bp, Homo sapiens
acatttaaattcagatctc

SEQ ID NO: 7296814 - DNA, 22 bp, Homo sapiens
acatttcatgttttccagagca

SEQ ID NO: 7296815 - DNA, 22 bp, Homo sapiens
acatttctgcatgtagggtaat

SEQ ID NO: 7296816 - DNA, 22 bp, Homo sapiens
acatttcatttgcagtatggat

SEQ ID NO: 7296817 - DNA, 22 bp, Homo sapiens
acatttctcttgatgtctctat

SEQ ID NO: 7296818 - DNA, 22 bp, Homo sapiens
acatttctggagtttctcaaca

SEQ ID NO: 7296819 - DNA, 22 bp, Homo sapiens
acatttctggagtttctcaaca

SEQ ID NO: 7296820 - DNA, 22 bp, Homo sapiens
acatttctggagtttctcaaca

SEQ ID NO: 7296821 - DNA, 22 bp, Homo sapiens
acatttgtgcacatgtgcatgg

SEQ ID NO: 7296822 - DNA, 22 bp, Homo sapiens
acatttcttcctaattatccct

SEQ ID NO: 7296823 - DNA, 22 bp, Homo sapiens
acatttcttccacatgctgctg

SEQ ID NO: 7296824 - DNA, 22 bp, Homo sapiens
aaggcctttgccccgatacagg

SEQ ID NO: 7296825 - DNA, 22 bp, Homo sapiens
acattcttccagctggctgttg

SEQ ID NO: 7296826 - DNA, 22 bp, Homo sapiens
acattcttcttgtgaatttact

SEQ ID NO: 7296827 - DNA, 21 bp, Homo sapiens
acattgtgtatgcgagagttt

SEQ ID NO: 7296828 - DNA, 22 bp, Homo sapiens
acattcttgaagtgaagtttat

SEQ ID NO: 7296829 - DNA, 22 bp, Homo sapiens
acccaggagctctggggtcctc

SEQ ID NO: 7296830 - DNA, 22 bp, Homo sapiens
acccaggaggtggaggctgcag

SEQ ID NO: 7296831 - DNA, 22 bp, Homo sapiens
accctgagaatgagtgtctcct

SEQ ID NO: 7296832 - DNA, 22 bp, Homo sapiens
acatttgtgcacatgtgcatgg

SEQ ID NO: 7296833 - DNA, 22 bp, Homo sapiens
acatttgtgcacatgtgcatgg

SEQ ID NO: 7296834 - DNA, 20 bp, Homo sapiens
acatttgtggatctgagaga

SEQ ID NO: 7296835 - DNA, 22 bp, Homo sapiens
acatttgttgccattcatggag

SEQ ID NO: 7296836 - DNA, 22 bp, Homo sapiens
acatttgttcagggctgaggaa

SEQ ID NO: 7296837 - DNA, 22 bp, Homo sapiens
acatttgttgccattcatggag

SEQ ID NO: 7296838 - DNA, 22 bp, Homo sapiens
acatttgtttctctagagtagg

SEQ ID NO: 7296839 - DNA, 22 bp, Homo sapiens
acatttgtttctctagagtagg

SEQ ID NO: 7296840 - DNA, 22 bp, Homo sapiens
acattttaatatgcttagtgtg

SEQ ID NO: 7296841 - DNA, 22 bp, Homo sapiens
acattttaatatgcttagtgtg

SEQ ID NO: 7296842 - DNA, 22 bp, Homo sapiens
acattttacaccaagacttctt

SEQ ID NO: 7296843 - DNA, 22 bp, Homo sapiens
acattttgcccttatttgctga

SEQ ID NO: 7296844 - DNA, 22 bp, Homo sapiens
accaggcccaccgcatgctcct

SEQ ID NO: 7296845 - DNA, 22 bp, Homo sapiens
accaggctgttgggcccagtgt

SEQ ID NO: 7296846 - DNA, 22 bp, Homo sapiens
accaggcttaatcctttgctat

SEQ ID NO: 7296847 - DNA, 19 bp, Homo sapiens
accaggcttatggtcagtg

SEQ ID NO: 7296848 - DNA, 22 bp, Homo sapiens
accaggcttgataccaagaaat

SEQ ID NO: 7296849 - DNA, 22 bp, Homo sapiens
acccagagctgggcttggcaaa

SEQ ID NO: 7296850 - DNA, 22 bp, Homo sapiens
accatgttggccaagctggtct

SEQ ID NO: 7296851 - DNA, 22 bp, Homo sapiens
accaggcttgatgatttgctta

SEQ ID NO: 7296852 - DNA, 21 bp, Homo sapiens
accaggcttgtgggagggagc

SEQ ID NO: 7296853 - DNA, 22 bp, Homo sapiens
accagggcaaatgtttgtactc

SEQ ID NO: 7296854 - DNA, 22 bp, Homo sapiens
accagggcacaggagtctgaag

SEQ ID NO: 7296855 - DNA, 22 bp, Homo sapiens
aagctcttatgatatttattta

SEQ ID NO: 7296856 - DNA, 22 bp, Homo sapiens
aagctgccttccatgtgaggaa

SEQ ID NO: 7296857 - DNA, 23 bp, Homo sapiens
aagctgccttcgcagttggtctg

SEQ ID NO: 7296858 - DNA, 22 bp, Homo sapiens
aagctgcctgccacgctagata

SEQ ID NO: 7296859 - DNA, 22 bp, Homo sapiens
aagcattttagtaatgaacttg

SEQ ID NO: 7296860 - DNA, 22 bp, Homo sapiens
aagcatttttcacagcaacagc

SEQ ID NO: 7296861 - DNA, 22 bp, Homo sapiens
aagcatttttcacagcaacagc

SEQ ID NO: 7296862 - DNA, 22 bp, Homo sapiens
aagcattttgttttaagaatga

SEQ ID NO: 7296863 - DNA, 22 bp, Homo sapiens
acagcctgtttgatctggtgct

SEQ ID NO: 7296864 - DNA, 19 bp, Homo sapiens
aagctaagacctgaaggtt

SEQ ID NO: 7296865 - DNA, 22 bp, Homo sapiens
aagctaagattacagatttggg

SEQ ID NO: 7296866 - DNA, 22 bp, Homo sapiens
aagctaagggtgtttaagcagg

SEQ ID NO: 7296867 - DNA, 22 bp, Homo sapiens
aagctaagtataggtgaatcct

SEQ ID NO: 7296868 - DNA, 22 bp, Homo sapiens
aagctaagtggaagtcttatca

SEQ ID NO: 7296869 - DNA, 22 bp, Homo sapiens
aagctaagtggaagtcttatca

SEQ ID NO: 7296870 - DNA, 21 bp, Homo sapiens
aagctacagaaaataatttga

SEQ ID NO: 7296871 - DNA, 22 bp, Homo sapiens
aaggagaatttggcttgtgatg

SEQ ID NO: 7296872 - DNA, 20 bp, Homo sapiens
aaggagaatgacacggctgc

SEQ ID NO: 7296873 - DNA, 22 bp, Homo sapiens
aaggagagtacaggagttggta

SEQ ID NO: 7296874 - DNA, 22 bp, Homo sapiens
aaggagctcttaaaatcagaga

SEQ ID NO: 7296875 - DNA, 22 bp, Homo sapiens
aaggagctcccggcagaccagg

SEQ ID NO: 7296876 - DNA, 22 bp, Homo sapiens
aaggagctatgcataactgatc

SEQ ID NO: 7296877 - DNA, 22 bp, Homo sapiens
aaggagcgcttagggggcagaa

SEQ ID NO: 7296878 - DNA, 17 bp, Homo sapiens
aaggagctgagagatgg

SEQ ID NO: 7296879 - DNA, 22 bp, Homo sapiens
aaggagctgggagggacacatg

SEQ ID NO: 7296880 - DNA, 22 bp, Homo sapiens
aaggagctgggagggacacatg

SEQ ID NO: 7296881 - DNA, 22 bp, Homo sapiens
aaggagcttgttcgccttcctc

SEQ ID NO: 7296882 - DNA, 22 bp, Homo sapiens
aaggagctttcattacagcctt

SEQ ID NO: 7296883 - DNA, 22 bp, Homo sapiens
acagtctttctacattctgtgc

SEQ ID NO: 7296884 - DNA, 22 bp, Homo sapiens
aaggaggaataaagaggtggtg

SEQ ID NO: 7296885 - DNA, 22 bp, Homo sapiens
aaggcagagggctggatcagag

SEQ ID NO: 7296886 - DNA, 22 bp, Homo sapiens
acatatgtgttgtacatgcatg

SEQ ID NO: 7296887 - DNA, 22 bp, Homo sapiens
acatatgtgttgtacatgcatg

SEQ ID NO: 7296888 - DNA, 22 bp, Homo sapiens
acatatgtgttgtacatgcatg

SEQ ID NO: 7296889 - DNA, 22 bp, Homo sapiens
acatatgagtactatacagtgc

SEQ ID NO: 7296890 - DNA, 22 bp, Homo sapiens
acatatgagtactatacagtgc

SEQ ID NO: 7296891 - DNA, 22 bp, Homo sapiens
acatatgtgtctgcacatgccc

SEQ ID NO: 7296892 - DNA, 19 bp, Homo sapiens
acatatgtggatatacatg

SEQ ID NO: 7296893 - DNA, 22 bp, Homo sapiens
aaggaggacacccaggactggg

SEQ ID NO: 7296894 - DNA, 22 bp, Homo sapiens
aaggaggacacccaggactggg

SEQ ID NO: 7296895 - DNA, 22 bp, Homo sapiens
aaggaggacacccaggactggg

SEQ ID NO: 7296896 - DNA, 22 bp, Homo sapiens
aaggaggaatttcagggtgaat

SEQ ID NO: 7296897 - DNA, 22 bp, Homo sapiens
aaggaggaattctgagttcatg

SEQ ID NO: 7296898 - DNA, 22 bp, Homo sapiens
aaggaggcactcgctctcaggg

SEQ ID NO: 7296899 - DNA, 22 bp, Homo sapiens
acatatgaggtgttattctatg

SEQ ID NO: 7296900 - DNA, 22 bp, Homo sapiens
agagcctgcatctagcctcaga

SEQ ID NO: 7296901 - DNA, 22 bp, Homo sapiens
agagcctggacctgagctacaa

SEQ ID NO: 7296902 - DNA, 22 bp, Homo sapiens
aatgtgtaaatgaggagtcttg

SEQ ID NO: 7296903 - DNA, 22 bp, Homo sapiens
aatgtttgtcatcacacagata

SEQ ID NO: 7296904 - DNA, 18 bp, Homo sapiens
aatgtttgtcctctctaa

SEQ ID NO: 7296905 - DNA, 22 bp, Homo sapiens
aatgtttggctagatagatgga

SEQ ID NO: 7296906 - DNA, 22 bp, Homo sapiens
aatgtttgtgcataaatatgtt

SEQ ID NO: 7296907 - DNA, 22 bp, Homo sapiens
agacccttgcatgaattaattc

SEQ ID NO: 7296908 - DNA, 22 bp, Homo sapiens
agagacaggagttctgtttcca

SEQ ID NO: 7296909 - DNA, 22 bp, Homo sapiens
aattaacagagggcttattact

SEQ ID NO: 7296910 - DNA, 22 bp, Homo sapiens
aattaacaaatgtagctgtgat

SEQ ID NO: 7296911 - DNA, 23 bp, Homo sapiens
agaagcagcttctggagtatcgg

SEQ ID NO: 7296912 - DNA, 22 bp, Homo sapiens
agaagcagcaagcccttcaaag

SEQ ID NO: 7296913 - DNA, 23 bp, Homo sapiens
agaagcagcttctggagtatcgg

SEQ ID NO: 7296914 - DNA, 22 bp, Homo sapiens
agaagcagaaggaagcagggcc

SEQ ID NO: 7296915 - DNA, 22 bp, Homo sapiens
agaagcagactctgaggcaagg

SEQ ID NO: 7296916 - DNA, 22 bp, Homo sapiens
agaagcagactctgaggcaagg

SEQ ID NO: 7296917 - DNA, 22 bp, Homo sapiens
agaagcagactctgaggcaagg

SEQ ID NO: 7296918 - DNA, 22 bp, Homo sapiens
agacaatatgtatattaagaat

SEQ ID NO: 7296919 - DNA, 21 bp, Homo sapiens
agacaatgctgtaaaattcag

SEQ ID NO: 7296920 - DNA, 22 bp, Homo sapiens
aatgggcatttggggttgagaa

SEQ ID NO: 7296921 - DNA, 20 bp, Homo sapiens
aatgggcagtgtgtgagata

SEQ ID NO: 7296922 - DNA, 22 bp, Homo sapiens
aatgtgaggccttggtagttat

SEQ ID NO: 7296923 - DNA, 22 bp, Homo sapiens
aatgtgaggccttggtagttat

SEQ ID NO: 7296924 - DNA, 22 bp, Homo sapiens
aatgtgagccaatgcccgtggg

SEQ ID NO: 7296925 - DNA, 22 bp, Homo sapiens
aatgtgcagatgaataaacaaa

SEQ ID NO: 7296926 - DNA, 22 bp, Homo sapiens
aatgtggattcacaagtgctca

SEQ ID NO: 7296927 - DNA, 22 bp, Homo sapiens
aatgtggacatctttgccttgt

SEQ ID NO: 7296928 - DNA, 23 bp, Homo sapiens
aatgtgctgtattcatttctgga

SEQ ID NO: 7296929 - DNA, 22 bp, Homo sapiens
aatgtaaaatatcttgtacttg

SEQ ID NO: 7296930 - DNA, 18 bp, Homo sapiens
aatgtgaatatttacttc

SEQ ID NO: 7296931 - DNA, 22 bp, Homo sapiens
aatgtgaactttgtcatgtaac

SEQ ID NO: 7296932 - DNA, 22 bp, Homo sapiens
aatgtgaatcttcctttttgat

SEQ ID NO: 7296933 - DNA, 22 bp, Homo sapiens
aatgggttgaacatcaaggtct

SEQ ID NO: 7296934 - DNA, 22 bp, Homo sapiens
aatggtaccctggtgacttaga

SEQ ID NO: 7296935 - DNA, 23 bp, Homo sapiens
aatggtcttcctccacccctctg

SEQ ID NO: 7296936 - DNA, 22 bp, Homo sapiens
agagggggaaaatagaggtgtt

SEQ ID NO: 7296937 - DNA, 22 bp, Homo sapiens
acaaagtagtcaaagtagatga

SEQ ID NO: 7296938 - DNA, 22 bp, Homo sapiens
acaaagtaggtcatcaaagctc

SEQ ID NO: 7296939 - DNA, 22 bp, Homo sapiens
acaaagtaggaagattagctga

SEQ ID NO: 7296940 - DNA, 22 bp, Homo sapiens
acaaaggcaggattgacttagt

SEQ ID NO: 7296941 - DNA, 22 bp, Homo sapiens
acaaaggtgagcagaagacaca

SEQ ID NO: 7296942 - DNA, 22 bp, Homo sapiens
acaaaggtgcgtcccttcagct

SEQ ID NO: 7296943 - DNA, 22 bp, Homo sapiens
acaaagtaagggctaatgagca

SEQ ID NO: 7296944 - DNA, 22 bp, Homo sapiens
acaaaggcagccaatcatctgc

SEQ ID NO: 7296945 - DNA, 21 bp, Homo sapiens
acaaaggaagtctcttttaag

SEQ ID NO: 7296946 - DNA, 22 bp, Homo sapiens
agaggctctgccgcctcaggta

SEQ ID NO: 7296947 - DNA, 22 bp, Homo sapiens
aattgacaaatcatacttgtat

SEQ ID NO: 7296948 - DNA, 22 bp, Homo sapiens
aattgacaaatcatacttgtat

SEQ ID NO: 7296949 - DNA, 22 bp, Homo sapiens
acaatgaatatcatgaagtact

SEQ ID NO: 7296950 - DNA, 22 bp, Homo sapiens
acaatgaatatcatgaagtact

SEQ ID NO: 7296951 - DNA, 22 bp, Homo sapiens
acaatgaagataatgttgcagt

SEQ ID NO: 7296952 - DNA, 22 bp, Homo sapiens
acaatgaagctccactgagctt

SEQ ID NO: 7296953 - DNA, 22 bp, Homo sapiens
acaatgaagggagacacttgct

SEQ ID NO: 7296954 - DNA, 22 bp, Homo sapiens
acaatgcaataggagctagaaa

SEQ ID NO: 7296955 - DNA, 22 bp, Homo sapiens
acaatgcaataggagctagaaa

SEQ ID NO: 7296956 - DNA, 22 bp, Homo sapiens
acaatgaaccaaatttaccaat

SEQ ID NO: 7296957 - DNA, 22 bp, Homo sapiens
acaatgaacgctttttaactgt

SEQ ID NO: 7296958 - DNA, 22 bp, Homo sapiens
acaatgaacacacaaggaattc

SEQ ID NO: 7296959 - DNA, 22 bp, Homo sapiens
acaatgaaaggtattctgaact

SEQ ID NO: 7296960 - DNA, 22 bp, Homo sapiens
agataaattcctaagatttcag

SEQ ID NO: 7296961 - DNA, 22 bp, Homo sapiens
agataactaaagaaagggatta

SEQ ID NO: 7296962 - DNA, 17 bp, Homo sapiens
acaacagaaatgtattc

SEQ ID NO: 7296963 - DNA, 22 bp, Homo sapiens
acaacacatgtgtatatgtgtg

SEQ ID NO: 7296964 - DNA, 22 bp, Homo sapiens
acaacaatctaccctagcttct

SEQ ID NO: 7296965 - DNA, 22 bp, Homo sapiens
agaggggttaagtgctagtccg

SEQ ID NO: 7296966 - DNA, 20 bp, Homo sapiens
acaacaaacttgcttaagga

SEQ ID NO: 7296967 - DNA, 22 bp, Homo sapiens
acaagagattatctacagatga

SEQ ID NO: 7296968 - DNA, 22 bp, Homo sapiens
acaagagtctgcatttctaaca

SEQ ID NO: 7296969 - DNA, 22 bp, Homo sapiens
acaagataaggtgtcagtgtgt

SEQ ID NO: 7296970 - DNA, 22 bp, Homo sapiens
agataactggtttacattattg

SEQ ID NO: 7296971 - DNA, 22 bp, Homo sapiens
agataagagcctgtgtttggaa

SEQ ID NO: 7296972 - DNA, 22 bp, Homo sapiens
acaacgtatgatctgaaagtat

SEQ ID NO: 7296973 - DNA, 22 bp, Homo sapiens
acacatgtgattctaagacagc

SEQ ID NO: 7296974 - DNA, 22 bp, Homo sapiens
acacatgtgattctaagacagc

SEQ ID NO: 7296975 - DNA, 22 bp, Homo sapiens
acacatgtatgttttgtatttg

SEQ ID NO: 7296976 - DNA, 22 bp, Homo sapiens
acacatgtacagattagtattt

SEQ ID NO: 7296977 - DNA, 22 bp, Homo sapiens
acacatgtacagattagtattt

SEQ ID NO: 7296978 - DNA, 22 bp, Homo sapiens
acacatgtatatgcttgtgtgt

SEQ ID NO: 7296979 - DNA, 22 bp, Homo sapiens
acacatgtatggcacttacatt

SEQ ID NO: 7296980 - DNA, 22 bp, Homo sapiens
acacatgtatggcacttacatt

SEQ ID NO: 7296981 - DNA, 22 bp, Homo sapiens
acacattaaaacgtctacaatg

SEQ ID NO: 7296982 - DNA, 22 bp, Homo sapiens
acacattaacctttgaaattct

SEQ ID NO: 7296983 - DNA, 19 bp, Homo sapiens
acacatgtgtgttatgtgc

SEQ ID NO: 7296984 - DNA, 22 bp, Homo sapiens
acacatgttcaagaatgttcag

SEQ ID NO: 7296985 - DNA, 22 bp, Homo sapiens
acacatgtttacagtcttcagt

SEQ ID NO: 7296986 - DNA, 22 bp, Homo sapiens
acacagggatatttcaggtggt

SEQ ID NO: 7296987 - DNA, 22 bp, Homo sapiens
agcagctgtactttcatctgtt

SEQ ID NO: 7296988 - DNA, 22 bp, Homo sapiens
acactttagaaaaaagaatggt

SEQ ID NO: 7296989 - DNA, 22 bp, Homo sapiens
acactttagaaaaaagaatggt

SEQ ID NO: 7296990 - DNA, 22 bp, Homo sapiens
acactttacagcttcctttgca

SEQ ID NO: 7296991 - DNA, 22 bp, Homo sapiens
acactttacagaatgttttgat

SEQ ID NO: 7296992 - DNA, 22 bp, Homo sapiens
acacttcagctccacaaacatt

SEQ ID NO: 7296993 - DNA, 22 bp, Homo sapiens
acactgaatgctgtttagaaat

SEQ ID NO: 7296994 - DNA, 22 bp, Homo sapiens
acactgaatgctgtttagaaat

SEQ ID NO: 7296995 - DNA, 19 bp, Homo sapiens
acactgaatgtagaattgg

SEQ ID NO: 7296996 - DNA, 22 bp, Homo sapiens
acactataagacagatacagca

SEQ ID NO: 7296997 - DNA, 22 bp, Homo sapiens
acacattaggcagtgcttaaat

SEQ ID NO: 7296998 - DNA, 22 bp, Homo sapiens
acacattagtgctctgtctcat

SEQ ID NO: 7296999 - DNA, 22 bp, Homo sapiens
acacattataggcaatcaaaag

SEQ ID NO: 7297000 - DNA, 23 bp, Homo sapiens
acactcttcccagaaggttctga

SEQ ID NO: 7297001 - DNA, 22 bp, Homo sapiens
acactgaatcagaaattgttgg

SEQ ID NO: 7297002 - DNA, 21 bp, Homo sapiens
acaatgcatggaactcatggc

SEQ ID NO: 7297003 - DNA, 21 bp, Homo sapiens
acaatgcatggaactcatggc

SEQ ID NO: 7297004 - DNA, 22 bp, Homo sapiens
acaatgcatacctagcagctca

SEQ ID NO: 7297005 - DNA, 22 bp, Homo sapiens
agcagagcagaatgtgaaggtg

SEQ ID NO: 7297006 - DNA, 19 bp, Homo sapiens
agcagagcagggccgtggg

SEQ ID NO: 7297007 - DNA, 22 bp, Homo sapiens
agcagagcatggtgggaagggc

SEQ ID NO: 7297008 - DNA, 22 bp, Homo sapiens
agcagcaaaagagaatagtttg

SEQ ID NO: 7297009 - DNA, 22 bp, Homo sapiens
agcagagcccttccatggcctt

SEQ ID NO: 7297010 - DNA, 22 bp, Homo sapiens
agcagagcctgggctaggggtg

SEQ ID NO: 7297011 - DNA, 19 bp, Homo sapiens
agcagagccctgaagatcc

SEQ ID NO: 7297012 - DNA, 22 bp, Homo sapiens
agcagataggacatttcattct

SEQ ID NO: 7297013 - DNA, 22 bp, Homo sapiens
acacagatgcattacacatcta

SEQ ID NO: 7297014 - DNA, 22 bp, Homo sapiens
acagactgtcatgacactatat

SEQ ID NO: 7297015 - DNA, 22 bp, Homo sapiens
acagactgtgagtatgcatagt

SEQ ID NO: 7297016 - DNA, 20 bp, Homo sapiens
acagaaagagagaatgtcag

SEQ ID NO: 7297017 - DNA, 22 bp, Homo sapiens
acagaaagataggcacaaggtc

SEQ ID NO: 7297018 - DNA, 20 bp, Homo sapiens
acagaaagagagaatgtcag

SEQ ID NO: 7297019 - DNA, 20 bp, Homo sapiens
acagaaagagagaatgtcag

SEQ ID NO: 7297020 - DNA, 22 bp, Homo sapiens
acagacagggcacctgcctcct

SEQ ID NO: 7297021 - DNA, 22 bp, Homo sapiens
acagacagaggctccatgagga

SEQ ID NO: 7297022 - DNA, 22 bp, Homo sapiens
acagaaagaaggtgtatttgag

SEQ ID NO: 7297023 - DNA, 22 bp, Homo sapiens
acagaaaaatgagggagctgga

SEQ ID NO: 7297024 - DNA, 22 bp, Homo sapiens
acagaaaagtttacttttgctc

SEQ ID NO: 7297025 - DNA, 22 bp, Homo sapiens
acactttatgtctagatctggg

SEQ ID NO: 7297026 - DNA, 22 bp, Homo sapiens
acactttatcaatattcaaaaa

SEQ ID NO: 7297027 - DNA, 22 bp, Homo sapiens
acactttatcaatattcaaaaa

SEQ ID NO: 7297028 - DNA, 22 bp, Homo sapiens
acactttatctcatctcagaca

SEQ ID NO: 7297029 - DNA, 22 bp, Homo sapiens
agctcctgcttgacagaagagg

SEQ ID NO: 7297030 - DNA, 22 bp, Homo sapiens
agctcctgctctttgtccctaa

SEQ ID NO: 7297031 - DNA, 22 bp, Homo sapiens
acagcacaggagttgaatgggc

SEQ ID NO: 7297032 - DNA, 22 bp, Homo sapiens
agctcctgcgcacggtgcacac

SEQ ID NO: 7297033 - DNA, 17 bp, Homo sapiens
agctcctgcccatggct

SEQ ID NO: 7297034 - DNA, 22 bp, Homo sapiens
agctcctgcccaggaaggctct

SEQ ID NO: 7297035 - DNA, 22 bp, Homo sapiens
agctcctgcacccagccttgag

SEQ ID NO: 7297036 - DNA, 22 bp, Homo sapiens
agctcctgcaccaggggcccct

SEQ ID NO: 7297037 - DNA, 22 bp, Homo sapiens
agctcctgccaacactgatggg

SEQ ID NO: 7297038 - DNA, 22 bp, Homo sapiens
agctcctgcagactcctgctca

SEQ ID NO: 7297039 - DNA, 22 bp, Homo sapiens
acagattcactgcactggccat

SEQ ID NO: 7297040 - DNA, 19 bp, Homo sapiens
acagatggaggaatctggg

SEQ ID NO: 7297041 - DNA, 20 bp, Homo sapiens
acagatatttgattttcagt

SEQ ID NO: 7297042 - DNA, 20 bp, Homo sapiens
agccctgtttcctggagaga

SEQ ID NO: 7297043 - DNA, 21 bp, Homo sapiens
acagttttaaggagcacatgg

SEQ ID NO: 7297044 - DNA, 18 bp, Homo sapiens
acagtgattgttctatgc

SEQ ID NO: 7297045 - DNA, 22 bp, Homo sapiens
acagtgatgagggaattttgtg

SEQ ID NO: 7297046 - DNA, 22 bp, Homo sapiens
acagtgatgggggtgcaggaag

SEQ ID NO: 7297047 - DNA, 22 bp, Homo sapiens
acagtgatatttttactcaaat

SEQ ID NO: 7297048 - DNA, 22 bp, Homo sapiens
acagtgataaaatttcacatgt

SEQ ID NO: 7297049 - DNA, 22 bp, Homo sapiens
acagttacatcacttactgaca

SEQ ID NO: 7297050 - DNA, 22 bp, Homo sapiens
acagttacatgattcttgtgag

SEQ ID NO: 7297051 - DNA, 22 bp, Homo sapiens
acagttacatgattcttgtgag

SEQ ID NO: 7297052 - DNA, 22 bp, Homo sapiens
acagttacattaaacaaaagga

SEQ ID NO: 7297053 - DNA, 22 bp, Homo sapiens
acagttacattccagcaacatc

SEQ ID NO: 7297054 - DNA, 22 bp, Homo sapiens
acagttaccacttagcagttac

SEQ ID NO: 7297055 - DNA, 22 bp, Homo sapiens
acagttactcatagaagcactt

SEQ ID NO: 7297056 - DNA, 22 bp, Homo sapiens
acagttatctttgaaatagaga

SEQ ID NO: 7297057 - DNA, 22 bp, Homo sapiens
acagttcaagtcttagacaaca

SEQ ID NO: 7297058 - DNA, 22 bp, Homo sapiens
acagttcaagcaagtttctgtt

SEQ ID NO: 7297059 - DNA, 20 bp, Homo sapiens
aggagtccctgtgctctctc

SEQ ID NO: 7297060 - DNA, 22 bp, Homo sapiens
aggagggtgatccgggctggtc

SEQ ID NO: 7297061 - DNA, 22 bp, Homo sapiens
aggagtcaggaattatttatga

SEQ ID NO: 7297062 - DNA, 22 bp, Homo sapiens
aggaggaactcagaaagaaggt

SEQ ID NO: 7297063 - DNA, 22 bp, Homo sapiens
aggaggaactcagaaagaaggt

SEQ ID NO: 7297064 - DNA, 22 bp, Homo sapiens
acaggtggcttattggctgatt

SEQ ID NO: 7297065 - DNA, 22 bp, Homo sapiens
acaggtggcttattggctgatt

SEQ ID NO: 7297066 - DNA, 22 bp, Homo sapiens
acaggtggggaggctgaggttc

SEQ ID NO: 7297067 - DNA, 22 bp, Homo sapiens
aggagctgttttgttcagcaaa

SEQ ID NO: 7297068 - DNA, 22 bp, Homo sapiens
aggagctgttttgttcagcaaa

SEQ ID NO: 7297069 - DNA, 21 bp, Homo sapiens
aggagctgtgttagctggtcg

SEQ ID NO: 7297070 - DNA, 22 bp, Homo sapiens
acagctcctactgaagccatgt

SEQ ID NO: 7297071 - DNA, 22 bp, Homo sapiens
acagctcctactgaagccatgt

SEQ ID NO: 7297072 - DNA, 23 bp, Homo sapiens
acagctgcacctggccgcctggc

SEQ ID NO: 7297073 - DNA, 22 bp, Homo sapiens
agctgcctgtgctgggagccca

SEQ ID NO: 7297074 - DNA, 22 bp, Homo sapiens
agctgcccccagggctgtgctt

SEQ ID NO: 7297075 - DNA, 22 bp, Homo sapiens
agctgccccatgagaggcaggt

SEQ ID NO: 7297076 - DNA, 22 bp, Homo sapiens
agctgcctgtcctaggccatca

SEQ ID NO: 7297077 - DNA, 22 bp, Homo sapiens
acagcagacagtcggcttcctg

SEQ ID NO: 7297078 - DNA, 22 bp, Homo sapiens
agctgcccaatcctgcagggcg

SEQ ID NO: 7297079 - DNA, 21 bp, Homo sapiens
agctgcccagagtagggaagg

SEQ ID NO: 7297080 - DNA, 22 bp, Homo sapiens
agctgcccagctaggaagaagg

SEQ ID NO: 7297081 - DNA, 22 bp, Homo sapiens
agctgcccagataggaggaggc

SEQ ID NO: 7297082 - DNA, 22 bp, Homo sapiens
aggaatggttatggggatagta

SEQ ID NO: 7297083 - DNA, 19 bp, Homo sapiens
aggaatggaattaattctg

SEQ ID NO: 7297084 - DNA, 22 bp, Homo sapiens
aggaatggttatggggatagta

SEQ ID NO: 7297085 - DNA, 22 bp, Homo sapiens
aggaatggtgctcagcagaaat

SEQ ID NO: 7297086 - DNA, 22 bp, Homo sapiens
aggaatgacttgtagctctgag

SEQ ID NO: 7297087 - DNA, 22 bp, Homo sapiens
acaggctgctgagccatttgct

SEQ ID NO: 7297088 - DNA, 22 bp, Homo sapiens
acaggccataaaggcaggccct

SEQ ID NO: 7297089 - DNA, 20 bp, Homo sapiens
agggcagcttgaggagccgg

SEQ ID NO: 7297090 - DNA, 22 bp, Homo sapiens
agggcagtgggaaagcctgctc

SEQ ID NO: 7297091 - DNA, 20 bp, Homo sapiens
agggcagcttgaggagccgg

SEQ ID NO: 7297092 - DNA, 22 bp, Homo sapiens
accatttgaaggaatcattgac

SEQ ID NO: 7297093 - DNA, 22 bp, Homo sapiens
agggcatgaaatgggcagaagc

SEQ ID NO: 7297094 - DNA, 23 bp, Homo sapiens
agggcatgaagcagaggacgtgg

SEQ ID NO: 7297095 - DNA, 22 bp, Homo sapiens
agggcatgaagcagtggacagc

SEQ ID NO: 7297096 - DNA, 22 bp, Homo sapiens
accatttaaggaaaatgtatca

SEQ ID NO: 7297097 - DNA, 22 bp, Homo sapiens
accatgtttagtgcagtgttca

SEQ ID NO: 7297098 - DNA, 22 bp, Homo sapiens
agggagctctaagtagagggac

SEQ ID NO: 7297099 - DNA, 22 bp, Homo sapiens
agggagctcacagtccagtaga

SEQ ID NO: 7297100 - DNA, 22 bp, Homo sapiens
agggagctctgggggcacacgg

SEQ ID NO: 7297101 - DNA, 22 bp, Homo sapiens
acccgggaggcaggagtcatag

SEQ ID NO: 7297102 - DNA, 22 bp, Homo sapiens
acccgatgttggtgctctagta

SEQ ID NO: 7297103 - DNA, 22 bp, Homo sapiens
agggaatgtagcaagatgccaa

SEQ ID NO: 7297104 - DNA, 22 bp, Homo sapiens
agggaatgtgaaaacacctctc

SEQ ID NO: 7297105 - DNA, 22 bp, Homo sapiens
agggacagatgaatgactgagt

SEQ ID NO: 7297106 - DNA, 22 bp, Homo sapiens
accaggcccatgtggattacta

SEQ ID NO: 7297107 - DNA, 20 bp, Homo sapiens
accaggccccgggccctgca

SEQ ID NO: 7297108 - DNA, 20 bp, Homo sapiens
accaggcccggtgtctcctc

SEQ ID NO: 7297109 - DNA, 22 bp, Homo sapiens
accaggcccgctgctatggtgg

SEQ ID NO: 7297110 - DNA, 23 bp, Homo sapiens
agggagctaaaaggctggagcag

SEQ ID NO: 7297111 - DNA, 19 bp, Homo sapiens
accaggcctcagaggccct

SEQ ID NO: 7297112 - DNA, 22 bp, Homo sapiens
accaggcctagcaagtacatta

SEQ ID NO: 7297113 - DNA, 22 bp, Homo sapiens
accaggccctccagctgcgtgg

SEQ ID NO: 7297114 - DNA, 22 bp, Homo sapiens
accaaacttctgggctcctttg

SEQ ID NO: 7297115 - DNA, 22 bp, Homo sapiens
agggaagaggaccagagtctct

SEQ ID NO: 7297116 - DNA, 22 bp, Homo sapiens
agggaagagcttgcaagaaacc

SEQ ID NO: 7297117 - DNA, 22 bp, Homo sapiens
acatttgtcttctttcagatta

SEQ ID NO: 7297118 - DNA, 22 bp, Homo sapiens
acattttttagagtcccacatt

SEQ ID NO: 7297119 - DNA, 22 bp, Homo sapiens
accaaaacctgctactaaagga

SEQ ID NO: 7297120 - DNA, 22 bp, Homo sapiens
acatgatattaatgtcttattt

SEQ ID NO: 7297121 - DNA, 23 bp, Homo sapiens
acatgatacacaattagcaaacc

SEQ ID NO: 7297122 - DNA, 22 bp, Homo sapiens
acatgaggaaacaagggtatat

SEQ ID NO: 7297123 - DNA, 22 bp, Homo sapiens
aggcagggctgggattagactc

SEQ ID NO: 7297124 - DNA, 22 bp, Homo sapiens
aggcaggggagctggaagggta

SEQ ID NO: 7297125 - DNA, 21 bp, Homo sapiens
acatgagacacacatatatgt

SEQ ID NO: 7297126 - DNA, 22 bp, Homo sapiens
acatgaaatgcagcctgtaacc

SEQ ID NO: 7297127 - DNA, 22 bp, Homo sapiens
aggcagggaccagttgttttct

SEQ ID NO: 7297128 - DNA, 22 bp, Homo sapiens
aggcagggctcatttcttaggc

SEQ ID NO: 7297129 - DNA, 17 bp, Homo sapiens
aggcaggcagagcggga

SEQ ID NO: 7297130 - DNA, 22 bp, Homo sapiens
acatggagaccagatggaagta

SEQ ID NO: 7297131 - DNA, 22 bp, Homo sapiens
acatttatataactcactagga

SEQ ID NO: 7297132 - DNA, 22 bp, Homo sapiens
acatttattttggcacggcaca

SEQ ID NO: 7297133 - DNA, 23 bp, Homo sapiens
acatttcaatactgagggtctga

SEQ ID NO: 7297134 - DNA, 22 bp, Homo sapiens
acatttattactcaggttgttg

SEQ ID NO: 7297135 - DNA, 22 bp, Homo sapiens
acatttagctgtacaatctatg

SEQ ID NO: 7297136 - DNA, 19 bp, Homo sapiens
acatttagaatgtacttgc

SEQ ID NO: 7297137 - DNA, 22 bp, Homo sapiens
acatttatataactcactagga

SEQ ID NO: 7297138 - DNA, 18 bp, Homo sapiens
acatttaggagagtcaat

SEQ ID NO: 7297139 - DNA, 22 bp, Homo sapiens
acatttacagtgctagacaatc

SEQ ID NO: 7297140 - DNA, 22 bp, Homo sapiens
acatttacctagttaagtcaat

SEQ ID NO: 7297141 - DNA, 22 bp, Homo sapiens
acatttcactgttcacagcagg

SEQ ID NO: 7297142 - DNA, 22 bp, Homo sapiens
acattgtgcctgtgatattaca

SEQ ID NO: 7297143 - DNA, 21 bp, Homo sapiens
acattgtgacatgcagggtgc

SEQ ID NO: 7297144 - DNA, 22 bp, Homo sapiens
acattgtgatccgactgattaa

SEQ ID NO: 7297145 - DNA, 22 bp, Homo sapiens
acattgtgacagttttggagaa

SEQ ID NO: 7297146 - DNA, 22 bp, Homo sapiens
acatttaaccaaactgtttaat

SEQ ID NO: 7297147 - DNA, 22 bp, Homo sapiens
acatttaaccaaactgtttaat

SEQ ID NO: 7297148 - DNA, 22 bp, Homo sapiens
acatttaaccctcaggtttctg

SEQ ID NO: 7297149 - DNA, 22 bp, Homo sapiens
acatttaacctttgaggaactg

SEQ ID NO: 7297150 - DNA, 22 bp, Homo sapiens
acatttaatgatcctactgtga

SEQ ID NO: 7297151 - DNA, 22 bp, Homo sapiens
acatttaagttaaaacctcagt

SEQ ID NO: 7297152 - DNA, 22 bp, Homo sapiens
acattgtgaagataccactgca

SEQ ID NO: 7297153 - DNA, 22 bp, Homo sapiens
aggctatttccactcttctcat

SEQ ID NO: 7297154 - DNA, 22 bp, Homo sapiens
aggctagctttggctcagtaaa

SEQ ID NO: 7297155 - DNA, 22 bp, Homo sapiens
aggctagctgtttcagggctag

SEQ ID NO: 7297156 - DNA, 22 bp, Homo sapiens
aggctagctaatgagtactgtg

SEQ ID NO: 7297157 - DNA, 23 bp, Homo sapiens
aggcgagctcttctccagcacgt

SEQ ID NO: 7297158 - DNA, 22 bp, Homo sapiens
aggcctgttccaggcccctttt

SEQ ID NO: 7297159 - DNA, 22 bp, Homo sapiens
aggccttaccatagctgtagca

SEQ ID NO: 7297160 - DNA, 22 bp, Homo sapiens
atcatttatgccccaattagat

SEQ ID NO: 7297161 - DNA, 22 bp, Homo sapiens
atcatttgaacagaatttgttt

SEQ ID NO: 7297162 - DNA, 22 bp, Homo sapiens
atcatttgcctcaagtgaaagt

SEQ ID NO: 7297163 - DNA, 22 bp, Homo sapiens
atcattttatggctgagaggac

SEQ ID NO: 7297164 - DNA, 22 bp, Homo sapiens
atcatttgtgcatagtaacaga

SEQ ID NO: 7297165 - DNA, 22 bp, Homo sapiens
atcatttgtgcatagtaacaga

SEQ ID NO: 7297166 - DNA, 22 bp, Homo sapiens
atccagacacctactgctactt

SEQ ID NO: 7297167 - DNA, 23 bp, Homo sapiens
atccagcctgggggtttaaccac

SEQ ID NO: 7297168 - DNA, 22 bp, Homo sapiens
agaagaaatgaggccgttctgc

SEQ ID NO: 7297169 - DNA, 22 bp, Homo sapiens
atcagaggaaattaactctctc

SEQ ID NO: 7297170 - DNA, 22 bp, Homo sapiens
atcactggagtgaaaggcaaac

SEQ ID NO: 7297171 - DNA, 20 bp, Homo sapiens
atcactggagaaggaaacct

SEQ ID NO: 7297172 - DNA, 22 bp, Homo sapiens
atcagatatttaagttatcaac

SEQ ID NO: 7297173 - DNA, 22 bp, Homo sapiens
atcacattgttagcatagactg

SEQ ID NO: 7297174 - DNA, 22 bp, Homo sapiens
agaaacatcattggaacacaag

SEQ ID NO: 7297175 - DNA, 22 bp, Homo sapiens
agaaacagaagggaaagctttt

SEQ ID NO: 7297176 - DNA, 22 bp, Homo sapiens
agaaacatcctgctttccattt

SEQ ID NO: 7297177 - DNA, 22 bp, Homo sapiens
atcacaaaggctgcttcatgat

SEQ ID NO: 7297178 - DNA, 22 bp, Homo sapiens
atatccagcagcaggtgagtat

SEQ ID NO: 7297179 - DNA, 22 bp, Homo sapiens
atatattttgaatagcctctgt

SEQ ID NO: 7297180 - DNA, 22 bp, Homo sapiens
atatcttctttattttgtgagg

SEQ ID NO: 7297181 - DNA, 21 bp, Homo sapiens
atatcttcttcaaaccactca

SEQ ID NO: 7297182 - DNA, 22 bp, Homo sapiens
atatatttactctcctgttgca

SEQ ID NO: 7297183 - DNA, 22 bp, Homo sapiens
atatatttgagaatattcatga

SEQ ID NO: 7297184 - DNA, 22 bp, Homo sapiens
atatatttgagaatattcatga

SEQ ID NO: 7297185 - DNA, 22 bp, Homo sapiens
agaaacaacttgtttctcttgc

SEQ ID NO: 7297186 - DNA, 22 bp, Homo sapiens
agaaaatttattcatgttagtt

SEQ ID NO: 7297187 - DNA, 22 bp, Homo sapiens
agaaaatttaaagagacacaca

SEQ ID NO: 7297188 - DNA, 22 bp, Homo sapiens
agaaacaacttgtttctcttgc

SEQ ID NO: 7297189 - DNA, 22 bp, Homo sapiens
agaaaatttattcatgttagtt

SEQ ID NO: 7297190 - DNA, 22 bp, Homo sapiens
agaaaatttaaagagacacaca

SEQ ID NO: 7297191 - DNA, 22 bp, Homo sapiens
agaaaataaattgatggtggaa

SEQ ID NO: 7297192 - DNA, 22 bp, Homo sapiens
atatgaaaagaagtcaccattg

SEQ ID NO: 7297193 - DNA, 22 bp, Homo sapiens
atatacacatctttttaaatat

SEQ ID NO: 7297194 - DNA, 22 bp, Homo sapiens
atatacacagagcttatggtga

SEQ ID NO: 7297195 - DNA, 22 bp, Homo sapiens
atatacacagagcttatggtga

SEQ ID NO: 7297196 - DNA, 22 bp, Homo sapiens
atataattaatttagctgcctc

SEQ ID NO: 7297197 - DNA, 22 bp, Homo sapiens
acttggtctaactagtgcttct

SEQ ID NO: 7297198 - DNA, 22 bp, Homo sapiens
actttgggtaagccaggtgcta

SEQ ID NO: 7297199 - DNA, 22 bp, Homo sapiens
actttgggtaagttgattaatc

SEQ ID NO: 7297200 - DNA, 22 bp, Homo sapiens
actttgggcacagtgaggccag

SEQ ID NO: 7297201 - DNA, 22 bp, Homo sapiens
atatacacatgtgtatacattt

SEQ ID NO: 7297202 - DNA, 22 bp, Homo sapiens
actttggggaacttttctcctc

SEQ ID NO: 7297203 - DNA, 21 bp, Homo sapiens
actttgggcactttcctgccc

SEQ ID NO: 7297204 - DNA, 22 bp, Homo sapiens
actttggggatctacggctgga

SEQ ID NO: 7297205 - DNA, 20 bp, Homo sapiens
actttggggtctttctcaga

SEQ ID NO: 7297206 - DNA, 18 bp, Homo sapiens
atatattgacaagaggga

SEQ ID NO: 7297207 - DNA, 22 bp, Homo sapiens
actttgtataagacaataaaga

SEQ ID NO: 7297208 - DNA, 22 bp, Homo sapiens
actttgtaggaaaaagtcacaa

SEQ ID NO: 7297209 - DNA, 22 bp, Homo sapiens
actttgtaggtttcagtgaaac

SEQ ID NO: 7297210 - DNA, 22 bp, Homo sapiens
actgttatgatttacacagtcc

SEQ ID NO: 7297211 - DNA, 22 bp, Homo sapiens
acttcaaaaataagtgagaggt

SEQ ID NO: 7297212 - DNA, 22 bp, Homo sapiens
acttcaaatctcttgaaagcaa

SEQ ID NO: 7297213 - DNA, 19 bp, Homo sapiens
acttcaaatcttagagaaa

SEQ ID NO: 7297214 - DNA, 22 bp, Homo sapiens
acttcaaatgtgacaatgtgaa

SEQ ID NO: 7297215 - DNA, 22 bp, Homo sapiens
acttcaaacaattaacagagaa

SEQ ID NO: 7297216 - DNA, 22 bp, Homo sapiens
acttcaaacaattaacagagaa

SEQ ID NO: 7297217 - DNA, 22 bp, Homo sapiens
acttcaaaatgagtttcctggt

SEQ ID NO: 7297218 - DNA, 22 bp, Homo sapiens
acttcacacagcaaatttatct

SEQ ID NO: 7297219 - DNA, 22 bp, Homo sapiens
acttcacaactgtacatggcag

SEQ ID NO: 7297220 - DNA, 22 bp, Homo sapiens
acttcacaaagagatcatctaa

SEQ ID NO: 7297221 - DNA, 22 bp, Homo sapiens
acttcaaattctgggggaagag

SEQ ID NO: 7297222 - DNA, 22 bp, Homo sapiens
acttcaaattttcagaagaaat

SEQ ID NO: 7297223 - DNA, 22 bp, Homo sapiens
acttcaaattttcagaagaaat

SEQ ID NO: 7297224 - DNA, 22 bp, Homo sapiens
acttcacattagctaaaaggga

SEQ ID NO: 7297225 - DNA, 22 bp, Homo sapiens
actgtgtgaaacatcaatgtgt

SEQ ID NO: 7297226 - DNA, 22 bp, Homo sapiens
actgtgtcattgaacatggaaa

SEQ ID NO: 7297227 - DNA, 22 bp, Homo sapiens
actgtgtattctaatgactaaa

SEQ ID NO: 7297228 - DNA, 19 bp, Homo sapiens
actgtgtggaagtgtgatt

SEQ ID NO: 7297229 - DNA, 22 bp, Homo sapiens
actgtgtggaaatttgtgaggg

SEQ ID NO: 7297230 - DNA, 22 bp, Homo sapiens
actgttaattcaatcaacaggt

SEQ ID NO: 7297231 - DNA, 21 bp, Homo sapiens
actgttaagacgtagctgggg

SEQ ID NO: 7297232 - DNA, 22 bp, Homo sapiens
actgttaacggtatgatgctcg

SEQ ID NO: 7297233 - DNA, 22 bp, Homo sapiens
actgtgtttctgaaacaagagg

SEQ ID NO: 7297234 - DNA, 22 bp, Homo sapiens
actgtgtttggcaatagggcct

SEQ ID NO: 7297235 - DNA, 22 bp, Homo sapiens
actgtgttttcctgctgaggca

SEQ ID NO: 7297236 - DNA, 22 bp, Homo sapiens
actgttaaagtaattaattgtc

SEQ ID NO: 7297237 - DNA, 22 bp, Homo sapiens
actgtgtttcacctgagtatgg

SEQ ID NO: 7297238 - DNA, 22 bp, Homo sapiens
actgtgttgtctcaacctgacc

SEQ ID NO: 7297239 - DNA, 22 bp, Homo sapiens
actgtgttcacacttacaaatg

SEQ ID NO: 7297240 - DNA, 22 bp, Homo sapiens
actgtgttcctctttggtatcc

SEQ ID NO: 7297241 - DNA, 22 bp, Homo sapiens
actgtgttgccttcccccagcc

SEQ ID NO: 7297242 - DNA, 22 bp, Homo sapiens
actgtgttcaattaaaaagctt

SEQ ID NO: 7297243 - DNA, 22 bp, Homo sapiens
actgtgttaaatacagagatgg

SEQ ID NO: 7297244 - DNA, 22 bp, Homo sapiens
acttcttttcaaatcatgcaaa

SEQ ID NO: 7297245 - DNA, 22 bp, Homo sapiens
acttcagtaggtgatatgtgca

SEQ ID NO: 7297246 - DNA, 22 bp, Homo sapiens
acttcagtgtggtataaaacgt

SEQ ID NO: 7297247 - DNA, 22 bp, Homo sapiens
acttcagtttccctcaacaaga

SEQ ID NO: 7297248 - DNA, 22 bp, Homo sapiens
acttcattgtaatattatagca

SEQ ID NO: 7297249 - DNA, 22 bp, Homo sapiens
acttcattgctaagaacaaggt

SEQ ID NO: 7297250 - DNA, 22 bp, Homo sapiens
acttgcatgtgtaaatcttcct

SEQ ID NO: 7297251 - DNA, 22 bp, Homo sapiens
acttgcatgtcaggaaattaac

SEQ ID NO: 7297252 - DNA, 22 bp, Homo sapiens
actgtgaacggactgaagccca

SEQ ID NO: 7297253 - DNA, 22 bp, Homo sapiens
actgtgaatcactactagtaga

SEQ ID NO: 7297254 - DNA, 22 bp, Homo sapiens
actgtaaattacataagaacag

SEQ ID NO: 7297255 - DNA, 22 bp, Homo sapiens
actgtaaagaggtgtatcttta

SEQ ID NO: 7297256 - DNA, 22 bp, Homo sapiens
actgtctggaggcagagaggga

SEQ ID NO: 7297257 - DNA, 22 bp, Homo sapiens
actgtcatgatcgaagatgtca

SEQ ID NO: 7297258 - DNA, 22 bp, Homo sapiens
actgtgactgagcattcacatg

SEQ ID NO: 7297259 - DNA, 22 bp, Homo sapiens
actgtgctatctactgaattat

SEQ ID NO: 7297260 - DNA, 22 bp, Homo sapiens
actgtgtatgatatgtactggg

SEQ ID NO: 7297261 - DNA, 22 bp, Homo sapiens
actgtgtattcctatatagtaa

SEQ ID NO: 7297262 - DNA, 22 bp, Homo sapiens
actgtgtattcctatatagtaa

SEQ ID NO: 7297263 - DNA, 22 bp, Homo sapiens
agtttacagatgctacaggagc

SEQ ID NO: 7297264 - DNA, 22 bp, Homo sapiens
agtttacagatgctacaggagc

SEQ ID NO: 7297265 - DNA, 22 bp, Homo sapiens
agtttacagatgtagtaggggt

SEQ ID NO: 7297266 - DNA, 22 bp, Homo sapiens
agttgctcaatgtggctgtgga

SEQ ID NO: 7297267 - DNA, 22 bp, Homo sapiens
agtttacataaaaaggcagagg

SEQ ID NO: 7297268 - DNA, 22 bp, Homo sapiens
agtttacatcttcaatctcatt

SEQ ID NO: 7297269 - DNA, 22 bp, Homo sapiens
agtttacatatttgtcggagtc

SEQ ID NO: 7297270 - DNA, 22 bp, Homo sapiens
agtttacatgacgtgtatttca

SEQ ID NO: 7297271 - DNA, 22 bp, Homo sapiens
actatatacacattatcttgtt

SEQ ID NO: 7297272 - DNA, 22 bp, Homo sapiens
actcattaaataggatgatttt

SEQ ID NO: 7297273 - DNA, 22 bp, Homo sapiens
actcatgttttctctagctgga

SEQ ID NO: 7297274 - DNA, 22 bp, Homo sapiens
actcattaaataggatgatttt

SEQ ID NO: 7297275 - DNA, 22 bp, Homo sapiens
actcatttaaacatttactgaa

SEQ ID NO: 7297276 - DNA, 22 bp, Homo sapiens
actattcaggctccatctggta

SEQ ID NO: 7297277 - DNA, 22 bp, Homo sapiens
actattcaagtgctcattcaga

SEQ ID NO: 7297278 - DNA, 23 bp, Homo sapiens
actcaaaatttggcatttgagga

SEQ ID NO: 7297279 - DNA, 22 bp, Homo sapiens
actaaactgaagcatgaaaagg

SEQ ID NO: 7297280 - DNA, 22 bp, Homo sapiens
actaaagaacagttcgttcatg

SEQ ID NO: 7297281 - DNA, 22 bp, Homo sapiens
actaaagtatggaagtgaataa

SEQ ID NO: 7297282 - DNA, 22 bp, Homo sapiens
acgtgtgtatgagtgtacatat

SEQ ID NO: 7297283 - DNA, 22 bp, Homo sapiens
acgtgtgtatgagtgtacatat

SEQ ID NO: 7297284 - DNA, 22 bp, Homo sapiens
acgtgtgttggtcagggggccc

SEQ ID NO: 7297285 - DNA, 20 bp, Homo sapiens
acgtgtgtgtgcacgcgcgc

SEQ ID NO: 7297286 - DNA, 22 bp, Homo sapiens
acgtgtgtgacattgggaacgt

SEQ ID NO: 7297287 - DNA, 22 bp, Homo sapiens
acgtgtgtttaacaaacctgca

SEQ ID NO: 7297288 - DNA, 22 bp, Homo sapiens
accttcaaactagatagaagtt

SEQ ID NO: 7297289 - DNA, 22 bp, Homo sapiens
accttcaatgaaaataatagtc

SEQ ID NO: 7297290 - DNA, 22 bp, Homo sapiens
acctgtttgttaagaaagcttc

SEQ ID NO: 7297291 - DNA, 22 bp, Homo sapiens
agggctttaatgattattttct

SEQ ID NO: 7297292 - DNA, 22 bp, Homo sapiens
agggctttaatgattattttct

SEQ ID NO: 7297293 - DNA, 22 bp, Homo sapiens
agggctttacttctcagttcta

SEQ ID NO: 7297294 - DNA, 22 bp, Homo sapiens
agggctttcggcactctgaggg

SEQ ID NO: 7297295 - DNA, 22 bp, Homo sapiens
agggctttcggcactctgaggg

SEQ ID NO: 7297296 - DNA, 20 bp, Homo sapiens
agggtgtgggccttagccat

SEQ ID NO: 7297297 - DNA, 22 bp, Homo sapiens
agggtgtgctgttgggtctttc

SEQ ID NO: 7297298 - DNA, 22 bp, Homo sapiens
agggtgtgctgttgggtctttc

SEQ ID NO: 7297299 - DNA, 20 bp, Homo sapiens
agggtgtgggccttagccat

SEQ ID NO: 7297300 - DNA, 22 bp, Homo sapiens
acctgctttgtagtgtttgctg

SEQ ID NO: 7297301 - DNA, 22 bp, Homo sapiens
acctgtgttttccctcagtttc

SEQ ID NO: 7297302 - DNA, 22 bp, Homo sapiens
aggtaccaaaagcctttttctg

SEQ ID NO: 7297303 - DNA, 22 bp, Homo sapiens
actgatgtctggggcagagtct

SEQ ID NO: 7297304 - DNA, 22 bp, Homo sapiens
actgattgcattcatagggttt

SEQ ID NO: 7297305 - DNA, 22 bp, Homo sapiens
actgcaacctccgcctgccagg

SEQ ID NO: 7297306 - DNA, 21 bp, Homo sapiens
actgcctgtctccatagtcta

SEQ ID NO: 7297307 - DNA, 23 bp, Homo sapiens
actgcctgtgccgatctctctca

SEQ ID NO: 7297308 - DNA, 22 bp, Homo sapiens
actgcctgtgcactggtctttt

SEQ ID NO: 7297309 - DNA, 22 bp, Homo sapiens
actgcaacctccacctcctggg

SEQ ID NO: 7297310 - DNA, 22 bp, Homo sapiens
actgcaacacctcctgggttca

SEQ ID NO: 7297311 - DNA, 22 bp, Homo sapiens
actgcaacctccacctcctggg

SEQ ID NO: 7297312 - DNA, 20 bp, Homo sapiens
actggacactgaggtgagct

SEQ ID NO: 7297313 - DNA, 20 bp, Homo sapiens
actgctgtagaccatctgca

SEQ ID NO: 7297314 - DNA, 23 bp, Homo sapiens
actgctgtctttgaagtgcttga

SEQ ID NO: 7297315 - DNA, 22 bp, Homo sapiens
actgctattttataacagaaga

SEQ ID NO: 7297316 - DNA, 22 bp, Homo sapiens
actgctgagagcaatcccaaac

SEQ ID NO: 7297317 - DNA, 20 bp, Homo sapiens
actgcttctttctctgacct

SEQ ID NO: 7297318 - DNA, 22 bp, Homo sapiens
actgctgtgttcggctccccgt

SEQ ID NO: 7297319 - DNA, 22 bp, Homo sapiens
actgctgtgatctgatgtaatt

SEQ ID NO: 7297320 - DNA, 22 bp, Homo sapiens
actgcttcctggatggccagca

SEQ ID NO: 7297321 - DNA, 22 bp, Homo sapiens
actcatttgacactttaaactg

SEQ ID NO: 7297322 - DNA, 20 bp, Homo sapiens
actcatttccagcatctgat

SEQ ID NO: 7297323 - DNA, 22 bp, Homo sapiens
actcatttgcatgatgtgctat

SEQ ID NO: 7297324 - DNA, 22 bp, Homo sapiens
actcattttataacactgtagt

SEQ ID NO: 7297325 - DNA, 22 bp, Homo sapiens
agtctacaaagaaaagttattg

SEQ ID NO: 7297326 - DNA, 22 bp, Homo sapiens
agtctctgcatgatgcagcaca

SEQ ID NO: 7297327 - DNA, 20 bp, Homo sapiens
agtctctgtagtgcctgaga

SEQ ID NO: 7297328 - DNA, 22 bp, Homo sapiens
agtctctggggaggagtggaaa

SEQ ID NO: 7297329 - DNA, 22 bp, Homo sapiens
agtctcttaaagacagtgttga

SEQ ID NO: 7297330 - DNA, 22 bp, Homo sapiens
agtctgggaactgggaacgttt

SEQ ID NO: 7297331 - DNA, 17 bp, Homo sapiens
agtctgggacctgcgtg

SEQ ID NO: 7297332 - DNA, 22 bp, Homo sapiens
agtctgggagaaggtgagatta

SEQ ID NO: 7297333 - DNA, 22 bp, Homo sapiens
agtctgggagggatgccagtgt

SEQ ID NO: 7297334 - DNA, 22 bp, Homo sapiens
agtctgggtggctgagctacag

SEQ ID NO: 7297335 - DNA, 22 bp, Homo sapiens
agtctgggtgtgaatgaacttg

SEQ ID NO: 7297336 - DNA, 22 bp, Homo sapiens
actcttcagtacaataatatct

SEQ ID NO: 7297337 - DNA, 22 bp, Homo sapiens
actcttcatacagtcatctaat

SEQ ID NO: 7297338 - DNA, 22 bp, Homo sapiens
actcttcatccctttatcagga

SEQ ID NO: 7297339 - DNA, 22 bp, Homo sapiens
actcttcatgctatgctcaact

SEQ ID NO: 7297340 - DNA, 22 bp, Homo sapiens
agtctggggtctggtagaacga

SEQ ID NO: 7297341 - DNA, 21 bp, Homo sapiens
agtctggggaagggatcccag

SEQ ID NO: 7297342 - DNA, 22 bp, Homo sapiens
agtctgggcatttaggatgttg

SEQ ID NO: 7297343 - DNA, 22 bp, Homo sapiens
agtctgggatgtataaactgaa

SEQ ID NO: 7297344 - DNA, 22 bp, Homo sapiens
agtctgggaggcttataaacag

SEQ ID NO: 7297345 - DNA, 22 bp, Homo sapiens
agtctgggctgtctgcaggagt

SEQ ID NO: 7297346 - DNA, 22 bp, Homo sapiens
actcttcattcaagtatgcaaa

SEQ ID NO: 7297347 - DNA, 22 bp, Homo sapiens
actgaaagtccagcatggtaca

SEQ ID NO: 7297348 - DNA, 23 bp, Homo sapiens
actgaaaggatcctagcagagac

SEQ ID NO: 7297349 - DNA, 22 bp, Homo sapiens
actgaaatatttagaagtgaag

SEQ ID NO: 7297350 - DNA, 22 bp, Homo sapiens
actgaacatatgcaagaccatt

SEQ ID NO: 7297351 - DNA, 22 bp, Homo sapiens
caaatgcagattcaggagttct

SEQ ID NO: 7297352 - DNA, 22 bp, Homo sapiens
caaatgttaagacaggatcaag

SEQ ID NO: 7297353 - DNA, 22 bp, Homo sapiens
caaatgttaaatgtgttaagac

SEQ ID NO: 7297354 - DNA, 22 bp, Homo sapiens
caaatgcatagaaagatgaaac

SEQ ID NO: 7297355 - DNA, 22 bp, Homo sapiens
caaatgttattcattcttgttt

SEQ ID NO: 7297356 - DNA, 22 bp, Homo sapiens
caaatgttgctgtaatgtttgt

SEQ ID NO: 7297357 - DNA, 22 bp, Homo sapiens
caaatgtttcttatctattgtt

SEQ ID NO: 7297358 - DNA, 22 bp, Homo sapiens
caaatgtttggtggcattttgt

SEQ ID NO: 7297359 - DNA, 22 bp, Homo sapiens
caaatgtttttattctacaaca

SEQ ID NO: 7297360 - DNA, 22 bp, Homo sapiens
agcacagagttgcagagagcgt

SEQ ID NO: 7297361 - DNA, 22 bp, Homo sapiens
agcacagagaagatttcaatta

SEQ ID NO: 7297362 - DNA, 22 bp, Homo sapiens
attttctatgttgtaattgtta

SEQ ID NO: 7297363 - DNA, 22 bp, Homo sapiens
attttctatgttgtaattgtta

SEQ ID NO: 7297364 - DNA, 22 bp, Homo sapiens
attttctctcaaaccttaaaat

SEQ ID NO: 7297365 - DNA, 22 bp, Homo sapiens
attttctctttgtatatgctag

SEQ ID NO: 7297366 - DNA, 21 bp, Homo sapiens
attttctctggatgatggtca

SEQ ID NO: 7297367 - DNA, 22 bp, Homo sapiens
agcacaaaaacattcccagagt

SEQ ID NO: 7297368 - DNA, 19 bp, Homo sapiens
caactcttgatactgttag

SEQ ID NO: 7297369 - DNA, 17 bp, Homo sapiens
caacttcacaaactgtc

SEQ ID NO: 7297370 - DNA, 22 bp, Homo sapiens
caactgtgaattttatgatacc

SEQ ID NO: 7297371 - DNA, 22 bp, Homo sapiens
agcagacaacccagatgaccca

SEQ ID NO: 7297372 - DNA, 22 bp, Homo sapiens
agcagaatgtgtgtgacaagta

SEQ ID NO: 7297373 - DNA, 22 bp, Homo sapiens
agcagaatctgggagcagcagt

SEQ ID NO: 7297374 - DNA, 22 bp, Homo sapiens
caactattaccatgttattgtc

SEQ ID NO: 7297375 - DNA, 22 bp, Homo sapiens
caacttcagggaaacatgaagc

SEQ ID NO: 7297376 - DNA, 22 bp, Homo sapiens
agcagcaatggaaagcaacaca

SEQ ID NO: 7297377 - DNA, 22 bp, Homo sapiens
agcagcaggtgacctcgatgcc

SEQ ID NO: 7297378 - DNA, 22 bp, Homo sapiens
caaggcatgcaatgtcttcagg

SEQ ID NO: 7297379 - DNA, 22 bp, Homo sapiens
caaggcatactcctttctcagc

SEQ ID NO: 7297380 - DNA, 22 bp, Homo sapiens
caatcttagagagattctttta

SEQ ID NO: 7297381 - DNA, 22 bp, Homo sapiens
caatgaaaatttaagttgcagc

SEQ ID NO: 7297382 - DNA, 22 bp, Homo sapiens
caatgaaagcaactgcctataa

SEQ ID NO: 7297383 - DNA, 22 bp, Homo sapiens
cacatcatgttaattcattaca

SEQ ID NO: 7297384 - DNA, 22 bp, Homo sapiens
cacatcattcaatggtgatatt

SEQ ID NO: 7297385 - DNA, 22 bp, Homo sapiens
cacatctatagggacagcaaca

SEQ ID NO: 7297386 - DNA, 22 bp, Homo sapiens
cacatgaacatgctggaaaagc

SEQ ID NO: 7297387 - DNA, 22 bp, Homo sapiens
cacatcttcttaactccaaagt

SEQ ID NO: 7297388 - DNA, 22 bp, Homo sapiens
cacatctgcgctctgcctcata

SEQ ID NO: 7297389 - DNA, 22 bp, Homo sapiens
cacatctgacttccagtgcagg

SEQ ID NO: 7297390 - DNA, 22 bp, Homo sapiens
cacagtcacatatctatgtgtg

SEQ ID NO: 7297391 - DNA, 22 bp, Homo sapiens
cacagtcaatgtagaaatatga

SEQ ID NO: 7297392 - DNA, 22 bp, Homo sapiens
agcagggcagtgcttcagctct

SEQ ID NO: 7297393 - DNA, 22 bp, Homo sapiens
caccagggacaatgctaggggt

SEQ ID NO: 7297394 - DNA, 22 bp, Homo sapiens
agcagtttgaatcaatggccag

SEQ ID NO: 7297395 - DNA, 22 bp, Homo sapiens
agcataagttggtacagccact

SEQ ID NO: 7297396 - DNA, 22 bp, Homo sapiens
agcataacacccgacactcagg

SEQ ID NO: 7297397 - DNA, 22 bp, Homo sapiens
cactctgcctgatgttacatgg

SEQ ID NO: 7297398 - DNA, 22 bp, Homo sapiens
agcaggagaacactgtggctct

SEQ ID NO: 7297399 - DNA, 22 bp, Homo sapiens
agcaggagatggggcgtgatgt

SEQ ID NO: 7297400 - DNA, 22 bp, Homo sapiens
agcaggagacatgggggtggtg

SEQ ID NO: 7297401 - DNA, 22 bp, Homo sapiens
agcaggagagcagtgcgtggtc

SEQ ID NO: 7297402 - DNA, 22 bp, Homo sapiens
agcagctgtttgttgaattggt

SEQ ID NO: 7297403 - DNA, 22 bp, Homo sapiens
caatgacatggataatcatatt

SEQ ID NO: 7297404 - DNA, 22 bp, Homo sapiens
cagaggctaagggtagcttggg

SEQ ID NO: 7297405 - DNA, 19 bp, Homo sapiens
cagcaagaatgaaggcata

SEQ ID NO: 7297406 - DNA, 22 bp, Homo sapiens
cagcacagggcttgagaggtgt

SEQ ID NO: 7297407 - DNA, 22 bp, Homo sapiens
cagcagagcttattaactaaaa

SEQ ID NO: 7297408 - DNA, 22 bp, Homo sapiens
cagcagaggtggttcacattgt

SEQ ID NO: 7297409 - DNA, 22 bp, Homo sapiens
cagcagaggttggaacagttct

SEQ ID NO: 7297410 - DNA, 22 bp, Homo sapiens
cagcagagggagccattgaaat

SEQ ID NO: 7297411 - DNA, 22 bp, Homo sapiens
cagcagaggcacgtctgtgaat

SEQ ID NO: 7297412 - DNA, 22 bp, Homo sapiens
cagcagaggaaagcaaatctaa

SEQ ID NO: 7297413 - DNA, 22 bp, Homo sapiens
cagcagaggcacgtctgtgaat

SEQ ID NO: 7297414 - DNA, 22 bp, Homo sapiens
cagcagcagtggctgcagaaca

SEQ ID NO: 7297415 - DNA, 22 bp, Homo sapiens
cagcagaggttttgctccatga

SEQ ID NO: 7297416 - DNA, 22 bp, Homo sapiens
cagcagaggttttgctccatga

SEQ ID NO: 7297417 - DNA, 22 bp, Homo sapiens
cagcagaggttttgctccatga

SEQ ID NO: 7297418 - DNA, 22 bp, Homo sapiens
cagcagcattgctctggattcc

SEQ ID NO: 7297419 - DNA, 22 bp, Homo sapiens
cagcaggataggtttctttgga

SEQ ID NO: 7297420 - DNA, 22 bp, Homo sapiens
cagcaggaggcatggcttccct

SEQ ID NO: 7297421 - DNA, 22 bp, Homo sapiens
cagcaggacccaggaatcctgc

SEQ ID NO: 7297422 - DNA, 22 bp, Homo sapiens
agccttttggagttattctggg

SEQ ID NO: 7297423 - DNA, 22 bp, Homo sapiens
agctcctgaaaagcgcttgctt

SEQ ID NO: 7297424 - DNA, 22 bp, Homo sapiens
agctcccagcagagctggccac

SEQ ID NO: 7297425 - DNA, 22 bp, Homo sapiens
agctcccattatcttctgaaac

SEQ ID NO: 7297426 - DNA, 22 bp, Homo sapiens
agctcccagtctcctctccatg

SEQ ID NO: 7297427 - DNA, 22 bp, Homo sapiens
agctcccctcgtttctctccat

SEQ ID NO: 7297428 - DNA, 22 bp, Homo sapiens
cagccagatcagggcaggggtt

SEQ ID NO: 7297429 - DNA, 22 bp, Homo sapiens
cagccagagaaagggcactgcc

SEQ ID NO: 7297430 - DNA, 22 bp, Homo sapiens
cagccagatcaaactcagatgt

SEQ ID NO: 7297431 - DNA, 22 bp, Homo sapiens
cagccagaggctgcgaggggcc

SEQ ID NO: 7297432 - DNA, 19 bp, Homo sapiens
agcccccagacagcaggcc

SEQ ID NO: 7297433 - DNA, 22 bp, Homo sapiens
cagagctggcctgtgatttttg

SEQ ID NO: 7297434 - DNA, 22 bp, Homo sapiens
agcccaggaagttgaggcttgc

SEQ ID NO: 7297435 - DNA, 22 bp, Homo sapiens
agccaggtgcagtggcacacac

SEQ ID NO: 7297436 - DNA, 22 bp, Homo sapiens
agccaggttaaaccacagtcaa

SEQ ID NO: 7297437 - DNA, 22 bp, Homo sapiens
agccaggtcagctcaccctgct

SEQ ID NO: 7297438 - DNA, 22 bp, Homo sapiens
cagacagacctgcaagggcaca

SEQ ID NO: 7297439 - DNA, 22 bp, Homo sapiens
cagacagagctcacaagtcttt

SEQ ID NO: 7297440 - DNA, 22 bp, Homo sapiens
cagagatgggtcgcagagatgg

SEQ ID NO: 7297441 - DNA, 22 bp, Homo sapiens
cagagcaacaccctttacatcg

SEQ ID NO: 7297442 - DNA, 22 bp, Homo sapiens
agccaggatggtctcgatcggc

SEQ ID NO: 7297443 - DNA, 17 bp, Homo sapiens
cagaaggaagcatggca

SEQ ID NO: 7297444 - DNA, 22 bp, Homo sapiens
agccaggatggtctcgatcggc

SEQ ID NO: 7297445 - DNA, 22 bp, Homo sapiens
cagaagcattgactccttgctc

SEQ ID NO: 7297446 - DNA, 22 bp, Homo sapiens
cagaagcagtgagagatgtgca

SEQ ID NO: 7297447 - DNA, 22 bp, Homo sapiens
cagaagaaatcattatctggac

SEQ ID NO: 7297448 - DNA, 22 bp, Homo sapiens
cagaagaatggtgtctgagctc

SEQ ID NO: 7297449 - DNA, 22 bp, Homo sapiens
cagaagagatgaaatagtatta

SEQ ID NO: 7297450 - DNA, 22 bp, Homo sapiens
cagaagaaatcattatctggac

SEQ ID NO: 7297451 - DNA, 22 bp, Homo sapiens
cagaagaaatcattatctggac

SEQ ID NO: 7297452 - DNA, 22 bp, Homo sapiens
cagaagaaagtggggagacaag

SEQ ID NO: 7297453 - DNA, 22 bp, Homo sapiens
cagaactgggctcgctctggtt

SEQ ID NO: 7297454 - DNA, 22 bp, Homo sapiens
cagaactgttataacagctgtt

SEQ ID NO: 7297455 - DNA, 22 bp, Homo sapiens
cactgaaatattaatatcttat

SEQ ID NO: 7297456 - DNA, 22 bp, Homo sapiens
agccacacctgtcctgccagct

SEQ ID NO: 7297457 - DNA, 22 bp, Homo sapiens
cactgaaatcgaaaaatgtagg

SEQ ID NO: 7297458 - DNA, 22 bp, Homo sapiens
cagaactgggcagggagcagag

SEQ ID NO: 7297459 - DNA, 22 bp, Homo sapiens
atgtttgtcaggattgtaatta

SEQ ID NO: 7297460 - DNA, 22 bp, Homo sapiens
atgtttgtcaggattgtaatta

SEQ ID NO: 7297461 - DNA, 22 bp, Homo sapiens
atgtttgtcaggattgtaatta

SEQ ID NO: 7297462 - DNA, 22 bp, Homo sapiens
atgtttgtaggtaagtgacact

SEQ ID NO: 7297463 - DNA, 22 bp, Homo sapiens
atgtttgtaggtaagtgacact

SEQ ID NO: 7297464 - DNA, 22 bp, Homo sapiens
atgtttgtgttacactctgcag

SEQ ID NO: 7297465 - DNA, 22 bp, Homo sapiens
atgtttgtgttacactctgcag

SEQ ID NO: 7297466 - DNA, 22 bp, Homo sapiens
atgtttgtgggataaacaaatg

SEQ ID NO: 7297467 - DNA, 22 bp, Homo sapiens
atgtttgtccctgacatcctct

SEQ ID NO: 7297468 - DNA, 22 bp, Homo sapiens
atgtttgtccctgacatcctct

SEQ ID NO: 7297469 - DNA, 22 bp, Homo sapiens
atgtttgttgatcatttatgaa

SEQ ID NO: 7297470 - DNA, 22 bp, Homo sapiens
atgtttgttgaacatctactgc

SEQ ID NO: 7297471 - DNA, 22 bp, Homo sapiens
atgtttgttgaacatctactgc

SEQ ID NO: 7297472 - DNA, 22 bp, Homo sapiens
atgtttgttgaacatctactgc

SEQ ID NO: 7297473 - DNA, 22 bp, Homo sapiens
atgttttaaatatgtgtgtaaa

SEQ ID NO: 7297474 - DNA, 22 bp, Homo sapiens
attaaacaatgtaaagttcttg

SEQ ID NO: 7297475 - DNA, 22 bp, Homo sapiens
attaaagaaacccagcatgtga

SEQ ID NO: 7297476 - DNA, 22 bp, Homo sapiens
attagcaagttgttatcctttg

SEQ ID NO: 7297477 - DNA, 22 bp, Homo sapiens
attagcaacatggtgaatatgt

SEQ ID NO: 7297478 - DNA, 22 bp, Homo sapiens
attagcaaaacaacttttctat

SEQ ID NO: 7297479 - DNA, 22 bp, Homo sapiens
attagcatgccaagcttttaga

SEQ ID NO: 7297480 - DNA, 22 bp, Homo sapiens
attagcaattgccctgtgcaat

SEQ ID NO: 7297481 - DNA, 22 bp, Homo sapiens
attagcaatcacgcagtcattt

SEQ ID NO: 7297482 - DNA, 22 bp, Homo sapiens
atgtgtgtaaacaagtataatt

SEQ ID NO: 7297483 - DNA, 22 bp, Homo sapiens
atgtgtgtaaacaagtataatt

SEQ ID NO: 7297484 - DNA, 22 bp, Homo sapiens
atgtgtgtaaacaagtataatt

SEQ ID NO: 7297485 - DNA, 22 bp, Homo sapiens
atgtgtgtaaacaagtataatt

SEQ ID NO: 7297486 - DNA, 22 bp, Homo sapiens
atgtgtgctcttgagccttcac

SEQ ID NO: 7297487 - DNA, 21 bp, Homo sapiens
atgtgtgctagaggactactg

SEQ ID NO: 7297488 - DNA, 22 bp, Homo sapiens
atgtgtgctacaggtgtgggaa

SEQ ID NO: 7297489 - DNA, 22 bp, Homo sapiens
atgttaaagatggtgggaaatt

SEQ ID NO: 7297490 - DNA, 22 bp, Homo sapiens
atgttaaataatcccttaaagc

SEQ ID NO: 7297491 - DNA, 22 bp, Homo sapiens
atgtgtgtacacacgtgactct

SEQ ID NO: 7297492 - DNA, 22 bp, Homo sapiens
atgtgtgtacacacgtgactct

SEQ ID NO: 7297493 - DNA, 22 bp, Homo sapiens
atgtgtgtacacacgtgactct

SEQ ID NO: 7297494 - DNA, 22 bp, Homo sapiens
atgtgtatccatctgtctattt

SEQ ID NO: 7297495 - DNA, 22 bp, Homo sapiens
atgtgtatctaaggtgttctat

SEQ ID NO: 7297496 - DNA, 22 bp, Homo sapiens
atgtgtatctaaggtgttctat

SEQ ID NO: 7297497 - DNA, 22 bp, Homo sapiens
atgtgtatctaaggtgttctat

SEQ ID NO: 7297498 - DNA, 22 bp, Homo sapiens
atgtgtatccatctgtctattt

SEQ ID NO: 7297499 - DNA, 18 bp, Homo sapiens
atgtgtctttcttgtttg

SEQ ID NO: 7297500 - DNA, 22 bp, Homo sapiens
atgtgtctttgagactctgcta

SEQ ID NO: 7297501 - DNA, 18 bp, Homo sapiens
atgtgtctttcttgtttg

SEQ ID NO: 7297502 - DNA, 22 bp, Homo sapiens
atgtgtatgagtgtgcttcttt

SEQ ID NO: 7297503 - DNA, 22 bp, Homo sapiens
atgtgtatgagtgtgcttcttt

SEQ ID NO: 7297504 - DNA, 22 bp, Homo sapiens
atgtgtctttcaaggtatagaa

SEQ ID NO: 7297505 - DNA, 22 bp, Homo sapiens
atgtgtgcatattctgccacct

SEQ ID NO: 7297506 - DNA, 22 bp, Homo sapiens
atgtgtgcaatgctattttggc

SEQ ID NO: 7297507 - DNA, 22 bp, Homo sapiens
atgtgtgcatcaatgatagatc

SEQ ID NO: 7297508 - DNA, 22 bp, Homo sapiens
atgtgtgcatgttagagagagt

SEQ ID NO: 7297509 - DNA, 22 bp, Homo sapiens
atgtgtgccccttttactcttt

SEQ ID NO: 7297510 - DNA, 22 bp, Homo sapiens
atgtgtgctacaggtgtgggaa

SEQ ID NO: 7297511 - DNA, 22 bp, Homo sapiens
atgtgtgcgggaaggaaagtga

SEQ ID NO: 7297512 - DNA, 22 bp, Homo sapiens
atgtgtgcctgagtgatggact

SEQ ID NO: 7297513 - DNA, 22 bp, Homo sapiens
atgtttgactgagtttggcaga

SEQ ID NO: 7297514 - DNA, 22 bp, Homo sapiens
atgtttgaaattgtaagtatat

SEQ ID NO: 7297515 - DNA, 22 bp, Homo sapiens
atgtttatgttgggctatattt

SEQ ID NO: 7297516 - DNA, 22 bp, Homo sapiens
atgttacaatccaacaaaatta

SEQ ID NO: 7297517 - DNA, 22 bp, Homo sapiens
atgttacaatccaacaaaatta

SEQ ID NO: 7297518 - DNA, 22 bp, Homo sapiens
atgttacaaatcctacaggtag

SEQ ID NO: 7297519 - DNA, 22 bp, Homo sapiens
atgttaactgaagccattctcg

SEQ ID NO: 7297520 - DNA, 22 bp, Homo sapiens
atgttaaatggtttattattaa

SEQ ID NO: 7297521 - DNA, 22 bp, Homo sapiens
atgttaaatagccatttgtttg

SEQ ID NO: 7297522 - DNA, 20 bp, Homo sapiens
atgttaaatagcatttagag

SEQ ID NO: 7297523 - DNA, 22 bp, Homo sapiens
attcacacatactcatgtgtga

SEQ ID NO: 7297524 - DNA, 22 bp, Homo sapiens
attcacaattagaagtagataa

SEQ ID NO: 7297525 - DNA, 22 bp, Homo sapiens
attcaaagcccagtaaacattg

SEQ ID NO: 7297526 - DNA, 22 bp, Homo sapiens
attcaaagcccagtaaacattg

SEQ ID NO: 7297527 - DNA, 22 bp, Homo sapiens
attcaaagatcatgatctctac

SEQ ID NO: 7297528 - DNA, 22 bp, Homo sapiens
attatacattttgtgtagagat

SEQ ID NO: 7297529 - DNA, 22 bp, Homo sapiens
attcagctaagtgcttcatgct

SEQ ID NO: 7297530 - DNA, 22 bp, Homo sapiens
attcagctgactttgattcatt

SEQ ID NO: 7297531 - DNA, 22 bp, Homo sapiens
attctggccttggctctgtcac

SEQ ID NO: 7297532 - DNA, 22 bp, Homo sapiens
attctggatattacttatctat

SEQ ID NO: 7297533 - DNA, 22 bp, Homo sapiens
agagggtgaatgagatagaaaa

SEQ ID NO: 7297534 - DNA, 22 bp, Homo sapiens
atttgctgtttctctggccaca

SEQ ID NO: 7297535 - DNA, 22 bp, Homo sapiens
agatgtaccaggtattacagga

SEQ ID NO: 7297536 - DNA, 22 bp, Homo sapiens
atttgcttgtaaatgtatgcct

SEQ ID NO: 7297537 - DNA, 22 bp, Homo sapiens
agcaaacagtgtgctaagaaat

SEQ ID NO: 7297538 - DNA, 22 bp, Homo sapiens
agcaaacagtgtgctaagaaat

SEQ ID NO: 7297539 - DNA, 22 bp, Homo sapiens
agcaaacacaagaggtaatttc

SEQ ID NO: 7297540 - DNA, 17 bp, Homo sapiens
agcaaaagtatcaaagc

SEQ ID NO: 7297541 - DNA, 22 bp, Homo sapiens
atttgctttaaggtataaaagg

SEQ ID NO: 7297542 - DNA, 22 bp, Homo sapiens
atttgctttaaggtataaaagg

SEQ ID NO: 7297543 - DNA, 22 bp, Homo sapiens
atttgctttcaggtataaaagg

SEQ ID NO: 7297544 - DNA, 22 bp, Homo sapiens
atttgctttcaggtataaaagg

SEQ ID NO: 7297545 - DNA, 22 bp, Homo sapiens
agatgaaagatttttatagaga

SEQ ID NO: 7297546 - DNA, 18 bp, Homo sapiens
agatgaaagcaaatgaca

SEQ ID NO: 7297547 - DNA, 22 bp, Homo sapiens
agatgaaagatttttatagaga

SEQ ID NO: 7297548 - DNA, 22 bp, Homo sapiens
agatgaaaatacgtgactttaa

SEQ ID NO: 7297549 - DNA, 22 bp, Homo sapiens
atttattgaagcttattacgtt

SEQ ID NO: 7297550 - DNA, 22 bp, Homo sapiens
agatcttttggttattataaga

SEQ ID NO: 7297551 - DNA, 22 bp, Homo sapiens
atttcattgaagttaattcttc

SEQ ID NO: 7297552 - DNA, 23 bp, Homo sapiens
agatgaaagcttcccatcacagt

SEQ ID NO: 7297553 - DNA, 22 bp, Homo sapiens
atttccaaggtaattttgagta

SEQ ID NO: 7297554 - DNA, 22 bp, Homo sapiens
atttccaatttcatccatgtcc

SEQ ID NO: 7297555 - DNA, 21 bp, Homo sapiens
atttccaaataaggtcacatt

SEQ ID NO: 7297556 - DNA, 22 bp, Homo sapiens
atttccaaaaccacttattgcc

SEQ ID NO: 7297557 - DNA, 22 bp, Homo sapiens
atttccaagaaagctttaggat

SEQ ID NO: 7297558 - DNA, 22 bp, Homo sapiens
atttccaagaaagctttaggat

SEQ ID NO: 7297559 - DNA, 22 bp, Homo sapiens
agatggtggactatctgacttg

SEQ ID NO: 7297560 - DNA, 22 bp, Homo sapiens
agatgggcgcgctgctctgatg

SEQ ID NO: 7297561 - DNA, 20 bp, Homo sapiens
agatggtgaaggccagggag

SEQ ID NO: 7297562 - DNA, 22 bp, Homo sapiens
agatggtgatagagctgggatt

SEQ ID NO: 7297563 - DNA, 22 bp, Homo sapiens
agatggtgagggcagaagtaac

SEQ ID NO: 7297564 - DNA, 22 bp, Homo sapiens
atttaagggatttggagaccaa

SEQ ID NO: 7297565 - DNA, 22 bp, Homo sapiens
atttaagggatttggagaccaa

SEQ ID NO: 7297566 - DNA, 22 bp, Homo sapiens
atttaagattgcgtattcatgt

SEQ ID NO: 7297567 - DNA, 22 bp, Homo sapiens
attgttaataactattacattg

SEQ ID NO: 7297568 - DNA, 22 bp, Homo sapiens
attgttaataactattacattg

SEQ ID NO: 7297569 - DNA, 22 bp, Homo sapiens
atttaacaagacagagaactgg

SEQ ID NO: 7297570 - DNA, 22 bp, Homo sapiens
attcttcatgttgaagctgtca

SEQ ID NO: 7297571 - DNA, 22 bp, Homo sapiens
attcttcctcatcaatctgtag

SEQ ID NO: 7297572 - DNA, 22 bp, Homo sapiens
atttagtaagtacttgttgaat

SEQ ID NO: 7297573 - DNA, 22 bp, Homo sapiens
atttagctttctctcactggtg

SEQ ID NO: 7297574 - DNA, 22 bp, Homo sapiens
atttattgaacactgactatgt

SEQ ID NO: 7297575 - DNA, 22 bp, Homo sapiens
atttattattgtggttacttct

SEQ ID NO: 7297576 - DNA, 22 bp, Homo sapiens
atttagcaagagtacaaaataa

SEQ ID NO: 7297577 - DNA, 22 bp, Homo sapiens
atttagcaaaaaatgatgaagc

SEQ ID NO: 7297578 - DNA, 22 bp, Homo sapiens
agagtggggacagggcctgtcc

SEQ ID NO: 7297579 - DNA, 23 bp, Homo sapiens
atttacaggttaaatgaaatcag

SEQ ID NO: 7297580 - DNA, 22 bp, Homo sapiens
agacacagtgttgaaggctagt

SEQ ID NO: 7297581 - DNA, 22 bp, Homo sapiens
agacacagtgttgaaggctagt

SEQ ID NO: 7297582 - DNA, 22 bp, Homo sapiens
agacacagtgagtttctttccc

SEQ ID NO: 7297583 - DNA, 21 bp, Homo sapiens
agacacaggggttgctggggt

SEQ ID NO: 7297584 - DNA, 22 bp, Homo sapiens
agacacaggattctgcatttct

SEQ ID NO: 7297585 - DNA, 22 bp, Homo sapiens
agacacaggattctgcatttct

SEQ ID NO: 7297586 - DNA, 22 bp, Homo sapiens
agacacagtctgtctggaggag

SEQ ID NO: 7297587 - DNA, 17 bp, Homo sapiens
agacagtgagtgccttg

SEQ ID NO: 7297588 - DNA, 22 bp, Homo sapiens
agacagtgaggcagagcttccg

SEQ ID NO: 7297589 - DNA, 22 bp, Homo sapiens
agacagtgatggacaggcagac

SEQ ID NO: 7297590 - DNA, 22 bp, Homo sapiens
agacagtgattcttcacatttc

SEQ ID NO: 7297591 - DNA, 22 bp, Homo sapiens
agacagtgatgtaagcaggagt

SEQ ID NO: 7297592 - DNA, 22 bp, Homo sapiens
agacagtgattcttcacatttc

SEQ ID NO: 7297593 - DNA, 22 bp, Homo sapiens
agacagtgcaagaagagcaggc

SEQ ID NO: 7297594 - DNA, 22 bp, Homo sapiens
agacagtgcaagaagagcaggc

SEQ ID NO: 7297595 - DNA, 22 bp, Homo sapiens
agacagtgctatcccatctgtg

SEQ ID NO: 7297596 - DNA, 22 bp, Homo sapiens
agacacagaacacaaaagcata

SEQ ID NO: 7297597 - DNA, 19 bp, Homo sapiens
agacacacttgatatgtgt

SEQ ID NO: 7297598 - DNA, 22 bp, Homo sapiens
agacaatttcaaagtaatatta

SEQ ID NO: 7297599 - DNA, 22 bp, Homo sapiens
agacaatttttggttttgcaag

SEQ ID NO: 7297600 - DNA, 22 bp, Homo sapiens
agacacagcagtgcctgcctca

SEQ ID NO: 7297601 - DNA, 22 bp, Homo sapiens
agacacagatggtacctgagcc

SEQ ID NO: 7297602 - DNA, 22 bp, Homo sapiens
agacacagaagttgctgttggg

SEQ ID NO: 7297603 - DNA, 22 bp, Homo sapiens
agaattagtcacaattatagga

SEQ ID NO: 7297604 - DNA, 22 bp, Homo sapiens
agaatgatactctatgccaaat

SEQ ID NO: 7297605 - DNA, 22 bp, Homo sapiens
agaagcacaccagtagacaggg

SEQ ID NO: 7297606 - DNA, 23 bp, Homo sapiens
agaagcaatgctttttttcctct

SEQ ID NO: 7297607 - DNA, 22 bp, Homo sapiens
atcttatgttgtattcaaaatc

SEQ ID NO: 7297608 - DNA, 22 bp, Homo sapiens
atctttaatttggatcagggcc

SEQ ID NO: 7297609 - DNA, 22 bp, Homo sapiens
agaagagaactgccaaacactt

SEQ ID NO: 7297610 - DNA, 21 bp, Homo sapiens
agaagagaagcaggaccctct

SEQ ID NO: 7297611 - DNA, 22 bp, Homo sapiens
agaagagagtcctaccccatac

SEQ ID NO: 7297612 - DNA, 22 bp, Homo sapiens
agaagagagtcctaccccatac

SEQ ID NO: 7297613 - DNA, 20 bp, Homo sapiens
agaagaggatacaaccaggc

SEQ ID NO: 7297614 - DNA, 22 bp, Homo sapiens
agaagatgtcactgcagacagc

SEQ ID NO: 7297615 - DNA, 22 bp, Homo sapiens
agaagaatttctctcatgattt

SEQ ID NO: 7297616 - DNA, 22 bp, Homo sapiens
agaagagaaatagtgccactgt

SEQ ID NO: 7297617 - DNA, 22 bp, Homo sapiens
agaagagaactgccaaacactt

SEQ ID NO: 7297618 - DNA, 22 bp, Homo sapiens
agaagagaaatagtgccactgt

SEQ ID NO: 7297619 - DNA, 22 bp, Homo sapiens
atctttggggcatccaggaaaa

SEQ ID NO: 7297620 - DNA, 19 bp, Homo sapiens
atctttgggtcctgaaggg

SEQ ID NO: 7297621 - DNA, 22 bp, Homo sapiens
atctttgggtacaaacttgcct

SEQ ID NO: 7297622 - DNA, 22 bp, Homo sapiens
atctttggtactattcttatca

SEQ ID NO: 7297623 - DNA, 22 bp, Homo sapiens
atctttggtcttgagtgcatct

SEQ ID NO: 7297624 - DNA, 22 bp, Homo sapiens
atctttggtgcatgatactttg

SEQ ID NO: 7297625 - DNA, 22 bp, Homo sapiens
atctttgtgaatctcaacttgg

SEQ ID NO: 7297626 - DNA, 22 bp, Homo sapiens
atctttggtgcttggtgctccc

SEQ ID NO: 7297627 - DNA, 22 bp, Homo sapiens
agaatacagtatgcaaaaagat

SEQ ID NO: 7297628 - DNA, 22 bp, Homo sapiens
agaatacaccacaggccgaaat

SEQ ID NO: 7297629 - DNA, 22 bp, Homo sapiens
atgtacacatgcatgcatgtgc

SEQ ID NO: 7297630 - DNA, 22 bp, Homo sapiens
atgggtgtgaaaatggtcatct

SEQ ID NO: 7297631 - DNA, 22 bp, Homo sapiens
atggtttgtaacccaatactcc

SEQ ID NO: 7297632 - DNA, 22 bp, Homo sapiens
atgggaggcagcagagcccagc

SEQ ID NO: 7297633 - DNA, 22 bp, Homo sapiens
atgggaggcagcagagcccagc

SEQ ID NO: 7297634 - DNA, 22 bp, Homo sapiens
atggctgtagtcatctgaaggc

SEQ ID NO: 7297635 - DNA, 22 bp, Homo sapiens
atgtacagccacttcacagtta

SEQ ID NO: 7297636 - DNA, 22 bp, Homo sapiens
atgtacactttggaagagtcac

SEQ ID NO: 7297637 - DNA, 22 bp, Homo sapiens
atgtacaggatggtgctcatct

SEQ ID NO: 7297638 - DNA, 22 bp, Homo sapiens
atgtacataaaatgtataatga

SEQ ID NO: 7297639 - DNA, 22 bp, Homo sapiens
atgtacataaaatgtataatga

SEQ ID NO: 7297640 - DNA, 22 bp, Homo sapiens
atgtacagtggaaactaacaaa

SEQ ID NO: 7297641 - DNA, 22 bp, Homo sapiens
atgtacagtttctagactcaaa

SEQ ID NO: 7297642 - DNA, 22 bp, Homo sapiens
atgtacagtttctagactcaaa

SEQ ID NO: 7297643 - DNA, 22 bp, Homo sapiens
atgtccaatttcagagtctcat

SEQ ID NO: 7297644 - DNA, 22 bp, Homo sapiens
atgtcaaatgctgcaaactcat

SEQ ID NO: 7297645 - DNA, 21 bp, Homo sapiens
atgtcaaatgctttattttat

SEQ ID NO: 7297646 - DNA, 22 bp, Homo sapiens
atgtctgtggcaattgttgatg

SEQ ID NO: 7297647 - DNA, 18 bp, Homo sapiens
atgtctgtgcactggata

SEQ ID NO: 7297648 - DNA, 22 bp, Homo sapiens
atgtctgtctttgtactccaca

SEQ ID NO: 7297649 - DNA, 22 bp, Homo sapiens
atgtctgtctatagccatgaga

SEQ ID NO: 7297650 - DNA, 22 bp, Homo sapiens
atgtctgttcattattaactgc

SEQ ID NO: 7297651 - DNA, 22 bp, Homo sapiens
atgtctgttaatcgaccctaat

SEQ ID NO: 7297652 - DNA, 22 bp, Homo sapiens
atgtctgtgttatctgtagaat

SEQ ID NO: 7297653 - DNA, 22 bp, Homo sapiens
atgtctgtgtgatcttggataa

SEQ ID NO: 7297654 - DNA, 22 bp, Homo sapiens
atgtctgtggcattatatgttt

SEQ ID NO: 7297655 - DNA, 22 bp, Homo sapiens
atgtctgtggcattatatgttt

SEQ ID NO: 7297656 - DNA, 19 bp, Homo sapiens
atgtctgttgaatttcata

SEQ ID NO: 7297657 - DNA, 22 bp, Homo sapiens
atgtctgtttatccttcaagat

SEQ ID NO: 7297658 - DNA, 21 bp, Homo sapiens
atgtctgttctttctggcagg

SEQ ID NO: 7297659 - DNA, 21 bp, Homo sapiens
atgtctgttctgattggtgcg

SEQ ID NO: 7297660 - DNA, 21 bp, Homo sapiens
atgtctgttctgattggtgcg

SEQ ID NO: 7297661 - DNA, 22 bp, Homo sapiens
atgtctgttttcatatcagata

SEQ ID NO: 7297662 - DNA, 22 bp, Homo sapiens
atgtctgtttgctgagcccggc

SEQ ID NO: 7297663 - DNA, 22 bp, Homo sapiens
atgtctgtttatccttcaagat

SEQ ID NO: 7297664 - DNA, 22 bp, Homo sapiens
atgtctgttttcatatcagata

SEQ ID NO: 7297665 - DNA, 22 bp, Homo sapiens
atgtctgtatgtggagaggggt

SEQ ID NO: 7297666 - DNA, 22 bp, Homo sapiens
atgtctgtcatcttccaggaag

SEQ ID NO: 7297667 - DNA, 22 bp, Homo sapiens
atgtctgtcccctagccctgat

SEQ ID NO: 7297668 - DNA, 22 bp, Homo sapiens
atgtctgtccaaccctgcaggg

SEQ ID NO: 7297669 - DNA, 22 bp, Homo sapiens
atgtctgtacgagttacaatgg

SEQ ID NO: 7297670 - DNA, 22 bp, Homo sapiens
atgtctgtacgagttacaatgg

SEQ ID NO: 7297671 - DNA, 22 bp, Homo sapiens
atggcagatggctggagcaggt

SEQ ID NO: 7297672 - DNA, 21 bp, Homo sapiens
atggctggtggctcagcctcc

SEQ ID NO: 7297673 - DNA, 22 bp, Homo sapiens
atggaaatacagccagagcaga

SEQ ID NO: 7297674 - DNA, 22 bp, Homo sapiens
atggaaagggaagcaaggaaca

SEQ ID NO: 7297675 - DNA, 19 bp, Homo sapiens
atggaaaattgtactcaat

SEQ ID NO: 7297676 - DNA, 22 bp, Homo sapiens
agactcatgacacttcctatga

SEQ ID NO: 7297677 - DNA, 23 bp, Homo sapiens
atggaaatagcatgtgtcattta

SEQ ID NO: 7297678 - DNA, 23 bp, Homo sapiens
atggaaatagcatgtgtcattta

SEQ ID NO: 7297679 - DNA, 19 bp, Homo sapiens
caggacagacttcaaagcc

SEQ ID NO: 7297680 - DNA, 22 bp, Homo sapiens
caggaaaaatgccaggagtcag

SEQ ID NO: 7297681 - DNA, 21 bp, Homo sapiens
caggaaaagcggaagtctagc

SEQ ID NO: 7297682 - DNA, 22 bp, Homo sapiens
caggaaaaggagactttagcac

SEQ ID NO: 7297683 - DNA, 22 bp, Homo sapiens
cagctctgaagaaaggtgtcta

SEQ ID NO: 7297684 - DNA, 22 bp, Homo sapiens
cagctcctgggccatctcctag

SEQ ID NO: 7297685 - DNA, 22 bp, Homo sapiens
cagctcctgcctgggcagctgt

SEQ ID NO: 7297686 - DNA, 22 bp, Homo sapiens
agctctggaagccctggtagtt

SEQ ID NO: 7297687 - DNA, 18 bp, Homo sapiens
agctctcccccacatgcc

SEQ ID NO: 7297688 - DNA, 21 bp, Homo sapiens
agctgcagcccaaaggcctgt

SEQ ID NO: 7297689 - DNA, 22 bp, Homo sapiens
agctgaggctctgagagggaag

SEQ ID NO: 7297690 - DNA, 22 bp, Homo sapiens
agctgaggccacgagtgaaggg

SEQ ID NO: 7297691 - DNA, 22 bp, Homo sapiens
agctgcaggcgccggggccgat

SEQ ID NO: 7297692 - DNA, 22 bp, Homo sapiens
agcttacagttcaatgacaaag

SEQ ID NO: 7297693 - DNA, 22 bp, Homo sapiens
agcttacaccccccaagattct

SEQ ID NO: 7297694 - DNA, 22 bp, Homo sapiens
agcttaaagtatttaaatttca

SEQ ID NO: 7297695 - DNA, 20 bp, Homo sapiens
agcttgcccctgtctttgcc

SEQ ID NO: 7297696 - DNA, 22 bp, Homo sapiens
agctgtgtgcatttgggtctca

SEQ ID NO: 7297697 - DNA, 22 bp, Homo sapiens
agctgtggccagatgtgagcgg

SEQ ID NO: 7297698 - DNA, 22 bp, Homo sapiens
caggcctcaggggctcaggctg

SEQ ID NO: 7297699 - DNA, 22 bp, Homo sapiens
caggcctcaccagcggagctgc

SEQ ID NO: 7297700 - DNA, 22 bp, Homo sapiens
aggaagctcctggagagccagt

SEQ ID NO: 7297701 - DNA, 22 bp, Homo sapiens
aggaagctcctggagagccagt

SEQ ID NO: 7297702 - DNA, 18 bp, Homo sapiens
aggaagcaggaggaaggc

SEQ ID NO: 7297703 - DNA, 22 bp, Homo sapiens
aggaaattgtctttttccttgt

SEQ ID NO: 7297704 - DNA, 22 bp, Homo sapiens
aggaaattgagaatcagaataa

SEQ ID NO: 7297705 - DNA, 22 bp, Homo sapiens
aggaaatgtacaaatgaagatg

SEQ ID NO: 7297706 - DNA, 22 bp, Homo sapiens
aggaacaattgataaactcaca

SEQ ID NO: 7297707 - DNA, 22 bp, Homo sapiens
aggaaaggggtaggtgtggacg

SEQ ID NO: 7297708 - DNA, 22 bp, Homo sapiens
aggaaagactggggccccagaa

SEQ ID NO: 7297709 - DNA, 18 bp, Homo sapiens
aggaaagacgaagagggc

SEQ ID NO: 7297710 - DNA, 18 bp, Homo sapiens
aggaaagacgaagagggc

SEQ ID NO: 7297711 - DNA, 18 bp, Homo sapiens
aggaaagacgaagagggc

SEQ ID NO: 7297712 - DNA, 22 bp, Homo sapiens
aggaaagaagtacattctcatg

SEQ ID NO: 7297713 - DNA, 22 bp, Homo sapiens
agctttacatcgaagttcagtc

SEQ ID NO: 7297714 - DNA, 22 bp, Homo sapiens
agctttacctgaaatttgatcc

SEQ ID NO: 7297715 - DNA, 22 bp, Homo sapiens
agcttgtctttcaaaggagttt

SEQ ID NO: 7297716 - DNA, 22 bp, Homo sapiens
cagggccagagagggctggctg

SEQ ID NO: 7297717 - DNA, 22 bp, Homo sapiens
aggaaagatggaaggaggataa

SEQ ID NO: 7297718 - DNA, 22 bp, Homo sapiens
aggaaagatggaaggaggataa

SEQ ID NO: 7297719 - DNA, 22 bp, Homo sapiens
aggaaggactgcagcatttggt

SEQ ID NO: 7297720 - DNA, 22 bp, Homo sapiens
aggaagctgggaaactgacatt

SEQ ID NO: 7297721 - DNA, 22 bp, Homo sapiens
aggaagctgggaaactgacatt

SEQ ID NO: 7297722 - DNA, 22 bp, Homo sapiens
aggaagctggggtgttcttcat

SEQ ID NO: 7297723 - DNA, 22 bp, Homo sapiens
cagtcctgcccaggctgacaga

SEQ ID NO: 7297724 - DNA, 18 bp, Homo sapiens
aggagaaagggaccaggg

SEQ ID NO: 7297725 - DNA, 22 bp, Homo sapiens
aggacagcatatgggaaccagt

SEQ ID NO: 7297726 - DNA, 23 bp, Homo sapiens
aggagaagagatttccacatgca

SEQ ID NO: 7297727 - DNA, 22 bp, Homo sapiens
cagtctctgccacttctaagct

SEQ ID NO: 7297728 - DNA, 22 bp, Homo sapiens
cagtctcttttcagctccatcc

SEQ ID NO: 7297729 - DNA, 22 bp, Homo sapiens
cagtctcttttcagctccatcc

SEQ ID NO: 7297730 - DNA, 22 bp, Homo sapiens
cagtctctggcagctgctggcc

SEQ ID NO: 7297731 - DNA, 22 bp, Homo sapiens
cagtctctgtgccagatcctgg

SEQ ID NO: 7297732 - DNA, 22 bp, Homo sapiens
aggagctgatagtctatggaga

SEQ ID NO: 7297733 - DNA, 22 bp, Homo sapiens
aggaggaggtaagaaaagcata

SEQ ID NO: 7297734 - DNA, 22 bp, Homo sapiens
aggaggagcagctttttgtctc

SEQ ID NO: 7297735 - DNA, 22 bp, Homo sapiens
aggaggaattgacacagaagcc

SEQ ID NO: 7297736 - DNA, 22 bp, Homo sapiens
aggagccatgagcaggaggcaa

SEQ ID NO: 7297737 - DNA, 22 bp, Homo sapiens
aggagataagaggctggtgtgg

SEQ ID NO: 7297738 - DNA, 22 bp, Homo sapiens
aggagatagtcaaagcttcttg

SEQ ID NO: 7297739 - DNA, 18 bp, Homo sapiens
aggagcctttgcactgga

SEQ ID NO: 7297740 - DNA, 22 bp, Homo sapiens
aggagctcacatctttatttct

SEQ ID NO: 7297741 - DNA, 22 bp, Homo sapiens
aggagctcagccattcatttga

SEQ ID NO: 7297742 - DNA, 22 bp, Homo sapiens
aggagagagctgagctttgctg

SEQ ID NO: 7297743 - DNA, 22 bp, Homo sapiens
catttacagcagactgatgaaa

SEQ ID NO: 7297744 - DNA, 22 bp, Homo sapiens
aggcagccatccaggaggctca

SEQ ID NO: 7297745 - DNA, 22 bp, Homo sapiens
aggcagccagatggcagcctgc

SEQ ID NO: 7297746 - DNA, 22 bp, Homo sapiens
aggcagcatttgaatccaggtc

SEQ ID NO: 7297747 - DNA, 22 bp, Homo sapiens
aggcagccaatcagaggctgac

SEQ ID NO: 7297748 - DNA, 22 bp, Homo sapiens
cattaacactttggatttagac

SEQ ID NO: 7297749 - DNA, 22 bp, Homo sapiens
cattaacactttggatttagac

SEQ ID NO: 7297750 - DNA, 22 bp, Homo sapiens
catggccttcacctcccctgcc

SEQ ID NO: 7297751 - DNA, 22 bp, Homo sapiens
catggcctctctcctggaatgg

SEQ ID NO: 7297752 - DNA, 22 bp, Homo sapiens
catggccctcttctggagcaat

SEQ ID NO: 7297753 - DNA, 22 bp, Homo sapiens
cattatgcaaagaacacttgag

SEQ ID NO: 7297754 - DNA, 22 bp, Homo sapiens
cattatgtgggaaaatgttctt

SEQ ID NO: 7297755 - DNA, 22 bp, Homo sapiens
cattcctacatgataagaatta

SEQ ID NO: 7297756 - DNA, 22 bp, Homo sapiens
cattcatttgcccagtaagtca

SEQ ID NO: 7297757 - DNA, 18 bp, Homo sapiens
cattccaagttctacctc

SEQ ID NO: 7297758 - DNA, 22 bp, Homo sapiens
catgaaaatgtcaagttctgct

SEQ ID NO: 7297759 - DNA, 22 bp, Homo sapiens
catctttaaaatgggaacaaca

SEQ ID NO: 7297760 - DNA, 17 bp, Homo sapiens
catctttaaaatcctga

SEQ ID NO: 7297761 - DNA, 22 bp, Homo sapiens
aggaggtggcaactgtcgacag

SEQ ID NO: 7297762 - DNA, 22 bp, Homo sapiens
aggaggtgctgtttgtcctgga

SEQ ID NO: 7297763 - DNA, 22 bp, Homo sapiens
aggaggtgtagatttcctgtca

SEQ ID NO: 7297764 - DNA, 22 bp, Homo sapiens
aggaggtgtagatttcctgtca

SEQ ID NO: 7297765 - DNA, 22 bp, Homo sapiens
aggaggtggcctgagcgtgccc

SEQ ID NO: 7297766 - DNA, 22 bp, Homo sapiens
aggaggtggctgaacttgaggg

SEQ ID NO: 7297767 - DNA, 22 bp, Homo sapiens
catgcctctgcagctgtttatt

SEQ ID NO: 7297768 - DNA, 22 bp, Homo sapiens
catgccatgtgtgaggagagga

SEQ ID NO: 7297769 - DNA, 22 bp, Homo sapiens
catgcaggcctatggagcagtg

SEQ ID NO: 7297770 - DNA, 22 bp, Homo sapiens
aggcacaggaatgtcatccagt

SEQ ID NO: 7297771 - DNA, 22 bp, Homo sapiens
ccactggagatgtcagacaggt

SEQ ID NO: 7297772 - DNA, 22 bp, Homo sapiens
ccactgctcggcctcaaagaag

SEQ ID NO: 7297773 - DNA, 22 bp, Homo sapiens
aggcatttaaagatgtaagact

SEQ ID NO: 7297774 - DNA, 22 bp, Homo sapiens
aggcagttctcgtgtgtgtccc

SEQ ID NO: 7297775 - DNA, 22 bp, Homo sapiens
aggcagttgtagagagggctct

SEQ ID NO: 7297776 - DNA, 22 bp, Homo sapiens
aggcatatgattgtaaccttta

SEQ ID NO: 7297777 - DNA, 22 bp, Homo sapiens
aggcatctctctgcttctgagc

SEQ ID NO: 7297778 - DNA, 22 bp, Homo sapiens
aggcagtggagctggaataggc

SEQ ID NO: 7297779 - DNA, 22 bp, Homo sapiens
aggcagccctgtgctggatgct

SEQ ID NO: 7297780 - DNA, 22 bp, Homo sapiens
aggccaggacacttaagtaaga

SEQ ID NO: 7297781 - DNA, 22 bp, Homo sapiens
aggccaggaccattagcccaga

SEQ ID NO: 7297782 - DNA, 22 bp, Homo sapiens
aggccaggatagcatggatcag

SEQ ID NO: 7297783 - DNA, 22 bp, Homo sapiens
aggcccagtgtggcttcctgga

SEQ ID NO: 7297784 - DNA, 22 bp, Homo sapiens
aggccctctcattccagaggca

SEQ ID NO: 7297785 - DNA, 22 bp, Homo sapiens
aggccctgacctgggagatcta

SEQ ID NO: 7297786 - DNA, 22 bp, Homo sapiens
aggcccccacaggcttgaggca

SEQ ID NO: 7297787 - DNA, 20 bp, Homo sapiens
aggccccaggaaactctcag

SEQ ID NO: 7297788 - DNA, 20 bp, Homo sapiens
aggccccaggaaactctcag

SEQ ID NO: 7297789 - DNA, 22 bp, Homo sapiens
aggccaagggcaaagcggagag

SEQ ID NO: 7297790 - DNA, 22 bp, Homo sapiens
aggccaaagcacagagctggaa

SEQ ID NO: 7297791 - DNA, 22 bp, Homo sapiens
ccagtgagaatgaagataaggc

SEQ ID NO: 7297792 - DNA, 22 bp, Homo sapiens
ccagtctgtactttgctctgtt

SEQ ID NO: 7297793 - DNA, 22 bp, Homo sapiens
ccagttactaacacctttggct

SEQ ID NO: 7297794 - DNA, 22 bp, Homo sapiens
ccagttacaagtgattcttggt

SEQ ID NO: 7297795 - DNA, 22 bp, Homo sapiens
ccagttgtttgccttgaaatga

SEQ ID NO: 7297796 - DNA, 19 bp, Homo sapiens
aggctctgagctcctggag

SEQ ID NO: 7297797 - DNA, 22 bp, Homo sapiens
aggcctcagtttgtcatctgta

SEQ ID NO: 7297798 - DNA, 22 bp, Homo sapiens
aggcctcattgcccacctgtgg

SEQ ID NO: 7297799 - DNA, 22 bp, Homo sapiens
aggcctccagccacatgccagt

SEQ ID NO: 7297800 - DNA, 22 bp, Homo sapiens
aggcctcagcctgccaggcctg

SEQ ID NO: 7297801 - DNA, 22 bp, Homo sapiens
ccaggcccttgcaagtcccacc

SEQ ID NO: 7297802 - DNA, 22 bp, Homo sapiens
ccaggccctgctcctcacacca

SEQ ID NO: 7297803 - DNA, 22 bp, Homo sapiens
ccaggcccttgcaagtcccacc

SEQ ID NO: 7297804 - DNA, 22 bp, Homo sapiens
ccaggccctgctcctcacacca

SEQ ID NO: 7297805 - DNA, 22 bp, Homo sapiens
ccaggccctgcctgtggttcct

SEQ ID NO: 7297806 - DNA, 22 bp, Homo sapiens
ccaggccctgctcctcacacca

SEQ ID NO: 7297807 - DNA, 22 bp, Homo sapiens
ccaggcccgttcccttctccag

SEQ ID NO: 7297808 - DNA, 22 bp, Homo sapiens
ccaggcctcacctgcccaccta

SEQ ID NO: 7297809 - DNA, 22 bp, Homo sapiens
ccaggctctgagcctcactctt

SEQ ID NO: 7297810 - DNA, 22 bp, Homo sapiens
ccaggctctgcgctggacatgg

SEQ ID NO: 7297811 - DNA, 19 bp, Homo sapiens
agggccaggattctggaac

SEQ ID NO: 7297812 - DNA, 19 bp, Homo sapiens
agggccaggattctggaac

SEQ ID NO: 7297813 - DNA, 22 bp, Homo sapiens
agggccaggatcacagccaaga

SEQ ID NO: 7297814 - DNA, 22 bp, Homo sapiens
agggccaggaacacctgaaggg

SEQ ID NO: 7297815 - DNA, 18 bp, Homo sapiens
agggccagctgtgagtag

SEQ ID NO: 7297816 - DNA, 22 bp, Homo sapiens
agggccagctgatgagaatgag

SEQ ID NO: 7297817 - DNA, 22 bp, Homo sapiens
agggccagctgatgagaatgag

SEQ ID NO: 7297818 - DNA, 22 bp, Homo sapiens
agggccagctgcagaattagca

SEQ ID NO: 7297819 - DNA, 22 bp, Homo sapiens
agggccagccgacttccagcct

SEQ ID NO: 7297820 - DNA, 22 bp, Homo sapiens
agggccagctagagccctcgcc

SEQ ID NO: 7297821 - DNA, 22 bp, Homo sapiens
agggccaggctcccatgtcagg

SEQ ID NO: 7297822 - DNA, 22 bp, Homo sapiens
agggccaggctcccatgtcagg

SEQ ID NO: 7297823 - DNA, 22 bp, Homo sapiens
agggccagggaaacgatcagca

SEQ ID NO: 7297824 - DNA, 22 bp, Homo sapiens
ccctgggatggattggcaggaa

SEQ ID NO: 7297825 - DNA, 22 bp, Homo sapiens
ccctggcccctcactccgaggc

SEQ ID NO: 7297826 - DNA, 22 bp, Homo sapiens
ccctggcccctcactccgaggc

SEQ ID NO: 7297827 - DNA, 22 bp, Homo sapiens
ccctgggattgccttggccttg

SEQ ID NO: 7297828 - DNA, 22 bp, Homo sapiens
agggcagcctctcagcctaggt

SEQ ID NO: 7297829 - DNA, 22 bp, Homo sapiens
agggcagcccttctgggagggc

SEQ ID NO: 7297830 - DNA, 22 bp, Homo sapiens
agggccagagtggcaaaagcct

SEQ ID NO: 7297831 - DNA, 22 bp, Homo sapiens
agggccagccccaccctctctg

SEQ ID NO: 7297832 - DNA, 22 bp, Homo sapiens
agggcagcccttctgggagggc

SEQ ID NO: 7297833 - DNA, 22 bp, Homo sapiens
agggcagccattgagggattct

SEQ ID NO: 7297834 - DNA, 22 bp, Homo sapiens
cctccccacaggccaaataggc

SEQ ID NO: 7297835 - DNA, 22 bp, Homo sapiens
cctccaggaggaaatggaacac

SEQ ID NO: 7297836 - DNA, 22 bp, Homo sapiens
cctccaggaggaaatggaacac

SEQ ID NO: 7297837 - DNA, 22 bp, Homo sapiens
cctccaggaacttgagagacac

SEQ ID NO: 7297838 - DNA, 22 bp, Homo sapiens
cctccaggctgaatatctagaa

SEQ ID NO: 7297839 - DNA, 22 bp, Homo sapiens
cctccaggataagtcagggcct

SEQ ID NO: 7297840 - DNA, 21 bp, Homo sapiens
ccccatggagtacagttgggc

SEQ ID NO: 7297841 - DNA, 22 bp, Homo sapiens
agggagctttttcatgtgtcta

SEQ ID NO: 7297842 - DNA, 22 bp, Homo sapiens
agggagcagcagccacaggatg

SEQ ID NO: 7297843 - DNA, 22 bp, Homo sapiens
agggagcagcagccacaggatg

SEQ ID NO: 7297844 - DNA, 22 bp, Homo sapiens
agggagcagcagccacaggatg

SEQ ID NO: 7297845 - DNA, 22 bp, Homo sapiens
agggagccagagttgggagctc

SEQ ID NO: 7297846 - DNA, 22 bp, Homo sapiens
agggagcatgggtgaagcaggc

SEQ ID NO: 7297847 - DNA, 22 bp, Homo sapiens
agggagcatgggtgaagcaggc

SEQ ID NO: 7297848 - DNA, 22 bp, Homo sapiens
agggagcattgtgacatatcac

SEQ ID NO: 7297849 - DNA, 19 bp, Homo sapiens
agggagaattccaagagga

SEQ ID NO: 7297850 - DNA, 22 bp, Homo sapiens
agggagaatgaccaaggtatat

SEQ ID NO: 7297851 - DNA, 22 bp, Homo sapiens
agggaatgctccgtataaatct

SEQ ID NO: 7297852 - DNA, 19 bp, Homo sapiens
agggaatccggctgaggga

SEQ ID NO: 7297853 - DNA, 22 bp, Homo sapiens
agggaaggaggttagaacccac

SEQ ID NO: 7297854 - DNA, 22 bp, Homo sapiens
agggaaggaggttagaacccac

SEQ ID NO: 7297855 - DNA, 22 bp, Homo sapiens
agggaaggaggccatgtgtccc

SEQ ID NO: 7297856 - DNA, 22 bp, Homo sapiens
agggaagaatcactgggatgtt

SEQ ID NO: 7297857 - DNA, 22 bp, Homo sapiens
ccatgaattcactccatgctag

SEQ ID NO: 7297858 - DNA, 22 bp, Homo sapiens
ccatgacattttaattttcact

SEQ ID NO: 7297859 - DNA, 22 bp, Homo sapiens
ccagtttttccagtgctttctg

SEQ ID NO: 7297860 - DNA, 22 bp, Homo sapiens
cccagcagtgacccagtgatac

SEQ ID NO: 7297861 - DNA, 22 bp, Homo sapiens
cccagcagttgttggtgcacat

SEQ ID NO: 7297862 - DNA, 22 bp, Homo sapiens
aggctgtgttctgccctctccc

SEQ ID NO: 7297863 - DNA, 22 bp, Homo sapiens
aggctgtgtaaagtgctttccc

SEQ ID NO: 7297864 - DNA, 22 bp, Homo sapiens
aggctgtgtggatgagtcttac

SEQ ID NO: 7297865 - DNA, 22 bp, Homo sapiens
aggctgtgtttcttgcgttttc

SEQ ID NO: 7297866 - DNA, 22 bp, Homo sapiens
atatttctgggggtgtgtttct

SEQ ID NO: 7297867 - DNA, 20 bp, Homo sapiens
atatttcttaagaactttca

SEQ ID NO: 7297868 - DNA, 22 bp, Homo sapiens
atatttctgggggtgtgtttct

SEQ ID NO: 7297869 - DNA, 22 bp, Homo sapiens
atatttggaaagaaaatcattg

SEQ ID NO: 7297870 - DNA, 22 bp, Homo sapiens
atatttgcaggaaactagtttt

SEQ ID NO: 7297871 - DNA, 22 bp, Homo sapiens
atatttgcaggaaactagtttt

SEQ ID NO: 7297872 - DNA, 22 bp, Homo sapiens
atatttgcaggaaactagtttt

SEQ ID NO: 7297873 - DNA, 22 bp, Homo sapiens
atatttgtagtgggtaagaagt

SEQ ID NO: 7297874 - DNA, 22 bp, Homo sapiens
atatttgtaaaattctgtgtct

SEQ ID NO: 7297875 - DNA, 22 bp, Homo sapiens
atatttgtaaaattctgtgtct

SEQ ID NO: 7297876 - DNA, 22 bp, Homo sapiens
atatttgtatttcgtgtgtgta

SEQ ID NO: 7297877 - DNA, 22 bp, Homo sapiens
atatttgtagtgggtaagaagt

SEQ ID NO: 7297878 - DNA, 22 bp, Homo sapiens
atatttgtagtgggtaagaagt

SEQ ID NO: 7297879 - DNA, 22 bp, Homo sapiens
atatttctccaaatgttttcaa

SEQ ID NO: 7297880 - DNA, 22 bp, Homo sapiens
atatttctccaaatgttttcaa

SEQ ID NO: 7297881 - DNA, 22 bp, Homo sapiens
atatgttgagcaagcatgatta

SEQ ID NO: 7297882 - DNA, 22 bp, Homo sapiens
atatgttttgtgcttcattggt

SEQ ID NO: 7297883 - DNA, 22 bp, Homo sapiens
atatggctgttgcacatctaag

SEQ ID NO: 7297884 - DNA, 22 bp, Homo sapiens
atatggtaagagtatatttact

SEQ ID NO: 7297885 - DNA, 22 bp, Homo sapiens
atatgtattttaacgtgtaagg

SEQ ID NO: 7297886 - DNA, 22 bp, Homo sapiens
atatgtatgtgttttctttgga

SEQ ID NO: 7297887 - DNA, 22 bp, Homo sapiens
atatgtatgtacgcacatattc

SEQ ID NO: 7297888 - DNA, 22 bp, Homo sapiens
atatgtatgtacgcacatattc

SEQ ID NO: 7297889 - DNA, 22 bp, Homo sapiens
atatgtatagccagtctttagg

SEQ ID NO: 7297890 - DNA, 22 bp, Homo sapiens
atatgtgtatggatttctatct

SEQ ID NO: 7297891 - DNA, 22 bp, Homo sapiens
atatgtgtcgtgctactgccca

SEQ ID NO: 7297892 - DNA, 22 bp, Homo sapiens
atatgtgtcgtgctactgccca

SEQ ID NO: 7297893 - DNA, 22 bp, Homo sapiens
atatgtgtatggatttctatct

SEQ ID NO: 7297894 - DNA, 22 bp, Homo sapiens
atatgtgtatggatttctatct

SEQ ID NO: 7297895 - DNA, 20 bp, Homo sapiens
atatgtgtacgtgtatacat

SEQ ID NO: 7297896 - DNA, 20 bp, Homo sapiens
atatgtgtacgtgtatacat

SEQ ID NO: 7297897 - DNA, 20 bp, Homo sapiens
atatgtgtacgtgtatacat

SEQ ID NO: 7297898 - DNA, 22 bp, Homo sapiens
atatgtgtgtatttcttactag

SEQ ID NO: 7297899 - DNA, 22 bp, Homo sapiens
atatgtgtgcacatatgtattt

SEQ ID NO: 7297900 - DNA, 22 bp, Homo sapiens
atatgtgtgcacatatgtattt

SEQ ID NO: 7297901 - DNA, 22 bp, Homo sapiens
atatgtcataattgtgtctgta

SEQ ID NO: 7297902 - DNA, 22 bp, Homo sapiens
atatgtctatagagcctgtggg

SEQ ID NO: 7297903 - DNA, 22 bp, Homo sapiens
atatgtgtacgtgcagtatata

SEQ ID NO: 7297904 - DNA, 22 bp, Homo sapiens
atatgtgtaaatgcatttgttt

SEQ ID NO: 7297905 - DNA, 22 bp, Homo sapiens
atatgtgtaaatgcatttgttt

SEQ ID NO: 7297906 - DNA, 22 bp, Homo sapiens
atatgtgtaaatgcatttgttt

SEQ ID NO: 7297907 - DNA, 22 bp, Homo sapiens
atatgtgaagtgggttattttg

SEQ ID NO: 7297908 - DNA, 22 bp, Homo sapiens
atatgtgaatgatatcactttg

SEQ ID NO: 7297909 - DNA, 22 bp, Homo sapiens
atatgtgaatgatatcactttg

SEQ ID NO: 7297910 - DNA, 22 bp, Homo sapiens
atatgagagaggaaagatttta

SEQ ID NO: 7297911 - DNA, 22 bp, Homo sapiens
atatgacagcggattcacatat

SEQ ID NO: 7297912 - DNA, 22 bp, Homo sapiens
atatgacagaatgtgtgtgtat

SEQ ID NO: 7297913 - DNA, 22 bp, Homo sapiens
atatgacagcggattcacatat

SEQ ID NO: 7297914 - DNA, 22 bp, Homo sapiens
atatatattgcccaggctggtt

SEQ ID NO: 7297915 - DNA, 22 bp, Homo sapiens
atatatattgcccaggctggtt

SEQ ID NO: 7297916 - DNA, 22 bp, Homo sapiens
atatatgcatgtgtacttatgt

SEQ ID NO: 7297917 - DNA, 18 bp, Homo sapiens
atatccaataatgaacac

SEQ ID NO: 7297918 - DNA, 22 bp, Homo sapiens
atatgattgtccttagcaaatt

SEQ ID NO: 7297919 - DNA, 22 bp, Homo sapiens
atatgattccactattgtatgg

SEQ ID NO: 7297920 - DNA, 22 bp, Homo sapiens
atatatattgcccaggctggtt

SEQ ID NO: 7297921 - DNA, 22 bp, Homo sapiens
atatatatgctgatggctgcca

SEQ ID NO: 7297922 - DNA, 22 bp, Homo sapiens
atatatatgctgatggctgcca

SEQ ID NO: 7297923 - DNA, 22 bp, Homo sapiens
atatatatgctgatggctgcca

SEQ ID NO: 7297924 - DNA, 22 bp, Homo sapiens
atatatatcgagttcatgtctc

SEQ ID NO: 7297925 - DNA, 22 bp, Homo sapiens
atatatatcgagttcatgtctc

SEQ ID NO: 7297926 - DNA, 22 bp, Homo sapiens
atatatagagctagatgttaaa

SEQ ID NO: 7297927 - DNA, 22 bp, Homo sapiens
atatatactttgacacattctg

SEQ ID NO: 7297928 - DNA, 22 bp, Homo sapiens
atatatactttgacacattctg

SEQ ID NO: 7297929 - DNA, 22 bp, Homo sapiens
atatatacaactagattaaaag

SEQ ID NO: 7297930 - DNA, 22 bp, Homo sapiens
ctgggagagaagcgaagctggg

SEQ ID NO: 7297931 - DNA, 22 bp, Homo sapiens
ctgggagaatttgttgaaggat

SEQ ID NO: 7297932 - DNA, 22 bp, Homo sapiens
atataactcttgttcttatagt

SEQ ID NO: 7297933 - DNA, 22 bp, Homo sapiens
atataagttagtggtcatgttt

SEQ ID NO: 7297934 - DNA, 22 bp, Homo sapiens
atataatacaacctgctaagtg

SEQ ID NO: 7297935 - DNA, 22 bp, Homo sapiens
atatatacaactagattaaaag

SEQ ID NO: 7297936 - DNA, 22 bp, Homo sapiens
ctgggaagcttcgagcaggaaa

SEQ ID NO: 7297937 - DNA, 23 bp, Homo sapiens
ctggcttctggggcctctgtttc

SEQ ID NO: 7297938 - DNA, 22 bp, Homo sapiens
ctggcagcttagcactctggtt

SEQ ID NO: 7297939 - DNA, 22 bp, Homo sapiens
atcatgcttggattatgtttgg

SEQ ID NO: 7297940 - DNA, 22 bp, Homo sapiens
atcatgctgacacagtttatct

SEQ ID NO: 7297941 - DNA, 22 bp, Homo sapiens
ctgtgatgttagctctgtgtta

SEQ ID NO: 7297942 - DNA, 22 bp, Homo sapiens
ctgtgcaaaggccttatgtttt

SEQ ID NO: 7297943 - DNA, 22 bp, Homo sapiens
ctgtctgtttctgattcaacct

SEQ ID NO: 7297944 - DNA, 22 bp, Homo sapiens
ctgtctgttttaccttctccag

SEQ ID NO: 7297945 - DNA, 22 bp, Homo sapiens
ctgtctgtttcaaaagtggtta

SEQ ID NO: 7297946 - DNA, 22 bp, Homo sapiens
ctgtctttggtcctgtctgtta

SEQ ID NO: 7297947 - DNA, 22 bp, Homo sapiens
ctgtctgttttgtatacaggcc

SEQ ID NO: 7297948 - DNA, 22 bp, Homo sapiens
atatttgtggtttttggctcct

SEQ ID NO: 7297949 - DNA, 22 bp, Homo sapiens
atatttgtcatctgccttagtt

SEQ ID NO: 7297950 - DNA, 22 bp, Homo sapiens
atatttgtggtaaaggtaagaa

SEQ ID NO: 7297951 - DNA, 22 bp, Homo sapiens
atatttgtatttcgtgtgtgta

SEQ ID NO: 7297952 - DNA, 22 bp, Homo sapiens
atatttgtcaattcactgttca

SEQ ID NO: 7297953 - DNA, 22 bp, Homo sapiens
atatttgtcaattcactgttca

SEQ ID NO: 7297954 - DNA, 22 bp, Homo sapiens
atcacatcacaggttgagctag

SEQ ID NO: 7297955 - DNA, 22 bp, Homo sapiens
atcacatatttaagaaacatgt

SEQ ID NO: 7297956 - DNA, 22 bp, Homo sapiens
atcacagttactcaaataatga

SEQ ID NO: 7297957 - DNA, 22 bp, Homo sapiens
atcacagtgccttcgtaaattt

SEQ ID NO: 7297958 - DNA, 22 bp, Homo sapiens
atcatttttaagagactcttct

SEQ ID NO: 7297959 - DNA, 22 bp, Homo sapiens
atcattttgtgacaatgcctgt

SEQ ID NO: 7297960 - DNA, 18 bp, Homo sapiens
atccaactatcgctcatt

SEQ ID NO: 7297961 - DNA, 22 bp, Homo sapiens
atccaacaggacaaagaaagga

SEQ ID NO: 7297962 - DNA, 22 bp, Homo sapiens
atccacaagaccccttttcact

SEQ ID NO: 7297963 - DNA, 22 bp, Homo sapiens
atcctcacatttgggcaggtga

SEQ ID NO: 7297964 - DNA, 17 bp, Homo sapiens
atccccagcatctagaa

SEQ ID NO: 7297965 - DNA, 23 bp, Homo sapiens
atccacattacagtatcatacaa

SEQ ID NO: 7297966 - DNA, 22 bp, Homo sapiens
atccacatttaggtctctaaaa

SEQ ID NO: 7297967 - DNA, 22 bp, Homo sapiens
atccccaggggcattcaagctt

SEQ ID NO: 7297968 - DNA, 22 bp, Homo sapiens
atccccctcttggatggcggca

SEQ ID NO: 7297969 - DNA, 22 bp, Homo sapiens
atccccctgtatctggaagaat

SEQ ID NO: 7297970 - DNA, 22 bp, Homo sapiens
atacttctcatgggctctgagc

SEQ ID NO: 7297971 - DNA, 22 bp, Homo sapiens
atacttcctgcttccctgatct

SEQ ID NO: 7297972 - DNA, 22 bp, Homo sapiens
atacttctttagcatattgaac

SEQ ID NO: 7297973 - DNA, 22 bp, Homo sapiens
atacttctctgaggtaggtaaa

SEQ ID NO: 7297974 - DNA, 22 bp, Homo sapiens
ctggcagcggtttgcagcctgg

SEQ ID NO: 7297975 - DNA, 22 bp, Homo sapiens
atactttctgaccaattaattg

SEQ ID NO: 7297976 - DNA, 22 bp, Homo sapiens
ctggcagcgcagcatgaagtcg

SEQ ID NO: 7297977 - DNA, 22 bp, Homo sapiens
ctggcagcgtgtttatgaacat

SEQ ID NO: 7297978 - DNA, 22 bp, Homo sapiens
atactctttatgacattccagc

SEQ ID NO: 7297979 - DNA, 22 bp, Homo sapiens
atactcttcctagcgctgaaat

SEQ ID NO: 7297980 - DNA, 22 bp, Homo sapiens
atactctttatgacattccagc

SEQ ID NO: 7297981 - DNA, 22 bp, Homo sapiens
ctggagggctgcagcgaggctg

SEQ ID NO: 7297982 - DNA, 22 bp, Homo sapiens
ctggagggctgcagcgaggctg

SEQ ID NO: 7297983 - DNA, 22 bp, Homo sapiens
ctggagccccaggctgtgcaga

SEQ ID NO: 7297984 - DNA, 22 bp, Homo sapiens
ctggagccatgtcttgactgct

SEQ ID NO: 7297985 - DNA, 22 bp, Homo sapiens
ctggagccatgtatagcctatg

SEQ ID NO: 7297986 - DNA, 22 bp, Homo sapiens
ctggagccactttttatccttt

SEQ ID NO: 7297987 - DNA, 22 bp, Homo sapiens
atacaagtggccacttgaattc

SEQ ID NO: 7297988 - DNA, 22 bp, Homo sapiens
atacaagtggccacttgaattc

SEQ ID NO: 7297989 - DNA, 22 bp, Homo sapiens
atacagagcagtaatagaggag

SEQ ID NO: 7297990 - DNA, 22 bp, Homo sapiens
atacagatgagatcaggcataa

SEQ ID NO: 7297991 - DNA, 22 bp, Homo sapiens
atacagagggtttcatgggcag

SEQ ID NO: 7297992 - DNA, 22 bp, Homo sapiens
atacagatcccacagcatgtga

SEQ ID NO: 7297993 - DNA, 22 bp, Homo sapiens
atacagatcccacagcatgtga

SEQ ID NO: 7297994 - DNA, 22 bp, Homo sapiens
ctggagggatgtagggtgtatt

SEQ ID NO: 7297995 - DNA, 22 bp, Homo sapiens
ctggagggagttaggacccgga

SEQ ID NO: 7297996 - DNA, 22 bp, Homo sapiens
ctggagggagttaggacccgga

SEQ ID NO: 7297997 - DNA, 22 bp, Homo sapiens
ctggagggaggaggctgctatt

SEQ ID NO: 7297998 - DNA, 22 bp, Homo sapiens
atacagatgggtcagatttcat

SEQ ID NO: 7297999 - DNA, 22 bp, Homo sapiens
atacagatgcttgctcgtgact

SEQ ID NO: 7298000 - DNA, 22 bp, Homo sapiens
atacaagactcagcacagacgg

SEQ ID NO: 7298001 - DNA, 22 bp, Homo sapiens
atacaagtgatataattgtttc

SEQ ID NO: 7298002 - DNA, 22 bp, Homo sapiens
ctgctttaatccctgcctggaa

SEQ ID NO: 7298003 - DNA, 22 bp, Homo sapiens
ctgctttaatttagacaaggca

SEQ ID NO: 7298004 - DNA, 22 bp, Homo sapiens
ctgctttaacagatgatggtgt

SEQ ID NO: 7298005 - DNA, 22 bp, Homo sapiens
ctgcttgtcttcgaggggtgca

SEQ ID NO: 7298006 - DNA, 22 bp, Homo sapiens
ctgcttctgggatgatggagta

SEQ ID NO: 7298007 - DNA, 18 bp, Homo sapiens
ctgcttctgtctgccagt

SEQ ID NO: 7298008 - DNA, 22 bp, Homo sapiens
ctgcttctccctgagatagtgt

SEQ ID NO: 7298009 - DNA, 22 bp, Homo sapiens
ataatatttgcattactgtgat

SEQ ID NO: 7298010 - DNA, 22 bp, Homo sapiens
ataatattgagtcaggacctga

SEQ ID NO: 7298011 - DNA, 20 bp, Homo sapiens
ctgctctgctttgcaggtgg

SEQ ID NO: 7298012 - DNA, 22 bp, Homo sapiens
ctgctctgctgatcagtgtctc

SEQ ID NO: 7298013 - DNA, 20 bp, Homo sapiens
ctgctctgctttgcaggtgg

SEQ ID NO: 7298014 - DNA, 22 bp, Homo sapiens
ctgctctgtatatgagcaggaa

SEQ ID NO: 7298015 - DNA, 22 bp, Homo sapiens
ctgctctggtctcttcatgttt

SEQ ID NO: 7298016 - DNA, 21 bp, Homo sapiens
ctgctctggggaccggctgtg

SEQ ID NO: 7298017 - DNA, 22 bp, Homo sapiens
ataaatctattggacatgtgtg

SEQ ID NO: 7298018 - DNA, 22 bp, Homo sapiens
agtttacaaagtttcactgttc

SEQ ID NO: 7298019 - DNA, 22 bp, Homo sapiens
agttgtgtggttggcggctgcg

SEQ ID NO: 7298020 - DNA, 22 bp, Homo sapiens
ctgcagcctccaccttttgggt

SEQ ID NO: 7298021 - DNA, 22 bp, Homo sapiens
ctgcagctcccctgagatcaag

SEQ ID NO: 7298022 - DNA, 22 bp, Homo sapiens
ctgcagctcctgagctcagaga

SEQ ID NO: 7298023 - DNA, 22 bp, Homo sapiens
agtttgaaggagttgaatcacc

SEQ ID NO: 7298024 - DNA, 22 bp, Homo sapiens
agtttgtaacctaagattcagg

SEQ ID NO: 7298025 - DNA, 22 bp, Homo sapiens
agtttgattgtatgggttttaa

SEQ ID NO: 7298026 - DNA, 22 bp, Homo sapiens
agtttggaaaatgagacaagga

SEQ ID NO: 7298027 - DNA, 20 bp, Homo sapiens
ataaaataactgccacaaga

SEQ ID NO: 7298028 - DNA, 22 bp, Homo sapiens
ataaaagttcaagagagtacag

SEQ ID NO: 7298029 - DNA, 20 bp, Homo sapiens
ataaaataactgccacaaga

SEQ ID NO: 7298030 - DNA, 22 bp, Homo sapiens
ctgccaggcactgggctctgca

SEQ ID NO: 7298031 - DNA, 22 bp, Homo sapiens
ctgccaaggctggggaggacaa

SEQ ID NO: 7298032 - DNA, 22 bp, Homo sapiens
ctgccaggcctcatcccagcca

SEQ ID NO: 7298033 - DNA, 22 bp, Homo sapiens
ataaaagtaggaccaacttaca

SEQ ID NO: 7298034 - DNA, 22 bp, Homo sapiens
ataaaagtaggaccaacttaca

SEQ ID NO: 7298035 - DNA, 21 bp, Homo sapiens
ctctttgggatctttggaaag

SEQ ID NO: 7298036 - DNA, 22 bp, Homo sapiens
ctctttgggatgggctctgctg

SEQ ID NO: 7298037 - DNA, 16 bp, Homo sapiens
ctctttgggcttccag

SEQ ID NO: 7298038 - DNA, 22 bp, Homo sapiens
ctctttggggctggaagcctag

SEQ ID NO: 7298039 - DNA, 22 bp, Homo sapiens
ctctttggggtgccccactggt

SEQ ID NO: 7298040 - DNA, 22 bp, Homo sapiens
ctctttggtcgcatcatccatt

SEQ ID NO: 7298041 - DNA, 22 bp, Homo sapiens
ctctttggtgcaccttgcagtc

SEQ ID NO: 7298042 - DNA, 22 bp, Homo sapiens
agttggtcttcttggatctcag

SEQ ID NO: 7298043 - DNA, 22 bp, Homo sapiens
agttgtaacagattctaacata

SEQ ID NO: 7298044 - DNA, 22 bp, Homo sapiens
ctgagggaacttgggcaagtct

SEQ ID NO: 7298045 - DNA, 22 bp, Homo sapiens
agttgtaataacaataccaaaa

SEQ ID NO: 7298046 - DNA, 22 bp, Homo sapiens
ctgaggcctctgttcaccagaa

SEQ ID NO: 7298047 - DNA, 22 bp, Homo sapiens
ccttggccctagcctcaggcaa

SEQ ID NO: 7298048 - DNA, 20 bp, Homo sapiens
ccttctctggaattgcctcc

SEQ ID NO: 7298049 - DNA, 22 bp, Homo sapiens
ccttgctgaccatcacctttga

SEQ ID NO: 7298050 - DNA, 22 bp, Homo sapiens
aggtgggaacccagcagggccc

SEQ ID NO: 7298051 - DNA, 22 bp, Homo sapiens
aggtgggacccgtggggtgcga

SEQ ID NO: 7298052 - DNA, 22 bp, Homo sapiens
aggtgccagtgctgtggtcccc

SEQ ID NO: 7298053 - DNA, 22 bp, Homo sapiens
cctgggagaactgctgggttgg

SEQ ID NO: 7298054 - DNA, 22 bp, Homo sapiens
aggtgctgccccgagaaggatg

SEQ ID NO: 7298055 - DNA, 22 bp, Homo sapiens
aggtgctggcgccccaggagac

SEQ ID NO: 7298056 - DNA, 22 bp, Homo sapiens
aggtgctggcgccccaggagac

SEQ ID NO: 7298057 - DNA, 22 bp, Homo sapiens
aggtgctggagtctgggcagga

SEQ ID NO: 7298058 - DNA, 22 bp, Homo sapiens
cggagcctgcttgttgcagctg

SEQ ID NO: 7298059 - DNA, 22 bp, Homo sapiens
cggagatatttaaggttctctc

SEQ ID NO: 7298060 - DNA, 22 bp, Homo sapiens
cggaggggtttgaacagaggag

SEQ ID NO: 7298061 - DNA, 22 bp, Homo sapiens
cggaggttgaggctgcagtgag

SEQ ID NO: 7298062 - DNA, 22 bp, Homo sapiens
agtatatttgttaagattattc

SEQ ID NO: 7298063 - DNA, 22 bp, Homo sapiens
agtatatgtgcacatatgcatg

SEQ ID NO: 7298064 - DNA, 22 bp, Homo sapiens
agtatatagtggcgctgtatgc

SEQ ID NO: 7298065 - DNA, 22 bp, Homo sapiens
agtatatatgaggaaccacaaa

SEQ ID NO: 7298066 - DNA, 22 bp, Homo sapiens
cctttgtaagatgtgaagactg

SEQ ID NO: 7298067 - DNA, 22 bp, Homo sapiens
cctctgagtgacagcctcctct

SEQ ID NO: 7298068 - DNA, 22 bp, Homo sapiens
cctgccaggacattgcttgaag

SEQ ID NO: 7298069 - DNA, 22 bp, Homo sapiens
cctgcccaggagtctctctgtg

SEQ ID NO: 7298070 - DNA, 22 bp, Homo sapiens
cctgccctgctcactgtcggta

SEQ ID NO: 7298071 - DNA, 22 bp, Homo sapiens
agggtctgtgcaagaacacgcc

SEQ ID NO: 7298072 - DNA, 22 bp, Homo sapiens
agggtctttatagaggtactta

SEQ ID NO: 7298073 - DNA, 21 bp, Homo sapiens
agggtcaggaaccagggtacc

SEQ ID NO: 7298074 - DNA, 22 bp, Homo sapiens
agggtccttctgttcctgagca

SEQ ID NO: 7298075 - DNA, 21 bp, Homo sapiens
agggtcctacagggctcagga

SEQ ID NO: 7298076 - DNA, 22 bp, Homo sapiens
cctggctgcttcctctgccatg

SEQ ID NO: 7298077 - DNA, 22 bp, Homo sapiens
cctggaagtcattcctcgttcc

SEQ ID NO: 7298078 - DNA, 20 bp, Homo sapiens
cctggaagagctccccaggc

SEQ ID NO: 7298079 - DNA, 22 bp, Homo sapiens
cctggaagattcaccactacca

SEQ ID NO: 7298080 - DNA, 22 bp, Homo sapiens
cctggaccaaacactggcctgg

SEQ ID NO: 7298081 - DNA, 22 bp, Homo sapiens
cctggcagcgtgccgagctgcg

SEQ ID NO: 7298082 - DNA, 22 bp, Homo sapiens
cctggcagcgccgaagctggcc

SEQ ID NO: 7298083 - DNA, 22 bp, Homo sapiens
cctggcacataatagtggctca

SEQ ID NO: 7298084 - DNA, 22 bp, Homo sapiens
cctgctctgccaagtcctcttt

SEQ ID NO: 7298085 - DNA, 22 bp, Homo sapiens
cctgctctgccaagtcctcttt

SEQ ID NO: 7298086 - DNA, 22 bp, Homo sapiens
cctgctctggtttagtcagtct

SEQ ID NO: 7298087 - DNA, 22 bp, Homo sapiens
ctcagaaattacaaaagggaca

SEQ ID NO: 7298088 - DNA, 22 bp, Homo sapiens
ctcagatgtttgatattgttat

SEQ ID NO: 7298089 - DNA, 22 bp, Homo sapiens
ctcagcaagattaagcagcttg

SEQ ID NO: 7298090 - DNA, 22 bp, Homo sapiens
ctcagcaacagcgacttaaggg

SEQ ID NO: 7298091 - DNA, 22 bp, Homo sapiens
ctcaaatataagctaaatgtgg

SEQ ID NO: 7298092 - DNA, 22 bp, Homo sapiens
ctcaacatatgactttggtggg

SEQ ID NO: 7298093 - DNA, 23 bp, Homo sapiens
ctcaacatccattcttgcccttc

SEQ ID NO: 7298094 - DNA, 22 bp, Homo sapiens
ctcaacatgcctactcagtctg

SEQ ID NO: 7298095 - DNA, 22 bp, Homo sapiens
ctcaacatttaacagtgaaaaa

SEQ ID NO: 7298096 - DNA, 22 bp, Homo sapiens
cgggttcacgccattctcctgc

SEQ ID NO: 7298097 - DNA, 22 bp, Homo sapiens
agtatgaatggaaactacctat

SEQ ID NO: 7298098 - DNA, 22 bp, Homo sapiens
agtatgaatctctttattctgc

SEQ ID NO: 7298099 - DNA, 22 bp, Homo sapiens
ctcagctccctccacccagacc

SEQ ID NO: 7298100 - DNA, 22 bp, Homo sapiens
ctcagggagtagcacatgtgga

SEQ ID NO: 7298101 - DNA, 17 bp, Homo sapiens
agtgaaatttacattgc

SEQ ID NO: 7298102 - DNA, 19 bp, Homo sapiens
ctccagaatacatgttcct

SEQ ID NO: 7298103 - DNA, 22 bp, Homo sapiens
ctccagaactgggagagaataa

SEQ ID NO: 7298104 - DNA, 22 bp, Homo sapiens
agtgctggagggaggcaggttc

SEQ ID NO: 7298105 - DNA, 23 bp, Homo sapiens
agtgctggagaagcttctggctt

SEQ ID NO: 7298106 - DNA, 18 bp, Homo sapiens
ctcctttccctacacctc

SEQ ID NO: 7298107 - DNA, 22 bp, Homo sapiens
ctcgctggcttttccggttccc

SEQ ID NO: 7298108 - DNA, 22 bp, Homo sapiens
ctccttctgggcctggcagtgg

SEQ ID NO: 7298109 - DNA, 22 bp, Homo sapiens
ctccttctgaggctctgggttc

SEQ ID NO: 7298110 - DNA, 22 bp, Homo sapiens
ctcctgccaccgcggtgtcctg

SEQ ID NO: 7298111 - DNA, 22 bp, Homo sapiens
ctcctgcaagcctccccaagca

SEQ ID NO: 7298112 - DNA, 22 bp, Homo sapiens
ctctcctttactgcagagagcg

SEQ ID NO: 7298113 - DNA, 20 bp, Homo sapiens
ctctcccagcacagcttcct

SEQ ID NO: 7298114 - DNA, 22 bp, Homo sapiens
ctctcccagtcaggctcaggat

SEQ ID NO: 7298115 - DNA, 22 bp, Homo sapiens
ctctcccagtcaggctcaggat

SEQ ID NO: 7298116 - DNA, 22 bp, Homo sapiens
agtgctgggctatctactgcta

SEQ ID NO: 7298117 - DNA, 22 bp, Homo sapiens
agtgctggcccatagctgctgg

SEQ ID NO: 7298118 - DNA, 22 bp, Homo sapiens
agtgctgggattacaggcataa

SEQ ID NO: 7298119 - DNA, 22 bp, Homo sapiens
agtgctgggattgcaggcatga

SEQ ID NO: 7298120 - DNA, 22 bp, Homo sapiens
ctctggacctcagtctactaat

SEQ ID NO: 7298121 - DNA, 22 bp, Homo sapiens
ctctggacactggcatggggtc

SEQ ID NO: 7298122 - DNA, 22 bp, Homo sapiens
ctctggacagccctccaggaag

SEQ ID NO: 7298123 - DNA, 23 bp, Homo sapiens
ctctggagatcctctgcctgggt

SEQ ID NO: 7298124 - DNA, 22 bp, Homo sapiens
ctctggagaggttcccatggga

SEQ ID NO: 7298125 - DNA, 22 bp, Homo sapiens
ctctggagaacgctatggatct

SEQ ID NO: 7298126 - DNA, 22 bp, Homo sapiens
ctctgtcaggctgcagatgctc

SEQ ID NO: 7298127 - DNA, 22 bp, Homo sapiens
ctctggggttagatctgatgct

SEQ ID NO: 7298128 - DNA, 22 bp, Homo sapiens
ctctggtttctgacctgaattt

SEQ ID NO: 7298129 - DNA, 21 bp, Homo sapiens
ctctggtttgcattggattat

SEQ ID NO: 7298130 - DNA, 22 bp, Homo sapiens
ctctgtctatcccattctgtgc

SEQ ID NO: 7298131 - DNA, 22 bp, Homo sapiens
agtgtaatactcatgacaaaaa

SEQ ID NO: 7298132 - DNA, 22 bp, Homo sapiens
agtgtacaaaatgatagataaa

SEQ ID NO: 7298133 - DNA, 22 bp, Homo sapiens
ctctttggctttgactcccatt

SEQ ID NO: 7298134 - DNA, 16 bp, Homo sapiens
ctctttggcttccaag

SEQ ID NO: 7298135 - DNA, 22 bp, Homo sapiens
ctcttggccagacacagaggca

SEQ ID NO: 7298136 - DNA, 22 bp, Homo sapiens
ctcttgcattctatccctccag

SEQ ID NO: 7298137 - DNA, 22 bp, Homo sapiens
ggggaagaaatctgggttcttc

SEQ ID NO: 7298138 - DNA, 22 bp, Homo sapiens
ggggaagaatgctctctagaga

SEQ ID NO: 7298139 - DNA, 22 bp, Homo sapiens
ggggaagaatgctctctagaga

SEQ ID NO: 7298140 - DNA, 22 bp, Homo sapiens
ggggaagaaccgggattcccat

SEQ ID NO: 7298141 - DNA, 19 bp, Homo sapiens
cagaggccagaagcacagg

SEQ ID NO: 7298142 - DNA, 22 bp, Homo sapiens
cagaggccccagaactagctct

SEQ ID NO: 7298143 - DNA, 21 bp, Homo sapiens
cagaggcctatcacagactcc

SEQ ID NO: 7298144 - DNA, 21 bp, Homo sapiens
cagaggcctcatgctctgtgc

SEQ ID NO: 7298145 - DNA, 22 bp, Homo sapiens
cagaggcctggcttggacacct

SEQ ID NO: 7298146 - DNA, 22 bp, Homo sapiens
gggtgcaggggaccctagggac

SEQ ID NO: 7298147 - DNA, 22 bp, Homo sapiens
gggtgcagggtctccagcagct

SEQ ID NO: 7298148 - DNA, 22 bp, Homo sapiens
cagaggccttcaatactcattt

SEQ ID NO: 7298149 - DNA, 22 bp, Homo sapiens
gggtgcatggtgtatgactgga

SEQ ID NO: 7298150 - DNA, 22 bp, Homo sapiens
gggtgcgaatactcataatgta

SEQ ID NO: 7298151 - DNA, 22 bp, Homo sapiens
gggtgccttggtgtgctgtagg

SEQ ID NO: 7298152 - DNA, 23 bp, Homo sapiens
gggtgctgcctgtagtcatgctg

SEQ ID NO: 7298153 - DNA, 22 bp, Homo sapiens
gggctttttacattgaacattt

SEQ ID NO: 7298154 - DNA, 22 bp, Homo sapiens
ggggaaagccagccctgcttcc

SEQ ID NO: 7298155 - DNA, 23 bp, Homo sapiens
ggggaaagaccatgcttgaggac

SEQ ID NO: 7298156 - DNA, 20 bp, Homo sapiens
ggggaagaaaaggatgtgat

SEQ ID NO: 7298157 - DNA, 22 bp, Homo sapiens
ggggaaaggccatggcaagaac

SEQ ID NO: 7298158 - DNA, 22 bp, Homo sapiens
ggggaaagtgaattgtgtagtg

SEQ ID NO: 7298159 - DNA, 22 bp, Homo sapiens
cagagctgcacattctatgatg

SEQ ID NO: 7298160 - DNA, 22 bp, Homo sapiens
cagagctgacccaaggattgaa

SEQ ID NO: 7298161 - DNA, 22 bp, Homo sapiens
cagagctgagaatgttgatgct

SEQ ID NO: 7298162 - DNA, 22 bp, Homo sapiens
gggcgcaagcatgtgtctgggt

SEQ ID NO: 7298163 - DNA, 22 bp, Homo sapiens
cagagcccctcgtctccaccac

SEQ ID NO: 7298164 - DNA, 22 bp, Homo sapiens
cagagcccctcagctctctccc

SEQ ID NO: 7298165 - DNA, 22 bp, Homo sapiens
cagagccctgggcacatggtag

SEQ ID NO: 7298166 - DNA, 22 bp, Homo sapiens
gggcagagaaatggacagttgg

SEQ ID NO: 7298167 - DNA, 22 bp, Homo sapiens
cagagcccatggcacatgtgga

SEQ ID NO: 7298168 - DNA, 22 bp, Homo sapiens
cagagcccatggcacatgtgga

SEQ ID NO: 7298169 - DNA, 22 bp, Homo sapiens
cagaataaaaactcctatgtct

SEQ ID NO: 7298170 - DNA, 22 bp, Homo sapiens
cagaagttgccacatgaccctt

SEQ ID NO: 7298171 - DNA, 22 bp, Homo sapiens
cagaagtggatattagagtaat

SEQ ID NO: 7298172 - DNA, 22 bp, Homo sapiens
gggactgtcctctgtgtctgtg

SEQ ID NO: 7298173 - DNA, 22 bp, Homo sapiens
cagacaggagactggatcatgg

SEQ ID NO: 7298174 - DNA, 20 bp, Homo sapiens
gggaggccagcctcagagaa

SEQ ID NO: 7298175 - DNA, 22 bp, Homo sapiens
gggaggtgaaaggttgctgcag

SEQ ID NO: 7298176 - DNA, 22 bp, Homo sapiens
gggaggtgaaaggtcatgtgtg

SEQ ID NO: 7298177 - DNA, 22 bp, Homo sapiens
cagacagggccctgtgatggta

SEQ ID NO: 7298178 - DNA, 22 bp, Homo sapiens
cagaagcagtgagagatgtgca

SEQ ID NO: 7298179 - DNA, 22 bp, Homo sapiens
cagaagcagtgagagatgtgca

SEQ ID NO: 7298180 - DNA, 22 bp, Homo sapiens
cagaaggcagcaaatgaaaacc

SEQ ID NO: 7298181 - DNA, 22 bp, Homo sapiens
gggaaagacttattttgacttc

SEQ ID NO: 7298182 - DNA, 22 bp, Homo sapiens
gggaaagagaggtggacgcagg

SEQ ID NO: 7298183 - DNA, 22 bp, Homo sapiens
gggaaagaccctgagtcttatt

SEQ ID NO: 7298184 - DNA, 22 bp, Homo sapiens
gggaaagaccttcctggggtgt

SEQ ID NO: 7298185 - DNA, 22 bp, Homo sapiens
gggaaagagtgcttgtccagag

SEQ ID NO: 7298186 - DNA, 22 bp, Homo sapiens
gggaaagaagatctagatactg

SEQ ID NO: 7298187 - DNA, 22 bp, Homo sapiens
gggaaagaagaagagccatttt

SEQ ID NO: 7298188 - DNA, 22 bp, Homo sapiens
gggaaggaaagttattagcaga

SEQ ID NO: 7298189 - DNA, 22 bp, Homo sapiens
gggaaggacacagccatgactg

SEQ ID NO: 7298190 - DNA, 22 bp, Homo sapiens
gggaaggaaatcttgcttgtga

SEQ ID NO: 7298191 - DNA, 22 bp, Homo sapiens
gggaaggacacagccatgactg

SEQ ID NO: 7298192 - DNA, 22 bp, Homo sapiens
gggaattgaggtatgctgggct

SEQ ID NO: 7298193 - DNA, 22 bp, Homo sapiens
gggaaggaggtggcttgaagtg

SEQ ID NO: 7298194 - DNA, 22 bp, Homo sapiens
gggaaggagcctgcttgctaga

SEQ ID NO: 7298195 - DNA, 22 bp, Homo sapiens
gggactctgagagcctgagggt

SEQ ID NO: 7298196 - DNA, 22 bp, Homo sapiens
gggactctgagagcctgagggt

SEQ ID NO: 7298197 - DNA, 22 bp, Homo sapiens
cagcatttggaggagaggcttt

SEQ ID NO: 7298198 - DNA, 22 bp, Homo sapiens
cagcattttccatagaaagaag

SEQ ID NO: 7298199 - DNA, 22 bp, Homo sapiens
gtatttgtagtagcatagaatt

SEQ ID NO: 7298200 - DNA, 22 bp, Homo sapiens
gtatttgtcttgttggtctcca

SEQ ID NO: 7298201 - DNA, 22 bp, Homo sapiens
gtatttgctcatacagtgatac

SEQ ID NO: 7298202 - DNA, 22 bp, Homo sapiens
gtattttactgctcaaagctct

SEQ ID NO: 7298203 - DNA, 22 bp, Homo sapiens
cagccaattctagcttgtgaat

SEQ ID NO: 7298204 - DNA, 22 bp, Homo sapiens
cagccactctcagacagtccca

SEQ ID NO: 7298205 - DNA, 22 bp, Homo sapiens
cagccactgaactcctggctat

SEQ ID NO: 7298206 - DNA, 22 bp, Homo sapiens
cagccactcggccataaaggct

SEQ ID NO: 7298207 - DNA, 22 bp, Homo sapiens
cagccactggtgccaggctgtt

SEQ ID NO: 7298208 - DNA, 22 bp, Homo sapiens
cagccactgacaggaatggtcc

SEQ ID NO: 7298209 - DNA, 22 bp, Homo sapiens
cagccactggtgccaggctgtt

SEQ ID NO: 7298210 - DNA, 22 bp, Homo sapiens
cagccactgtggaatagccccc

SEQ ID NO: 7298211 - DNA, 22 bp, Homo sapiens
cagccactgtggtctagctgca

SEQ ID NO: 7298212 - DNA, 22 bp, Homo sapiens
cagccacttgtgatgctgggga

SEQ ID NO: 7298213 - DNA, 22 bp, Homo sapiens
cagcccagagccagttcccgct

SEQ ID NO: 7298214 - DNA, 22 bp, Homo sapiens
cagcaataaggtaagcttctcc

SEQ ID NO: 7298215 - DNA, 22 bp, Homo sapiens
cagcaagtcagtgagtagaaga

SEQ ID NO: 7298216 - DNA, 23 bp, Homo sapiens
cagcaagtgaattccaagagaga

SEQ ID NO: 7298217 - DNA, 22 bp, Homo sapiens
cagcaagtgatggaaatcagag

SEQ ID NO: 7298218 - DNA, 22 bp, Homo sapiens
ggtgtgccacttcactgagcag

SEQ ID NO: 7298219 - DNA, 22 bp, Homo sapiens
ggtgtgcctggggcttagctgc

SEQ ID NO: 7298220 - DNA, 22 bp, Homo sapiens
ggttctccttgagtgtcccagg

SEQ ID NO: 7298221 - DNA, 22 bp, Homo sapiens
ggttcctgtgcccatgtcatgg

SEQ ID NO: 7298222 - DNA, 22 bp, Homo sapiens
ggttgaatatctttatgttggt

SEQ ID NO: 7298223 - DNA, 22 bp, Homo sapiens
ggttgaatcattctttgcaccg

SEQ ID NO: 7298224 - DNA, 22 bp, Homo sapiens
gtaaaattctagcatctgaaag

SEQ ID NO: 7298225 - DNA, 22 bp, Homo sapiens
gtaaacaagtctaccattagaa

SEQ ID NO: 7298226 - DNA, 22 bp, Homo sapiens
gtatatgagctctatgtaatgg

SEQ ID NO: 7298227 - DNA, 22 bp, Homo sapiens
gtatatgtatgcgtatacacac

SEQ ID NO: 7298228 - DNA, 22 bp, Homo sapiens
gtatatgtgtgcaagtgcatgg

SEQ ID NO: 7298229 - DNA, 19 bp, Homo sapiens
gtatatttatatggctgta

SEQ ID NO: 7298230 - DNA, 22 bp, Homo sapiens
gtatattttgatcaccctctat

SEQ ID NO: 7298231 - DNA, 22 bp, Homo sapiens
cagcagcaaatctagaagagga

SEQ ID NO: 7298232 - DNA, 22 bp, Homo sapiens
cagcagcaacaatagcggtcac

SEQ ID NO: 7298233 - DNA, 22 bp, Homo sapiens
cagcagagtaattctcacctct

SEQ ID NO: 7298234 - DNA, 21 bp, Homo sapiens
cagcagagtaatgcattcgta

SEQ ID NO: 7298235 - DNA, 22 bp, Homo sapiens
cagcagagcttatgttgggtca

SEQ ID NO: 7298236 - DNA, 22 bp, Homo sapiens
cagcagagtatggcactcaact

SEQ ID NO: 7298237 - DNA, 22 bp, Homo sapiens
cagcagagtaggtgctacttct

SEQ ID NO: 7298238 - DNA, 22 bp, Homo sapiens
cagcagagtttggcttctaatg

SEQ ID NO: 7298239 - DNA, 22 bp, Homo sapiens
cagcagcctggagggggccacg

SEQ ID NO: 7298240 - DNA, 22 bp, Homo sapiens
cagcagcctggagggggccacg

SEQ ID NO: 7298241 - DNA, 22 bp, Homo sapiens
cagcaggaccattgaggcatca

SEQ ID NO: 7298242 - DNA, 22 bp, Homo sapiens
cagcagctacttggagcagcag

SEQ ID NO: 7298243 - DNA, 22 bp, Homo sapiens
gtatgcataattgtgtattcat

SEQ ID NO: 7298244 - DNA, 22 bp, Homo sapiens
gtatgcatttggcatattgtcc

SEQ ID NO: 7298245 - DNA, 22 bp, Homo sapiens
gtatgcatgcatgtgtatgtac

SEQ ID NO: 7298246 - DNA, 22 bp, Homo sapiens
gtatgcatgcatgtgtatgtac

SEQ ID NO: 7298247 - DNA, 22 bp, Homo sapiens
gtatttctagaaaatgcagatt

SEQ ID NO: 7298248 - DNA, 22 bp, Homo sapiens
gtatttctttccattatagtca

SEQ ID NO: 7298249 - DNA, 22 bp, Homo sapiens
gctgtctgagaacatggtggaa

SEQ ID NO: 7298250 - DNA, 22 bp, Homo sapiens
gctgtctgccgcaggctgccac

SEQ ID NO: 7298251 - DNA, 22 bp, Homo sapiens
gctgtggatgctatggatcatc

SEQ ID NO: 7298252 - DNA, 20 bp, Homo sapiens
gctgtggcaaagctttgtgt

SEQ ID NO: 7298253 - DNA, 22 bp, Homo sapiens
gctgtggcaatgtttataatta

SEQ ID NO: 7298254 - DNA, 22 bp, Homo sapiens
gctgtgctgtttccacctctct

SEQ ID NO: 7298255 - DNA, 22 bp, Homo sapiens
caaggattaatagaatgaatca

SEQ ID NO: 7298256 - DNA, 22 bp, Homo sapiens
caaggaggcagtgggacttgaa

SEQ ID NO: 7298257 - DNA, 22 bp, Homo sapiens
caaggatctcagctcactccct

SEQ ID NO: 7298258 - DNA, 22 bp, Homo sapiens
caaggcagaattcagactcagg

SEQ ID NO: 7298259 - DNA, 22 bp, Homo sapiens
gcttggctttgtcttgttcact

SEQ ID NO: 7298260 - DNA, 22 bp, Homo sapiens
cacaaaagtaggaggcaggcgg

SEQ ID NO: 7298261 - DNA, 22 bp, Homo sapiens
gcttctcctcccgctcccaggc

SEQ ID NO: 7298262 - DNA, 22 bp, Homo sapiens
gcttctcctcccgctcccaggc

SEQ ID NO: 7298263 - DNA, 22 bp, Homo sapiens
gcttctccagaccttcatcccc

SEQ ID NO: 7298264 - DNA, 22 bp, Homo sapiens
gctgtggcctggcgcagagctg

SEQ ID NO: 7298265 - DNA, 22 bp, Homo sapiens
gcttccaggtcattctcaccct

SEQ ID NO: 7298266 - DNA, 22 bp, Homo sapiens
gctgtggcctggcgcagagctg

SEQ ID NO: 7298267 - DNA, 22 bp, Homo sapiens
gctgtggcctagtttgttatat

SEQ ID NO: 7298268 - DNA, 22 bp, Homo sapiens
gctgtggccgggcccaggccgc

SEQ ID NO: 7298269 - DNA, 23 bp, Homo sapiens
cacaaaggttccattctctcacc

SEQ ID NO: 7298270 - DNA, 22 bp, Homo sapiens
cacaaaatatcaagcactttta

SEQ ID NO: 7298271 - DNA, 22 bp, Homo sapiens
cacaaaatatcaagcactttta

SEQ ID NO: 7298272 - DNA, 22 bp, Homo sapiens
cacaaaatctttctcgattatt

SEQ ID NO: 7298273 - DNA, 22 bp, Homo sapiens
cacaaagtataacttgatggaa

SEQ ID NO: 7298274 - DNA, 22 bp, Homo sapiens
cacaataaatgtttgctgatga

SEQ ID NO: 7298275 - DNA, 22 bp, Homo sapiens
cacaactttaggaaccacattc

SEQ ID NO: 7298276 - DNA, 22 bp, Homo sapiens
cacaactttccttgactgtaag

SEQ ID NO: 7298277 - DNA, 22 bp, Homo sapiens
cacaactttccttgactgtaag

SEQ ID NO: 7298278 - DNA, 18 bp, Homo sapiens
ggaaaaggagtgtctagc

SEQ ID NO: 7298279 - DNA, 22 bp, Homo sapiens
ggaaaaggccacagggacacat

SEQ ID NO: 7298280 - DNA, 17 bp, Homo sapiens
ggaaaaggatgatacag

SEQ ID NO: 7298281 - DNA, 22 bp, Homo sapiens
cacaatttgtttgctcttagtc

SEQ ID NO: 7298282 - DNA, 22 bp, Homo sapiens
cacaatttgttttatcagtatt

SEQ ID NO: 7298283 - DNA, 22 bp, Homo sapiens
cacacatattgtccctagtgtg

SEQ ID NO: 7298284 - DNA, 22 bp, Homo sapiens
cacacattagagccaatgtcag

SEQ ID NO: 7298285 - DNA, 22 bp, Homo sapiens
cacaatttggacttcactggtt

SEQ ID NO: 7298286 - DNA, 22 bp, Homo sapiens
cacaatttccttgcttcacttt

SEQ ID NO: 7298287 - DNA, 18 bp, Homo sapiens
cacaatttacagatgaca

SEQ ID NO: 7298288 - DNA, 22 bp, Homo sapiens
cacaattgtatcagaaaatagt

SEQ ID NO: 7298289 - DNA, 18 bp, Homo sapiens
cacaatttacagatgaca

SEQ ID NO: 7298290 - DNA, 22 bp, Homo sapiens
cacaatttcagttgcatgcaac

SEQ ID NO: 7298291 - DNA, 22 bp, Homo sapiens
cacaatttccaagtcatgttat

SEQ ID NO: 7298292 - DNA, 22 bp, Homo sapiens
cacaatttccaagtcatgttat

SEQ ID NO: 7298293 - DNA, 22 bp, Homo sapiens
cacacattggttttactccttt

SEQ ID NO: 7298294 - DNA, 22 bp, Homo sapiens
cacacatttcagatgctacaat

SEQ ID NO: 7298295 - DNA, 22 bp, Homo sapiens
cacacattgagcagctgtttgt

SEQ ID NO: 7298296 - DNA, 22 bp, Homo sapiens
cacacattcaccatgactgaaa

SEQ ID NO: 7298297 - DNA, 22 bp, Homo sapiens
caaagtatatttcatagtctca

SEQ ID NO: 7298298 - DNA, 17 bp, Homo sapiens
gctcctgcaggtcagga

SEQ ID NO: 7298299 - DNA, 18 bp, Homo sapiens
gctcctggaccaggtcac

SEQ ID NO: 7298300 - DNA, 22 bp, Homo sapiens
caaagtaatttggagatatata

SEQ ID NO: 7298301 - DNA, 22 bp, Homo sapiens
caaagtaaactaccactgtttc

SEQ ID NO: 7298302 - DNA, 19 bp, Homo sapiens
caaagtacctggcacagtg

SEQ ID NO: 7298303 - DNA, 22 bp, Homo sapiens
caaagtatattggattgaatgg

SEQ ID NO: 7298304 - DNA, 22 bp, Homo sapiens
caaagtatattggattgaatgg

SEQ ID NO: 7298305 - DNA, 22 bp, Homo sapiens
caaagtacagtgcttcctggga

SEQ ID NO: 7298306 - DNA, 22 bp, Homo sapiens
gctcctggagagattgagaaag

SEQ ID NO: 7298307 - DNA, 19 bp, Homo sapiens
gctcctggatgacctgtgg

SEQ ID NO: 7298308 - DNA, 18 bp, Homo sapiens
gctcctggagtctgactc

SEQ ID NO: 7298309 - DNA, 22 bp, Homo sapiens
gctgcagcagaagttctcagag

SEQ ID NO: 7298310 - DNA, 22 bp, Homo sapiens
gctgcagcaagccctccagggg

SEQ ID NO: 7298311 - DNA, 22 bp, Homo sapiens
gctgcagcccggcgcgcctgag

SEQ ID NO: 7298312 - DNA, 22 bp, Homo sapiens
gctgcagccttcttgccattaa

SEQ ID NO: 7298313 - DNA, 22 bp, Homo sapiens
gctgcagccctgcggatcactt

SEQ ID NO: 7298314 - DNA, 22 bp, Homo sapiens
gctgccaccgtggagatgagtg

SEQ ID NO: 7298315 - DNA, 22 bp, Homo sapiens
caacatttgtgatgagcaaact

SEQ ID NO: 7298316 - DNA, 22 bp, Homo sapiens
caacatttcaaggtctttagga

SEQ ID NO: 7298317 - DNA, 22 bp, Homo sapiens
caacatttgagtaaagaaatgg

SEQ ID NO: 7298318 - DNA, 22 bp, Homo sapiens
caacattatatagccacatgcc

SEQ ID NO: 7298319 - DNA, 22 bp, Homo sapiens
caacatctgtatcattagtaca

SEQ ID NO: 7298320 - DNA, 22 bp, Homo sapiens
caacatatgattttgtatataa

SEQ ID NO: 7298321 - DNA, 22 bp, Homo sapiens
caacatatgattttgtatataa

SEQ ID NO: 7298322 - DNA, 22 bp, Homo sapiens
caacatatataaggatttacta

SEQ ID NO: 7298323 - DNA, 22 bp, Homo sapiens
caacatatataaggatttacta

SEQ ID NO: 7298324 - DNA, 22 bp, Homo sapiens
caacatataatatttgagttct

SEQ ID NO: 7298325 - DNA, 22 bp, Homo sapiens
caacagttctcatagcagattc

SEQ ID NO: 7298326 - DNA, 22 bp, Homo sapiens
caaggacagcgtcaggtgcaac

SEQ ID NO: 7298327 - DNA, 22 bp, Homo sapiens
caaggacccaaatcttgttctt

SEQ ID NO: 7298328 - DNA, 22 bp, Homo sapiens
caaggagaaaacggcttctgaa

SEQ ID NO: 7298329 - DNA, 21 bp, Homo sapiens
caaggacaggttgcagggcaa

SEQ ID NO: 7298330 - DNA, 22 bp, Homo sapiens
caaggaggaagatgcaggggac

SEQ ID NO: 7298331 - DNA, 22 bp, Homo sapiens
caaggacaacttcatattgtgg

SEQ ID NO: 7298332 - DNA, 22 bp, Homo sapiens
caagatcttggctgaagtacag

SEQ ID NO: 7298333 - DNA, 22 bp, Homo sapiens
caagatcaaggtatcagcagat

SEQ ID NO: 7298334 - DNA, 22 bp, Homo sapiens
caagatcaaggtgtcagcaggt

SEQ ID NO: 7298335 - DNA, 22 bp, Homo sapiens
caagatatgtcctgttactaag

SEQ ID NO: 7298336 - DNA, 22 bp, Homo sapiens
caagatattgatttccagctga

SEQ ID NO: 7298337 - DNA, 22 bp, Homo sapiens
caagatatatgtatgattccat

SEQ ID NO: 7298338 - DNA, 22 bp, Homo sapiens
caagatatcaatgacatagtat

SEQ ID NO: 7298339 - DNA, 18 bp, Homo sapiens
caagagctgctcctggcc

SEQ ID NO: 7298340 - DNA, 22 bp, Homo sapiens
caagaggagcaggcaggtgtgc

SEQ ID NO: 7298341 - DNA, 22 bp, Homo sapiens
caagaggattattaataaataa

SEQ ID NO: 7298342 - DNA, 22 bp, Homo sapiens
caagataaagccaccagaagct

SEQ ID NO: 7298343 - DNA, 22 bp, Homo sapiens
caagataatttattctgagttt

SEQ ID NO: 7298344 - DNA, 22 bp, Homo sapiens
caagataagatcatttacacta

SEQ ID NO: 7298345 - DNA, 22 bp, Homo sapiens
caagataaaatcagcattccaa

SEQ ID NO: 7298346 - DNA, 22 bp, Homo sapiens
gctgctggatgcgcttgatggt

SEQ ID NO: 7298347 - DNA, 22 bp, Homo sapiens
caagagctctccactaggttgg

SEQ ID NO: 7298348 - DNA, 22 bp, Homo sapiens
cacagtgtagactaataataga

SEQ ID NO: 7298349 - DNA, 22 bp, Homo sapiens
cacagtgtagttaatgtgacat

SEQ ID NO: 7298350 - DNA, 22 bp, Homo sapiens
ggcagatggaaggacagacgga

SEQ ID NO: 7298351 - DNA, 22 bp, Homo sapiens
ggcagccagagggcagctggat

SEQ ID NO: 7298352 - DNA, 22 bp, Homo sapiens
ggcagagctctggactgagaac

SEQ ID NO: 7298353 - DNA, 22 bp, Homo sapiens
ggcagagcattcgatggacctg

SEQ ID NO: 7298354 - DNA, 22 bp, Homo sapiens
ggatgggcagacaggacggcac

SEQ ID NO: 7298355 - DNA, 22 bp, Homo sapiens
ggatgtcgaggatggggtagca

SEQ ID NO: 7298356 - DNA, 22 bp, Homo sapiens
ggatgtggaccttgcctggtga

SEQ ID NO: 7298357 - DNA, 23 bp, Homo sapiens
cacagggagggaaactctttcag

SEQ ID NO: 7298358 - DNA, 22 bp, Homo sapiens
cacagggaggcagccatgctcc

SEQ ID NO: 7298359 - DNA, 22 bp, Homo sapiens
ggagggagcatccccttgctga

SEQ ID NO: 7298360 - DNA, 22 bp, Homo sapiens
ggatctggggctctgctgctca

SEQ ID NO: 7298361 - DNA, 22 bp, Homo sapiens
ggatctgggctctgccaatcag

SEQ ID NO: 7298362 - DNA, 22 bp, Homo sapiens
ggagggagtttcattcctgccc

SEQ ID NO: 7298363 - DNA, 22 bp, Homo sapiens
cacccagagcagacactgtcca

SEQ ID NO: 7298364 - DNA, 22 bp, Homo sapiens
cacccagagcctgagagggata

SEQ ID NO: 7298365 - DNA, 22 bp, Homo sapiens
cacccagagggcttgctgaaca

SEQ ID NO: 7298366 - DNA, 20 bp, Homo sapiens
ggcagttaaggcacagtcat

SEQ ID NO: 7298367 - DNA, 22 bp, Homo sapiens
caccatttaagaaagccaaatt

SEQ ID NO: 7298368 - DNA, 22 bp, Homo sapiens
cacccagacatgtggtcccaga

SEQ ID NO: 7298369 - DNA, 22 bp, Homo sapiens
caccaggctggagtgcagtggc

SEQ ID NO: 7298370 - DNA, 22 bp, Homo sapiens
caccctggctggaggtgcagtg

SEQ ID NO: 7298371 - DNA, 22 bp, Homo sapiens
cacccaggctggaatgcagtgg

SEQ ID NO: 7298372 - DNA, 22 bp, Homo sapiens
cacccaggttggagtgcagtgg

SEQ ID NO: 7298373 - DNA, 22 bp, Homo sapiens
cactgcactccatcctgggaaa

SEQ ID NO: 7298374 - DNA, 22 bp, Homo sapiens
cactgaagatgcgactagtgct

SEQ ID NO: 7298375 - DNA, 22 bp, Homo sapiens
cactggaatggatagagcagag

SEQ ID NO: 7298376 - DNA, 22 bp, Homo sapiens
cactgcttttcagacagttatt

SEQ ID NO: 7298377 - DNA, 22 bp, Homo sapiens
cactggcaaagcctgttcctta

SEQ ID NO: 7298378 - DNA, 18 bp, Homo sapiens
gcagagctgggattccca

SEQ ID NO: 7298379 - DNA, 22 bp, Homo sapiens
attcagttccttgtgattgtag

SEQ ID NO: 7298380 - DNA, 22 bp, Homo sapiens
attcagttagtagatttggtca

SEQ ID NO: 7298381 - DNA, 22 bp, Homo sapiens
attcagtgtagttattatcttt

SEQ ID NO: 7298382 - DNA, 22 bp, Homo sapiens
attcagtgtgaggttttcaagt

SEQ ID NO: 7298383 - DNA, 22 bp, Homo sapiens
attcagtattcttgaaaggttc

SEQ ID NO: 7298384 - DNA, 22 bp, Homo sapiens
attcagtgacctaattacttac

SEQ ID NO: 7298385 - DNA, 22 bp, Homo sapiens
attattgttagtgacagggtga

SEQ ID NO: 7298386 - DNA, 22 bp, Homo sapiens
attcctgattaacgacctttca

SEQ ID NO: 7298387 - DNA, 23 bp, Homo sapiens
attcctgaggctccttatgcacc

SEQ ID NO: 7298388 - DNA, 22 bp, Homo sapiens
attcctgagacttatctgtttc

SEQ ID NO: 7298389 - DNA, 22 bp, Homo sapiens
attcctgactgctagtcattca

SEQ ID NO: 7298390 - DNA, 22 bp, Homo sapiens
attcctgactgttagagtttgc

SEQ ID NO: 7298391 - DNA, 22 bp, Homo sapiens
attccttctaaaacgctgccct

SEQ ID NO: 7298392 - DNA, 22 bp, Homo sapiens
attccttctattctctgtgggt

SEQ ID NO: 7298393 - DNA, 22 bp, Homo sapiens
attccactttatgtctgtatga

SEQ ID NO: 7298394 - DNA, 22 bp, Homo sapiens
attctactttgtgtaattatct

SEQ ID NO: 7298395 - DNA, 22 bp, Homo sapiens
attctagaaggcaaagcaaggg

SEQ ID NO: 7298396 - DNA, 18 bp, Homo sapiens
attctagaagatgccttg

SEQ ID NO: 7298397 - DNA, 22 bp, Homo sapiens
attctattaatatttctaggaa

SEQ ID NO: 7298398 - DNA, 22 bp, Homo sapiens
attctatagacagaaggtcaat

SEQ ID NO: 7298399 - DNA, 22 bp, Homo sapiens
attctatagacagaaggtcaat

SEQ ID NO: 7298400 - DNA, 22 bp, Homo sapiens
attctagacatctgcagttgtt

SEQ ID NO: 7298401 - DNA, 22 bp, Homo sapiens
attcttcacaaatatatagaag

SEQ ID NO: 7298402 - DNA, 22 bp, Homo sapiens
attcttcaccatggataatttg

SEQ ID NO: 7298403 - DNA, 22 bp, Homo sapiens
attcttattaaatagccagaag

SEQ ID NO: 7298404 - DNA, 22 bp, Homo sapiens
attcttaattgccatgctgtat

SEQ ID NO: 7298405 - DNA, 22 bp, Homo sapiens
attcttaattccaaagactgag

SEQ ID NO: 7298406 - DNA, 22 bp, Homo sapiens
attgacagcaggggctgtcact

SEQ ID NO: 7298407 - DNA, 22 bp, Homo sapiens
attgacaagcagtatgtcttag

SEQ ID NO: 7298408 - DNA, 22 bp, Homo sapiens
attgacaagcagtatgtcttag

SEQ ID NO: 7298409 - DNA, 22 bp, Homo sapiens
attgacaagaaagatattttta

SEQ ID NO: 7298410 - DNA, 22 bp, Homo sapiens
attgctggatgagctcttggat

SEQ ID NO: 7298411 - DNA, 22 bp, Homo sapiens
attgacattaactatattagcc

SEQ ID NO: 7298412 - DNA, 22 bp, Homo sapiens
attgctgcttcttgcatgaagt

SEQ ID NO: 7298413 - DNA, 22 bp, Homo sapiens
attgaagattaaatgcttcctt

SEQ ID NO: 7298414 - DNA, 22 bp, Homo sapiens
attgaagagttgattattatct

SEQ ID NO: 7298415 - DNA, 22 bp, Homo sapiens
attattgccagctattacaaca

SEQ ID NO: 7298416 - DNA, 22 bp, Homo sapiens
attagaagatagtgatttctgc

SEQ ID NO: 7298417 - DNA, 22 bp, Homo sapiens
attagaagcgtgaatcctttca

SEQ ID NO: 7298418 - DNA, 21 bp, Homo sapiens
attagaaggtatttagggcct

SEQ ID NO: 7298419 - DNA, 22 bp, Homo sapiens
gcaagttatttccatttaaagc

SEQ ID NO: 7298420 - DNA, 22 bp, Homo sapiens
attagaatgcagggttcattgt

SEQ ID NO: 7298421 - DNA, 22 bp, Homo sapiens
attagaattatgcttgctaatg

SEQ ID NO: 7298422 - DNA, 22 bp, Homo sapiens
attaattttacctttgtaaaca

SEQ ID NO: 7298423 - DNA, 22 bp, Homo sapiens
attaattttacctttgtaaaca

SEQ ID NO: 7298424 - DNA, 22 bp, Homo sapiens
attaatttccaggcactgtgct

SEQ ID NO: 7298425 - DNA, 22 bp, Homo sapiens
attaatgtctaccagttgtgtg

SEQ ID NO: 7298426 - DNA, 22 bp, Homo sapiens
attaagatgtgggaaaatttaa

SEQ ID NO: 7298427 - DNA, 22 bp, Homo sapiens
attaatatcctgctggctaaat

SEQ ID NO: 7298428 - DNA, 22 bp, Homo sapiens
attaatatacactgttagcatg

SEQ ID NO: 7298429 - DNA, 22 bp, Homo sapiens
attacaataaggtttatttgta

SEQ ID NO: 7298430 - DNA, 22 bp, Homo sapiens
attacaataatacatgctcatt

SEQ ID NO: 7298431 - DNA, 22 bp, Homo sapiens
attacaacaagaaaagggtaag

SEQ ID NO: 7298432 - DNA, 22 bp, Homo sapiens
attacaagtagactaactttca

SEQ ID NO: 7298433 - DNA, 22 bp, Homo sapiens
attaaattaagtggctaattta

SEQ ID NO: 7298434 - DNA, 22 bp, Homo sapiens
attaaattagcaaactgtgaaa

SEQ ID NO: 7298435 - DNA, 22 bp, Homo sapiens
attaaaagagataatgtgtgtt

SEQ ID NO: 7298436 - DNA, 22 bp, Homo sapiens
attaaaagcttcccaagagtta

SEQ ID NO: 7298437 - DNA, 22 bp, Homo sapiens
atgttttatattttgcagcagt

SEQ ID NO: 7298438 - DNA, 22 bp, Homo sapiens
atgttttattaccaacttgtac

SEQ ID NO: 7298439 - DNA, 22 bp, Homo sapiens
atgttttccccaaatgatcttc

SEQ ID NO: 7298440 - DNA, 22 bp, Homo sapiens
atgttttgattggttaggtctg

SEQ ID NO: 7298441 - DNA, 22 bp, Homo sapiens
atgtgtgtgtgcgcgcgcagga

SEQ ID NO: 7298442 - DNA, 22 bp, Homo sapiens
atgtgtgtgtgcgcgcgcagga

SEQ ID NO: 7298443 - DNA, 22 bp, Homo sapiens
atgtgtgtgtttaatcctcaaa

SEQ ID NO: 7298444 - DNA, 22 bp, Homo sapiens
atgtgtgtgtttaatcctcaaa

SEQ ID NO: 7298445 - DNA, 22 bp, Homo sapiens
atgtgtgtgtgcgcgcgcagga

SEQ ID NO: 7298446 - DNA, 22 bp, Homo sapiens
atgtgtgtgtatatacacacat

SEQ ID NO: 7298447 - DNA, 22 bp, Homo sapiens
atgtgtgtgtatatacacacat

SEQ ID NO: 7298448 - DNA, 22 bp, Homo sapiens
atgtgtgtgtatatacacacat

SEQ ID NO: 7298449 - DNA, 22 bp, Homo sapiens
atgtgtgtgtttaatcctcaaa

SEQ ID NO: 7298450 - DNA, 22 bp, Homo sapiens
atgttaaaaaccagtacagttg

SEQ ID NO: 7298451 - DNA, 22 bp, Homo sapiens
atgtgtttttattctggcatgt

SEQ ID NO: 7298452 - DNA, 22 bp, Homo sapiens
atgtgtttttattctggcatgt

SEQ ID NO: 7298453 - DNA, 22 bp, Homo sapiens
atgtgttttggtaatttctgct

SEQ ID NO: 7298454 - DNA, 22 bp, Homo sapiens
atgtgttttggtaatttctgct

SEQ ID NO: 7298455 - DNA, 22 bp, Homo sapiens
atgtgttttggtggatcattca

SEQ ID NO: 7298456 - DNA, 22 bp, Homo sapiens
atgtgttttggtggatcattca

SEQ ID NO: 7298457 - DNA, 22 bp, Homo sapiens
atgtgttttggtaatttctgct

SEQ ID NO: 7298458 - DNA, 22 bp, Homo sapiens
atgtgtttataattactcaatc

SEQ ID NO: 7298459 - DNA, 22 bp, Homo sapiens
atgtgtttggttatatggtatt

SEQ ID NO: 7298460 - DNA, 22 bp, Homo sapiens
atgtgttggatattagtgggga

SEQ ID NO: 7298461 - DNA, 22 bp, Homo sapiens
atgtgtttataattactcaatc

SEQ ID NO: 7298462 - DNA, 22 bp, Homo sapiens
atgtgtttgtacctttaaatat

SEQ ID NO: 7298463 - DNA, 22 bp, Homo sapiens
atgtgtttgtacctttaaatat

SEQ ID NO: 7298464 - DNA, 22 bp, Homo sapiens
atgtgtttgtcctgcagaaata

SEQ ID NO: 7298465 - DNA, 22 bp, Homo sapiens
atttcaggaatctgtatgaaag

SEQ ID NO: 7298466 - DNA, 22 bp, Homo sapiens
atttcaggagcagtttcagtgg

SEQ ID NO: 7298467 - DNA, 22 bp, Homo sapiens
atttcagggtaaaaagtgttca

SEQ ID NO: 7298468 - DNA, 22 bp, Homo sapiens
atttcagggagtcatttacaca

SEQ ID NO: 7298469 - DNA, 22 bp, Homo sapiens
atttcaggccaccagatgtctt

SEQ ID NO: 7298470 - DNA, 22 bp, Homo sapiens
atttcaggatagcctagttttg

SEQ ID NO: 7298471 - DNA, 22 bp, Homo sapiens
atttcagtgttggttagcaagc

SEQ ID NO: 7298472 - DNA, 20 bp, Homo sapiens
atttcaggttgtgttctgtt

SEQ ID NO: 7298473 - DNA, 22 bp, Homo sapiens
atttcatctctggaacataact

SEQ ID NO: 7298474 - DNA, 22 bp, Homo sapiens
atttcatggcagactttaaccc

SEQ ID NO: 7298475 - DNA, 22 bp, Homo sapiens
atttcatggtacatcgtgactt

SEQ ID NO: 7298476 - DNA, 18 bp, Homo sapiens
atttctactactataaag

SEQ ID NO: 7298477 - DNA, 22 bp, Homo sapiens
atttccttgcaacttaggcatg

SEQ ID NO: 7298478 - DNA, 22 bp, Homo sapiens
atttccttcggacagtttgggt

SEQ ID NO: 7298479 - DNA, 22 bp, Homo sapiens
atttccttcccagatttggttc

SEQ ID NO: 7298480 - DNA, 22 bp, Homo sapiens
atttcctagggtagatgtcaca

SEQ ID NO: 7298481 - DNA, 22 bp, Homo sapiens
atttcatgtgaagaagagataa

SEQ ID NO: 7298482 - DNA, 21 bp, Homo sapiens
atttcatggtgcttttaagaa

SEQ ID NO: 7298483 - DNA, 21 bp, Homo sapiens
atttcagaaatattggtggga

SEQ ID NO: 7298484 - DNA, 19 bp, Homo sapiens
gccaggcctggacctgcag

SEQ ID NO: 7298485 - DNA, 22 bp, Homo sapiens
gccaggcctgcaagtgctggtg

SEQ ID NO: 7298486 - DNA, 22 bp, Homo sapiens
gccaggccctgggcacttcgtg

SEQ ID NO: 7298487 - DNA, 22 bp, Homo sapiens
atttattggatgcttacttggg

SEQ ID NO: 7298488 - DNA, 22 bp, Homo sapiens
atttattggtttgcatggtgaa

SEQ ID NO: 7298489 - DNA, 22 bp, Homo sapiens
gccaggccactcccgggtcctg

SEQ ID NO: 7298490 - DNA, 22 bp, Homo sapiens
atttattgagagggaggggaat

SEQ ID NO: 7298491 - DNA, 22 bp, Homo sapiens
atttattgagcctttcctatgt

SEQ ID NO: 7298492 - DNA, 22 bp, Homo sapiens
atttattgagacttaacaaccc

SEQ ID NO: 7298493 - DNA, 22 bp, Homo sapiens
atttattgagacttaacaaccc

SEQ ID NO: 7298494 - DNA, 22 bp, Homo sapiens
atttaatttggagagagaaacc

SEQ ID NO: 7298495 - DNA, 22 bp, Homo sapiens
atttaatttggagagagaaacc

SEQ ID NO: 7298496 - DNA, 22 bp, Homo sapiens
attgcttttagtgaaattatat

SEQ ID NO: 7298497 - DNA, 22 bp, Homo sapiens
attgctttagaaagaaaaatat

SEQ ID NO: 7298498 - DNA, 22 bp, Homo sapiens
attgcttttgagctagaatttt

SEQ ID NO: 7298499 - DNA, 18 bp, Homo sapiens
attgcttttgtaccaacc

SEQ ID NO: 7298500 - DNA, 22 bp, Homo sapiens
attgcttttccttaacacatgc

SEQ ID NO: 7298501 - DNA, 22 bp, Homo sapiens
atttactggaaaaactatgagc

SEQ ID NO: 7298502 - DNA, 22 bp, Homo sapiens
atttactttgctgagatccatc

SEQ ID NO: 7298503 - DNA, 22 bp, Homo sapiens
atttactgagcagctaccatgt

SEQ ID NO: 7298504 - DNA, 22 bp, Homo sapiens
atttactgaggtaaataaactg

SEQ ID NO: 7298505 - DNA, 20 bp, Homo sapiens
gccaggagggtgtgatgagc

SEQ ID NO: 7298506 - DNA, 22 bp, Homo sapiens
atttacagaagcatgtaatagc

SEQ ID NO: 7298507 - DNA, 22 bp, Homo sapiens
atttacagaaacttaatcatag

SEQ ID NO: 7298508 - DNA, 22 bp, Homo sapiens
atttacacattcataagatttc

SEQ ID NO: 7298509 - DNA, 22 bp, Homo sapiens
atttacagaagcatgtaatagc

SEQ ID NO: 7298510 - DNA, 22 bp, Homo sapiens
gccagctggagtgagagtgggc

SEQ ID NO: 7298511 - DNA, 23 bp, Homo sapiens
gcctgtgcctatgcccagctctg

SEQ ID NO: 7298512 - DNA, 22 bp, Homo sapiens
gcctgtgcctcagcctgcagcc

SEQ ID NO: 7298513 - DNA, 22 bp, Homo sapiens
gcctgtctcttggaacttggta

SEQ ID NO: 7298514 - DNA, 22 bp, Homo sapiens
caaaacattctctgcagcaggg

SEQ ID NO: 7298515 - DNA, 21 bp, Homo sapiens
caaaacttaggtgacttagga

SEQ ID NO: 7298516 - DNA, 22 bp, Homo sapiens
gcctgtgctgttccctctgcca

SEQ ID NO: 7298517 - DNA, 22 bp, Homo sapiens
caaaaaacacctgtgtgagtat

SEQ ID NO: 7298518 - DNA, 22 bp, Homo sapiens
caaaacattcagagagctcact

SEQ ID NO: 7298519 - DNA, 22 bp, Homo sapiens
caaacattgcactttctgctat

SEQ ID NO: 7298520 - DNA, 22 bp, Homo sapiens
caaactgagcatcagaaagttt

SEQ ID NO: 7298521 - DNA, 22 bp, Homo sapiens
caaactgaacacgaaagtcttt

SEQ ID NO: 7298522 - DNA, 22 bp, Homo sapiens
caaacttttcctggaaaagatt

SEQ ID NO: 7298523 - DNA, 22 bp, Homo sapiens
caaactttcagttataacatga

SEQ ID NO: 7298524 - DNA, 22 bp, Homo sapiens
gcctggagctactggacactga

SEQ ID NO: 7298525 - DNA, 22 bp, Homo sapiens
gcctcactgcagccccaggaag

SEQ ID NO: 7298526 - DNA, 22 bp, Homo sapiens
gcctcactgcagccccaggaag

SEQ ID NO: 7298527 - DNA, 22 bp, Homo sapiens
atttctcaaaggaatagagtga

SEQ ID NO: 7298528 - DNA, 22 bp, Homo sapiens
cttggtcaaatgcaggcttccc

SEQ ID NO: 7298529 - DNA, 22 bp, Homo sapiens
cttggtcatttggggctgctat

SEQ ID NO: 7298530 - DNA, 22 bp, Homo sapiens
cttggtcatgcaagatatcgat

SEQ ID NO: 7298531 - DNA, 22 bp, Homo sapiens
cttggtcatttcttgtcctgtt

SEQ ID NO: 7298532 - DNA, 22 bp, Homo sapiens
cttggtcatcgataattgaatc

SEQ ID NO: 7298533 - DNA, 22 bp, Homo sapiens
cttggtcagctcgagagtttgt

SEQ ID NO: 7298534 - DNA, 22 bp, Homo sapiens
cttggtcaggcttttgtaactg

SEQ ID NO: 7298535 - DNA, 22 bp, Homo sapiens
cttggtcagaggggctggcatg

SEQ ID NO: 7298536 - DNA, 22 bp, Homo sapiens
cttggtcacaggcttgtgtgct

SEQ ID NO: 7298537 - DNA, 22 bp, Homo sapiens
cttggtcacagttcccaacatt

SEQ ID NO: 7298538 - DNA, 22 bp, Homo sapiens
cttggccagacagggagctcca

SEQ ID NO: 7298539 - DNA, 22 bp, Homo sapiens
cttgctggggtaagtctgtgct

SEQ ID NO: 7298540 - DNA, 22 bp, Homo sapiens
cttgtaaaatatccagttaagg

SEQ ID NO: 7298541 - DNA, 22 bp, Homo sapiens
cttggtcttgggagcagggaca

SEQ ID NO: 7298542 - DNA, 22 bp, Homo sapiens
atcttctatagatattctgaag

SEQ ID NO: 7298543 - DNA, 20 bp, Homo sapiens
atcttcttggccagcttgct

SEQ ID NO: 7298544 - DNA, 22 bp, Homo sapiens
atcttctggtcaaatttttgca

SEQ ID NO: 7298545 - DNA, 22 bp, Homo sapiens
atcttcttcaaggatctggagc

SEQ ID NO: 7298546 - DNA, 22 bp, Homo sapiens
cttgcctttgtcttcaaaggct

SEQ ID NO: 7298547 - DNA, 22 bp, Homo sapiens
cttgctctgggaagaaaaagtc

SEQ ID NO: 7298548 - DNA, 22 bp, Homo sapiens
cttgatctacatagtgaaaccc

SEQ ID NO: 7298549 - DNA, 19 bp, Homo sapiens
cttgcctgttcctacagct

SEQ ID NO: 7298550 - DNA, 23 bp, Homo sapiens
cttgcctggcctctctgcccaga

SEQ ID NO: 7298551 - DNA, 22 bp, Homo sapiens
atctacattctcaccaatgttt

SEQ ID NO: 7298552 - DNA, 22 bp, Homo sapiens
atctacatgttgatttaaagaa

SEQ ID NO: 7298553 - DNA, 22 bp, Homo sapiens
atctacataaaacgaatacata

SEQ ID NO: 7298554 - DNA, 22 bp, Homo sapiens
atctacaggatagtttaatatt

SEQ ID NO: 7298555 - DNA, 22 bp, Homo sapiens
atctagattaggtataagagct

SEQ ID NO: 7298556 - DNA, 22 bp, Homo sapiens
atctagcaccaaactagctttt

SEQ ID NO: 7298557 - DNA, 22 bp, Homo sapiens
atgaaattaatcaacacataca

SEQ ID NO: 7298558 - DNA, 22 bp, Homo sapiens
atgaaatgtgaatgcttttcat

SEQ ID NO: 7298559 - DNA, 22 bp, Homo sapiens
cttttcaaacgctgatgtcagt

SEQ ID NO: 7298560 - DNA, 22 bp, Homo sapiens
atgaaatgtaagtagagagttt

SEQ ID NO: 7298561 - DNA, 22 bp, Homo sapiens
atgaaatggtggttttccattt

SEQ ID NO: 7298562 - DNA, 22 bp, Homo sapiens
atgaaatatcttgaagaaattc

SEQ ID NO: 7298563 - DNA, 22 bp, Homo sapiens
atgaaatatttcagagcagagt

SEQ ID NO: 7298564 - DNA, 22 bp, Homo sapiens
cttgttgctaacatatgcttct

SEQ ID NO: 7298565 - DNA, 18 bp, Homo sapiens
cttgttcttctcttggcg

SEQ ID NO: 7298566 - DNA, 22 bp, Homo sapiens
atgaaatatcttgaagaaattc

SEQ ID NO: 7298567 - DNA, 22 bp, Homo sapiens
cttgtgtggtctggtcttgcta

SEQ ID NO: 7298568 - DNA, 22 bp, Homo sapiens
cttgttatctccgtgtccttgt

SEQ ID NO: 7298569 - DNA, 22 bp, Homo sapiens
cttgtgtggtctggtcttgcta

SEQ ID NO: 7298570 - DNA, 22 bp, Homo sapiens
atctttttatctgtttggaaca

SEQ ID NO: 7298571 - DNA, 22 bp, Homo sapiens
atcttttttgtcttggtcactg

SEQ ID NO: 7298572 - DNA, 22 bp, Homo sapiens
atcttttttgtcttggtcactg

SEQ ID NO: 7298573 - DNA, 22 bp, Homo sapiens
atgaaaacggaccagagctatt

SEQ ID NO: 7298574 - DNA, 22 bp, Homo sapiens
atcttttatgagcgttctgaca

SEQ ID NO: 7298575 - DNA, 22 bp, Homo sapiens
atctttgggcaatgatgaggga

SEQ ID NO: 7298576 - DNA, 22 bp, Homo sapiens
atgagttgaagctacaagaggc

SEQ ID NO: 7298577 - DNA, 20 bp, Homo sapiens
atgagtttaaacattcagag

SEQ ID NO: 7298578 - DNA, 22 bp, Homo sapiens
atgattttttctaacacagtcg

SEQ ID NO: 7298579 - DNA, 22 bp, Homo sapiens
atgattttttctaacacagtcg

SEQ ID NO: 7298580 - DNA, 20 bp, Homo sapiens
atgattttgcactaacttca

SEQ ID NO: 7298581 - DNA, 22 bp, Homo sapiens
atgatttttcagcagaggatct

SEQ ID NO: 7298582 - DNA, 22 bp, Homo sapiens
atgaagatttataattgccttt

SEQ ID NO: 7298583 - DNA, 22 bp, Homo sapiens
atgaagatttcccagagacatg

SEQ ID NO: 7298584 - DNA, 22 bp, Homo sapiens
gaaagcaagttgactgcagaat

SEQ ID NO: 7298585 - DNA, 21 bp, Homo sapiens
gaaagcacagaaaggactctt

SEQ ID NO: 7298586 - DNA, 22 bp, Homo sapiens
atgcaggaagtcggggagcggg

SEQ ID NO: 7298587 - DNA, 23 bp, Homo sapiens
atgcatcatgaaaactagagagc

SEQ ID NO: 7298588 - DNA, 22 bp, Homo sapiens
atgcatgtttatagggtgcttc

SEQ ID NO: 7298589 - DNA, 22 bp, Homo sapiens
atgcatgttaagctcttaaaat

SEQ ID NO: 7298590 - DNA, 22 bp, Homo sapiens
atgcatgttgcttggcccactc

SEQ ID NO: 7298591 - DNA, 22 bp, Homo sapiens
atgcatgtttaaggggcatgca

SEQ ID NO: 7298592 - DNA, 21 bp, Homo sapiens
atgcatgttacagtatatgcc

SEQ ID NO: 7298593 - DNA, 22 bp, Homo sapiens
atgcatgttactgcccccgtct

SEQ ID NO: 7298594 - DNA, 21 bp, Homo sapiens
atgcatgttccataaagtggg

SEQ ID NO: 7298595 - DNA, 22 bp, Homo sapiens
atgcatgtgtgtagcatcagca

SEQ ID NO: 7298596 - DNA, 22 bp, Homo sapiens
atgcatgttaagcctgactgga

SEQ ID NO: 7298597 - DNA, 22 bp, Homo sapiens
atgcatgtgtgaattatttgac

SEQ ID NO: 7298598 - DNA, 22 bp, Homo sapiens
atgcatgtgtgagagcaagagg

SEQ ID NO: 7298599 - DNA, 22 bp, Homo sapiens
atgcatgtgtgtttacatgctt

SEQ ID NO: 7298600 - DNA, 22 bp, Homo sapiens
atgcatgtctgccagttgctta

SEQ ID NO: 7298601 - DNA, 22 bp, Homo sapiens
atgcatgtgacatgatcctgga

SEQ ID NO: 7298602 - DNA, 22 bp, Homo sapiens
atgcatgtattatctagatgag

SEQ ID NO: 7298603 - DNA, 22 bp, Homo sapiens
atgcatgtcagctgtgcccatg

SEQ ID NO: 7298604 - DNA, 22 bp, Homo sapiens
atgcatgtattcatgtgtgaca

SEQ ID NO: 7298605 - DNA, 22 bp, Homo sapiens
atgcatgtgcatggctctatct

SEQ ID NO: 7298606 - DNA, 22 bp, Homo sapiens
atgcatgtgcatacatgcacag

SEQ ID NO: 7298607 - DNA, 22 bp, Homo sapiens
atgcatgtggatagacggagat

SEQ ID NO: 7298608 - DNA, 22 bp, Homo sapiens
atgcatgtgtgaaagtctggca

SEQ ID NO: 7298609 - DNA, 22 bp, Homo sapiens
atgcatgtgtacatgcatagca

SEQ ID NO: 7298610 - DNA, 22 bp, Homo sapiens
atgcatgtatatattacactca

SEQ ID NO: 7298611 - DNA, 22 bp, Homo sapiens
atgcatgtaggctaaggtgtgt

SEQ ID NO: 7298612 - DNA, 22 bp, Homo sapiens
atgcatgtaacagtgttatgaa

SEQ ID NO: 7298613 - DNA, 22 bp, Homo sapiens
atgcattgtaacgatgtgcaca

SEQ ID NO: 7298614 - DNA, 22 bp, Homo sapiens
atgcaaaagtaattgcaatttt

SEQ ID NO: 7298615 - DNA, 22 bp, Homo sapiens
atgcaaataaagcaactataca

SEQ ID NO: 7298616 - DNA, 20 bp, Homo sapiens
atgcaaatcccaaaatcagg

SEQ ID NO: 7298617 - DNA, 20 bp, Homo sapiens
atgcaaatcccaaaatcagg

SEQ ID NO: 7298618 - DNA, 22 bp, Homo sapiens
atggccagtctattcatggtta

SEQ ID NO: 7298619 - DNA, 22 bp, Homo sapiens
gagaggaaagatatatacttct

SEQ ID NO: 7298620 - DNA, 22 bp, Homo sapiens
gagagctgtttatcttcttcaa

SEQ ID NO: 7298621 - DNA, 22 bp, Homo sapiens
gagaacactaatggtttcttaa

SEQ ID NO: 7298622 - DNA, 20 bp, Homo sapiens
atggcagtccgtgttcaggg

SEQ ID NO: 7298623 - DNA, 22 bp, Homo sapiens
gagcagtgactggagcatgaga

SEQ ID NO: 7298624 - DNA, 22 bp, Homo sapiens
atggccctggcccagaccccac

SEQ ID NO: 7298625 - DNA, 22 bp, Homo sapiens
atggccctgccaggaggaacaa

SEQ ID NO: 7298626 - DNA, 22 bp, Homo sapiens
gagccagctacatggtctgcaa

SEQ ID NO: 7298627 - DNA, 22 bp, Homo sapiens
gagccagctgagctgcactgtc

SEQ ID NO: 7298628 - DNA, 22 bp, Homo sapiens
gacagcaacactcaattctgca

SEQ ID NO: 7298629 - DNA, 23 bp, Homo sapiens
gacagagtgagaccttgtcttac

SEQ ID NO: 7298630 - DNA, 18 bp, Homo sapiens
gacactgagcattttgag

SEQ ID NO: 7298631 - DNA, 21 bp, Homo sapiens
atggaaattggcaaatgctac

SEQ ID NO: 7298632 - DNA, 22 bp, Homo sapiens
atggaaatgtaacttctgattc

SEQ ID NO: 7298633 - DNA, 22 bp, Homo sapiens
atggaaaaggctgatttcatta

SEQ ID NO: 7298634 - DNA, 22 bp, Homo sapiens
atggaaatgatggaacattaaa

SEQ ID NO: 7298635 - DNA, 22 bp, Homo sapiens
atggaaatgatggaacattaaa

SEQ ID NO: 7298636 - DNA, 22 bp, Homo sapiens
atgccactgtactcaacaatag

SEQ ID NO: 7298637 - DNA, 22 bp, Homo sapiens
atggaagaaagagacaatttga

SEQ ID NO: 7298638 - DNA, 22 bp, Homo sapiens
atggaagacagataaggcagaa

SEQ ID NO: 7298639 - DNA, 22 bp, Homo sapiens
atggaagactaacagaaacatg

SEQ ID NO: 7298640 - DNA, 22 bp, Homo sapiens
atggaagggacagaagggcaag

SEQ ID NO: 7298641 - DNA, 22 bp, Homo sapiens
atggaaggtcctacagagcgca

SEQ ID NO: 7298642 - DNA, 20 bp, Homo sapiens
atggaggaagggcaagagaa

SEQ ID NO: 7298643 - DNA, 22 bp, Homo sapiens
atggagatttttagaattacag

SEQ ID NO: 7298644 - DNA, 22 bp, Homo sapiens
atggagcacacgccatcacata

SEQ ID NO: 7298645 - DNA, 22 bp, Homo sapiens
atggagcacacgccatcacata

SEQ ID NO: 7298646 - DNA, 22 bp, Homo sapiens
atggagacattacactaagtga

SEQ ID NO: 7298647 - DNA, 22 bp, Homo sapiens
gagaaatgcatgcatgtcatca

SEQ ID NO: 7298648 - DNA, 22 bp, Homo sapiens
gagaaagggataatttgaagag

SEQ ID NO: 7298649 - DNA, 22 bp, Homo sapiens
gagaaaggtactattccctcca

SEQ ID NO: 7298650 - DNA, 22 bp, Homo sapiens
gagaaaggtactattccctcca

SEQ ID NO: 7298651 - DNA, 22 bp, Homo sapiens
atgtacatttgtagtaatatca

SEQ ID NO: 7298652 - DNA, 22 bp, Homo sapiens
atgtacatttgtagtaatatca

SEQ ID NO: 7298653 - DNA, 21 bp, Homo sapiens
atgtacattcggcaacagata

SEQ ID NO: 7298654 - DNA, 22 bp, Homo sapiens
atgtacatgtttaagtgaagga

SEQ ID NO: 7298655 - DNA, 22 bp, Homo sapiens
atgtacattattcgagtgatgg

SEQ ID NO: 7298656 - DNA, 17 bp, Homo sapiens
gaggagctccagtaggt

SEQ ID NO: 7298657 - DNA, 22 bp, Homo sapiens
gaggagctcatgaaagcggtgt

SEQ ID NO: 7298658 - DNA, 20 bp, Homo sapiens
atgtactacaggtgataaag

SEQ ID NO: 7298659 - DNA, 22 bp, Homo sapiens
atgtactactacttgagtgagc

SEQ ID NO: 7298660 - DNA, 22 bp, Homo sapiens
gaggagctgcagggggagtcta

SEQ ID NO: 7298661 - DNA, 22 bp, Homo sapiens
gaggagctgcccgtgtgtctgc

SEQ ID NO: 7298662 - DNA, 22 bp, Homo sapiens
gaggagctgatatttataatga

SEQ ID NO: 7298663 - DNA, 22 bp, Homo sapiens
gaggagctgaggctgaggcctc

SEQ ID NO: 7298664 - DNA, 22 bp, Homo sapiens
gaggagctgagccacgtcctgg

SEQ ID NO: 7298665 - DNA, 22 bp, Homo sapiens
gaggagctctgctccatccttc

SEQ ID NO: 7298666 - DNA, 22 bp, Homo sapiens
gaggccagggatgcaatgagag

SEQ ID NO: 7298667 - DNA, 22 bp, Homo sapiens
gaggccaggagtgctgtaagtt

SEQ ID NO: 7298668 - DNA, 22 bp, Homo sapiens
gaggagctggctgtcgggaggc

SEQ ID NO: 7298669 - DNA, 22 bp, Homo sapiens
gaggagctgcccgtgtgtctgc

SEQ ID NO: 7298670 - DNA, 22 bp, Homo sapiens
gaggagctggcagcgtctccgc

SEQ ID NO: 7298671 - DNA, 22 bp, Homo sapiens
gaggagctggcgctatttatga

SEQ ID NO: 7298672 - DNA, 22 bp, Homo sapiens
gaggagctgggctgagagggtc

SEQ ID NO: 7298673 - DNA, 22 bp, Homo sapiens
gaggagctgggaccctgtcatc

SEQ ID NO: 7298674 - DNA, 22 bp, Homo sapiens
atggctggatttgatccatggg

SEQ ID NO: 7298675 - DNA, 22 bp, Homo sapiens
atgggttcaagtgattctcctg

SEQ ID NO: 7298676 - DNA, 22 bp, Homo sapiens
atggtaaaagatatactgtgca

SEQ ID NO: 7298677 - DNA, 22 bp, Homo sapiens
atggggctgaaacatggaagag

SEQ ID NO: 7298678 - DNA, 22 bp, Homo sapiens
atggtcacaccactgtactcca

SEQ ID NO: 7298679 - DNA, 22 bp, Homo sapiens
atggtatagagccacatgtatt

SEQ ID NO: 7298680 - DNA, 22 bp, Homo sapiens
atggtcacttcacccatgagct

SEQ ID NO: 7298681 - DNA, 22 bp, Homo sapiens
atggtcactttttgactgttca

SEQ ID NO: 7298682 - DNA, 22 bp, Homo sapiens
atggtcacagagcttaattaat

SEQ ID NO: 7298683 - DNA, 22 bp, Homo sapiens
atggtcacatgaccctttccaa

SEQ ID NO: 7298684 - DNA, 22 bp, Homo sapiens
atggtcaccttgggagcctgct

SEQ ID NO: 7298685 - DNA, 22 bp, Homo sapiens
gagctgggcctgcgagtgctgc

SEQ ID NO: 7298686 - DNA, 22 bp, Homo sapiens
atgtacatctttataacaagct

SEQ ID NO: 7298687 - DNA, 21 bp, Homo sapiens
gagctgggcgaggctccgggg

SEQ ID NO: 7298688 - DNA, 22 bp, Homo sapiens
gaggggagaggcttatggatca

SEQ ID NO: 7298689 - DNA, 22 bp, Homo sapiens
atgtgtcttgagggggatggag

SEQ ID NO: 7298690 - DNA, 22 bp, Homo sapiens
atgtgtcttctgtgggtttgaa

SEQ ID NO: 7298691 - DNA, 22 bp, Homo sapiens
atgtgtgtatgtgcctatatct

SEQ ID NO: 7298692 - DNA, 22 bp, Homo sapiens
atgtgtgtgatgggcgccgcca

SEQ ID NO: 7298693 - DNA, 22 bp, Homo sapiens
atgtgtgtgatgggcgccgcca

SEQ ID NO: 7298694 - DNA, 22 bp, Homo sapiens
atgtgtgtgatgggcgccgcca

SEQ ID NO: 7298695 - DNA, 22 bp, Homo sapiens
atgtgtgtgcatttctctccct

SEQ ID NO: 7298696 - DNA, 22 bp, Homo sapiens
atgtgtgtgcatttctctccct

SEQ ID NO: 7298697 - DNA, 22 bp, Homo sapiens
atgtgtgtgcatttctctccct

SEQ ID NO: 7298698 - DNA, 22 bp, Homo sapiens
atgtgtgtatatatagtcattt

SEQ ID NO: 7298699 - DNA, 22 bp, Homo sapiens
atgtgtgtatatatagtcattt

SEQ ID NO: 7298700 - DNA, 22 bp, Homo sapiens
atgtgtgtatgtgcctatatct

SEQ ID NO: 7298701 - DNA, 22 bp, Homo sapiens
atgtgtgtatgtgcctatatct

SEQ ID NO: 7298702 - DNA, 22 bp, Homo sapiens
atgtgtgtatatatagtcattt

SEQ ID NO: 7298703 - DNA, 22 bp, Homo sapiens
atgtgtcttggagttttaatgt

SEQ ID NO: 7298704 - DNA, 22 bp, Homo sapiens
atgtgtcttgcggcagttggta

SEQ ID NO: 7298705 - DNA, 22 bp, Homo sapiens
atgtgtcttgcggcagttggta

SEQ ID NO: 7298706 - DNA, 22 bp, Homo sapiens
atgtgtcttgagggggatggag

SEQ ID NO: 7298707 - DNA, 22 bp, Homo sapiens
atgtgtatgagtgtgcttcttt

SEQ ID NO: 7298708 - DNA, 22 bp, Homo sapiens
atgtgtatgtcttattcaaaga

SEQ ID NO: 7298709 - DNA, 22 bp, Homo sapiens
atgtgtatgcatgcactaagat

SEQ ID NO: 7298710 - DNA, 22 bp, Homo sapiens
atgtgtatgcatgcactaagat

SEQ ID NO: 7298711 - DNA, 22 bp, Homo sapiens
atgtgtatgatacctttgctga

SEQ ID NO: 7298712 - DNA, 22 bp, Homo sapiens
atgtgtatgatacctttgctga

SEQ ID NO: 7298713 - DNA, 22 bp, Homo sapiens
atgtgtattacctcgattgtga

SEQ ID NO: 7298714 - DNA, 22 bp, Homo sapiens
atgtgtattaccctttcattcc

SEQ ID NO: 7298715 - DNA, 22 bp, Homo sapiens
atgtgtatgtcttattcaaaga

SEQ ID NO: 7298716 - DNA, 22 bp, Homo sapiens
atgtgtatgtgtatacacacag

SEQ ID NO: 7298717 - DNA, 22 bp, Homo sapiens
atgtgtatgtgtatacacacag

SEQ ID NO: 7298718 - DNA, 22 bp, Homo sapiens
atgtgtattaccctttcattcc

SEQ ID NO: 7298719 - DNA, 22 bp, Homo sapiens
atgtgtattttgtactattggg

SEQ ID NO: 7298720 - DNA, 22 bp, Homo sapiens
atgtgtattagttagtttaatg

SEQ ID NO: 7298721 - DNA, 22 bp, Homo sapiens
atgtgtattagttagtttaatg

SEQ ID NO: 7298722 - DNA, 22 bp, Homo sapiens
atgtgtattgagcacctactgc

SEQ ID NO: 7298723 - DNA, 22 bp, Homo sapiens
atgtgtattgagcacctactgc

SEQ ID NO: 7298724 - DNA, 22 bp, Homo sapiens
atgtgtatttatttggggctta

SEQ ID NO: 7298725 - DNA, 22 bp, Homo sapiens
atgtgtatttatttggggctta

SEQ ID NO: 7298726 - DNA, 22 bp, Homo sapiens
atgtgtatttccatcgatcagc

SEQ ID NO: 7298727 - DNA, 22 bp, Homo sapiens
atgtgtatttccatcgatcagc

SEQ ID NO: 7298728 - DNA, 22 bp, Homo sapiens
atgtctttgccatagttcatat

SEQ ID NO: 7298729 - DNA, 22 bp, Homo sapiens
atgtgaaaatccaatggcagca

SEQ ID NO: 7298730 - DNA, 22 bp, Homo sapiens
atgtgaaaaatttcttattaca

SEQ ID NO: 7298731 - DNA, 22 bp, Homo sapiens
atgtctttgccatagttcatat

SEQ ID NO: 7298732 - DNA, 22 bp, Homo sapiens
gaggcctggctgggaggaggtg

SEQ ID NO: 7298733 - DNA, 22 bp, Homo sapiens
atgtctttcaaattctgcctag

SEQ ID NO: 7298734 - DNA, 22 bp, Homo sapiens
atgtctttaaacttgagttgtt

SEQ ID NO: 7298735 - DNA, 22 bp, Homo sapiens
atgtctttataaatgtataatg

SEQ ID NO: 7298736 - DNA, 22 bp, Homo sapiens
atgtctttattaatatcatgcc

SEQ ID NO: 7298737 - DNA, 22 bp, Homo sapiens
atgtctttataaatgtataatg

SEQ ID NO: 7298738 - DNA, 22 bp, Homo sapiens
gaggcctgggttacctactcgt

SEQ ID NO: 7298739 - DNA, 22 bp, Homo sapiens
tcagaagtcccagaattcacat

SEQ ID NO: 7298740 - DNA, 22 bp, Homo sapiens
tcagaagtaggagacattcttg

SEQ ID NO: 7298741 - DNA, 22 bp, Homo sapiens
cagtttggggtcggagtcaggg

SEQ ID NO: 7298742 - DNA, 22 bp, Homo sapiens
cagtttggtacatagttcaaaa

SEQ ID NO: 7298743 - DNA, 22 bp, Homo sapiens
cagtttctttccattgttacct

SEQ ID NO: 7298744 - DNA, 22 bp, Homo sapiens
cataatttttttaagtcagaac

SEQ ID NO: 7298745 - DNA, 22 bp, Homo sapiens
catacatttatacacatctatg

SEQ ID NO: 7298746 - DNA, 22 bp, Homo sapiens
catacattgctcattcagtatc

SEQ ID NO: 7298747 - DNA, 22 bp, Homo sapiens
catacttttgccctgacattct

SEQ ID NO: 7298748 - DNA, 20 bp, Homo sapiens
tcagctctgtgcctgggatg

SEQ ID NO: 7298749 - DNA, 22 bp, Homo sapiens
tcagcccatcactcacgtatta

SEQ ID NO: 7298750 - DNA, 22 bp, Homo sapiens
catatattctggttttcactgg

SEQ ID NO: 7298751 - DNA, 22 bp, Homo sapiens
catatatgtagatgtatgtgaa

SEQ ID NO: 7298752 - DNA, 22 bp, Homo sapiens
catatatgtagatgtatgtgaa

SEQ ID NO: 7298753 - DNA, 20 bp, Homo sapiens
catatatacctagaagtgga

SEQ ID NO: 7298754 - DNA, 20 bp, Homo sapiens
catatatacctagaagtgga

SEQ ID NO: 7298755 - DNA, 22 bp, Homo sapiens
catatactgcatacatatgtgt

SEQ ID NO: 7298756 - DNA, 22 bp, Homo sapiens
catatacttttctatagctttc

SEQ ID NO: 7298757 - DNA, 22 bp, Homo sapiens
catatactgcatacatatgtgt

SEQ ID NO: 7298758 - DNA, 22 bp, Homo sapiens
catatcatttgcttataaatct

SEQ ID NO: 7298759 - DNA, 22 bp, Homo sapiens
catatcatttgcttataaatct

SEQ ID NO: 7298760 - DNA, 22 bp, Homo sapiens
catatcttatggttttctaagt

SEQ ID NO: 7298761 - DNA, 21 bp, Homo sapiens
catatgaaagaagtatctgac

SEQ ID NO: 7298762 - DNA, 23 bp, Homo sapiens
catatgaaagtagacactttcca

SEQ ID NO: 7298763 - DNA, 23 bp, Homo sapiens
catatgaaagtagacactttcca

SEQ ID NO: 7298764 - DNA, 22 bp, Homo sapiens
catatgaaatatgagttgaaca

SEQ ID NO: 7298765 - DNA, 22 bp, Homo sapiens
catatgaagttcaacagagatg

SEQ ID NO: 7298766 - DNA, 23 bp, Homo sapiens
catatgaattttagaggcagttt

SEQ ID NO: 7298767 - DNA, 19 bp, Homo sapiens
tcaggaagttgatgaggtg

SEQ ID NO: 7298768 - DNA, 22 bp, Homo sapiens
catagacattcagcactcacta

SEQ ID NO: 7298769 - DNA, 22 bp, Homo sapiens
catatacacttccacctctgtg

SEQ ID NO: 7298770 - DNA, 22 bp, Homo sapiens
catataatgtttgaagatgtgg

SEQ ID NO: 7298771 - DNA, 22 bp, Homo sapiens
tcaggaagtctcaattagctac

SEQ ID NO: 7298772 - DNA, 22 bp, Homo sapiens
tcaggaagtgcctaggctggcc

SEQ ID NO: 7298773 - DNA, 22 bp, Homo sapiens
tcaggaagtgctgaggctgctt

SEQ ID NO: 7298774 - DNA, 22 bp, Homo sapiens
tcaggaagtggtaaaggatgtt

SEQ ID NO: 7298775 - DNA, 19 bp, Homo sapiens
catcacatggtctgatgaa

SEQ ID NO: 7298776 - DNA, 22 bp, Homo sapiens
catccagcccacgataaagagg

SEQ ID NO: 7298777 - DNA, 22 bp, Homo sapiens
catccaatgtcctattaagact

SEQ ID NO: 7298778 - DNA, 22 bp, Homo sapiens
catccaatgtcctattaagact

SEQ ID NO: 7298779 - DNA, 22 bp, Homo sapiens
catcacaaatgtaataatgtct

SEQ ID NO: 7298780 - DNA, 22 bp, Homo sapiens
tcagggccatcttttgcctcaa

SEQ ID NO: 7298781 - DNA, 22 bp, Homo sapiens
tcagggccacaacaccagagtc

SEQ ID NO: 7298782 - DNA, 22 bp, Homo sapiens
tcattttcacacataaatagca

SEQ ID NO: 7298783 - DNA, 22 bp, Homo sapiens
tcatttttagcgcgcaaaagtt

SEQ ID NO: 7298784 - DNA, 22 bp, Homo sapiens
tcattttggggtttgtcatctt

SEQ ID NO: 7298785 - DNA, 22 bp, Homo sapiens
catgatttactaaaatttgttt

SEQ ID NO: 7298786 - DNA, 22 bp, Homo sapiens
catgtacatgcctactatcaat

SEQ ID NO: 7298787 - DNA, 22 bp, Homo sapiens
catgtacatgcctactatcaat

SEQ ID NO: 7298788 - DNA, 22 bp, Homo sapiens
catccccagagcagttccacta

SEQ ID NO: 7298789 - DNA, 22 bp, Homo sapiens
catcttaaattaaagcttaagg

SEQ ID NO: 7298790 - DNA, 22 bp, Homo sapiens
catctttaacaatttacaatgt

SEQ ID NO: 7298791 - DNA, 22 bp, Homo sapiens
catctttaaaggggagacaccc

SEQ ID NO: 7298792 - DNA, 22 bp, Homo sapiens
catctttgccatatgatgtaat

SEQ ID NO: 7298793 - DNA, 22 bp, Homo sapiens
catctttgcccatccacttcca

SEQ ID NO: 7298794 - DNA, 22 bp, Homo sapiens
catctttagttattgaatatag

SEQ ID NO: 7298795 - DNA, 22 bp, Homo sapiens
catctttagtaggttctggaga

SEQ ID NO: 7298796 - DNA, 22 bp, Homo sapiens
catctttaatttgtgacaacta

SEQ ID NO: 7298797 - DNA, 22 bp, Homo sapiens
catctttagggaccattattct

SEQ ID NO: 7298798 - DNA, 22 bp, Homo sapiens
catctttatttatatagacagg

SEQ ID NO: 7298799 - DNA, 22 bp, Homo sapiens
catctttgaactctgtataaac

SEQ ID NO: 7298800 - DNA, 22 bp, Homo sapiens
catctttgcaccctcaaaacct

SEQ ID NO: 7298801 - DNA, 22 bp, Homo sapiens
catctttgagacagcattaccc

SEQ ID NO: 7298802 - DNA, 22 bp, Homo sapiens
catgattgatccttctaaatgc

SEQ ID NO: 7298803 - DNA, 22 bp, Homo sapiens
tcatggggtgacagaagggagg

SEQ ID NO: 7298804 - DNA, 22 bp, Homo sapiens
tcatttgtttctgtttggggct

SEQ ID NO: 7298805 - DNA, 22 bp, Homo sapiens
tcatttgtttaggtagcaccat

SEQ ID NO: 7298806 - DNA, 18 bp, Homo sapiens
tcatttgttttgcatgaa

SEQ ID NO: 7298807 - DNA, 22 bp, Homo sapiens
tcatttgttgaactttagtgcg

SEQ ID NO: 7298808 - DNA, 22 bp, Homo sapiens
tcatttatttgactttggagtg

SEQ ID NO: 7298809 - DNA, 22 bp, Homo sapiens
tcatttcaagttctgacagcta

SEQ ID NO: 7298810 - DNA, 22 bp, Homo sapiens
catgatcagaaagagaagctag

SEQ ID NO: 7298811 - DNA, 22 bp, Homo sapiens
catgatcaccacttgacagccc

SEQ ID NO: 7298812 - DNA, 22 bp, Homo sapiens
catgatacttgaatttggaagg

SEQ ID NO: 7298813 - DNA, 21 bp, Homo sapiens
catgataatgaaggtgttatt

SEQ ID NO: 7298814 - DNA, 23 bp, Homo sapiens
catgatgttaactttgttatgct

SEQ ID NO: 7298815 - DNA, 22 bp, Homo sapiens
catgagaagtggccttcaaaaa

SEQ ID NO: 7298816 - DNA, 22 bp, Homo sapiens
tatctgtaaaccaaggaggctt

SEQ ID NO: 7298817 - DNA, 22 bp, Homo sapiens
tatctcccaactagactctgca

SEQ ID NO: 7298818 - DNA, 22 bp, Homo sapiens
tatctctttcattttagagtca

SEQ ID NO: 7298819 - DNA, 22 bp, Homo sapiens
tatctcttgtctgttttgcaaa

SEQ ID NO: 7298820 - DNA, 22 bp, Homo sapiens
tatgtactaactttcattctag

SEQ ID NO: 7298821 - DNA, 22 bp, Homo sapiens
tattgctgccaggaccctatcc

SEQ ID NO: 7298822 - DNA, 22 bp, Homo sapiens
tatgtgtcccttggtgtagcaa

SEQ ID NO: 7298823 - DNA, 22 bp, Homo sapiens
tatgtgtatttagttctataca

SEQ ID NO: 7298824 - DNA, 22 bp, Homo sapiens
tatgtgtatttagttctataca

SEQ ID NO: 7298825 - DNA, 22 bp, Homo sapiens
tatgtgtatgtacatacataca

SEQ ID NO: 7298826 - DNA, 19 bp, Homo sapiens
tatgtgtatatgtatctgt

SEQ ID NO: 7298827 - DNA, 19 bp, Homo sapiens
tatgtgtatatgtatctgt

SEQ ID NO: 7298828 - DNA, 22 bp, Homo sapiens
tatgtgtatgtacatacataca

SEQ ID NO: 7298829 - DNA, 22 bp, Homo sapiens
tatgtgtatgttcattcatgca

SEQ ID NO: 7298830 - DNA, 22 bp, Homo sapiens
tatgtgtactcgttaaatattt

SEQ ID NO: 7298831 - DNA, 22 bp, Homo sapiens
tatgtgtactcgttaaatattt

SEQ ID NO: 7298832 - DNA, 22 bp, Homo sapiens
tatgtgtatacctatacatgtg

SEQ ID NO: 7298833 - DNA, 22 bp, Homo sapiens
tatgtgtatacctatacatgtg

SEQ ID NO: 7298834 - DNA, 22 bp, Homo sapiens
tatgtgtatatctgtatgtgca

SEQ ID NO: 7298835 - DNA, 22 bp, Homo sapiens
tatgtgtaagctgtttatcttt

SEQ ID NO: 7298836 - DNA, 22 bp, Homo sapiens
tatgtggccttttatgtctgac

SEQ ID NO: 7298837 - DNA, 22 bp, Homo sapiens
tatgtgtaaccttgtgatttat

SEQ ID NO: 7298838 - DNA, 22 bp, Homo sapiens
tatgtgtaagctgtttatcttt

SEQ ID NO: 7298839 - DNA, 22 bp, Homo sapiens
tatgtgtaatcaaacacatgct

SEQ ID NO: 7298840 - DNA, 22 bp, Homo sapiens
tatgtgtaatcatatctgatac

SEQ ID NO: 7298841 - DNA, 18 bp, Homo sapiens
tatgtgcatatgtgtgta

SEQ ID NO: 7298842 - DNA, 18 bp, Homo sapiens
tatgtgcatatgtgtgta

SEQ ID NO: 7298843 - DNA, 22 bp, Homo sapiens
tatgtgcatgctgacttgagga

SEQ ID NO: 7298844 - DNA, 19 bp, Homo sapiens
tatgtgcatgtgtgcatat

SEQ ID NO: 7298845 - DNA, 22 bp, Homo sapiens
tatgtgcattatctagttcatt

SEQ ID NO: 7298846 - DNA, 23 bp, Homo sapiens
tatgtgcatatgtgtaagaatac

SEQ ID NO: 7298847 - DNA, 22 bp, Homo sapiens
tatgtgctttgcactgtgctat

SEQ ID NO: 7298848 - DNA, 17 bp, Homo sapiens
tacatgtgtatctgatt

SEQ ID NO: 7298849 - DNA, 22 bp, Homo sapiens
tacatgtggccagaaatttgag

SEQ ID NO: 7298850 - DNA, 22 bp, Homo sapiens
tataatattccttgttgtaggt

SEQ ID NO: 7298851 - DNA, 22 bp, Homo sapiens
tataagtctggcatatgtatgc

SEQ ID NO: 7298852 - DNA, 22 bp, Homo sapiens
caggggcctgtcctggcttctg

SEQ ID NO: 7298853 - DNA, 22 bp, Homo sapiens
caggggccggctgtccgtgccc

SEQ ID NO: 7298854 - DNA, 22 bp, Homo sapiens
tatacagtttgagttcttgcat

SEQ ID NO: 7298855 - DNA, 22 bp, Homo sapiens
tatacagatatctaagatgtaa

SEQ ID NO: 7298856 - DNA, 21 bp, Homo sapiens
tatacagtaattaagtggtat

SEQ ID NO: 7298857 - DNA, 22 bp, Homo sapiens
tatacagatggaaagatacaca

SEQ ID NO: 7298858 - DNA, 22 bp, Homo sapiens
tatacagattaacagatttaaa

SEQ ID NO: 7298859 - DNA, 22 bp, Homo sapiens
tatacagtcttttgctatattc

SEQ ID NO: 7298860 - DNA, 23 bp, Homo sapiens
tatacagtctccaggcagtcctt

SEQ ID NO: 7298861 - DNA, 22 bp, Homo sapiens
tatacagtatcttttgaaggca

SEQ ID NO: 7298862 - DNA, 20 bp, Homo sapiens
tatacagtcttttgggaaaa

SEQ ID NO: 7298863 - DNA, 22 bp, Homo sapiens
tatacagtgcctcttccattag

SEQ ID NO: 7298864 - DNA, 22 bp, Homo sapiens
tatacagtgcctcttccattag

SEQ ID NO: 7298865 - DNA, 22 bp, Homo sapiens
tatacagttaagtttcttcagt

SEQ ID NO: 7298866 - DNA, 22 bp, Homo sapiens
tatacagttaagtttcttcagt

SEQ ID NO: 7298867 - DNA, 22 bp, Homo sapiens
tatttagaacagacaatagaaa

SEQ ID NO: 7298868 - DNA, 20 bp, Homo sapiens
tatttacaacttagagcctc

SEQ ID NO: 7298869 - DNA, 22 bp, Homo sapiens
cagtcctgtgttaaacaagagc

SEQ ID NO: 7298870 - DNA, 22 bp, Homo sapiens
cagtgaggtggatggatggcct

SEQ ID NO: 7298871 - DNA, 22 bp, Homo sapiens
cagtgcagacgtggagggggca

SEQ ID NO: 7298872 - DNA, 22 bp, Homo sapiens
tcactcaggctggagtgcagtg

SEQ ID NO: 7298873 - DNA, 22 bp, Homo sapiens
tcacttccctcttcagctccca

SEQ ID NO: 7298874 - DNA, 22 bp, Homo sapiens
tcactcagcattcactgggcct

SEQ ID NO: 7298875 - DNA, 22 bp, Homo sapiens
tcactcagaaatagaatgaacc

SEQ ID NO: 7298876 - DNA, 21 bp, Homo sapiens
tcagaacaattccatgcctcc

SEQ ID NO: 7298877 - DNA, 22 bp, Homo sapiens
tcagaaataatgaatgatgggg

SEQ ID NO: 7298878 - DNA, 22 bp, Homo sapiens
tcagaaatacaaaacacttact

SEQ ID NO: 7298879 - DNA, 22 bp, Homo sapiens
cagtgctgctctctgtaagaga

SEQ ID NO: 7298880 - DNA, 22 bp, Homo sapiens
cagtgctggctgttaggacagt

SEQ ID NO: 7298881 - DNA, 22 bp, Homo sapiens
cagtgctgagagcctggccagg

SEQ ID NO: 7298882 - DNA, 22 bp, Homo sapiens
cagtgcccaagatgtgccatgc

SEQ ID NO: 7298883 - DNA, 22 bp, Homo sapiens
cagtgctgttgtaagctcattg

SEQ ID NO: 7298884 - DNA, 22 bp, Homo sapiens
tctgtcactattggccagaaca

SEQ ID NO: 7298885 - DNA, 22 bp, Homo sapiens
tctgtggcacgattgcactgca

SEQ ID NO: 7298886 - DNA, 22 bp, Homo sapiens
tctgtggcacgattgcactgca

SEQ ID NO: 7298887 - DNA, 18 bp, Homo sapiens
tctgtctgtgttgtcttt

SEQ ID NO: 7298888 - DNA, 18 bp, Homo sapiens
tctgtctgtgttgtcttt

SEQ ID NO: 7298889 - DNA, 21 bp, Homo sapiens
tctgtctggttttagagtggc

SEQ ID NO: 7298890 - DNA, 22 bp, Homo sapiens
ccaggaagcggtgagggctgcc

SEQ ID NO: 7298891 - DNA, 22 bp, Homo sapiens
ccaggaagcggtgagggctgcc

SEQ ID NO: 7298892 - DNA, 21 bp, Homo sapiens
ccaggaaggactgagctccct

SEQ ID NO: 7298893 - DNA, 22 bp, Homo sapiens
ccaggaaggaagcaggggtttc

SEQ ID NO: 7298894 - DNA, 22 bp, Homo sapiens
ccaggaagctctgctccacggg

SEQ ID NO: 7298895 - DNA, 22 bp, Homo sapiens
ccaggaagcctcagatgctgag

SEQ ID NO: 7298896 - DNA, 22 bp, Homo sapiens
ccaggaagcctgtgtctctgga

SEQ ID NO: 7298897 - DNA, 23 bp, Homo sapiens
ccaggaagaggccatccacagtc

SEQ ID NO: 7298898 - DNA, 22 bp, Homo sapiens
tctggagcttcctcatttacag

SEQ ID NO: 7298899 - DNA, 22 bp, Homo sapiens
ccagctggtaagtgatggagcc

SEQ ID NO: 7298900 - DNA, 22 bp, Homo sapiens
ccagctggggaagtggggcata

SEQ ID NO: 7298901 - DNA, 22 bp, Homo sapiens
ccagctggtctgtgctcatgtt

SEQ ID NO: 7298902 - DNA, 22 bp, Homo sapiens
tctgcctgaaattcacatgtaa

SEQ ID NO: 7298903 - DNA, 22 bp, Homo sapiens
tctgcctgagaagtggggtgcc

SEQ ID NO: 7298904 - DNA, 22 bp, Homo sapiens
tctgcctgagaagtggggtgcc

SEQ ID NO: 7298905 - DNA, 22 bp, Homo sapiens
tctgcctgaatctcttagaaca

SEQ ID NO: 7298906 - DNA, 22 bp, Homo sapiens
tctgcctgaaccactcttggag

SEQ ID NO: 7298907 - DNA, 22 bp, Homo sapiens
tctgccttttcactgccactaa

SEQ ID NO: 7298908 - DNA, 20 bp, Homo sapiens
tctgcggaaagggagggtgg

SEQ ID NO: 7298909 - DNA, 22 bp, Homo sapiens
tctgcgtgaatttgcattgtgg

SEQ ID NO: 7298910 - DNA, 22 bp, Homo sapiens
tctgcgtggcgtggttctgtgc

SEQ ID NO: 7298911 - DNA, 22 bp, Homo sapiens
tctgcgtgatgagggtgcagca

SEQ ID NO: 7298912 - DNA, 22 bp, Homo sapiens
tctgcgtggctgctgtgagcgt

SEQ ID NO: 7298913 - DNA, 22 bp, Homo sapiens
tctgcgtgatgagggtgcagca

SEQ ID NO: 7298914 - DNA, 22 bp, Homo sapiens
tctgcctttcacacagacggcc

SEQ ID NO: 7298915 - DNA, 22 bp, Homo sapiens
tctctcttcatgcttttagaat

SEQ ID NO: 7298916 - DNA, 22 bp, Homo sapiens
tctcttgagctcagttctgatg

SEQ ID NO: 7298917 - DNA, 22 bp, Homo sapiens
tctcttggacatgtggctctgc

SEQ ID NO: 7298918 - DNA, 22 bp, Homo sapiens
tctgaaataggagccatgtaga

SEQ ID NO: 7298919 - DNA, 22 bp, Homo sapiens
tctgaaataggcttcttttggt

SEQ ID NO: 7298920 - DNA, 22 bp, Homo sapiens
tctgaaatattggtaatacttt

SEQ ID NO: 7298921 - DNA, 22 bp, Homo sapiens
tctgaaataggaaagcaaatgg

SEQ ID NO: 7298922 - DNA, 22 bp, Homo sapiens
ccagccacgaagctcccttcat

SEQ ID NO: 7298923 - DNA, 22 bp, Homo sapiens
tctgaggacctactgaagagtt

SEQ ID NO: 7298924 - DNA, 23 bp, Homo sapiens
tctgaggatgaaggatagcaagt

SEQ ID NO: 7298925 - DNA, 21 bp, Homo sapiens
ccagcccagctgtgtcccagc

SEQ ID NO: 7298926 - DNA, 22 bp, Homo sapiens
ccagctccagcatagccaccat

SEQ ID NO: 7298927 - DNA, 22 bp, Homo sapiens
ccagctccactgtcagatgaga

SEQ ID NO: 7298928 - DNA, 21 bp, Homo sapiens
ccagctccaggaccttggatc

SEQ ID NO: 7298929 - DNA, 22 bp, Homo sapiens
ccagctccaagtttgggcatca

SEQ ID NO: 7298930 - DNA, 22 bp, Homo sapiens
ccagctcatattttatgtgcag

SEQ ID NO: 7298931 - DNA, 22 bp, Homo sapiens
ccagctcaagcactgtgtgaag

SEQ ID NO: 7298932 - DNA, 22 bp, Homo sapiens
ccagcgactgtgacctcagcta

SEQ ID NO: 7298933 - DNA, 22 bp, Homo sapiens
ccagcctcatcatattcctgct

SEQ ID NO: 7298934 - DNA, 22 bp, Homo sapiens
ccagcctcatcatattcctgct

SEQ ID NO: 7298935 - DNA, 22 bp, Homo sapiens
tctgatagataccatgaggcaa

SEQ ID NO: 7298936 - DNA, 22 bp, Homo sapiens
tctgataggtggtagaaggagg

SEQ ID NO: 7298937 - DNA, 22 bp, Homo sapiens
ccagctccaggactgggagctg

SEQ ID NO: 7298938 - DNA, 22 bp, Homo sapiens
ccagctcctcttcccagtgtca

SEQ ID NO: 7298939 - DNA, 22 bp, Homo sapiens
ccagctcctgagcatggtttcc

SEQ ID NO: 7298940 - DNA, 22 bp, Homo sapiens
ccagctcctgggtcttagtcag

SEQ ID NO: 7298941 - DNA, 22 bp, Homo sapiens
ccagctcctgggtcttagtcag

SEQ ID NO: 7298942 - DNA, 22 bp, Homo sapiens
ccagctcctcttgtctctagca

SEQ ID NO: 7298943 - DNA, 22 bp, Homo sapiens
ccagctccttctgtctgtggag

SEQ ID NO: 7298944 - DNA, 22 bp, Homo sapiens
ccagctctagccccatgtggct

SEQ ID NO: 7298945 - DNA, 22 bp, Homo sapiens
ccactctgattttggctccact

SEQ ID NO: 7298946 - DNA, 22 bp, Homo sapiens
ccactctttactgttgggtttt

SEQ ID NO: 7298947 - DNA, 22 bp, Homo sapiens
ccactgaaggtcaacatagagc

SEQ ID NO: 7298948 - DNA, 22 bp, Homo sapiens
ccactgccagctttgtcctccc

SEQ ID NO: 7298949 - DNA, 22 bp, Homo sapiens
ccagaagatggctcaaaccatg

SEQ ID NO: 7298950 - DNA, 22 bp, Homo sapiens
ccagaagaggacacagtgtgga

SEQ ID NO: 7298951 - DNA, 22 bp, Homo sapiens
ccagatatcactgccgtgttgt

SEQ ID NO: 7298952 - DNA, 22 bp, Homo sapiens
ccagatagaaaagaaggcagga

SEQ ID NO: 7298953 - DNA, 22 bp, Homo sapiens
ccagatagggatgagagtgcta

SEQ ID NO: 7298954 - DNA, 22 bp, Homo sapiens
tctctagggtttagcacagata

SEQ ID NO: 7298955 - DNA, 22 bp, Homo sapiens
tctctaggtgcagtcactgctc

SEQ ID NO: 7298956 - DNA, 22 bp, Homo sapiens
ccagaggacttgggggctgaat

SEQ ID NO: 7298957 - DNA, 22 bp, Homo sapiens
ccagacaggggctgttcctgct

SEQ ID NO: 7298958 - DNA, 20 bp, Homo sapiens
ccagacagcacctgcctggt

SEQ ID NO: 7298959 - DNA, 22 bp, Homo sapiens
ccagacagcagttaaaggacat

SEQ ID NO: 7298960 - DNA, 22 bp, Homo sapiens
ccagagctgattcctgggactt

SEQ ID NO: 7298961 - DNA, 21 bp, Homo sapiens
tctccagtgcttctgcctctt

SEQ ID NO: 7298962 - DNA, 21 bp, Homo sapiens
tctccagttgacagtgtctcc

SEQ ID NO: 7298963 - DNA, 19 bp, Homo sapiens
tctccagttgctttcaggg

SEQ ID NO: 7298964 - DNA, 22 bp, Homo sapiens
tctcctgggaggacaaggaagg

SEQ ID NO: 7298965 - DNA, 22 bp, Homo sapiens
tctcctgggaggacaaggaagg

SEQ ID NO: 7298966 - DNA, 22 bp, Homo sapiens
tctctaaagtagaaaagacccc

SEQ ID NO: 7298967 - DNA, 22 bp, Homo sapiens
ccacaagatgcaaactctaaca

SEQ ID NO: 7298968 - DNA, 22 bp, Homo sapiens
ccaattgtcctaattaattaga

SEQ ID NO: 7298969 - DNA, 20 bp, Homo sapiens
ccaatgtttacagattactt

SEQ ID NO: 7298970 - DNA, 22 bp, Homo sapiens
tcctccccaaagcccagcctgg

SEQ ID NO: 7298971 - DNA, 22 bp, Homo sapiens
ccaaatgtgcctgtttcaacaa

SEQ ID NO: 7298972 - DNA, 20 bp, Homo sapiens
ccaaatgtggagaaaaagta

SEQ ID NO: 7298973 - DNA, 22 bp, Homo sapiens
ccaaagtttttatagttagcat

SEQ ID NO: 7298974 - DNA, 22 bp, Homo sapiens
ccaaatattaacaaagtaattt

SEQ ID NO: 7298975 - DNA, 22 bp, Homo sapiens
ccacagagttgatgcaataaga

SEQ ID NO: 7298976 - DNA, 22 bp, Homo sapiens
ccacagagttacaaaacagtca

SEQ ID NO: 7298977 - DNA, 22 bp, Homo sapiens
ccacagcaccgctgccagtccc

SEQ ID NO: 7298978 - DNA, 18 bp, Homo sapiens
ccacagcagagttcttac

SEQ ID NO: 7298979 - DNA, 22 bp, Homo sapiens
ccacagcaggactggagccgcc

SEQ ID NO: 7298980 - DNA, 22 bp, Homo sapiens
ccacagcatgcaggcctgacac

SEQ ID NO: 7298981 - DNA, 22 bp, Homo sapiens
ccacagccattccagggaggct

SEQ ID NO: 7298982 - DNA, 22 bp, Homo sapiens
ccacagctcctcagcctctttc

SEQ ID NO: 7298983 - DNA, 22 bp, Homo sapiens
tcctgccagcccacagactcat

SEQ ID NO: 7298984 - DNA, 22 bp, Homo sapiens
tcctgccaaaatatccctacct

SEQ ID NO: 7298985 - DNA, 22 bp, Homo sapiens
ccacagaggacaactgcctggc

SEQ ID NO: 7298986 - DNA, 22 bp, Homo sapiens
catttgctgtattttcagattc

SEQ ID NO: 7298987 - DNA, 20 bp, Homo sapiens
tccctgccttttactgctgg

SEQ ID NO: 7298988 - DNA, 22 bp, Homo sapiens
catttgctctggttccttctgg

SEQ ID NO: 7298989 - DNA, 22 bp, Homo sapiens
catttgctgaggccttcagagg

SEQ ID NO: 7298990 - DNA, 22 bp, Homo sapiens
catttgcagagggtgacactct

SEQ ID NO: 7298991 - DNA, 22 bp, Homo sapiens
catttgcaagagataaatgttt

SEQ ID NO: 7298992 - DNA, 23 bp, Homo sapiens
catttgatcctcacaataaatgg

SEQ ID NO: 7298993 - DNA, 22 bp, Homo sapiens
catttgatctcctgaataaaca

SEQ ID NO: 7298994 - DNA, 22 bp, Homo sapiens
catttgaagaagaaacgtacta

SEQ ID NO: 7298995 - DNA, 22 bp, Homo sapiens
catttgaactaataactgtgct

SEQ ID NO: 7298996 - DNA, 15 bp, Homo sapiens
tccctgctggtcaaa

SEQ ID NO: 7298997 - DNA, 22 bp, Homo sapiens
tccctgctgggagatgacctta

SEQ ID NO: 7298998 - DNA, 22 bp, Homo sapiens
ccaaagtattaaatcttagcaa

SEQ ID NO: 7298999 - DNA, 22 bp, Homo sapiens
ccaaagtaaggcaattcctaaa

SEQ ID NO: 7299000 - DNA, 22 bp, Homo sapiens
catttagagtcttgcaatttta

SEQ ID NO: 7299001 - DNA, 22 bp, Homo sapiens
catttagagagtaaaaattagc

SEQ ID NO: 7299002 - DNA, 22 bp, Homo sapiens
catttagtccttgacttctctc

SEQ ID NO: 7299003 - DNA, 19 bp, Homo sapiens
catttagaagtacatatta

SEQ ID NO: 7299004 - DNA, 20 bp, Homo sapiens
catttagaaattggcatgga

SEQ ID NO: 7299005 - DNA, 19 bp, Homo sapiens
catttagaagtacatatta

SEQ ID NO: 7299006 - DNA, 22 bp, Homo sapiens
catttagaagtcttagaactat

SEQ ID NO: 7299007 - DNA, 22 bp, Homo sapiens
catttagagaagattacaagga

SEQ ID NO: 7299008 - DNA, 22 bp, Homo sapiens
catttagagagtaaaaattagc

SEQ ID NO: 7299009 - DNA, 22 bp, Homo sapiens
catttatataaaatgtccagaa

SEQ ID NO: 7299010 - DNA, 22 bp, Homo sapiens
taattgtatggagaaggctgca

SEQ ID NO: 7299011 - DNA, 22 bp, Homo sapiens
taattgtcctcggtccaaatga

SEQ ID NO: 7299012 - DNA, 22 bp, Homo sapiens
taattgtcatcgtagtaaacat

SEQ ID NO: 7299013 - DNA, 22 bp, Homo sapiens
taattgtcttagtctgtgcagg

SEQ ID NO: 7299014 - DNA, 22 bp, Homo sapiens
caggcagagccaatcgtggggt

SEQ ID NO: 7299015 - DNA, 22 bp, Homo sapiens
taatgttagtatgtaatcttat

SEQ ID NO: 7299016 - DNA, 22 bp, Homo sapiens
caggcagactttgagaatgatg

SEQ ID NO: 7299017 - DNA, 22 bp, Homo sapiens
caggcagagacgtcagtgtagg

SEQ ID NO: 7299018 - DNA, 22 bp, Homo sapiens
caggcagagcaactggtccaga

SEQ ID NO: 7299019 - DNA, 22 bp, Homo sapiens
caggcagaatgaccgacctcgc

SEQ ID NO: 7299020 - DNA, 17 bp, Homo sapiens
caggcagacatgtaagc

SEQ ID NO: 7299021 - DNA, 22 bp, Homo sapiens
caggcagaagaagtggaaggac

SEQ ID NO: 7299022 - DNA, 22 bp, Homo sapiens
caggcagaaggaagtaccaggc

SEQ ID NO: 7299023 - DNA, 22 bp, Homo sapiens
caggcaggagaggaggatttct

SEQ ID NO: 7299024 - DNA, 22 bp, Homo sapiens
caggcaggagccagggattcca

SEQ ID NO: 7299025 - DNA, 22 bp, Homo sapiens
tacagtttgttacattgttagt

SEQ ID NO: 7299026 - DNA, 20 bp, Homo sapiens
tacatattatatcagctgca

SEQ ID NO: 7299027 - DNA, 22 bp, Homo sapiens
tacatatgtaaacatgtataaa

SEQ ID NO: 7299028 - DNA, 22 bp, Homo sapiens
tacatatgtaaacatgtataaa

SEQ ID NO: 7299029 - DNA, 22 bp, Homo sapiens
tacatattgtccatagttgctt

SEQ ID NO: 7299030 - DNA, 20 bp, Homo sapiens
tacatattatatcagctgca

SEQ ID NO: 7299031 - DNA, 22 bp, Homo sapiens
tacatatttgtctttgtactgt

SEQ ID NO: 7299032 - DNA, 22 bp, Homo sapiens
tacatattgtccatagttgctt

SEQ ID NO: 7299033 - DNA, 22 bp, Homo sapiens
tacatattgtccatagttgctt

SEQ ID NO: 7299034 - DNA, 22 bp, Homo sapiens
tacatatttgtctttgtactgt

SEQ ID NO: 7299035 - DNA, 21 bp, Homo sapiens
tacatcagttttcttggctca

SEQ ID NO: 7299036 - DNA, 22 bp, Homo sapiens
tacatcaagataaaaactgtca

SEQ ID NO: 7299037 - DNA, 22 bp, Homo sapiens
tacatatttgtctttgtactgt

SEQ ID NO: 7299038 - DNA, 22 bp, Homo sapiens
tacatcataataatacttagaa

SEQ ID NO: 7299039 - DNA, 22 bp, Homo sapiens
tacatcatgaaagcatacatca

SEQ ID NO: 7299040 - DNA, 22 bp, Homo sapiens
tacatgtggccagaaatttgag

SEQ ID NO: 7299041 - DNA, 22 bp, Homo sapiens
tacagtaacatgttgtacaagc

SEQ ID NO: 7299042 - DNA, 22 bp, Homo sapiens
tacagtaaagctgctatgaatt

SEQ ID NO: 7299043 - DNA, 22 bp, Homo sapiens
caggcagggagctggaaaggat

SEQ ID NO: 7299044 - DNA, 22 bp, Homo sapiens
tacaaatgaaccaactttgatg

SEQ ID NO: 7299045 - DNA, 22 bp, Homo sapiens
tacaaattaatgggcatgttta

SEQ ID NO: 7299046 - DNA, 22 bp, Homo sapiens
tacaaattaatgggcatgttta

SEQ ID NO: 7299047 - DNA, 22 bp, Homo sapiens
tacaaatgtattttattttggt

SEQ ID NO: 7299048 - DNA, 20 bp, Homo sapiens
tacaaattttccatgtttcc

SEQ ID NO: 7299049 - DNA, 22 bp, Homo sapiens
tacaagtttatccatcattgtt

SEQ ID NO: 7299050 - DNA, 21 bp, Homo sapiens
tacaagttgcttttgaagtcc

SEQ ID NO: 7299051 - DNA, 22 bp, Homo sapiens
tacagggattgttttaatcacc

SEQ ID NO: 7299052 - DNA, 22 bp, Homo sapiens
tacaagtactgtggctttgaat

SEQ ID NO: 7299053 - DNA, 22 bp, Homo sapiens
tacaagtatggaatgattctca

SEQ ID NO: 7299054 - DNA, 20 bp, Homo sapiens
tacaagtacattatagttat

SEQ ID NO: 7299055 - DNA, 22 bp, Homo sapiens
tacaagtaaattgtagatacca

SEQ ID NO: 7299056 - DNA, 22 bp, Homo sapiens
tacaaggttgtactttctctct

SEQ ID NO: 7299057 - DNA, 23 bp, Homo sapiens
tacaaggtagcattagtttcttc

SEQ ID NO: 7299058 - DNA, 21 bp, Homo sapiens
tacaagttcatgttgaaggaa

SEQ ID NO: 7299059 - DNA, 22 bp, Homo sapiens
tacaagttccattttgaaagtg

SEQ ID NO: 7299060 - DNA, 21 bp, Homo sapiens
caggatgatgataattcatgg

SEQ ID NO: 7299061 - DNA, 22 bp, Homo sapiens
caggatggtggcatgatcagaa

SEQ ID NO: 7299062 - DNA, 22 bp, Homo sapiens
caggatgaggtagaggcagata

SEQ ID NO: 7299063 - DNA, 22 bp, Homo sapiens
caggatctgttaagttgttcca

SEQ ID NO: 7299064 - DNA, 22 bp, Homo sapiens
taagaaacatttttatgacagt

SEQ ID NO: 7299065 - DNA, 22 bp, Homo sapiens
taacttttacttaccatctgag

SEQ ID NO: 7299066 - DNA, 21 bp, Homo sapiens
taacttttgtgcctatcttgt

SEQ ID NO: 7299067 - DNA, 22 bp, Homo sapiens
taacttgagctctcagtgctat

SEQ ID NO: 7299068 - DNA, 16 bp, Homo sapiens
taacatttttaaaagg

SEQ ID NO: 7299069 - DNA, 22 bp, Homo sapiens
taacatttcggtgacagtggga

SEQ ID NO: 7299070 - DNA, 22 bp, Homo sapiens
taacatttgctgtctcctatgt

SEQ ID NO: 7299071 - DNA, 22 bp, Homo sapiens
taacatttaaatttttcacata

SEQ ID NO: 7299072 - DNA, 22 bp, Homo sapiens
taacatttaaatttttcacata

SEQ ID NO: 7299073 - DNA, 22 bp, Homo sapiens
taacatttagaaagtgtccatt

SEQ ID NO: 7299074 - DNA, 22 bp, Homo sapiens
taacatttagaaagtgtccatt

SEQ ID NO: 7299075 - DNA, 22 bp, Homo sapiens
taacagaaatagaaatgagagt

SEQ ID NO: 7299076 - DNA, 22 bp, Homo sapiens
taacagaagaaaacatattgga

SEQ ID NO: 7299077 - DNA, 22 bp, Homo sapiens
taacattgtcagttcaactgct

SEQ ID NO: 7299078 - DNA, 22 bp, Homo sapiens
taacattccctttgtgccaagg

SEQ ID NO: 7299079 - DNA, 22 bp, Homo sapiens
taacacttgggggcatccttag

SEQ ID NO: 7299080 - DNA, 22 bp, Homo sapiens
taacacttcagatgattttgtt

SEQ ID NO: 7299081 - DNA, 22 bp, Homo sapiens
taacacttgaagccatttttgc

SEQ ID NO: 7299082 - DNA, 20 bp, Homo sapiens
taacacttgctttttgactt

SEQ ID NO: 7299083 - DNA, 22 bp, Homo sapiens
taacaagtcattttatcagcag

SEQ ID NO: 7299084 - DNA, 21 bp, Homo sapiens
taacaagtctgcatacattca

SEQ ID NO: 7299085 - DNA, 22 bp, Homo sapiens
taacaagttctgacagcattgt

SEQ ID NO: 7299086 - DNA, 22 bp, Homo sapiens
taacaagttctgacagcattgt

SEQ ID NO: 7299087 - DNA, 22 bp, Homo sapiens
taacaagtttcatttatagaat

SEQ ID NO: 7299088 - DNA, 22 bp, Homo sapiens
taacaagtcattttaaattatg

SEQ ID NO: 7299089 - DNA, 22 bp, Homo sapiens
taacaagtcattttaaattatg

SEQ ID NO: 7299090 - DNA, 22 bp, Homo sapiens
taacaagatttgtaaaattgta

SEQ ID NO: 7299091 - DNA, 22 bp, Homo sapiens
taagacaattcttcagtcacaa

SEQ ID NO: 7299092 - DNA, 22 bp, Homo sapiens
caggatgttgctcccatgtccc

SEQ ID NO: 7299093 - DNA, 22 bp, Homo sapiens
caggattaaggtgaggggagta

SEQ ID NO: 7299094 - DNA, 22 bp, Homo sapiens
caggatttcatacatctttact

SEQ ID NO: 7299095 - DNA, 22 bp, Homo sapiens
taagcaaataatgcatcaaggg

SEQ ID NO: 7299096 - DNA, 22 bp, Homo sapiens
taagcaaagtttataaggctct

SEQ ID NO: 7299097 - DNA, 22 bp, Homo sapiens
taagatttttaaaatgtcctca

SEQ ID NO: 7299098 - DNA, 19 bp, Homo sapiens
taagacagattcctagagt

SEQ ID NO: 7299099 - DNA, 22 bp, Homo sapiens
caggagctctcatcgtcagggc

SEQ ID NO: 7299100 - DNA, 22 bp, Homo sapiens
caggagctctcatcgtcagggc

SEQ ID NO: 7299101 - DNA, 22 bp, Homo sapiens
caggagctcttaaggatgtgat

SEQ ID NO: 7299102 - DNA, 22 bp, Homo sapiens
caggagctggatctccttgcgg

SEQ ID NO: 7299103 - DNA, 22 bp, Homo sapiens
caggagctggataggaccacaa

SEQ ID NO: 7299104 - DNA, 22 bp, Homo sapiens
taaagcataatgaatatctaga

SEQ ID NO: 7299105 - DNA, 22 bp, Homo sapiens
taaagcataatgaatatctaga

SEQ ID NO: 7299106 - DNA, 22 bp, Homo sapiens
caggagctactcaggttgggtt

SEQ ID NO: 7299107 - DNA, 22 bp, Homo sapiens
caggagctcaagaccaccctgg

SEQ ID NO: 7299108 - DNA, 22 bp, Homo sapiens
caggagctcagatgacatctca

SEQ ID NO: 7299109 - DNA, 22 bp, Homo sapiens
caggagctcacagtctttgggt

SEQ ID NO: 7299110 - DNA, 22 bp, Homo sapiens
caggagctcactgtctaatggg

SEQ ID NO: 7299111 - DNA, 22 bp, Homo sapiens
caggagctcacagtctttgggt

SEQ ID NO: 7299112 - DNA, 22 bp, Homo sapiens
caggagcaaggagcagtgggat

SEQ ID NO: 7299113 - DNA, 22 bp, Homo sapiens
caggagatgacagggaagaacc

SEQ ID NO: 7299114 - DNA, 22 bp, Homo sapiens
caggagatgacagggaagaacc

SEQ ID NO: 7299115 - DNA, 22 bp, Homo sapiens
taaagctacacattattaatcc

SEQ ID NO: 7299116 - DNA, 22 bp, Homo sapiens
taaagtccttgaaccggatgta

SEQ ID NO: 7299117 - DNA, 22 bp, Homo sapiens
taaatcacaaattttctcattt

SEQ ID NO: 7299118 - DNA, 22 bp, Homo sapiens
taaatgctttctatgaaagagg

SEQ ID NO: 7299119 - DNA, 22 bp, Homo sapiens
taaatatcacctggaattgtta

SEQ ID NO: 7299120 - DNA, 22 bp, Homo sapiens
taaatatcagtccagctcttcc

SEQ ID NO: 7299121 - DNA, 18 bp, Homo sapiens
taaatatatttccccctt

SEQ ID NO: 7299122 - DNA, 22 bp, Homo sapiens
taaatgtactgaggcaacagga

SEQ ID NO: 7299123 - DNA, 22 bp, Homo sapiens
caggagctgggtctggaagcag

SEQ ID NO: 7299124 - DNA, 22 bp, Homo sapiens
caggagctttcttcccaaactt

SEQ ID NO: 7299125 - DNA, 22 bp, Homo sapiens
caggaggaaactggattcactt

SEQ ID NO: 7299126 - DNA, 22 bp, Homo sapiens
caggagcttctgcccatggcca

SEQ ID NO: 7299127 - DNA, 22 bp, Homo sapiens
taacaaagtattgtttgtgtat

SEQ ID NO: 7299128 - DNA, 22 bp, Homo sapiens
taacaaagtaccatagactgga

SEQ ID NO: 7299129 - DNA, 22 bp, Homo sapiens
taacaaaggttgccaaactaag

SEQ ID NO: 7299130 - DNA, 22 bp, Homo sapiens
caggaccattgcaactgcccct

SEQ ID NO: 7299131 - DNA, 22 bp, Homo sapiens
caggaccaggcgttctgggctg

SEQ ID NO: 7299132 - DNA, 22 bp, Homo sapiens
caggaccattgcaactgcccct

SEQ ID NO: 7299133 - DNA, 22 bp, Homo sapiens
caggaccaagcaaagtttcttt

SEQ ID NO: 7299134 - DNA, 22 bp, Homo sapiens
caggaccaagcaaagtttcttt

SEQ ID NO: 7299135 - DNA, 22 bp, Homo sapiens
taaactgaagctcaactcaaat

SEQ ID NO: 7299136 - DNA, 22 bp, Homo sapiens
taaactgaagctcaactcaaat

SEQ ID NO: 7299137 - DNA, 22 bp, Homo sapiens
taaactacccatgacagtttca

SEQ ID NO: 7299138 - DNA, 22 bp, Homo sapiens
taaacatttgttattcttgttt

SEQ ID NO: 7299139 - DNA, 22 bp, Homo sapiens
taaaccaagtgtccatattagt

SEQ ID NO: 7299140 - DNA, 22 bp, Homo sapiens
taaaatcgcactgctgttgtta

SEQ ID NO: 7299141 - DNA, 22 bp, Homo sapiens
taaaatgacttcctccaacatc

SEQ ID NO: 7299142 - DNA, 22 bp, Homo sapiens
taaaatcattctggtgtcagta

SEQ ID NO: 7299143 - DNA, 22 bp, Homo sapiens
taaaatgacttcctccaacatc

SEQ ID NO: 7299144 - DNA, 22 bp, Homo sapiens
taaaatcatgacagattgacat

SEQ ID NO: 7299145 - DNA, 22 bp, Homo sapiens
gttttctaccagggaagagagt

SEQ ID NO: 7299146 - DNA, 22 bp, Homo sapiens
gttttctaagtaggtagcacca

SEQ ID NO: 7299147 - DNA, 22 bp, Homo sapiens
taaaaaacattactctgtcctg

SEQ ID NO: 7299148 - DNA, 22 bp, Homo sapiens
gttttcttcctgcaattggcat

SEQ ID NO: 7299149 - DNA, 22 bp, Homo sapiens
gttttcttcctgcaattggcat

SEQ ID NO: 7299150 - DNA, 22 bp, Homo sapiens
caggacagctcaacacctcctc

SEQ ID NO: 7299151 - DNA, 22 bp, Homo sapiens
caggacaggtgttctagatcag

SEQ ID NO: 7299152 - DNA, 22 bp, Homo sapiens
caggaatagggcgtgagcatat

SEQ ID NO: 7299153 - DNA, 22 bp, Homo sapiens
caggaagggggatccttggaag

SEQ ID NO: 7299154 - DNA, 22 bp, Homo sapiens
caggaagctgtgaaggagacgg

SEQ ID NO: 7299155 - DNA, 22 bp, Homo sapiens
caggaagctggtcagatcctgt

SEQ ID NO: 7299156 - DNA, 21 bp, Homo sapiens
gtttgtaaggcactgtgttct

SEQ ID NO: 7299157 - DNA, 22 bp, Homo sapiens
gtttgtaattactgcagcatgg

SEQ ID NO: 7299158 - DNA, 22 bp, Homo sapiens
gtttgtaaccagaacagagagt

SEQ ID NO: 7299159 - DNA, 22 bp, Homo sapiens
caggaagccacaggacaggtag

SEQ ID NO: 7299160 - DNA, 22 bp, Homo sapiens
caggaagctgagctgcactgca

SEQ ID NO: 7299161 - DNA, 22 bp, Homo sapiens
gtttggtgacacatagtttgat

SEQ ID NO: 7299162 - DNA, 22 bp, Homo sapiens
gtttggcataggatgtgggtta

SEQ ID NO: 7299163 - DNA, 22 bp, Homo sapiens
gtgtgagcatcaaagcctgtca

SEQ ID NO: 7299164 - DNA, 22 bp, Homo sapiens
gtgtgacctcatcttaactgga

SEQ ID NO: 7299165 - DNA, 22 bp, Homo sapiens
gtgtgaaagttcctaagactat

SEQ ID NO: 7299166 - DNA, 22 bp, Homo sapiens
gtgtgaaatggttctctttgtt

SEQ ID NO: 7299167 - DNA, 22 bp, Homo sapiens
gtgtctttattcctctatgttt

SEQ ID NO: 7299168 - DNA, 17 bp, Homo sapiens
gtgtctttgctgttgtg

SEQ ID NO: 7299169 - DNA, 22 bp, Homo sapiens
gtgtatgtgccttacattttat

SEQ ID NO: 7299170 - DNA, 19 bp, Homo sapiens
gtgtatgtaagttgtgagg

SEQ ID NO: 7299171 - DNA, 19 bp, Homo sapiens
gtgtatgtaagttgtgagg

SEQ ID NO: 7299172 - DNA, 22 bp, Homo sapiens
gtgtatgttctacttaatatta

SEQ ID NO: 7299173 - DNA, 19 bp, Homo sapiens
gtgtctgcctttgtgccac

SEQ ID NO: 7299174 - DNA, 20 bp, Homo sapiens
gtgtctggagtactagagag

SEQ ID NO: 7299175 - DNA, 22 bp, Homo sapiens
gtgtctgtgtcattactaatag

SEQ ID NO: 7299176 - DNA, 22 bp, Homo sapiens
gtgtctgttatacagaggagac

SEQ ID NO: 7299177 - DNA, 22 bp, Homo sapiens
gtgtctgctcagcttgctagaa

SEQ ID NO: 7299178 - DNA, 22 bp, Homo sapiens
gtgggtgtggaactgtgagacc

SEQ ID NO: 7299179 - DNA, 22 bp, Homo sapiens
gtgtacatagaattgtgctttg

SEQ ID NO: 7299180 - DNA, 22 bp, Homo sapiens
gtgggtggggagctctctggag

SEQ ID NO: 7299181 - DNA, 22 bp, Homo sapiens
gtgggtgtgagtgacggcgtcc

SEQ ID NO: 7299182 - DNA, 22 bp, Homo sapiens
gtgtataatgctgtttgtacat

SEQ ID NO: 7299183 - DNA, 19 bp, Homo sapiens
gtgtatgtaagttgtgagg

SEQ ID NO: 7299184 - DNA, 22 bp, Homo sapiens
gtgtatctgttaagtataaaaa

SEQ ID NO: 7299185 - DNA, 22 bp, Homo sapiens
gtgtaggtaagcatgcagctga

SEQ ID NO: 7299186 - DNA, 22 bp, Homo sapiens
gtgtataacccaaatatgctgc

SEQ ID NO: 7299187 - DNA, 22 bp, Homo sapiens
gtgtagatagtttagatttcaa

SEQ ID NO: 7299188 - DNA, 22 bp, Homo sapiens
gtgtacatattgagtctgctga

SEQ ID NO: 7299189 - DNA, 22 bp, Homo sapiens
gtgtactgcaaatgctgctgcc

SEQ ID NO: 7299190 - DNA, 22 bp, Homo sapiens
gtgtacatgagaaatcaacttt

SEQ ID NO: 7299191 - DNA, 22 bp, Homo sapiens
gtgtgcgttcctagtaaacgtg

SEQ ID NO: 7299192 - DNA, 22 bp, Homo sapiens
gtgtgcgcgctcataggtgtgt

SEQ ID NO: 7299193 - DNA, 22 bp, Homo sapiens
gtgtgcgccgacacagccaggt

SEQ ID NO: 7299194 - DNA, 22 bp, Homo sapiens
gtgtgctgagtgactgtcatca

SEQ ID NO: 7299195 - DNA, 18 bp, Homo sapiens
gtgtgctcagagagtgag

SEQ ID NO: 7299196 - DNA, 18 bp, Homo sapiens
gtgtgctcagagagtgag

SEQ ID NO: 7299197 - DNA, 22 bp, Homo sapiens
gtgtggaagcagatgggtgagc

SEQ ID NO: 7299198 - DNA, 22 bp, Homo sapiens
gtgtggccgtgtatccatggct

SEQ ID NO: 7299199 - DNA, 22 bp, Homo sapiens
gtgtggccgccacttggggcag

SEQ ID NO: 7299200 - DNA, 22 bp, Homo sapiens
gtgtggccctgcgtcctgagtc

SEQ ID NO: 7299201 - DNA, 23 bp, Homo sapiens
gtgtggccccagggcctcctcgc

SEQ ID NO: 7299202 - DNA, 22 bp, Homo sapiens
gtgtggccaattatgggcattc

SEQ ID NO: 7299203 - DNA, 22 bp, Homo sapiens
cagctggggcagccacgtgcgg

SEQ ID NO: 7299204 - DNA, 22 bp, Homo sapiens
cagctggggagagacatggcag

SEQ ID NO: 7299205 - DNA, 22 bp, Homo sapiens
cagctgggctaagagtagaggc

SEQ ID NO: 7299206 - DNA, 22 bp, Homo sapiens
cagctggctgcatgatgccaaa

SEQ ID NO: 7299207 - DNA, 22 bp, Homo sapiens
gtgggtggatcatgaggtcagg

SEQ ID NO: 7299208 - DNA, 22 bp, Homo sapiens
cagctgctctggtggtctctcc

SEQ ID NO: 7299209 - DNA, 22 bp, Homo sapiens
cagctgctgagaagcctccctt

SEQ ID NO: 7299210 - DNA, 22 bp, Homo sapiens
cagctgctgagaagcctccctt

SEQ ID NO: 7299211 - DNA, 22 bp, Homo sapiens
cagctgctgttcagttttgttt

SEQ ID NO: 7299212 - DNA, 22 bp, Homo sapiens
cagctgctgttactgcttatta

SEQ ID NO: 7299213 - DNA, 22 bp, Homo sapiens
cagctgctgttcagttttgttt

SEQ ID NO: 7299214 - DNA, 22 bp, Homo sapiens
cagctgcttactagctgtgtga

SEQ ID NO: 7299215 - DNA, 22 bp, Homo sapiens
cagctgctttagttttccatcc

SEQ ID NO: 7299216 - DNA, 22 bp, Homo sapiens
cagctgcttctcctccagagct

SEQ ID NO: 7299217 - DNA, 22 bp, Homo sapiens
gtggggcatgcacgctgctcct

SEQ ID NO: 7299218 - DNA, 22 bp, Homo sapiens
cagctgcagttcaatgcttgct

SEQ ID NO: 7299219 - DNA, 22 bp, Homo sapiens
cagcccagccgagggcctggct

SEQ ID NO: 7299220 - DNA, 22 bp, Homo sapiens
cagcccagccgagggcctggct

SEQ ID NO: 7299221 - DNA, 22 bp, Homo sapiens
cagcccaggccgacagttcctc

SEQ ID NO: 7299222 - DNA, 22 bp, Homo sapiens
gtggcagagaacaaggagaggt

SEQ ID NO: 7299223 - DNA, 22 bp, Homo sapiens
gtggcagagatagaactggaat

SEQ ID NO: 7299224 - DNA, 22 bp, Homo sapiens
gtggcagagcaggagacaggac

SEQ ID NO: 7299225 - DNA, 22 bp, Homo sapiens
gtggcagaaactggcagaggag

SEQ ID NO: 7299226 - DNA, 22 bp, Homo sapiens
gtggcagagccaaggctggagc

SEQ ID NO: 7299227 - DNA, 22 bp, Homo sapiens
cagctctgctggtggtgccagg

SEQ ID NO: 7299228 - DNA, 22 bp, Homo sapiens
cagctctggctattgaggacca

SEQ ID NO: 7299229 - DNA, 22 bp, Homo sapiens
cagctctggcgtcagggagcga

SEQ ID NO: 7299230 - DNA, 22 bp, Homo sapiens
cagctctggccagatctatcct

SEQ ID NO: 7299231 - DNA, 22 bp, Homo sapiens
cagctctggcagagcccaaccc

SEQ ID NO: 7299232 - DNA, 22 bp, Homo sapiens
cagctctgtgcaggcctgggga

SEQ ID NO: 7299233 - DNA, 22 bp, Homo sapiens
cagctctggctttggggagctt

SEQ ID NO: 7299234 - DNA, 20 bp, Homo sapiens
cagctctgggaaagaggcca

SEQ ID NO: 7299235 - DNA, 22 bp, Homo sapiens
cagctctgggagtcccacccct

SEQ ID NO: 7299236 - DNA, 19 bp, Homo sapiens
gtggccagggcaggggctg

SEQ ID NO: 7299237 - DNA, 22 bp, Homo sapiens
gtggcttctggctgggcctcag

SEQ ID NO: 7299238 - DNA, 22 bp, Homo sapiens
gtggcttcttctgccagaagga

SEQ ID NO: 7299239 - DNA, 22 bp, Homo sapiens
cagctgaagagaggtgctgagt

SEQ ID NO: 7299240 - DNA, 22 bp, Homo sapiens
cagctctgttgccctggaaacg

SEQ ID NO: 7299241 - DNA, 22 bp, Homo sapiens
cagctctgttgccaaagtgggc

SEQ ID NO: 7299242 - DNA, 22 bp, Homo sapiens
cagctctgttcaaactatccag

SEQ ID NO: 7299243 - DNA, 22 bp, Homo sapiens
gttattctacagtcattgaagt

SEQ ID NO: 7299244 - DNA, 22 bp, Homo sapiens
gttattcttttatagcaataca

SEQ ID NO: 7299245 - DNA, 22 bp, Homo sapiens
gttacataggtgtgttcagttt

SEQ ID NO: 7299246 - DNA, 22 bp, Homo sapiens
gttacattaaaaacattcactg

SEQ ID NO: 7299247 - DNA, 22 bp, Homo sapiens
gttacattacttgtgcagttgt

SEQ ID NO: 7299248 - DNA, 22 bp, Homo sapiens
gttacattaggataatttgctg

SEQ ID NO: 7299249 - DNA, 23 bp, Homo sapiens
gttaccatctacatttgtgttgc

SEQ ID NO: 7299250 - DNA, 22 bp, Homo sapiens
gttacatttggtgatttggtgc

SEQ ID NO: 7299251 - DNA, 22 bp, Homo sapiens
gttacatttggtgatttggtgc

SEQ ID NO: 7299252 - DNA, 22 bp, Homo sapiens
gttacatttattagaggtctct

SEQ ID NO: 7299253 - DNA, 22 bp, Homo sapiens
gttaccattgtctaggtcattg

SEQ ID NO: 7299254 - DNA, 22 bp, Homo sapiens
gttaccattgtctaggtcattg

SEQ ID NO: 7299255 - DNA, 22 bp, Homo sapiens
gttactcctggttgagcttggt

SEQ ID NO: 7299256 - DNA, 22 bp, Homo sapiens
gttattctacagtcattgaagt

SEQ ID NO: 7299257 - DNA, 22 bp, Homo sapiens
caggaaaatgtcaatggaaagc

SEQ ID NO: 7299258 - DNA, 22 bp, Homo sapiens
caggaaaatggaatcacctgta

SEQ ID NO: 7299259 - DNA, 22 bp, Homo sapiens
caggaaaatctgcccacacaag

SEQ ID NO: 7299260 - DNA, 22 bp, Homo sapiens
gttcacaatttttactgattgg

SEQ ID NO: 7299261 - DNA, 22 bp, Homo sapiens
gtgtgtgtatatatacacacac

SEQ ID NO: 7299262 - DNA, 22 bp, Homo sapiens
gtgtgtgtatatatacacacac

SEQ ID NO: 7299263 - DNA, 22 bp, Homo sapiens
gtgtgtgtatatatacacacac

SEQ ID NO: 7299264 - DNA, 22 bp, Homo sapiens
gtgtttgtgagctaggtgacat

SEQ ID NO: 7299265 - DNA, 22 bp, Homo sapiens
gtgtttgtgagctaggtgacat

SEQ ID NO: 7299266 - DNA, 22 bp, Homo sapiens
gtgtttgtctcttggcctacct

SEQ ID NO: 7299267 - DNA, 22 bp, Homo sapiens
gtgtttgtctcttggcctacct

SEQ ID NO: 7299268 - DNA, 22 bp, Homo sapiens
gtgtgtgtatctgcctatcaca

SEQ ID NO: 7299269 - DNA, 22 bp, Homo sapiens
gtgtttggtcagacgtccgggg

SEQ ID NO: 7299270 - DNA, 22 bp, Homo sapiens
gtgtttgtttgggtagctagac

SEQ ID NO: 7299271 - DNA, 22 bp, Homo sapiens
gtgtttgtttagtgcagagaga

SEQ ID NO: 7299272 - DNA, 22 bp, Homo sapiens
gtgtttgttcgtgactccaaag

SEQ ID NO: 7299273 - DNA, 22 bp, Homo sapiens
gtgttttagtgctgctgagctg

SEQ ID NO: 7299274 - DNA, 22 bp, Homo sapiens
gtgtgtgtactctgtatataaa

SEQ ID NO: 7299275 - DNA, 22 bp, Homo sapiens
gtgtgtgtactctgtatataaa

SEQ ID NO: 7299276 - DNA, 22 bp, Homo sapiens
gtgtgtgtactctgtatataaa

SEQ ID NO: 7299277 - DNA, 22 bp, Homo sapiens
gtgtgtgctccccaggagagct

SEQ ID NO: 7299278 - DNA, 22 bp, Homo sapiens
gtgtgtgccaactttatgtgca

SEQ ID NO: 7299279 - DNA, 22 bp, Homo sapiens
gtgtgtgccaactttatgtgca

SEQ ID NO: 7299280 - DNA, 22 bp, Homo sapiens
gtgtgtgcaagaggtttattga

SEQ ID NO: 7299281 - DNA, 22 bp, Homo sapiens
gtgtgtctttcatttcatgagg

SEQ ID NO: 7299282 - DNA, 20 bp, Homo sapiens
gtgtgtgctccatgcatgct

SEQ ID NO: 7299283 - DNA, 22 bp, Homo sapiens
gtgtgtgctccccaggagagct

SEQ ID NO: 7299284 - DNA, 20 bp, Homo sapiens
gtgtgtgctccatgcatgct

SEQ ID NO: 7299285 - DNA, 22 bp, Homo sapiens
gtgtgtgccatcaagagctttc

SEQ ID NO: 7299286 - DNA, 22 bp, Homo sapiens
gttaaaagaacaactcggaggt

SEQ ID NO: 7299287 - DNA, 22 bp, Homo sapiens
gtgttttattggtgcagtcaga

SEQ ID NO: 7299288 - DNA, 22 bp, Homo sapiens
gtgttttattggtgcagtcaga

SEQ ID NO: 7299289 - DNA, 20 bp, Homo sapiens
gttaaaagagtaatttgagg

SEQ ID NO: 7299290 - DNA, 22 bp, Homo sapiens
gttaaacagttacatgtgctgg

SEQ ID NO: 7299291 - DNA, 22 bp, Homo sapiens
gttacagtgcttggcaataagt

SEQ ID NO: 7299292 - DNA, 22 bp, Homo sapiens
gttacacaggaaaacattagca

SEQ ID NO: 7299293 - DNA, 22 bp, Homo sapiens
gttacaatgttcttcagttctg

SEQ ID NO: 7299294 - DNA, 22 bp, Homo sapiens
cagctgtgtagatgcagggtca

SEQ ID NO: 7299295 - DNA, 22 bp, Homo sapiens
cagctgtgctagaagccacgaa

SEQ ID NO: 7299296 - DNA, 22 bp, Homo sapiens
cagcttacctcccacagctctc

SEQ ID NO: 7299297 - DNA, 22 bp, Homo sapiens
gtgtgtctcccaagaaggccca

SEQ ID NO: 7299298 - DNA, 22 bp, Homo sapiens
gtgtgtctgaagttgagtagac

SEQ ID NO: 7299299 - DNA, 22 bp, Homo sapiens
gtgtgtctttataagaagaggg

SEQ ID NO: 7299300 - DNA, 22 bp, Homo sapiens
gtgtgtcttgaccaggatcgga

SEQ ID NO: 7299301 - DNA, 22 bp, Homo sapiens
caggaacagcaccaggagctag

SEQ ID NO: 7299302 - DNA, 22 bp, Homo sapiens
caggaagaggacaggcttcccc

SEQ ID NO: 7299303 - DNA, 22 bp, Homo sapiens
caggaagaggacaggcttcccc

SEQ ID NO: 7299304 - DNA, 22 bp, Homo sapiens
caggaagaggtatcaccgagca

SEQ ID NO: 7299305 - DNA, 22 bp, Homo sapiens
caggaagaggtatcaccgagca

SEQ ID NO: 7299306 - DNA, 22 bp, Homo sapiens
gtttacatgcagaaaatcaatg

SEQ ID NO: 7299307 - DNA, 22 bp, Homo sapiens
caggaagattagaccaagagct

SEQ ID NO: 7299308 - DNA, 22 bp, Homo sapiens
caggaagattagaccaagagct

SEQ ID NO: 7299309 - DNA, 22 bp, Homo sapiens
caggaagaggtggggctaaagt

SEQ ID NO: 7299310 - DNA, 22 bp, Homo sapiens
caggaagaggtggggctaaagt

SEQ ID NO: 7299311 - DNA, 22 bp, Homo sapiens
caggaagattgtggaggtggtt

SEQ ID NO: 7299312 - DNA, 22 bp, Homo sapiens
caggaagattgtggaggtggtt

SEQ ID NO: 7299313 - DNA, 22 bp, Homo sapiens
gtttcaaaagtcaggctattct

SEQ ID NO: 7299314 - DNA, 22 bp, Homo sapiens
gtttcaaaagtcaggctattct

SEQ ID NO: 7299315 - DNA, 22 bp, Homo sapiens
gtttcaaaatgatgctgtaact

SEQ ID NO: 7299316 - DNA, 22 bp, Homo sapiens
gtttattgggtattgtggagcc

SEQ ID NO: 7299317 - DNA, 22 bp, Homo sapiens
gtttattgataaaagctggaca

SEQ ID NO: 7299318 - DNA, 22 bp, Homo sapiens
gtttacatgtaatgtgttattg

SEQ ID NO: 7299319 - DNA, 22 bp, Homo sapiens
gtttacatgtactcattatact

SEQ ID NO: 7299320 - DNA, 22 bp, Homo sapiens
gtttacatgtaatgtgttattg

SEQ ID NO: 7299321 - DNA, 22 bp, Homo sapiens
gtttacattaagtattagcatc

SEQ ID NO: 7299322 - DNA, 18 bp, Homo sapiens
gtttacattactgaatag

SEQ ID NO: 7299323 - DNA, 22 bp, Homo sapiens
gtttacatgtactcattatact

SEQ ID NO: 7299324 - DNA, 22 bp, Homo sapiens
gtttacatgtttttctcttaca

SEQ ID NO: 7299325 - DNA, 22 bp, Homo sapiens
gtttacattgctgtttgtgtct

SEQ ID NO: 7299326 - DNA, 22 bp, Homo sapiens
gtttgcatttcttgaactatat

SEQ ID NO: 7299327 - DNA, 22 bp, Homo sapiens
gtttgctaatttaaagctattt

SEQ ID NO: 7299328 - DNA, 22 bp, Homo sapiens
gtttcaaagcacagctcacatt

SEQ ID NO: 7299329 - DNA, 22 bp, Homo sapiens
caggaaaggtgtgtcatgatgg

SEQ ID NO: 7299330 - DNA, 22 bp, Homo sapiens
gttgggaagcagatggatgagc

SEQ ID NO: 7299331 - DNA, 22 bp, Homo sapiens
gttgggaacatgacctaatggt

SEQ ID NO: 7299332 - DNA, 22 bp, Homo sapiens
caggaaataaaaagtatcttct

SEQ ID NO: 7299333 - DNA, 22 bp, Homo sapiens
caggaaatggctgaataaattc

SEQ ID NO: 7299334 - DNA, 22 bp, Homo sapiens
caggaaatggctgaataaattc

SEQ ID NO: 7299335 - DNA, 22 bp, Homo sapiens
caggaaattcaagagaggctgc

SEQ ID NO: 7299336 - DNA, 22 bp, Homo sapiens
caggaaatgtataattttataa

SEQ ID NO: 7299337 - DNA, 22 bp, Homo sapiens
caggaaatttatgttctactta

SEQ ID NO: 7299338 - DNA, 22 bp, Homo sapiens
caggaaatttaagagtgtacaa

SEQ ID NO: 7299339 - DNA, 22 bp, Homo sapiens
caggaaattggctatttgggat

SEQ ID NO: 7299340 - DNA, 20 bp, Homo sapiens
gttggaaagttcactctgct

SEQ ID NO: 7299341 - DNA, 22 bp, Homo sapiens
gttgcttctcttaagtccagct

SEQ ID NO: 7299342 - DNA, 22 bp, Homo sapiens
gttcacagtctacatagtaaag

SEQ ID NO: 7299343 - DNA, 22 bp, Homo sapiens
ttggtacaaaagtaactgtggt

SEQ ID NO: 7299344 - DNA, 22 bp, Homo sapiens
ttggtacaatgtgctaggtagg

SEQ ID NO: 7299345 - DNA, 22 bp, Homo sapiens
ttgggtcatgggatcccagcat

SEQ ID NO: 7299346 - DNA, 22 bp, Homo sapiens
ttggtactccctgtgggcctca

SEQ ID NO: 7299347 - DNA, 22 bp, Homo sapiens
ttggtcacatgagtataaaacg

SEQ ID NO: 7299348 - DNA, 22 bp, Homo sapiens
ttggtcacagaacgtgatttta

SEQ ID NO: 7299349 - DNA, 22 bp, Homo sapiens
ttggtcacatttgtttcaatta

SEQ ID NO: 7299350 - DNA, 22 bp, Homo sapiens
ttggtcaccataaagaagaaca

SEQ ID NO: 7299351 - DNA, 22 bp, Homo sapiens
ttggtcacctgctgtcctttgt

SEQ ID NO: 7299352 - DNA, 22 bp, Homo sapiens
ttggtcaattctgtgaggcaac

SEQ ID NO: 7299353 - DNA, 22 bp, Homo sapiens
ttggtcaaatgtcatctggtgt

SEQ ID NO: 7299354 - DNA, 22 bp, Homo sapiens
ttgtatttcttccggtctcatt

SEQ ID NO: 7299355 - DNA, 22 bp, Homo sapiens
ttgtatttgattgtcatatcgt

SEQ ID NO: 7299356 - DNA, 22 bp, Homo sapiens
ttgttaaaatattggagaaagg

SEQ ID NO: 7299357 - DNA, 22 bp, Homo sapiens
ttgttaaaatgaggtcattctg

SEQ ID NO: 7299358 - DNA, 22 bp, Homo sapiens
ttgttaaaattggagccgagag

SEQ ID NO: 7299359 - DNA, 22 bp, Homo sapiens
ttgttaaaatgcatattctggt

SEQ ID NO: 7299360 - DNA, 22 bp, Homo sapiens
ttgttaaaatgcatattctggt

SEQ ID NO: 7299361 - DNA, 22 bp, Homo sapiens
ttgttaaaaatagatttccagg

SEQ ID NO: 7299362 - DNA, 22 bp, Homo sapiens
ttgttaaaactccattggtttg

SEQ ID NO: 7299363 - DNA, 22 bp, Homo sapiens
ttgttaaaactccattggtttg

SEQ ID NO: 7299364 - DNA, 22 bp, Homo sapiens
ttgtattttgttatgctactgc

SEQ ID NO: 7299365 - DNA, 22 bp, Homo sapiens
ttgttacacataataacatttt

SEQ ID NO: 7299366 - DNA, 22 bp, Homo sapiens
ttgttaaatggatgcagaataa

SEQ ID NO: 7299367 - DNA, 22 bp, Homo sapiens
ttgttaaatggatgcagaataa

SEQ ID NO: 7299368 - DNA, 22 bp, Homo sapiens
ttgttaaagatgcagattccat

SEQ ID NO: 7299369 - DNA, 22 bp, Homo sapiens
ttgttaaaggcaaaacaagcac

SEQ ID NO: 7299370 - DNA, 22 bp, Homo sapiens
tttaaaaaactagtctgagtct

SEQ ID NO: 7299371 - DNA, 22 bp, Homo sapiens
tttaaaaaactagtctgagtct

SEQ ID NO: 7299372 - DNA, 22 bp, Homo sapiens
tttaaaaaactagtctgagtct

SEQ ID NO: 7299373 - DNA, 22 bp, Homo sapiens
tttaaaaaactagtctgagtct

SEQ ID NO: 7299374 - DNA, 22 bp, Homo sapiens
ctccaggttgacttcagtcaat

SEQ ID NO: 7299375 - DNA, 22 bp, Homo sapiens
ctccaggttttacaaggtctat

SEQ ID NO: 7299376 - DNA, 22 bp, Homo sapiens
ctccaggttacttagcctagct

SEQ ID NO: 7299377 - DNA, 22 bp, Homo sapiens
ctccaggtgcagaaggactcag

SEQ ID NO: 7299378 - DNA, 22 bp, Homo sapiens
ctccaggtagctaagtcctggg

SEQ ID NO: 7299379 - DNA, 22 bp, Homo sapiens
ttgctttggtagcagctataga

SEQ ID NO: 7299380 - DNA, 18 bp, Homo sapiens
ttgctttgtaagcttgca

SEQ ID NO: 7299381 - DNA, 22 bp, Homo sapiens
ttgcttttaatctttgtacatc

SEQ ID NO: 7299382 - DNA, 22 bp, Homo sapiens
ttgctttgtttaaaagtggtat

SEQ ID NO: 7299383 - DNA, 22 bp, Homo sapiens
ttgcttttccctgtctctgatt

SEQ ID NO: 7299384 - DNA, 22 bp, Homo sapiens
ttgcttttgggaaaacatgcct

SEQ ID NO: 7299385 - DNA, 22 bp, Homo sapiens
ttgcttttgggaaaacatgcct

SEQ ID NO: 7299386 - DNA, 22 bp, Homo sapiens
ttgcttttgtgtgctctctgga

SEQ ID NO: 7299387 - DNA, 20 bp, Homo sapiens
ttggatcttatgggaggggg

SEQ ID NO: 7299388 - DNA, 22 bp, Homo sapiens
ttggaaaaattgcctgatgtct

SEQ ID NO: 7299389 - DNA, 22 bp, Homo sapiens
ttggaaaaacacgatagtggtt

SEQ ID NO: 7299390 - DNA, 22 bp, Homo sapiens
ttgctttgccaccagaagtcta

SEQ ID NO: 7299391 - DNA, 22 bp, Homo sapiens
ttgggcactgtgggttgtctgt

SEQ ID NO: 7299392 - DNA, 22 bp, Homo sapiens
ttgggcacggacaggtggggat

SEQ ID NO: 7299393 - DNA, 22 bp, Homo sapiens
ttgggcacactttgctggggag

SEQ ID NO: 7299394 - DNA, 22 bp, Homo sapiens
ctcatccaccctcaacaaagat

SEQ ID NO: 7299395 - DNA, 22 bp, Homo sapiens
ctcataggtttggaaccaggta

SEQ ID NO: 7299396 - DNA, 22 bp, Homo sapiens
ctcatagggtgaggataaaaga

SEQ ID NO: 7299397 - DNA, 22 bp, Homo sapiens
ctcataatgtgactgtatttga

SEQ ID NO: 7299398 - DNA, 22 bp, Homo sapiens
ctcataaacaattctttgaggt

SEQ ID NO: 7299399 - DNA, 22 bp, Homo sapiens
ctcataaaagctttgtttacac

SEQ ID NO: 7299400 - DNA, 22 bp, Homo sapiens
ctcataaaggcacacttgttgt

SEQ ID NO: 7299401 - DNA, 22 bp, Homo sapiens
tttagacatctataattgctaa

SEQ ID NO: 7299402 - DNA, 22 bp, Homo sapiens
tttagacatagctgaaatcatt

SEQ ID NO: 7299403 - DNA, 22 bp, Homo sapiens
tttagacaggggcaaaataagg

SEQ ID NO: 7299404 - DNA, 22 bp, Homo sapiens
tttagacacactttgtatattt

SEQ ID NO: 7299405 - DNA, 22 bp, Homo sapiens
tttacatgtccttcaagagcag

SEQ ID NO: 7299406 - DNA, 22 bp, Homo sapiens
tttacatgtcaagactggcagt

SEQ ID NO: 7299407 - DNA, 22 bp, Homo sapiens
tttacatgagtagcagatgttc

SEQ ID NO: 7299408 - DNA, 22 bp, Homo sapiens
tttacatagtgctttcccacta

SEQ ID NO: 7299409 - DNA, 22 bp, Homo sapiens
tttaacagatgctatgtctacc

SEQ ID NO: 7299410 - DNA, 22 bp, Homo sapiens
tttaaatttagaagaaacactg

SEQ ID NO: 7299411 - DNA, 22 bp, Homo sapiens
tttaacacccaggtagttctga

SEQ ID NO: 7299412 - DNA, 22 bp, Homo sapiens
tttaacactcagtttaatagcc

SEQ ID NO: 7299413 - DNA, 22 bp, Homo sapiens
tttaaaaggcagcttcttttgt

SEQ ID NO: 7299414 - DNA, 22 bp, Homo sapiens
tttaaaaggggtattaagtcca

SEQ ID NO: 7299415 - DNA, 22 bp, Homo sapiens
tttaaaaccaaagaaagcctct

SEQ ID NO: 7299416 - DNA, 22 bp, Homo sapiens
ctctccagccacagaagctgct

SEQ ID NO: 7299417 - DNA, 22 bp, Homo sapiens
ctctccagcagatgtagtctgt

SEQ ID NO: 7299418 - DNA, 22 bp, Homo sapiens
ctcctgggatgactctttcttt

SEQ ID NO: 7299419 - DNA, 22 bp, Homo sapiens
ctcctgggctatgtctgcttgg

SEQ ID NO: 7299420 - DNA, 22 bp, Homo sapiens
tttcagttcatgtattccgagt

SEQ ID NO: 7299421 - DNA, 22 bp, Homo sapiens
tttcagttctgtacaagtccag

SEQ ID NO: 7299422 - DNA, 22 bp, Homo sapiens
tttcagttgtcctgttaatagc

SEQ ID NO: 7299423 - DNA, 22 bp, Homo sapiens
tttcagttgtcctgttaatagc

SEQ ID NO: 7299424 - DNA, 22 bp, Homo sapiens
ctctccagttacctaggtctga

SEQ ID NO: 7299425 - DNA, 22 bp, Homo sapiens
ctctccagttatagctgatttg

SEQ ID NO: 7299426 - DNA, 22 bp, Homo sapiens
ctctccaggactttggcccaat

SEQ ID NO: 7299427 - DNA, 22 bp, Homo sapiens
tttcagtgttatgactttcatt

SEQ ID NO: 7299428 - DNA, 22 bp, Homo sapiens
ttgacttttcttggtcacatga

SEQ ID NO: 7299429 - DNA, 22 bp, Homo sapiens
ttgagaaaatagttcgaatgtt

SEQ ID NO: 7299430 - DNA, 22 bp, Homo sapiens
ttgagcttgaggagttatttga

SEQ ID NO: 7299431 - DNA, 22 bp, Homo sapiens
ttgactctaaatttacttttcc

SEQ ID NO: 7299432 - DNA, 22 bp, Homo sapiens
ttgactttacagttttcttagg

SEQ ID NO: 7299433 - DNA, 22 bp, Homo sapiens
ctatttttctgtaccctaattt

SEQ ID NO: 7299434 - DNA, 22 bp, Homo sapiens
ctatttttctgtaccctaattt

SEQ ID NO: 7299435 - DNA, 17 bp, Homo sapiens
ctattttggagattaaa

SEQ ID NO: 7299436 - DNA, 17 bp, Homo sapiens
ctattttggagattaaa

SEQ ID NO: 7299437 - DNA, 22 bp, Homo sapiens
ctattttgtccttagtgcaggg

SEQ ID NO: 7299438 - DNA, 22 bp, Homo sapiens
ctcagcaggtaccacatgatct

SEQ ID NO: 7299439 - DNA, 22 bp, Homo sapiens
ttcttgtttattaagatataaa

SEQ ID NO: 7299440 - DNA, 22 bp, Homo sapiens
ctattttgcctgcctagaaatc

SEQ ID NO: 7299441 - DNA, 22 bp, Homo sapiens
ttcttgtactggagatacatga

SEQ ID NO: 7299442 - DNA, 22 bp, Homo sapiens
ttcttgtatataaaaatcattt

SEQ ID NO: 7299443 - DNA, 22 bp, Homo sapiens
ctatttcagcagaagccggaga

SEQ ID NO: 7299444 - DNA, 22 bp, Homo sapiens
ctatttcaaggcccagatatga

SEQ ID NO: 7299445 - DNA, 22 bp, Homo sapiens
ctatttcattgtgctgagtctg

SEQ ID NO: 7299446 - DNA, 22 bp, Homo sapiens
ctatttctaaacctataagtga

SEQ ID NO: 7299447 - DNA, 22 bp, Homo sapiens
ctatttctgcctaatgacctgt

SEQ ID NO: 7299448 - DNA, 22 bp, Homo sapiens
ctatttgtaaagtgcctggtgt

SEQ ID NO: 7299449 - DNA, 22 bp, Homo sapiens
ctatttgtaagagccccacacc

SEQ ID NO: 7299450 - DNA, 22 bp, Homo sapiens
ctatttgtacagcattagtaat

SEQ ID NO: 7299451 - DNA, 22 bp, Homo sapiens
ctattcaattttgctattgtag

SEQ ID NO: 7299452 - DNA, 22 bp, Homo sapiens
ctattcagcctctaagacaagt

SEQ ID NO: 7299453 - DNA, 22 bp, Homo sapiens
ctattcagttgtgggcaacaat

SEQ ID NO: 7299454 - DNA, 22 bp, Homo sapiens
ctatttatgtgctattttgtat

SEQ ID NO: 7299455 - DNA, 22 bp, Homo sapiens
ctagggagtggcagagctggga

SEQ ID NO: 7299456 - DNA, 22 bp, Homo sapiens
ctatttgtacagcattcgagtt

SEQ ID NO: 7299457 - DNA, 22 bp, Homo sapiens
ctatttgtcacaactggtgttt

SEQ ID NO: 7299458 - DNA, 22 bp, Homo sapiens
ctatttgtcagtttggctttaa

SEQ ID NO: 7299459 - DNA, 22 bp, Homo sapiens
ttctgtaggcacacagtttcaa

SEQ ID NO: 7299460 - DNA, 22 bp, Homo sapiens
ttcctttctctggactgcagcc

SEQ ID NO: 7299461 - DNA, 22 bp, Homo sapiens
ctagcccaggaatgccgtggcc

SEQ ID NO: 7299462 - DNA, 22 bp, Homo sapiens
ctaggctgttcatgctcagacc

SEQ ID NO: 7299463 - DNA, 22 bp, Homo sapiens
ttcactgttgttagcagaggcg

SEQ ID NO: 7299464 - DNA, 22 bp, Homo sapiens
ttcactgttggctttgcttgtc

SEQ ID NO: 7299465 - DNA, 22 bp, Homo sapiens
ttcactgtttcatcctacttct

SEQ ID NO: 7299466 - DNA, 22 bp, Homo sapiens
ttcatgatagtatctattcaat

SEQ ID NO: 7299467 - DNA, 22 bp, Homo sapiens
ttcatgaggtacctgtgatcat

SEQ ID NO: 7299468 - DNA, 22 bp, Homo sapiens
ttcattctgcagttctcagctc

SEQ ID NO: 7299469 - DNA, 22 bp, Homo sapiens
cctgggtgtcatgggcagctgg

SEQ ID NO: 7299470 - DNA, 22 bp, Homo sapiens
ttcacataaatagatcacatca

SEQ ID NO: 7299471 - DNA, 22 bp, Homo sapiens
ttcacataaatagatcacatca

SEQ ID NO: 7299472 - DNA, 22 bp, Homo sapiens
ttcacatataatgtctttaaaa

SEQ ID NO: 7299473 - DNA, 22 bp, Homo sapiens
ttcacataggagcatggttttt

SEQ ID NO: 7299474 - DNA, 22 bp, Homo sapiens
ttcacataggagcatggttttt

SEQ ID NO: 7299475 - DNA, 22 bp, Homo sapiens
ttcacataatctgcagcaagcg

SEQ ID NO: 7299476 - DNA, 22 bp, Homo sapiens
ttcacattaagcctcctcctac

SEQ ID NO: 7299477 - DNA, 22 bp, Homo sapiens
cggcatgggcgtccccctcact

SEQ ID NO: 7299478 - DNA, 22 bp, Homo sapiens
ttccatttggcacttcactgag

SEQ ID NO: 7299479 - DNA, 22 bp, Homo sapiens
ttcccaaaatataacagttaac

SEQ ID NO: 7299480 - DNA, 22 bp, Homo sapiens
ttccatttattcttgtccagat

SEQ ID NO: 7299481 - DNA, 22 bp, Homo sapiens
ttccaaatgcccatctacacag

SEQ ID NO: 7299482 - DNA, 22 bp, Homo sapiens
ttccgctgtttagttgaagttt

SEQ ID NO: 7299483 - DNA, 22 bp, Homo sapiens
ctaatttttgttctgcattgaa

SEQ ID NO: 7299484 - DNA, 22 bp, Homo sapiens
ctaattttcccaaggccttcta

SEQ ID NO: 7299485 - DNA, 22 bp, Homo sapiens
ctaatttaatgaatgagtctta

SEQ ID NO: 7299486 - DNA, 22 bp, Homo sapiens
ctacaaaagtaattgtggtttt

SEQ ID NO: 7299487 - DNA, 22 bp, Homo sapiens
ctaatactcatttctgtaactc

SEQ ID NO: 7299488 - DNA, 22 bp, Homo sapiens
ttccttcctggggatttatcat

SEQ ID NO: 7299489 - DNA, 22 bp, Homo sapiens
ttccttcctgtcttccttactg

SEQ ID NO: 7299490 - DNA, 22 bp, Homo sapiens
ttccttccctcagtggctgaag

SEQ ID NO: 7299491 - DNA, 22 bp, Homo sapiens
tttgtcttggcctcagttttct

SEQ ID NO: 7299492 - DNA, 22 bp, Homo sapiens
tttgtcttggcctcagttttct

SEQ ID NO: 7299493 - DNA, 22 bp, Homo sapiens
tttgtacatcctaattctgagt

SEQ ID NO: 7299494 - DNA, 22 bp, Homo sapiens
tttgtctttcccctcctcattg

SEQ ID NO: 7299495 - DNA, 22 bp, Homo sapiens
tttgtgaacaaacatgaagatg

SEQ ID NO: 7299496 - DNA, 22 bp, Homo sapiens
tttgtgaataggttggcttcca

SEQ ID NO: 7299497 - DNA, 22 bp, Homo sapiens
tttgtgaataagagaatgacag

SEQ ID NO: 7299498 - DNA, 19 bp, Homo sapiens
tttgtgaagaaaatgatgc

SEQ ID NO: 7299499 - DNA, 22 bp, Homo sapiens
ctctggctggcattgctggact

SEQ ID NO: 7299500 - DNA, 22 bp, Homo sapiens
ctctggcttctaccttgcagtt

SEQ ID NO: 7299501 - DNA, 22 bp, Homo sapiens
ttttagtttggatttctaaagc

SEQ ID NO: 7299502 - DNA, 23 bp, Homo sapiens
ttttattgatatgtagctgttgt

SEQ ID NO: 7299503 - DNA, 22 bp, Homo sapiens
ttttattcatagggatggagag

SEQ ID NO: 7299504 - DNA, 22 bp, Homo sapiens
ctctgggcaggaccagtggacc

SEQ ID NO: 7299505 - DNA, 22 bp, Homo sapiens
ctctgggatgaggcctaggcac

SEQ ID NO: 7299506 - DNA, 22 bp, Homo sapiens
ctgaaattctgcctctgcacaa

SEQ ID NO: 7299507 - DNA, 19 bp, Homo sapiens
tttttaatgggctggagca

SEQ ID NO: 7299508 - DNA, 22 bp, Homo sapiens
ctgaagactgctgagaagttac

SEQ ID NO: 7299509 - DNA, 22 bp, Homo sapiens
ctgaagagcactgtggccagtt

SEQ ID NO: 7299510 - DNA, 22 bp, Homo sapiens
ctgactgtgagagcaggaatgg

SEQ ID NO: 7299511 - DNA, 22 bp, Homo sapiens
ctgagaagcactgtctgcaaga

SEQ ID NO: 7299512 - DNA, 22 bp, Homo sapiens
ctgagaaatacccaagtctggt

SEQ ID NO: 7299513 - DNA, 22 bp, Homo sapiens
ctctttttcagccttaccaaag

SEQ ID NO: 7299514 - DNA, 19 bp, Homo sapiens
ctgaaaaacattctcagga

SEQ ID NO: 7299515 - DNA, 22 bp, Homo sapiens
tttttaagctcctttgatgtca

SEQ ID NO: 7299516 - DNA, 21 bp, Homo sapiens
ttttattgatgaatggccact

SEQ ID NO: 7299517 - DNA, 22 bp, Homo sapiens
ctctggttcgtggtagatttta

SEQ ID NO: 7299518 - DNA, 22 bp, Homo sapiens
ctctggttgagtgagaaccaag

SEQ ID NO: 7299519 - DNA, 22 bp, Homo sapiens
ctctttggcccccgatgattca

SEQ ID NO: 7299520 - DNA, 22 bp, Homo sapiens
ctctttggcgttggcagagcca

SEQ ID NO: 7299521 - DNA, 22 bp, Homo sapiens
ctctttgtcactcatacagtca

SEQ ID NO: 7299522 - DNA, 22 bp, Homo sapiens
ctctttgtgctattatgatcct

SEQ ID NO: 7299523 - DNA, 21 bp, Homo sapiens
ctctttgtggcaatgtatttt

SEQ ID NO: 7299524 - DNA, 22 bp, Homo sapiens
ctgcagatgtctcaattttatt

SEQ ID NO: 7299525 - DNA, 22 bp, Homo sapiens
ctgccaggcctggggtgctgtc

SEQ ID NO: 7299526 - DNA, 22 bp, Homo sapiens
ctgcctcatgctgcctgcagcc

SEQ ID NO: 7299527 - DNA, 22 bp, Homo sapiens
ctgccgtgtttttcatgttaaa

SEQ ID NO: 7299528 - DNA, 22 bp, Homo sapiens
ctgcctagaaaaccaggctcct

SEQ ID NO: 7299529 - DNA, 22 bp, Homo sapiens
ctgagagaaacatgactcagga

SEQ ID NO: 7299530 - DNA, 22 bp, Homo sapiens
ctgaggagtgggtgggcagtga

SEQ ID NO: 7299531 - DNA, 22 bp, Homo sapiens
ctgattttcaaaatgtgttaaa

SEQ ID NO: 7299532 - DNA, 22 bp, Homo sapiens
ctgatcctcctttaagtagctg

SEQ ID NO: 7299533 - DNA, 22 bp, Homo sapiens
ctgatcttaagtaacattattt

SEQ ID NO: 7299534 - DNA, 22 bp, Homo sapiens
ctgatcttaagtaacattattt

SEQ ID NO: 7299535 - DNA, 22 bp, Homo sapiens
ctgatgcctctcttcttggctt

SEQ ID NO: 7299536 - DNA, 22 bp, Homo sapiens
ctgatggagactccactgtgat

SEQ ID NO: 7299537 - DNA, 22 bp, Homo sapiens
ctggaaagtacagtgtgtcaca

SEQ ID NO: 7299538 - DNA, 22 bp, Homo sapiens
ctggacagaaaaggccactgga

SEQ ID NO: 7299539 - DNA, 22 bp, Homo sapiens
ctggacacactggagtctggca

SEQ ID NO: 7299540 - DNA, 22 bp, Homo sapiens
ctggacactggggatgcgcagt

SEQ ID NO: 7299541 - DNA, 22 bp, Homo sapiens
ctggacagaaagggctgctgtg

SEQ ID NO: 7299542 - DNA, 22 bp, Homo sapiens
ctggacaggctggggactgcaa

SEQ ID NO: 7299543 - DNA, 22 bp, Homo sapiens
ctggaaaatgaagaagcagagg

SEQ ID NO: 7299544 - DNA, 20 bp, Homo sapiens
ctggaaaccctgctgatggt

SEQ ID NO: 7299545 - DNA, 22 bp, Homo sapiens
ctgctttttctaggaggacaat

SEQ ID NO: 7299546 - DNA, 22 bp, Homo sapiens
ctgctttgtgtggtccctccag

SEQ ID NO: 7299547 - DNA, 22 bp, Homo sapiens
ctgctttgtgtggtccctccag

SEQ ID NO: 7299548 - DNA, 22 bp, Homo sapiens
ctgctttgtaaaatagacataa

SEQ ID NO: 7299549 - DNA, 17 bp, Homo sapiens
ctgctttgtgcaacgct

SEQ ID NO: 7299550 - DNA, 22 bp, Homo sapiens
ctgctttgtggaatcacactgg

SEQ ID NO: 7299551 - DNA, 22 bp, Homo sapiens
ctgctttggacaactattcttg

SEQ ID NO: 7299552 - DNA, 18 bp, Homo sapiens
ctgctttgccttcattcc

SEQ ID NO: 7299553 - DNA, 22 bp, Homo sapiens
ctgctttggctcagtgacatca

SEQ ID NO: 7299554 - DNA, 22 bp, Homo sapiens
ctgctttgggcagctttgtggc

SEQ ID NO: 7299555 - DNA, 22 bp, Homo sapiens
ctgctttggcagaagtcagcta

SEQ ID NO: 7299556 - DNA, 22 bp, Homo sapiens
ctgctttgaggggctctgtata

SEQ ID NO: 7299557 - DNA, 22 bp, Homo sapiens
ctgctttgcatagctgccagag

SEQ ID NO: 7299558 - DNA, 22 bp, Homo sapiens
ctgctttgattagaagagtaca

SEQ ID NO: 7299559 - DNA, 22 bp, Homo sapiens
ctgctttgactgttaagaacca

SEQ ID NO: 7299560 - DNA, 22 bp, Homo sapiens
ctgctttgaaaataaacttgtc

SEQ ID NO: 7299561 - DNA, 22 bp, Homo sapiens
ctgcttctaagaacctgcagct

SEQ ID NO: 7299562 - DNA, 22 bp, Homo sapiens
ctgctttatctgagacaagtca

SEQ ID NO: 7299563 - DNA, 22 bp, Homo sapiens
ctgcctggatgaatggcgcctt

SEQ ID NO: 7299564 - DNA, 22 bp, Homo sapiens
ctgcctggaatgccagcttctc

SEQ ID NO: 7299565 - DNA, 22 bp, Homo sapiens
ctgcctggagcattctgaaggt

SEQ ID NO: 7299566 - DNA, 22 bp, Homo sapiens
ctggagggtgagcctcatctct

SEQ ID NO: 7299567 - DNA, 21 bp, Homo sapiens
ctggagggtagagttgggctg

SEQ ID NO: 7299568 - DNA, 22 bp, Homo sapiens
ctggaggggccatccacagtct

SEQ ID NO: 7299569 - DNA, 22 bp, Homo sapiens
ctggaggggccatccacagtct

SEQ ID NO: 7299570 - DNA, 22 bp, Homo sapiens
ctggaggggctggcatggtagc

SEQ ID NO: 7299571 - DNA, 22 bp, Homo sapiens
ctggagggggaaatgttcattg

SEQ ID NO: 7299572 - DNA, 22 bp, Homo sapiens
ctggagggggaaatgttcattg

SEQ ID NO: 7299573 - DNA, 22 bp, Homo sapiens
ctggagggcttctgcaggttac

SEQ ID NO: 7299574 - DNA, 22 bp, Homo sapiens
ctggagggcttctgcaggttac

SEQ ID NO: 7299575 - DNA, 22 bp, Homo sapiens
ctggagggactttctcacggat

SEQ ID NO: 7299576 - DNA, 22 bp, Homo sapiens
ctggaggagaacttgaggaagg

SEQ ID NO: 7299577 - DNA, 22 bp, Homo sapiens
ctggaggagcaatatggttagg

SEQ ID NO: 7299578 - DNA, 22 bp, Homo sapiens
ctggaggagcatggactggagt

SEQ ID NO: 7299579 - DNA, 22 bp, Homo sapiens
ctggagggacaaggtatgcatt

SEQ ID NO: 7299580 - DNA, 22 bp, Homo sapiens
ctggaggctggcttcccctggc

SEQ ID NO: 7299581 - DNA, 22 bp, Homo sapiens
ctggaggcagttgccccagtca

SEQ ID NO: 7299582 - DNA, 22 bp, Homo sapiens
ctggagctcttctgagtgtgct

SEQ ID NO: 7299583 - DNA, 22 bp, Homo sapiens
ctggaggaatcacagaaggctt

SEQ ID NO: 7299584 - DNA, 22 bp, Homo sapiens
ctggaggaccacagaagctggt

SEQ ID NO: 7299585 - DNA, 22 bp, Homo sapiens
ctggactcagggtgctccagcg

SEQ ID NO: 7299586 - DNA, 22 bp, Homo sapiens
ctggaccctgtttccctaggtc

SEQ ID NO: 7299587 - DNA, 22 bp, Homo sapiens
ctggataatcacagaggagcat

SEQ ID NO: 7299588 - DNA, 22 bp, Homo sapiens
ctggataaatgctttagttgga

SEQ ID NO: 7299589 - DNA, 22 bp, Homo sapiens
ctggatctaaaggtggatgtag

SEQ ID NO: 7299590 - DNA, 22 bp, Homo sapiens
ctggatctgtcccctttttgtt

SEQ ID NO: 7299591 - DNA, 22 bp, Homo sapiens
ctggatctgtcttttggatccc

SEQ ID NO: 7299592 - DNA, 22 bp, Homo sapiens
ctggatgcttcctctctgctag

SEQ ID NO: 7299593 - DNA, 22 bp, Homo sapiens
ctggcaagaaatatatatctta

SEQ ID NO: 7299594 - DNA, 22 bp, Homo sapiens
ctggcagacttaccatcagaca

SEQ ID NO: 7299595 - DNA, 22 bp, Homo sapiens
ctggcacttggcacccatgaaa

SEQ ID NO: 7299596 - DNA, 22 bp, Homo sapiens
ctggcagcatggagcctgtgct

SEQ ID NO: 7299597 - DNA, 22 bp, Homo sapiens
ctggcatgtgtttggctcctgt

SEQ ID NO: 7299598 - DNA, 22 bp, Homo sapiens
ctggcatgccttgggtgcctct

SEQ ID NO: 7299599 - DNA, 22 bp, Homo sapiens
ctggccacccatgcctccctga

SEQ ID NO: 7299600 - DNA, 22 bp, Homo sapiens
ctggccaggcggcccctgcatg

SEQ ID NO: 7299601 - DNA, 23 bp, Homo sapiens
ctggccaccatctttctggcttc

SEQ ID NO: 7299602 - DNA, 22 bp, Homo sapiens
ctggccctgtggcctaaggact

SEQ ID NO: 7299603 - DNA, 22 bp, Homo sapiens
ctggctctgggctaagctccca

SEQ ID NO: 7299604 - DNA, 22 bp, Homo sapiens
ctggctctatctccaaggctgg

SEQ ID NO: 7299605 - DNA, 22 bp, Homo sapiens
ctggctccaggtcatgcactca

SEQ ID NO: 7299606 - DNA, 22 bp, Homo sapiens
ctggcctgggagctgctagcgt

SEQ ID NO: 7299607 - DNA, 22 bp, Homo sapiens
cccccagccagcagtgctcagc

SEQ ID NO: 7299608 - DNA, 22 bp, Homo sapiens
cccccagctctgctgggtcccg

SEQ ID NO: 7299609 - DNA, 22 bp, Homo sapiens
cccccaggctctgacacaggag

SEQ ID NO: 7299610 - DNA, 22 bp, Homo sapiens
cccctaggaggcgatggtggaa

SEQ ID NO: 7299611 - DNA, 22 bp, Homo sapiens
ccccagctcagtgcagggacat

SEQ ID NO: 7299612 - DNA, 22 bp, Homo sapiens
tgctggagaggaaggtggggtc

SEQ ID NO: 7299613 - DNA, 22 bp, Homo sapiens
ccccagccagcaggacctctga

SEQ ID NO: 7299614 - DNA, 22 bp, Homo sapiens
ccccactctcggccagataggc

SEQ ID NO: 7299615 - DNA, 22 bp, Homo sapiens
ccccagcagcacctggggcagt

SEQ ID NO: 7299616 - DNA, 22 bp, Homo sapiens
tgctgcaggaattctcaaggga

SEQ ID NO: 7299617 - DNA, 22 bp, Homo sapiens
tgctgagagatttaaagggcca

SEQ ID NO: 7299618 - DNA, 22 bp, Homo sapiens
tgctgagataagctatgaccag

SEQ ID NO: 7299619 - DNA, 19 bp, Homo sapiens
tgctgactgggcctcaccg

SEQ ID NO: 7299620 - DNA, 22 bp, Homo sapiens
tgctgcagaaattctgtgagga

SEQ ID NO: 7299621 - DNA, 22 bp, Homo sapiens
tgctgcactaggatttgctttc

SEQ ID NO: 7299622 - DNA, 22 bp, Homo sapiens
tgctgcacagcccgctggccca

SEQ ID NO: 7299623 - DNA, 22 bp, Homo sapiens
tgctgaatcaaaacaaaggttt

SEQ ID NO: 7299624 - DNA, 22 bp, Homo sapiens
tgctgaatcaaaacaaaggttt

SEQ ID NO: 7299625 - DNA, 21 bp, Homo sapiens
tgctgaatctgccatattttc

SEQ ID NO: 7299626 - DNA, 22 bp, Homo sapiens
tgctgaattaaactctatgtgg

SEQ ID NO: 7299627 - DNA, 22 bp, Homo sapiens
tgctgaatggtaaagaagtata

SEQ ID NO: 7299628 - DNA, 22 bp, Homo sapiens
tgctcccacactactcggaggc

SEQ ID NO: 7299629 - DNA, 22 bp, Homo sapiens
tgcctgggactctgttatcttg

SEQ ID NO: 7299630 - DNA, 22 bp, Homo sapiens
cccaggctcctactgtattctg

SEQ ID NO: 7299631 - DNA, 22 bp, Homo sapiens
cccaggctcctagaggcccaga

SEQ ID NO: 7299632 - DNA, 22 bp, Homo sapiens
cccaggctcttatgtgacttgc

SEQ ID NO: 7299633 - DNA, 21 bp, Homo sapiens
cccaggctgaattaaaaatat

SEQ ID NO: 7299634 - DNA, 22 bp, Homo sapiens
cccaggctcctgctgtgttgac

SEQ ID NO: 7299635 - DNA, 22 bp, Homo sapiens
cccaggctcctgactcattcta

SEQ ID NO: 7299636 - DNA, 22 bp, Homo sapiens
cccagctcttcctgggagctaa

SEQ ID NO: 7299637 - DNA, 19 bp, Homo sapiens
cccagcttgaccacctgct

SEQ ID NO: 7299638 - DNA, 22 bp, Homo sapiens
tgcatcaacctaatatcagctc

SEQ ID NO: 7299639 - DNA, 22 bp, Homo sapiens
tctgtggcatggtatctggagg

SEQ ID NO: 7299640 - DNA, 22 bp, Homo sapiens
tgccaagctagaacgttcccag

SEQ ID NO: 7299641 - DNA, 22 bp, Homo sapiens
tgccacagacaggacagaacag

SEQ ID NO: 7299642 - DNA, 22 bp, Homo sapiens
tgccaagttacacaatcagaaa

SEQ ID NO: 7299643 - DNA, 22 bp, Homo sapiens
cccaggcagcggggtctccttg

SEQ ID NO: 7299644 - DNA, 22 bp, Homo sapiens
cccaggcacatccactctgtga

SEQ ID NO: 7299645 - DNA, 22 bp, Homo sapiens
cccaggagttcgaggctgtagt

SEQ ID NO: 7299646 - DNA, 21 bp, Homo sapiens
tggcagcacccacaccctctg

SEQ ID NO: 7299647 - DNA, 22 bp, Homo sapiens
tggcagcaatttgtgatgttga

SEQ ID NO: 7299648 - DNA, 22 bp, Homo sapiens
tggcaagagcaaaatgtacagt

SEQ ID NO: 7299649 - DNA, 22 bp, Homo sapiens
tggcaaggccacaggtgcagtt

SEQ ID NO: 7299650 - DNA, 22 bp, Homo sapiens
tggcaaggctgtgggggcagag

SEQ ID NO: 7299651 - DNA, 22 bp, Homo sapiens
tggcaagggattgtggagaact

SEQ ID NO: 7299652 - DNA, 22 bp, Homo sapiens
cctatacaggcttctttacatg

SEQ ID NO: 7299653 - DNA, 22 bp, Homo sapiens
cctatgactctgattctttaga

SEQ ID NO: 7299654 - DNA, 23 bp, Homo sapiens
tggccaggcataaaggtgggtgg

SEQ ID NO: 7299655 - DNA, 22 bp, Homo sapiens
tggccaggaggctgcttctgac

SEQ ID NO: 7299656 - DNA, 22 bp, Homo sapiens
tggccacacccacctagaggag

SEQ ID NO: 7299657 - DNA, 22 bp, Homo sapiens
ccctggcaaaatccctggtaca

SEQ ID NO: 7299658 - DNA, 22 bp, Homo sapiens
ccctggcaaaacactctcttga

SEQ ID NO: 7299659 - DNA, 18 bp, Homo sapiens
tggagctgagggcaatgc

SEQ ID NO: 7299660 - DNA, 17 bp, Homo sapiens
ccctggctctaggtgga

SEQ ID NO: 7299661 - DNA, 22 bp, Homo sapiens
ccctggctctgcctcagagccc

SEQ ID NO: 7299662 - DNA, 22 bp, Homo sapiens
ccctggctcttcaccacctgcc

SEQ ID NO: 7299663 - DNA, 22 bp, Homo sapiens
ccctggctgataccggaaaggc

SEQ ID NO: 7299664 - DNA, 22 bp, Homo sapiens
ccctggctgccagtcaccagac

SEQ ID NO: 7299665 - DNA, 22 bp, Homo sapiens
tggatctgtttgttcaagggcc

SEQ ID NO: 7299666 - DNA, 22 bp, Homo sapiens
tggatcttcacaagagagggcg

SEQ ID NO: 7299667 - DNA, 22 bp, Homo sapiens
tggatcatggctaaggcgatgg

SEQ ID NO: 7299668 - DNA, 22 bp, Homo sapiens
tggatctcggcaatgcgggact

SEQ ID NO: 7299669 - DNA, 22 bp, Homo sapiens
tggatctcggcaatgcgggact

SEQ ID NO: 7299670 - DNA, 22 bp, Homo sapiens
tggatcctgcactgagtggagt

SEQ ID NO: 7299671 - DNA, 22 bp, Homo sapiens
tggatctatctccaggggtcct

SEQ ID NO: 7299672 - DNA, 22 bp, Homo sapiens
tggatctgaacgcttgggtgca

SEQ ID NO: 7299673 - DNA, 22 bp, Homo sapiens
tggatctgacaaggacgggaaa

SEQ ID NO: 7299674 - DNA, 22 bp, Homo sapiens
tggatctgactggcttttcttc

SEQ ID NO: 7299675 - DNA, 22 bp, Homo sapiens
tggatctgctctatgaactgct

SEQ ID NO: 7299676 - DNA, 22 bp, Homo sapiens
tggatctggttccctgagcctt

SEQ ID NO: 7299677 - DNA, 22 bp, Homo sapiens
tggatctgattaggggagccag

SEQ ID NO: 7299678 - DNA, 22 bp, Homo sapiens
tggatctggcagaatatatgta

SEQ ID NO: 7299679 - DNA, 22 bp, Homo sapiens
tggatctgtcccaaggctaggc

SEQ ID NO: 7299680 - DNA, 21 bp, Homo sapiens
tggatctgtgatctggggcac

SEQ ID NO: 7299681 - DNA, 17 bp, Homo sapiens
tggcaagacagctcagg

SEQ ID NO: 7299682 - DNA, 22 bp, Homo sapiens
ccctggagctagtctgagcaga

SEQ ID NO: 7299683 - DNA, 22 bp, Homo sapiens
tggagctgagaagtggagctct

SEQ ID NO: 7299684 - DNA, 22 bp, Homo sapiens
tggagctgagaagtggagctct

SEQ ID NO: 7299685 - DNA, 22 bp, Homo sapiens
tggagctgagaagtggagctct

SEQ ID NO: 7299686 - DNA, 22 bp, Homo sapiens
tggagctgagagccaggctggc

SEQ ID NO: 7299687 - DNA, 22 bp, Homo sapiens
ccctggactgttcagggcctga

SEQ ID NO: 7299688 - DNA, 22 bp, Homo sapiens
ccctccaggcactgccctcttc

SEQ ID NO: 7299689 - DNA, 22 bp, Homo sapiens
ccctccaggcctgtcatgttcc

SEQ ID NO: 7299690 - DNA, 22 bp, Homo sapiens
ccctccagagcttgacctgctg

SEQ ID NO: 7299691 - DNA, 22 bp, Homo sapiens
tggccccattttacagatgaaa

SEQ ID NO: 7299692 - DNA, 22 bp, Homo sapiens
tggcccagtgcttatgctctga

SEQ ID NO: 7299693 - DNA, 22 bp, Homo sapiens
tggcccagccctgctctagggc

SEQ ID NO: 7299694 - DNA, 22 bp, Homo sapiens
tggcccgaagatccgagggtca

SEQ ID NO: 7299695 - DNA, 22 bp, Homo sapiens
cctccctgtctacctgttgtgg

SEQ ID NO: 7299696 - DNA, 22 bp, Homo sapiens
cctcctccttatggtggcccag

SEQ ID NO: 7299697 - DNA, 22 bp, Homo sapiens
tggctgagggggcagttcagga

SEQ ID NO: 7299698 - DNA, 22 bp, Homo sapiens
cctctaggatgtggctggagga

SEQ ID NO: 7299699 - DNA, 20 bp, Homo sapiens
cctctctgcatgctccctga

SEQ ID NO: 7299700 - DNA, 22 bp, Homo sapiens
cctctgagagaaggccttcagc

SEQ ID NO: 7299701 - DNA, 22 bp, Homo sapiens
cctctgagaccagctctgcacc

SEQ ID NO: 7299702 - DNA, 22 bp, Homo sapiens
cctctcttggatgtggatgggt

SEQ ID NO: 7299703 - DNA, 22 bp, Homo sapiens
cctctgtgacttctaccttcac

SEQ ID NO: 7299704 - DNA, 22 bp, Homo sapiens
cctctgtgacaaacagtcctgg

SEQ ID NO: 7299705 - DNA, 22 bp, Homo sapiens
tgtgtgggcgaagacagccttt

SEQ ID NO: 7299706 - DNA, 22 bp, Homo sapiens
tgtgtgggtacagatgattgtt

SEQ ID NO: 7299707 - DNA, 23 bp, Homo sapiens
tgtgtctgtttagggaggatgtg

SEQ ID NO: 7299708 - DNA, 23 bp, Homo sapiens
tgtgtctgtttagggaggatgtg

SEQ ID NO: 7299709 - DNA, 22 bp, Homo sapiens
tgtgtctgtgtatacacggcat

SEQ ID NO: 7299710 - DNA, 22 bp, Homo sapiens
tgtgtctgtcctcggttgatgc

SEQ ID NO: 7299711 - DNA, 22 bp, Homo sapiens
tgtgtctgtcctcggttgatgc

SEQ ID NO: 7299712 - DNA, 22 bp, Homo sapiens
tgtgggggtacacgtacacatg

SEQ ID NO: 7299713 - DNA, 22 bp, Homo sapiens
tgtgtctgtcctcggttgatgc

SEQ ID NO: 7299714 - DNA, 22 bp, Homo sapiens
cctgggcctatcctagaaccaa

SEQ ID NO: 7299715 - DNA, 22 bp, Homo sapiens
cctgggccaggcttgggaatgc

SEQ ID NO: 7299716 - DNA, 22 bp, Homo sapiens
cctgggcatctcatgcacctgc

SEQ ID NO: 7299717 - DNA, 22 bp, Homo sapiens
cctgggaggctgaggctgcagt

SEQ ID NO: 7299718 - DNA, 17 bp, Homo sapiens
cctgggaggagttatga

SEQ ID NO: 7299719 - DNA, 22 bp, Homo sapiens
tgtggctggtctccgagcgtcg

SEQ ID NO: 7299720 - DNA, 22 bp, Homo sapiens
tgtgctttggttttacaggatg

SEQ ID NO: 7299721 - DNA, 22 bp, Homo sapiens
tgtgctttcaaagttaagtaaa

SEQ ID NO: 7299722 - DNA, 22 bp, Homo sapiens
tgtgtgtctgcacatgtataat

SEQ ID NO: 7299723 - DNA, 22 bp, Homo sapiens
tgtgtgtctgcacatgtataat

SEQ ID NO: 7299724 - DNA, 22 bp, Homo sapiens
tgtgtgtccttgacctcagtgg

SEQ ID NO: 7299725 - DNA, 22 bp, Homo sapiens
tgtgtgtccttgacctcagtgg

SEQ ID NO: 7299726 - DNA, 22 bp, Homo sapiens
tgtgtgtcatttagggtggagc

SEQ ID NO: 7299727 - DNA, 22 bp, Homo sapiens
tgtgtgtctggaagctcaggga

SEQ ID NO: 7299728 - DNA, 22 bp, Homo sapiens
tgtgtgtcagtcttgtttaggg

SEQ ID NO: 7299729 - DNA, 22 bp, Homo sapiens
tgtgtgtcagtcttgtttaggg

SEQ ID NO: 7299730 - DNA, 22 bp, Homo sapiens
tgtgtgtcagagtctccatggt

SEQ ID NO: 7299731 - DNA, 22 bp, Homo sapiens
tgtgtgtcactgaaagaaatct

SEQ ID NO: 7299732 - DNA, 22 bp, Homo sapiens
tgtgtgtcagagtctccatggt

SEQ ID NO: 7299733 - DNA, 22 bp, Homo sapiens
tgtgtgtcagcccaagggcctt

SEQ ID NO: 7299734 - DNA, 22 bp, Homo sapiens
tgtgtgtcagagtctccatggt

SEQ ID NO: 7299735 - DNA, 19 bp, Homo sapiens
tgtgtgtatttcagttctt

SEQ ID NO: 7299736 - DNA, 22 bp, Homo sapiens
tgtgtgtcactgaaagaaatct

SEQ ID NO: 7299737 - DNA, 21 bp, Homo sapiens
tgtgtgtatgcacacacatgc

SEQ ID NO: 7299738 - DNA, 22 bp, Homo sapiens
tgtgtgtatgtttacttttcct

SEQ ID NO: 7299739 - DNA, 22 bp, Homo sapiens
tgtgtgtatatgcatttatcta

SEQ ID NO: 7299740 - DNA, 22 bp, Homo sapiens
tgtgtgtatatgcatttatcta

SEQ ID NO: 7299741 - DNA, 22 bp, Homo sapiens
tgtgtgtaatgtttctctcttc

SEQ ID NO: 7299742 - DNA, 22 bp, Homo sapiens
tgtgtgtaaggaagctttatgg

SEQ ID NO: 7299743 - DNA, 22 bp, Homo sapiens
tgtgtgtataataatgtctgca

SEQ ID NO: 7299744 - DNA, 22 bp, Homo sapiens
tgtgtgtataataatgtctgca

SEQ ID NO: 7299745 - DNA, 22 bp, Homo sapiens
tgtgtgtataataatgtctgca

SEQ ID NO: 7299746 - DNA, 22 bp, Homo sapiens
cctggggaatcttgcaggggaa

SEQ ID NO: 7299747 - DNA, 22 bp, Homo sapiens
cctggggaaaagcaggcattta

SEQ ID NO: 7299748 - DNA, 22 bp, Homo sapiens
cctggggaagtcacttctcttt

SEQ ID NO: 7299749 - DNA, 23 bp, Homo sapiens
tgtgttctcacacagatgcagta

SEQ ID NO: 7299750 - DNA, 22 bp, Homo sapiens
tgtgttctccaactgtagattt

SEQ ID NO: 7299751 - DNA, 22 bp, Homo sapiens
cctggggctccagagcagcgga

SEQ ID NO: 7299752 - DNA, 22 bp, Homo sapiens
tgtgttcctgcctggctctggt

SEQ ID NO: 7299753 - DNA, 22 bp, Homo sapiens
tgtgttccttaaaggatgggca

SEQ ID NO: 7299754 - DNA, 22 bp, Homo sapiens
tgtgttccttcgtcttcccttc

SEQ ID NO: 7299755 - DNA, 22 bp, Homo sapiens
tgtgttcattagcattgccttg

SEQ ID NO: 7299756 - DNA, 22 bp, Homo sapiens
tgtgttcatgtatgtatacata

SEQ ID NO: 7299757 - DNA, 22 bp, Homo sapiens
tgtgttcagcaggcaccttctt

SEQ ID NO: 7299758 - DNA, 22 bp, Homo sapiens
tgtgttcaatgacttcatcttt

SEQ ID NO: 7299759 - DNA, 22 bp, Homo sapiens
cctggggaatagagtcaagggg

SEQ ID NO: 7299760 - DNA, 22 bp, Homo sapiens
cctggggacctgcctcagccct

SEQ ID NO: 7299761 - DNA, 22 bp, Homo sapiens
cctgggtgatgtgctgccctcg

SEQ ID NO: 7299762 - DNA, 22 bp, Homo sapiens
cctgggtcttcagtctgctggt

SEQ ID NO: 7299763 - DNA, 22 bp, Homo sapiens
cctgggtcccatcccagagtga

SEQ ID NO: 7299764 - DNA, 22 bp, Homo sapiens
cctgggtcccatcccagagtga

SEQ ID NO: 7299765 - DNA, 22 bp, Homo sapiens
cctgggtccctgagagatgatt

SEQ ID NO: 7299766 - DNA, 19 bp, Homo sapiens
cctgggtctgcagcattca

SEQ ID NO: 7299767 - DNA, 22 bp, Homo sapiens
cctgggaagagctgacaggagg

SEQ ID NO: 7299768 - DNA, 22 bp, Homo sapiens
cctgggagagccatctgtggcc

SEQ ID NO: 7299769 - DNA, 21 bp, Homo sapiens
cctgggagatcagctgccttc

SEQ ID NO: 7299770 - DNA, 22 bp, Homo sapiens
cctgggagagtctgtggtctcc

SEQ ID NO: 7299771 - DNA, 22 bp, Homo sapiens
cctgggagagtctgtggtctcc

SEQ ID NO: 7299772 - DNA, 22 bp, Homo sapiens
cctgggagccgactgactgtgc

SEQ ID NO: 7299773 - DNA, 22 bp, Homo sapiens
tgtgctggtacatgtgaggatg

SEQ ID NO: 7299774 - DNA, 19 bp, Homo sapiens
tgtgcttatgtttagatat

SEQ ID NO: 7299775 - DNA, 22 bp, Homo sapiens
tgtgcttactttgaattatata

SEQ ID NO: 7299776 - DNA, 22 bp, Homo sapiens
cctggctgtgtgaccttggcaa

SEQ ID NO: 7299777 - DNA, 21 bp, Homo sapiens
cctggcttcagggtgcactgg

SEQ ID NO: 7299778 - DNA, 22 bp, Homo sapiens
cctggcttccttcatgacctgg

SEQ ID NO: 7299779 - DNA, 18 bp, Homo sapiens
cctggcttttctacttgc

SEQ ID NO: 7299780 - DNA, 22 bp, Homo sapiens
cctggctgcattttgctggatg

SEQ ID NO: 7299781 - DNA, 22 bp, Homo sapiens
cctggctgtcgttttgtgaaat

SEQ ID NO: 7299782 - DNA, 22 bp, Homo sapiens
cctggctgtcgttttgtgaaat

SEQ ID NO: 7299783 - DNA, 22 bp, Homo sapiens
tgtgaaggagatgaagggagtg

SEQ ID NO: 7299784 - DNA, 22 bp, Homo sapiens
tgtctttggaatatttagctga

SEQ ID NO: 7299785 - DNA, 22 bp, Homo sapiens
tgtctttagttttactgtctgg

SEQ ID NO: 7299786 - DNA, 22 bp, Homo sapiens
tgtgaggataaaaaggaaggag

SEQ ID NO: 7299787 - DNA, 22 bp, Homo sapiens
tgtgaggataaaaaggaaggag

SEQ ID NO: 7299788 - DNA, 23 bp, Homo sapiens
cctggctgacctgaaggtgtagt

SEQ ID NO: 7299789 - DNA, 21 bp, Homo sapiens
cctggctgcacagttgctggt

SEQ ID NO: 7299790 - DNA, 23 bp, Homo sapiens
tgtctggggcgccagaagagaga

SEQ ID NO: 7299791 - DNA, 22 bp, Homo sapiens
tgtctgggggttctgaaagctg

SEQ ID NO: 7299792 - DNA, 22 bp, Homo sapiens
tgtctgggtcacccctcctggc

SEQ ID NO: 7299793 - DNA, 22 bp, Homo sapiens
tgtctgggttcaaaacctggct

SEQ ID NO: 7299794 - DNA, 22 bp, Homo sapiens
tgtctgggttttgggtcatatt

SEQ ID NO: 7299795 - DNA, 22 bp, Homo sapiens
tgtctggtgggttgacaggcag

SEQ ID NO: 7299796 - DNA, 22 bp, Homo sapiens
tgtctttagccagcagtcttct

SEQ ID NO: 7299797 - DNA, 22 bp, Homo sapiens
tgtcctggccaaggccttgctt

SEQ ID NO: 7299798 - DNA, 22 bp, Homo sapiens
tgtcctcttccagtgctccttc

SEQ ID NO: 7299799 - DNA, 22 bp, Homo sapiens
tgtctcttactttgattcttgg

SEQ ID NO: 7299800 - DNA, 22 bp, Homo sapiens
tgtctctgtgcatttgtgcttc

SEQ ID NO: 7299801 - DNA, 22 bp, Homo sapiens
tgtctctgtgcatttgtgcttc

SEQ ID NO: 7299802 - DNA, 22 bp, Homo sapiens
tgtctcttactttgattcttgg

SEQ ID NO: 7299803 - DNA, 22 bp, Homo sapiens
tgtctcttgagtttgttttaat

SEQ ID NO: 7299804 - DNA, 22 bp, Homo sapiens
tgtctcttgagctgcctgatgc

SEQ ID NO: 7299805 - DNA, 22 bp, Homo sapiens
tgtctcttctgcctccagctgt

SEQ ID NO: 7299806 - DNA, 18 bp, Homo sapiens
tgtctcttcttatgtggg

SEQ ID NO: 7299807 - DNA, 22 bp, Homo sapiens
tgtctcttggattgcttgctct

SEQ ID NO: 7299808 - DNA, 22 bp, Homo sapiens
tgtctcttggagggtctagtga

SEQ ID NO: 7299809 - DNA, 22 bp, Homo sapiens
cctggcctgctcggctcttaag

SEQ ID NO: 7299810 - DNA, 22 bp, Homo sapiens
cctggcctggcactccctctgc

SEQ ID NO: 7299811 - DNA, 22 bp, Homo sapiens
cctggcctcctggccttctcat

SEQ ID NO: 7299812 - DNA, 22 bp, Homo sapiens
cctggcctcagcctagggctga

SEQ ID NO: 7299813 - DNA, 22 bp, Homo sapiens
cctggccctggaatagggcagg

SEQ ID NO: 7299814 - DNA, 22 bp, Homo sapiens
cctggccctggaatagggcagg

SEQ ID NO: 7299815 - DNA, 19 bp, Homo sapiens
cctggccctgctgcgcggg

SEQ ID NO: 7299816 - DNA, 23 bp, Homo sapiens
cctggcagcaaacgaggaggtta

SEQ ID NO: 7299817 - DNA, 22 bp, Homo sapiens
cctggcagctgtttggcttggc

SEQ ID NO: 7299818 - DNA, 22 bp, Homo sapiens
cctggcagcattggtagagatt

SEQ ID NO: 7299819 - DNA, 23 bp, Homo sapiens
cctggcagcaaacgaggaggtta

SEQ ID NO: 7299820 - DNA, 21 bp, Homo sapiens
tgtcattaatcgctatagaag

SEQ ID NO: 7299821 - DNA, 22 bp, Homo sapiens
tgtcatgtttcatgtttgtagg

SEQ ID NO: 7299822 - DNA, 22 bp, Homo sapiens
tgtcatgtttcatgtttgtagg

SEQ ID NO: 7299823 - DNA, 21 bp, Homo sapiens
tgtcatgtttttccaggcatc

SEQ ID NO: 7299824 - DNA, 22 bp, Homo sapiens
tgtcattaaaatgcttctcaaa

SEQ ID NO: 7299825 - DNA, 22 bp, Homo sapiens
cctggcaggcaagaggaaggga

SEQ ID NO: 7299826 - DNA, 22 bp, Homo sapiens
cctggcaggtggaggttgcagt

SEQ ID NO: 7299827 - DNA, 22 bp, Homo sapiens
cctggcaggtggcgccctcggc

SEQ ID NO: 7299828 - DNA, 22 bp, Homo sapiens
cctggcagtcaggggagtcctt

SEQ ID NO: 7299829 - DNA, 22 bp, Homo sapiens
cctggcagttcatcaaatggca

SEQ ID NO: 7299830 - DNA, 18 bp, Homo sapiens
tgtccatgttgttcctga

SEQ ID NO: 7299831 - DNA, 22 bp, Homo sapiens
tgtcctcatcctccagtctgtc

SEQ ID NO: 7299832 - DNA, 22 bp, Homo sapiens
cctctgtgctttgtccagcctc

SEQ ID NO: 7299833 - DNA, 21 bp, Homo sapiens
cctctgtgctaaagggctccc

SEQ ID NO: 7299834 - DNA, 22 bp, Homo sapiens
cctctgtgcctcagtttcatgt

SEQ ID NO: 7299835 - DNA, 22 bp, Homo sapiens
tggtccagtgacagataggcac

SEQ ID NO: 7299836 - DNA, 22 bp, Homo sapiens
tggtccctagcacagctgtcct

SEQ ID NO: 7299837 - DNA, 23 bp, Homo sapiens
tggtccctgagagctggggaggg

SEQ ID NO: 7299838 - DNA, 22 bp, Homo sapiens
tggtccctgagacctttgggag

SEQ ID NO: 7299839 - DNA, 22 bp, Homo sapiens
tggtccctagtgtgggagcttg

SEQ ID NO: 7299840 - DNA, 22 bp, Homo sapiens
tggtccctgatctaatgtctca

SEQ ID NO: 7299841 - DNA, 22 bp, Homo sapiens
tggtccctggatttctggaaca

SEQ ID NO: 7299842 - DNA, 21 bp, Homo sapiens
tggtccctttcagagtctgga

SEQ ID NO: 7299843 - DNA, 22 bp, Homo sapiens
tggtccctttctactgagcaca

SEQ ID NO: 7299844 - DNA, 23 bp, Homo sapiens
tggtcttgaactcctgtccctgc

SEQ ID NO: 7299845 - DNA, 22 bp, Homo sapiens
tggtcttgtactatgttgcatt

SEQ ID NO: 7299846 - DNA, 22 bp, Homo sapiens
cctgcccagagcccctttcact

SEQ ID NO: 7299847 - DNA, 22 bp, Homo sapiens
tggtcctagccagggctctgct

SEQ ID NO: 7299848 - DNA, 22 bp, Homo sapiens
tggtcctaaggagagttctgta

SEQ ID NO: 7299849 - DNA, 22 bp, Homo sapiens
tggtcctaggctggggaaggct

SEQ ID NO: 7299850 - DNA, 22 bp, Homo sapiens
tggtggccgaagccctctctca

SEQ ID NO: 7299851 - DNA, 22 bp, Homo sapiens
tggtgctgcctcagatgcctta

SEQ ID NO: 7299852 - DNA, 22 bp, Homo sapiens
tggtggctgtaagggagagaag

SEQ ID NO: 7299853 - DNA, 22 bp, Homo sapiens
tggtggcttctgaggatggcga

SEQ ID NO: 7299854 - DNA, 22 bp, Homo sapiens
cctggagacctgatggcagcgg

SEQ ID NO: 7299855 - DNA, 22 bp, Homo sapiens
cctggagagctcgggccaggca

SEQ ID NO: 7299856 - DNA, 22 bp, Homo sapiens
cctggactcaggctgtgggcac

SEQ ID NO: 7299857 - DNA, 22 bp, Homo sapiens
cctggagacccacttctgccaa

SEQ ID NO: 7299858 - DNA, 20 bp, Homo sapiens
tgtcatgcattagatgaaga

SEQ ID NO: 7299859 - DNA, 22 bp, Homo sapiens
tgtcatgccaccgtttcccaga

SEQ ID NO: 7299860 - DNA, 22 bp, Homo sapiens
tgtcatgtaacctttctgagcc

SEQ ID NO: 7299861 - DNA, 22 bp, Homo sapiens
tgtatgtttctaaatgattgct

SEQ ID NO: 7299862 - DNA, 22 bp, Homo sapiens
tgtattatgattgttgttcatg

SEQ ID NO: 7299863 - DNA, 22 bp, Homo sapiens
cctggcacatagtgggcatgca

SEQ ID NO: 7299864 - DNA, 22 bp, Homo sapiens
cctggcacatgatagatgctca

SEQ ID NO: 7299865 - DNA, 22 bp, Homo sapiens
cctggcagaatattaaagtgca

SEQ ID NO: 7299866 - DNA, 22 bp, Homo sapiens
cctggcagactgtgagggcagg

SEQ ID NO: 7299867 - DNA, 22 bp, Homo sapiens
tgtatgtatgcatcttttatgt

SEQ ID NO: 7299868 - DNA, 22 bp, Homo sapiens
tgtatgtgcttgagaaggtggg

SEQ ID NO: 7299869 - DNA, 17 bp, Homo sapiens
tgtatgtggatacacta

SEQ ID NO: 7299870 - DNA, 22 bp, Homo sapiens
tgtatgtatgtatgtatttggg

SEQ ID NO: 7299871 - DNA, 22 bp, Homo sapiens
tgtatgtattttgctaggctga

SEQ ID NO: 7299872 - DNA, 22 bp, Homo sapiens
tgtatgtctgtgaattcatatt

SEQ ID NO: 7299873 - DNA, 22 bp, Homo sapiens
tgtatgtgtggatagatgtata

SEQ ID NO: 7299874 - DNA, 22 bp, Homo sapiens
tgtatgtgtggatagatgtata

SEQ ID NO: 7299875 - DNA, 22 bp, Homo sapiens
tgtatgtgtatgtacatatgca

SEQ ID NO: 7299876 - DNA, 22 bp, Homo sapiens
tgtatgtggctacttttcttgc

SEQ ID NO: 7299877 - DNA, 22 bp, Homo sapiens
tgtatgtgtatgtacatatgca

SEQ ID NO: 7299878 - DNA, 22 bp, Homo sapiens
tgtataaaccatggacagcttt

SEQ ID NO: 7299879 - DNA, 22 bp, Homo sapiens
tgtataaaccatggacagcttt

SEQ ID NO: 7299880 - DNA, 22 bp, Homo sapiens
tgtagtgtgacataggtgtcca

SEQ ID NO: 7299881 - DNA, 22 bp, Homo sapiens
cctggagaggcgctgcagagga

SEQ ID NO: 7299882 - DNA, 22 bp, Homo sapiens
tgtaccactctactaagggttc

SEQ ID NO: 7299883 - DNA, 22 bp, Homo sapiens
gagaaaatcttgggtcaagaat

SEQ ID NO: 7299884 - DNA, 22 bp, Homo sapiens
gagaaaatcttgggtcaagaat

SEQ ID NO: 7299885 - DNA, 22 bp, Homo sapiens
gactttattatagtggcaatag

SEQ ID NO: 7299886 - DNA, 20 bp, Homo sapiens
gactttacatcagcactctt

SEQ ID NO: 7299887 - DNA, 22 bp, Homo sapiens
gagacacaggtggttcctgtca

SEQ ID NO: 7299888 - DNA, 22 bp, Homo sapiens
gagagctgtaatagtcatgtct

SEQ ID NO: 7299889 - DNA, 17 bp, Homo sapiens
gagagctgctgcttccg

SEQ ID NO: 7299890 - DNA, 22 bp, Homo sapiens
gagagctgaggggcctggcact

SEQ ID NO: 7299891 - DNA, 22 bp, Homo sapiens
gagagctgatagatgagctact

SEQ ID NO: 7299892 - DNA, 22 bp, Homo sapiens
gagacagagatcttgctgagtc

SEQ ID NO: 7299893 - DNA, 22 bp, Homo sapiens
gactggaaagcctgtcctcaga

SEQ ID NO: 7299894 - DNA, 22 bp, Homo sapiens
gactggaaagcctgtcctcaga

SEQ ID NO: 7299895 - DNA, 22 bp, Homo sapiens
gactggaaagcctgtcctcaga

SEQ ID NO: 7299896 - DNA, 22 bp, Homo sapiens
gactggaaagcctgtcctcaga

SEQ ID NO: 7299897 - DNA, 22 bp, Homo sapiens
gacccagggtttctgcacaggg

SEQ ID NO: 7299898 - DNA, 23 bp, Homo sapiens
gacttgtccctggcaattcatcc

SEQ ID NO: 7299899 - DNA, 22 bp, Homo sapiens
gacttaaaggctgaatgtagga

SEQ ID NO: 7299900 - DNA, 22 bp, Homo sapiens
gactgttacctatatttatgtg

SEQ ID NO: 7299901 - DNA, 22 bp, Homo sapiens
gacttctcccaaccatcagagg

SEQ ID NO: 7299902 - DNA, 22 bp, Homo sapiens
gacttcagatattttttaagtt

SEQ ID NO: 7299903 - DNA, 22 bp, Homo sapiens
gacccaggggtccatttctcct

SEQ ID NO: 7299904 - DNA, 22 bp, Homo sapiens
gacccaggcaatgaacttactt

SEQ ID NO: 7299905 - DNA, 22 bp, Homo sapiens
gacccaggaagctacttctggt

SEQ ID NO: 7299906 - DNA, 22 bp, Homo sapiens
gacccagcttaagtcacatgtt

SEQ ID NO: 7299907 - DNA, 22 bp, Homo sapiens
gacccagaaggagtgccctaga

SEQ ID NO: 7299908 - DNA, 22 bp, Homo sapiens
gacccagaggcctgacagtgtg

SEQ ID NO: 7299909 - DNA, 22 bp, Homo sapiens
gaccatttctaggaatcagact

SEQ ID NO: 7299910 - DNA, 22 bp, Homo sapiens
gacaggaggcagagctcaggtg

SEQ ID NO: 7299911 - DNA, 22 bp, Homo sapiens
gacaggccagacaggagactga

SEQ ID NO: 7299912 - DNA, 22 bp, Homo sapiens
gaccaggtccaaagctactgtc

SEQ ID NO: 7299913 - DNA, 20 bp, Homo sapiens
gacaggagagttaggtaggt

SEQ ID NO: 7299914 - DNA, 22 bp, Homo sapiens
gacagctgtgcaggagaagggg

SEQ ID NO: 7299915 - DNA, 22 bp, Homo sapiens
gacagctgtggagaggcatgtg

SEQ ID NO: 7299916 - DNA, 22 bp, Homo sapiens
gacagctgtgcaggagaagggg

SEQ ID NO: 7299917 - DNA, 22 bp, Homo sapiens
gacacaggggggcgctagaaga

SEQ ID NO: 7299918 - DNA, 22 bp, Homo sapiens
gacacagatgatcaggtgtgga

SEQ ID NO: 7299919 - DNA, 22 bp, Homo sapiens
gacacagctttctgaagagcat

SEQ ID NO: 7299920 - DNA, 22 bp, Homo sapiens
gacacagcttgatgagggcttt

SEQ ID NO: 7299921 - DNA, 22 bp, Homo sapiens
gacacagatgatcaggtgtgga

SEQ ID NO: 7299922 - DNA, 18 bp, Homo sapiens
gacacaggagagagtccc

SEQ ID NO: 7299923 - DNA, 22 bp, Homo sapiens
gaattgtatgctgtcttgatag

SEQ ID NO: 7299924 - DNA, 22 bp, Homo sapiens
gaatttaaatttaaatctacca

SEQ ID NO: 7299925 - DNA, 22 bp, Homo sapiens
gaatttaaggaccaagcatttt

SEQ ID NO: 7299926 - DNA, 22 bp, Homo sapiens
gaagttagttggggcccaagaa

SEQ ID NO: 7299927 - DNA, 22 bp, Homo sapiens
gaagttagtgtaatgcagggtg

SEQ ID NO: 7299928 - DNA, 22 bp, Homo sapiens
gaagttagtgtggatgcaggga

SEQ ID NO: 7299929 - DNA, 22 bp, Homo sapiens
gaagttagtcttgaagttagtc

SEQ ID NO: 7299930 - DNA, 18 bp, Homo sapiens
gaagttagtggtgtgcta

SEQ ID NO: 7299931 - DNA, 22 bp, Homo sapiens
gaagttaggctttcctatgctt

SEQ ID NO: 7299932 - DNA, 22 bp, Homo sapiens
gaagttagtacctggtatactt

SEQ ID NO: 7299933 - DNA, 22 bp, Homo sapiens
gaagttagtcattgaagcccca

SEQ ID NO: 7299934 - DNA, 22 bp, Homo sapiens
gaattacatagtttctaggttc

SEQ ID NO: 7299935 - DNA, 20 bp, Homo sapiens
gaattcctgcagcatttagt

SEQ ID NO: 7299936 - DNA, 22 bp, Homo sapiens
gaacttaacggcaactatttaa

SEQ ID NO: 7299937 - DNA, 22 bp, Homo sapiens
gaactgtttttaagtcctaaga

SEQ ID NO: 7299938 - DNA, 23 bp, Homo sapiens
gaactgttgatgaatagaatata

SEQ ID NO: 7299939 - DNA, 22 bp, Homo sapiens
gaactgttccctcacaggctgg

SEQ ID NO: 7299940 - DNA, 22 bp, Homo sapiens
gaaggaagctgtctggatgtgt

SEQ ID NO: 7299941 - DNA, 22 bp, Homo sapiens
gaaggaagctgtctggatgtgt

SEQ ID NO: 7299942 - DNA, 22 bp, Homo sapiens
gaacttagtagtctacttctta

SEQ ID NO: 7299943 - DNA, 22 bp, Homo sapiens
gaaggaagccgtttctctccag

SEQ ID NO: 7299944 - DNA, 22 bp, Homo sapiens
gaaggaagccgtttctctccag

SEQ ID NO: 7299945 - DNA, 22 bp, Homo sapiens
gaaggaagggctggctgtcttg

SEQ ID NO: 7299946 - DNA, 22 bp, Homo sapiens
gaaggaagggctggctgtcttg

SEQ ID NO: 7299947 - DNA, 22 bp, Homo sapiens
gaaggaaggaaaaatatattta

SEQ ID NO: 7299948 - DNA, 22 bp, Homo sapiens
gaaggaaggaaaaatatattta

SEQ ID NO: 7299949 - DNA, 22 bp, Homo sapiens
gaaggacccacgaagtcactgg

SEQ ID NO: 7299950 - DNA, 22 bp, Homo sapiens
gaaggaagtttattttagaaga

SEQ ID NO: 7299951 - DNA, 22 bp, Homo sapiens
gaaggaagtttattttagaaga

SEQ ID NO: 7299952 - DNA, 22 bp, Homo sapiens
gaaggaagtgctcatactagtt

SEQ ID NO: 7299953 - DNA, 22 bp, Homo sapiens
gaaggaagtgctcatactagtt

SEQ ID NO: 7299954 - DNA, 21 bp, Homo sapiens
gaaggagaaagcaagtgctgc

SEQ ID NO: 7299955 - DNA, 22 bp, Homo sapiens
gaaggaagtcattagtgcagac

SEQ ID NO: 7299956 - DNA, 22 bp, Homo sapiens
gaaggaagtcattagtgcagac

SEQ ID NO: 7299957 - DNA, 22 bp, Homo sapiens
gaaggaagtcattagtgcagac

SEQ ID NO: 7299958 - DNA, 20 bp, Homo sapiens
gaaggaagggggcaaggtga

SEQ ID NO: 7299959 - DNA, 20 bp, Homo sapiens
gaaggaagggggcaaggtga

SEQ ID NO: 7299960 - DNA, 20 bp, Homo sapiens
gaaggaagggggcaaggtga

SEQ ID NO: 7299961 - DNA, 20 bp, Homo sapiens
gaaggaagggggcaaggtga

SEQ ID NO: 7299962 - DNA, 22 bp, Homo sapiens
gaaggagaccctgaagatgctg

SEQ ID NO: 7299963 - DNA, 22 bp, Homo sapiens
gaaggagagaaaggcaattctg

SEQ ID NO: 7299964 - DNA, 22 bp, Homo sapiens
gaaggagaccctgaagatgctg

SEQ ID NO: 7299965 - DNA, 22 bp, Homo sapiens
gaaggagaggattgtgaggctg

SEQ ID NO: 7299966 - DNA, 22 bp, Homo sapiens
gaaggagagggtcaaggataat

SEQ ID NO: 7299967 - DNA, 22 bp, Homo sapiens
gaaggagagggtcaaggataat

SEQ ID NO: 7299968 - DNA, 22 bp, Homo sapiens
gaaggagagggtcaaggataat

SEQ ID NO: 7299969 - DNA, 22 bp, Homo sapiens
gaaggagagggtcaaggataat

SEQ ID NO: 7299970 - DNA, 22 bp, Homo sapiens
gaagttacaggcttatgggggc

SEQ ID NO: 7299971 - DNA, 22 bp, Homo sapiens
gaagttacccatagccggaatt

SEQ ID NO: 7299972 - DNA, 22 bp, Homo sapiens
gaagttaccgaacctctccatg

SEQ ID NO: 7299973 - DNA, 22 bp, Homo sapiens
gaagttacatactgtcacttct

SEQ ID NO: 7299974 - DNA, 22 bp, Homo sapiens
gaagttactttagaggaggctg

SEQ ID NO: 7299975 - DNA, 22 bp, Homo sapiens
gaagttagatgtggtcactgac

SEQ ID NO: 7299976 - DNA, 22 bp, Homo sapiens
gaagttacttctttgtgcctca

SEQ ID NO: 7299977 - DNA, 22 bp, Homo sapiens
gaagttacttgataaagaccga

SEQ ID NO: 7299978 - DNA, 22 bp, Homo sapiens
gaagttactctcgttaaatatg

SEQ ID NO: 7299979 - DNA, 20 bp, Homo sapiens
ctttatcaaagggctactag

SEQ ID NO: 7299980 - DNA, 19 bp, Homo sapiens
ctttgtcagaacatgcttc

SEQ ID NO: 7299981 - DNA, 22 bp, Homo sapiens
ctttgtcattttgtctctcagt

SEQ ID NO: 7299982 - DNA, 22 bp, Homo sapiens
ctttagatttctatgtatcact

SEQ ID NO: 7299983 - DNA, 22 bp, Homo sapiens
ctttagtttgtaagagcaagag

SEQ ID NO: 7299984 - DNA, 22 bp, Homo sapiens
ctttagtttgtgatacgaagat

SEQ ID NO: 7299985 - DNA, 22 bp, Homo sapiens
ctttagttgtctcctcaagggt

SEQ ID NO: 7299986 - DNA, 22 bp, Homo sapiens
ctttagttctagaaagtgaaac

SEQ ID NO: 7299987 - DNA, 22 bp, Homo sapiens
ctttagttgtatcagtcaagtt

SEQ ID NO: 7299988 - DNA, 22 bp, Homo sapiens
cttgggaatgctaacagatgac

SEQ ID NO: 7299989 - DNA, 22 bp, Homo sapiens
cttgaattgggggaagatcact

SEQ ID NO: 7299990 - DNA, 22 bp, Homo sapiens
cttggggaagccactgatccct

SEQ ID NO: 7299991 - DNA, 22 bp, Homo sapiens
cttggggaggacgcagtgtcct

SEQ ID NO: 7299992 - DNA, 22 bp, Homo sapiens
cttggggacacagagcccaggg

SEQ ID NO: 7299993 - DNA, 22 bp, Homo sapiens
cttggggatgcaaagccagtgt

SEQ ID NO: 7299994 - DNA, 22 bp, Homo sapiens
cttggggattttaaagacctct

SEQ ID NO: 7299995 - DNA, 22 bp, Homo sapiens
cttctctggcatagcaagcagg

SEQ ID NO: 7299996 - DNA, 17 bp, Homo sapiens
cttctctggcagaagat

SEQ ID NO: 7299997 - DNA, 23 bp, Homo sapiens
cttctctgagctaggaatgctct

SEQ ID NO: 7299998 - DNA, 22 bp, Homo sapiens
cttcttgaagtcctccagaagt

SEQ ID NO: 7299999 - DNA, 22 bp, Homo sapiens
cttctctgtgtagagattcaga

SEQ ID NO: 7300000 - DNA, 22 bp, Homo sapiens
cttctttgttctgttgtctcac

SEQ ID NO: 7300001 - DNA, 22 bp, Homo sapiens
cttctttgtgcctattggtgac

SEQ ID NO: 7300002 - DNA, 22 bp, Homo sapiens
cttgaaaataagaaagactttc

SEQ ID NO: 7300003 - DNA, 22 bp, Homo sapiens
cttgaaaataagaaagactttc

SEQ ID NO: 7300004 - DNA, 22 bp, Homo sapiens
ctggctggggtccatcctctaa

SEQ ID NO: 7300005 - DNA, 22 bp, Homo sapiens
ctggctggtcatgtcatgagcc

SEQ ID NO: 7300006 - DNA, 22 bp, Homo sapiens
cttctctcggtgcatccctcac

SEQ ID NO: 7300007 - DNA, 22 bp, Homo sapiens
cttctctccctggcactcagac

SEQ ID NO: 7300008 - DNA, 22 bp, Homo sapiens
gaaatttacaactttctcatgg

SEQ ID NO: 7300009 - DNA, 22 bp, Homo sapiens
gaacacagcagggataaccact

SEQ ID NO: 7300010 - DNA, 22 bp, Homo sapiens
gaaatacagaaagggctgaatg

SEQ ID NO: 7300011 - DNA, 22 bp, Homo sapiens
gaaatacaattttgtcccagct

SEQ ID NO: 7300012 - DNA, 22 bp, Homo sapiens
gaacacagtggttgtttggagg

SEQ ID NO: 7300013 - DNA, 22 bp, Homo sapiens
gaaagttttcatatataccaaa

SEQ ID NO: 7300014 - DNA, 22 bp, Homo sapiens
gaaataacagctctggaagagt

SEQ ID NO: 7300015 - DNA, 22 bp, Homo sapiens
gaaatacaaagccagccatttt

SEQ ID NO: 7300016 - DNA, 22 bp, Homo sapiens
gaaatacaaagccagccatttt

SEQ ID NO: 7300017 - DNA, 22 bp, Homo sapiens
gaaatacaaagccagccatttt

SEQ ID NO: 7300018 - DNA, 22 bp, Homo sapiens
gaaatacaaatgcctagatcct

SEQ ID NO: 7300019 - DNA, 22 bp, Homo sapiens
gaacactttaacattccttttc

SEQ ID NO: 7300020 - DNA, 22 bp, Homo sapiens
gaacacttggctttggatttaa

SEQ ID NO: 7300021 - DNA, 22 bp, Homo sapiens
gaacacttgctgttaataagtg

SEQ ID NO: 7300022 - DNA, 19 bp, Homo sapiens
gaacacttactatatttct

SEQ ID NO: 7300023 - DNA, 22 bp, Homo sapiens
gaactacaggtgcagcaagtga

SEQ ID NO: 7300024 - DNA, 22 bp, Homo sapiens
gaactacagtgcattttcttaa

SEQ ID NO: 7300025 - DNA, 22 bp, Homo sapiens
gaacgggtgcagccatgggccc

SEQ ID NO: 7300026 - DNA, 22 bp, Homo sapiens
gaactcaacacagtatttggta

SEQ ID NO: 7300027 - DNA, 22 bp, Homo sapiens
gaactcagagcctgagctagga

SEQ ID NO: 7300028 - DNA, 22 bp, Homo sapiens
gaaagggataccatgttacttg

SEQ ID NO: 7300029 - DNA, 22 bp, Homo sapiens
gaaagggcatgggcatgacaac

SEQ ID NO: 7300030 - DNA, 21 bp, Homo sapiens
gaaaggtcttaacttacagag

SEQ ID NO: 7300031 - DNA, 22 bp, Homo sapiens
gaaagttacagaaaccattagt

SEQ ID NO: 7300032 - DNA, 22 bp, Homo sapiens
gaaagggagtgaagatggtata

SEQ ID NO: 7300033 - DNA, 22 bp, Homo sapiens
gaaagggagtgaagatggtata

SEQ ID NO: 7300034 - DNA, 21 bp, Homo sapiens
gaaaatacaatgagcttgacc

SEQ ID NO: 7300035 - DNA, 22 bp, Homo sapiens
gaaaagttcatcatatattcag

SEQ ID NO: 7300036 - DNA, 22 bp, Homo sapiens
ctttgtgatagtgttaagacca

SEQ ID NO: 7300037 - DNA, 22 bp, Homo sapiens
ctttgtgctttgaatgatagct

SEQ ID NO: 7300038 - DNA, 22 bp, Homo sapiens
ctttgtgcgtagtgagtggtca

SEQ ID NO: 7300039 - DNA, 22 bp, Homo sapiens
ctttgtttatatttctcctcga

SEQ ID NO: 7300040 - DNA, 22 bp, Homo sapiens
ctttgttttactcagaggcatg

SEQ ID NO: 7300041 - DNA, 17 bp, Homo sapiens
cttttaatttacttccc

SEQ ID NO: 7300042 - DNA, 22 bp, Homo sapiens
cttttaatgagcattgctgtct

SEQ ID NO: 7300043 - DNA, 22 bp, Homo sapiens
cttttaagggataataagatgt

SEQ ID NO: 7300044 - DNA, 22 bp, Homo sapiens
cttttaagggataataagatgt

SEQ ID NO: 7300045 - DNA, 21 bp, Homo sapiens
gaaaagcaagggagtagaaca

SEQ ID NO: 7300046 - DNA, 22 bp, Homo sapiens
gaaaacatccagagatagacct

SEQ ID NO: 7300047 - DNA, 22 bp, Homo sapiens
gaaaacatccagagatagacct

SEQ ID NO: 7300048 - DNA, 22 bp, Homo sapiens
gaaaaggaaatttatagagatc

SEQ ID NO: 7300049 - DNA, 22 bp, Homo sapiens
gagtctggactattctggtctt

SEQ ID NO: 7300050 - DNA, 22 bp, Homo sapiens
gagtgcgtgtttggggatgtgg

SEQ ID NO: 7300051 - DNA, 21 bp, Homo sapiens
gagtggaacgctcttcacacc

SEQ ID NO: 7300052 - DNA, 22 bp, Homo sapiens
gagtggggctttaaaggctcag

SEQ ID NO: 7300053 - DNA, 22 bp, Homo sapiens
gagtgtgttctttatgctgtga

SEQ ID NO: 7300054 - DNA, 22 bp, Homo sapiens
gagtgtgttctttatgctgtga

SEQ ID NO: 7300055 - DNA, 22 bp, Homo sapiens
gagtgtgttattaaagatggaa

SEQ ID NO: 7300056 - DNA, 22 bp, Homo sapiens
gagtgttttactcaaagaaaga

SEQ ID NO: 7300057 - DNA, 22 bp, Homo sapiens
gagtgtgtcggtcagcgtggcg

SEQ ID NO: 7300058 - DNA, 22 bp, Homo sapiens
gagttaaaggaaaataacttta

SEQ ID NO: 7300059 - DNA, 22 bp, Homo sapiens
gagttaaaaatgcctccatgga

SEQ ID NO: 7300060 - DNA, 22 bp, Homo sapiens
gagtgtggatcccagaagcaga

SEQ ID NO: 7300061 - DNA, 22 bp, Homo sapiens
gagtggggggtccgtctcagtg

SEQ ID NO: 7300062 - DNA, 22 bp, Homo sapiens
gagtggggtctgggcatcagtc

SEQ ID NO: 7300063 - DNA, 22 bp, Homo sapiens
gagttctgtgattatttgggac

SEQ ID NO: 7300064 - DNA, 20 bp, Homo sapiens
gataaattgtctcttaagtg

SEQ ID NO: 7300065 - DNA, 22 bp, Homo sapiens
gatgattgttggctctcttgat

SEQ ID NO: 7300066 - DNA, 22 bp, Homo sapiens
gatgattttatgtcttgtcatt

SEQ ID NO: 7300067 - DNA, 22 bp, Homo sapiens
gatgcagggctggcaggagctt

SEQ ID NO: 7300068 - DNA, 22 bp, Homo sapiens
gatgacttatgtttacaaatgt

SEQ ID NO: 7300069 - DNA, 22 bp, Homo sapiens
gatgagctgtctagctgttgga

SEQ ID NO: 7300070 - DNA, 22 bp, Homo sapiens
gatgacaaaacttttgccagca

SEQ ID NO: 7300071 - DNA, 22 bp, Homo sapiens
gatctttggaatctgtgtatca

SEQ ID NO: 7300072 - DNA, 22 bp, Homo sapiens
gatctttgacacagtggattag

SEQ ID NO: 7300073 - DNA, 22 bp, Homo sapiens
gatctttgcaaactttgtcact

SEQ ID NO: 7300074 - DNA, 19 bp, Homo sapiens
gatctttgccaatttaagc

SEQ ID NO: 7300075 - DNA, 22 bp, Homo sapiens
gatgaaaaaagacgagcatata

SEQ ID NO: 7300076 - DNA, 22 bp, Homo sapiens
gatgaaaaaagacgagcatata

SEQ ID NO: 7300077 - DNA, 22 bp, Homo sapiens
gatgaaaatcttgagatgtcga

SEQ ID NO: 7300078 - DNA, 22 bp, Homo sapiens
gatgaaaatcttgagatgtcga

SEQ ID NO: 7300079 - DNA, 22 bp, Homo sapiens
gatgaaaaattgctgtgtcata

SEQ ID NO: 7300080 - DNA, 22 bp, Homo sapiens
gatctttaaggcttaccctgga

SEQ ID NO: 7300081 - DNA, 22 bp, Homo sapiens
gatctttactactgccttctct

SEQ ID NO: 7300082 - DNA, 22 bp, Homo sapiens
gatctgtccagaaagtgtgtac

SEQ ID NO: 7300083 - DNA, 22 bp, Homo sapiens
gatctgtgtgattggatgcatt

SEQ ID NO: 7300084 - DNA, 22 bp, Homo sapiens
gatctgttataatctcttttat

SEQ ID NO: 7300085 - DNA, 22 bp, Homo sapiens
gatctgggctggagactgagaa

SEQ ID NO: 7300086 - DNA, 22 bp, Homo sapiens
gatccacagggccctggcccag

SEQ ID NO: 7300087 - DNA, 22 bp, Homo sapiens
gatccacagtttgatgatcata

SEQ ID NO: 7300088 - DNA, 22 bp, Homo sapiens
gatccctgccctcagcctggac

SEQ ID NO: 7300089 - DNA, 22 bp, Homo sapiens
gatccacagcccgcttgggccc

SEQ ID NO: 7300090 - DNA, 22 bp, Homo sapiens
gatccacagctgcggtaggaga

SEQ ID NO: 7300091 - DNA, 22 bp, Homo sapiens
gatccacaggaaccaaaacgca

SEQ ID NO: 7300092 - DNA, 22 bp, Homo sapiens
gatacacacccttgataggact

SEQ ID NO: 7300093 - DNA, 22 bp, Homo sapiens
gatacacacccttgataggact

SEQ ID NO: 7300094 - DNA, 20 bp, Homo sapiens
gatacacagcacagagggcc

SEQ ID NO: 7300095 - DNA, 20 bp, Homo sapiens
gatacacagcacagagggcc

SEQ ID NO: 7300096 - DNA, 22 bp, Homo sapiens
gatacacatgcatgtgcatgta

SEQ ID NO: 7300097 - DNA, 15 bp, Homo sapiens
gatacacatgactgg

SEQ ID NO: 7300098 - DNA, 15 bp, Homo sapiens
gatacacatgactgg

SEQ ID NO: 7300099 - DNA, 22 bp, Homo sapiens
gatacacatgcatgtgcatgta

SEQ ID NO: 7300100 - DNA, 20 bp, Homo sapiens
gatacacagcttcactgttg

SEQ ID NO: 7300101 - DNA, 20 bp, Homo sapiens
gatacacagcttcactgttg

SEQ ID NO: 7300102 - DNA, 22 bp, Homo sapiens
gatacacagggctaagatggat

SEQ ID NO: 7300103 - DNA, 22 bp, Homo sapiens
gatacacagggctaagatggat

SEQ ID NO: 7300104 - DNA, 22 bp, Homo sapiens
gataatatctggtttattcacc

SEQ ID NO: 7300105 - DNA, 21 bp, Homo sapiens
gatacagagggccactgattg

SEQ ID NO: 7300106 - DNA, 22 bp, Homo sapiens
gatacagtatttaaagagcaac

SEQ ID NO: 7300107 - DNA, 22 bp, Homo sapiens
gatacacattttagctttgtct

SEQ ID NO: 7300108 - DNA, 22 bp, Homo sapiens
gatacacattttagctttgtct

SEQ ID NO: 7300109 - DNA, 22 bp, Homo sapiens
gatacagtgtgttaacgagaaa

SEQ ID NO: 7300110 - DNA, 22 bp, Homo sapiens
gatacattgagggtggaggacc

SEQ ID NO: 7300111 - DNA, 22 bp, Homo sapiens
gatactcatttcagtgctttac

SEQ ID NO: 7300112 - DNA, 22 bp, Homo sapiens
gatactgtgtcattctcacatg

SEQ ID NO: 7300113 - DNA, 22 bp, Homo sapiens
gatatacaatccacagttgatt

SEQ ID NO: 7300114 - DNA, 22 bp, Homo sapiens
gatatacagagcattctttgat

SEQ ID NO: 7300115 - DNA, 22 bp, Homo sapiens
gatatttacattaagcacattg

SEQ ID NO: 7300116 - DNA, 22 bp, Homo sapiens
gatatatgtaaaagtagacaga

SEQ ID NO: 7300117 - DNA, 22 bp, Homo sapiens
gatatacataggtttctatgca

SEQ ID NO: 7300118 - DNA, 18 bp, Homo sapiens
gatatataggaggaaagt

SEQ ID NO: 7300119 - DNA, 22 bp, Homo sapiens
gatatttttagtatttctgcct

SEQ ID NO: 7300120 - DNA, 22 bp, Homo sapiens
gatattttcattcggatgctca

SEQ ID NO: 7300121 - DNA, 22 bp, Homo sapiens
gatattttcgcagggagaattc

SEQ ID NO: 7300122 - DNA, 22 bp, Homo sapiens
gatattttcagtctcctttcaa

SEQ ID NO: 7300123 - DNA, 22 bp, Homo sapiens
gatcatcatctttcaggcaagt

SEQ ID NO: 7300124 - DNA, 22 bp, Homo sapiens
gatcatcaagcaagaacctgat

SEQ ID NO: 7300125 - DNA, 22 bp, Homo sapiens
gatcagtttaatcttcaggggt

SEQ ID NO: 7300126 - DNA, 22 bp, Homo sapiens
gatcatagcgtcttcttgcagc

SEQ ID NO: 7300127 - DNA, 22 bp, Homo sapiens
gatcactacagggtgggtgggg

SEQ ID NO: 7300128 - DNA, 22 bp, Homo sapiens
gatcacataatttggaaacagc

SEQ ID NO: 7300129 - DNA, 22 bp, Homo sapiens
gatcaacaaatgtcctttgtga

SEQ ID NO: 7300130 - DNA, 22 bp, Homo sapiens
gatcaacaacttttgaatagct

SEQ ID NO: 7300131 - DNA, 22 bp, Homo sapiens
gaggggcagaatgtgatcaggg

SEQ ID NO: 7300132 - DNA, 22 bp, Homo sapiens
gaggggcagaggtagagaacaa

SEQ ID NO: 7300133 - DNA, 22 bp, Homo sapiens
gaggggcagaatgtgatcaggg

SEQ ID NO: 7300134 - DNA, 22 bp, Homo sapiens
gaggggcagaatgtgatcaggg

SEQ ID NO: 7300135 - DNA, 22 bp, Homo sapiens
gaggggagtgtcctccgggccc

SEQ ID NO: 7300136 - DNA, 22 bp, Homo sapiens
gagggcaggggtcttgcacggt

SEQ ID NO: 7300137 - DNA, 22 bp, Homo sapiens
gagggcagtagcctcgtaccct

SEQ ID NO: 7300138 - DNA, 22 bp, Homo sapiens
gagggcagtagcctcgtaccct

SEQ ID NO: 7300139 - DNA, 22 bp, Homo sapiens
gagggcagagtctaatgatgca

SEQ ID NO: 7300140 - DNA, 20 bp, Homo sapiens
gagggcaggcacccatttca

SEQ ID NO: 7300141 - DNA, 22 bp, Homo sapiens
gagggcatagttaaataggagg

SEQ ID NO: 7300142 - DNA, 22 bp, Homo sapiens
gagggcagtgaattttgaagct

SEQ ID NO: 7300143 - DNA, 22 bp, Homo sapiens
gaggggaaagtgtgaggctgcg

SEQ ID NO: 7300144 - DNA, 22 bp, Homo sapiens
gagggccaatgtgtccctgagc

SEQ ID NO: 7300145 - DNA, 22 bp, Homo sapiens
gagggcagagacagtgattcac

SEQ ID NO: 7300146 - DNA, 16 bp, Homo sapiens
gagggcagaggcggaa

SEQ ID NO: 7300147 - DNA, 22 bp, Homo sapiens
gaggctggacgtgcatttctac

SEQ ID NO: 7300148 - DNA, 22 bp, Homo sapiens
gaggcctgctttggcactctgg

SEQ ID NO: 7300149 - DNA, 20 bp, Homo sapiens
gagtcacagaagaagctgaa

SEQ ID NO: 7300150 - DNA, 22 bp, Homo sapiens
gagtcactagtgaagttggtgc

SEQ ID NO: 7300151 - DNA, 22 bp, Homo sapiens
gagtcactgaggagggtactca

SEQ ID NO: 7300152 - DNA, 22 bp, Homo sapiens
gaggtcatctgttttggttact

SEQ ID NO: 7300153 - DNA, 21 bp, Homo sapiens
gaggcctcagcctcagctcct

SEQ ID NO: 7300154 - DNA, 22 bp, Homo sapiens
gaggcctgaggctgcctggagc

SEQ ID NO: 7300155 - DNA, 22 bp, Homo sapiens
gaggagggttggccttaggtag

SEQ ID NO: 7300156 - DNA, 22 bp, Homo sapiens
gaggagggagctggaagctctt

SEQ ID NO: 7300157 - DNA, 22 bp, Homo sapiens
gaggagggagaattaggcttaa

SEQ ID NO: 7300158 - DNA, 23 bp, Homo sapiens
gaggagggtctgacaagtgtagc

SEQ ID NO: 7300159 - DNA, 22 bp, Homo sapiens
gaggaggctgtttctctgcatt

SEQ ID NO: 7300160 - DNA, 22 bp, Homo sapiens
gaggaagtctctctacaagaaa

SEQ ID NO: 7300161 - DNA, 22 bp, Homo sapiens
gaggaagatggttgagtggtcc

SEQ ID NO: 7300162 - DNA, 23 bp, Homo sapiens
gagctgggatacaggcttactgc

SEQ ID NO: 7300163 - DNA, 22 bp, Homo sapiens
gaggaagatggttgagtggtcc

SEQ ID NO: 7300164 - DNA, 22 bp, Homo sapiens
gaggaagagcatggccagtttc

SEQ ID NO: 7300165 - DNA, 22 bp, Homo sapiens
gaggaagagcatggccagtttc

SEQ ID NO: 7300166 - DNA, 22 bp, Homo sapiens
gaggaagagagctctgccttgt

SEQ ID NO: 7300167 - DNA, 22 bp, Homo sapiens
gaggaagagagctctgccttgt

SEQ ID NO: 7300168 - DNA, 22 bp, Homo sapiens
gaggaagagagctctgccttgt

SEQ ID NO: 7300169 - DNA, 22 bp, Homo sapiens
gagctgggagctgggatttgga

SEQ ID NO: 7300170 - DNA, 22 bp, Homo sapiens
gagctgggagttatagcatgtt

SEQ ID NO: 7300171 - DNA, 22 bp, Homo sapiens
gagctggactttcagatacatc

SEQ ID NO: 7300172 - DNA, 22 bp, Homo sapiens
gagctgggacatgggtcctctc

SEQ ID NO: 7300173 - DNA, 22 bp, Homo sapiens
gagctgggaagatagcttgagc

SEQ ID NO: 7300174 - DNA, 22 bp, Homo sapiens
gagagtgcgattcattcattta

SEQ ID NO: 7300175 - DNA, 20 bp, Homo sapiens
gagagtgcttttcattgctc

SEQ ID NO: 7300176 - DNA, 22 bp, Homo sapiens
gagataaatttttgataaatat

SEQ ID NO: 7300177 - DNA, 22 bp, Homo sapiens
gagataaatttttgataaatat

SEQ ID NO: 7300178 - DNA, 22 bp, Homo sapiens
gagataaagctaccatgttgat

SEQ ID NO: 7300179 - DNA, 22 bp, Homo sapiens
gattgagtctgaggatgctgca

SEQ ID NO: 7300180 - DNA, 22 bp, Homo sapiens
gattggagagtggaacatgctg

SEQ ID NO: 7300181 - DNA, 22 bp, Homo sapiens
gattgcttgatacccagtcaat

SEQ ID NO: 7300182 - DNA, 22 bp, Homo sapiens
gattgtaaaacagatcattatc

SEQ ID NO: 7300183 - DNA, 22 bp, Homo sapiens
gattgtgtctcactgtgatgct

SEQ ID NO: 7300184 - DNA, 22 bp, Homo sapiens
gatttattggtctttcattggt

SEQ ID NO: 7300185 - DNA, 22 bp, Homo sapiens
gatttatagtatgtgctttcag

SEQ ID NO: 7300186 - DNA, 22 bp, Homo sapiens
gatttatttttaatcagcaggg

SEQ ID NO: 7300187 - DNA, 22 bp, Homo sapiens
gatttataaaggttgcactgga

SEQ ID NO: 7300188 - DNA, 22 bp, Homo sapiens
gatgtgtgtgccctgggcctgc

SEQ ID NO: 7300189 - DNA, 22 bp, Homo sapiens
gatgtgtgtttatacatatatt

SEQ ID NO: 7300190 - DNA, 22 bp, Homo sapiens
gatgtttatatctaacttaagt

SEQ ID NO: 7300191 - DNA, 22 bp, Homo sapiens
gatgtttggctcaaacgagtgt

SEQ ID NO: 7300192 - DNA, 22 bp, Homo sapiens
gatgtttctgggaaggaaaagt

SEQ ID NO: 7300193 - DNA, 22 bp, Homo sapiens
gatgtttcccgttaagagaaaa

SEQ ID NO: 7300194 - DNA, 22 bp, Homo sapiens
gattaagattacatatttaagt

SEQ ID NO: 7300195 - DNA, 22 bp, Homo sapiens
gattaacatttctaagatgcca

SEQ ID NO: 7300196 - DNA, 22 bp, Homo sapiens
gattaagagaagtttcttatcg

SEQ ID NO: 7300197 - DNA, 22 bp, Homo sapiens
gattaacaaatttcatatccaa

SEQ ID NO: 7300198 - DNA, 22 bp, Homo sapiens
gattaacagcccctgattgctg

SEQ ID NO: 7300199 - DNA, 22 bp, Homo sapiens
gattctttacatctctgctgac

SEQ ID NO: 7300200 - DNA, 22 bp, Homo sapiens
gattcactcatattttacgttt

SEQ ID NO: 7300201 - DNA, 22 bp, Homo sapiens
gatgcgggcccgctccactgcc

SEQ ID NO: 7300202 - DNA, 22 bp, Homo sapiens
gatgccctgcatgagtcctgct

SEQ ID NO: 7300203 - DNA, 22 bp, Homo sapiens
gatgtgtgcttttcgcagtgtc

SEQ ID NO: 7300204 - DNA, 22 bp, Homo sapiens
gatgtgtgctgcatagtatatt

SEQ ID NO: 7300205 - DNA, 22 bp, Homo sapiens
gatgtgtgcttttcgcagtgtc

SEQ ID NO: 7300206 - DNA, 22 bp, Homo sapiens
gatgtataacctggctatgtta

SEQ ID NO: 7300207 - DNA, 22 bp, Homo sapiens
gatgtacatggattcctttcct

SEQ ID NO: 7300208 - DNA, 22 bp, Homo sapiens
gatgtcctttgagggtatctgt

SEQ ID NO: 7300209 - DNA, 22 bp, Homo sapiens
gatgtcctatttccatactgta

SEQ ID NO: 7300210 - DNA, 17 bp, Homo sapiens
gatgtcctctggactac

SEQ ID NO: 7300211 - DNA, 22 bp, Homo sapiens
gatgtatattctgtgccaggat

SEQ ID NO: 7300212 - DNA, 22 bp, Homo sapiens
gatgtatagtatgtaatttctg

SEQ ID NO: 7300213 - DNA, 22 bp, Homo sapiens
gatgtatatacctggtgtggaa

SEQ ID NO: 7300214 - DNA, 23 bp, Homo sapiens
gatgtatatatgagccgtcacat

SEQ ID NO: 7300215 - DNA, 22 bp, Homo sapiens
gatgtatacagggttgactcat

SEQ ID NO: 7300216 - DNA, 22 bp, Homo sapiens
gatgtatacttttctttctctg

SEQ ID NO: 7300217 - DNA, 22 bp, Homo sapiens
gatggtcatctcctatttggtt

SEQ ID NO: 7300218 - DNA, 22 bp, Homo sapiens
gatggtgtcccaggctcaggct

SEQ ID NO: 7300219 - DNA, 22 bp, Homo sapiens
gatgtacaagtaaaatatgtgt

SEQ ID NO: 7300220 - DNA, 22 bp, Homo sapiens
gcagagcagtgcttgcccagcg

SEQ ID NO: 7300221 - DNA, 22 bp, Homo sapiens
gcagaacaacgtaggagtggag

SEQ ID NO: 7300222 - DNA, 22 bp, Homo sapiens
gcagaagctgggagaagggatt

SEQ ID NO: 7300223 - DNA, 22 bp, Homo sapiens
gcagaagaccatggtggaaaga

SEQ ID NO: 7300224 - DNA, 22 bp, Homo sapiens
gattttatagtcaggaaaaaga

SEQ ID NO: 7300225 - DNA, 22 bp, Homo sapiens
gattttatatggcatactgtgg

SEQ ID NO: 7300226 - DNA, 22 bp, Homo sapiens
gattttatagtcaggaaaaaga

SEQ ID NO: 7300227 - DNA, 22 bp, Homo sapiens
gatttgtttcaagttagcatct

SEQ ID NO: 7300228 - DNA, 22 bp, Homo sapiens
gattttaattataggaggtcct

SEQ ID NO: 7300229 - DNA, 21 bp, Homo sapiens
gattttaaagagactgccaca

SEQ ID NO: 7300230 - DNA, 22 bp, Homo sapiens
gattttattagcccaaactttg

SEQ ID NO: 7300231 - DNA, 22 bp, Homo sapiens
gattttatctttgtgtgcagta

SEQ ID NO: 7300232 - DNA, 22 bp, Homo sapiens
gattttatcgtcatccttctgg

SEQ ID NO: 7300233 - DNA, 22 bp, Homo sapiens
gattttatctttgtgtgcagta

SEQ ID NO: 7300234 - DNA, 22 bp, Homo sapiens
gatttgtagcttttcagtctgt

SEQ ID NO: 7300235 - DNA, 22 bp, Homo sapiens
gatttcttgataattcaaatcc

SEQ ID NO: 7300236 - DNA, 20 bp, Homo sapiens
gcaattaatttttggttaca

SEQ ID NO: 7300237 - DNA, 22 bp, Homo sapiens
gcacaaagatgaatacagaatg

SEQ ID NO: 7300238 - DNA, 22 bp, Homo sapiens
gcaattgctttagggaaaggta

SEQ ID NO: 7300239 - DNA, 22 bp, Homo sapiens
gcaatagattatgatctacagt

SEQ ID NO: 7300240 - DNA, 22 bp, Homo sapiens
gcaatataaccagttgtcatgc

SEQ ID NO: 7300241 - DNA, 22 bp, Homo sapiens
gatttttatataaagtgagaaa

SEQ ID NO: 7300242 - DNA, 21 bp, Homo sapiens
gcaggggatagaaatggtctg

SEQ ID NO: 7300243 - DNA, 22 bp, Homo sapiens
gcagggtgacgttgcccacctc

SEQ ID NO: 7300244 - DNA, 22 bp, Homo sapiens
gcaggacctctggatgcaatgc

SEQ ID NO: 7300245 - DNA, 22 bp, Homo sapiens
gcaggaccaggcacgagggcca

SEQ ID NO: 7300246 - DNA, 22 bp, Homo sapiens
gcaggacctggcagatggggca

SEQ ID NO: 7300247 - DNA, 22 bp, Homo sapiens
gcaggagaacaaagcaagctgc

SEQ ID NO: 7300248 - DNA, 22 bp, Homo sapiens
gcagcctctgcagttcaggagg

SEQ ID NO: 7300249 - DNA, 22 bp, Homo sapiens
gcagagcctgacgggatttttc

SEQ ID NO: 7300250 - DNA, 22 bp, Homo sapiens
gcagagccttgcgtcatgtgcc

SEQ ID NO: 7300251 - DNA, 18 bp, Homo sapiens
gcagctgacactggagtt

SEQ ID NO: 7300252 - DNA, 18 bp, Homo sapiens
gcagctgacactggagtt

SEQ ID NO: 7300253 - DNA, 22 bp, Homo sapiens
gcagctcctcctgggctggaga

SEQ ID NO: 7300254 - DNA, 22 bp, Homo sapiens
gccacagcttagatcacagcct

SEQ ID NO: 7300255 - DNA, 22 bp, Homo sapiens
gccacaggaaagcaccctggag

SEQ ID NO: 7300256 - DNA, 22 bp, Homo sapiens
gccacagctcacgttccccatt

SEQ ID NO: 7300257 - DNA, 22 bp, Homo sapiens
gccacagctccagtcaggtgac

SEQ ID NO: 7300258 - DNA, 22 bp, Homo sapiens
gccacagcttagatcacagcct

SEQ ID NO: 7300259 - DNA, 22 bp, Homo sapiens
gccacaggctccagcatcagta

SEQ ID NO: 7300260 - DNA, 22 bp, Homo sapiens
gccacaggctccagcatcagta

SEQ ID NO: 7300261 - DNA, 19 bp, Homo sapiens
gccagcagaatgatgaggc

SEQ ID NO: 7300262 - DNA, 22 bp, Homo sapiens
gccagcagccacagaagtcact

SEQ ID NO: 7300263 - DNA, 22 bp, Homo sapiens
gccagcagctcttgggcgggca

SEQ ID NO: 7300264 - DNA, 22 bp, Homo sapiens
gccagcagctgtggggtggcca

SEQ ID NO: 7300265 - DNA, 22 bp, Homo sapiens
gccagcagcttcttctcatcct

SEQ ID NO: 7300266 - DNA, 22 bp, Homo sapiens
gccacagcagggccctctcagg

SEQ ID NO: 7300267 - DNA, 22 bp, Homo sapiens
gccacagcccgagcaccatgag

SEQ ID NO: 7300268 - DNA, 22 bp, Homo sapiens
gccacagacagagagtctagtg

SEQ ID NO: 7300269 - DNA, 22 bp, Homo sapiens
gcatgtgttattttatgtatga

SEQ ID NO: 7300270 - DNA, 22 bp, Homo sapiens
gcatgttttgcaacaagtgacc

SEQ ID NO: 7300271 - DNA, 22 bp, Homo sapiens
gcatgtgttagagtgtgcatgc

SEQ ID NO: 7300272 - DNA, 22 bp, Homo sapiens
gcatgtgttatttctctgtggg

SEQ ID NO: 7300273 - DNA, 22 bp, Homo sapiens
gcatgtgttagagtgtgcatgc

SEQ ID NO: 7300274 - DNA, 22 bp, Homo sapiens
gcatgtgttatttctctgtggg

SEQ ID NO: 7300275 - DNA, 22 bp, Homo sapiens
gcatgtgttattttatgtatga

SEQ ID NO: 7300276 - DNA, 22 bp, Homo sapiens
gccaatctttgactatatgtgt

SEQ ID NO: 7300277 - DNA, 22 bp, Homo sapiens
gcatgggtaccccttctgtgca

SEQ ID NO: 7300278 - DNA, 22 bp, Homo sapiens
gcatgtgtggaggagatgtgct

SEQ ID NO: 7300279 - DNA, 22 bp, Homo sapiens
gcatgtgtccctcagtctgtgc

SEQ ID NO: 7300280 - DNA, 21 bp, Homo sapiens
gcatgtgtgggactggatcct

SEQ ID NO: 7300281 - DNA, 22 bp, Homo sapiens
gcatgtgtccctcagtctgtgc

SEQ ID NO: 7300282 - DNA, 22 bp, Homo sapiens
gcagtgggcaacaagagctgga

SEQ ID NO: 7300283 - DNA, 22 bp, Homo sapiens
gcagtggggaatgctggggaga

SEQ ID NO: 7300284 - DNA, 22 bp, Homo sapiens
gcagtggggaatgctggggaga

SEQ ID NO: 7300285 - DNA, 23 bp, Homo sapiens
gcagtgtgaatccagtgtttcag

SEQ ID NO: 7300286 - DNA, 22 bp, Homo sapiens
gcagtgtccagggtggtctgca

SEQ ID NO: 7300287 - DNA, 19 bp, Homo sapiens
gcagggtggcagagctctt

SEQ ID NO: 7300288 - DNA, 22 bp, Homo sapiens
gcagggtggatggcagggccag

SEQ ID NO: 7300289 - DNA, 22 bp, Homo sapiens
gcagggtgatagtgaggctcag

SEQ ID NO: 7300290 - DNA, 22 bp, Homo sapiens
gccgggaccaaggccacggagc

SEQ ID NO: 7300291 - DNA, 22 bp, Homo sapiens
gccgggttcaagccattctcct

SEQ ID NO: 7300292 - DNA, 22 bp, Homo sapiens
gccgtgggtgtcatggcccata

SEQ ID NO: 7300293 - DNA, 22 bp, Homo sapiens
gcctcctgtcccaggctgagga

SEQ ID NO: 7300294 - DNA, 22 bp, Homo sapiens
gcctcctgttatgccatgtgcc

SEQ ID NO: 7300295 - DNA, 22 bp, Homo sapiens
gcccttggaacagcctcctgct

SEQ ID NO: 7300296 - DNA, 22 bp, Homo sapiens
gccctcagtgaccactgattca

SEQ ID NO: 7300297 - DNA, 22 bp, Homo sapiens
gccctcagcatcctcagggcca

SEQ ID NO: 7300298 - DNA, 22 bp, Homo sapiens
gcccaggctggagtgcagtggt

SEQ ID NO: 7300299 - DNA, 22 bp, Homo sapiens
gccagtgtgcaagaggccacca

SEQ ID NO: 7300300 - DNA, 19 bp, Homo sapiens
gccagtgtgtggtacagtg

SEQ ID NO: 7300301 - DNA, 22 bp, Homo sapiens
gccataatagagtgtgaggaat

SEQ ID NO: 7300302 - DNA, 22 bp, Homo sapiens
gccagtgtttatagcagtgagg

SEQ ID NO: 7300303 - DNA, 22 bp, Homo sapiens
gccaggctgtggggaacttgaa

SEQ ID NO: 7300304 - DNA, 22 bp, Homo sapiens
gccaggctgtttttattactgt

SEQ ID NO: 7300305 - DNA, 22 bp, Homo sapiens
gccagtggtcagtgggagggtg

SEQ ID NO: 7300306 - DNA, 22 bp, Homo sapiens
gccaggctctcagtgactgccc

SEQ ID NO: 7300307 - DNA, 19 bp, Homo sapiens
gccaggctcttattctgtg

SEQ ID NO: 7300308 - DNA, 22 bp, Homo sapiens
gccaggctcttccatttgggtc

SEQ ID NO: 7300309 - DNA, 22 bp, Homo sapiens
gccaggctcttggttatgtttt

SEQ ID NO: 7300310 - DNA, 22 bp, Homo sapiens
gccaggctgaggctctggaaga

SEQ ID NO: 7300311 - DNA, 22 bp, Homo sapiens
gccaggctgactcccccggcct

SEQ ID NO: 7300312 - DNA, 22 bp, Homo sapiens
gccaggctgccttatctctagc

SEQ ID NO: 7300313 - DNA, 22 bp, Homo sapiens
gccaggctgctccagggaggcc

SEQ ID NO: 7300314 - DNA, 22 bp, Homo sapiens
gccaggctggtgtcacaactct

SEQ ID NO: 7300315 - DNA, 22 bp, Homo sapiens
gccaggctggttatttaatgag

SEQ ID NO: 7300316 - DNA, 22 bp, Homo sapiens
gccatcatatcccctgtgacct

SEQ ID NO: 7300317 - DNA, 23 bp, Homo sapiens
gccatggctgccccacaggcctc

SEQ ID NO: 7300318 - DNA, 18 bp, Homo sapiens
gccatgttctatgcttac

SEQ ID NO: 7300319 - DNA, 20 bp, Homo sapiens
gcccaggatctctgaggcat

SEQ ID NO: 7300320 - DNA, 22 bp, Homo sapiens
gcccaggctggagtgcagtggc

SEQ ID NO: 7300321 - DNA, 21 bp, Homo sapiens
gcctgtgtaaattgagtttcc

SEQ ID NO: 7300322 - DNA, 21 bp, Homo sapiens
gcctgtgtaaattgagtttcc

SEQ ID NO: 7300323 - DNA, 20 bp, Homo sapiens
gcctgttcacaggcttcttg

SEQ ID NO: 7300324 - DNA, 18 bp, Homo sapiens
gcctgttccctactatcc

SEQ ID NO: 7300325 - DNA, 22 bp, Homo sapiens
gcctgttccttagtggcttcac

SEQ ID NO: 7300326 - DNA, 22 bp, Homo sapiens
gcctggggaacttgatcctgtc

SEQ ID NO: 7300327 - DNA, 19 bp, Homo sapiens
gcctgggatgggcagaact

SEQ ID NO: 7300328 - DNA, 23 bp, Homo sapiens
gcctgggactcaggaggagctca

SEQ ID NO: 7300329 - DNA, 22 bp, Homo sapiens
gcctggccgctccgagctccgc

SEQ ID NO: 7300330 - DNA, 23 bp, Homo sapiens
gcctggccaccccagggctgctt

SEQ ID NO: 7300331 - DNA, 22 bp, Homo sapiens
gcctggagggatagaatgcaag

SEQ ID NO: 7300332 - DNA, 22 bp, Homo sapiens
gcctgccttttggaggcacatt

SEQ ID NO: 7300333 - DNA, 23 bp, Homo sapiens
gcctgctggtcacctaatctgcc

SEQ ID NO: 7300334 - DNA, 22 bp, Homo sapiens
gcctgctgttgagggaagagct

SEQ ID NO: 7300335 - DNA, 22 bp, Homo sapiens
gcctggaagacgtcttggcttc

SEQ ID NO: 7300336 - DNA, 20 bp, Homo sapiens
gcctgcctcagctagctgag

SEQ ID NO: 7300337 - DNA, 23 bp, Homo sapiens
gcctgcctgacctgtgcaaagtc

SEQ ID NO: 7300338 - DNA, 20 bp, Homo sapiens
gcctctggagccaaggacca

SEQ ID NO: 7300339 - DNA, 22 bp, Homo sapiens
gcctgccacgcatgcagagtca

SEQ ID NO: 7300340 - DNA, 18 bp, Homo sapiens
gcctgccaactcctgatc

SEQ ID NO: 7300341 - DNA, 22 bp, Homo sapiens
gcctgccaaaagaagctgctgg

SEQ ID NO: 7300342 - DNA, 22 bp, Homo sapiens
gcctgcctttgtatgaccctga

SEQ ID NO: 7300343 - DNA, 22 bp, Homo sapiens
gctgaggatatagcaggaacaa

SEQ ID NO: 7300344 - DNA, 22 bp, Homo sapiens
gctgcctgaatgaaccttgttc

SEQ ID NO: 7300345 - DNA, 22 bp, Homo sapiens
gctgcctgatcatacaccaggg

SEQ ID NO: 7300346 - DNA, 22 bp, Homo sapiens
gctgcctggctgatgaaaattc

SEQ ID NO: 7300347 - DNA, 22 bp, Homo sapiens
gctgcctggatttgcaatcctc

SEQ ID NO: 7300348 - DNA, 22 bp, Homo sapiens
gctgcctgggcaggaggcgctg

SEQ ID NO: 7300349 - DNA, 22 bp, Homo sapiens
gctgcctggctttagtccactt

SEQ ID NO: 7300350 - DNA, 22 bp, Homo sapiens
gctgcctggagaggcagggatg

SEQ ID NO: 7300351 - DNA, 22 bp, Homo sapiens
gctgcctggagctcagcctgcc

SEQ ID NO: 7300352 - DNA, 22 bp, Homo sapiens
gctgcctgctcggctcctggga

SEQ ID NO: 7300353 - DNA, 22 bp, Homo sapiens
gctgcctggaataacggctggc

SEQ ID NO: 7300354 - DNA, 22 bp, Homo sapiens
gctgcctgcttcatgtgggaga

SEQ ID NO: 7300355 - DNA, 22 bp, Homo sapiens
gctgcctgctcacccggcctgg

SEQ ID NO: 7300356 - DNA, 22 bp, Homo sapiens
gctgcctgctcacccggcctgg

SEQ ID NO: 7300357 - DNA, 22 bp, Homo sapiens
gctgcctgatgtccagcaggac

SEQ ID NO: 7300358 - DNA, 22 bp, Homo sapiens
gctgctctacccatgcatctgt

SEQ ID NO: 7300359 - DNA, 22 bp, Homo sapiens
gctgcctgtcccaggatgagga

SEQ ID NO: 7300360 - DNA, 22 bp, Homo sapiens
gctgcctgggctggcattccca

SEQ ID NO: 7300361 - DNA, 22 bp, Homo sapiens
gctgcctggtttctcagctgca

SEQ ID NO: 7300362 - DNA, 22 bp, Homo sapiens
gctgctcttgaggggctcactg

SEQ ID NO: 7300363 - DNA, 22 bp, Homo sapiens
gctgctctgtgacagcctccgg

SEQ ID NO: 7300364 - DNA, 22 bp, Homo sapiens
gctgctgctggtctggggccac

SEQ ID NO: 7300365 - DNA, 22 bp, Homo sapiens
gctggcccagtgacccacagtg

SEQ ID NO: 7300366 - DNA, 22 bp, Homo sapiens
gctctgtgttgtcagaggcacc

SEQ ID NO: 7300367 - DNA, 22 bp, Homo sapiens
gctctgtgttttgcccaggaga

SEQ ID NO: 7300368 - DNA, 22 bp, Homo sapiens
gctctgttcatcagtttgttgg

SEQ ID NO: 7300369 - DNA, 22 bp, Homo sapiens
gctcttctcagattgtacactc

SEQ ID NO: 7300370 - DNA, 22 bp, Homo sapiens
gctcttcagacaacgactccat

SEQ ID NO: 7300371 - DNA, 22 bp, Homo sapiens
gctgaaatgccttgtaaatatt

SEQ ID NO: 7300372 - DNA, 18 bp, Homo sapiens
gctgaaattctaaacaaa

SEQ ID NO: 7300373 - DNA, 22 bp, Homo sapiens
gctctgaaaaatggaggttggc

SEQ ID NO: 7300374 - DNA, 22 bp, Homo sapiens
gctcctgggtgtggctgcccct

SEQ ID NO: 7300375 - DNA, 22 bp, Homo sapiens
gctcctgggctctaccttgcta

SEQ ID NO: 7300376 - DNA, 22 bp, Homo sapiens
gctcctggtctggagcttcaag

SEQ ID NO: 7300377 - DNA, 19 bp, Homo sapiens
gctcctgggcctcactcat

SEQ ID NO: 7300378 - DNA, 22 bp, Homo sapiens
gctcctgggccctgggctaact

SEQ ID NO: 7300379 - DNA, 22 bp, Homo sapiens
gctcctggctctggccaaggga

SEQ ID NO: 7300380 - DNA, 22 bp, Homo sapiens
gctcctggcttcactgacatca

SEQ ID NO: 7300381 - DNA, 16 bp, Homo sapiens
gctcctgggccctcga

SEQ ID NO: 7300382 - DNA, 22 bp, Homo sapiens
gctcctggctctctgagggctg

SEQ ID NO: 7300383 - DNA, 22 bp, Homo sapiens
gctcctggcatcctgcttttaa

SEQ ID NO: 7300384 - DNA, 22 bp, Homo sapiens
gctcctggccagcacagggccc

SEQ ID NO: 7300385 - DNA, 22 bp, Homo sapiens
gctcctggctccaggcagccaa

SEQ ID NO: 7300386 - DNA, 22 bp, Homo sapiens
gctcctggcaggcagtgtgtgt

SEQ ID NO: 7300387 - DNA, 22 bp, Homo sapiens
gctcatttcttctttccacaat

SEQ ID NO: 7300388 - DNA, 18 bp, Homo sapiens
gctcatttggatgggctt

SEQ ID NO: 7300389 - DNA, 22 bp, Homo sapiens
ggggactctgcttctgggatca

SEQ ID NO: 7300390 - DNA, 22 bp, Homo sapiens
ggggactgaggcactgaaggtg

SEQ ID NO: 7300391 - DNA, 22 bp, Homo sapiens
gggggctggactttcccacaca

SEQ ID NO: 7300392 - DNA, 22 bp, Homo sapiens
ggggggctgttctggacaggaa

SEQ ID NO: 7300393 - DNA, 22 bp, Homo sapiens
gggggtgacgatggcagctggt

SEQ ID NO: 7300394 - DNA, 22 bp, Homo sapiens
gggggtgaggacaggagcactg

SEQ ID NO: 7300395 - DNA, 22 bp, Homo sapiens
gggggtgagcctgccaggccca

SEQ ID NO: 7300396 - DNA, 16 bp, Homo sapiens
gggggtgagagagagt

SEQ ID NO: 7300397 - DNA, 22 bp, Homo sapiens
gggtccagctacatcagggtgg

SEQ ID NO: 7300398 - DNA, 22 bp, Homo sapiens
gggtctgcctgctgtgaagtca

SEQ ID NO: 7300399 - DNA, 22 bp, Homo sapiens
gggtctggacggctgcaggaag

SEQ ID NO: 7300400 - DNA, 22 bp, Homo sapiens
gggtgaggagctgccagtcatg

SEQ ID NO: 7300401 - DNA, 22 bp, Homo sapiens
ggggacagttaaagaccaagac

SEQ ID NO: 7300402 - DNA, 22 bp, Homo sapiens
ggggacagtcgatctagtgatt

SEQ ID NO: 7300403 - DNA, 22 bp, Homo sapiens
ggggacagtcgatctagtgatt

SEQ ID NO: 7300404 - DNA, 23 bp, Homo sapiens
ggggacagttcccactggggtct

SEQ ID NO: 7300405 - DNA, 23 bp, Homo sapiens
ggggacagttcccactggggtct

SEQ ID NO: 7300406 - DNA, 23 bp, Homo sapiens
ggggacagttcccactggggtct

SEQ ID NO: 7300407 - DNA, 22 bp, Homo sapiens
ggggaatgagtgcccagaaagc

SEQ ID NO: 7300408 - DNA, 22 bp, Homo sapiens
gggctctgggtcgtgtctccat

SEQ ID NO: 7300409 - DNA, 23 bp, Homo sapiens
gggcccagcacaggacctggcag

SEQ ID NO: 7300410 - DNA, 22 bp, Homo sapiens
gggcccagcactggctgggatc

SEQ ID NO: 7300411 - DNA, 22 bp, Homo sapiens
gggccagtgaacaatgagggaa

SEQ ID NO: 7300412 - DNA, 22 bp, Homo sapiens
gggccatgagaggttcatcaac

SEQ ID NO: 7300413 - DNA, 19 bp, Homo sapiens
gggcccagcatggagggtt

SEQ ID NO: 7300414 - DNA, 19 bp, Homo sapiens
gggcccagcatggagggtt

SEQ ID NO: 7300415 - DNA, 22 bp, Homo sapiens
gggcggatcacctgaggtcagg

SEQ ID NO: 7300416 - DNA, 22 bp, Homo sapiens
gggcggatcacctgaggtcagg

SEQ ID NO: 7300417 - DNA, 22 bp, Homo sapiens
gggcggatcatttgaggtcagg

SEQ ID NO: 7300418 - DNA, 22 bp, Homo sapiens
gggcggatcatttgaggtcagg

SEQ ID NO: 7300419 - DNA, 20 bp, Homo sapiens
gggcagcctcgggagtgggt

SEQ ID NO: 7300420 - DNA, 22 bp, Homo sapiens
gggcagcagaattggacagaaa

SEQ ID NO: 7300421 - DNA, 22 bp, Homo sapiens
gggcagcagaattggacagaaa

SEQ ID NO: 7300422 - DNA, 20 bp, Homo sapiens
gggcagctcccctcattctg

SEQ ID NO: 7300423 - DNA, 22 bp, Homo sapiens
gggcagcctcggtgcctgctgc

SEQ ID NO: 7300424 - DNA, 20 bp, Homo sapiens
gggcagcctcgggagtgggt

SEQ ID NO: 7300425 - DNA, 22 bp, Homo sapiens
gggccagtagcacctgtgtgga

SEQ ID NO: 7300426 - DNA, 22 bp, Homo sapiens
gggccaggtcggtgaatggtca

SEQ ID NO: 7300427 - DNA, 22 bp, Homo sapiens
gggccaggtatcgtctttagta

SEQ ID NO: 7300428 - DNA, 22 bp, Homo sapiens
gggatctgacttgctggtgggt

SEQ ID NO: 7300429 - DNA, 21 bp, Homo sapiens
gggatctgaggcaagtctcct

SEQ ID NO: 7300430 - DNA, 22 bp, Homo sapiens
gggatctgagtaggcagaagct

SEQ ID NO: 7300431 - DNA, 22 bp, Homo sapiens
gggatgaggatcaatcagggag

SEQ ID NO: 7300432 - DNA, 22 bp, Homo sapiens
gggatctgagttgtcaggaagg

SEQ ID NO: 7300433 - DNA, 22 bp, Homo sapiens
gggatctgatgcactgctgaaa

SEQ ID NO: 7300434 - DNA, 22 bp, Homo sapiens
gggatggggagctggaaagggg

SEQ ID NO: 7300435 - DNA, 22 bp, Homo sapiens
gggatgggagagcatttagaga

SEQ ID NO: 7300436 - DNA, 22 bp, Homo sapiens
gggacctcgcatgcacgaagcc

SEQ ID NO: 7300437 - DNA, 22 bp, Homo sapiens
gggacgacaggctctgtggtag

SEQ ID NO: 7300438 - DNA, 22 bp, Homo sapiens
gggagaagaatgtgtcaattgt

SEQ ID NO: 7300439 - DNA, 20 bp, Homo sapiens
gggaggccccagagtccagg

SEQ ID NO: 7300440 - DNA, 18 bp, Homo sapiens
gggaggccccagcaggag

SEQ ID NO: 7300441 - DNA, 20 bp, Homo sapiens
gggagaagggctgatgagag

SEQ ID NO: 7300442 - DNA, 22 bp, Homo sapiens
gggagaaggagctagttcttga

SEQ ID NO: 7300443 - DNA, 22 bp, Homo sapiens
gggagaaggaggactgtgctgt

SEQ ID NO: 7300444 - DNA, 22 bp, Homo sapiens
gggaaaggatcagtgggaggct

SEQ ID NO: 7300445 - DNA, 22 bp, Homo sapiens
gggaaaggatcagtgggaggct

SEQ ID NO: 7300446 - DNA, 22 bp, Homo sapiens
gggaagaagacatggtgaaggc

SEQ ID NO: 7300447 - DNA, 22 bp, Homo sapiens
gggaactgtgtggtgctctgat

SEQ ID NO: 7300448 - DNA, 22 bp, Homo sapiens
gggaagaagacatggtgaaggc

SEQ ID NO: 7300449 - DNA, 22 bp, Homo sapiens
gggaagaagacatggtgaaggc

SEQ ID NO: 7300450 - DNA, 22 bp, Homo sapiens
ggctgtgttccaagtgtcagga

SEQ ID NO: 7300451 - DNA, 22 bp, Homo sapiens
ggctgtggtggcatccctgagc

SEQ ID NO: 7300452 - DNA, 22 bp, Homo sapiens
ggctggcttgccaagctcaggg

SEQ ID NO: 7300453 - DNA, 22 bp, Homo sapiens
ggctggctggctggtagacaag

SEQ ID NO: 7300454 - DNA, 22 bp, Homo sapiens
ggctggctggcttagcagagga

SEQ ID NO: 7300455 - DNA, 22 bp, Homo sapiens
ggctgcctgtgcccaggcacac

SEQ ID NO: 7300456 - DNA, 22 bp, Homo sapiens
ggctgcctgggagccctcctct

SEQ ID NO: 7300457 - DNA, 22 bp, Homo sapiens
ggctgccttccctgagccccgg

SEQ ID NO: 7300458 - DNA, 22 bp, Homo sapiens
ggctgccttgaccctggctccg

SEQ ID NO: 7300459 - DNA, 22 bp, Homo sapiens
ggctcctgggagaagttttatt

SEQ ID NO: 7300460 - DNA, 22 bp, Homo sapiens
ggctcctgggagatagaggtca

SEQ ID NO: 7300461 - DNA, 22 bp, Homo sapiens
ggctcctgggatgggactgagc

SEQ ID NO: 7300462 - DNA, 22 bp, Homo sapiens
ggctcctgggcagctgctccct

SEQ ID NO: 7300463 - DNA, 22 bp, Homo sapiens
ggctcctgggcgtcttcgaaca

SEQ ID NO: 7300464 - DNA, 23 bp, Homo sapiens
ggctcctggattcaaatcctgcc

SEQ ID NO: 7300465 - DNA, 22 bp, Homo sapiens
ggctcctggaggcaccactggt

SEQ ID NO: 7300466 - DNA, 22 bp, Homo sapiens
ggctcctggcaatgtaacttta

SEQ ID NO: 7300467 - DNA, 22 bp, Homo sapiens
ggctcctggcatctggtgggta

SEQ ID NO: 7300468 - DNA, 19 bp, Homo sapiens
ggctcctggggctcagccc

SEQ ID NO: 7300469 - DNA, 22 bp, Homo sapiens
ggctcctggggaggtgagcttg

SEQ ID NO: 7300470 - DNA, 22 bp, Homo sapiens
ggctcctgttttaaaaggtgaa

SEQ ID NO: 7300471 - DNA, 22 bp, Homo sapiens
ggctcctgttatttaatgagga

SEQ ID NO: 7300472 - DNA, 22 bp, Homo sapiens
ggctcagccccgtaacacagca

SEQ ID NO: 7300473 - DNA, 18 bp, Homo sapiens
ggctcagcaggctctctc

SEQ ID NO: 7300474 - DNA, 22 bp, Homo sapiens
ggctccaccctgcttccagaag

SEQ ID NO: 7300475 - DNA, 22 bp, Homo sapiens
ggctccaccctgcttccagaag

SEQ ID NO: 7300476 - DNA, 22 bp, Homo sapiens
ggctcctgatttgagggggctg

SEQ ID NO: 7300477 - DNA, 22 bp, Homo sapiens
ggctcctgcacctgtccctctg

SEQ ID NO: 7300478 - DNA, 22 bp, Homo sapiens
ggctcctggaaagccctcgctc

SEQ ID NO: 7300479 - DNA, 21 bp, Homo sapiens
ggctcctgctttgtgaggggc

SEQ ID NO: 7300480 - DNA, 22 bp, Homo sapiens
ggctcctgccgtcttttctgag

SEQ ID NO: 7300481 - DNA, 22 bp, Homo sapiens
ggctcctgctgtcctttgaagc

SEQ ID NO: 7300482 - DNA, 23 bp, Homo sapiens
ggctcctgcttcatgtcccacct

SEQ ID NO: 7300483 - DNA, 22 bp, Homo sapiens
ggcccacaccaggggccacagt

SEQ ID NO: 7300484 - DNA, 22 bp, Homo sapiens
ggcccccagggtgggtgtagac

SEQ ID NO: 7300485 - DNA, 22 bp, Homo sapiens
ggccccagttcactcctggccg

SEQ ID NO: 7300486 - DNA, 22 bp, Homo sapiens
ggccccaggtctgaacacgctg

SEQ ID NO: 7300487 - DNA, 22 bp, Homo sapiens
ggccagaagttggaaaagagcc

SEQ ID NO: 7300488 - DNA, 22 bp, Homo sapiens
ggccagactgagtgaggtcaag

SEQ ID NO: 7300489 - DNA, 22 bp, Homo sapiens
ggccagagagcagccaggattc

SEQ ID NO: 7300490 - DNA, 22 bp, Homo sapiens
ggccagaggtgtcctcagttct

SEQ ID NO: 7300491 - DNA, 18 bp, Homo sapiens
ggccagagggagggtccc

SEQ ID NO: 7300492 - DNA, 17 bp, Homo sapiens
ggccagaggcggggctg

SEQ ID NO: 7300493 - DNA, 22 bp, Homo sapiens
ggaaagagcccagcagtgcttg

SEQ ID NO: 7300494 - DNA, 22 bp, Homo sapiens
ggaaagaaccctggatggctgg

SEQ ID NO: 7300495 - DNA, 21 bp, Homo sapiens
ggaaagaaggcaaggctcagg

SEQ ID NO: 7300496 - DNA, 22 bp, Homo sapiens
ggaaagatgtaatattatctaa

SEQ ID NO: 7300497 - DNA, 22 bp, Homo sapiens
ggaaagatttgtcacatgaatg

SEQ ID NO: 7300498 - DNA, 22 bp, Homo sapiens
ggaaagagctaaaagggtgaga

SEQ ID NO: 7300499 - DNA, 22 bp, Homo sapiens
ggaactcagacgatcctatgtt

SEQ ID NO: 7300500 - DNA, 22 bp, Homo sapiens
ggaaagcatccaggtgccccca

SEQ ID NO: 7300501 - DNA, 22 bp, Homo sapiens
ggaaagaaagtgtgaacaactt

SEQ ID NO: 7300502 - DNA, 22 bp, Homo sapiens
ggaaaacaagagaatgatgttt

SEQ ID NO: 7300503 - DNA, 20 bp, Homo sapiens
ggaaaaatgcatgctcaaga

SEQ ID NO: 7300504 - DNA, 22 bp, Homo sapiens
gcttctggggttctggcatgct

SEQ ID NO: 7300505 - DNA, 22 bp, Homo sapiens
ggaagaaatctggttaagagat

SEQ ID NO: 7300506 - DNA, 22 bp, Homo sapiens
ggaagaaaatgggcaacaggtg

SEQ ID NO: 7300507 - DNA, 17 bp, Homo sapiens
ggaagaaaaggatcatc

SEQ ID NO: 7300508 - DNA, 22 bp, Homo sapiens
ggaactgattaagtcatgagaa

SEQ ID NO: 7300509 - DNA, 22 bp, Homo sapiens
ggaactgattaagtcatgagaa

SEQ ID NO: 7300510 - DNA, 22 bp, Homo sapiens
ggaactgagaagcagctatgcc

SEQ ID NO: 7300511 - DNA, 22 bp, Homo sapiens
ggaagaaaggtggacaacaggt

SEQ ID NO: 7300512 - DNA, 22 bp, Homo sapiens
ggaagaaaggtggacaacaggt

SEQ ID NO: 7300513 - DNA, 22 bp, Homo sapiens
ggaagaaaggtggacaacaggt

SEQ ID NO: 7300514 - DNA, 22 bp, Homo sapiens
ggaagaaaggtggacaacaggt

SEQ ID NO: 7300515 - DNA, 22 bp, Homo sapiens
ggaagaaagcacacaaacttga

SEQ ID NO: 7300516 - DNA, 22 bp, Homo sapiens
gcttattaggttatttcaagga

SEQ ID NO: 7300517 - DNA, 22 bp, Homo sapiens
gctgggctggaaggccaaggca

SEQ ID NO: 7300518 - DNA, 22 bp, Homo sapiens
gcttaattctggctcagtttcc

SEQ ID NO: 7300519 - DNA, 22 bp, Homo sapiens
gcttacaaacaacagaaattaa

SEQ ID NO: 7300520 - DNA, 22 bp, Homo sapiens
gctgggctccaccctcaactgt

SEQ ID NO: 7300521 - DNA, 22 bp, Homo sapiens
gctgggctgagctagacttggc

SEQ ID NO: 7300522 - DNA, 23 bp, Homo sapiens
gcttctgccatttgctagctgtg

SEQ ID NO: 7300523 - DNA, 17 bp, Homo sapiens
gcttcctgtgctgggga

SEQ ID NO: 7300524 - DNA, 22 bp, Homo sapiens
gcttcctgtccctcagccatga

SEQ ID NO: 7300525 - DNA, 22 bp, Homo sapiens
gcttcctgtccaggccccacat

SEQ ID NO: 7300526 - DNA, 22 bp, Homo sapiens
gcttcctgtaggcaggtccaag

SEQ ID NO: 7300527 - DNA, 22 bp, Homo sapiens
gcttcctgtatcctcctgtacc

SEQ ID NO: 7300528 - DNA, 22 bp, Homo sapiens
gcttcctgggacaggctatgtg

SEQ ID NO: 7300529 - DNA, 22 bp, Homo sapiens
gcttcattactgacagtctgtg

SEQ ID NO: 7300530 - DNA, 22 bp, Homo sapiens
gcttcctggagggagagagctg

SEQ ID NO: 7300531 - DNA, 22 bp, Homo sapiens
gcttcctggagggagagagctg

SEQ ID NO: 7300532 - DNA, 20 bp, Homo sapiens
gcttcagtttcctcactggt

SEQ ID NO: 7300533 - DNA, 22 bp, Homo sapiens
gcttcaggaggtcggtctcctt

SEQ ID NO: 7300534 - DNA, 22 bp, Homo sapiens
gcttcattaactcagagttttg

SEQ ID NO: 7300535 - DNA, 22 bp, Homo sapiens
gcttcaaactgagcttcaagtg

SEQ ID NO: 7300536 - DNA, 22 bp, Homo sapiens
gcttcaaagaacaaagggaggc

SEQ ID NO: 7300537 - DNA, 22 bp, Homo sapiens
gcttcaaagattcacagtttca

SEQ ID NO: 7300538 - DNA, 20 bp, Homo sapiens
gcttcaaagccatcctttta

SEQ ID NO: 7300539 - DNA, 22 bp, Homo sapiens
gcttcaaattaaggtgaatccc

SEQ ID NO: 7300540 - DNA, 17 bp, Homo sapiens
ggagctccagctactgc

SEQ ID NO: 7300541 - DNA, 16 bp, Homo sapiens
ggagctcctcgacttt

SEQ ID NO: 7300542 - DNA, 22 bp, Homo sapiens
ggagctcctggcagtgacagag

SEQ ID NO: 7300543 - DNA, 22 bp, Homo sapiens
ggagctgcacgctctgaagcct

SEQ ID NO: 7300544 - DNA, 22 bp, Homo sapiens
ggaggaaatccttagtaaggca

SEQ ID NO: 7300545 - DNA, 22 bp, Homo sapiens
ggaggagcatgagagggtagtg

SEQ ID NO: 7300546 - DNA, 22 bp, Homo sapiens
ggaggaagggcccaggctttat

SEQ ID NO: 7300547 - DNA, 22 bp, Homo sapiens
ggaggaagggtagcataatgta

SEQ ID NO: 7300548 - DNA, 22 bp, Homo sapiens
ggaggaggcggcagaagttcct

SEQ ID NO: 7300549 - DNA, 22 bp, Homo sapiens
ggaggccacggtttagcaccga

SEQ ID NO: 7300550 - DNA, 22 bp, Homo sapiens
ggaggccacctgacctgctgtt

SEQ ID NO: 7300551 - DNA, 22 bp, Homo sapiens
ggaggccagggacccagtcagc

SEQ ID NO: 7300552 - DNA, 22 bp, Homo sapiens
ggaggccaggatgggaactcaa

SEQ ID NO: 7300553 - DNA, 22 bp, Homo sapiens
ggaggccatctggctggaggct

SEQ ID NO: 7300554 - DNA, 22 bp, Homo sapiens
ggaggccagtcctggccgggct

SEQ ID NO: 7300555 - DNA, 22 bp, Homo sapiens
ggaggccatagtttgggagtca

SEQ ID NO: 7300556 - DNA, 22 bp, Homo sapiens
ggagatggaatagattctgact

SEQ ID NO: 7300557 - DNA, 22 bp, Homo sapiens
ggagcctgtgggatgagatgtg

SEQ ID NO: 7300558 - DNA, 22 bp, Homo sapiens
ggaagtaatgtcttaagattct

SEQ ID NO: 7300559 - DNA, 22 bp, Homo sapiens
ggaataggatttacctctgtaa

SEQ ID NO: 7300560 - DNA, 22 bp, Homo sapiens
ggagaaggaagaaagctactat

SEQ ID NO: 7300561 - DNA, 22 bp, Homo sapiens
ggagaaggcacacccacctctg

SEQ ID NO: 7300562 - DNA, 23 bp, Homo sapiens
ggagacaaggtaccacgttaaca

SEQ ID NO: 7300563 - DNA, 22 bp, Homo sapiens
ggcacagagcaggccactaatc

SEQ ID NO: 7300564 - DNA, 22 bp, Homo sapiens
ggagtgtcccgattttccaggt

SEQ ID NO: 7300565 - DNA, 22 bp, Homo sapiens
ggcagacacaaaaacataaggt

SEQ ID NO: 7300566 - DNA, 22 bp, Homo sapiens
ggcacagagctccagccttggc

SEQ ID NO: 7300567 - DNA, 22 bp, Homo sapiens
ggcacagatagatcaagtgtct

SEQ ID NO: 7300568 - DNA, 22 bp, Homo sapiens
ggcacagagttggcagagctgc

SEQ ID NO: 7300569 - DNA, 21 bp, Homo sapiens
ggcagagaagctggaagttgg

SEQ ID NO: 7300570 - DNA, 22 bp, Homo sapiens
ggcagaggaagctggaagtggg

SEQ ID NO: 7300571 - DNA, 20 bp, Homo sapiens
ggcagctctagtcgaggccc

SEQ ID NO: 7300572 - DNA, 22 bp, Homo sapiens
ggagggctgccaggtggagcgg

SEQ ID NO: 7300573 - DNA, 18 bp, Homo sapiens
ggagggctttggggactg

SEQ ID NO: 7300574 - DNA, 18 bp, Homo sapiens
ggagggctttggggactg

SEQ ID NO: 7300575 - DNA, 22 bp, Homo sapiens
ggagggctgtagaggagacctg

SEQ ID NO: 7300576 - DNA, 22 bp, Homo sapiens
ggagggctgtagaggagacctg

SEQ ID NO: 7300577 - DNA, 22 bp, Homo sapiens
ggagggctgccaggtggagcgg

SEQ ID NO: 7300578 - DNA, 22 bp, Homo sapiens
ggagggcacaggaccagaaatc

SEQ ID NO: 7300579 - DNA, 22 bp, Homo sapiens
ggagggagagtgaccctaccaa

SEQ ID NO: 7300580 - DNA, 22 bp, Homo sapiens
ggagggcatcaatcaggcctgg

SEQ ID NO: 7300581 - DNA, 21 bp, Homo sapiens
ggagggcagcccagactggct

SEQ ID NO: 7300582 - DNA, 22 bp, Homo sapiens
ggagggcagagtcccctgctga

SEQ ID NO: 7300583 - DNA, 20 bp, Homo sapiens
ggagggcagctgagagttgg

SEQ ID NO: 7300584 - DNA, 22 bp, Homo sapiens
ggagggtccactgtgaggcaga

SEQ ID NO: 7300585 - DNA, 22 bp, Homo sapiens
ggagggtccactgtgaggcaga

SEQ ID NO: 7300586 - DNA, 22 bp, Homo sapiens
ggaggggtggtcgcgaagagca

SEQ ID NO: 7300587 - DNA, 22 bp, Homo sapiens
ggaggggtggtcacctggcagg

SEQ ID NO: 7300588 - DNA, 22 bp, Homo sapiens
ggaggggtggtcacctggcagg

SEQ ID NO: 7300589 - DNA, 22 bp, Homo sapiens
ggagggtccccagcagcatgaa

SEQ ID NO: 7300590 - DNA, 22 bp, Homo sapiens
ggagggtctaagggagaactga

SEQ ID NO: 7300591 - DNA, 22 bp, Homo sapiens
ggaggggtctctagcgaggaga

SEQ ID NO: 7300592 - DNA, 22 bp, Homo sapiens
ggaggggtctctagcgaggaga

SEQ ID NO: 7300593 - DNA, 22 bp, Homo sapiens
ggaggggtgctcagctgtcacg

SEQ ID NO: 7300594 - DNA, 22 bp, Homo sapiens
ggagggggaattcagccccagc

SEQ ID NO: 7300595 - DNA, 22 bp, Homo sapiens
ggaggggctcctgttcgccccc

SEQ ID NO: 7300596 - DNA, 22 bp, Homo sapiens
ggaggtggcagagggacattct

SEQ ID NO: 7300597 - DNA, 22 bp, Homo sapiens
ggagtagctgcattccgagcac

SEQ ID NO: 7300598 - DNA, 22 bp, Homo sapiens
gtgtcactggaatactgtctgt

SEQ ID NO: 7300599 - DNA, 22 bp, Homo sapiens
gtgtcaatgaggtttatttttg

SEQ ID NO: 7300600 - DNA, 22 bp, Homo sapiens
gtgtaaggtgaaatcaacaaat

SEQ ID NO: 7300601 - DNA, 22 bp, Homo sapiens
gtgtaaagatgccaggaatctt

SEQ ID NO: 7300602 - DNA, 22 bp, Homo sapiens
gtgtaaatgccccattcattga

SEQ ID NO: 7300603 - DNA, 22 bp, Homo sapiens
gtggtctggggtcaggcctgag

SEQ ID NO: 7300604 - DNA, 22 bp, Homo sapiens
gtggtgcaggaagcatctggct

SEQ ID NO: 7300605 - DNA, 18 bp, Homo sapiens
gtggggtgttgtgaggat

SEQ ID NO: 7300606 - DNA, 22 bp, Homo sapiens
gtggggtgtccagcagcgagct

SEQ ID NO: 7300607 - DNA, 22 bp, Homo sapiens
gtgggggctggctcgtcctgtg

SEQ ID NO: 7300608 - DNA, 22 bp, Homo sapiens
gtggggggagctgcaagctgga

SEQ ID NO: 7300609 - DNA, 22 bp, Homo sapiens
gtgggtctggctttgagggtca

SEQ ID NO: 7300610 - DNA, 22 bp, Homo sapiens
gtgggtgcggggagccgaggcg

SEQ ID NO: 7300611 - DNA, 22 bp, Homo sapiens
gtggtcaccatgaatgtgggtt

SEQ ID NO: 7300612 - DNA, 20 bp, Homo sapiens
gtggtcacacctgagtgggt

SEQ ID NO: 7300613 - DNA, 22 bp, Homo sapiens
gtgggggagatgcttaggtccg

SEQ ID NO: 7300614 - DNA, 22 bp, Homo sapiens
gtggggacgggatggctcactg

SEQ ID NO: 7300615 - DNA, 22 bp, Homo sapiens
gttgtgcaaacactggggtctg

SEQ ID NO: 7300616 - DNA, 22 bp, Homo sapiens
gttgtgcaaacactggggtctg

SEQ ID NO: 7300617 - DNA, 22 bp, Homo sapiens
gttgtgcaaccatcaccaccat

SEQ ID NO: 7300618 - DNA, 22 bp, Homo sapiens
gttgtgcaccactgttgattga

SEQ ID NO: 7300619 - DNA, 22 bp, Homo sapiens
gttgtgcaccactgttgattga

SEQ ID NO: 7300620 - DNA, 22 bp, Homo sapiens
gttgtgcagaagtgcctcagta

SEQ ID NO: 7300621 - DNA, 22 bp, Homo sapiens
gttgtgcagggcgaggacctga

SEQ ID NO: 7300622 - DNA, 22 bp, Homo sapiens
gttgtgcagtcagactgcctgg

SEQ ID NO: 7300623 - DNA, 22 bp, Homo sapiens
gttgtgcatttatgaagaagtt

SEQ ID NO: 7300624 - DNA, 22 bp, Homo sapiens
gttctcctggctcccaccctgc

SEQ ID NO: 7300625 - DNA, 21 bp, Homo sapiens
gttattttaagtgagctttgc

SEQ ID NO: 7300626 - DNA, 22 bp, Homo sapiens
gttattttatctctgagaggtt

SEQ ID NO: 7300627 - DNA, 22 bp, Homo sapiens
gttattttcattggctcagact

SEQ ID NO: 7300628 - DNA, 22 bp, Homo sapiens
gtgtccagggccgtgttgtctt

SEQ ID NO: 7300629 - DNA, 22 bp, Homo sapiens
gtgtcatgcacactcagtgttg

SEQ ID NO: 7300630 - DNA, 22 bp, Homo sapiens
gtgtcatgcacactcagtgttg

SEQ ID NO: 7300631 - DNA, 22 bp, Homo sapiens
gtgtgagccatgatgtgtccag

SEQ ID NO: 7300632 - DNA, 22 bp, Homo sapiens
gtgtctcttagcctgctaatgc

SEQ ID NO: 7300633 - DNA, 22 bp, Homo sapiens
gtgtcgtatgtaatatggtcca

SEQ ID NO: 7300634 - DNA, 22 bp, Homo sapiens
gtgtcgtgcttgccatgggtac

SEQ ID NO: 7300635 - DNA, 22 bp, Homo sapiens
gtgtcgtgcttgccatgggtac

SEQ ID NO: 7300636 - DNA, 18 bp, Homo sapiens
gtgtcctttgcaagaaac

SEQ ID NO: 7300637 - DNA, 22 bp, Homo sapiens
gtgtcctttccgggcctggagg

SEQ ID NO: 7300638 - DNA, 22 bp, Homo sapiens
gtgtccttatttctgtctctca

SEQ ID NO: 7300639 - DNA, 22 bp, Homo sapiens
gtgtccttataagaagagatgc

SEQ ID NO: 7300640 - DNA, 22 bp, Homo sapiens
gtgtccttaagtcggttctcct

SEQ ID NO: 7300641 - DNA, 22 bp, Homo sapiens
gtgtcctgggggacttcaggtt

SEQ ID NO: 7300642 - DNA, 22 bp, Homo sapiens
gtgtcctgttcagaagcttggg

SEQ ID NO: 7300643 - DNA, 22 bp, Homo sapiens
gtgtcctgcaggccaggaatgg

SEQ ID NO: 7300644 - DNA, 22 bp, Homo sapiens
gtgtgcagatgtgatgctgggc

SEQ ID NO: 7300645 - DNA, 21 bp, Homo sapiens
gtgtgagtagcatgtgtctca

SEQ ID NO: 7300646 - DNA, 22 bp, Homo sapiens
gtgtgagtgaaagtagtttgat

SEQ ID NO: 7300647 - DNA, 21 bp, Homo sapiens
gtgtgagtagcatgtgtctca

SEQ ID NO: 7300648 - DNA, 22 bp, Homo sapiens
gtgtgcacagagctccagtgtt

SEQ ID NO: 7300649 - DNA, 23 bp, Homo sapiens
gtgtgcaggattatttgcagaca

SEQ ID NO: 7300650 - DNA, 22 bp, Homo sapiens
gtgtgcagggctgcctgtgccg

SEQ ID NO: 7300651 - DNA, 22 bp, Homo sapiens
gtgtgcaggggcttggtggagc

SEQ ID NO: 7300652 - DNA, 22 bp, Homo sapiens
gtgtggggagctgcagccacat

SEQ ID NO: 7300653 - DNA, 22 bp, Homo sapiens
gtgtgggctatgtgcgtgggca

SEQ ID NO: 7300654 - DNA, 22 bp, Homo sapiens
gtgtgggcagggccgtgctccc

SEQ ID NO: 7300655 - DNA, 22 bp, Homo sapiens
gtgtgggaggaaggtgaacaga

SEQ ID NO: 7300656 - DNA, 22 bp, Homo sapiens
gtgtgggtgtactgttctagat

SEQ ID NO: 7300657 - DNA, 22 bp, Homo sapiens
gtgtgtcaggtactgtgctagg

SEQ ID NO: 7300658 - DNA, 22 bp, Homo sapiens
gtgtgtcagagctcagagaagt

SEQ ID NO: 7300659 - DNA, 22 bp, Homo sapiens
gtgtgtattattgcatacacat

SEQ ID NO: 7300660 - DNA, 22 bp, Homo sapiens
gtgtgtatttaaaggatagttg

SEQ ID NO: 7300661 - DNA, 22 bp, Homo sapiens
gtgtgtattattgcatacacat

SEQ ID NO: 7300662 - DNA, 22 bp, Homo sapiens
gtgtgtatgtagaactatgtat

SEQ ID NO: 7300663 - DNA, 22 bp, Homo sapiens
gtgtgtatgtagaactatgtat

SEQ ID NO: 7300664 - DNA, 22 bp, Homo sapiens
gtgtgtatgtagaactatgtat

SEQ ID NO: 7300665 - DNA, 22 bp, Homo sapiens
gtgtgtacatatttttaatggg

SEQ ID NO: 7300666 - DNA, 22 bp, Homo sapiens
taaaacagcagggcagagaagt

SEQ ID NO: 7300667 - DNA, 22 bp, Homo sapiens
taaaggaacagaggactcattt

SEQ ID NO: 7300668 - DNA, 22 bp, Homo sapiens
taaaggaactgctgctatggaa

SEQ ID NO: 7300669 - DNA, 22 bp, Homo sapiens
taaagctatgcttaatttatca

SEQ ID NO: 7300670 - DNA, 22 bp, Homo sapiens
taaaggaatcagttttagagat

SEQ ID NO: 7300671 - DNA, 22 bp, Homo sapiens
taaaggaggagttaatgagact

SEQ ID NO: 7300672 - DNA, 19 bp, Homo sapiens
taaaggaagaggaagggaa

SEQ ID NO: 7300673 - DNA, 18 bp, Homo sapiens
taaaggaagtgggagagg

SEQ ID NO: 7300674 - DNA, 22 bp, Homo sapiens
taaaggaagaattctctgtgat

SEQ ID NO: 7300675 - DNA, 19 bp, Homo sapiens
taaaggaagaagggaggat

SEQ ID NO: 7300676 - DNA, 22 bp, Homo sapiens
taaaggagtgtgatgaaaggga

SEQ ID NO: 7300677 - DNA, 22 bp, Homo sapiens
taaaggctttattttccagtca

SEQ ID NO: 7300678 - DNA, 22 bp, Homo sapiens
taaatacttttactccactgat

SEQ ID NO: 7300679 - DNA, 22 bp, Homo sapiens
gtttaataatgttgaattacta

SEQ ID NO: 7300680 - DNA, 22 bp, Homo sapiens
gtttttctaagtagcgatattt

SEQ ID NO: 7300681 - DNA, 22 bp, Homo sapiens
gtttaaagtagcttccttttgg

SEQ ID NO: 7300682 - DNA, 22 bp, Homo sapiens
gtttaaagtagcttccttttgg

SEQ ID NO: 7300683 - DNA, 22 bp, Homo sapiens
gtttaaagtcttggaaggagga

SEQ ID NO: 7300684 - DNA, 20 bp, Homo sapiens
gtttttctctcttgccacta

SEQ ID NO: 7300685 - DNA, 22 bp, Homo sapiens
gtttttctaggaccatgtgatt

SEQ ID NO: 7300686 - DNA, 22 bp, Homo sapiens
gtttttctagactgggagtttg

SEQ ID NO: 7300687 - DNA, 22 bp, Homo sapiens
gtttttctagaaatctcctcct

SEQ ID NO: 7300688 - DNA, 22 bp, Homo sapiens
gtttttctctgaaatagttgac

SEQ ID NO: 7300689 - DNA, 20 bp, Homo sapiens
gtttttcttgggcgagctat

SEQ ID NO: 7300690 - DNA, 22 bp, Homo sapiens
gtttttctgtgagcggtaaagg

SEQ ID NO: 7300691 - DNA, 22 bp, Homo sapiens
gtttttctttgtgtgaagacaa

SEQ ID NO: 7300692 - DNA, 22 bp, Homo sapiens
taacagaatagcagaaacagaa

SEQ ID NO: 7300693 - DNA, 22 bp, Homo sapiens
taagaacaagatgttcctgttt

SEQ ID NO: 7300694 - DNA, 22 bp, Homo sapiens
taaatagaatctaaactgctca

SEQ ID NO: 7300695 - DNA, 22 bp, Homo sapiens
taaatctcaataaagtctgtgg

SEQ ID NO: 7300696 - DNA, 22 bp, Homo sapiens
taaatctcagggaatatattga

SEQ ID NO: 7300697 - DNA, 22 bp, Homo sapiens
taaatctcagcctttctgctta

SEQ ID NO: 7300698 - DNA, 21 bp, Homo sapiens
taaatctctgtattcttcagt

SEQ ID NO: 7300699 - DNA, 22 bp, Homo sapiens
taaatctctgctcctcttgggt

SEQ ID NO: 7300700 - DNA, 22 bp, Homo sapiens
taaatctcctgtttttcatcta

SEQ ID NO: 7300701 - DNA, 22 bp, Homo sapiens
taacactggcttttgctgaggc

SEQ ID NO: 7300702 - DNA, 21 bp, Homo sapiens
gtatatcagcagtgaattcaa

SEQ ID NO: 7300703 - DNA, 22 bp, Homo sapiens
gtatatctcttacatacacaca

SEQ ID NO: 7300704 - DNA, 22 bp, Homo sapiens
gtatatattggataaaccagag

SEQ ID NO: 7300705 - DNA, 22 bp, Homo sapiens
gtatatatgtgtgaacatgtat

SEQ ID NO: 7300706 - DNA, 22 bp, Homo sapiens
gtatatcttcagaaattatagg

SEQ ID NO: 7300707 - DNA, 18 bp, Homo sapiens
gtatatctgcacatatac

SEQ ID NO: 7300708 - DNA, 22 bp, Homo sapiens
gtatgtatacattgtggaatgg

SEQ ID NO: 7300709 - DNA, 22 bp, Homo sapiens
gtatgtatatatgtgtacacac

SEQ ID NO: 7300710 - DNA, 22 bp, Homo sapiens
gtatatatcggcactattttaa

SEQ ID NO: 7300711 - DNA, 22 bp, Homo sapiens
gtatatatgtgtgaacatgtat

SEQ ID NO: 7300712 - DNA, 22 bp, Homo sapiens
gtatatatcggcactattttaa

SEQ ID NO: 7300713 - DNA, 22 bp, Homo sapiens
gtatactagatagacagtatca

SEQ ID NO: 7300714 - DNA, 20 bp, Homo sapiens
gtatataaccatagtgacta

SEQ ID NO: 7300715 - DNA, 22 bp, Homo sapiens
gtacagttttcagtgttcactg

SEQ ID NO: 7300716 - DNA, 22 bp, Homo sapiens
gtacatattaaaggtctataaa

SEQ ID NO: 7300717 - DNA, 22 bp, Homo sapiens
gtacataattttcagccagttt

SEQ ID NO: 7300718 - DNA, 22 bp, Homo sapiens
gtacataagaaattactacaga

SEQ ID NO: 7300719 - DNA, 22 bp, Homo sapiens
gtacataaaggaggctctttgc

SEQ ID NO: 7300720 - DNA, 22 bp, Homo sapiens
gtacattcagcttagcacttct

SEQ ID NO: 7300721 - DNA, 22 bp, Homo sapiens
gtacatattataaaatacagct

SEQ ID NO: 7300722 - DNA, 22 bp, Homo sapiens
gtaaaatagaataacgtggcta

SEQ ID NO: 7300723 - DNA, 23 bp, Homo sapiens
gtaaaatacgcagtgcagtgtga

SEQ ID NO: 7300724 - DNA, 22 bp, Homo sapiens
gtaaagtttctcagtgatgttc

SEQ ID NO: 7300725 - DNA, 22 bp, Homo sapiens
gtacagaggttgctggaggctc

SEQ ID NO: 7300726 - DNA, 22 bp, Homo sapiens
gtacagattaataatatactga

SEQ ID NO: 7300727 - DNA, 22 bp, Homo sapiens
gtacaggacatagacagagtag

SEQ ID NO: 7300728 - DNA, 22 bp, Homo sapiens
gtacagaaagtacccatagaag

SEQ ID NO: 7300729 - DNA, 21 bp, Homo sapiens
gtacacacaggtggatgggct

SEQ ID NO: 7300730 - DNA, 22 bp, Homo sapiens
gtacacacaatctctggtcagt

SEQ ID NO: 7300731 - DNA, 22 bp, Homo sapiens
ggtgtccatcaggctgtgcttc

SEQ ID NO: 7300732 - DNA, 22 bp, Homo sapiens
ggtgtagctctgtgtcccactg

SEQ ID NO: 7300733 - DNA, 22 bp, Homo sapiens
ggtggcaggccctgagcatccc

SEQ ID NO: 7300734 - DNA, 22 bp, Homo sapiens
ggtggcatacatttctgtcttg

SEQ ID NO: 7300735 - DNA, 22 bp, Homo sapiens
ggtgagggtaaatataggcaaa

SEQ ID NO: 7300736 - DNA, 22 bp, Homo sapiens
gtcctttgaaggcaaaaggaga

SEQ ID NO: 7300737 - DNA, 22 bp, Homo sapiens
gtccttgggatagaaagatgaa

SEQ ID NO: 7300738 - DNA, 22 bp, Homo sapiens
gtccttgagtaagtcatggtgg

SEQ ID NO: 7300739 - DNA, 22 bp, Homo sapiens
gtccttgaagccatttcagggc

SEQ ID NO: 7300740 - DNA, 22 bp, Homo sapiens
gtccttcctgcagggatggatg

SEQ ID NO: 7300741 - DNA, 22 bp, Homo sapiens
gtccttccccagccagctctgg

SEQ ID NO: 7300742 - DNA, 22 bp, Homo sapiens
gtccttccacatggccaacttc

SEQ ID NO: 7300743 - DNA, 22 bp, Homo sapiens
gtctgaatacgtacttgtgaag

SEQ ID NO: 7300744 - DNA, 22 bp, Homo sapiens
gtctgggctcctggcaggcagc

SEQ ID NO: 7300745 - DNA, 22 bp, Homo sapiens
gtctgggcttagggacatggca

SEQ ID NO: 7300746 - DNA, 22 bp, Homo sapiens
gtctggggcagcaaggcgcgcg

SEQ ID NO: 7300747 - DNA, 22 bp, Homo sapiens
gtctgggggtccgggtgcctgc

SEQ ID NO: 7300748 - DNA, 22 bp, Homo sapiens
gtctgggggtccgggtgcctgc

SEQ ID NO: 7300749 - DNA, 22 bp, Homo sapiens
gtctggggaagtcagggcatca

SEQ ID NO: 7300750 - DNA, 22 bp, Homo sapiens
gtctgggattggggtaaagaag

SEQ ID NO: 7300751 - DNA, 22 bp, Homo sapiens
gtctgggcaagggagatggcgc

SEQ ID NO: 7300752 - DNA, 22 bp, Homo sapiens
gtctgggagtttggtgctgccg

SEQ ID NO: 7300753 - DNA, 22 bp, Homo sapiens
gtctggcttttgccctgtgttt

SEQ ID NO: 7300754 - DNA, 22 bp, Homo sapiens
gtcccacaggaactcggtggag

SEQ ID NO: 7300755 - DNA, 22 bp, Homo sapiens
gtatgtgaggttggtttccagg

SEQ ID NO: 7300756 - DNA, 22 bp, Homo sapiens
gtatgtgtcttagaacttggga

SEQ ID NO: 7300757 - DNA, 22 bp, Homo sapiens
gtatgtgtgcaaatgtaaatat

SEQ ID NO: 7300758 - DNA, 22 bp, Homo sapiens
gtatgtgtgcaaatgtaaatat

SEQ ID NO: 7300759 - DNA, 22 bp, Homo sapiens
gtatgtgtgcaaatgtaaatat

SEQ ID NO: 7300760 - DNA, 22 bp, Homo sapiens
gtatgtgttgaattcaggggtc

SEQ ID NO: 7300761 - DNA, 22 bp, Homo sapiens
gtcagctactgcagggaacttt

SEQ ID NO: 7300762 - DNA, 22 bp, Homo sapiens
gtcagctaggcagctgcgatgg

SEQ ID NO: 7300763 - DNA, 22 bp, Homo sapiens
gtcagctaggcagctgtgatgg

SEQ ID NO: 7300764 - DNA, 22 bp, Homo sapiens
gtcaggactctgacccgtcccg

SEQ ID NO: 7300765 - DNA, 20 bp, Homo sapiens
gtggcccttaaagagggaag

SEQ ID NO: 7300766 - DNA, 22 bp, Homo sapiens
gtgggagccctcagggaggtgc

SEQ ID NO: 7300767 - DNA, 22 bp, Homo sapiens
gtgggagcatggtcccagtgcc

SEQ ID NO: 7300768 - DNA, 22 bp, Homo sapiens
gtgggagctgctacctccttcc

SEQ ID NO: 7300769 - DNA, 22 bp, Homo sapiens
gtgggagctttggcatcaggct

SEQ ID NO: 7300770 - DNA, 22 bp, Homo sapiens
gtgggagctgcggaggcctggg

SEQ ID NO: 7300771 - DNA, 22 bp, Homo sapiens
gtgggagctgcggaggcctggg

SEQ ID NO: 7300772 - DNA, 22 bp, Homo sapiens
gtggctggagtatgaggaaagg

SEQ ID NO: 7300773 - DNA, 22 bp, Homo sapiens
gtggccctctgatagggtcagg

SEQ ID NO: 7300774 - DNA, 22 bp, Homo sapiens
gtggccctggagttgtgacact

SEQ ID NO: 7300775 - DNA, 21 bp, Homo sapiens
gtggccctgccgcagtgtcca

SEQ ID NO: 7300776 - DNA, 21 bp, Homo sapiens
gtggccctgccgcagtgtcca

SEQ ID NO: 7300777 - DNA, 22 bp, Homo sapiens
gtggccaggacattgccaggca

SEQ ID NO: 7300778 - DNA, 22 bp, Homo sapiens
gtggccagaagttaagtggtta

SEQ ID NO: 7300779 - DNA, 22 bp, Homo sapiens
gtggccagccagggtgctgatg

SEQ ID NO: 7300780 - DNA, 22 bp, Homo sapiens
gtggcatgaaagcatctgtgat

SEQ ID NO: 7300781 - DNA, 22 bp, Homo sapiens
gtggccaatttccatctgtaag

SEQ ID NO: 7300782 - DNA, 22 bp, Homo sapiens
gtggcagagggtgagctggact

SEQ ID NO: 7300783 - DNA, 22 bp, Homo sapiens
gtggatggagctggaagccatt

SEQ ID NO: 7300784 - DNA, 22 bp, Homo sapiens
gtggatggagcagtgacccagg

SEQ ID NO: 7300785 - DNA, 22 bp, Homo sapiens
gtggatggattgaggcagtggg

SEQ ID NO: 7300786 - DNA, 22 bp, Homo sapiens
gtggatggattttgaggaatgg

SEQ ID NO: 7300787 - DNA, 22 bp, Homo sapiens
gtggatggccctgcacacaggt

SEQ ID NO: 7300788 - DNA, 22 bp, Homo sapiens
gtggatggctagttgagaaggg

SEQ ID NO: 7300789 - DNA, 22 bp, Homo sapiens
gtggacatgcatacatatgttt

SEQ ID NO: 7300790 - DNA, 22 bp, Homo sapiens
gtggaggaaaagaagttgggtg

SEQ ID NO: 7300791 - DNA, 22 bp, Homo sapiens
gtggatctactgtatgggatag

SEQ ID NO: 7300792 - DNA, 22 bp, Homo sapiens
gtggatctcattcaccatggct

SEQ ID NO: 7300793 - DNA, 22 bp, Homo sapiens
gtggatctgatgtttttcgcca

SEQ ID NO: 7300794 - DNA, 22 bp, Homo sapiens
gtggatctggctctgtctggtc

SEQ ID NO: 7300795 - DNA, 22 bp, Homo sapiens
gtggatctggctgtgtcctggc

SEQ ID NO: 7300796 - DNA, 22 bp, Homo sapiens
gtggatggacatgggcaagagg

SEQ ID NO: 7300797 - DNA, 22 bp, Homo sapiens
gtggatctaaagaaggagggtg

SEQ ID NO: 7300798 - DNA, 18 bp, Homo sapiens
gtggagggttctcagaat

SEQ ID NO: 7300799 - DNA, 22 bp, Homo sapiens
gtggagggtttgcaatgtgcag

SEQ ID NO: 7300800 - DNA, 22 bp, Homo sapiens
gtggagggaatgaatcttctct

SEQ ID NO: 7300801 - DNA, 22 bp, Homo sapiens
gtggagggtgagctcatgtttg

SEQ ID NO: 7300802 - DNA, 23 bp, Homo sapiens
gtgctacttacagggagcttggt

SEQ ID NO: 7300803 - DNA, 22 bp, Homo sapiens
gtgctactacacatcaggactt

SEQ ID NO: 7300804 - DNA, 22 bp, Homo sapiens
gtgctactagtttcatttttca

SEQ ID NO: 7300805 - DNA, 22 bp, Homo sapiens
gtggaaggtgctagaacaagga

SEQ ID NO: 7300806 - DNA, 22 bp, Homo sapiens
gtgcgggcctgggggtttctct

SEQ ID NO: 7300807 - DNA, 22 bp, Homo sapiens
gtgcgtcctgggggctgggtcg

SEQ ID NO: 7300808 - DNA, 22 bp, Homo sapiens
gtgcgtatgcatgtgaatacgt

SEQ ID NO: 7300809 - DNA, 22 bp, Homo sapiens
gtgcgtgaggcccctgagcgaa

SEQ ID NO: 7300810 - DNA, 22 bp, Homo sapiens
gtgctaaatattgtgtttgtct

SEQ ID NO: 7300811 - DNA, 22 bp, Homo sapiens
gtgcgtgtgcctatcaataaag

SEQ ID NO: 7300812 - DNA, 22 bp, Homo sapiens
gtgacagatttgctgcgcatgg

SEQ ID NO: 7300813 - DNA, 22 bp, Homo sapiens
gtgacagagattaatagcttgg

SEQ ID NO: 7300814 - DNA, 22 bp, Homo sapiens
gtgacaaaaacactgattattt

SEQ ID NO: 7300815 - DNA, 22 bp, Homo sapiens
gtctggggtactttcatctgat

SEQ ID NO: 7300816 - DNA, 22 bp, Homo sapiens
gtgcctgccccactcctcagca

SEQ ID NO: 7300817 - DNA, 22 bp, Homo sapiens
gtgcctgccccactcctcagca

SEQ ID NO: 7300818 - DNA, 22 bp, Homo sapiens
gtgcctgctacctgacttgttt

SEQ ID NO: 7300819 - DNA, 22 bp, Homo sapiens
gtgcctgctgcagagtcgctgt

SEQ ID NO: 7300820 - DNA, 22 bp, Homo sapiens
gtgcctgctgcagctgagcagt

SEQ ID NO: 7300821 - DNA, 22 bp, Homo sapiens
gtgacatttttactgatgagag

SEQ ID NO: 7300822 - DNA, 22 bp, Homo sapiens
gtgacatttcccatcagtatcc

SEQ ID NO: 7300823 - DNA, 22 bp, Homo sapiens
gtgacattcaggatatcaatgg

SEQ ID NO: 7300824 - DNA, 22 bp, Homo sapiens
gtgacatccgctgacatcgcca

SEQ ID NO: 7300825 - DNA, 22 bp, Homo sapiens
gtgacattgctaggaacagatt

SEQ ID NO: 7300826 - DNA, 22 bp, Homo sapiens
tcttctgttaccacagcgatga

SEQ ID NO: 7300827 - DNA, 22 bp, Homo sapiens
tcttctccagttcatcctacca

SEQ ID NO: 7300828 - DNA, 22 bp, Homo sapiens
tcttctccagttcatcctacca

SEQ ID NO: 7300829 - DNA, 22 bp, Homo sapiens
tcttctttgaatcatagtgacc

SEQ ID NO: 7300830 - DNA, 22 bp, Homo sapiens
tcttctttatgtcatatgccag

SEQ ID NO: 7300831 - DNA, 22 bp, Homo sapiens
tcttctttttgtcccacagaat

SEQ ID NO: 7300832 - DNA, 22 bp, Homo sapiens
tcttgaaagcattttcttcatc

SEQ ID NO: 7300833 - DNA, 22 bp, Homo sapiens
tcttgaaagcattttcttcatc

SEQ ID NO: 7300834 - DNA, 21 bp, Homo sapiens
tcttgaaaagttagattctct

SEQ ID NO: 7300835 - DNA, 21 bp, Homo sapiens
tcttgaaaagttagattctct

SEQ ID NO: 7300836 - DNA, 21 bp, Homo sapiens
tcttcctgacatatgcaaggc

SEQ ID NO: 7300837 - DNA, 21 bp, Homo sapiens
tcttcctgctccacactcccc

SEQ ID NO: 7300838 - DNA, 23 bp, Homo sapiens
tcttcctgaactatcaggcacat

SEQ ID NO: 7300839 - DNA, 22 bp, Homo sapiens
tcttcctgaaaccctgttccag

SEQ ID NO: 7300840 - DNA, 22 bp, Homo sapiens
tcttcctctctaattgatcaga

SEQ ID NO: 7300841 - DNA, 22 bp, Homo sapiens
tcttcctttcattcatgtgtta

SEQ ID NO: 7300842 - DNA, 22 bp, Homo sapiens
tcttcctggcattgatgctgca

SEQ ID NO: 7300843 - DNA, 22 bp, Homo sapiens
tcttcctggtttctgggccatc

SEQ ID NO: 7300844 - DNA, 22 bp, Homo sapiens
tcttcctgcttggtgtgtctgg

SEQ ID NO: 7300845 - DNA, 22 bp, Homo sapiens
tcttcctgctttggtgaggctt

SEQ ID NO: 7300846 - DNA, 22 bp, Homo sapiens
tcttcaaatgctagtaatatca

SEQ ID NO: 7300847 - DNA, 22 bp, Homo sapiens
tcttcaaatgctagtaatatca

SEQ ID NO: 7300848 - DNA, 22 bp, Homo sapiens
tcttcaaatcctacagtgtctg

SEQ ID NO: 7300849 - DNA, 22 bp, Homo sapiens
tcttcaaatgagtgtggattat

SEQ ID NO: 7300850 - DNA, 22 bp, Homo sapiens
tcttcaaatacagtcatattga

SEQ ID NO: 7300851 - DNA, 22 bp, Homo sapiens
tcttattcttttaaacaacgca

SEQ ID NO: 7300852 - DNA, 22 bp, Homo sapiens
tcttattggtaatgatggcatt

SEQ ID NO: 7300853 - DNA, 22 bp, Homo sapiens
tcttatgataatatcactacca

SEQ ID NO: 7300854 - DNA, 22 bp, Homo sapiens
tcttatgtcaagaatgaatatt

SEQ ID NO: 7300855 - DNA, 22 bp, Homo sapiens
tcttattgtttaaaagtacaca

SEQ ID NO: 7300856 - DNA, 22 bp, Homo sapiens
tcttcaaagaattttagtaatt

SEQ ID NO: 7300857 - DNA, 22 bp, Homo sapiens
tcttcaaagaattttagtaatt

SEQ ID NO: 7300858 - DNA, 22 bp, Homo sapiens
tcttcaaatacagtcatattga

SEQ ID NO: 7300859 - DNA, 22 bp, Homo sapiens
tcttcaaagcatatgcaggcat

SEQ ID NO: 7300860 - DNA, 22 bp, Homo sapiens
tcttcaaaaatacaggttttca

SEQ ID NO: 7300861 - DNA, 22 bp, Homo sapiens
tcttcaaagaagccttggatta

SEQ ID NO: 7300862 - DNA, 22 bp, Homo sapiens
tcttcaaactgaaaatttagaa

SEQ ID NO: 7300863 - DNA, 22 bp, Homo sapiens
tcttcaaaaactgcaccttgct

SEQ ID NO: 7300864 - DNA, 22 bp, Homo sapiens
tcttcaaaaaatatccatcagt

SEQ ID NO: 7300865 - DNA, 22 bp, Homo sapiens
tcttcaaaccctggctcttcct

SEQ ID NO: 7300866 - DNA, 22 bp, Homo sapiens
tcttcaaaccctggttttgtga

SEQ ID NO: 7300867 - DNA, 22 bp, Homo sapiens
tcttcaaaattgattggagaag

SEQ ID NO: 7300868 - DNA, 22 bp, Homo sapiens
tcttcaaaatattccatccatt

SEQ ID NO: 7300869 - DNA, 22 bp, Homo sapiens
tcttccagaagtgttttcagaa

SEQ ID NO: 7300870 - DNA, 22 bp, Homo sapiens
tcttccaaggtgcagatcttct

SEQ ID NO: 7300871 - DNA, 22 bp, Homo sapiens
tcttccaaatgcagctaaagct

SEQ ID NO: 7300872 - DNA, 22 bp, Homo sapiens
tcttccaaatgaatatggtttt

SEQ ID NO: 7300873 - DNA, 22 bp, Homo sapiens
tcttcattttgaagaggcagaa

SEQ ID NO: 7300874 - DNA, 18 bp, Homo sapiens
tcttcatctcctgagctg

SEQ ID NO: 7300875 - DNA, 22 bp, Homo sapiens
tcttcagctctgaggctctggc

SEQ ID NO: 7300876 - DNA, 22 bp, Homo sapiens
tcttcagctgtagtcattgttc

SEQ ID NO: 7300877 - DNA, 22 bp, Homo sapiens
tcttcagcagggcctctctgag

SEQ ID NO: 7300878 - DNA, 21 bp, Homo sapiens
tcttcagtacacttgcacgcc

SEQ ID NO: 7300879 - DNA, 22 bp, Homo sapiens
tcttcagtaggtcctcagaatc

SEQ ID NO: 7300880 - DNA, 22 bp, Homo sapiens
tcttcagtgcacctgatgtctt

SEQ ID NO: 7300881 - DNA, 23 bp, Homo sapiens
tcttcagtgagaccagcaaggcc

SEQ ID NO: 7300882 - DNA, 22 bp, Homo sapiens
tcttcagtgcatgccctcaggc

SEQ ID NO: 7300883 - DNA, 22 bp, Homo sapiens
tctttgatgggagatctgagag

SEQ ID NO: 7300884 - DNA, 22 bp, Homo sapiens
tctttgatacagatgtaagctg

SEQ ID NO: 7300885 - DNA, 22 bp, Homo sapiens
tctttgatcagcctttcactga

SEQ ID NO: 7300886 - DNA, 22 bp, Homo sapiens
tctttgatgcttctgaaggtgt

SEQ ID NO: 7300887 - DNA, 22 bp, Homo sapiens
tctttgaatcctttacatctga

SEQ ID NO: 7300888 - DNA, 22 bp, Homo sapiens
tctttgaattcaaactgttcaa

SEQ ID NO: 7300889 - DNA, 22 bp, Homo sapiens
tctttgaattcaaactgttcaa

SEQ ID NO: 7300890 - DNA, 22 bp, Homo sapiens
tctttgaactttttgtaagtta

SEQ ID NO: 7300891 - DNA, 22 bp, Homo sapiens
tctttgaagtatcttaaatggt

SEQ ID NO: 7300892 - DNA, 22 bp, Homo sapiens
tctttgaagttgaagtagttgg

SEQ ID NO: 7300893 - DNA, 22 bp, Homo sapiens
tctttgaatcctttacatctga

SEQ ID NO: 7300894 - DNA, 22 bp, Homo sapiens
tctttgaactctgtgtattaac

SEQ ID NO: 7300895 - DNA, 21 bp, Homo sapiens
tctttctgaaatctcagtctg

SEQ ID NO: 7300896 - DNA, 22 bp, Homo sapiens
tctttcctagaggctgatgagt

SEQ ID NO: 7300897 - DNA, 22 bp, Homo sapiens
tctttctacattttatatgctt

SEQ ID NO: 7300898 - DNA, 22 bp, Homo sapiens
tctttccttagaataattcttt

SEQ ID NO: 7300899 - DNA, 20 bp, Homo sapiens
tctttagatttatcttatgt

SEQ ID NO: 7300900 - DNA, 20 bp, Homo sapiens
tctttagatttatcttatgt

SEQ ID NO: 7300901 - DNA, 20 bp, Homo sapiens
tctttagatttatcttatgt

SEQ ID NO: 7300902 - DNA, 22 bp, Homo sapiens
tctttataaaagtcattatgtc

SEQ ID NO: 7300903 - DNA, 22 bp, Homo sapiens
tctttataaaagtcattatgtc

SEQ ID NO: 7300904 - DNA, 22 bp, Homo sapiens
tctttattgctactggtttgtc

SEQ ID NO: 7300905 - DNA, 22 bp, Homo sapiens
tctttatgcacataaagaaact

SEQ ID NO: 7300906 - DNA, 22 bp, Homo sapiens
tctttccatggccacacagtct

SEQ ID NO: 7300907 - DNA, 22 bp, Homo sapiens
tctttccatggccacacagtct

SEQ ID NO: 7300908 - DNA, 22 bp, Homo sapiens
tctttcaatgtgaaaccatgta

SEQ ID NO: 7300909 - DNA, 22 bp, Homo sapiens
tctttatttaagtctgttgtaa

SEQ ID NO: 7300910 - DNA, 22 bp, Homo sapiens
tctttcaatgagcattctttcc

SEQ ID NO: 7300911 - DNA, 22 bp, Homo sapiens
tctttcaatgagcattctttcc

SEQ ID NO: 7300912 - DNA, 22 bp, Homo sapiens
tctttaatgtgattgtaattat

SEQ ID NO: 7300913 - DNA, 21 bp, Homo sapiens
tcttggggaggagggctgcac

SEQ ID NO: 7300914 - DNA, 21 bp, Homo sapiens
tctttacatttgcctcttgca

SEQ ID NO: 7300915 - DNA, 22 bp, Homo sapiens
tctttagaaacttttcttcatg

SEQ ID NO: 7300916 - DNA, 22 bp, Homo sapiens
tcttgggagtcccaggacatag

SEQ ID NO: 7300917 - DNA, 22 bp, Homo sapiens
tcttgacaactatactacttac

SEQ ID NO: 7300918 - DNA, 22 bp, Homo sapiens
tcttgattggttgtatagctac

SEQ ID NO: 7300919 - DNA, 19 bp, Homo sapiens
tcttgcttcttcatccctc

SEQ ID NO: 7300920 - DNA, 22 bp, Homo sapiens
tcttggcaggcagtggggtaag

SEQ ID NO: 7300921 - DNA, 22 bp, Homo sapiens
tctgtaaagatgtttatacctt

SEQ ID NO: 7300922 - DNA, 20 bp, Homo sapiens
tctgtaattatgccatcact

SEQ ID NO: 7300923 - DNA, 22 bp, Homo sapiens
tctgtaaatctactaagagctc

SEQ ID NO: 7300924 - DNA, 20 bp, Homo sapiens
tctgtacactcatcttctgc

SEQ ID NO: 7300925 - DNA, 22 bp, Homo sapiens
tctgtagtaggttgtagttctt

SEQ ID NO: 7300926 - DNA, 22 bp, Homo sapiens
tctgtaggggccggcggagccc

SEQ ID NO: 7300927 - DNA, 22 bp, Homo sapiens
tctgtagggtagtagtggagat

SEQ ID NO: 7300928 - DNA, 22 bp, Homo sapiens
tctgtatttatgttggtggtgc

SEQ ID NO: 7300929 - DNA, 22 bp, Homo sapiens
tctgtcacatacacttttcagg

SEQ ID NO: 7300930 - DNA, 22 bp, Homo sapiens
tctgtcacccaggctggagtgc

SEQ ID NO: 7300931 - DNA, 22 bp, Homo sapiens
tctggggatggtctactttctg

SEQ ID NO: 7300932 - DNA, 22 bp, Homo sapiens
tctggggatgagtgatgtcgta

SEQ ID NO: 7300933 - DNA, 22 bp, Homo sapiens
tctgggggcgaccagggactgc

SEQ ID NO: 7300934 - DNA, 22 bp, Homo sapiens
tctgtaaaattagtataattgt

SEQ ID NO: 7300935 - DNA, 22 bp, Homo sapiens
tctgtaaaacaatattgtattc

SEQ ID NO: 7300936 - DNA, 22 bp, Homo sapiens
tctgggttgggttcctggaatt

SEQ ID NO: 7300937 - DNA, 23 bp, Homo sapiens
tctgggttctaatcatgtgtgat

SEQ ID NO: 7300938 - DNA, 21 bp, Homo sapiens
tctgggtgctagtgtttgctt

SEQ ID NO: 7300939 - DNA, 22 bp, Homo sapiens
tctgggtggcagtgatggcgtg

SEQ ID NO: 7300940 - DNA, 22 bp, Homo sapiens
tctgggtgaccctgggcaaggc

SEQ ID NO: 7300941 - DNA, 22 bp, Homo sapiens
tctgggtgccctttgctctgtt

SEQ ID NO: 7300942 - DNA, 22 bp, Homo sapiens
tctgggtgccactgtctgtaca

SEQ ID NO: 7300943 - DNA, 22 bp, Homo sapiens
tctggggtgcagcctggacata

SEQ ID NO: 7300944 - DNA, 22 bp, Homo sapiens
tctgggtaataggaagtgcagt

SEQ ID NO: 7300945 - DNA, 22 bp, Homo sapiens
tctggggttggtgcttacacca

SEQ ID NO: 7300946 - DNA, 22 bp, Homo sapiens
tctggggttaagcccaggaatg

SEQ ID NO: 7300947 - DNA, 22 bp, Homo sapiens
tctgtgcggtctgtgttatgaa

SEQ ID NO: 7300948 - DNA, 20 bp, Homo sapiens
tctgtgcattgcctgctggt

SEQ ID NO: 7300949 - DNA, 22 bp, Homo sapiens
tctgtgcagttcttgtcttgac

SEQ ID NO: 7300950 - DNA, 22 bp, Homo sapiens
tctgtgaaaggaaagaactgac

SEQ ID NO: 7300951 - DNA, 22 bp, Homo sapiens
tctgtctgagggagtgacattt

SEQ ID NO: 7300952 - DNA, 18 bp, Homo sapiens
tctgtggagagggcagtt

SEQ ID NO: 7300953 - DNA, 21 bp, Homo sapiens
tctgtgcttttttggctccta

SEQ ID NO: 7300954 - DNA, 22 bp, Homo sapiens
tctgtggagttgaggaaggttg

SEQ ID NO: 7300955 - DNA, 22 bp, Homo sapiens
tctgtggctggtaattgcatgt

SEQ ID NO: 7300956 - DNA, 19 bp, Homo sapiens
tctgtgctgggaggcagca

SEQ ID NO: 7300957 - DNA, 21 bp, Homo sapiens
tctgtgctgccgtcaacatcc

SEQ ID NO: 7300958 - DNA, 22 bp, Homo sapiens
tctgtgctgccatcctgtggcc

SEQ ID NO: 7300959 - DNA, 22 bp, Homo sapiens
tctgtgctcaagttctgcctct

SEQ ID NO: 7300960 - DNA, 22 bp, Homo sapiens
tctgtgtaagaccagtgctggg

SEQ ID NO: 7300961 - DNA, 22 bp, Homo sapiens
tctgtgtacgcaggcgtgcgcg

SEQ ID NO: 7300962 - DNA, 23 bp, Homo sapiens
tctgtgtcctcctggaccacaga

SEQ ID NO: 7300963 - DNA, 23 bp, Homo sapiens
tctgtgtagccaggtctggaggg

SEQ ID NO: 7300964 - DNA, 22 bp, Homo sapiens
tctgtgtatagggttgtgcgct

SEQ ID NO: 7300965 - DNA, 23 bp, Homo sapiens
tctgtgtctccacccaaatctca

SEQ ID NO: 7300966 - DNA, 22 bp, Homo sapiens
tctgtgtgcccacctgacacct

SEQ ID NO: 7300967 - DNA, 22 bp, Homo sapiens
tctgtgtgaccataagccagct

SEQ ID NO: 7300968 - DNA, 22 bp, Homo sapiens
tctgtgtggtagtttcagtgaa

SEQ ID NO: 7300969 - DNA, 22 bp, Homo sapiens
tctgtgtggtagtttcagtgaa

SEQ ID NO: 7300970 - DNA, 22 bp, Homo sapiens
tctgtgtggtagtttcagtgaa

SEQ ID NO: 7300971 - DNA, 22 bp, Homo sapiens
tctgtgtgggatagtttgagga

SEQ ID NO: 7300972 - DNA, 22 bp, Homo sapiens
tctgtgtgggatagtttgagga

SEQ ID NO: 7300973 - DNA, 22 bp, Homo sapiens
tctgtgtgccctaaagcctgct

SEQ ID NO: 7300974 - DNA, 22 bp, Homo sapiens
tctgttagctgtcaaagtgttt

SEQ ID NO: 7300975 - DNA, 22 bp, Homo sapiens
tctgttaacctggtcttggctt

SEQ ID NO: 7300976 - DNA, 18 bp, Homo sapiens
tctgtgttctgtcattgc

SEQ ID NO: 7300977 - DNA, 22 bp, Homo sapiens
tctgtgtttaaaagatatgtcc

SEQ ID NO: 7300978 - DNA, 22 bp, Homo sapiens
tctgtgttgataattttggaga

SEQ ID NO: 7300979 - DNA, 22 bp, Homo sapiens
tctgtgttgagaaggatcatga

SEQ ID NO: 7300980 - DNA, 22 bp, Homo sapiens
tctgtgttgagaaggatcatga

SEQ ID NO: 7300981 - DNA, 22 bp, Homo sapiens
tctgtgttttaaacagtagaaa

SEQ ID NO: 7300982 - DNA, 22 bp, Homo sapiens
tctgtgttttgtgcctactgct

SEQ ID NO: 7300983 - DNA, 22 bp, Homo sapiens
tctgtgtttgccatccttgctc

SEQ ID NO: 7300984 - DNA, 20 bp, Homo sapiens
tctgtgtttcagctgcttga

SEQ ID NO: 7300985 - DNA, 22 bp, Homo sapiens
tctgttgactcctagcagccat

SEQ ID NO: 7300986 - DNA, 22 bp, Homo sapiens
tctgttgcaatgtgcatggtga

SEQ ID NO: 7300987 - DNA, 22 bp, Homo sapiens
tctgttgtctgcaattctggga

SEQ ID NO: 7300988 - DNA, 22 bp, Homo sapiens
tctgtttttgaggctatcttct

SEQ ID NO: 7300989 - DNA, 22 bp, Homo sapiens
tctgttttgtaccagatacagc

SEQ ID NO: 7300990 - DNA, 22 bp, Homo sapiens
tcttaaagcttacttcaattgt

SEQ ID NO: 7300991 - DNA, 22 bp, Homo sapiens
tcttaaactttgctgtaattct

SEQ ID NO: 7300992 - DNA, 22 bp, Homo sapiens
tcttaaaccacacatgtgctct

SEQ ID NO: 7300993 - DNA, 22 bp, Homo sapiens
tctgtttgctggtgcatgggtt

SEQ ID NO: 7300994 - DNA, 23 bp, Homo sapiens
tctgttttgcaacatgtgacaag

SEQ ID NO: 7300995 - DNA, 22 bp, Homo sapiens
tcttataatctctattttaatg

SEQ ID NO: 7300996 - DNA, 22 bp, Homo sapiens
tcttatacccctaaactgcagc

SEQ ID NO: 7300997 - DNA, 22 bp, Homo sapiens
tcttaaatgactgataagagga

SEQ ID NO: 7300998 - DNA, 20 bp, Homo sapiens
tcttaaatccccagggccat

SEQ ID NO: 7300999 - DNA, 22 bp, Homo sapiens
tcttaacagtgctacagagcag

SEQ ID NO: 7301000 - DNA, 22 bp, Homo sapiens
tctgcagctttcccctgattta

SEQ ID NO: 7301001 - DNA, 22 bp, Homo sapiens
tctgcagaaactgtgactatgt

SEQ ID NO: 7301002 - DNA, 22 bp, Homo sapiens
tctgcatggagaggagatgcta

SEQ ID NO: 7301003 - DNA, 22 bp, Homo sapiens
tctgcatggagaggagatgcta

SEQ ID NO: 7301004 - DNA, 22 bp, Homo sapiens
tctgcatattgttaatggaatg

SEQ ID NO: 7301005 - DNA, 22 bp, Homo sapiens
tctgcccacagcctcctgtcca

SEQ ID NO: 7301006 - DNA, 22 bp, Homo sapiens
tctgctcagccgatctgctccg

SEQ ID NO: 7301007 - DNA, 22 bp, Homo sapiens
tctgccttgatggcattgagaa

SEQ ID NO: 7301008 - DNA, 22 bp, Homo sapiens
tctgcctgttgagcctaaggcc

SEQ ID NO: 7301009 - DNA, 22 bp, Homo sapiens
tctgcctgttcccgattccatg

SEQ ID NO: 7301010 - DNA, 22 bp, Homo sapiens
tctgcctgttgctagaatgtca

SEQ ID NO: 7301011 - DNA, 20 bp, Homo sapiens
tctgccttagggggagcctc

SEQ ID NO: 7301012 - DNA, 22 bp, Homo sapiens
tctgcctgtggatacatgctct

SEQ ID NO: 7301013 - DNA, 22 bp, Homo sapiens
tctgcctgtctccttgaattgt

SEQ ID NO: 7301014 - DNA, 22 bp, Homo sapiens
tctgcctgtgctgtgttttcat

SEQ ID NO: 7301015 - DNA, 22 bp, Homo sapiens
tctgcctgtggtggaggaagtt

SEQ ID NO: 7301016 - DNA, 22 bp, Homo sapiens
tctgcctgttcaagtcttctag

SEQ ID NO: 7301017 - DNA, 22 bp, Homo sapiens
tctgcctgttcccgattccatg

SEQ ID NO: 7301018 - DNA, 22 bp, Homo sapiens
tctgcctgctaactcctgcacc

SEQ ID NO: 7301019 - DNA, 22 bp, Homo sapiens
tctgcctgcggctgcaggtggc

SEQ ID NO: 7301020 - DNA, 22 bp, Homo sapiens
tctgcctggatgatggcagggc

SEQ ID NO: 7301021 - DNA, 22 bp, Homo sapiens
tctgcctggaccctggtgagct

SEQ ID NO: 7301022 - DNA, 22 bp, Homo sapiens
tctgcctggaccctggtgagct

SEQ ID NO: 7301023 - DNA, 22 bp, Homo sapiens
tctgcctggagagttcttctct

SEQ ID NO: 7301024 - DNA, 22 bp, Homo sapiens
tctgcctgctgcctgggggctc

SEQ ID NO: 7301025 - DNA, 22 bp, Homo sapiens
tctgcctgcttcttcatagtct

SEQ ID NO: 7301026 - DNA, 19 bp, Homo sapiens
tctgcctgcttgtaggggc

SEQ ID NO: 7301027 - DNA, 19 bp, Homo sapiens
tctgcctgcttgtaggggc

SEQ ID NO: 7301028 - DNA, 22 bp, Homo sapiens
tctgcctggcggactcccggaa

SEQ ID NO: 7301029 - DNA, 22 bp, Homo sapiens
tctgcctggctcatggcagtga

SEQ ID NO: 7301030 - DNA, 22 bp, Homo sapiens
tctgcctgggtgtggagcagag

SEQ ID NO: 7301031 - DNA, 22 bp, Homo sapiens
tctgcctgtacctcttttttgc

SEQ ID NO: 7301032 - DNA, 22 bp, Homo sapiens
tctgcctgtagtcccacacctc

SEQ ID NO: 7301033 - DNA, 22 bp, Homo sapiens
tctgcctgtaatatttggagaa

SEQ ID NO: 7301034 - DNA, 22 bp, Homo sapiens
tctgcctggattccattctcca

SEQ ID NO: 7301035 - DNA, 22 bp, Homo sapiens
tctgcctggcctggagggcaca

SEQ ID NO: 7301036 - DNA, 22 bp, Homo sapiens
tctgcctggattttggaaagct

SEQ ID NO: 7301037 - DNA, 18 bp, Homo sapiens
tctgcctgcagggcatct

SEQ ID NO: 7301038 - DNA, 22 bp, Homo sapiens
tctgcctgaggactgacaccag

SEQ ID NO: 7301039 - DNA, 22 bp, Homo sapiens
tctgcctgagggagctgaggaa

SEQ ID NO: 7301040 - DNA, 22 bp, Homo sapiens
tctgcctgccagtctggtcctc

SEQ ID NO: 7301041 - DNA, 22 bp, Homo sapiens
tctgcctgcagtgtggcagggc

SEQ ID NO: 7301042 - DNA, 22 bp, Homo sapiens
tctgcctgcgctcacggggccg

SEQ ID NO: 7301043 - DNA, 22 bp, Homo sapiens
tctgcctgccgagaacacctac

SEQ ID NO: 7301044 - DNA, 22 bp, Homo sapiens
tctgccctgccattcactggaa

SEQ ID NO: 7301045 - DNA, 22 bp, Homo sapiens
tctgccctgcagggagcagtaa

SEQ ID NO: 7301046 - DNA, 22 bp, Homo sapiens
tctgccgtgcgaggtcccacca

SEQ ID NO: 7301047 - DNA, 22 bp, Homo sapiens
tctgcctgagcagagggaggcc

SEQ ID NO: 7301048 - DNA, 21 bp, Homo sapiens
tctgcctgagactttgctggt

SEQ ID NO: 7301049 - DNA, 22 bp, Homo sapiens
tctgccctcattgctgcctgga

SEQ ID NO: 7301050 - DNA, 21 bp, Homo sapiens
tctgccctccaggagctcata

SEQ ID NO: 7301051 - DNA, 22 bp, Homo sapiens
tctgacaggtcattttctatag

SEQ ID NO: 7301052 - DNA, 22 bp, Homo sapiens
tctgagaagcaccttctggaca

SEQ ID NO: 7301053 - DNA, 17 bp, Homo sapiens
tctgagaaaggagaatc

SEQ ID NO: 7301054 - DNA, 22 bp, Homo sapiens
tctgagaaaataggaaacttga

SEQ ID NO: 7301055 - DNA, 22 bp, Homo sapiens
tctgagaagctagaggacaaag

SEQ ID NO: 7301056 - DNA, 22 bp, Homo sapiens
tctgaggaaaagaggaggtagc

SEQ ID NO: 7301057 - DNA, 22 bp, Homo sapiens
tctgaggaagcagcaggaagtg

SEQ ID NO: 7301058 - DNA, 22 bp, Homo sapiens
tctgaggaataagaaggaagtg

SEQ ID NO: 7301059 - DNA, 22 bp, Homo sapiens
tctgagggttgtagagagggac

SEQ ID NO: 7301060 - DNA, 22 bp, Homo sapiens
tctgagggtgggagaaggagct

SEQ ID NO: 7301061 - DNA, 22 bp, Homo sapiens
tctgcaaacccccatctatcat

SEQ ID NO: 7301062 - DNA, 22 bp, Homo sapiens
tctgatttatatatgcagatac

SEQ ID NO: 7301063 - DNA, 22 bp, Homo sapiens
tctgattacttgagttatttag

SEQ ID NO: 7301064 - DNA, 22 bp, Homo sapiens
tctgattgacctgtgaagcagc

SEQ ID NO: 7301065 - DNA, 22 bp, Homo sapiens
tctgatatttgaagaccattag

SEQ ID NO: 7301066 - DNA, 22 bp, Homo sapiens
tctgatattggggtcagagtag

SEQ ID NO: 7301067 - DNA, 22 bp, Homo sapiens
tctgatatttcattcaaaagta

SEQ ID NO: 7301068 - DNA, 21 bp, Homo sapiens
tctgatggtagatgagatgtg

SEQ ID NO: 7301069 - DNA, 21 bp, Homo sapiens
tctgatggtagatgagatgtg

SEQ ID NO: 7301070 - DNA, 22 bp, Homo sapiens
tctgatgtaggcttttctggga

SEQ ID NO: 7301071 - DNA, 22 bp, Homo sapiens
tctggcagttccttgttgatat

SEQ ID NO: 7301072 - DNA, 22 bp, Homo sapiens
tctggcaggttcccatgttatg

SEQ ID NO: 7301073 - DNA, 22 bp, Homo sapiens
tctggcagtgaagtcatgaggt

SEQ ID NO: 7301074 - DNA, 22 bp, Homo sapiens
tctggcagcaagataacaatgg

SEQ ID NO: 7301075 - DNA, 22 bp, Homo sapiens
tctggaggggtttagagggaca

SEQ ID NO: 7301076 - DNA, 22 bp, Homo sapiens
tctggagttgaagttcttcccc

SEQ ID NO: 7301077 - DNA, 22 bp, Homo sapiens
tctggagttactgctggctttg

SEQ ID NO: 7301078 - DNA, 22 bp, Homo sapiens
tctggagtgtccagttctactc

SEQ ID NO: 7301079 - DNA, 22 bp, Homo sapiens
tctggatctccctcatcctggg

SEQ ID NO: 7301080 - DNA, 22 bp, Homo sapiens
tctggattgtggctattgttct

SEQ ID NO: 7301081 - DNA, 22 bp, Homo sapiens
tctggactataggctgccaagt

SEQ ID NO: 7301082 - DNA, 22 bp, Homo sapiens
tctggagaggaggatgtggaca

SEQ ID NO: 7301083 - DNA, 22 bp, Homo sapiens
tctggagaagcccagggagctg

SEQ ID NO: 7301084 - DNA, 22 bp, Homo sapiens
tctgctgtaaccttcagaggta

SEQ ID NO: 7301085 - DNA, 22 bp, Homo sapiens
tctgctgtaaagaatttctgcc

SEQ ID NO: 7301086 - DNA, 22 bp, Homo sapiens
tctgctgtacttttggtctgtt

SEQ ID NO: 7301087 - DNA, 22 bp, Homo sapiens
tctgctgtaaagaatttctgcc

SEQ ID NO: 7301088 - DNA, 22 bp, Homo sapiens
tctgctgtgttgaatgattggt

SEQ ID NO: 7301089 - DNA, 22 bp, Homo sapiens
tctgctgtgtcccctgtgcggg

SEQ ID NO: 7301090 - DNA, 22 bp, Homo sapiens
tctgctgtgtcccctgtgcggg

SEQ ID NO: 7301091 - DNA, 22 bp, Homo sapiens
tctgctgtgtccctggtctcct

SEQ ID NO: 7301092 - DNA, 22 bp, Homo sapiens
tctgctgttcattcttttagct

SEQ ID NO: 7301093 - DNA, 22 bp, Homo sapiens
tctgctgttctcatgctgattt

SEQ ID NO: 7301094 - DNA, 22 bp, Homo sapiens
tctgctgttgagcacaagtgaa

SEQ ID NO: 7301095 - DNA, 22 bp, Homo sapiens
tctgctgttgccatgagtaata

SEQ ID NO: 7301096 - DNA, 22 bp, Homo sapiens
tctgctgtgaaaggtgaatatt

SEQ ID NO: 7301097 - DNA, 22 bp, Homo sapiens
tctgctgtctgattcccacttc

SEQ ID NO: 7301098 - DNA, 22 bp, Homo sapiens
tctgctgtcttttctgggtgag

SEQ ID NO: 7301099 - DNA, 22 bp, Homo sapiens
tctgctgtcctttatatagatt

SEQ ID NO: 7301100 - DNA, 22 bp, Homo sapiens
tctgctgtctatgcaagtcctt

SEQ ID NO: 7301101 - DNA, 22 bp, Homo sapiens
tctgctgtcactcatttgcttc

SEQ ID NO: 7301102 - DNA, 22 bp, Homo sapiens
tctgctgtcccgagggccactt

SEQ ID NO: 7301103 - DNA, 22 bp, Homo sapiens
tctgctgtattaggttgaactg

SEQ ID NO: 7301104 - DNA, 22 bp, Homo sapiens
tctgctgtgggcagagacccct

SEQ ID NO: 7301105 - DNA, 22 bp, Homo sapiens
tctgctgtgatttgctacctgt

SEQ ID NO: 7301106 - DNA, 22 bp, Homo sapiens
tctgctgtgggtctatatttta

SEQ ID NO: 7301107 - DNA, 22 bp, Homo sapiens
tctgctgtgattctactagtgt

SEQ ID NO: 7301108 - DNA, 22 bp, Homo sapiens
tctgctgtgaggaggcaggatg

SEQ ID NO: 7301109 - DNA, 22 bp, Homo sapiens
tctgctctgtggcttcagctaa

SEQ ID NO: 7301110 - DNA, 22 bp, Homo sapiens
tctgctctgtggcttcagctaa

SEQ ID NO: 7301111 - DNA, 22 bp, Homo sapiens
tctgctctgggccagctattaa

SEQ ID NO: 7301112 - DNA, 22 bp, Homo sapiens
tctgctctgtactgcactggcc

SEQ ID NO: 7301113 - DNA, 17 bp, Homo sapiens
tctgctctgccaatcca

SEQ ID NO: 7301114 - DNA, 23 bp, Homo sapiens
tctgctctgaagttcggctgagc

SEQ ID NO: 7301115 - DNA, 22 bp, Homo sapiens
tctgctctgagagggccatcag

SEQ ID NO: 7301116 - DNA, 22 bp, Homo sapiens
tctgctgaatcagatagctaag

SEQ ID NO: 7301117 - DNA, 22 bp, Homo sapiens
tctgctgacatttatgaataga

SEQ ID NO: 7301118 - DNA, 22 bp, Homo sapiens
tctgctgagatgcccatggtta

SEQ ID NO: 7301119 - DNA, 22 bp, Homo sapiens
tctgctgaggtggttttagaga

SEQ ID NO: 7301120 - DNA, 22 bp, Homo sapiens
tctgctgaggccttcccactcc

SEQ ID NO: 7301121 - DNA, 22 bp, Homo sapiens
tctgctgagtaccgccatgtct

SEQ ID NO: 7301122 - DNA, 22 bp, Homo sapiens
tctgctgcctcggtgtgggtac

SEQ ID NO: 7301123 - DNA, 22 bp, Homo sapiens
tctggctgattccctgggactg

SEQ ID NO: 7301124 - DNA, 22 bp, Homo sapiens
tctggctgccaccatcctcccc

SEQ ID NO: 7301125 - DNA, 22 bp, Homo sapiens
tctggctggcagtgatggtgtg

SEQ ID NO: 7301126 - DNA, 22 bp, Homo sapiens
tctggctgggaagggggcccga

SEQ ID NO: 7301127 - DNA, 22 bp, Homo sapiens
tctggctggctcggccgggagt

SEQ ID NO: 7301128 - DNA, 22 bp, Homo sapiens
tctggctgtgtatgagagtttt

SEQ ID NO: 7301129 - DNA, 22 bp, Homo sapiens
tctggctgtcattggaggcccc

SEQ ID NO: 7301130 - DNA, 22 bp, Homo sapiens
tctggctgggtgagagcttctc

SEQ ID NO: 7301131 - DNA, 21 bp, Homo sapiens
tctgggaaattgggaaagaag

SEQ ID NO: 7301132 - DNA, 22 bp, Homo sapiens
tctgggaacacacgtcacttca

SEQ ID NO: 7301133 - DNA, 22 bp, Homo sapiens
tctgggaaagtaaatgtaaagg

SEQ ID NO: 7301134 - DNA, 22 bp, Homo sapiens
tctggcttttctcttggatggt

SEQ ID NO: 7301135 - DNA, 22 bp, Homo sapiens
tctgggaaggagcctgagaatt

SEQ ID NO: 7301136 - DNA, 22 bp, Homo sapiens
tctggctgaaattagaaggttc

SEQ ID NO: 7301137 - DNA, 22 bp, Homo sapiens
tctggctgaattagccttgggt

SEQ ID NO: 7301138 - DNA, 22 bp, Homo sapiens
tctggctctaactaggcatcag

SEQ ID NO: 7301139 - DNA, 22 bp, Homo sapiens
tctgggaggtggcagggtgcat

SEQ ID NO: 7301140 - DNA, 21 bp, Homo sapiens
tctgggagtgggaaaatggtc

SEQ ID NO: 7301141 - DNA, 22 bp, Homo sapiens
tctgggagtttctgtgggagct

SEQ ID NO: 7301142 - DNA, 22 bp, Homo sapiens
tctgggagttgtagtccggtgg

SEQ ID NO: 7301143 - DNA, 22 bp, Homo sapiens
tctgggagagtagataaaggaa

SEQ ID NO: 7301144 - DNA, 22 bp, Homo sapiens
tctgggaggggctgccattgct

SEQ ID NO: 7301145 - DNA, 22 bp, Homo sapiens
tctgggagggctggttcagtat

SEQ ID NO: 7301146 - DNA, 22 bp, Homo sapiens
tctgggaggtaaccatgctgat

SEQ ID NO: 7301147 - DNA, 22 bp, Homo sapiens
tctgggaggtactgggaggtgt

SEQ ID NO: 7301148 - DNA, 22 bp, Homo sapiens
tctgggaggtggcagggtgcat

SEQ ID NO: 7301149 - DNA, 22 bp, Homo sapiens
tctgggaggtcacattggtctt

SEQ ID NO: 7301150 - DNA, 22 bp, Homo sapiens
tctgggaatttattggcacttt

SEQ ID NO: 7301151 - DNA, 23 bp, Homo sapiens
tctgggaattggctgtccacagg

SEQ ID NO: 7301152 - DNA, 22 bp, Homo sapiens
tctgggaagtcctctgtcatgc

SEQ ID NO: 7301153 - DNA, 22 bp, Homo sapiens
tctgggaagtgagatgctgtgt

SEQ ID NO: 7301154 - DNA, 22 bp, Homo sapiens
tctgggagagggaaagaagact

SEQ ID NO: 7301155 - DNA, 22 bp, Homo sapiens
tctgggagagctgctgtcagag

SEQ ID NO: 7301156 - DNA, 22 bp, Homo sapiens
tctgggagagctgctgtcagag

SEQ ID NO: 7301157 - DNA, 22 bp, Homo sapiens
tctgggagagcacgtggctgac

SEQ ID NO: 7301158 - DNA, 22 bp, Homo sapiens
tctgggcagaagcagtgcaaag

SEQ ID NO: 7301159 - DNA, 22 bp, Homo sapiens
tctgggcactgctgagcctgta

SEQ ID NO: 7301160 - DNA, 23 bp, Homo sapiens
tctgggcaccttgttgacatgat

SEQ ID NO: 7301161 - DNA, 19 bp, Homo sapiens
tctctgcttctcttggcat

SEQ ID NO: 7301162 - DNA, 22 bp, Homo sapiens
tctctgctaagattgtgtctag

SEQ ID NO: 7301163 - DNA, 19 bp, Homo sapiens
tctctggatgacagacact

SEQ ID NO: 7301164 - DNA, 21 bp, Homo sapiens
tctctggagttagcagagaga

SEQ ID NO: 7301165 - DNA, 20 bp, Homo sapiens
tctctgggttctcactcagc

SEQ ID NO: 7301166 - DNA, 21 bp, Homo sapiens
tctctgggccctcctgtgggg

SEQ ID NO: 7301167 - DNA, 22 bp, Homo sapiens
tctctctgagttgagcaggagt

SEQ ID NO: 7301168 - DNA, 21 bp, Homo sapiens
tctctcctcaagctcgacccc

SEQ ID NO: 7301169 - DNA, 21 bp, Homo sapiens
tctctcctcaagctcgacccc

SEQ ID NO: 7301170 - DNA, 22 bp, Homo sapiens
tctctcctccacaccgggtgct

SEQ ID NO: 7301171 - DNA, 22 bp, Homo sapiens
tctctcctctagtcagggtggt

SEQ ID NO: 7301172 - DNA, 22 bp, Homo sapiens
tctctcctgcactgaattatgt

SEQ ID NO: 7301173 - DNA, 22 bp, Homo sapiens
tctctcctgtgttctgatgttt

SEQ ID NO: 7301174 - DNA, 22 bp, Homo sapiens
tctctccaacatggtggtgctg

SEQ ID NO: 7301175 - DNA, 22 bp, Homo sapiens
tctctgagcacctaagatatat

SEQ ID NO: 7301176 - DNA, 22 bp, Homo sapiens
tctctgagcatgccatattgct

SEQ ID NO: 7301177 - DNA, 22 bp, Homo sapiens
tctctgagctgcttcttgcata

SEQ ID NO: 7301178 - DNA, 22 bp, Homo sapiens
tctctgaaggggagctgtttaa

SEQ ID NO: 7301179 - DNA, 22 bp, Homo sapiens
tctctgaagctcaattgagata

SEQ ID NO: 7301180 - DNA, 22 bp, Homo sapiens
tctctgaaggctgtgttgatgg

SEQ ID NO: 7301181 - DNA, 22 bp, Homo sapiens
tctctctttttaatcatgtaat

SEQ ID NO: 7301182 - DNA, 22 bp, Homo sapiens
tctctgaacttcctggaaaggc

SEQ ID NO: 7301183 - DNA, 22 bp, Homo sapiens
tctctgaagaatcgatgattct

SEQ ID NO: 7301184 - DNA, 22 bp, Homo sapiens
tctgaaatgcaggcaatttgct

SEQ ID NO: 7301185 - DNA, 22 bp, Homo sapiens
tctgaaatagaagtgtctttct

SEQ ID NO: 7301186 - DNA, 22 bp, Homo sapiens
tctgaacagcatggaatcattt

SEQ ID NO: 7301187 - DNA, 22 bp, Homo sapiens
tctgaagccacctctgcttgtc

SEQ ID NO: 7301188 - DNA, 19 bp, Homo sapiens
tctgaagaattagagagca

SEQ ID NO: 7301189 - DNA, 22 bp, Homo sapiens
tctgaaataaatgcactgttag

SEQ ID NO: 7301190 - DNA, 22 bp, Homo sapiens
tctgaaagtctgaaacagtgtc

SEQ ID NO: 7301191 - DNA, 22 bp, Homo sapiens
tctgaaagctagaaaatgctct

SEQ ID NO: 7301192 - DNA, 22 bp, Homo sapiens
tctgaaagcataatttgtccca

SEQ ID NO: 7301193 - DNA, 22 bp, Homo sapiens
tctgaaaactccatgagctcgt

SEQ ID NO: 7301194 - DNA, 22 bp, Homo sapiens
tctcttcttgtgttttcctgcc

SEQ ID NO: 7301195 - DNA, 18 bp, Homo sapiens
tctctttcctcagtggag

SEQ ID NO: 7301196 - DNA, 17 bp, Homo sapiens
tctctttccctttctgc

SEQ ID NO: 7301197 - DNA, 22 bp, Homo sapiens
tctctttctttgtatgtctatt

SEQ ID NO: 7301198 - DNA, 21 bp, Homo sapiens
tctctttctggaagcttccct

SEQ ID NO: 7301199 - DNA, 21 bp, Homo sapiens
tctctgtggcctaccctctac

SEQ ID NO: 7301200 - DNA, 22 bp, Homo sapiens
tctctgtggcaagcatgctgct

SEQ ID NO: 7301201 - DNA, 22 bp, Homo sapiens
tctctgtggagcagtgtgttca

SEQ ID NO: 7301202 - DNA, 20 bp, Homo sapiens
tctcttcaggaggtccatgt

SEQ ID NO: 7301203 - DNA, 22 bp, Homo sapiens
tctcttccttgacctattgtaa

SEQ ID NO: 7301204 - DNA, 19 bp, Homo sapiens
tctcttctccctggtttta

SEQ ID NO: 7301205 - DNA, 22 bp, Homo sapiens
tctcccagaagtcctcagtaca

SEQ ID NO: 7301206 - DNA, 22 bp, Homo sapiens
tctccaggtggcttgggcttct

SEQ ID NO: 7301207 - DNA, 22 bp, Homo sapiens
tctccaggtggggtcacctttt

SEQ ID NO: 7301208 - DNA, 22 bp, Homo sapiens
tctccaggtagatatgtcagga

SEQ ID NO: 7301209 - DNA, 22 bp, Homo sapiens
tctccaggtgaaacttgcaggg

SEQ ID NO: 7301210 - DNA, 22 bp, Homo sapiens
tctccaggtgactctgatgtat

SEQ ID NO: 7301211 - DNA, 22 bp, Homo sapiens
tctccaggtgctaagtgtgcct

SEQ ID NO: 7301212 - DNA, 22 bp, Homo sapiens
tctccaggtaaatggcatcctg

SEQ ID NO: 7301213 - DNA, 22 bp, Homo sapiens
tctccagggtgagctaggccag

SEQ ID NO: 7301214 - DNA, 22 bp, Homo sapiens
tctccaggggcagggtctggag

SEQ ID NO: 7301215 - DNA, 22 bp, Homo sapiens
tctccagggactgaggctggag

SEQ ID NO: 7301216 - DNA, 23 bp, Homo sapiens
tctccaggccttactccaggcct

SEQ ID NO: 7301217 - DNA, 22 bp, Homo sapiens
tctcccaggtcatacacagaga

SEQ ID NO: 7301218 - DNA, 22 bp, Homo sapiens
tctcccaggtgggtgcctggag

SEQ ID NO: 7301219 - DNA, 22 bp, Homo sapiens
tctcccagtcctctgtgcttac

SEQ ID NO: 7301220 - DNA, 22 bp, Homo sapiens
tctcccagtcctctgtgcttac

SEQ ID NO: 7301221 - DNA, 22 bp, Homo sapiens
tctcccaggctggagtgcagtg

SEQ ID NO: 7301222 - DNA, 22 bp, Homo sapiens
tctcccaggcaggagtgcagtg

SEQ ID NO: 7301223 - DNA, 22 bp, Homo sapiens
tctcccattacttatggcccac

SEQ ID NO: 7301224 - DNA, 19 bp, Homo sapiens
tctcccatgcctgtgtcta

SEQ ID NO: 7301225 - DNA, 22 bp, Homo sapiens
tctcccatgaggctgcggtcaa

SEQ ID NO: 7301226 - DNA, 22 bp, Homo sapiens
tctcctgccactgcttcccatt

SEQ ID NO: 7301227 - DNA, 22 bp, Homo sapiens
tctcctggaagtgattcccctg

SEQ ID NO: 7301228 - DNA, 22 bp, Homo sapiens
tctcctggaagaataccacact

SEQ ID NO: 7301229 - DNA, 22 bp, Homo sapiens
tctcctggaagaataccacact

SEQ ID NO: 7301230 - DNA, 22 bp, Homo sapiens
tctcctggagcccagatgctgg

SEQ ID NO: 7301231 - DNA, 22 bp, Homo sapiens
tctcctggatagatactatcca

SEQ ID NO: 7301232 - DNA, 22 bp, Homo sapiens
tctcctggagcaggaaggtggg

SEQ ID NO: 7301233 - DNA, 22 bp, Homo sapiens
tctcctggatggaccttctctt

SEQ ID NO: 7301234 - DNA, 22 bp, Homo sapiens
tctcctggcatgtgggtcatct

SEQ ID NO: 7301235 - DNA, 22 bp, Homo sapiens
tctcctggccctgtcgccatct

SEQ ID NO: 7301236 - DNA, 22 bp, Homo sapiens
tctcctggcatttggttgagta

SEQ ID NO: 7301237 - DNA, 22 bp, Homo sapiens
tctcctggcatgtgggtcatct

SEQ ID NO: 7301238 - DNA, 22 bp, Homo sapiens
tctcctctactgggtctgcaga

SEQ ID NO: 7301239 - DNA, 22 bp, Homo sapiens
tctcctttaagatttcctcagg

SEQ ID NO: 7301240 - DNA, 22 bp, Homo sapiens
tctcgctctgtcgcccaggctg

SEQ ID NO: 7301241 - DNA, 21 bp, Homo sapiens
tctctaaaaagattctatttg

SEQ ID NO: 7301242 - DNA, 22 bp, Homo sapiens
tctcctggtcacctcagaagtc

SEQ ID NO: 7301243 - DNA, 20 bp, Homo sapiens
tctcctggtctggtccgtgc

SEQ ID NO: 7301244 - DNA, 22 bp, Homo sapiens
tctcctggtcacctcagaagtc

SEQ ID NO: 7301245 - DNA, 22 bp, Homo sapiens
tctcctggtttgttaaataatt

SEQ ID NO: 7301246 - DNA, 20 bp, Homo sapiens
tctcctggtgacagtaccca

SEQ ID NO: 7301247 - DNA, 22 bp, Homo sapiens
tctcctgtcttctcagcacccc

SEQ ID NO: 7301248 - DNA, 22 bp, Homo sapiens
tctcctgtgcaccctccctgtg

SEQ ID NO: 7301249 - DNA, 22 bp, Homo sapiens
tctcctggtatgtatgcacctg

SEQ ID NO: 7301250 - DNA, 22 bp, Homo sapiens
tctcctggtatgtatgcacctg

SEQ ID NO: 7301251 - DNA, 22 bp, Homo sapiens
tctcctggtacccttcctagca

SEQ ID NO: 7301252 - DNA, 22 bp, Homo sapiens
tctcctgggtgctttatcagaa

SEQ ID NO: 7301253 - DNA, 21 bp, Homo sapiens
tctcctgggtccaacccatgc

SEQ ID NO: 7301254 - DNA, 18 bp, Homo sapiens
tctcctgggtaggggcct

SEQ ID NO: 7301255 - DNA, 22 bp, Homo sapiens
tctcctgggcttggttgaagtt

SEQ ID NO: 7301256 - DNA, 22 bp, Homo sapiens
tctcctgggtaaaagggttgat

SEQ ID NO: 7301257 - DNA, 22 bp, Homo sapiens
tctcattatccatcactgcact

SEQ ID NO: 7301258 - DNA, 22 bp, Homo sapiens
tctcattattatttgtatgggt

SEQ ID NO: 7301259 - DNA, 22 bp, Homo sapiens
tctcattcatccaaggatttat

SEQ ID NO: 7301260 - DNA, 22 bp, Homo sapiens
tctcattcatccaaggatttat

SEQ ID NO: 7301261 - DNA, 22 bp, Homo sapiens
tctcatttggctttgttttaaa

SEQ ID NO: 7301262 - DNA, 22 bp, Homo sapiens
tctcatttgcctcatctataaa

SEQ ID NO: 7301263 - DNA, 23 bp, Homo sapiens
tctcatttcccttgatctatctt

SEQ ID NO: 7301264 - DNA, 22 bp, Homo sapiens
tctcatttgtgtgcaattcaga

SEQ ID NO: 7301265 - DNA, 22 bp, Homo sapiens
tctcattttgagtcagacacta

SEQ ID NO: 7301266 - DNA, 22 bp, Homo sapiens
tctccacaagctgatgctagga

SEQ ID NO: 7301267 - DNA, 17 bp, Homo sapiens
tctccaggacgagctca

SEQ ID NO: 7301268 - DNA, 22 bp, Homo sapiens
tctccaggaagccctccctgac

SEQ ID NO: 7301269 - DNA, 19 bp, Homo sapiens
tctccaggcaggtgagcga

SEQ ID NO: 7301270 - DNA, 22 bp, Homo sapiens
tctccaggcacttggctgctac

SEQ ID NO: 7301271 - DNA, 22 bp, Homo sapiens
tctccaggagaaatatgaagga

SEQ ID NO: 7301272 - DNA, 22 bp, Homo sapiens
tctccaggcactacctgggtaa

SEQ ID NO: 7301273 - DNA, 22 bp, Homo sapiens
tctcagtgctatccatattcca

SEQ ID NO: 7301274 - DNA, 22 bp, Homo sapiens
tctcagtggatctcagaatttt

SEQ ID NO: 7301275 - DNA, 22 bp, Homo sapiens
tctcataattaggtaagtcaga

SEQ ID NO: 7301276 - DNA, 22 bp, Homo sapiens
tctcatgatgcctatgcagggt

SEQ ID NO: 7301277 - DNA, 17 bp, Homo sapiens
tctcagtgactgatagc

SEQ ID NO: 7301278 - DNA, 22 bp, Homo sapiens
tctcagtgagcttttctatgtt

SEQ ID NO: 7301279 - DNA, 22 bp, Homo sapiens
tctcagtgcagcaaggaattta

SEQ ID NO: 7301280 - DNA, 22 bp, Homo sapiens
tctcagtgacactcttcataca

SEQ ID NO: 7301281 - DNA, 22 bp, Homo sapiens
tctcagagggaaacatgagtga

SEQ ID NO: 7301282 - DNA, 22 bp, Homo sapiens
tctcactcatttcctaggtctt

SEQ ID NO: 7301283 - DNA, 22 bp, Homo sapiens
tctacaaaggttgaggtgccct

SEQ ID NO: 7301284 - DNA, 22 bp, Homo sapiens
tctacagagagtcatagactca

SEQ ID NO: 7301285 - DNA, 22 bp, Homo sapiens
tctacagactcctatgtaacac

SEQ ID NO: 7301286 - DNA, 22 bp, Homo sapiens
tctacattttaacaagatgccc

SEQ ID NO: 7301287 - DNA, 22 bp, Homo sapiens
tctacattccttttataatatc

SEQ ID NO: 7301288 - DNA, 22 bp, Homo sapiens
tctacattccttttataatatc

SEQ ID NO: 7301289 - DNA, 21 bp, Homo sapiens
tctacatatcaatatgtaatt

SEQ ID NO: 7301290 - DNA, 22 bp, Homo sapiens
tctacaaactaaggagggtaat

SEQ ID NO: 7301291 - DNA, 22 bp, Homo sapiens
tctacaaagaagaattaatgtc

SEQ ID NO: 7301292 - DNA, 23 bp, Homo sapiens
tctacaaagctgtgtcaggaccc

SEQ ID NO: 7301293 - DNA, 22 bp, Homo sapiens
tctaattccattaaattgatgt

SEQ ID NO: 7301294 - DNA, 22 bp, Homo sapiens
tctaacttgtgagtatagatga

SEQ ID NO: 7301295 - DNA, 22 bp, Homo sapiens
tctaagaaagattaagaaattt

SEQ ID NO: 7301296 - DNA, 22 bp, Homo sapiens
tctaaagtgagtcatttcgact

SEQ ID NO: 7301297 - DNA, 22 bp, Homo sapiens
tctaacatttatggccactgga

SEQ ID NO: 7301298 - DNA, 22 bp, Homo sapiens
tctaacattgtttttcacagat

SEQ ID NO: 7301299 - DNA, 22 bp, Homo sapiens
tctaacttgaactcatgactgt

SEQ ID NO: 7301300 - DNA, 22 bp, Homo sapiens
tctagctttgagatcagtagcc

SEQ ID NO: 7301301 - DNA, 19 bp, Homo sapiens
tctaggagatctgaacctt

SEQ ID NO: 7301302 - DNA, 22 bp, Homo sapiens
tctaggagaaccatcagggagg

SEQ ID NO: 7301303 - DNA, 22 bp, Homo sapiens
tctacattttctttatgtacat

SEQ ID NO: 7301304 - DNA, 22 bp, Homo sapiens
tctagaaaaacaaagtatctga

SEQ ID NO: 7301305 - DNA, 22 bp, Homo sapiens
tctcaatattatatgtcataaa

SEQ ID NO: 7301306 - DNA, 22 bp, Homo sapiens
tctcaatattatatgtcataaa

SEQ ID NO: 7301307 - DNA, 22 bp, Homo sapiens
tctattttatactcaaatcttc

SEQ ID NO: 7301308 - DNA, 22 bp, Homo sapiens
tctattttatactcaaatcttc

SEQ ID NO: 7301309 - DNA, 22 bp, Homo sapiens
tctattttatactcaaatcttc

SEQ ID NO: 7301310 - DNA, 22 bp, Homo sapiens
tctattcaggcagagtgcagca

SEQ ID NO: 7301311 - DNA, 22 bp, Homo sapiens
tctattcattcaatttagctct

SEQ ID NO: 7301312 - DNA, 21 bp, Homo sapiens
tctattcattacagttatttg

SEQ ID NO: 7301313 - DNA, 22 bp, Homo sapiens
tctattggtaggggctgaggca

SEQ ID NO: 7301314 - DNA, 22 bp, Homo sapiens
tctatttacagaaagcagaatt

SEQ ID NO: 7301315 - DNA, 22 bp, Homo sapiens
tctattttgtttccagctctac

SEQ ID NO: 7301316 - DNA, 22 bp, Homo sapiens
tctatattccagatacagatta

SEQ ID NO: 7301317 - DNA, 22 bp, Homo sapiens
tctatgtgccctttgtgtgatg

SEQ ID NO: 7301318 - DNA, 22 bp, Homo sapiens
tctatgtgccctttgtgtgatg

SEQ ID NO: 7301319 - DNA, 22 bp, Homo sapiens
tctattaatgattcaatagtgt

SEQ ID NO: 7301320 - DNA, 22 bp, Homo sapiens
tctattaatgattcaatagtgt

SEQ ID NO: 7301321 - DNA, 22 bp, Homo sapiens
tctataaagggccagatagtag

SEQ ID NO: 7301322 - DNA, 22 bp, Homo sapiens
tctagttttctcaaatgacttg

SEQ ID NO: 7301323 - DNA, 22 bp, Homo sapiens
tctagttttctcaaatgacttg

SEQ ID NO: 7301324 - DNA, 22 bp, Homo sapiens
tctaggggcaatgtgcaaggac

SEQ ID NO: 7301325 - DNA, 22 bp, Homo sapiens
tctaggggtgcagaagggatcc

SEQ ID NO: 7301326 - DNA, 22 bp, Homo sapiens
tctagggaacatgggtcaagct

SEQ ID NO: 7301327 - DNA, 22 bp, Homo sapiens
tctagggttgaggccacaggga

SEQ ID NO: 7301328 - DNA, 22 bp, Homo sapiens
tctaggtggatgaggaacatag

SEQ ID NO: 7301329 - DNA, 22 bp, Homo sapiens
tccttacatagtgctgaaatat

SEQ ID NO: 7301330 - DNA, 22 bp, Homo sapiens
tccttattgatagtgccaccta

SEQ ID NO: 7301331 - DNA, 22 bp, Homo sapiens
tccttcactccctctgcatcca

SEQ ID NO: 7301332 - DNA, 22 bp, Homo sapiens
tccttctttccccctagtcatt

SEQ ID NO: 7301333 - DNA, 22 bp, Homo sapiens
tccttctttcacctcatagtca

SEQ ID NO: 7301334 - DNA, 22 bp, Homo sapiens
tccttctttcacctcatagtca

SEQ ID NO: 7301335 - DNA, 22 bp, Homo sapiens
tccttctttgacaagtggcaga

SEQ ID NO: 7301336 - DNA, 22 bp, Homo sapiens
tccttgaagcaacgtgcagaca

SEQ ID NO: 7301337 - DNA, 22 bp, Homo sapiens
tccttgaatgaagagaggtgac

SEQ ID NO: 7301338 - DNA, 22 bp, Homo sapiens
tccttctaccagctggatacct

SEQ ID NO: 7301339 - DNA, 22 bp, Homo sapiens
tccttctatttgtttatgtggc

SEQ ID NO: 7301340 - DNA, 21 bp, Homo sapiens
tccttctctatgattgtctga

SEQ ID NO: 7301341 - DNA, 22 bp, Homo sapiens
tccttcctggggtctctgctgc

SEQ ID NO: 7301342 - DNA, 22 bp, Homo sapiens
tcgtctgtgaaattgggataag

SEQ ID NO: 7301343 - DNA, 22 bp, Homo sapiens
tcgcatttgttaaagcatgttg

SEQ ID NO: 7301344 - DNA, 22 bp, Homo sapiens
tcgtgaggctctgcatcgcaca

SEQ ID NO: 7301345 - DNA, 22 bp, Homo sapiens
tcgtgtgtattccctctccttc

SEQ ID NO: 7301346 - DNA, 22 bp, Homo sapiens
tctaaagatttggattcatttg

SEQ ID NO: 7301347 - DNA, 22 bp, Homo sapiens
tcctttgttcgggtgtgctgtc

SEQ ID NO: 7301348 - DNA, 22 bp, Homo sapiens
tcctttgcttctgtcattctcc

SEQ ID NO: 7301349 - DNA, 23 bp, Homo sapiens
tcctttgacaagagacagatgtt

SEQ ID NO: 7301350 - DNA, 22 bp, Homo sapiens
tcctttgcttctgtcattctcc

SEQ ID NO: 7301351 - DNA, 22 bp, Homo sapiens
tcgatgtggtgacaaggtacgt

SEQ ID NO: 7301352 - DNA, 22 bp, Homo sapiens
tcctttttggtccaaggtgacc

SEQ ID NO: 7301353 - DNA, 22 bp, Homo sapiens
tcctttcttcttctgcccatgg

SEQ ID NO: 7301354 - DNA, 22 bp, Homo sapiens
tcctttcttttctatgggccca

SEQ ID NO: 7301355 - DNA, 18 bp, Homo sapiens
tcctgtggcccagagttt

SEQ ID NO: 7301356 - DNA, 22 bp, Homo sapiens
tcctgtgcctccacctgctccg

SEQ ID NO: 7301357 - DNA, 22 bp, Homo sapiens
tcctgtcctctgggtgccccat

SEQ ID NO: 7301358 - DNA, 20 bp, Homo sapiens
tcctgtccgcgccttgcgtc

SEQ ID NO: 7301359 - DNA, 22 bp, Homo sapiens
tcctgtcagtgaggcagatgaa

SEQ ID NO: 7301360 - DNA, 22 bp, Homo sapiens
tcctggggtttagagggaagtg

SEQ ID NO: 7301361 - DNA, 22 bp, Homo sapiens
tcctggggccaggcacctctgg

SEQ ID NO: 7301362 - DNA, 22 bp, Homo sapiens
tcctggggctctgagcgagaca

SEQ ID NO: 7301363 - DNA, 22 bp, Homo sapiens
tcctgggcagcctctctggaag

SEQ ID NO: 7301364 - DNA, 22 bp, Homo sapiens
tcctgggcacaagtgagtctcc

SEQ ID NO: 7301365 - DNA, 22 bp, Homo sapiens
tcctgggcagcgggacgctcag

SEQ ID NO: 7301366 - DNA, 21 bp, Homo sapiens
tcctggctttatgctacctct

SEQ ID NO: 7301367 - DNA, 22 bp, Homo sapiens
tcctggcttgtcacatctacgt

SEQ ID NO: 7301368 - DNA, 22 bp, Homo sapiens
tcctggcttttcttggctcatc

SEQ ID NO: 7301369 - DNA, 22 bp, Homo sapiens
tcctggcttctgtctccttatt

SEQ ID NO: 7301370 - DNA, 22 bp, Homo sapiens
tcctggaggcactcgctggggc

SEQ ID NO: 7301371 - DNA, 22 bp, Homo sapiens
tcctggaggcactcgctggggc

SEQ ID NO: 7301372 - DNA, 22 bp, Homo sapiens
tcctggagggaggcggtgctac

SEQ ID NO: 7301373 - DNA, 22 bp, Homo sapiens
tcctggaggggacagcatgggc

SEQ ID NO: 7301374 - DNA, 22 bp, Homo sapiens
tcctggagggctcacaggcggc

SEQ ID NO: 7301375 - DNA, 22 bp, Homo sapiens
tcctggagtatttctgtggtgt

SEQ ID NO: 7301376 - DNA, 22 bp, Homo sapiens
tcctggagccaatgtgctgctg

SEQ ID NO: 7301377 - DNA, 22 bp, Homo sapiens
tcctggagataattgcagtgaa

SEQ ID NO: 7301378 - DNA, 22 bp, Homo sapiens
tcctggagagtgggcgagcaca

SEQ ID NO: 7301379 - DNA, 22 bp, Homo sapiens
tcctggagagaggcctggaaga

SEQ ID NO: 7301380 - DNA, 19 bp, Homo sapiens
tcctgctttctactctgct

SEQ ID NO: 7301381 - DNA, 22 bp, Homo sapiens
tcctggagaaactcagagatct

SEQ ID NO: 7301382 - DNA, 22 bp, Homo sapiens
tcctggagaagaggggcttgga

SEQ ID NO: 7301383 - DNA, 22 bp, Homo sapiens
taagacaaatactatttcaaga

SEQ ID NO: 7301384 - DNA, 22 bp, Homo sapiens
taagaattatctcatggataat

SEQ ID NO: 7301385 - DNA, 22 bp, Homo sapiens
tcctgcttccttgtctttagac

SEQ ID NO: 7301386 - DNA, 20 bp, Homo sapiens
tcctgcttccaccagagcac

SEQ ID NO: 7301387 - DNA, 22 bp, Homo sapiens
tcctgcttgaaactctgccttc

SEQ ID NO: 7301388 - DNA, 22 bp, Homo sapiens
tcctgctgttttctggcccaca

SEQ ID NO: 7301389 - DNA, 22 bp, Homo sapiens
taagaagtgtttgcccagccat

SEQ ID NO: 7301390 - DNA, 22 bp, Homo sapiens
taagaagtgttgcctaatgcaa

SEQ ID NO: 7301391 - DNA, 23 bp, Homo sapiens
taagaacagacaagcatttacat

SEQ ID NO: 7301392 - DNA, 22 bp, Homo sapiens
taagaacagataaagtttcccc

SEQ ID NO: 7301393 - DNA, 23 bp, Homo sapiens
taagaacagacaagcatttacat

SEQ ID NO: 7301394 - DNA, 22 bp, Homo sapiens
taagaacagtgtctgtctcaca

SEQ ID NO: 7301395 - DNA, 21 bp, Homo sapiens
taagaacattatcttcttcct

SEQ ID NO: 7301396 - DNA, 22 bp, Homo sapiens
taagaacataaattcatacggg

SEQ ID NO: 7301397 - DNA, 20 bp, Homo sapiens
tcctggagtctggtttggct

SEQ ID NO: 7301398 - DNA, 22 bp, Homo sapiens
tcctggagttgtgcagtgcaca

SEQ ID NO: 7301399 - DNA, 22 bp, Homo sapiens
tcctggagtttgtaaggtgagc

SEQ ID NO: 7301400 - DNA, 22 bp, Homo sapiens
tcctggagtttgtggtgatatg

SEQ ID NO: 7301401 - DNA, 22 bp, Homo sapiens
tcctggctctgctgcctcctag

SEQ ID NO: 7301402 - DNA, 22 bp, Homo sapiens
tcctggctcgattgctaccaat

SEQ ID NO: 7301403 - DNA, 22 bp, Homo sapiens
tgagtgtgctaggtgtctcggt

SEQ ID NO: 7301404 - DNA, 22 bp, Homo sapiens
tgagtgtggggaatgtcatgag

SEQ ID NO: 7301405 - DNA, 22 bp, Homo sapiens
tgagtgtgaggtgggagcttgg

SEQ ID NO: 7301406 - DNA, 22 bp, Homo sapiens
tgagtgtgctaggtgtctcggt

SEQ ID NO: 7301407 - DNA, 22 bp, Homo sapiens
tgagtgtggggaatgtcatgag

SEQ ID NO: 7301408 - DNA, 23 bp, Homo sapiens
tgagtgtggggacagtggtttgc

SEQ ID NO: 7301409 - DNA, 22 bp, Homo sapiens
tgagtgtgtattatgtatcagg

SEQ ID NO: 7301410 - DNA, 19 bp, Homo sapiens
tgagtgtgtgtttctctaa

SEQ ID NO: 7301411 - DNA, 22 bp, Homo sapiens
tgagtgtgtattatgtatcagg

SEQ ID NO: 7301412 - DNA, 23 bp, Homo sapiens
tgagtgtggggacagtggtttgc

SEQ ID NO: 7301413 - DNA, 19 bp, Homo sapiens
tgagtgtcacgtcagtgcc

SEQ ID NO: 7301414 - DNA, 23 bp, Homo sapiens
tgagtgtgaaaatcctggagatg

SEQ ID NO: 7301415 - DNA, 23 bp, Homo sapiens
tgagtgtgttccctgtgagattt

SEQ ID NO: 7301416 - DNA, 22 bp, Homo sapiens
tgagtgttgtaaccatatgatt

SEQ ID NO: 7301417 - DNA, 22 bp, Homo sapiens
tgagtgcctgcaacggaccaga

SEQ ID NO: 7301418 - DNA, 22 bp, Homo sapiens
tgagtgccaatggaactccata

SEQ ID NO: 7301419 - DNA, 22 bp, Homo sapiens
tgagtgccccctcctaccaaaa

SEQ ID NO: 7301420 - DNA, 22 bp, Homo sapiens
tgatatcagctggcagcagtgg

SEQ ID NO: 7301421 - DNA, 22 bp, Homo sapiens
tgatattttatgagctttcata

SEQ ID NO: 7301422 - DNA, 22 bp, Homo sapiens
tgagttctccaggaagcagact

SEQ ID NO: 7301423 - DNA, 22 bp, Homo sapiens
tgatcttcaccttgttctttgg

SEQ ID NO: 7301424 - DNA, 22 bp, Homo sapiens
tgatctttactgctgtttataa

SEQ ID NO: 7301425 - DNA, 18 bp, Homo sapiens
tgatctttcatgattcca

SEQ ID NO: 7301426 - DNA, 22 bp, Homo sapiens
tgatctttcctcttgtttgtct

SEQ ID NO: 7301427 - DNA, 23 bp, Homo sapiens
tgatctctcttgggaggcaatat

SEQ ID NO: 7301428 - DNA, 22 bp, Homo sapiens
tgatctggaccttggaggaaaa

SEQ ID NO: 7301429 - DNA, 19 bp, Homo sapiens
tgatctggaaggaaccagg

SEQ ID NO: 7301430 - DNA, 22 bp, Homo sapiens
tgatctggtcctactgtgggca

SEQ ID NO: 7301431 - DNA, 22 bp, Homo sapiens
tgatctcctgaccttgtaatcc

SEQ ID NO: 7301432 - DNA, 22 bp, Homo sapiens
tgatattttatgagctttcata

SEQ ID NO: 7301433 - DNA, 22 bp, Homo sapiens
tgatattttatgagctttcata

SEQ ID NO: 7301434 - DNA, 22 bp, Homo sapiens
tgatcactttggaagttggggg

SEQ ID NO: 7301435 - DNA, 22 bp, Homo sapiens
tgattctttctccaccaattca

SEQ ID NO: 7301436 - DNA, 21 bp, Homo sapiens
tgattctgttttatcatcagc

SEQ ID NO: 7301437 - DNA, 22 bp, Homo sapiens
tgattctgttctccttgagaat

SEQ ID NO: 7301438 - DNA, 22 bp, Homo sapiens
tgattctgtctccttcactccg

SEQ ID NO: 7301439 - DNA, 22 bp, Homo sapiens
tgattctttgaccaaaaaattg

SEQ ID NO: 7301440 - DNA, 22 bp, Homo sapiens
tgattggtcaggctgtggtgac

SEQ ID NO: 7301441 - DNA, 22 bp, Homo sapiens
tgattaaaatttaacttagtta

SEQ ID NO: 7301442 - DNA, 22 bp, Homo sapiens
tgatgtttaatactatgctttt

SEQ ID NO: 7301443 - DNA, 23 bp, Homo sapiens
tgattcagaaggttgttattgct

SEQ ID NO: 7301444 - DNA, 22 bp, Homo sapiens
tgatggcctttttcaccaggct

SEQ ID NO: 7301445 - DNA, 22 bp, Homo sapiens
tgatggccctgtacaaggagtg

SEQ ID NO: 7301446 - DNA, 22 bp, Homo sapiens
tgatggccctgtacaaggagtg

SEQ ID NO: 7301447 - DNA, 22 bp, Homo sapiens
tgatggccagtcgcactggagg

SEQ ID NO: 7301448 - DNA, 19 bp, Homo sapiens
tgatgccctgacctgagcc

SEQ ID NO: 7301449 - DNA, 22 bp, Homo sapiens
tgatgccatctttccacctata

SEQ ID NO: 7301450 - DNA, 22 bp, Homo sapiens
tgatgccagtgcttagaccatt

SEQ ID NO: 7301451 - DNA, 22 bp, Homo sapiens
tgatgccaataaaactctccct

SEQ ID NO: 7301452 - DNA, 23 bp, Homo sapiens
tgatgccaagcatggagatacaa

SEQ ID NO: 7301453 - DNA, 22 bp, Homo sapiens
tgatctttggtaatctggcaca

SEQ ID NO: 7301454 - DNA, 22 bp, Homo sapiens
tgatgaaaatgttcagcaatta

SEQ ID NO: 7301455 - DNA, 22 bp, Homo sapiens
tgatcttttctatttatggtag

SEQ ID NO: 7301456 - DNA, 22 bp, Homo sapiens
tgcaacagtggggcatgctgaa

SEQ ID NO: 7301457 - DNA, 22 bp, Homo sapiens
tgcaaatttgagcagactgttc

SEQ ID NO: 7301458 - DNA, 21 bp, Homo sapiens
tgcaagaatcaggaagctgcc

SEQ ID NO: 7301459 - DNA, 22 bp, Homo sapiens
tgcaagagacagacatgactca

SEQ ID NO: 7301460 - DNA, 22 bp, Homo sapiens
tgcaagagacatgggttgtgtg

SEQ ID NO: 7301461 - DNA, 22 bp, Homo sapiens
tgcaagagcccagggccaggaa

SEQ ID NO: 7301462 - DNA, 22 bp, Homo sapiens
tgcaagagctgtggcaaaagca

SEQ ID NO: 7301463 - DNA, 22 bp, Homo sapiens
tgcaagaggcatcttttaaaaa

SEQ ID NO: 7301464 - DNA, 22 bp, Homo sapiens
tgcaagagggtgttcagtttgt

SEQ ID NO: 7301465 - DNA, 23 bp, Homo sapiens
tgcaagagttccaaactgttcaa

SEQ ID NO: 7301466 - DNA, 22 bp, Homo sapiens
tgcaaggtccagtataacttaa

SEQ ID NO: 7301467 - DNA, 22 bp, Homo sapiens
tgcaaggtgctttttggtgtca

SEQ ID NO: 7301468 - DNA, 22 bp, Homo sapiens
tgcaagtaattccagctactga

SEQ ID NO: 7301469 - DNA, 22 bp, Homo sapiens
tgcacaaatttgtgtatgctca

SEQ ID NO: 7301470 - DNA, 22 bp, Homo sapiens
tgcacaaaggctccctgctgag

SEQ ID NO: 7301471 - DNA, 22 bp, Homo sapiens
tgcacacacacgtagagaaaag

SEQ ID NO: 7301472 - DNA, 22 bp, Homo sapiens
tgcacaaagcattctagacgca

SEQ ID NO: 7301473 - DNA, 21 bp, Homo sapiens
tgcacaaactttctgtggctt

SEQ ID NO: 7301474 - DNA, 22 bp, Homo sapiens
tgcacaaacttgtgtcccaggg

SEQ ID NO: 7301475 - DNA, 22 bp, Homo sapiens
tgcacaaacacagagaatagat

SEQ ID NO: 7301476 - DNA, 22 bp, Homo sapiens
tgcaatttggcttccattttct

SEQ ID NO: 7301477 - DNA, 22 bp, Homo sapiens
tgcacacaggtctaggacatgg

SEQ ID NO: 7301478 - DNA, 22 bp, Homo sapiens
tgcacacactcgtgtatatgag

SEQ ID NO: 7301479 - DNA, 22 bp, Homo sapiens
tgcacacactcgtgtatatgag

SEQ ID NO: 7301480 - DNA, 22 bp, Homo sapiens
tgcacacactctgcatatactt

SEQ ID NO: 7301481 - DNA, 19 bp, Homo sapiens
tgcacacagataagtatct

SEQ ID NO: 7301482 - DNA, 20 bp, Homo sapiens
tgcacacagaaatttgcatt

SEQ ID NO: 7301483 - DNA, 20 bp, Homo sapiens
tgcacacaccctgtcctcca

SEQ ID NO: 7301484 - DNA, 22 bp, Homo sapiens
tgatttccatgaagctgaaggc

SEQ ID NO: 7301485 - DNA, 22 bp, Homo sapiens
tgatttccagttgctgggtgct

SEQ ID NO: 7301486 - DNA, 22 bp, Homo sapiens
tgatttccaataaggagaatgt

SEQ ID NO: 7301487 - DNA, 22 bp, Homo sapiens
tgatttcatagtatatacatga

SEQ ID NO: 7301488 - DNA, 22 bp, Homo sapiens
tgattttattggtgaggaaatt

SEQ ID NO: 7301489 - DNA, 22 bp, Homo sapiens
tgatttcctaggtctggagaag

SEQ ID NO: 7301490 - DNA, 22 bp, Homo sapiens
tgatttttaaaattctccttgc

SEQ ID NO: 7301491 - DNA, 22 bp, Homo sapiens
tgcaaaagaatatagatattgt

SEQ ID NO: 7301492 - DNA, 22 bp, Homo sapiens
tgcaaaatgacttctgaaaaga

SEQ ID NO: 7301493 - DNA, 22 bp, Homo sapiens
tgcaaaatgacttctgaaaaga

SEQ ID NO: 7301494 - DNA, 22 bp, Homo sapiens
tgcaaagaagggctgaggagca

SEQ ID NO: 7301495 - DNA, 22 bp, Homo sapiens
tgcaaatcataaacaatagtgt

SEQ ID NO: 7301496 - DNA, 22 bp, Homo sapiens
tgcaaattgcatgatgtgtatc

SEQ ID NO: 7301497 - DNA, 22 bp, Homo sapiens
tgcaaatttatatggtgactgc

SEQ ID NO: 7301498 - DNA, 22 bp, Homo sapiens
tgcaggagctgtgcggtgaggg

SEQ ID NO: 7301499 - DNA, 22 bp, Homo sapiens
tgcaggagcccttgggctctgg

SEQ ID NO: 7301500 - DNA, 22 bp, Homo sapiens
tgcaggaggattttgtggagct

SEQ ID NO: 7301501 - DNA, 22 bp, Homo sapiens
tgcaggaggctttattcaggat

SEQ ID NO: 7301502 - DNA, 22 bp, Homo sapiens
tgcaggagtccaatcaggagac

SEQ ID NO: 7301503 - DNA, 18 bp, Homo sapiens
tgcaggagtgaccccggc

SEQ ID NO: 7301504 - DNA, 22 bp, Homo sapiens
tgcaggctcaccctggagctga

SEQ ID NO: 7301505 - DNA, 22 bp, Homo sapiens
tgcaggctccaggtgcacatat

SEQ ID NO: 7301506 - DNA, 21 bp, Homo sapiens
tgcaggctacttctgactcta

SEQ ID NO: 7301507 - DNA, 22 bp, Homo sapiens
tgcaggagcagagatggctgga

SEQ ID NO: 7301508 - DNA, 22 bp, Homo sapiens
tgcaggagataatggtgcttag

SEQ ID NO: 7301509 - DNA, 22 bp, Homo sapiens
tgcaggagaaagtacggagcgt

SEQ ID NO: 7301510 - DNA, 18 bp, Homo sapiens
tgcagcctgtagtcttgt

SEQ ID NO: 7301511 - DNA, 22 bp, Homo sapiens
tgcagcctggtggtcactggag

SEQ ID NO: 7301512 - DNA, 22 bp, Homo sapiens
tgcagcctggcttcgcgcctcc

SEQ ID NO: 7301513 - DNA, 21 bp, Homo sapiens
tgcagcctctgcccagcagtg

SEQ ID NO: 7301514 - DNA, 22 bp, Homo sapiens
tgcagcctctctgcttcaggaa

SEQ ID NO: 7301515 - DNA, 22 bp, Homo sapiens
tgcagcctagacattctggtca

SEQ ID NO: 7301516 - DNA, 22 bp, Homo sapiens
tgcagccatcgcagagtctgta

SEQ ID NO: 7301517 - DNA, 22 bp, Homo sapiens
tgcagcagcagggaggaggctc

SEQ ID NO: 7301518 - DNA, 22 bp, Homo sapiens
tgcagccttggcaaccagggac

SEQ ID NO: 7301519 - DNA, 22 bp, Homo sapiens
tgcagctgacccactccagtcc

SEQ ID NO: 7301520 - DNA, 17 bp, Homo sapiens
tgcagctgctcccaggc

SEQ ID NO: 7301521 - DNA, 22 bp, Homo sapiens
tgcagctgatgatacccccatg

SEQ ID NO: 7301522 - DNA, 22 bp, Homo sapiens
tgcagctgagtcacccagccat

SEQ ID NO: 7301523 - DNA, 20 bp, Homo sapiens
tgcagctggtttcacaggga

SEQ ID NO: 7301524 - DNA, 22 bp, Homo sapiens
tgcagctggtatcccatggatt

SEQ ID NO: 7301525 - DNA, 21 bp, Homo sapiens
tgcagctgggttctggtttgc

SEQ ID NO: 7301526 - DNA, 22 bp, Homo sapiens
tgcagacaagccaggctatggc

SEQ ID NO: 7301527 - DNA, 22 bp, Homo sapiens
tgcagacagagaaatgaggccc

SEQ ID NO: 7301528 - DNA, 22 bp, Homo sapiens
tgcagacaagtgcatctaaccc

SEQ ID NO: 7301529 - DNA, 22 bp, Homo sapiens
tgcagacaagaagaaccaagga

SEQ ID NO: 7301530 - DNA, 22 bp, Homo sapiens
tgcagagattgaacaagaagga

SEQ ID NO: 7301531 - DNA, 22 bp, Homo sapiens
tgcagagcagcaactgcgtgcg

SEQ ID NO: 7301532 - DNA, 20 bp, Homo sapiens
tgcagagctggctggctcct

SEQ ID NO: 7301533 - DNA, 22 bp, Homo sapiens
tgcagattcaaatgaaatgcaa

SEQ ID NO: 7301534 - DNA, 22 bp, Homo sapiens
tgcagcaagaaggcactgtctg

SEQ ID NO: 7301535 - DNA, 22 bp, Homo sapiens
tgcagcaacaagatagaatggc

SEQ ID NO: 7301536 - DNA, 22 bp, Homo sapiens
tgcagcaaatggggcccgtcct

SEQ ID NO: 7301537 - DNA, 21 bp, Homo sapiens
tgcagcagaagtctctgtgtc

SEQ ID NO: 7301538 - DNA, 22 bp, Homo sapiens
tgcagagtcccaggacccagag

SEQ ID NO: 7301539 - DNA, 21 bp, Homo sapiens
tgcacctgtgccccatccttc

SEQ ID NO: 7301540 - DNA, 22 bp, Homo sapiens
tgcaccattttgtcaggctact

SEQ ID NO: 7301541 - DNA, 22 bp, Homo sapiens
tgcacacagttctcaggaaaga

SEQ ID NO: 7301542 - DNA, 22 bp, Homo sapiens
tgcagaaataaagatattatca

SEQ ID NO: 7301543 - DNA, 22 bp, Homo sapiens
tgcagaaataaagatattatca

SEQ ID NO: 7301544 - DNA, 22 bp, Homo sapiens
tgcagaaaccaattcaagtaag

SEQ ID NO: 7301545 - DNA, 23 bp, Homo sapiens
tgcatcctcatttttcacacgag

SEQ ID NO: 7301546 - DNA, 22 bp, Homo sapiens
tgcatctgtgctccctcttcta

SEQ ID NO: 7301547 - DNA, 22 bp, Homo sapiens
tgcatctggcctttgctggcta

SEQ ID NO: 7301548 - DNA, 22 bp, Homo sapiens
tgcatctggcctttgctggcta

SEQ ID NO: 7301549 - DNA, 22 bp, Homo sapiens
tgcatctaagtggctaacaacc

SEQ ID NO: 7301550 - DNA, 22 bp, Homo sapiens
tgcatacacttcaaatgagcat

SEQ ID NO: 7301551 - DNA, 19 bp, Homo sapiens
tgcatacatgttaacatgt

SEQ ID NO: 7301552 - DNA, 22 bp, Homo sapiens
tgcatacacacatcaaatgttt

SEQ ID NO: 7301553 - DNA, 22 bp, Homo sapiens
tgcatacacatgtgcacatacg

SEQ ID NO: 7301554 - DNA, 22 bp, Homo sapiens
tgcatacacacatcaaatgttt

SEQ ID NO: 7301555 - DNA, 22 bp, Homo sapiens
tgcatacacaagcatacatgta

SEQ ID NO: 7301556 - DNA, 22 bp, Homo sapiens
tgcataattcatccttctggga

SEQ ID NO: 7301557 - DNA, 22 bp, Homo sapiens
tgcataatgctggacttttcaa

SEQ ID NO: 7301558 - DNA, 22 bp, Homo sapiens
tgcatatacccgcatttacata

SEQ ID NO: 7301559 - DNA, 22 bp, Homo sapiens
tgcatatacccgcatttacata

SEQ ID NO: 7301560 - DNA, 22 bp, Homo sapiens
tgcatagaggatccagtgtggt

SEQ ID NO: 7301561 - DNA, 22 bp, Homo sapiens
tgcatacttgtatgtgttacat

SEQ ID NO: 7301562 - DNA, 22 bp, Homo sapiens
tgcatacatgtttgtgtatttt

SEQ ID NO: 7301563 - DNA, 22 bp, Homo sapiens
tgcataaagtgccatagtatta

SEQ ID NO: 7301564 - DNA, 19 bp, Homo sapiens
tgcataaattatatacttt

SEQ ID NO: 7301565 - DNA, 22 bp, Homo sapiens
tgcagtttgccctttgctcact

SEQ ID NO: 7301566 - DNA, 22 bp, Homo sapiens
tgcatgcgttagttggcgtgtt

SEQ ID NO: 7301567 - DNA, 17 bp, Homo sapiens
tgcatgcgtctgtgata

SEQ ID NO: 7301568 - DNA, 22 bp, Homo sapiens
tgcatgcatgtttttacccaca

SEQ ID NO: 7301569 - DNA, 17 bp, Homo sapiens
tgcatgcgtctgtgata

SEQ ID NO: 7301570 - DNA, 22 bp, Homo sapiens
tgcatgcaacaattcttctata

SEQ ID NO: 7301571 - DNA, 22 bp, Homo sapiens
tgcatgcaaaaaaatctgcatt

SEQ ID NO: 7301572 - DNA, 22 bp, Homo sapiens
tgcatgcacgtgctatgtatga

SEQ ID NO: 7301573 - DNA, 22 bp, Homo sapiens
tgcatgcactatctagatgatg

SEQ ID NO: 7301574 - DNA, 22 bp, Homo sapiens
tgcatgaaatattttctgtagg

SEQ ID NO: 7301575 - DNA, 22 bp, Homo sapiens
tgcatctttctgcatatgtaaa

SEQ ID NO: 7301576 - DNA, 22 bp, Homo sapiens
tgcatctttctgcatatgtaaa

SEQ ID NO: 7301577 - DNA, 22 bp, Homo sapiens
tgcatctgttcattcgttccca

SEQ ID NO: 7301578 - DNA, 20 bp, Homo sapiens
tgcatggcgcacatctgtgg

SEQ ID NO: 7301579 - DNA, 22 bp, Homo sapiens
tgcatgtctttagcatttgtta

SEQ ID NO: 7301580 - DNA, 22 bp, Homo sapiens
tgcatgtgcccactctggctta

SEQ ID NO: 7301581 - DNA, 23 bp, Homo sapiens
tgcatgtgaattcatacttgttt

SEQ ID NO: 7301582 - DNA, 22 bp, Homo sapiens
tgcatgtggacccctggtgcct

SEQ ID NO: 7301583 - DNA, 22 bp, Homo sapiens
tgcatgtggacccctggtgcct

SEQ ID NO: 7301584 - DNA, 22 bp, Homo sapiens
tgcatgtgcccactctggctta

SEQ ID NO: 7301585 - DNA, 23 bp, Homo sapiens
tgcatgtgaattcatacttgttt

SEQ ID NO: 7301586 - DNA, 22 bp, Homo sapiens
tgcatgtatgtaaatgtgagcg

SEQ ID NO: 7301587 - DNA, 19 bp, Homo sapiens
tgcatgtgttctcccattg

SEQ ID NO: 7301588 - DNA, 22 bp, Homo sapiens
tgcatgtgtgtgtatttataaa

SEQ ID NO: 7301589 - DNA, 22 bp, Homo sapiens
tgcatgtgtgttaagatgcttt

SEQ ID NO: 7301590 - DNA, 22 bp, Homo sapiens
tgcatgtgtcgggcctgtgcta

SEQ ID NO: 7301591 - DNA, 22 bp, Homo sapiens
tgcatgtggatcatatgtccta

SEQ ID NO: 7301592 - DNA, 22 bp, Homo sapiens
tgcatgtggatcatatgtccta

SEQ ID NO: 7301593 - DNA, 22 bp, Homo sapiens
tgcatgtgtttgccacagtgag

SEQ ID NO: 7301594 - DNA, 22 bp, Homo sapiens
tgccactggacccagaactctt

SEQ ID NO: 7301595 - DNA, 17 bp, Homo sapiens
tgccacttacctataca

SEQ ID NO: 7301596 - DNA, 22 bp, Homo sapiens
tgccagactctggggtgctaga

SEQ ID NO: 7301597 - DNA, 22 bp, Homo sapiens
tgccagagaagacccagtcact

SEQ ID NO: 7301598 - DNA, 22 bp, Homo sapiens
tgccacagttgtttgtgctcta

SEQ ID NO: 7301599 - DNA, 22 bp, Homo sapiens
tgccacaggcaatccctgcacg

SEQ ID NO: 7301600 - DNA, 22 bp, Homo sapiens
tgccaaattgccctataaatga

SEQ ID NO: 7301601 - DNA, 22 bp, Homo sapiens
tgccagcagaaataaatacttg

SEQ ID NO: 7301602 - DNA, 22 bp, Homo sapiens
tgccagagagtggctgggtgtc

SEQ ID NO: 7301603 - DNA, 22 bp, Homo sapiens
tgccagagcaaaatgcccttaa

SEQ ID NO: 7301604 - DNA, 22 bp, Homo sapiens
tgccagagatttcacactgcta

SEQ ID NO: 7301605 - DNA, 22 bp, Homo sapiens
tgccagagccaggctttaggaa

SEQ ID NO: 7301606 - DNA, 22 bp, Homo sapiens
tgccagagaatcacctctcctt

SEQ ID NO: 7301607 - DNA, 19 bp, Homo sapiens
tgccagagatactcccaga

SEQ ID NO: 7301608 - DNA, 21 bp, Homo sapiens
tgcattcttgtgtaaggtagt

SEQ ID NO: 7301609 - DNA, 21 bp, Homo sapiens
tgcattcttgtgtaaggtagt

SEQ ID NO: 7301610 - DNA, 22 bp, Homo sapiens
tgcattctgacttagttaatat

SEQ ID NO: 7301611 - DNA, 22 bp, Homo sapiens
tgcattctgaacgtaaatgtga

SEQ ID NO: 7301612 - DNA, 22 bp, Homo sapiens
tgcattctgaacgtaaatgtga

SEQ ID NO: 7301613 - DNA, 22 bp, Homo sapiens
tgcatttcttttgagtatatgc

SEQ ID NO: 7301614 - DNA, 22 bp, Homo sapiens
tgcattttcttccaccaatatc

SEQ ID NO: 7301615 - DNA, 22 bp, Homo sapiens
tgcattttcttccaccaatatc

SEQ ID NO: 7301616 - DNA, 23 bp, Homo sapiens
tgcaggtgtgcagagggctcttg

SEQ ID NO: 7301617 - DNA, 22 bp, Homo sapiens
tgcaggtgtctctgtctagcgt

SEQ ID NO: 7301618 - DNA, 22 bp, Homo sapiens
tgcaggtggtccttcctctgct

SEQ ID NO: 7301619 - DNA, 22 bp, Homo sapiens
tgcaggtggtccatttgggaac

SEQ ID NO: 7301620 - DNA, 20 bp, Homo sapiens
tgcaggtgggcccttctggg

SEQ ID NO: 7301621 - DNA, 22 bp, Homo sapiens
tgcaggtggtttggacactgct

SEQ ID NO: 7301622 - DNA, 22 bp, Homo sapiens
tgcagtgtggccatgtcagcta

SEQ ID NO: 7301623 - DNA, 22 bp, Homo sapiens
tgcagtgttcagtgatctctcc

SEQ ID NO: 7301624 - DNA, 22 bp, Homo sapiens
tgcagtgttcctgtagcctgcc

SEQ ID NO: 7301625 - DNA, 22 bp, Homo sapiens
tgcagtgttcctgtgggtttat

SEQ ID NO: 7301626 - DNA, 22 bp, Homo sapiens
tgcagtgttcctgtgggtttat

SEQ ID NO: 7301627 - DNA, 22 bp, Homo sapiens
tgcagtgtttggatgctgagtc

SEQ ID NO: 7301628 - DNA, 22 bp, Homo sapiens
tgcagtgtttccagatattgtc

SEQ ID NO: 7301629 - DNA, 22 bp, Homo sapiens
tgcagtgtttggatgctgagtc

SEQ ID NO: 7301630 - DNA, 22 bp, Homo sapiens
tgcagtgtgattttctggctga

SEQ ID NO: 7301631 - DNA, 22 bp, Homo sapiens
tgcagtgtgaggtccacatctg

SEQ ID NO: 7301632 - DNA, 20 bp, Homo sapiens
tgcagtgtcctcacttgtca

SEQ ID NO: 7301633 - DNA, 22 bp, Homo sapiens
tgcaggtgattctgatgcagtt

SEQ ID NO: 7301634 - DNA, 22 bp, Homo sapiens
tgcaggtgcagcgatactgtga

SEQ ID NO: 7301635 - DNA, 22 bp, Homo sapiens
tgcaggtgaaaattatgaggat

SEQ ID NO: 7301636 - DNA, 22 bp, Homo sapiens
tgcagggaaagtgttggcagca

SEQ ID NO: 7301637 - DNA, 20 bp, Homo sapiens
tgcaggcttcgctctaggag

SEQ ID NO: 7301638 - DNA, 22 bp, Homo sapiens
tgcaggctttagccccatggct

SEQ ID NO: 7301639 - DNA, 21 bp, Homo sapiens
tgcaggctgtgcgctcctgcc

SEQ ID NO: 7301640 - DNA, 22 bp, Homo sapiens
tgcaggctgtaatctgaggcta

SEQ ID NO: 7301641 - DNA, 22 bp, Homo sapiens
tgcaggctctctgctgccagat

SEQ ID NO: 7301642 - DNA, 22 bp, Homo sapiens
tgcaggctgcacccctgccctg

SEQ ID NO: 7301643 - DNA, 22 bp, Homo sapiens
tgcagggcagtggaggttgagt

SEQ ID NO: 7301644 - DNA, 22 bp, Homo sapiens
tgcagggccgctggaggtcatg

SEQ ID NO: 7301645 - DNA, 22 bp, Homo sapiens
tgcagggcccttggggttgaac

SEQ ID NO: 7301646 - DNA, 19 bp, Homo sapiens
tgcccaggcctcccaaaag

SEQ ID NO: 7301647 - DNA, 19 bp, Homo sapiens
tgcccccagcacctccctg

SEQ ID NO: 7301648 - DNA, 22 bp, Homo sapiens
tgcccagcacccagcatgatgc

SEQ ID NO: 7301649 - DNA, 22 bp, Homo sapiens
tgcccagcaataaaccagaaga

SEQ ID NO: 7301650 - DNA, 20 bp, Homo sapiens
tgcccagcaagagtgcagtt

SEQ ID NO: 7301651 - DNA, 20 bp, Homo sapiens
tgcccagcaagagtgcagtt

SEQ ID NO: 7301652 - DNA, 22 bp, Homo sapiens
tgccatttctcaaatatgacta

SEQ ID NO: 7301653 - DNA, 22 bp, Homo sapiens
tgcccaaggtcacctagttagt

SEQ ID NO: 7301654 - DNA, 22 bp, Homo sapiens
tgcccaagattcttacatcatg

SEQ ID NO: 7301655 - DNA, 22 bp, Homo sapiens
tgcccaagatcctacatcctga

SEQ ID NO: 7301656 - DNA, 22 bp, Homo sapiens
tgccatccatcagtatttgtgg

SEQ ID NO: 7301657 - DNA, 22 bp, Homo sapiens
tgccatccccatgtggtggaga

SEQ ID NO: 7301658 - DNA, 22 bp, Homo sapiens
tgccatctctccatagcataga

SEQ ID NO: 7301659 - DNA, 22 bp, Homo sapiens
tgccatctgaaaattacatcct

SEQ ID NO: 7301660 - DNA, 22 bp, Homo sapiens
tgccatggaagtggccagacct

SEQ ID NO: 7301661 - DNA, 22 bp, Homo sapiens
tgccatcttcaataacactgag

SEQ ID NO: 7301662 - DNA, 22 bp, Homo sapiens
tgccagggagccctgctgacca

SEQ ID NO: 7301663 - DNA, 22 bp, Homo sapiens
tgcctctgctgcatattcacct

SEQ ID NO: 7301664 - DNA, 22 bp, Homo sapiens
tgcctcagtctaaagtctctca

SEQ ID NO: 7301665 - DNA, 22 bp, Homo sapiens
tgcctggagtgtgttcaggatt

SEQ ID NO: 7301666 - DNA, 19 bp, Homo sapiens
tgcctggagcataacaggc

SEQ ID NO: 7301667 - DNA, 21 bp, Homo sapiens
tgcctgcattctatcagacca

SEQ ID NO: 7301668 - DNA, 18 bp, Homo sapiens
tgcctggaaggaacagga

SEQ ID NO: 7301669 - DNA, 22 bp, Homo sapiens
tgcctggaaggcccatgggaag

SEQ ID NO: 7301670 - DNA, 22 bp, Homo sapiens
tgccctggaaccatctacagtc

SEQ ID NO: 7301671 - DNA, 22 bp, Homo sapiens
tgccctggcattgggttggata

SEQ ID NO: 7301672 - DNA, 22 bp, Homo sapiens
tgccctggcacacacacagctg

SEQ ID NO: 7301673 - DNA, 22 bp, Homo sapiens
tgccctggctctccactagttt

SEQ ID NO: 7301674 - DNA, 22 bp, Homo sapiens
tgccctggctcttcttgttcca

SEQ ID NO: 7301675 - DNA, 22 bp, Homo sapiens
tgccctggctcctcccacgctg

SEQ ID NO: 7301676 - DNA, 22 bp, Homo sapiens
tgccgcagtgcggggagggccc

SEQ ID NO: 7301677 - DNA, 22 bp, Homo sapiens
tgcctagcatagtatttgtcac

SEQ ID NO: 7301678 - DNA, 22 bp, Homo sapiens
tgcctcagagacctgacagtac

SEQ ID NO: 7301679 - DNA, 22 bp, Homo sapiens
tgccgtgtcccattgtgctctg

SEQ ID NO: 7301680 - DNA, 22 bp, Homo sapiens
tgcctacattccttgcttatgg

SEQ ID NO: 7301681 - DNA, 22 bp, Homo sapiens
tgccgctccaggtctcgcggtg

SEQ ID NO: 7301682 - DNA, 22 bp, Homo sapiens
tgccgctgtcgccaccatggct

SEQ ID NO: 7301683 - DNA, 22 bp, Homo sapiens
tgccgtgcccatattgtgggtg

SEQ ID NO: 7301684 - DNA, 22 bp, Homo sapiens
tgaaatcttcactaagtctctt

SEQ ID NO: 7301685 - DNA, 22 bp, Homo sapiens
tgaaatgaaacagaacatatca

SEQ ID NO: 7301686 - DNA, 22 bp, Homo sapiens
tgaaatcattgccaagtattga

SEQ ID NO: 7301687 - DNA, 22 bp, Homo sapiens
tgaaatcattggggttgaataa

SEQ ID NO: 7301688 - DNA, 21 bp, Homo sapiens
tgaaatctgatgggacaaatg

SEQ ID NO: 7301689 - DNA, 22 bp, Homo sapiens
tgaaatctcctctttatatatc

SEQ ID NO: 7301690 - DNA, 22 bp, Homo sapiens
tgaaatctaccctattcagggt

SEQ ID NO: 7301691 - DNA, 22 bp, Homo sapiens
tgaaatctgcatgcaaagtcct

SEQ ID NO: 7301692 - DNA, 22 bp, Homo sapiens
tgaaatctgtcccactttagct

SEQ ID NO: 7301693 - DNA, 22 bp, Homo sapiens
tgaaatcatgaacaaggtaggt

SEQ ID NO: 7301694 - DNA, 22 bp, Homo sapiens
tgaaatcatgagatagtgtcac

SEQ ID NO: 7301695 - DNA, 22 bp, Homo sapiens
tgaaatcatgtagttattgcaa

SEQ ID NO: 7301696 - DNA, 22 bp, Homo sapiens
tgaaatcatgtagttattgcaa

SEQ ID NO: 7301697 - DNA, 22 bp, Homo sapiens
tgaaatcattgccaagtattga

SEQ ID NO: 7301698 - DNA, 22 bp, Homo sapiens
tgaaattagaaatatgtatggg

SEQ ID NO: 7301699 - DNA, 22 bp, Homo sapiens
tgaaatgttctggagtttctgt

SEQ ID NO: 7301700 - DNA, 22 bp, Homo sapiens
tgaaatgtggagatggtaagta

SEQ ID NO: 7301701 - DNA, 22 bp, Homo sapiens
tgaaatgtcagtgttttataag

SEQ ID NO: 7301702 - DNA, 22 bp, Homo sapiens
tgaaatcagtatgtctttctca

SEQ ID NO: 7301703 - DNA, 23 bp, Homo sapiens
tgaaatcagaacccttacctctc

SEQ ID NO: 7301704 - DNA, 17 bp, Homo sapiens
tgaaatcagcacccagg

SEQ ID NO: 7301705 - DNA, 22 bp, Homo sapiens
tgaaatcaattgcaatgtttat

SEQ ID NO: 7301706 - DNA, 22 bp, Homo sapiens
tgaaatcaattgcaatgtttat

SEQ ID NO: 7301707 - DNA, 22 bp, Homo sapiens
tgaaatcatctgccaataagtt

SEQ ID NO: 7301708 - DNA, 22 bp, Homo sapiens
tgaaatcataacagtttggctt

SEQ ID NO: 7301709 - DNA, 22 bp, Homo sapiens
tgaaatcatcaaaagagccatt

SEQ ID NO: 7301710 - DNA, 22 bp, Homo sapiens
tgaaatcagtggtataatcggg

SEQ ID NO: 7301711 - DNA, 22 bp, Homo sapiens
tgaaatcaactaggagacacca

SEQ ID NO: 7301712 - DNA, 22 bp, Homo sapiens
tgaaatcaatgtcttctgtctc

SEQ ID NO: 7301713 - DNA, 22 bp, Homo sapiens
tgaaatcaataattggtgattg

SEQ ID NO: 7301714 - DNA, 22 bp, Homo sapiens
tgaaatatgctcccattcactt

SEQ ID NO: 7301715 - DNA, 22 bp, Homo sapiens
tgaaatatcattttcatctccc

SEQ ID NO: 7301716 - DNA, 20 bp, Homo sapiens
tgaaatagatactcagagat

SEQ ID NO: 7301717 - DNA, 22 bp, Homo sapiens
tgaaatagtcaagtatttgaac

SEQ ID NO: 7301718 - DNA, 23 bp, Homo sapiens
tgaaagttctgaagagatcatgc

SEQ ID NO: 7301719 - DNA, 22 bp, Homo sapiens
tgaaagttcaataccaatttgg

SEQ ID NO: 7301720 - DNA, 22 bp, Homo sapiens
tgaaagttgcacataagagaat

SEQ ID NO: 7301721 - DNA, 21 bp, Homo sapiens
tgaaagttggagtcaaatgta

SEQ ID NO: 7301722 - DNA, 22 bp, Homo sapiens
tgaaagttacaggaaaacagat

SEQ ID NO: 7301723 - DNA, 22 bp, Homo sapiens
tgaaagttaggatgtagtaatt

SEQ ID NO: 7301724 - DNA, 22 bp, Homo sapiens
tgaagattttcgggtacttgat

SEQ ID NO: 7301725 - DNA, 22 bp, Homo sapiens
tgaagattttgtagctttcagc

SEQ ID NO: 7301726 - DNA, 19 bp, Homo sapiens
tgaagcaggcagagaagat

SEQ ID NO: 7301727 - DNA, 22 bp, Homo sapiens
tgaagcaggaaccagcagcatt

SEQ ID NO: 7301728 - DNA, 22 bp, Homo sapiens
tgaagagaagaaaattatcttt

SEQ ID NO: 7301729 - DNA, 22 bp, Homo sapiens
tgaagacagttttactcatgag

SEQ ID NO: 7301730 - DNA, 22 bp, Homo sapiens
tgaagacaaagtcaggcccaga

SEQ ID NO: 7301731 - DNA, 22 bp, Homo sapiens
tgaagaaacagaccaagaggat

SEQ ID NO: 7301732 - DNA, 22 bp, Homo sapiens
tgaagaaacgcagagaggtagg

SEQ ID NO: 7301733 - DNA, 22 bp, Homo sapiens
tgaagaaaggtgtgggatactc

SEQ ID NO: 7301734 - DNA, 22 bp, Homo sapiens
tgaagaaacgcagagaggtagg

SEQ ID NO: 7301735 - DNA, 22 bp, Homo sapiens
tgaagaacgtgagatccagaaa

SEQ ID NO: 7301736 - DNA, 22 bp, Homo sapiens
tgaacatgctgttgatggcctg

SEQ ID NO: 7301737 - DNA, 22 bp, Homo sapiens
tgaacattcctgaatgaagcat

SEQ ID NO: 7301738 - DNA, 22 bp, Homo sapiens
tgaactttgtagtaatggagat

SEQ ID NO: 7301739 - DNA, 22 bp, Homo sapiens
tgaactttcacaagaatatgct

SEQ ID NO: 7301740 - DNA, 22 bp, Homo sapiens
tgaacttcagtgcataattatc

SEQ ID NO: 7301741 - DNA, 22 bp, Homo sapiens
tgaacttcagtgatttgctgca

SEQ ID NO: 7301742 - DNA, 18 bp, Homo sapiens
tgaactggcatcagaatc

SEQ ID NO: 7301743 - DNA, 22 bp, Homo sapiens
tgaactcctgacctcatgatcc

SEQ ID NO: 7301744 - DNA, 22 bp, Homo sapiens
tgaactctccaggcaaatgatc

SEQ ID NO: 7301745 - DNA, 21 bp, Homo sapiens
tgaactctggtcatcttcatt

SEQ ID NO: 7301746 - DNA, 22 bp, Homo sapiens
tgaaattattcttaccaaggtg

SEQ ID NO: 7301747 - DNA, 22 bp, Homo sapiens
tgaaattatgcattgttgtacc

SEQ ID NO: 7301748 - DNA, 22 bp, Homo sapiens
tgaaattatgcattgttgtacc

SEQ ID NO: 7301749 - DNA, 22 bp, Homo sapiens
tgaaattagaaatatgtatggg

SEQ ID NO: 7301750 - DNA, 22 bp, Homo sapiens
tgaaattagtgaagttacagtt

SEQ ID NO: 7301751 - DNA, 22 bp, Homo sapiens
tgaaatttaggtgcagataaat

SEQ ID NO: 7301752 - DNA, 22 bp, Homo sapiens
tgaacaaactgcattcttcact

SEQ ID NO: 7301753 - DNA, 22 bp, Homo sapiens
tgaacacacacctatgtacaaa

SEQ ID NO: 7301754 - DNA, 23 bp, Homo sapiens
tgaacaaaggcaggagaaggcgg

SEQ ID NO: 7301755 - DNA, 22 bp, Homo sapiens
tgaacaaatggaaataaccagt

SEQ ID NO: 7301756 - DNA, 22 bp, Homo sapiens
tgaacaaatggaaataaccagt

SEQ ID NO: 7301757 - DNA, 22 bp, Homo sapiens
tgaacaaatgaatcagtgtagc

SEQ ID NO: 7301758 - DNA, 22 bp, Homo sapiens
tgaaagaaacaggtatattggg

SEQ ID NO: 7301759 - DNA, 22 bp, Homo sapiens
tgaaacttctaatatgaatagt

SEQ ID NO: 7301760 - DNA, 22 bp, Homo sapiens
tgaaacttgagtatatatggat

SEQ ID NO: 7301761 - DNA, 22 bp, Homo sapiens
tgaaacttataagaatatgaat

SEQ ID NO: 7301762 - DNA, 17 bp, Homo sapiens
tgaaagaatcagggaga

SEQ ID NO: 7301763 - DNA, 22 bp, Homo sapiens
tgaaagacaaggttttttcaga

SEQ ID NO: 7301764 - DNA, 22 bp, Homo sapiens
tgaaagaagccttcgaggctcg

SEQ ID NO: 7301765 - DNA, 21 bp, Homo sapiens
tgaaagaaggtgcagtctgaa

SEQ ID NO: 7301766 - DNA, 22 bp, Homo sapiens
tgaaagaagggtggaaaatgta

SEQ ID NO: 7301767 - DNA, 22 bp, Homo sapiens
tgaaagaagggtggaaaatgta

SEQ ID NO: 7301768 - DNA, 22 bp, Homo sapiens
tgaaacaaaattaagattctcg

SEQ ID NO: 7301769 - DNA, 19 bp, Homo sapiens
tgaaacaaacttaaaagga

SEQ ID NO: 7301770 - DNA, 22 bp, Homo sapiens
tgaaacagtctccagacttgga

SEQ ID NO: 7301771 - DNA, 23 bp, Homo sapiens
tgaaacatttagggtagaatttc

SEQ ID NO: 7301772 - DNA, 22 bp, Homo sapiens
tgaaacattgcactgtatgaat

SEQ ID NO: 7301773 - DNA, 22 bp, Homo sapiens
tgaaacattaggaaatcattat

SEQ ID NO: 7301774 - DNA, 22 bp, Homo sapiens
tgaaacattatagaatatttat

SEQ ID NO: 7301775 - DNA, 22 bp, Homo sapiens
tgaaacattatagaatatttat

SEQ ID NO: 7301776 - DNA, 22 bp, Homo sapiens
tgaaacattaggaaatcattat

SEQ ID NO: 7301777 - DNA, 22 bp, Homo sapiens
tgaaacattaggaaatcattat

SEQ ID NO: 7301778 - DNA, 22 bp, Homo sapiens
tgaaaaggagtccttgttttca

SEQ ID NO: 7301779 - DNA, 22 bp, Homo sapiens
tgaaaagggtagatccctaagt

SEQ ID NO: 7301780 - DNA, 22 bp, Homo sapiens
tgaaaagtcttatattgtctga

SEQ ID NO: 7301781 - DNA, 22 bp, Homo sapiens
tgaaaagtgatcatggattagg

SEQ ID NO: 7301782 - DNA, 22 bp, Homo sapiens
tgaaaatatagttttccagact

SEQ ID NO: 7301783 - DNA, 22 bp, Homo sapiens
tgaaaatatagttttccagact

SEQ ID NO: 7301784 - DNA, 22 bp, Homo sapiens
tgaaaattgttgtacttgataa

SEQ ID NO: 7301785 - DNA, 22 bp, Homo sapiens
tgaaaatttccatcagttatat

SEQ ID NO: 7301786 - DNA, 22 bp, Homo sapiens
tgaaaatggcctgaagaagcaa

SEQ ID NO: 7301787 - DNA, 22 bp, Homo sapiens
tgaaaatgccctctatgtctca

SEQ ID NO: 7301788 - DNA, 22 bp, Homo sapiens
tgaaaattcatctcatagcaga

SEQ ID NO: 7301789 - DNA, 22 bp, Homo sapiens
tctttttatattgacaaaaggt

SEQ ID NO: 7301790 - DNA, 22 bp, Homo sapiens
tcttttgttgcctacttattaa

SEQ ID NO: 7301791 - DNA, 22 bp, Homo sapiens
tctttttatattgacaaaaggt

SEQ ID NO: 7301792 - DNA, 22 bp, Homo sapiens
tgaaaaactttaatccataaag

SEQ ID NO: 7301793 - DNA, 22 bp, Homo sapiens
tgaaaaactttaatccataaag

SEQ ID NO: 7301794 - DNA, 22 bp, Homo sapiens
tgaaaacactttagtttaggtc

SEQ ID NO: 7301795 - DNA, 22 bp, Homo sapiens
tgaaaacagaatccttgttttc

SEQ ID NO: 7301796 - DNA, 22 bp, Homo sapiens
tgaaaactccaagtttcatcag

SEQ ID NO: 7301797 - DNA, 22 bp, Homo sapiens
tgaaaaacactaattggaaagc

SEQ ID NO: 7301798 - DNA, 22 bp, Homo sapiens
tgaaaaactgaatagttgagta

SEQ ID NO: 7301799 - DNA, 22 bp, Homo sapiens
tctttgattttgttactaagac

SEQ ID NO: 7301800 - DNA, 22 bp, Homo sapiens
tctttgcacacagcgattcttc

SEQ ID NO: 7301801 - DNA, 22 bp, Homo sapiens
tctttgcatgtgcttcttggcc

SEQ ID NO: 7301802 - DNA, 22 bp, Homo sapiens
tctttgtaagacatgtaagtcc

SEQ ID NO: 7301803 - DNA, 22 bp, Homo sapiens
tctttgtacaggaaggcactgt

SEQ ID NO: 7301804 - DNA, 22 bp, Homo sapiens
tctttgtatgtatgtttcaaag

SEQ ID NO: 7301805 - DNA, 22 bp, Homo sapiens
tctttgtcattaaactagtaac

SEQ ID NO: 7301806 - DNA, 22 bp, Homo sapiens
tctttgtgccatgcagtgaggc

SEQ ID NO: 7301807 - DNA, 22 bp, Homo sapiens
tctttgtggcgggcttaaatac

SEQ ID NO: 7301808 - DNA, 22 bp, Homo sapiens
tcttttagctctgcaaggaaag

SEQ ID NO: 7301809 - DNA, 22 bp, Homo sapiens
tcttttagtaataaatatttgt

SEQ ID NO: 7301810 - DNA, 22 bp, Homo sapiens
tcttttatagtgaattttcttg

SEQ ID NO: 7301811 - DNA, 22 bp, Homo sapiens
tcttttaagcctctggcatagg

SEQ ID NO: 7301812 - DNA, 22 bp, Homo sapiens
tcttttaagcctctggcatagg

SEQ ID NO: 7301813 - DNA, 22 bp, Homo sapiens
tctttgttattgctttatctat

SEQ ID NO: 7301814 - DNA, 22 bp, Homo sapiens
tctttgttattgctttatctat

SEQ ID NO: 7301815 - DNA, 20 bp, Homo sapiens
tctttgttaattttatctcc

SEQ ID NO: 7301816 - DNA, 20 bp, Homo sapiens
tctttgttaattttatctcc

SEQ ID NO: 7301817 - DNA, 22 bp, Homo sapiens
tctttgtttgtactgttagaat

SEQ ID NO: 7301818 - DNA, 22 bp, Homo sapiens
tcttttaaaagccctgctgtct

SEQ ID NO: 7301819 - DNA, 22 bp, Homo sapiens
tcttttccttccctacagatct

SEQ ID NO: 7301820 - DNA, 22 bp, Homo sapiens
tcttttcaggaatggctctagt

SEQ ID NO: 7301821 - DNA, 19 bp, Homo sapiens
tcttttcacgcattttgaa

SEQ ID NO: 7301822 - DNA, 23 bp, Homo sapiens
tcttttcaatggttctttatgtg

SEQ ID NO: 7301823 - DNA, 22 bp, Homo sapiens
tcttttcacaaaggagctggag

SEQ ID NO: 7301824 - DNA, 22 bp, Homo sapiens
tgaaggtgacctgacagtggct

SEQ ID NO: 7301825 - DNA, 22 bp, Homo sapiens
tgaaggtcatggtaatattttt

SEQ ID NO: 7301826 - DNA, 22 bp, Homo sapiens
tgaagtttaaggttagataagt

SEQ ID NO: 7301827 - DNA, 21 bp, Homo sapiens
tgaagggcagcctcaggctcc

SEQ ID NO: 7301828 - DNA, 22 bp, Homo sapiens
tgaagggcaaccccaggcccag

SEQ ID NO: 7301829 - DNA, 22 bp, Homo sapiens
tgaaggcataaatcttgggaac

SEQ ID NO: 7301830 - DNA, 22 bp, Homo sapiens
tgaaggcatttgagttggtgag

SEQ ID NO: 7301831 - DNA, 22 bp, Homo sapiens
tgaaggcacttgcctaggggca

SEQ ID NO: 7301832 - DNA, 22 bp, Homo sapiens
tgaaggcacgtgggtggatact

SEQ ID NO: 7301833 - DNA, 22 bp, Homo sapiens
tgaagctggaagcatgcagact

SEQ ID NO: 7301834 - DNA, 22 bp, Homo sapiens
tgacacaaacaagatatttgcc

SEQ ID NO: 7301835 - DNA, 22 bp, Homo sapiens
tgacaaatacaataagatctgt

SEQ ID NO: 7301836 - DNA, 20 bp, Homo sapiens
tgacaaatgatctgattttc

SEQ ID NO: 7301837 - DNA, 22 bp, Homo sapiens
tgaattgctgccatcatatttc

SEQ ID NO: 7301838 - DNA, 21 bp, Homo sapiens
tgaatttccctctatcattct

SEQ ID NO: 7301839 - DNA, 22 bp, Homo sapiens
tgaattctggctcttctgttta

SEQ ID NO: 7301840 - DNA, 22 bp, Homo sapiens
tgaattcatccatttatgcaag

SEQ ID NO: 7301841 - DNA, 22 bp, Homo sapiens
tgaattccattgccaaagtttt

SEQ ID NO: 7301842 - DNA, 22 bp, Homo sapiens
tgaattcaggggctattatatt

SEQ ID NO: 7301843 - DNA, 22 bp, Homo sapiens
tgaattcacctgaaagtctgga

SEQ ID NO: 7301844 - DNA, 22 bp, Homo sapiens
tgaatccagagctatttcgtcc

SEQ ID NO: 7301845 - DNA, 22 bp, Homo sapiens
tgaatcaatgaattgcacttca

SEQ ID NO: 7301846 - DNA, 22 bp, Homo sapiens
tgaatcaaagctgaagttttca

SEQ ID NO: 7301847 - DNA, 22 bp, Homo sapiens
tgaatatgttcctcacaagttc

SEQ ID NO: 7301848 - DNA, 22 bp, Homo sapiens
tgaatctttttggaaataaaga

SEQ ID NO: 7301849 - DNA, 22 bp, Homo sapiens
tgaatgaatgaattaatagagt

SEQ ID NO: 7301850 - DNA, 22 bp, Homo sapiens
tgaatgaatcctaacaaagaca

SEQ ID NO: 7301851 - DNA, 19 bp, Homo sapiens
tgaattaaagattaaagtc

SEQ ID NO: 7301852 - DNA, 22 bp, Homo sapiens
tgactctgaatttatgaaatgg

SEQ ID NO: 7301853 - DNA, 22 bp, Homo sapiens
tgactctgaattgggaaatggg

SEQ ID NO: 7301854 - DNA, 22 bp, Homo sapiens
tgactctggcttcaagtttctt

SEQ ID NO: 7301855 - DNA, 19 bp, Homo sapiens
tgactctgtggaacagaag

SEQ ID NO: 7301856 - DNA, 20 bp, Homo sapiens
tgactattcccacatgagag

SEQ ID NO: 7301857 - DNA, 22 bp, Homo sapiens
tgacctttctctgggtgcttgg

SEQ ID NO: 7301858 - DNA, 22 bp, Homo sapiens
tgacctttcaacccttcttggc

SEQ ID NO: 7301859 - DNA, 22 bp, Homo sapiens
tgacctgggcattacaggtgca

SEQ ID NO: 7301860 - DNA, 22 bp, Homo sapiens
tgactgcccccaccgcacaggc

SEQ ID NO: 7301861 - DNA, 22 bp, Homo sapiens
tgactgccatgagggtgagggc

SEQ ID NO: 7301862 - DNA, 22 bp, Homo sapiens
tgactgaagaagccacattgga

SEQ ID NO: 7301863 - DNA, 22 bp, Homo sapiens
tgacttcctgcactcaggtgat

SEQ ID NO: 7301864 - DNA, 22 bp, Homo sapiens
tgacttcctgcactcaggtgat

SEQ ID NO: 7301865 - DNA, 22 bp, Homo sapiens
tgactttaaaataacaagttta

SEQ ID NO: 7301866 - DNA, 22 bp, Homo sapiens
tgacttgtattttaaataattg

SEQ ID NO: 7301867 - DNA, 22 bp, Homo sapiens
tgacttgtctctttgggagaca

SEQ ID NO: 7301868 - DNA, 22 bp, Homo sapiens
tgaccctggcctggtggcggaa

SEQ ID NO: 7301869 - DNA, 22 bp, Homo sapiens
tgacatttttataagagtcaaa

SEQ ID NO: 7301870 - DNA, 22 bp, Homo sapiens
tgaccctggcagcccactggcc

SEQ ID NO: 7301871 - DNA, 22 bp, Homo sapiens
tgacattttatcaatatcacag

SEQ ID NO: 7301872 - DNA, 22 bp, Homo sapiens
tgacattttatcaatatcacag

SEQ ID NO: 7301873 - DNA, 21 bp, Homo sapiens
tgacatttggattcatagtaa

SEQ ID NO: 7301874 - DNA, 22 bp, Homo sapiens
tgacatttgagcatacatgtaa

SEQ ID NO: 7301875 - DNA, 22 bp, Homo sapiens
tgacatttgagcatacatgtaa

SEQ ID NO: 7301876 - DNA, 22 bp, Homo sapiens
tgacatttgagagagatataca

SEQ ID NO: 7301877 - DNA, 22 bp, Homo sapiens
tgacatttgagagagatataca

SEQ ID NO: 7301878 - DNA, 22 bp, Homo sapiens
tgacatttcttgttgatataaa

SEQ ID NO: 7301879 - DNA, 22 bp, Homo sapiens
tgacatttcttgttgatataaa

SEQ ID NO: 7301880 - DNA, 22 bp, Homo sapiens
tgacatttcggtgtatgtgatg

SEQ ID NO: 7301881 - DNA, 22 bp, Homo sapiens
tgacatttcggtgtatgtgatg

SEQ ID NO: 7301882 - DNA, 22 bp, Homo sapiens
tgacatttcctagtgctttgtg

SEQ ID NO: 7301883 - DNA, 22 bp, Homo sapiens
tgacatttcctagtgctttgtg

SEQ ID NO: 7301884 - DNA, 22 bp, Homo sapiens
tgacatttaatccctaaatatt

SEQ ID NO: 7301885 - DNA, 22 bp, Homo sapiens
tgacatttaattaacgaatgct

SEQ ID NO: 7301886 - DNA, 22 bp, Homo sapiens
tgacatttaatccctaaatatt

SEQ ID NO: 7301887 - DNA, 22 bp, Homo sapiens
tgacatttaagcctctgatttc

SEQ ID NO: 7301888 - DNA, 22 bp, Homo sapiens
tgacatttaagcctctgatttc

SEQ ID NO: 7301889 - DNA, 22 bp, Homo sapiens
tgacattgtgtgcatttaaagt

SEQ ID NO: 7301890 - DNA, 22 bp, Homo sapiens
tgacattggttgcaaggtactc

SEQ ID NO: 7301891 - DNA, 22 bp, Homo sapiens
tgacatttcagatatggtattt

SEQ ID NO: 7301892 - DNA, 22 bp, Homo sapiens
tgacatttcagatatggtattt

SEQ ID NO: 7301893 - DNA, 22 bp, Homo sapiens
tgacatttatcttctacaatga

SEQ ID NO: 7301894 - DNA, 21 bp, Homo sapiens
tgacatttccaatataaagcc

SEQ ID NO: 7301895 - DNA, 21 bp, Homo sapiens
tgacatttccaatataaagcc

SEQ ID NO: 7301896 - DNA, 21 bp, Homo sapiens
tgacatttccaatataaagcc

SEQ ID NO: 7301897 - DNA, 22 bp, Homo sapiens
tgacatttatcttctacaatga

SEQ ID NO: 7301898 - DNA, 22 bp, Homo sapiens
tgacatttatcaaagaaatggt

SEQ ID NO: 7301899 - DNA, 22 bp, Homo sapiens
tgacacttccggtaaaaaatgc

SEQ ID NO: 7301900 - DNA, 22 bp, Homo sapiens
tgacagaaagaatatgtcaatc

SEQ ID NO: 7301901 - DNA, 22 bp, Homo sapiens
tgacagaaagagtattaaagat

SEQ ID NO: 7301902 - DNA, 22 bp, Homo sapiens
tgacagcagcatagtgagcaat

SEQ ID NO: 7301903 - DNA, 23 bp, Homo sapiens
tgacagaccttcccagacagtca

SEQ ID NO: 7301904 - DNA, 22 bp, Homo sapiens
tgacacagattagagacatacc

SEQ ID NO: 7301905 - DNA, 19 bp, Homo sapiens
tgacacagctaggtttgct

SEQ ID NO: 7301906 - DNA, 22 bp, Homo sapiens
tgacacagggcatgcagcagaa

SEQ ID NO: 7301907 - DNA, 22 bp, Homo sapiens
tgacacagtatcaaacatgatt

SEQ ID NO: 7301908 - DNA, 22 bp, Homo sapiens
tgacacagtatcaaacatgatt

SEQ ID NO: 7301909 - DNA, 22 bp, Homo sapiens
tgacacagtgggggatcctttt

SEQ ID NO: 7301910 - DNA, 22 bp, Homo sapiens
tgacacagttgtcgactctaca

SEQ ID NO: 7301911 - DNA, 23 bp, Homo sapiens
tgacagcaggaactgattatgta

SEQ ID NO: 7301912 - DNA, 22 bp, Homo sapiens
tgacagctgccacaaaggccat

SEQ ID NO: 7301913 - DNA, 22 bp, Homo sapiens
tgacagcattactaatacatgt

SEQ ID NO: 7301914 - DNA, 22 bp, Homo sapiens
tgacaggatgatgagcaggggg

SEQ ID NO: 7301915 - DNA, 22 bp, Homo sapiens
tgagcaggctcccacttcagtg

SEQ ID NO: 7301916 - DNA, 22 bp, Homo sapiens
tgagcaggcgcagcaggaggtc

SEQ ID NO: 7301917 - DNA, 22 bp, Homo sapiens
tgagcaggattcgcctcttgca

SEQ ID NO: 7301918 - DNA, 22 bp, Homo sapiens
tgagcaggagataaacaggtag

SEQ ID NO: 7301919 - DNA, 22 bp, Homo sapiens
tgagcagagcaataggactctc

SEQ ID NO: 7301920 - DNA, 22 bp, Homo sapiens
tgagcagtgatgcgttttgttt

SEQ ID NO: 7301921 - DNA, 22 bp, Homo sapiens
tgagcagtggcaccaggtcacc

SEQ ID NO: 7301922 - DNA, 22 bp, Homo sapiens
tgagcagtggctcctgctggac

SEQ ID NO: 7301923 - DNA, 22 bp, Homo sapiens
tgagcagtggggcctgcattct

SEQ ID NO: 7301924 - DNA, 22 bp, Homo sapiens
tgagcagtggtgtttttctatc

SEQ ID NO: 7301925 - DNA, 22 bp, Homo sapiens
tgagcagttcgacttcttcccc

SEQ ID NO: 7301926 - DNA, 22 bp, Homo sapiens
tgagcagggagctgggctgagc

SEQ ID NO: 7301927 - DNA, 22 bp, Homo sapiens
tgagccagaggaggctgtgtgg

SEQ ID NO: 7301928 - DNA, 22 bp, Homo sapiens
tgagccagctccttgcctgtca

SEQ ID NO: 7301929 - DNA, 22 bp, Homo sapiens
tgagccctccaaacccaggatt

SEQ ID NO: 7301930 - DNA, 22 bp, Homo sapiens
tgagccctaatttacaacatct

SEQ ID NO: 7301931 - DNA, 22 bp, Homo sapiens
tgagccctgacctagcctggcc

SEQ ID NO: 7301932 - DNA, 22 bp, Homo sapiens
tgagcgtgcagtagtgttggta

SEQ ID NO: 7301933 - DNA, 22 bp, Homo sapiens
tgagcctgcaataagcacagcc

SEQ ID NO: 7301934 - DNA, 22 bp, Homo sapiens
tgaggaaaacgtattgaaagga

SEQ ID NO: 7301935 - DNA, 22 bp, Homo sapiens
tgagctgtatattgttttaata

SEQ ID NO: 7301936 - DNA, 22 bp, Homo sapiens
tgagctccggcatatggaatta

SEQ ID NO: 7301937 - DNA, 22 bp, Homo sapiens
tgagctcctggtcacaattatc

SEQ ID NO: 7301938 - DNA, 22 bp, Homo sapiens
tgagaagctgctgacttagcct

SEQ ID NO: 7301939 - DNA, 22 bp, Homo sapiens
tgagaagctgctgacttagcct

SEQ ID NO: 7301940 - DNA, 22 bp, Homo sapiens
tgagaagctgcttgtgctgtat

SEQ ID NO: 7301941 - DNA, 22 bp, Homo sapiens
tgagaatgtgcaatatccttcc

SEQ ID NO: 7301942 - DNA, 22 bp, Homo sapiens
tgagaagctctgaaacagtatc

SEQ ID NO: 7301943 - DNA, 20 bp, Homo sapiens
tgagaagctcctgtctcctc

SEQ ID NO: 7301944 - DNA, 23 bp, Homo sapiens
tgagaagccgccgggcagcctgg

SEQ ID NO: 7301945 - DNA, 22 bp, Homo sapiens
tgagaattacaaatgagtcaca

SEQ ID NO: 7301946 - DNA, 22 bp, Homo sapiens
tgagacagcagattagcaatga

SEQ ID NO: 7301947 - DNA, 22 bp, Homo sapiens
tgagacagcctctgcactcatg

SEQ ID NO: 7301948 - DNA, 22 bp, Homo sapiens
tgagaaaatccagaggctagtt

SEQ ID NO: 7301949 - DNA, 22 bp, Homo sapiens
tgagaaaattactataattgtc

SEQ ID NO: 7301950 - DNA, 22 bp, Homo sapiens
tgagaaaattactataattgtc

SEQ ID NO: 7301951 - DNA, 22 bp, Homo sapiens
tgagaaaggtatttcatgcact

SEQ ID NO: 7301952 - DNA, 22 bp, Homo sapiens
tgagaaatggcagcattactgg

SEQ ID NO: 7301953 - DNA, 22 bp, Homo sapiens
tgagaaatccagatgtgcagtt

SEQ ID NO: 7301954 - DNA, 22 bp, Homo sapiens
tgagaaattacttcagtgatgg

SEQ ID NO: 7301955 - DNA, 19 bp, Homo sapiens
tgagaaattccacaggatg

SEQ ID NO: 7301956 - DNA, 22 bp, Homo sapiens
tgagaaatattgcacagtgagg

SEQ ID NO: 7301957 - DNA, 22 bp, Homo sapiens
tgagaagcagcttacaggtgtc

SEQ ID NO: 7301958 - DNA, 22 bp, Homo sapiens
tgagaagcacagctcactcacg

SEQ ID NO: 7301959 - DNA, 22 bp, Homo sapiens
tgagaagcacagctcactcacg

SEQ ID NO: 7301960 - DNA, 22 bp, Homo sapiens
tgagaagatttgctcttctgag

SEQ ID NO: 7301961 - DNA, 22 bp, Homo sapiens
tgagaagattgggcagagtgga

SEQ ID NO: 7301962 - DNA, 22 bp, Homo sapiens
tgagaagattgggcagagtgga

SEQ ID NO: 7301963 - DNA, 22 bp, Homo sapiens
tgagaagatttgctcttctgag

SEQ ID NO: 7301964 - DNA, 23 bp, Homo sapiens
tgagaagccaggggagcgtgagg

SEQ ID NO: 7301965 - DNA, 22 bp, Homo sapiens
tgagaagcattaggaagaacat

SEQ ID NO: 7301966 - DNA, 22 bp, Homo sapiens
tgagaagcagtttcagtaagaa

SEQ ID NO: 7301967 - DNA, 23 bp, Homo sapiens
tgagaagccattagagcaggtgg

SEQ ID NO: 7301968 - DNA, 22 bp, Homo sapiens
tgagaagcccaagccgggtggt

SEQ ID NO: 7301969 - DNA, 22 bp, Homo sapiens
tgagaagcccacactctttcct

SEQ ID NO: 7301970 - DNA, 22 bp, Homo sapiens
tgagaagcccacactctttcct

SEQ ID NO: 7301971 - DNA, 17 bp, Homo sapiens
tgagagcagggctgggc

SEQ ID NO: 7301972 - DNA, 22 bp, Homo sapiens
tgagagcaacacgcagtagtat

SEQ ID NO: 7301973 - DNA, 22 bp, Homo sapiens
tgagagaggatgccctcatatt

SEQ ID NO: 7301974 - DNA, 22 bp, Homo sapiens
tgagagagcctgaatctcttac

SEQ ID NO: 7301975 - DNA, 18 bp, Homo sapiens
tgagagaatgttcatgct

SEQ ID NO: 7301976 - DNA, 18 bp, Homo sapiens
tgagagaatgttcatgct

SEQ ID NO: 7301977 - DNA, 22 bp, Homo sapiens
tgagaggctagatcagctctgt

SEQ ID NO: 7301978 - DNA, 18 bp, Homo sapiens
tgagaggcaggtagagga

SEQ ID NO: 7301979 - DNA, 22 bp, Homo sapiens
tgagaggcgctcactctcaggt

SEQ ID NO: 7301980 - DNA, 22 bp, Homo sapiens
tgagagctgctgagactgtcct

SEQ ID NO: 7301981 - DNA, 22 bp, Homo sapiens
tgagagctgccacgtgaccatg

SEQ ID NO: 7301982 - DNA, 22 bp, Homo sapiens
tgagagctgaagatatgttaac

SEQ ID NO: 7301983 - DNA, 22 bp, Homo sapiens
tgagagcttgagtatcactggc

SEQ ID NO: 7301984 - DNA, 22 bp, Homo sapiens
tgagagctgtccacctgtggga

SEQ ID NO: 7301985 - DNA, 20 bp, Homo sapiens
tgagaggacatttttcatgt

SEQ ID NO: 7301986 - DNA, 22 bp, Homo sapiens
tgagatgtaaggtatgcttact

SEQ ID NO: 7301987 - DNA, 22 bp, Homo sapiens
tgagatgtaaggtatgcttact

SEQ ID NO: 7301988 - DNA, 22 bp, Homo sapiens
tgagatggttcacagagaaggc

SEQ ID NO: 7301989 - DNA, 22 bp, Homo sapiens
tgagatggggagggctgcagaa

SEQ ID NO: 7301990 - DNA, 20 bp, Homo sapiens
tgagatttgtattataagtc

SEQ ID NO: 7301991 - DNA, 22 bp, Homo sapiens
tgagattttcctaaatataatg

SEQ ID NO: 7301992 - DNA, 22 bp, Homo sapiens
tgagattttcagcatcacttca

SEQ ID NO: 7301993 - DNA, 22 bp, Homo sapiens
tgagattttcctaaatataatg

SEQ ID NO: 7301994 - DNA, 22 bp, Homo sapiens
tgagatttgggttgtttaacat

SEQ ID NO: 7301995 - DNA, 22 bp, Homo sapiens
tgagatgaataactcctgctaa

SEQ ID NO: 7301996 - DNA, 17 bp, Homo sapiens
tgagatggaagaagact

SEQ ID NO: 7301997 - DNA, 22 bp, Homo sapiens
tgagatgaaagcagaaagactt

SEQ ID NO: 7301998 - DNA, 22 bp, Homo sapiens
tgagatcatttatttacctttc

SEQ ID NO: 7301999 - DNA, 23 bp, Homo sapiens
tgagataggtattattatcatgc

SEQ ID NO: 7302000 - DNA, 22 bp, Homo sapiens
tgagatcattgacttgttcctg

SEQ ID NO: 7302001 - DNA, 22 bp, Homo sapiens
tgagaggtcattaggccatgag

SEQ ID NO: 7302002 - DNA, 22 bp, Homo sapiens
tgagaggtcaaagggcatggag

SEQ ID NO: 7302003 - DNA, 22 bp, Homo sapiens
tgagtagcggctatgtgtaact

SEQ ID NO: 7302004 - DNA, 22 bp, Homo sapiens
tgagtcttctgcctaaagaagt

SEQ ID NO: 7302005 - DNA, 22 bp, Homo sapiens
tgagtcaccttggtattggcag

SEQ ID NO: 7302006 - DNA, 22 bp, Homo sapiens
tgagtcactgggtaatctggat

SEQ ID NO: 7302007 - DNA, 22 bp, Homo sapiens
tgagtcaccgacctggctggtt

SEQ ID NO: 7302008 - DNA, 23 bp, Homo sapiens
tgagtcaccacagttacagtcac

SEQ ID NO: 7302009 - DNA, 22 bp, Homo sapiens
tgaggggttgtgagaaatgtag

SEQ ID NO: 7302010 - DNA, 21 bp, Homo sapiens
tgaggggttataacagggtgg

SEQ ID NO: 7302011 - DNA, 22 bp, Homo sapiens
tgagggtctggaatctgggctt

SEQ ID NO: 7302012 - DNA, 22 bp, Homo sapiens
tgagggtctggaatctgggctt

SEQ ID NO: 7302013 - DNA, 22 bp, Homo sapiens
tgagggtgcatttagcatgtag

SEQ ID NO: 7302014 - DNA, 22 bp, Homo sapiens
tgaggggtaagtaaaggaattg

SEQ ID NO: 7302015 - DNA, 22 bp, Homo sapiens
tgaggggggtaatcactgggtt

SEQ ID NO: 7302016 - DNA, 22 bp, Homo sapiens
tgaggggggtaatcactgggtt

SEQ ID NO: 7302017 - DNA, 22 bp, Homo sapiens
tgagggaggcctccatctgcca

SEQ ID NO: 7302018 - DNA, 18 bp, Homo sapiens
tgaggaaggggaagtatt

SEQ ID NO: 7302019 - DNA, 23 bp, Homo sapiens
tgaggaagtaattgtaaaggtct

SEQ ID NO: 7302020 - DNA, 22 bp, Homo sapiens
tgaggaagttgatctcatcagt

SEQ ID NO: 7302021 - DNA, 22 bp, Homo sapiens
tgaggaagtggttgtatggttt

SEQ ID NO: 7302022 - DNA, 22 bp, Homo sapiens
tgaggaagtggttgtatggttt

SEQ ID NO: 7302023 - DNA, 22 bp, Homo sapiens
tgaggaagccaaacagctacac

SEQ ID NO: 7302024 - DNA, 22 bp, Homo sapiens
tgaggaagaacaagaatttaga

SEQ ID NO: 7302025 - DNA, 22 bp, Homo sapiens
tgaggataacccaggcaaactg

SEQ ID NO: 7302026 - DNA, 21 bp, Homo sapiens
tgaggataagtaaagctgaag

SEQ ID NO: 7302027 - DNA, 22 bp, Homo sapiens
tgaggatatagtggtaaacagt

SEQ ID NO: 7302028 - DNA, 22 bp, Homo sapiens
tgaggatggcagtgtgctcagc

SEQ ID NO: 7302029 - DNA, 22 bp, Homo sapiens
tgaggagcgggcagggatgcag

SEQ ID NO: 7302030 - DNA, 22 bp, Homo sapiens
tgaggagcttctggaaagtgca

SEQ ID NO: 7302031 - DNA, 23 bp, Homo sapiens
tgaggagcatagctgactgacag

SEQ ID NO: 7302032 - DNA, 19 bp, Homo sapiens
tgaggagcagctggttgat

SEQ ID NO: 7302033 - DNA, 19 bp, Homo sapiens
tgaggccaaggtcacagat

SEQ ID NO: 7302034 - DNA, 22 bp, Homo sapiens
tgaggccaggacccccagcagg

SEQ ID NO: 7302035 - DNA, 22 bp, Homo sapiens
tgaggccagcttcagcagtgga

SEQ ID NO: 7302036 - DNA, 22 bp, Homo sapiens
tgaggccacttccccacagccc

SEQ ID NO: 7302037 - DNA, 22 bp, Homo sapiens
tgaggccacagtatcagaacag

SEQ ID NO: 7302038 - DNA, 21 bp, Homo sapiens
tggaaagattcaaagaccagg

SEQ ID NO: 7302039 - DNA, 21 bp, Homo sapiens
tggaaagattcaaagaccagg

SEQ ID NO: 7302040 - DNA, 22 bp, Homo sapiens
tggaaagatgaagatgtttaag

SEQ ID NO: 7302041 - DNA, 22 bp, Homo sapiens
tggaaagagatgttgtttctga

SEQ ID NO: 7302042 - DNA, 22 bp, Homo sapiens
tggaaagaggaagtgcccagca

SEQ ID NO: 7302043 - DNA, 22 bp, Homo sapiens
tggaaagaggtagaggatctgg

SEQ ID NO: 7302044 - DNA, 22 bp, Homo sapiens
tggaaagaggtagaggatctgg

SEQ ID NO: 7302045 - DNA, 22 bp, Homo sapiens
tggaaaatgtgactattctaaa

SEQ ID NO: 7302046 - DNA, 22 bp, Homo sapiens
tggaaacaaagtcataagctca

SEQ ID NO: 7302047 - DNA, 22 bp, Homo sapiens
tggaaaacattgagataccaag

SEQ ID NO: 7302048 - DNA, 22 bp, Homo sapiens
tgctttgtgatatgctgtgtct

SEQ ID NO: 7302049 - DNA, 22 bp, Homo sapiens
tgctttggatctatttgctgag

SEQ ID NO: 7302050 - DNA, 22 bp, Homo sapiens
tgctttggccactagaattcag

SEQ ID NO: 7302051 - DNA, 22 bp, Homo sapiens
tgctttggcccaacattgatgc

SEQ ID NO: 7302052 - DNA, 22 bp, Homo sapiens
tgctttgggtttgactctcatg

SEQ ID NO: 7302053 - DNA, 22 bp, Homo sapiens
tggaaaaactgagacttagaca

SEQ ID NO: 7302054 - DNA, 22 bp, Homo sapiens
tggaaaaaacccagactctaga

SEQ ID NO: 7302055 - DNA, 19 bp, Homo sapiens
tggaaatggaagctcagcc

SEQ ID NO: 7302056 - DNA, 21 bp, Homo sapiens
tggaaatgagcgttcagcttt

SEQ ID NO: 7302057 - DNA, 22 bp, Homo sapiens
tggaaatatttgctcattatct

SEQ ID NO: 7302058 - DNA, 22 bp, Homo sapiens
tggaaatagttgtgagtcaggc

SEQ ID NO: 7302059 - DNA, 22 bp, Homo sapiens
tggaaagggacttatgagttcc

SEQ ID NO: 7302060 - DNA, 21 bp, Homo sapiens
tggaaagattcaaagaccagg

SEQ ID NO: 7302061 - DNA, 22 bp, Homo sapiens
tggaaaggtgtaaagcagaacc

SEQ ID NO: 7302062 - DNA, 22 bp, Homo sapiens
tggaaattactaacacttagag

SEQ ID NO: 7302063 - DNA, 22 bp, Homo sapiens
tggaagaaaattcaatcgagtt

SEQ ID NO: 7302064 - DNA, 23 bp, Homo sapiens
tggaagaaaatggtttggctgtg

SEQ ID NO: 7302065 - DNA, 22 bp, Homo sapiens
tggaagaaaattcaatcgagtt

SEQ ID NO: 7302066 - DNA, 22 bp, Homo sapiens
tggaagaaaattcaatcgagtt

SEQ ID NO: 7302067 - DNA, 22 bp, Homo sapiens
tggaacaatcccggtttagctc

SEQ ID NO: 7302068 - DNA, 22 bp, Homo sapiens
tgcttctgtttgtttctgtcat

SEQ ID NO: 7302069 - DNA, 22 bp, Homo sapiens
tgctttaaaatggactgttttg

SEQ ID NO: 7302070 - DNA, 22 bp, Homo sapiens
tgcttgtgtgagggcctgggag

SEQ ID NO: 7302071 - DNA, 22 bp, Homo sapiens
tgcttgtgacagaactgtgtcc

SEQ ID NO: 7302072 - DNA, 22 bp, Homo sapiens
tgctttaagacactaagtttga

SEQ ID NO: 7302073 - DNA, 22 bp, Homo sapiens
tgcttgtgacagaactgtgtcc

SEQ ID NO: 7302074 - DNA, 22 bp, Homo sapiens
tgcttgtcttcaggaatgctga

SEQ ID NO: 7302075 - DNA, 23 bp, Homo sapiens
tgctttgccagagcaaaagtcta

SEQ ID NO: 7302076 - DNA, 20 bp, Homo sapiens
tgctttatgctatactttgt

SEQ ID NO: 7302077 - DNA, 22 bp, Homo sapiens
tgctttatggatttgtgtcctg

SEQ ID NO: 7302078 - DNA, 22 bp, Homo sapiens
tgctttatatctctcttcttag

SEQ ID NO: 7302079 - DNA, 22 bp, Homo sapiens
tgctttataacttagtttatgg

SEQ ID NO: 7302080 - DNA, 22 bp, Homo sapiens
tggaccagggtcccagagtatg

SEQ ID NO: 7302081 - DNA, 22 bp, Homo sapiens
tggaccaacattcactggcata

SEQ ID NO: 7302082 - DNA, 22 bp, Homo sapiens
tggaccctgaagcaacagggag

SEQ ID NO: 7302083 - DNA, 23 bp, Homo sapiens
tggaccctgcacaccagctctac

SEQ ID NO: 7302084 - DNA, 22 bp, Homo sapiens
tggactctatgatgcgccagca

SEQ ID NO: 7302085 - DNA, 22 bp, Homo sapiens
tggactcagagttggtggcagt

SEQ ID NO: 7302086 - DNA, 22 bp, Homo sapiens
tggactaaagaggaaagatgta

SEQ ID NO: 7302087 - DNA, 23 bp, Homo sapiens
tggacactgtgcggggactaggt

SEQ ID NO: 7302088 - DNA, 22 bp, Homo sapiens
tggacacagtaggagctgcgca

SEQ ID NO: 7302089 - DNA, 22 bp, Homo sapiens
tggacacatcactgcagccact

SEQ ID NO: 7302090 - DNA, 22 bp, Homo sapiens
tggaatgagctggctaataacc

SEQ ID NO: 7302091 - DNA, 22 bp, Homo sapiens
tggaatgagtggctaagattca

SEQ ID NO: 7302092 - DNA, 22 bp, Homo sapiens
tggaattatctgaagtgatttg

SEQ ID NO: 7302093 - DNA, 22 bp, Homo sapiens
tggaattttgtattagctttga

SEQ ID NO: 7302094 - DNA, 22 bp, Homo sapiens
tggacaacatagtgagacctca

SEQ ID NO: 7302095 - DNA, 22 bp, Homo sapiens
tggaaggggagctggaaagggg

SEQ ID NO: 7302096 - DNA, 22 bp, Homo sapiens
tggaagggggaagacagctctg

SEQ ID NO: 7302097 - DNA, 22 bp, Homo sapiens
tggaaggagctaaggacctggg

SEQ ID NO: 7302098 - DNA, 22 bp, Homo sapiens
tggaagggagtgacagtcagag

SEQ ID NO: 7302099 - DNA, 22 bp, Homo sapiens
tggaaggggagctggaaagggg

SEQ ID NO: 7302100 - DNA, 20 bp, Homo sapiens
tggaagaagaactcaggctt

SEQ ID NO: 7302101 - DNA, 19 bp, Homo sapiens
tggaagaggaagggaaata

SEQ ID NO: 7302102 - DNA, 22 bp, Homo sapiens
tggaagagcaggcagacaatgc

SEQ ID NO: 7302103 - DNA, 22 bp, Homo sapiens
tggaagagcaggcagacaatgc

SEQ ID NO: 7302104 - DNA, 22 bp, Homo sapiens
tggaagatgaataaagattcta

SEQ ID NO: 7302105 - DNA, 22 bp, Homo sapiens
tggaagatatgctgattctctg

SEQ ID NO: 7302106 - DNA, 22 bp, Homo sapiens
tggaaggaagccaaggaaggtt

SEQ ID NO: 7302107 - DNA, 22 bp, Homo sapiens
tggaaggaaaggtagcagagaa

SEQ ID NO: 7302108 - DNA, 22 bp, Homo sapiens
tggaaggaacagagtttgaaac

SEQ ID NO: 7302109 - DNA, 22 bp, Homo sapiens
tggaaggaacagagtttgaaac

SEQ ID NO: 7302110 - DNA, 22 bp, Homo sapiens
tggaaggaaaggtagcagagaa

SEQ ID NO: 7302111 - DNA, 22 bp, Homo sapiens
tggaagcatcacttcttgcctg

SEQ ID NO: 7302112 - DNA, 23 bp, Homo sapiens
tggaagcagttccagcacaaata

SEQ ID NO: 7302113 - DNA, 22 bp, Homo sapiens
tggaagcactgaagagacaacc

SEQ ID NO: 7302114 - DNA, 22 bp, Homo sapiens
tggaagcacaggatcagtggaa

SEQ ID NO: 7302115 - DNA, 22 bp, Homo sapiens
tggaagcaacaactatggacca

SEQ ID NO: 7302116 - DNA, 23 bp, Homo sapiens
tggaagcaatcactgtagtgaat

SEQ ID NO: 7302117 - DNA, 22 bp, Homo sapiens
tggaagcagtcacttcctagtt

SEQ ID NO: 7302118 - DNA, 23 bp, Homo sapiens
tggaagcagaagtttcaatatcc

SEQ ID NO: 7302119 - DNA, 22 bp, Homo sapiens
tggagccagcaggactcagagg

SEQ ID NO: 7302120 - DNA, 22 bp, Homo sapiens
tggagccagcccaggcccctct

SEQ ID NO: 7302121 - DNA, 22 bp, Homo sapiens
tggagcaggtgctcagggtaat

SEQ ID NO: 7302122 - DNA, 22 bp, Homo sapiens
tggagccaaaaagggaaggaga

SEQ ID NO: 7302123 - DNA, 22 bp, Homo sapiens
tggagcaggtgccaggtgtgtg

SEQ ID NO: 7302124 - DNA, 22 bp, Homo sapiens
tggagcaggaaacatctagagg

SEQ ID NO: 7302125 - DNA, 21 bp, Homo sapiens
tggagctgaatttttggcatc

SEQ ID NO: 7302126 - DNA, 23 bp, Homo sapiens
tggagctgacagtcagagggagg

SEQ ID NO: 7302127 - DNA, 18 bp, Homo sapiens
tggagctgagtgctgtgc

SEQ ID NO: 7302128 - DNA, 22 bp, Homo sapiens
tggagcccaggagaggataaac

SEQ ID NO: 7302129 - DNA, 22 bp, Homo sapiens
tggagcccagggtgagaaggag

SEQ ID NO: 7302130 - DNA, 22 bp, Homo sapiens
tggagcccaggtgcaagagagt

SEQ ID NO: 7302131 - DNA, 22 bp, Homo sapiens
tggagcctcctcacactgtggc

SEQ ID NO: 7302132 - DNA, 22 bp, Homo sapiens
tggagctggcttgtggaagttg

SEQ ID NO: 7302133 - DNA, 22 bp, Homo sapiens
tggagctggcttgtggaagttg

SEQ ID NO: 7302134 - DNA, 22 bp, Homo sapiens
tggagctggaatttctgggcct

SEQ ID NO: 7302135 - DNA, 22 bp, Homo sapiens
tggagctggaatttgagctgga

SEQ ID NO: 7302136 - DNA, 22 bp, Homo sapiens
tggagctggaagaatgtagacg

SEQ ID NO: 7302137 - DNA, 17 bp, Homo sapiens
tggagctgcgtgtgttc

SEQ ID NO: 7302138 - DNA, 21 bp, Homo sapiens
tggagctgccacttgagctgc

SEQ ID NO: 7302139 - DNA, 21 bp, Homo sapiens
tggagctgccacttgagctgc

SEQ ID NO: 7302140 - DNA, 22 bp, Homo sapiens
tggagctgatacagctggcttt

SEQ ID NO: 7302141 - DNA, 22 bp, Homo sapiens
tggagctgatacagctggcttt

SEQ ID NO: 7302142 - DNA, 22 bp, Homo sapiens
tggagcagaggctgaggttggg

SEQ ID NO: 7302143 - DNA, 22 bp, Homo sapiens
tggagcagccatgatgacagag

SEQ ID NO: 7302144 - DNA, 22 bp, Homo sapiens
tggagcagccttttctaagcaa

SEQ ID NO: 7302145 - DNA, 22 bp, Homo sapiens
tggagcagcattcatccagcag

SEQ ID NO: 7302146 - DNA, 22 bp, Homo sapiens
tggagcagcacaagaaagggga

SEQ ID NO: 7302147 - DNA, 22 bp, Homo sapiens
tggagaagtcaaagtgaacagg

SEQ ID NO: 7302148 - DNA, 22 bp, Homo sapiens
tggagagaagaggcagtgtgct

SEQ ID NO: 7302149 - DNA, 22 bp, Homo sapiens
tggagaaagctgcatatggaaa

SEQ ID NO: 7302150 - DNA, 22 bp, Homo sapiens
tggagaaagctgcatatggaaa

SEQ ID NO: 7302151 - DNA, 22 bp, Homo sapiens
tggagaagctgtaggtggactc

SEQ ID NO: 7302152 - DNA, 22 bp, Homo sapiens
tggagaaggccggccaggagtg

SEQ ID NO: 7302153 - DNA, 22 bp, Homo sapiens
tggagaaggccggccaggagtg

SEQ ID NO: 7302154 - DNA, 22 bp, Homo sapiens
tggagagcaagtcgcagacatg

SEQ ID NO: 7302155 - DNA, 22 bp, Homo sapiens
tggagagcaagtcgcagacatg

SEQ ID NO: 7302156 - DNA, 22 bp, Homo sapiens
tggagagcaatgaggggcaggc

SEQ ID NO: 7302157 - DNA, 22 bp, Homo sapiens
tggagagcgcgacgggaggaag

SEQ ID NO: 7302158 - DNA, 22 bp, Homo sapiens
tggaggagaccattccactcag

SEQ ID NO: 7302159 - DNA, 22 bp, Homo sapiens
tggaggaaaaaaccaggcagag

SEQ ID NO: 7302160 - DNA, 20 bp, Homo sapiens
tggagctgtggtaaggagca

SEQ ID NO: 7302161 - DNA, 22 bp, Homo sapiens
tggagctggttctggggaagct

SEQ ID NO: 7302162 - DNA, 22 bp, Homo sapiens
tggagctggttctggggaagct

SEQ ID NO: 7302163 - DNA, 22 bp, Homo sapiens
tggagctggggtttgaatctgg

SEQ ID NO: 7302164 - DNA, 23 bp, Homo sapiens
tggagctgggcagctgggaaagt

SEQ ID NO: 7302165 - DNA, 22 bp, Homo sapiens
tggagctgggatttgaactgca

SEQ ID NO: 7302166 - DNA, 18 bp, Homo sapiens
tggaggcagagttctggc

SEQ ID NO: 7302167 - DNA, 19 bp, Homo sapiens
tggaggcctcaggaaaaga

SEQ ID NO: 7302168 - DNA, 22 bp, Homo sapiens
tggaggccggactgagaggcat

SEQ ID NO: 7302169 - DNA, 22 bp, Homo sapiens
tggaggccctcattgtagaagt

SEQ ID NO: 7302170 - DNA, 22 bp, Homo sapiens
tggaggccagtgaaagtagatt

SEQ ID NO: 7302171 - DNA, 23 bp, Homo sapiens
tggagggcagaataacagactac

SEQ ID NO: 7302172 - DNA, 22 bp, Homo sapiens
tggagggcatagctgttctttc

SEQ ID NO: 7302173 - DNA, 22 bp, Homo sapiens
tggagggcatctgtggtcaggc

SEQ ID NO: 7302174 - DNA, 22 bp, Homo sapiens
tggagggcatgctgtccatggg

SEQ ID NO: 7302175 - DNA, 22 bp, Homo sapiens
tggagggaacccaggctgctct

SEQ ID NO: 7302176 - DNA, 22 bp, Homo sapiens
tggagggctaagctgagggata

SEQ ID NO: 7302177 - DNA, 22 bp, Homo sapiens
tggagggcgcttagatggaggg

SEQ ID NO: 7302178 - DNA, 22 bp, Homo sapiens
tggagggctaagctgagggata

SEQ ID NO: 7302179 - DNA, 18 bp, Homo sapiens
tggagggcttgctgcagc

SEQ ID NO: 7302180 - DNA, 22 bp, Homo sapiens
tggaggtggagttggaaactga

SEQ ID NO: 7302181 - DNA, 22 bp, Homo sapiens
tggagggctctttcacctggta

SEQ ID NO: 7302182 - DNA, 22 bp, Homo sapiens
tggaggtgggagggactgtcct

SEQ ID NO: 7302183 - DNA, 20 bp, Homo sapiens
tggaggtggtctgctgtcct

SEQ ID NO: 7302184 - DNA, 22 bp, Homo sapiens
tggaggtggggctcaggaatct

SEQ ID NO: 7302185 - DNA, 22 bp, Homo sapiens
tggaggtgtataaggtagcttc

SEQ ID NO: 7302186 - DNA, 16 bp, Homo sapiens
tggaggtgtttctagt

SEQ ID NO: 7302187 - DNA, 22 bp, Homo sapiens
tggaggtgtccaactcgtgggt

SEQ ID NO: 7302188 - DNA, 20 bp, Homo sapiens
tggagtctgacagatgggta

SEQ ID NO: 7302189 - DNA, 22 bp, Homo sapiens
tggatcacttgaggttgggatt

SEQ ID NO: 7302190 - DNA, 22 bp, Homo sapiens
tggatgctgctgtcagggatgg

SEQ ID NO: 7302191 - DNA, 22 bp, Homo sapiens
tggatggggcagcttaggtgtg

SEQ ID NO: 7302192 - DNA, 22 bp, Homo sapiens
tgcttctgattcatggttattg

SEQ ID NO: 7302193 - DNA, 22 bp, Homo sapiens
tgcttcatttccttatattgta

SEQ ID NO: 7302194 - DNA, 22 bp, Homo sapiens
tgcttccaattcaaatctgtgg

SEQ ID NO: 7302195 - DNA, 22 bp, Homo sapiens
tgcttccactaatgagctgtgt

SEQ ID NO: 7302196 - DNA, 22 bp, Homo sapiens
tgcttccagccttcccaatgct

SEQ ID NO: 7302197 - DNA, 22 bp, Homo sapiens
tgcttccagctctctgtaaggt

SEQ ID NO: 7302198 - DNA, 22 bp, Homo sapiens
tgctgtgcaaaggtgatgtgag

SEQ ID NO: 7302199 - DNA, 22 bp, Homo sapiens
tgctgtgcaaaggtgatgtgag

SEQ ID NO: 7302200 - DNA, 22 bp, Homo sapiens
tgctgtgcatcatagtgtttgg

SEQ ID NO: 7302201 - DNA, 22 bp, Homo sapiens
tgctgtgcaaaggtgatgtgag

SEQ ID NO: 7302202 - DNA, 22 bp, Homo sapiens
tgcttaaaatagttcatttttg

SEQ ID NO: 7302203 - DNA, 22 bp, Homo sapiens
tgcttaaaaagtaactgctgat

SEQ ID NO: 7302204 - DNA, 22 bp, Homo sapiens
tgcttaaaatagttcatttttg

SEQ ID NO: 7302205 - DNA, 22 bp, Homo sapiens
tgcttaaaatgatgattatttt

SEQ ID NO: 7302206 - DNA, 22 bp, Homo sapiens
tgctgtctttttcccttcctaa

SEQ ID NO: 7302207 - DNA, 22 bp, Homo sapiens
tgctgtctttttcccttcctaa

SEQ ID NO: 7302208 - DNA, 22 bp, Homo sapiens
tgctgtctttcattgtctgcct

SEQ ID NO: 7302209 - DNA, 22 bp, Homo sapiens
tgcttactatggaggatgtgtc

SEQ ID NO: 7302210 - DNA, 22 bp, Homo sapiens
tgcttactccaactgtggtcct

SEQ ID NO: 7302211 - DNA, 22 bp, Homo sapiens
tgcttaaatttcagcagcttaa

SEQ ID NO: 7302212 - DNA, 22 bp, Homo sapiens
tgcttaaagctgctcagttgta

SEQ ID NO: 7302213 - DNA, 22 bp, Homo sapiens
tgcttaaaggatagtttaaact

SEQ ID NO: 7302214 - DNA, 22 bp, Homo sapiens
tgcttaaaggatagtttaaact

SEQ ID NO: 7302215 - DNA, 22 bp, Homo sapiens
tgcttaaaccctgatcatgtgt

SEQ ID NO: 7302216 - DNA, 22 bp, Homo sapiens
tgcttaaacatccagacagtat

SEQ ID NO: 7302217 - DNA, 22 bp, Homo sapiens
tgcttaaacatccagacagtat

SEQ ID NO: 7302218 - DNA, 22 bp, Homo sapiens
tgcttaaacatactatttatat

SEQ ID NO: 7302219 - DNA, 22 bp, Homo sapiens
tgcttaaacatactatttatat

SEQ ID NO: 7302220 - DNA, 22 bp, Homo sapiens
tgcttaaacacatacatacata

SEQ ID NO: 7302221 - DNA, 22 bp, Homo sapiens
tgcttaaacacatacatacata

SEQ ID NO: 7302222 - DNA, 22 bp, Homo sapiens
tgctgtattacttttacaaact

SEQ ID NO: 7302223 - DNA, 22 bp, Homo sapiens
tgctgggcactgtctctgggga

SEQ ID NO: 7302224 - DNA, 22 bp, Homo sapiens
tgctggcttcctgtgcacagca

SEQ ID NO: 7302225 - DNA, 20 bp, Homo sapiens
tgctgggcatgcagtggaaa

SEQ ID NO: 7302226 - DNA, 20 bp, Homo sapiens
tgctgggcatgcagtggaaa

SEQ ID NO: 7302227 - DNA, 22 bp, Homo sapiens
tgctgggcctcttccctggata

SEQ ID NO: 7302228 - DNA, 20 bp, Homo sapiens
tgctgctttgccactagttg

SEQ ID NO: 7302229 - DNA, 22 bp, Homo sapiens
tgctgcttttagttggatagaa

SEQ ID NO: 7302230 - DNA, 22 bp, Homo sapiens
tgctgctgtagctaggctttct

SEQ ID NO: 7302231 - DNA, 22 bp, Homo sapiens
tgctgctgtatcatgccttcat

SEQ ID NO: 7302232 - DNA, 22 bp, Homo sapiens
tgctgcctctgctgatatggcc

SEQ ID NO: 7302233 - DNA, 22 bp, Homo sapiens
tgctgctcctgcctggctccca

SEQ ID NO: 7302234 - DNA, 21 bp, Homo sapiens
tgctgctgatcggggttggct

SEQ ID NO: 7302235 - DNA, 22 bp, Homo sapiens
tgctgctgacatttggggcttg

SEQ ID NO: 7302236 - DNA, 22 bp, Homo sapiens
tgctgcctccttcctgccagga

SEQ ID NO: 7302237 - DNA, 22 bp, Homo sapiens
tgctgccatgcagagcaacaga

SEQ ID NO: 7302238 - DNA, 22 bp, Homo sapiens
tgctgccatctcaactgccctt

SEQ ID NO: 7302239 - DNA, 17 bp, Homo sapiens
tgctgccaagtcccaac

SEQ ID NO: 7302240 - DNA, 22 bp, Homo sapiens
tgctggccaagcagaggtcaat

SEQ ID NO: 7302241 - DNA, 22 bp, Homo sapiens
tgctggctctgggccaagcagg

SEQ ID NO: 7302242 - DNA, 22 bp, Homo sapiens
tgctcttcggggccactgcttg

SEQ ID NO: 7302243 - DNA, 23 bp, Homo sapiens
tgctcttctcagacctgtcagcc

SEQ ID NO: 7302244 - DNA, 22 bp, Homo sapiens
tgctcttcacagtttcagcatc

SEQ ID NO: 7302245 - DNA, 22 bp, Homo sapiens
tgctcttcaccattacatcatg

SEQ ID NO: 7302246 - DNA, 22 bp, Homo sapiens
tgctctgtccagtgcaccatca

SEQ ID NO: 7302247 - DNA, 22 bp, Homo sapiens
tgctctggtaactcacttccat

SEQ ID NO: 7302248 - DNA, 21 bp, Homo sapiens
tgctctggtgttttatttaac

SEQ ID NO: 7302249 - DNA, 21 bp, Homo sapiens
tgctctggtgttttatttaac

SEQ ID NO: 7302250 - DNA, 22 bp, Homo sapiens
tgctgagcccagaacggcctgg

SEQ ID NO: 7302251 - DNA, 22 bp, Homo sapiens
tgctgagcgcatccggcggccg

SEQ ID NO: 7302252 - DNA, 22 bp, Homo sapiens
tgctgaaagaccgtatttatct

SEQ ID NO: 7302253 - DNA, 22 bp, Homo sapiens
tgctgcagggccttccctgcat

SEQ ID NO: 7302254 - DNA, 22 bp, Homo sapiens
tgctgcaggtgtgttcagtgag

SEQ ID NO: 7302255 - DNA, 22 bp, Homo sapiens
tgctgcagggccttccctgcat

SEQ ID NO: 7302256 - DNA, 22 bp, Homo sapiens
tgctgcagtgtttgctgaagtt

SEQ ID NO: 7302257 - DNA, 22 bp, Homo sapiens
tgctgagtatttgtttgaataa

SEQ ID NO: 7302258 - DNA, 22 bp, Homo sapiens
tgctcctgagcggtttccatga

SEQ ID NO: 7302259 - DNA, 22 bp, Homo sapiens
tgctcctgatatctaatgtgta

SEQ ID NO: 7302260 - DNA, 22 bp, Homo sapiens
tgctcctgctgcatgcatctcc

SEQ ID NO: 7302261 - DNA, 22 bp, Homo sapiens
tgctcctgccgtggtcgggact

SEQ ID NO: 7302262 - DNA, 22 bp, Homo sapiens
tgctcctgctcctcccggttga

SEQ ID NO: 7302263 - DNA, 22 bp, Homo sapiens
tgctcctgcttagccgtgtttt

SEQ ID NO: 7302264 - DNA, 22 bp, Homo sapiens
tgctcctgctggccctcgtgcc

SEQ ID NO: 7302265 - DNA, 22 bp, Homo sapiens
tgctcctgaggttggagatcca

SEQ ID NO: 7302266 - DNA, 22 bp, Homo sapiens
tgctcctgagggataaactgcc

SEQ ID NO: 7302267 - DNA, 22 bp, Homo sapiens
tgctcctgagtgtgcaggagat

SEQ ID NO: 7302268 - DNA, 22 bp, Homo sapiens
tgctcctgacagttttaggctc

SEQ ID NO: 7302269 - DNA, 22 bp, Homo sapiens
tgctcctgacagagtccatatg

SEQ ID NO: 7302270 - DNA, 22 bp, Homo sapiens
tgctcctgaattacactactac

SEQ ID NO: 7302271 - DNA, 22 bp, Homo sapiens
tgctcctgaacacagccctatg

SEQ ID NO: 7302272 - DNA, 22 bp, Homo sapiens
tgctcctgaacacagccctatg

SEQ ID NO: 7302273 - DNA, 22 bp, Homo sapiens
tgctctggggagctcctctgcg

SEQ ID NO: 7302274 - DNA, 22 bp, Homo sapiens
tgctctgggggaagccagctgt

SEQ ID NO: 7302275 - DNA, 22 bp, Homo sapiens
tgctctgggggaagccagctgt

SEQ ID NO: 7302276 - DNA, 22 bp, Homo sapiens
tgctctgggctcaatggcagct

SEQ ID NO: 7302277 - DNA, 22 bp, Homo sapiens
tgctctgggctatctgagaaag

SEQ ID NO: 7302278 - DNA, 19 bp, Homo sapiens
tgctctctggtgcttcatg

SEQ ID NO: 7302279 - DNA, 22 bp, Homo sapiens
tgctctgggaccgtcattaaaa

SEQ ID NO: 7302280 - DNA, 22 bp, Homo sapiens
tgctcctggatgaggtactcca

SEQ ID NO: 7302281 - DNA, 22 bp, Homo sapiens
tgctcctggactggtgtgagat

SEQ ID NO: 7302282 - DNA, 22 bp, Homo sapiens
tgctcctggcatctctgcgtcc

SEQ ID NO: 7302283 - DNA, 22 bp, Homo sapiens
tgctcctggcttcaggttgggc

SEQ ID NO: 7302284 - DNA, 17 bp, Homo sapiens
tgctcctgggacaagga

SEQ ID NO: 7302285 - DNA, 22 bp, Homo sapiens
tgctcctggctccttccctaac

SEQ ID NO: 7302286 - DNA, 17 bp, Homo sapiens
tgctcctgtggcagcct

SEQ ID NO: 7302287 - DNA, 22 bp, Homo sapiens
tgctcctgggctgaagcacact

SEQ ID NO: 7302288 - DNA, 22 bp, Homo sapiens
tgctcctgtttcatcagctata

SEQ ID NO: 7302289 - DNA, 22 bp, Homo sapiens
tgctcgccccacatgccctcat

SEQ ID NO: 7302290 - DNA, 22 bp, Homo sapiens
tgctcgaggtccccaccggctc

SEQ ID NO: 7302291 - DNA, 22 bp, Homo sapiens
tgctctaagaactctaggaatt

SEQ ID NO: 7302292 - DNA, 16 bp, Homo sapiens
tgctattttagagagg

SEQ ID NO: 7302293 - DNA, 22 bp, Homo sapiens
tgctattttagacatactttgt

SEQ ID NO: 7302294 - DNA, 19 bp, Homo sapiens
tgctatttgaagaagtgta

SEQ ID NO: 7302295 - DNA, 22 bp, Homo sapiens
tgctatttggaaaagcatttgg

SEQ ID NO: 7302296 - DNA, 22 bp, Homo sapiens
tgctatttgggggctacatgat

SEQ ID NO: 7302297 - DNA, 22 bp, Homo sapiens
tgctaactattcctaaagatca

SEQ ID NO: 7302298 - DNA, 22 bp, Homo sapiens
tgctatataatggaatttctaa

SEQ ID NO: 7302299 - DNA, 22 bp, Homo sapiens
tgctatctaggcaaggtggtcc

SEQ ID NO: 7302300 - DNA, 22 bp, Homo sapiens
tgctatgtaaagctctgggttt

SEQ ID NO: 7302301 - DNA, 22 bp, Homo sapiens
tgcgatgtatgcagtatttgtt

SEQ ID NO: 7302302 - DNA, 17 bp, Homo sapiens
tgcgatgtctgtgtttg

SEQ ID NO: 7302303 - DNA, 22 bp, Homo sapiens
tgcgcgccagctcccaggttcg

SEQ ID NO: 7302304 - DNA, 22 bp, Homo sapiens
tgcgcctgtaagtccagagtcc

SEQ ID NO: 7302305 - DNA, 22 bp, Homo sapiens
tgcgcctctaatctcgggcgtc

SEQ ID NO: 7302306 - DNA, 22 bp, Homo sapiens
tgcgggcgttcgttaccacttt

SEQ ID NO: 7302307 - DNA, 23 bp, Homo sapiens
tgcgtacggctgccagtgtgact

SEQ ID NO: 7302308 - DNA, 21 bp, Homo sapiens
tgcgtgtgcatggccttcggg

SEQ ID NO: 7302309 - DNA, 22 bp, Homo sapiens
tgcgtggctggtccctgtgacc

SEQ ID NO: 7302310 - DNA, 22 bp, Homo sapiens
tgcgtggcgcagcgtgtgggat

SEQ ID NO: 7302311 - DNA, 22 bp, Homo sapiens
tgcgtctggagtggagtttgaa

SEQ ID NO: 7302312 - DNA, 22 bp, Homo sapiens
tgcgtagtacgaatttgtgcct

SEQ ID NO: 7302313 - DNA, 20 bp, Homo sapiens
tgcgtgtgtatttattttct

SEQ ID NO: 7302314 - DNA, 23 bp, Homo sapiens
tgcgtgtgtgctgaggggcgtcc

SEQ ID NO: 7302315 - DNA, 22 bp, Homo sapiens
tgcgtgtgtgtatatacacagg

SEQ ID NO: 7302316 - DNA, 22 bp, Homo sapiens
tgcgtgtgtgtatatacacagg

SEQ ID NO: 7302317 - DNA, 22 bp, Homo sapiens
tgctcacattaggcatccatgg

SEQ ID NO: 7302318 - DNA, 22 bp, Homo sapiens
tgctcactgaactcttgctgtc

SEQ ID NO: 7302319 - DNA, 22 bp, Homo sapiens
tgctcacactcatgtccacgct

SEQ ID NO: 7302320 - DNA, 22 bp, Homo sapiens
tgctcacagcccagaacataat

SEQ ID NO: 7302321 - DNA, 17 bp, Homo sapiens
tgctcaaatacttttga

SEQ ID NO: 7302322 - DNA, 22 bp, Homo sapiens
tgctcatgctggggacagatgt

SEQ ID NO: 7302323 - DNA, 22 bp, Homo sapiens
tgctcattggcgatctgaggga

SEQ ID NO: 7302324 - DNA, 17 bp, Homo sapiens
tgcgatgtctgtgtttg

SEQ ID NO: 7302325 - DNA, 22 bp, Homo sapiens
tgcgatgtatgcagtatttgtt

SEQ ID NO: 7302326 - DNA, 22 bp, Homo sapiens
tgccttttgaagcctcacaggt

SEQ ID NO: 7302327 - DNA, 22 bp, Homo sapiens
tgccttttgtatgcaggccatg

SEQ ID NO: 7302328 - DNA, 22 bp, Homo sapiens
tgccttttgttagggctgccag

SEQ ID NO: 7302329 - DNA, 20 bp, Homo sapiens
tgccttttatacctttaaac

SEQ ID NO: 7302330 - DNA, 22 bp, Homo sapiens
tgccttttagtgctcaataaag

SEQ ID NO: 7302331 - DNA, 22 bp, Homo sapiens
tgccttttagtgctcaataaag

SEQ ID NO: 7302332 - DNA, 22 bp, Homo sapiens
tgccttttaccttgtaattctg

SEQ ID NO: 7302333 - DNA, 22 bp, Homo sapiens
tgccttttccagttcctagaag

SEQ ID NO: 7302334 - DNA, 22 bp, Homo sapiens
tgccttttctgtagctctggaa

SEQ ID NO: 7302335 - DNA, 22 bp, Homo sapiens
tgccttttccagtttctagggg

SEQ ID NO: 7302336 - DNA, 20 bp, Homo sapiens
tgccttttatacctttaaac

SEQ ID NO: 7302337 - DNA, 22 bp, Homo sapiens
tgccttttatggctagcctcag

SEQ ID NO: 7302338 - DNA, 22 bp, Homo sapiens
tgccttttccagcttccaggag

SEQ ID NO: 7302339 - DNA, 22 bp, Homo sapiens
tgccttttccagcttccagagg

SEQ ID NO: 7302340 - DNA, 22 bp, Homo sapiens
tgccttgtccttcgtcagggct

SEQ ID NO: 7302341 - DNA, 22 bp, Homo sapiens
tgcctgtgtcacagtgatgttt

SEQ ID NO: 7302342 - DNA, 22 bp, Homo sapiens
tgcctgtgtatttccggcctgc

SEQ ID NO: 7302343 - DNA, 22 bp, Homo sapiens
tgcctgtgtcacagtgatgttt

SEQ ID NO: 7302344 - DNA, 22 bp, Homo sapiens
tgcctgtgtcagcaggtggaag

SEQ ID NO: 7302345 - DNA, 22 bp, Homo sapiens
tgcctgtgtccccttcttggca

SEQ ID NO: 7302346 - DNA, 22 bp, Homo sapiens
tgcctgtgtccccttcttggca

SEQ ID NO: 7302347 - DNA, 22 bp, Homo sapiens
tgcctgtgggtgatgatttgat

SEQ ID NO: 7302348 - DNA, 22 bp, Homo sapiens
tgcctgtgggtgatgatttgat

SEQ ID NO: 7302349 - DNA, 22 bp, Homo sapiens
tgcctgtgggcagagggccaga

SEQ ID NO: 7302350 - DNA, 22 bp, Homo sapiens
tgcctgtgggcagagggccaga

SEQ ID NO: 7302351 - DNA, 22 bp, Homo sapiens
tgcctgtgcccttcttggcatt

SEQ ID NO: 7302352 - DNA, 22 bp, Homo sapiens
tgcctgtgcccttcttggcatt

SEQ ID NO: 7302353 - DNA, 22 bp, Homo sapiens
tgcctgtgccctttgctgggag

SEQ ID NO: 7302354 - DNA, 22 bp, Homo sapiens
tgcctgtgccctttgctgggag

SEQ ID NO: 7302355 - DNA, 22 bp, Homo sapiens
tgcctgtggagccactagtttt

SEQ ID NO: 7302356 - DNA, 22 bp, Homo sapiens
tgcctgtgctgggattgcatgt

SEQ ID NO: 7302357 - DNA, 22 bp, Homo sapiens
tgcctgtggaaaggctggtgct

SEQ ID NO: 7302358 - DNA, 22 bp, Homo sapiens
tgcctgtggaaaggctggtgct

SEQ ID NO: 7302359 - DNA, 22 bp, Homo sapiens
tgcctgtgacccaaggatgcga

SEQ ID NO: 7302360 - DNA, 17 bp, Homo sapiens
tgcctgtgataagcaca

SEQ ID NO: 7302361 - DNA, 22 bp, Homo sapiens
tgcctgggaaccaatcctggct

SEQ ID NO: 7302362 - DNA, 22 bp, Homo sapiens
tgcctggggattgctctgggcc

SEQ ID NO: 7302363 - DNA, 22 bp, Homo sapiens
tggcaaagatgaagcatttcgt

SEQ ID NO: 7302364 - DNA, 22 bp, Homo sapiens
tggcaaagacgctagctaagat

SEQ ID NO: 7302365 - DNA, 22 bp, Homo sapiens
tggcaaaggaacctattttaaa

SEQ ID NO: 7302366 - DNA, 22 bp, Homo sapiens
tggcaaagtttatcaggaatat

SEQ ID NO: 7302367 - DNA, 20 bp, Homo sapiens
tggattctggagctgccctc

SEQ ID NO: 7302368 - DNA, 22 bp, Homo sapiens
tggattcacaccattctcctgc

SEQ ID NO: 7302369 - DNA, 22 bp, Homo sapiens
tggatttccccctgcattgtcc

SEQ ID NO: 7302370 - DNA, 22 bp, Homo sapiens
tggatttctccagctctccatt

SEQ ID NO: 7302371 - DNA, 22 bp, Homo sapiens
tggatttcagcaagggtgggtg

SEQ ID NO: 7302372 - DNA, 22 bp, Homo sapiens
tggatttcatagactgccatct

SEQ ID NO: 7302373 - DNA, 22 bp, Homo sapiens
tggatgtgagaaggatcaggct

SEQ ID NO: 7302374 - DNA, 17 bp, Homo sapiens
tggatgtgggatctgga

SEQ ID NO: 7302375 - DNA, 17 bp, Homo sapiens
tggatgtgggatctgga

SEQ ID NO: 7302376 - DNA, 22 bp, Homo sapiens
tggatgtgtcgccctggctctc

SEQ ID NO: 7302377 - DNA, 22 bp, Homo sapiens
tggatggttctgggcggcagca

SEQ ID NO: 7302378 - DNA, 22 bp, Homo sapiens
tggcaatttgtagagtaaatta

SEQ ID NO: 7302379 - DNA, 22 bp, Homo sapiens
tggcactgaagctggaaagcct

SEQ ID NO: 7302380 - DNA, 22 bp, Homo sapiens
tggcactatggatgagactgat

SEQ ID NO: 7302381 - DNA, 22 bp, Homo sapiens
tggcacttaaaaattattcttc

SEQ ID NO: 7302382 - DNA, 22 bp, Homo sapiens
tggcacttaatgcatgtgctat

SEQ ID NO: 7302383 - DNA, 22 bp, Homo sapiens
tggcactggaatcgtagccttg

SEQ ID NO: 7302384 - DNA, 22 bp, Homo sapiens
tggcaggaagacgtggggcacc

SEQ ID NO: 7302385 - DNA, 20 bp, Homo sapiens
tggcaggaatagggccagag

SEQ ID NO: 7302386 - DNA, 22 bp, Homo sapiens
tggcaggagcctgcggggaggt

SEQ ID NO: 7302387 - DNA, 22 bp, Homo sapiens
tggcaggaaccaggaggctctc

SEQ ID NO: 7302388 - DNA, 22 bp, Homo sapiens
tggcaggatctttgagagtgaa

SEQ ID NO: 7302389 - DNA, 22 bp, Homo sapiens
tggcaggcattgatgcgagttc

SEQ ID NO: 7302390 - DNA, 22 bp, Homo sapiens
tggcagataacctgctgtgccc

SEQ ID NO: 7302391 - DNA, 22 bp, Homo sapiens
tggcagcagacatctgaggtct

SEQ ID NO: 7302392 - DNA, 22 bp, Homo sapiens
tggccagcccttcagccatgcc

SEQ ID NO: 7302393 - DNA, 22 bp, Homo sapiens
tggccagcccttcagccatgcc

SEQ ID NO: 7302394 - DNA, 22 bp, Homo sapiens
tggccagcccttcagccatgcc

SEQ ID NO: 7302395 - DNA, 22 bp, Homo sapiens
tggccagcagagttcactctct

SEQ ID NO: 7302396 - DNA, 21 bp, Homo sapiens
tggccagctgctcgtctcctc

SEQ ID NO: 7302397 - DNA, 22 bp, Homo sapiens
tggccagccttgtcatcgcttt

SEQ ID NO: 7302398 - DNA, 19 bp, Homo sapiens
tggccaggtactgtctgct

SEQ ID NO: 7302399 - DNA, 22 bp, Homo sapiens
tggccaggctggtctggaacgc

SEQ ID NO: 7302400 - DNA, 22 bp, Homo sapiens
tggccacagcctctgccagttc

SEQ ID NO: 7302401 - DNA, 23 bp, Homo sapiens
tggccacagtccatgcatgccca

SEQ ID NO: 7302402 - DNA, 22 bp, Homo sapiens
tggccacactgcccccactggg

SEQ ID NO: 7302403 - DNA, 22 bp, Homo sapiens
tggcatgtggcagctggttcag

SEQ ID NO: 7302404 - DNA, 22 bp, Homo sapiens
tggcatgtggcaatgttgggat

SEQ ID NO: 7302405 - DNA, 22 bp, Homo sapiens
tggccaccaccaatacttgcct

SEQ ID NO: 7302406 - DNA, 22 bp, Homo sapiens
tggccacatatgtgggacagct

SEQ ID NO: 7302407 - DNA, 22 bp, Homo sapiens
tggccacagtgtccagcagcag

SEQ ID NO: 7302408 - DNA, 22 bp, Homo sapiens
tggccactcctccctgcaggct

SEQ ID NO: 7302409 - DNA, 22 bp, Homo sapiens
tggccacttggcatgtgtgcca

SEQ ID NO: 7302410 - DNA, 22 bp, Homo sapiens
tggcatggactagtgctgaggt

SEQ ID NO: 7302411 - DNA, 22 bp, Homo sapiens
tggcatgggccagggagagctg

SEQ ID NO: 7302412 - DNA, 22 bp, Homo sapiens
tggcatggccagtgctgggagt

SEQ ID NO: 7302413 - DNA, 22 bp, Homo sapiens
tggcagtggctcagagtgcaga

SEQ ID NO: 7302414 - DNA, 18 bp, Homo sapiens
tggcaggtccagctgtgg

SEQ ID NO: 7302415 - DNA, 18 bp, Homo sapiens
tggcagtgaggtaggcat

SEQ ID NO: 7302416 - DNA, 23 bp, Homo sapiens
tggcagtgcccagggagatgatc

SEQ ID NO: 7302417 - DNA, 22 bp, Homo sapiens
tggcccagtagaaaagggatcg

SEQ ID NO: 7302418 - DNA, 22 bp, Homo sapiens
tggccctgaatcaaggccagca

SEQ ID NO: 7302419 - DNA, 22 bp, Homo sapiens
tggccctgacacgtggtactgg

SEQ ID NO: 7302420 - DNA, 22 bp, Homo sapiens
tggccctcagcactgagacctt

SEQ ID NO: 7302421 - DNA, 17 bp, Homo sapiens
tggccctagactccagc

SEQ ID NO: 7302422 - DNA, 22 bp, Homo sapiens
tggccctgccactcactgctga

SEQ ID NO: 7302423 - DNA, 22 bp, Homo sapiens
tggccctgagggctcggagcca

SEQ ID NO: 7302424 - DNA, 22 bp, Homo sapiens
tggccctgcacccagagcagtt

SEQ ID NO: 7302425 - DNA, 22 bp, Homo sapiens
tggccctgacaggtcctgggca

SEQ ID NO: 7302426 - DNA, 22 bp, Homo sapiens
tggccctgactgatgtggaggg

SEQ ID NO: 7302427 - DNA, 22 bp, Homo sapiens
tggccctgaggacccagtgtgg

SEQ ID NO: 7302428 - DNA, 22 bp, Homo sapiens
tggccctgacttggaggcctga

SEQ ID NO: 7302429 - DNA, 22 bp, Homo sapiens
tggcccagggcacagcagggag

SEQ ID NO: 7302430 - DNA, 22 bp, Homo sapiens
tggcccaggggctcttggtgtt

SEQ ID NO: 7302431 - DNA, 22 bp, Homo sapiens
tggcccaggtctctctgagccc

SEQ ID NO: 7302432 - DNA, 22 bp, Homo sapiens
tggcccaggtgcaagagacaga

SEQ ID NO: 7302433 - DNA, 22 bp, Homo sapiens
tggcccaggccaaagccctgga

SEQ ID NO: 7302434 - DNA, 22 bp, Homo sapiens
tggcccaggcgaggtgggcaga

SEQ ID NO: 7302435 - DNA, 22 bp, Homo sapiens
tggccctgggcagaggcaacat

SEQ ID NO: 7302436 - DNA, 22 bp, Homo sapiens
tggccctggtggcacagcctgc

SEQ ID NO: 7302437 - DNA, 22 bp, Homo sapiens
tggccctgtctgcacacaggat

SEQ ID NO: 7302438 - DNA, 22 bp, Homo sapiens
tggccctgtgtgcaggctgcac

SEQ ID NO: 7302439 - DNA, 22 bp, Homo sapiens
tggccctgttctgtacctcata

SEQ ID NO: 7302440 - DNA, 22 bp, Homo sapiens
tggccctgtgtcctgctgccag

SEQ ID NO: 7302441 - DNA, 22 bp, Homo sapiens
tggcctggaaaaatgcagatgg

SEQ ID NO: 7302442 - DNA, 22 bp, Homo sapiens
tggcctggaacctggcagggac

SEQ ID NO: 7302443 - DNA, 22 bp, Homo sapiens
tggcctcttaggacatcctcta

SEQ ID NO: 7302444 - DNA, 22 bp, Homo sapiens
tggcctctggctgaggactaac

SEQ ID NO: 7302445 - DNA, 22 bp, Homo sapiens
tggcctgtgtggcttcctggga

SEQ ID NO: 7302446 - DNA, 22 bp, Homo sapiens
tggcctgtgtggcttcctggga

SEQ ID NO: 7302447 - DNA, 22 bp, Homo sapiens
tggcctgtggcatgacctctag

SEQ ID NO: 7302448 - DNA, 22 bp, Homo sapiens
tggcctgtggcttaaggtctgt

SEQ ID NO: 7302449 - DNA, 22 bp, Homo sapiens
tggcctgtggcacgtgctccat

SEQ ID NO: 7302450 - DNA, 22 bp, Homo sapiens
tggcctgtggatcccagctctg

SEQ ID NO: 7302451 - DNA, 22 bp, Homo sapiens
tggcctgtgactgcctctgggc

SEQ ID NO: 7302452 - DNA, 22 bp, Homo sapiens
tggcctgtcttgttgtgctaga

SEQ ID NO: 7302453 - DNA, 22 bp, Homo sapiens
tggcctggttgttgctgccgtt

SEQ ID NO: 7302454 - DNA, 22 bp, Homo sapiens
tggcctgtcactgcccagggct

SEQ ID NO: 7302455 - DNA, 22 bp, Homo sapiens
tggcctggtgtctgcgaggcct

SEQ ID NO: 7302456 - DNA, 22 bp, Homo sapiens
tggcctgggtgctgctgacatc

SEQ ID NO: 7302457 - DNA, 22 bp, Homo sapiens
tggcctggtccttgtcaaggca

SEQ ID NO: 7302458 - DNA, 22 bp, Homo sapiens
tggctcacttccgtggagaggt

SEQ ID NO: 7302459 - DNA, 22 bp, Homo sapiens
tggctcacaggactctctgggc

SEQ ID NO: 7302460 - DNA, 20 bp, Homo sapiens
tggctcctcttggctgtggc

SEQ ID NO: 7302461 - DNA, 22 bp, Homo sapiens
tggctcctcatcacagttggtg

SEQ ID NO: 7302462 - DNA, 22 bp, Homo sapiens
tggctcctatcaaggagtgggt

SEQ ID NO: 7302463 - DNA, 22 bp, Homo sapiens
tggctcctaggatggtgcctgg

SEQ ID NO: 7302464 - DNA, 22 bp, Homo sapiens
tggctcccaaggagctcctgcc

SEQ ID NO: 7302465 - DNA, 22 bp, Homo sapiens
tggctccagatttcctgctgca

SEQ ID NO: 7302466 - DNA, 22 bp, Homo sapiens
tggctctgtgcttctagtatct

SEQ ID NO: 7302467 - DNA, 22 bp, Homo sapiens
tggctctgtcgccgtttggaat

SEQ ID NO: 7302468 - DNA, 22 bp, Homo sapiens
tggctctgggcaccgtgtccac

SEQ ID NO: 7302469 - DNA, 22 bp, Homo sapiens
tggctctggccaccgggagggc

SEQ ID NO: 7302470 - DNA, 19 bp, Homo sapiens
tggctctgtttctctggag

SEQ ID NO: 7302471 - DNA, 22 bp, Homo sapiens
tggctctgttgtgctgagccag

SEQ ID NO: 7302472 - DNA, 22 bp, Homo sapiens
tggctctgttgaggtatggatt

SEQ ID NO: 7302473 - DNA, 22 bp, Homo sapiens
tggctcctttccagcctggttt

SEQ ID NO: 7302474 - DNA, 21 bp, Homo sapiens
tggctctgagcctcatggctg

SEQ ID NO: 7302475 - DNA, 17 bp, Homo sapiens
tggctctgaggctgaat

SEQ ID NO: 7302476 - DNA, 22 bp, Homo sapiens
tggctctgagtctgcccttggc

SEQ ID NO: 7302477 - DNA, 21 bp, Homo sapiens
tggctctgctcagagcagtcc

SEQ ID NO: 7302478 - DNA, 22 bp, Homo sapiens
tggctctgcgtctgttcgtggg

SEQ ID NO: 7302479 - DNA, 18 bp, Homo sapiens
tggctctggacttgctcc

SEQ ID NO: 7302480 - DNA, 22 bp, Homo sapiens
tggctctgctgaacctagtgca

SEQ ID NO: 7302481 - DNA, 22 bp, Homo sapiens
tggctctggagctcctgggccc

SEQ ID NO: 7302482 - DNA, 22 bp, Homo sapiens
tggctctgcagcagtgtgcgtg

SEQ ID NO: 7302483 - DNA, 22 bp, Homo sapiens
tggctgaggctggagtgcagtg

SEQ ID NO: 7302484 - DNA, 19 bp, Homo sapiens
tggctgagctggactgagg

SEQ ID NO: 7302485 - DNA, 22 bp, Homo sapiens
tggctgaggagggtcttctggt

SEQ ID NO: 7302486 - DNA, 22 bp, Homo sapiens
tggctgagttctccaggagtag

SEQ ID NO: 7302487 - DNA, 22 bp, Homo sapiens
tgggaagaggatgaggcatatg

SEQ ID NO: 7302488 - DNA, 22 bp, Homo sapiens
tgggaactctctgggaggcatc

SEQ ID NO: 7302489 - DNA, 22 bp, Homo sapiens
tgggaaagtctttatttctctt

SEQ ID NO: 7302490 - DNA, 22 bp, Homo sapiens
tgggaaagtgtagcctgcaggc

SEQ ID NO: 7302491 - DNA, 22 bp, Homo sapiens
tgggaaagtgttgaggtgtctt

SEQ ID NO: 7302492 - DNA, 18 bp, Homo sapiens
tgggaaagtttatagaat

SEQ ID NO: 7302493 - DNA, 22 bp, Homo sapiens
tgggaaagactcaggacaggag

SEQ ID NO: 7302494 - DNA, 22 bp, Homo sapiens
tgggaaagactcaggacaggag

SEQ ID NO: 7302495 - DNA, 22 bp, Homo sapiens
tgggaaagtaattgtcatcctt

SEQ ID NO: 7302496 - DNA, 20 bp, Homo sapiens
tgggaaagtctaagtgcctc

SEQ ID NO: 7302497 - DNA, 22 bp, Homo sapiens
tgggaaagccagcagtgtcacc

SEQ ID NO: 7302498 - DNA, 22 bp, Homo sapiens
tgggaaagctgcagaaattctc

SEQ ID NO: 7302499 - DNA, 19 bp, Homo sapiens
tgggaaagtaacatacaaa

SEQ ID NO: 7302500 - DNA, 22 bp, Homo sapiens
tggcttcctaaactgatttcca

SEQ ID NO: 7302501 - DNA, 19 bp, Homo sapiens
tggctgggtgccaatggcc

SEQ ID NO: 7302502 - DNA, 22 bp, Homo sapiens
tggctgtgcctctttccaggcc

SEQ ID NO: 7302503 - DNA, 22 bp, Homo sapiens
tggctgtgtccctgtccagagt

SEQ ID NO: 7302504 - DNA, 22 bp, Homo sapiens
tggctgtgttaccacttcatgt

SEQ ID NO: 7302505 - DNA, 22 bp, Homo sapiens
tgggaaggggagctggaaagga

SEQ ID NO: 7302506 - DNA, 22 bp, Homo sapiens
tgggaaggggagctggaaagga

SEQ ID NO: 7302507 - DNA, 22 bp, Homo sapiens
tgggaagggtcaacagctggaa

SEQ ID NO: 7302508 - DNA, 22 bp, Homo sapiens
tgggaaggtacacgggaaagag

SEQ ID NO: 7302509 - DNA, 22 bp, Homo sapiens
tgggaaggtacacgggaaagag

SEQ ID NO: 7302510 - DNA, 22 bp, Homo sapiens
tgggaagatgaggtgccatggg

SEQ ID NO: 7302511 - DNA, 22 bp, Homo sapiens
tgggaagagttagagacagctg

SEQ ID NO: 7302512 - DNA, 22 bp, Homo sapiens
tgggaagatggagtgacaggca

SEQ ID NO: 7302513 - DNA, 22 bp, Homo sapiens
tgggaagcattaatgatagggg

SEQ ID NO: 7302514 - DNA, 22 bp, Homo sapiens
tgggaagcctagcagacagctg

SEQ ID NO: 7302515 - DNA, 22 bp, Homo sapiens
tgggaagggagagtgtcctgga

SEQ ID NO: 7302516 - DNA, 22 bp, Homo sapiens
tgggaaggcgtggaagtagaag

SEQ ID NO: 7302517 - DNA, 22 bp, Homo sapiens
tgggaagggccgatggagcctc

SEQ ID NO: 7302518 - DNA, 22 bp, Homo sapiens
tgggaagggagtttcttggagt

SEQ ID NO: 7302519 - DNA, 22 bp, Homo sapiens
tgggaagggagtttcttggagt

SEQ ID NO: 7302520 - DNA, 22 bp, Homo sapiens
tgggaatggatgctaagtgcta

SEQ ID NO: 7302521 - DNA, 22 bp, Homo sapiens
tgggaatgctgatttcaggaac

SEQ ID NO: 7302522 - DNA, 22 bp, Homo sapiens
tgggaatgctgatttcaggaac

SEQ ID NO: 7302523 - DNA, 22 bp, Homo sapiens
tgggaatgctgagcccatgtat

SEQ ID NO: 7302524 - DNA, 22 bp, Homo sapiens
tgggaatgtggcaaggcataga

SEQ ID NO: 7302525 - DNA, 22 bp, Homo sapiens
tgggaatgtgagcattcattca

SEQ ID NO: 7302526 - DNA, 22 bp, Homo sapiens
tgggaatgggcctagaaggctg

SEQ ID NO: 7302527 - DNA, 22 bp, Homo sapiens
tgggaatgtagaatgtaaacca

SEQ ID NO: 7302528 - DNA, 23 bp, Homo sapiens
tgggaatgacatctagagcagag

SEQ ID NO: 7302529 - DNA, 23 bp, Homo sapiens
tgggaatgacatctagagcagag

SEQ ID NO: 7302530 - DNA, 22 bp, Homo sapiens
tgggaatgcaaggaaagctgtt

SEQ ID NO: 7302531 - DNA, 18 bp, Homo sapiens
tgggaatgctcaaggccc

SEQ ID NO: 7302532 - DNA, 22 bp, Homo sapiens
tgggacaggttggagagaagca

SEQ ID NO: 7302533 - DNA, 20 bp, Homo sapiens
tgggactgacccatctgagc

SEQ ID NO: 7302534 - DNA, 22 bp, Homo sapiens
tgggactgtgacctccagggta

SEQ ID NO: 7302535 - DNA, 22 bp, Homo sapiens
tgggactgctcttgctggggtc

SEQ ID NO: 7302536 - DNA, 22 bp, Homo sapiens
tgggactgagaatatgatgggg

SEQ ID NO: 7302537 - DNA, 22 bp, Homo sapiens
tgggactgagaatatgatgggg

SEQ ID NO: 7302538 - DNA, 22 bp, Homo sapiens
tgggacctctcttgagagagca

SEQ ID NO: 7302539 - DNA, 22 bp, Homo sapiens
tgggacatctgtgaagctgaat

SEQ ID NO: 7302540 - DNA, 22 bp, Homo sapiens
tgggacatgcttggaatctaga

SEQ ID NO: 7302541 - DNA, 22 bp, Homo sapiens
tgggagcaccctgaggagcttc

SEQ ID NO: 7302542 - DNA, 22 bp, Homo sapiens
tgggagaagacgtactttagac

SEQ ID NO: 7302543 - DNA, 22 bp, Homo sapiens
tgggagaagcagtgggacagta

SEQ ID NO: 7302544 - DNA, 22 bp, Homo sapiens
tgggagaagagaaattactgcc

SEQ ID NO: 7302545 - DNA, 22 bp, Homo sapiens
tgggagaatatatttaaaactt

SEQ ID NO: 7302546 - DNA, 17 bp, Homo sapiens
tgggggcgccagggtct

SEQ ID NO: 7302547 - DNA, 22 bp, Homo sapiens
tgggggctagaacccagggatt

SEQ ID NO: 7302548 - DNA, 22 bp, Homo sapiens
tgggggctgagtaagatgagat

SEQ ID NO: 7302549 - DNA, 22 bp, Homo sapiens
tgggggctgtgcacaggctcac

SEQ ID NO: 7302550 - DNA, 22 bp, Homo sapiens
tgggggcatggaccagcctggc

SEQ ID NO: 7302551 - DNA, 22 bp, Homo sapiens
tgggggagccttcacagtagct

SEQ ID NO: 7302552 - DNA, 22 bp, Homo sapiens
tgggggagagtttagatgattt

SEQ ID NO: 7302553 - DNA, 22 bp, Homo sapiens
tggggctggctattgtctccct

SEQ ID NO: 7302554 - DNA, 22 bp, Homo sapiens
tggggccagagctgcagggagc

SEQ ID NO: 7302555 - DNA, 22 bp, Homo sapiens
tggggccagagctgcagggagc

SEQ ID NO: 7302556 - DNA, 22 bp, Homo sapiens
tggggccacactgatctcccag

SEQ ID NO: 7302557 - DNA, 22 bp, Homo sapiens
tggggcacagctgagaaagcac

SEQ ID NO: 7302558 - DNA, 22 bp, Homo sapiens
tggggccaggtggctgcaggtc

SEQ ID NO: 7302559 - DNA, 22 bp, Homo sapiens
tggggccagggaggaccagaca

SEQ ID NO: 7302560 - DNA, 22 bp, Homo sapiens
tggggccagggaggaccagaca

SEQ ID NO: 7302561 - DNA, 22 bp, Homo sapiens
tggggccagcggggaggactca

SEQ ID NO: 7302562 - DNA, 22 bp, Homo sapiens
tgggctggctgaggcattcact

SEQ ID NO: 7302563 - DNA, 22 bp, Homo sapiens
tgggctgtggagaggagctgga

SEQ ID NO: 7302564 - DNA, 22 bp, Homo sapiens
tgggctttatcatgggtctggt

SEQ ID NO: 7302565 - DNA, 22 bp, Homo sapiens
tgggctttgagctcggtcacct

SEQ ID NO: 7302566 - DNA, 22 bp, Homo sapiens
tggggacaggagacttacagct

SEQ ID NO: 7302567 - DNA, 22 bp, Homo sapiens
tggggaagggcaccctggagac

SEQ ID NO: 7302568 - DNA, 16 bp, Homo sapiens
tggggaagctcgtgag

SEQ ID NO: 7302569 - DNA, 22 bp, Homo sapiens
tggggaaggatcaccacaatct

SEQ ID NO: 7302570 - DNA, 22 bp, Homo sapiens
tggggaagggcaccctggagac

SEQ ID NO: 7302571 - DNA, 22 bp, Homo sapiens
tggggaagcactttgaacttaa

SEQ ID NO: 7302572 - DNA, 22 bp, Homo sapiens
tggggaagacagcagacactgt

SEQ ID NO: 7302573 - DNA, 19 bp, Homo sapiens
tggggatgctgatgaccaa

SEQ ID NO: 7302574 - DNA, 19 bp, Homo sapiens
tggggatgctgatgaccaa

SEQ ID NO: 7302575 - DNA, 19 bp, Homo sapiens
tggggatgctgatgaccaa

SEQ ID NO: 7302576 - DNA, 22 bp, Homo sapiens
tggggatgtaaatgaggtgata

SEQ ID NO: 7302577 - DNA, 22 bp, Homo sapiens
tggggatgtaaatgaggtgata

SEQ ID NO: 7302578 - DNA, 17 bp, Homo sapiens
tggggatggttcatgag

SEQ ID NO: 7302579 - DNA, 16 bp, Homo sapiens
tggggatggggaagag

SEQ ID NO: 7302580 - DNA, 22 bp, Homo sapiens
tggggatgtcatataagaggaa

SEQ ID NO: 7302581 - DNA, 22 bp, Homo sapiens
tggggatgtcatataagaggaa

SEQ ID NO: 7302582 - DNA, 22 bp, Homo sapiens
tggggatgtagaaatgaacaac

SEQ ID NO: 7302583 - DNA, 22 bp, Homo sapiens
tggggaggttcgggaatcttgt

SEQ ID NO: 7302584 - DNA, 22 bp, Homo sapiens
tggggactgacagccaggcctc

SEQ ID NO: 7302585 - DNA, 22 bp, Homo sapiens
tggggacagggctcagcaattt

SEQ ID NO: 7302586 - DNA, 22 bp, Homo sapiens
tggggacattcatgcaggttgt

SEQ ID NO: 7302587 - DNA, 19 bp, Homo sapiens
tgggtgtgaccatctctgc

SEQ ID NO: 7302588 - DNA, 22 bp, Homo sapiens
tgggtgtgcccagatggtgtcc

SEQ ID NO: 7302589 - DNA, 22 bp, Homo sapiens
tgggtgtgcccagatggtgtcc

SEQ ID NO: 7302590 - DNA, 22 bp, Homo sapiens
tgggtgtgcccagatggtgtcc

SEQ ID NO: 7302591 - DNA, 22 bp, Homo sapiens
tgggtgtgtccatattttgact

SEQ ID NO: 7302592 - DNA, 22 bp, Homo sapiens
tgggtgtgaagtctgttggcct

SEQ ID NO: 7302593 - DNA, 22 bp, Homo sapiens
tgggtgtgaagtctgttggcct

SEQ ID NO: 7302594 - DNA, 22 bp, Homo sapiens
tgggtgcaggtcttgtgccagg

SEQ ID NO: 7302595 - DNA, 21 bp, Homo sapiens
tgggtgcaagctgcggatgct

SEQ ID NO: 7302596 - DNA, 22 bp, Homo sapiens
tggtaaagtgctctaacttcat

SEQ ID NO: 7302597 - DNA, 22 bp, Homo sapiens
tggtaactttcagcatggtgac

SEQ ID NO: 7302598 - DNA, 22 bp, Homo sapiens
tggtaactttgatgatttgggt

SEQ ID NO: 7302599 - DNA, 22 bp, Homo sapiens
tggtaactggattctgtctcac

SEQ ID NO: 7302600 - DNA, 22 bp, Homo sapiens
tggtaactgtgtggtgctcgat

SEQ ID NO: 7302601 - DNA, 22 bp, Homo sapiens
tggtaagataagagccaggcct

SEQ ID NO: 7302602 - DNA, 22 bp, Homo sapiens
tggtatgtaataagtgttctaa

SEQ ID NO: 7302603 - DNA, 22 bp, Homo sapiens
tggtattacttctagacacaag

SEQ ID NO: 7302604 - DNA, 22 bp, Homo sapiens
tggtcaacaggcagggatgaaa

SEQ ID NO: 7302605 - DNA, 22 bp, Homo sapiens
tggtcaacaacattgactggat

SEQ ID NO: 7302606 - DNA, 22 bp, Homo sapiens
tggtcacagtgtattgatcagg

SEQ ID NO: 7302607 - DNA, 22 bp, Homo sapiens
tggtatgaccgtggtgcaagca

SEQ ID NO: 7302608 - DNA, 22 bp, Homo sapiens
tggtatattaactagtttcttc

SEQ ID NO: 7302609 - DNA, 22 bp, Homo sapiens
tggtatattttgctctatggtg

SEQ ID NO: 7302610 - DNA, 22 bp, Homo sapiens
tggtatatgcatggaggtatca

SEQ ID NO: 7302611 - DNA, 22 bp, Homo sapiens
tggtatatgtgttagcacaagt

SEQ ID NO: 7302612 - DNA, 22 bp, Homo sapiens
tgggtcctggctttgtcagggt

SEQ ID NO: 7302613 - DNA, 22 bp, Homo sapiens
tggggtgctttcttgcctgtac

SEQ ID NO: 7302614 - DNA, 22 bp, Homo sapiens
tgggggtggttcttgcctccag

SEQ ID NO: 7302615 - DNA, 22 bp, Homo sapiens
tggggtctggagttgcccatga

SEQ ID NO: 7302616 - DNA, 23 bp, Homo sapiens
tgggggtgcacgggccacatctt

SEQ ID NO: 7302617 - DNA, 22 bp, Homo sapiens
tgggggctgtgcacaggctcac

SEQ ID NO: 7302618 - DNA, 22 bp, Homo sapiens
tgggcctgggctggacagcctg

SEQ ID NO: 7302619 - DNA, 23 bp, Homo sapiens
tgggcctggaaagccttagagag

SEQ ID NO: 7302620 - DNA, 19 bp, Homo sapiens
tgggcctgcatctgggtct

SEQ ID NO: 7302621 - DNA, 18 bp, Homo sapiens
tgggcctgcatcctagtc

SEQ ID NO: 7302622 - DNA, 22 bp, Homo sapiens
tgggcctgagctcaccaggggc

SEQ ID NO: 7302623 - DNA, 21 bp, Homo sapiens
tgggcctgattcccagggtca

SEQ ID NO: 7302624 - DNA, 22 bp, Homo sapiens
tgggccagttggtgactacaaa

SEQ ID NO: 7302625 - DNA, 22 bp, Homo sapiens
tgggccagttggaatggatact

SEQ ID NO: 7302626 - DNA, 22 bp, Homo sapiens
tgggccagtcctgcctaaggtg

SEQ ID NO: 7302627 - DNA, 22 bp, Homo sapiens
tgggccagttatttcacctctg

SEQ ID NO: 7302628 - DNA, 22 bp, Homo sapiens
tgggccagttctttactcgtcc

SEQ ID NO: 7302629 - DNA, 23 bp, Homo sapiens
tgggccagttctgttgaaagcca

SEQ ID NO: 7302630 - DNA, 22 bp, Homo sapiens
tgggccaggtgcagtgctttag

SEQ ID NO: 7302631 - DNA, 21 bp, Homo sapiens
tgggccagtagaaaggaaggc

SEQ ID NO: 7302632 - DNA, 22 bp, Homo sapiens
tgggccagtccagccccaggga

SEQ ID NO: 7302633 - DNA, 22 bp, Homo sapiens
tgggccagtagctactcgcaag

SEQ ID NO: 7302634 - DNA, 17 bp, Homo sapiens
tgggccagtagaaggga

SEQ ID NO: 7302635 - DNA, 22 bp, Homo sapiens
tgggccagtccagccccaggga

SEQ ID NO: 7302636 - DNA, 23 bp, Homo sapiens
tgggccagggagtccggtttctt

SEQ ID NO: 7302637 - DNA, 22 bp, Homo sapiens
tgggccagggcacccagtccag

SEQ ID NO: 7302638 - DNA, 22 bp, Homo sapiens
tgggccaggcatgtgatcagca

SEQ ID NO: 7302639 - DNA, 22 bp, Homo sapiens
tgggccaggggcctcttctgat

SEQ ID NO: 7302640 - DNA, 22 bp, Homo sapiens
tgggccaggtctgcggtcattt

SEQ ID NO: 7302641 - DNA, 22 bp, Homo sapiens
tgggccaggtctgtgtcagctg

SEQ ID NO: 7302642 - DNA, 22 bp, Homo sapiens
tgggcctgtgatgctgggctat

SEQ ID NO: 7302643 - DNA, 22 bp, Homo sapiens
tgggcgacagagcaagactccg

SEQ ID NO: 7302644 - DNA, 22 bp, Homo sapiens
tgggcagatctttggtggctag

SEQ ID NO: 7302645 - DNA, 20 bp, Homo sapiens
tgggcagcactgctggctgg

SEQ ID NO: 7302646 - DNA, 22 bp, Homo sapiens
tgggcaggggccctgcttccgt

SEQ ID NO: 7302647 - DNA, 22 bp, Homo sapiens
tgggcagggatctcttttgcaa

SEQ ID NO: 7302648 - DNA, 22 bp, Homo sapiens
tgggcagggagctggaaccaca

SEQ ID NO: 7302649 - DNA, 22 bp, Homo sapiens
tgggcaggagagaagctaaaga

SEQ ID NO: 7302650 - DNA, 22 bp, Homo sapiens
tgggcagggagctggaaccaca

SEQ ID NO: 7302651 - DNA, 22 bp, Homo sapiens
tgggcaggtgctattttccatg

SEQ ID NO: 7302652 - DNA, 19 bp, Homo sapiens
tgggcaggttcagtaatgg

SEQ ID NO: 7302653 - DNA, 22 bp, Homo sapiens
tgggcagggtctctgttatcag

SEQ ID NO: 7302654 - DNA, 22 bp, Homo sapiens
tgggcaggttgttatttgacat

SEQ ID NO: 7302655 - DNA, 22 bp, Homo sapiens
tgggccagctgaagtgccgccc

SEQ ID NO: 7302656 - DNA, 22 bp, Homo sapiens
tgggccaggatttcaagaccct

SEQ ID NO: 7302657 - DNA, 22 bp, Homo sapiens
tgggccagcactgggtgctcat

SEQ ID NO: 7302658 - DNA, 22 bp, Homo sapiens
tgggccagctccctgcccctgg

SEQ ID NO: 7302659 - DNA, 22 bp, Homo sapiens
tgggccagcaattgctgctcag

SEQ ID NO: 7302660 - DNA, 22 bp, Homo sapiens
tgggatgaggcctctgttgtga

SEQ ID NO: 7302661 - DNA, 23 bp, Homo sapiens
tgggatggattcaccagtgtgct

SEQ ID NO: 7302662 - DNA, 22 bp, Homo sapiens
tgggaggccgaggcaggtggat

SEQ ID NO: 7302663 - DNA, 22 bp, Homo sapiens
tgggaggcttccagaccttgct

SEQ ID NO: 7302664 - DNA, 22 bp, Homo sapiens
tgggaggccaaggcaggcggat

SEQ ID NO: 7302665 - DNA, 22 bp, Homo sapiens
tgggaggcaggtaggtgatgat

SEQ ID NO: 7302666 - DNA, 22 bp, Homo sapiens
tgggcactatggctctgtgcac

SEQ ID NO: 7302667 - DNA, 22 bp, Homo sapiens
tgtaagaataatgatttctaag

SEQ ID NO: 7302668 - DNA, 22 bp, Homo sapiens
tgtaagaataatgatttctaag

SEQ ID NO: 7302669 - DNA, 22 bp, Homo sapiens
tgtaagaatcagtctttaatgt

SEQ ID NO: 7302670 - DNA, 22 bp, Homo sapiens
tgtaagaacatgtgtgggcaca

SEQ ID NO: 7302671 - DNA, 22 bp, Homo sapiens
tgtaagaagggccagagctcca

SEQ ID NO: 7302672 - DNA, 20 bp, Homo sapiens
tgtaagaagtaggagggtta

SEQ ID NO: 7302673 - DNA, 22 bp, Homo sapiens
tgtaaggacaacaggagaaaaa

SEQ ID NO: 7302674 - DNA, 22 bp, Homo sapiens
tgtaagatgctgggatagatga

SEQ ID NO: 7302675 - DNA, 22 bp, Homo sapiens
tgtaagaaaagtaaatagtgac

SEQ ID NO: 7302676 - DNA, 22 bp, Homo sapiens
tgtaagaaaagtaaatagtgac

SEQ ID NO: 7302677 - DNA, 22 bp, Homo sapiens
tgtaagaaaacctgtacaaaga

SEQ ID NO: 7302678 - DNA, 22 bp, Homo sapiens
tgtaagaacaactgtcaaatgt

SEQ ID NO: 7302679 - DNA, 22 bp, Homo sapiens
tgtaaggaggaaaattagtggt

SEQ ID NO: 7302680 - DNA, 22 bp, Homo sapiens
tgtaaggagtgtgagtttgagt

SEQ ID NO: 7302681 - DNA, 22 bp, Homo sapiens
tgtaagtacattgaaacatctt

SEQ ID NO: 7302682 - DNA, 22 bp, Homo sapiens
tgtaacatcacagtgatgtttg

SEQ ID NO: 7302683 - DNA, 22 bp, Homo sapiens
tgtaacatatgtaaaagcacct

SEQ ID NO: 7302684 - DNA, 22 bp, Homo sapiens
tgtaacatatagcatgttcttg

SEQ ID NO: 7302685 - DNA, 22 bp, Homo sapiens
tgtaacagttataacaatgtgg

SEQ ID NO: 7302686 - DNA, 22 bp, Homo sapiens
tgtaacagtagttactattctt

SEQ ID NO: 7302687 - DNA, 23 bp, Homo sapiens
tgtaacagagcactgattgacaa

SEQ ID NO: 7302688 - DNA, 22 bp, Homo sapiens
tgtaacagagcttttttatagc

SEQ ID NO: 7302689 - DNA, 22 bp, Homo sapiens
tgtaacagctctccatgtgggg

SEQ ID NO: 7302690 - DNA, 23 bp, Homo sapiens
tgtaacaatttcatatacatgca

SEQ ID NO: 7302691 - DNA, 22 bp, Homo sapiens
tgtaacaatgaatatagtgact

SEQ ID NO: 7302692 - DNA, 22 bp, Homo sapiens
tgtaacaagtgcttactttggg

SEQ ID NO: 7302693 - DNA, 22 bp, Homo sapiens
tgtacagaggtgtacatatgat

SEQ ID NO: 7302694 - DNA, 22 bp, Homo sapiens
tgtacagactttgcagtgtgca

SEQ ID NO: 7302695 - DNA, 22 bp, Homo sapiens
tgtacagagactaccattaata

SEQ ID NO: 7302696 - DNA, 22 bp, Homo sapiens
tgtacagaacttgctgtccctt

SEQ ID NO: 7302697 - DNA, 22 bp, Homo sapiens
tgtacagaaattcctactacat

SEQ ID NO: 7302698 - DNA, 22 bp, Homo sapiens
tgtacagactgtatttacaagt

SEQ ID NO: 7302699 - DNA, 22 bp, Homo sapiens
tgtacagaaggcactaaggtca

SEQ ID NO: 7302700 - DNA, 22 bp, Homo sapiens
tgtaccttaggtgccttgcttg

SEQ ID NO: 7302701 - DNA, 22 bp, Homo sapiens
tgtacagattgatcatggagag

SEQ ID NO: 7302702 - DNA, 22 bp, Homo sapiens
tgtacagataaagactgtaaat

SEQ ID NO: 7302703 - DNA, 22 bp, Homo sapiens
tgtacagatatcaggagtgagg

SEQ ID NO: 7302704 - DNA, 22 bp, Homo sapiens
tgtacaatctgatgatgtatgg

SEQ ID NO: 7302705 - DNA, 22 bp, Homo sapiens
tgtacaatctgatgatgtatgg

SEQ ID NO: 7302706 - DNA, 22 bp, Homo sapiens
tgtacacaatgataaattatta

SEQ ID NO: 7302707 - DNA, 22 bp, Homo sapiens
tgtacacaattcttaacataca

SEQ ID NO: 7302708 - DNA, 22 bp, Homo sapiens
tggtgtgttagagctcagggca

SEQ ID NO: 7302709 - DNA, 22 bp, Homo sapiens
tggtgtggtccagtgacatact

SEQ ID NO: 7302710 - DNA, 22 bp, Homo sapiens
tggtgtgtacatttttgcttct

SEQ ID NO: 7302711 - DNA, 22 bp, Homo sapiens
tggtgtcttggaagtaggtgct

SEQ ID NO: 7302712 - DNA, 18 bp, Homo sapiens
tggtttctggaggaataa

SEQ ID NO: 7302713 - DNA, 22 bp, Homo sapiens
tggttctaaaggactatacaga

SEQ ID NO: 7302714 - DNA, 23 bp, Homo sapiens
tggttctaggcctataattatat

SEQ ID NO: 7302715 - DNA, 22 bp, Homo sapiens
tggttgtgagcgatggatggag

SEQ ID NO: 7302716 - DNA, 22 bp, Homo sapiens
tggttgtgcacggagctgcagg

SEQ ID NO: 7302717 - DNA, 17 bp, Homo sapiens
tggttgtgggaactgaa

SEQ ID NO: 7302718 - DNA, 20 bp, Homo sapiens
tgtaaataggcattgtagtt

SEQ ID NO: 7302719 - DNA, 22 bp, Homo sapiens
tgtaaataattcctaggctttt

SEQ ID NO: 7302720 - DNA, 22 bp, Homo sapiens
tgtaaataatgcatgtaaatca

SEQ ID NO: 7302721 - DNA, 22 bp, Homo sapiens
tgtaaagatccttagcaacatc

SEQ ID NO: 7302722 - DNA, 22 bp, Homo sapiens
tgtaaagagaatggtatatgga

SEQ ID NO: 7302723 - DNA, 23 bp, Homo sapiens
tgtaaagatcaagtgactgattt

SEQ ID NO: 7302724 - DNA, 23 bp, Homo sapiens
tgtaaagatgatgctctagacac

SEQ ID NO: 7302725 - DNA, 22 bp, Homo sapiens
tgtaaagattagattacatgaa

SEQ ID NO: 7302726 - DNA, 22 bp, Homo sapiens
tgtaaaataattctccatgttt

SEQ ID NO: 7302727 - DNA, 22 bp, Homo sapiens
tgtaaaaggttgttctttcgtt

SEQ ID NO: 7302728 - DNA, 22 bp, Homo sapiens
tgtaaaagacatttctaagcaa

SEQ ID NO: 7302729 - DNA, 20 bp, Homo sapiens
tgtaaaacaaggtgaatcct

SEQ ID NO: 7302730 - DNA, 22 bp, Homo sapiens
tggttttaaaagatgtttgaga

SEQ ID NO: 7302731 - DNA, 22 bp, Homo sapiens
tggtggcaacattgctggagtg

SEQ ID NO: 7302732 - DNA, 22 bp, Homo sapiens
tggtgccattagccctgctgtt

SEQ ID NO: 7302733 - DNA, 22 bp, Homo sapiens
tggtgccatcatagctcactgc

SEQ ID NO: 7302734 - DNA, 22 bp, Homo sapiens
tggtgccaagcatgaggactct

SEQ ID NO: 7302735 - DNA, 22 bp, Homo sapiens
tggtgccacaagaatacaaagc

SEQ ID NO: 7302736 - DNA, 22 bp, Homo sapiens
tggtgcagtagagctgtctggg

SEQ ID NO: 7302737 - DNA, 22 bp, Homo sapiens
tggtggccaattcacagggctc

SEQ ID NO: 7302738 - DNA, 22 bp, Homo sapiens
tggtggggtcatcgtcagatgc

SEQ ID NO: 7302739 - DNA, 22 bp, Homo sapiens
tggtgggcacagtgcccaggct

SEQ ID NO: 7302740 - DNA, 22 bp, Homo sapiens
tggtcacttttgccagtggatg

SEQ ID NO: 7302741 - DNA, 22 bp, Homo sapiens
tggtcacccactgggactgcgg

SEQ ID NO: 7302742 - DNA, 22 bp, Homo sapiens
tggtcactatatttaaatatct

SEQ ID NO: 7302743 - DNA, 18 bp, Homo sapiens
tggtcactgtggatagtg

SEQ ID NO: 7302744 - DNA, 23 bp, Homo sapiens
tggtcagtgccttgcatgtggga

SEQ ID NO: 7302745 - DNA, 22 bp, Homo sapiens
tggtcattttggcatcttgggt

SEQ ID NO: 7302746 - DNA, 22 bp, Homo sapiens
tggtccacagggagtccgtgct

SEQ ID NO: 7302747 - DNA, 22 bp, Homo sapiens
tggtcattgtttgctggctctt

SEQ ID NO: 7302748 - DNA, 22 bp, Homo sapiens
tggtcatttctgggttctgacc

SEQ ID NO: 7302749 - DNA, 22 bp, Homo sapiens
tggtcattgatagtgcagggaa

SEQ ID NO: 7302750 - DNA, 21 bp, Homo sapiens
tggtcattgatagtgcaggga

SEQ ID NO: 7302751 - DNA, 22 bp, Homo sapiens
tggtcattggtagtgcagggag

SEQ ID NO: 7302752 - DNA, 22 bp, Homo sapiens
tggtcattgctattgtttctca

SEQ ID NO: 7302753 - DNA, 21 bp, Homo sapiens
tggtcattgcggtggaaggag

SEQ ID NO: 7302754 - DNA, 22 bp, Homo sapiens
tggtcctgatcaccgctgggca

SEQ ID NO: 7302755 - DNA, 22 bp, Homo sapiens
tggtccagggtgtagtacagag

SEQ ID NO: 7302756 - DNA, 22 bp, Homo sapiens
tggtgaggtcatagagaactgt

SEQ ID NO: 7302757 - DNA, 22 bp, Homo sapiens
tggtgcagatagtggtgtagta

SEQ ID NO: 7302758 - DNA, 22 bp, Homo sapiens
tggtgaggccaaagccatgaca

SEQ ID NO: 7302759 - DNA, 22 bp, Homo sapiens
tggtgactgggactggatatga

SEQ ID NO: 7302760 - DNA, 22 bp, Homo sapiens
tggtgactgattggtgttctct

SEQ ID NO: 7302761 - DNA, 22 bp, Homo sapiens
tggtctctgctgcagcttctca

SEQ ID NO: 7302762 - DNA, 22 bp, Homo sapiens
tggtcctggtagcggtgtgctt

SEQ ID NO: 7302763 - DNA, 22 bp, Homo sapiens
tggtcctggtcatctgggctgg

SEQ ID NO: 7302764 - DNA, 22 bp, Homo sapiens
tggtcctgtctcaaggagcctt

SEQ ID NO: 7302765 - DNA, 22 bp, Homo sapiens
tgtaggaagatataaaatatct

SEQ ID NO: 7302766 - DNA, 22 bp, Homo sapiens
tgtagatgagtcagggtgcacc

SEQ ID NO: 7302767 - DNA, 22 bp, Homo sapiens
tgtagatgagtcagggtgcatg

SEQ ID NO: 7302768 - DNA, 22 bp, Homo sapiens
tgtacttcaaaccctttggttt

SEQ ID NO: 7302769 - DNA, 22 bp, Homo sapiens
tgtacttcacctggtccactag

SEQ ID NO: 7302770 - DNA, 19 bp, Homo sapiens
tgtacgtgtgggtgtttaa

SEQ ID NO: 7302771 - DNA, 22 bp, Homo sapiens
tgtatatgtttgtatgtacaca

SEQ ID NO: 7302772 - DNA, 22 bp, Homo sapiens
tgtatatgtttgtatgtacaca

SEQ ID NO: 7302773 - DNA, 22 bp, Homo sapiens
tgtatatgtgatgtacatgtac

SEQ ID NO: 7302774 - DNA, 22 bp, Homo sapiens
tgtatatgtgatgtacatgtac

SEQ ID NO: 7302775 - DNA, 22 bp, Homo sapiens
tgtatatgtgcacatgtgcttc

SEQ ID NO: 7302776 - DNA, 22 bp, Homo sapiens
tgtatatgtgcacatgtgcttc

SEQ ID NO: 7302777 - DNA, 22 bp, Homo sapiens
tgtatatgtgtattttatgaca

SEQ ID NO: 7302778 - DNA, 22 bp, Homo sapiens
tgtatatgagtctgagtgtaca

SEQ ID NO: 7302779 - DNA, 22 bp, Homo sapiens
tgtatatgagtctgagtgtaca

SEQ ID NO: 7302780 - DNA, 22 bp, Homo sapiens
tgtatatgcactttccttatcc

SEQ ID NO: 7302781 - DNA, 22 bp, Homo sapiens
tgtatatgtcctggcatgtcat

SEQ ID NO: 7302782 - DNA, 22 bp, Homo sapiens
tgtatatatttctttcattcta

SEQ ID NO: 7302783 - DNA, 22 bp, Homo sapiens
tgtatatacatacacacatgaa

SEQ ID NO: 7302784 - DNA, 20 bp, Homo sapiens
tgtatattttctggtgtaaa

SEQ ID NO: 7302785 - DNA, 22 bp, Homo sapiens
tgtatattgttctgtctcttca

SEQ ID NO: 7302786 - DNA, 22 bp, Homo sapiens
tgtatcttcagtttgtctttcc

SEQ ID NO: 7302787 - DNA, 22 bp, Homo sapiens
tgtatctttctactgtctagtt

SEQ ID NO: 7302788 - DNA, 22 bp, Homo sapiens
tgtatctgacagtggagcggag

SEQ ID NO: 7302789 - DNA, 22 bp, Homo sapiens
tgtatacatgtgttcatgcatg

SEQ ID NO: 7302790 - DNA, 22 bp, Homo sapiens
tgtatacatgtctgtgtgcaca

SEQ ID NO: 7302791 - DNA, 22 bp, Homo sapiens
tgtatacaggattactcatagc

SEQ ID NO: 7302792 - DNA, 22 bp, Homo sapiens
tgtatacatttaactagataga

SEQ ID NO: 7302793 - DNA, 22 bp, Homo sapiens
tgtatacatttggtgcatattt

SEQ ID NO: 7302794 - DNA, 22 bp, Homo sapiens
tgtatatacacactcccatgtt

SEQ ID NO: 7302795 - DNA, 22 bp, Homo sapiens
tgtatataagcatttacttgtt

SEQ ID NO: 7302796 - DNA, 22 bp, Homo sapiens
tgtatagtttcttagttactga

SEQ ID NO: 7302797 - DNA, 22 bp, Homo sapiens
tgtatacactatgctatatggt

SEQ ID NO: 7302798 - DNA, 21 bp, Homo sapiens
tgtatacacacatatatgtac

SEQ ID NO: 7302799 - DNA, 21 bp, Homo sapiens
tgtatacacacatatatgtac

SEQ ID NO: 7302800 - DNA, 21 bp, Homo sapiens
tgtataacaactatgcaatgt

SEQ ID NO: 7302801 - DNA, 22 bp, Homo sapiens
tgtatacaaattggaatcagat

SEQ ID NO: 7302802 - DNA, 22 bp, Homo sapiens
tgtcacacctcgtttagcattc

SEQ ID NO: 7302803 - DNA, 22 bp, Homo sapiens
tgtcacacttggtggttttggt

SEQ ID NO: 7302804 - DNA, 22 bp, Homo sapiens
tgtcaaactgtgacttctaatg

SEQ ID NO: 7302805 - DNA, 22 bp, Homo sapiens
tgtatttttagacctttagacc

SEQ ID NO: 7302806 - DNA, 22 bp, Homo sapiens
tgtcacatatataatgttcaat

SEQ ID NO: 7302807 - DNA, 22 bp, Homo sapiens
tgtcacatatataatgttcaat

SEQ ID NO: 7302808 - DNA, 22 bp, Homo sapiens
tgtcacatgaagccaacatagc

SEQ ID NO: 7302809 - DNA, 22 bp, Homo sapiens
tgtcacctctttggctgcagct

SEQ ID NO: 7302810 - DNA, 22 bp, Homo sapiens
tgtcacctctttggctgcagct

SEQ ID NO: 7302811 - DNA, 22 bp, Homo sapiens
tgtcaccaccggaagaaactgc

SEQ ID NO: 7302812 - DNA, 22 bp, Homo sapiens
tgtcaccagttccaggaaataa

SEQ ID NO: 7302813 - DNA, 22 bp, Homo sapiens
tgtcacatgacacaaatatcta

SEQ ID NO: 7302814 - DNA, 22 bp, Homo sapiens
tgtatgctttccttctttctgg

SEQ ID NO: 7302815 - DNA, 22 bp, Homo sapiens
tgtatgtaaagaaggatatttt

SEQ ID NO: 7302816 - DNA, 22 bp, Homo sapiens
tgtatgtaaagtttgtaataga

SEQ ID NO: 7302817 - DNA, 22 bp, Homo sapiens
tgtatgtaaagtttgtaataga

SEQ ID NO: 7302818 - DNA, 22 bp, Homo sapiens
tgtatgtatacactgatcatca

SEQ ID NO: 7302819 - DNA, 22 bp, Homo sapiens
tgtatgtatacacatagatacg

SEQ ID NO: 7302820 - DNA, 22 bp, Homo sapiens
tgtatgtatacacatagatacg

SEQ ID NO: 7302821 - DNA, 22 bp, Homo sapiens
tgtatttaattgtatcatcaca

SEQ ID NO: 7302822 - DNA, 22 bp, Homo sapiens
tgtatttaattgtatcatcaca

SEQ ID NO: 7302823 - DNA, 22 bp, Homo sapiens
tgtattgttataatttgtatgt

SEQ ID NO: 7302824 - DNA, 22 bp, Homo sapiens
tgtatttgagttatgaaagaga

SEQ ID NO: 7302825 - DNA, 22 bp, Homo sapiens
tgtatttgaaacagtgcatggg

SEQ ID NO: 7302826 - DNA, 22 bp, Homo sapiens
tgtatttggtgtatttaatgag

SEQ ID NO: 7302827 - DNA, 22 bp, Homo sapiens
tgtcatcagcatataagacagt

SEQ ID NO: 7302828 - DNA, 22 bp, Homo sapiens
tgtcatatagaatgttctatga

SEQ ID NO: 7302829 - DNA, 22 bp, Homo sapiens
tgtcatttatcttatagtaatc

SEQ ID NO: 7302830 - DNA, 22 bp, Homo sapiens
tgtcatttatcttatagtaatc

SEQ ID NO: 7302831 - DNA, 22 bp, Homo sapiens
tgtccagcacctggatgtttgg

SEQ ID NO: 7302832 - DNA, 22 bp, Homo sapiens
tgtccacatatgttgtttctga

SEQ ID NO: 7302833 - DNA, 22 bp, Homo sapiens
tgtccaatgccctttccacatg

SEQ ID NO: 7302834 - DNA, 22 bp, Homo sapiens
tgtcatttcctgaatgctgagt

SEQ ID NO: 7302835 - DNA, 22 bp, Homo sapiens
tgtcatagtgtggtagcagtgg

SEQ ID NO: 7302836 - DNA, 22 bp, Homo sapiens
tgtcactacatcataaatatat

SEQ ID NO: 7302837 - DNA, 19 bp, Homo sapiens
tgtcaccttctgtcagttt

SEQ ID NO: 7302838 - DNA, 22 bp, Homo sapiens
tgtcaccttgatgatggcctag

SEQ ID NO: 7302839 - DNA, 22 bp, Homo sapiens
tgtcaccttgcagggctggggc

SEQ ID NO: 7302840 - DNA, 23 bp, Homo sapiens
tgtcactataagagggcttgccc

SEQ ID NO: 7302841 - DNA, 21 bp, Homo sapiens
tgtcactttaagctagctcta

SEQ ID NO: 7302842 - DNA, 22 bp, Homo sapiens
tgtcacttcagttttgaaacaa

SEQ ID NO: 7302843 - DNA, 22 bp, Homo sapiens
tgtccctggagcttctgtcccc

SEQ ID NO: 7302844 - DNA, 22 bp, Homo sapiens
tgtccccacccaaatctcatct

SEQ ID NO: 7302845 - DNA, 22 bp, Homo sapiens
tgtccccagagcctgttcctgc

SEQ ID NO: 7302846 - DNA, 22 bp, Homo sapiens
tgtccccacctaaatcttatct

SEQ ID NO: 7302847 - DNA, 22 bp, Homo sapiens
tgtccccaggtcctctgccgtc

SEQ ID NO: 7302848 - DNA, 22 bp, Homo sapiens
tgtccccattctaagaggtggc

SEQ ID NO: 7302849 - DNA, 22 bp, Homo sapiens
tgtcctggtgctccaggtggct

SEQ ID NO: 7302850 - DNA, 21 bp, Homo sapiens
tgtcctggtcactgctctccc

SEQ ID NO: 7302851 - DNA, 22 bp, Homo sapiens
tgtcctgggtggatgcttcatt

SEQ ID NO: 7302852 - DNA, 22 bp, Homo sapiens
tgtcctgtgacctggcaccaca

SEQ ID NO: 7302853 - DNA, 19 bp, Homo sapiens
tgtcctgtcctgctctgac

SEQ ID NO: 7302854 - DNA, 22 bp, Homo sapiens
tgtcctggtgcttcttgggatt

SEQ ID NO: 7302855 - DNA, 22 bp, Homo sapiens
tgtccttcttgtcttgcccaaa

SEQ ID NO: 7302856 - DNA, 23 bp, Homo sapiens
tgtcctatgcagctaaaattcct

SEQ ID NO: 7302857 - DNA, 22 bp, Homo sapiens
tgtcctcaggacctggcacagt

SEQ ID NO: 7302858 - DNA, 22 bp, Homo sapiens
tgtcctgggaactcacagtcca

SEQ ID NO: 7302859 - DNA, 22 bp, Homo sapiens
tgtcctgggaatgggatgcagt

SEQ ID NO: 7302860 - DNA, 22 bp, Homo sapiens
ttcagcagcttttagtacattg

SEQ ID NO: 7302861 - DNA, 22 bp, Homo sapiens
ttcaccattctaagacattggt

SEQ ID NO: 7302862 - DNA, 22 bp, Homo sapiens
ttcactgcagcccatgaaggga

SEQ ID NO: 7302863 - DNA, 22 bp, Homo sapiens
ttcactacggtcacgaccctgg

SEQ ID NO: 7302864 - DNA, 22 bp, Homo sapiens
ttcaccgagatcagatgttaag

SEQ ID NO: 7302865 - DNA, 22 bp, Homo sapiens
ttcagcctgtctgcagacccct

SEQ ID NO: 7302866 - DNA, 22 bp, Homo sapiens
ttcagccagtcatcagtcttgt

SEQ ID NO: 7302867 - DNA, 21 bp, Homo sapiens
ttcagctctgcttcagggaat

SEQ ID NO: 7302868 - DNA, 22 bp, Homo sapiens
ttcagctctagtaagcagacac

SEQ ID NO: 7302869 - DNA, 22 bp, Homo sapiens
ttcagctcctttcttccaccag

SEQ ID NO: 7302870 - DNA, 22 bp, Homo sapiens
ttcagctcagtctgtgcagcag

SEQ ID NO: 7302871 - DNA, 22 bp, Homo sapiens
ttcagctcagcactgacaagat

SEQ ID NO: 7302872 - DNA, 22 bp, Homo sapiens
ttcagcttgcttagtctccttc

SEQ ID NO: 7302873 - DNA, 22 bp, Homo sapiens
ttcagcttgctgactgcggcag

SEQ ID NO: 7302874 - DNA, 20 bp, Homo sapiens
ttatttctcattctcctact

SEQ ID NO: 7302875 - DNA, 22 bp, Homo sapiens
ttatttcttgtctatgtagcca

SEQ ID NO: 7302876 - DNA, 22 bp, Homo sapiens
ttatttcttgtctatgtagcca

SEQ ID NO: 7302877 - DNA, 22 bp, Homo sapiens
ttatttgacttcttgctatgct

SEQ ID NO: 7302878 - DNA, 22 bp, Homo sapiens
ttatttgaatgatggcacaatt

SEQ ID NO: 7302879 - DNA, 22 bp, Homo sapiens
ttatttgcccatgtttagcaga

SEQ ID NO: 7302880 - DNA, 22 bp, Homo sapiens
ttatttggaaatatggcttctg

SEQ ID NO: 7302881 - DNA, 22 bp, Homo sapiens
ttatttgtaaaggtccatagta

SEQ ID NO: 7302882 - DNA, 22 bp, Homo sapiens
ttatttgtgaatcatttatcta

SEQ ID NO: 7302883 - DNA, 22 bp, Homo sapiens
ttatttgtaaggcagggccagt

SEQ ID NO: 7302884 - DNA, 22 bp, Homo sapiens
ttatttgtatcaaggacggttg

SEQ ID NO: 7302885 - DNA, 22 bp, Homo sapiens
ttcacattggttcttgatagct

SEQ ID NO: 7302886 - DNA, 22 bp, Homo sapiens
ttcacattggtgatatgtttct

SEQ ID NO: 7302887 - DNA, 23 bp, Homo sapiens
ttcattcaaaaggaaaagtcatg

SEQ ID NO: 7302888 - DNA, 22 bp, Homo sapiens
ttcattcatctctaaaatgcct

SEQ ID NO: 7302889 - DNA, 17 bp, Homo sapiens
ttcattaataaaagcaa

SEQ ID NO: 7302890 - DNA, 22 bp, Homo sapiens
ttcattaattcattcagtgact

SEQ ID NO: 7302891 - DNA, 22 bp, Homo sapiens
ttcattaattcattcagtgact

SEQ ID NO: 7302892 - DNA, 22 bp, Homo sapiens
ttcattaagtataaaatgtggt

SEQ ID NO: 7302893 - DNA, 22 bp, Homo sapiens
ttcattaagtataaaatgtggt

SEQ ID NO: 7302894 - DNA, 17 bp, Homo sapiens
ttcattaataaaagcaa

SEQ ID NO: 7302895 - DNA, 22 bp, Homo sapiens
ttcattagagattataaaatga

SEQ ID NO: 7302896 - DNA, 22 bp, Homo sapiens
ttcattagcaaggtcttcaagt

SEQ ID NO: 7302897 - DNA, 22 bp, Homo sapiens
ttcattagaaaagtaaaaatgc

SEQ ID NO: 7302898 - DNA, 22 bp, Homo sapiens
ttcattgatagttttatgtatg

SEQ ID NO: 7302899 - DNA, 22 bp, Homo sapiens
ttcattgatagttttatgtatg

SEQ ID NO: 7302900 - DNA, 22 bp, Homo sapiens
ttcattgagctgtacacttagg

SEQ ID NO: 7302901 - DNA, 22 bp, Homo sapiens
ttccagaggctctaggggagaa

SEQ ID NO: 7302902 - DNA, 22 bp, Homo sapiens
ttcattcttttacatgtgaata

SEQ ID NO: 7302903 - DNA, 22 bp, Homo sapiens
ttccagctaactcacatccctt

SEQ ID NO: 7302904 - DNA, 22 bp, Homo sapiens
ttccagctaactcacatccctt

SEQ ID NO: 7302905 - DNA, 22 bp, Homo sapiens
ttagaagcactaattactcaca

SEQ ID NO: 7302906 - DNA, 22 bp, Homo sapiens
ttagataatgttattgtaattt

SEQ ID NO: 7302907 - DNA, 22 bp, Homo sapiens
ttagataggactcatagattgg

SEQ ID NO: 7302908 - DNA, 22 bp, Homo sapiens
ttagatatgtttttgctaatgc

SEQ ID NO: 7302909 - DNA, 22 bp, Homo sapiens
ttagatacattctcatttgttt

SEQ ID NO: 7302910 - DNA, 22 bp, Homo sapiens
ttagatacgcaggcagttttaa

SEQ ID NO: 7302911 - DNA, 22 bp, Homo sapiens
ttagaacatagcaacagaatta

SEQ ID NO: 7302912 - DNA, 22 bp, Homo sapiens
ttagaaatgtcacagatctgat

SEQ ID NO: 7302913 - DNA, 22 bp, Homo sapiens
ttagaaaggggtgaatcaatgg

SEQ ID NO: 7302914 - DNA, 22 bp, Homo sapiens
ttagaaaggggtgaatcaatgg

SEQ ID NO: 7302915 - DNA, 22 bp, Homo sapiens
ttagaaaggttttgctctgaaa

SEQ ID NO: 7302916 - DNA, 22 bp, Homo sapiens
ttagaaaggaatcttcatttca

SEQ ID NO: 7302917 - DNA, 19 bp, Homo sapiens
ttaggggtatgaagtggta

SEQ ID NO: 7302918 - DNA, 22 bp, Homo sapiens
ttagtacattgattcattatgt

SEQ ID NO: 7302919 - DNA, 22 bp, Homo sapiens
ttaggtattttgttatgtcagc

SEQ ID NO: 7302920 - DNA, 22 bp, Homo sapiens
ttagcattctcatttgcataaa

SEQ ID NO: 7302921 - DNA, 22 bp, Homo sapiens
ttatttcattgatttctaagac

SEQ ID NO: 7302922 - DNA, 22 bp, Homo sapiens
ttattcttggatctgagtctct

SEQ ID NO: 7302923 - DNA, 19 bp, Homo sapiens
ttattcttaaagtagctta

SEQ ID NO: 7302924 - DNA, 19 bp, Homo sapiens
ttattctgtcagagcacac

SEQ ID NO: 7302925 - DNA, 22 bp, Homo sapiens
ttattcagtgcatatattaaaa

SEQ ID NO: 7302926 - DNA, 22 bp, Homo sapiens
ttattattgattcgctctcaaa

SEQ ID NO: 7302927 - DNA, 22 bp, Homo sapiens
ttattcatcagtgcattaattt

SEQ ID NO: 7302928 - DNA, 21 bp, Homo sapiens
ttattctgagatgagattctt

SEQ ID NO: 7302929 - DNA, 22 bp, Homo sapiens
ttatgacaggaaaatcacagaa

SEQ ID NO: 7302930 - DNA, 22 bp, Homo sapiens
ttatgatttgccacagattggt

SEQ ID NO: 7302931 - DNA, 22 bp, Homo sapiens
ttatgacagaaatgaaaagctg

SEQ ID NO: 7302932 - DNA, 22 bp, Homo sapiens
ttatgaaagacatttctgttgg

SEQ ID NO: 7302933 - DNA, 22 bp, Homo sapiens
ttatcttgtagagatattttcg

SEQ ID NO: 7302934 - DNA, 17 bp, Homo sapiens
ttatcttgctgtttcta

SEQ ID NO: 7302935 - DNA, 22 bp, Homo sapiens
ttatcttgggtaactttgtgca

SEQ ID NO: 7302936 - DNA, 22 bp, Homo sapiens
ttagtgataggactttaaagcc

SEQ ID NO: 7302937 - DNA, 22 bp, Homo sapiens
ttagtgatgactagacttttgt

SEQ ID NO: 7302938 - DNA, 22 bp, Homo sapiens
ttaaagcaaccatcaatttgga

SEQ ID NO: 7302939 - DNA, 22 bp, Homo sapiens
ttaaagcagtttgtatacatgg

SEQ ID NO: 7302940 - DNA, 22 bp, Homo sapiens
ttaaagagtaatcataggtcaa

SEQ ID NO: 7302941 - DNA, 22 bp, Homo sapiens
ttaaagagtaatcataggtcaa

SEQ ID NO: 7302942 - DNA, 22 bp, Homo sapiens
ttaaacctcagagtctttttca

SEQ ID NO: 7302943 - DNA, 22 bp, Homo sapiens
ttaatacatttcagactgttat

SEQ ID NO: 7302944 - DNA, 22 bp, Homo sapiens
ttaatacaagcatatgcacaca

SEQ ID NO: 7302945 - DNA, 22 bp, Homo sapiens
ttacaacatatgataggagtct

SEQ ID NO: 7302946 - DNA, 22 bp, Homo sapiens
ttacaacatatttagcttgatt

SEQ ID NO: 7302947 - DNA, 21 bp, Homo sapiens
ttacaacatttgtgttctatg

SEQ ID NO: 7302948 - DNA, 22 bp, Homo sapiens
ttacaactggtgaattttatgg

SEQ ID NO: 7302949 - DNA, 22 bp, Homo sapiens
ttacaactggtgaattttatgg

SEQ ID NO: 7302950 - DNA, 22 bp, Homo sapiens
ttacaactctgaactacagagg

SEQ ID NO: 7302951 - DNA, 22 bp, Homo sapiens
ttacaacagacacatattctaa

SEQ ID NO: 7302952 - DNA, 22 bp, Homo sapiens
ttacaacactacttatccttga

SEQ ID NO: 7302953 - DNA, 23 bp, Homo sapiens
ttacaacagtgtccatatttgta

SEQ ID NO: 7302954 - DNA, 23 bp, Homo sapiens
ttacaacagtgtccatatttgta

SEQ ID NO: 7302955 - DNA, 22 bp, Homo sapiens
ttacaacaccaggcagtatcct

SEQ ID NO: 7302956 - DNA, 22 bp, Homo sapiens
ttacaaagttctgagttcaaac

SEQ ID NO: 7302957 - DNA, 22 bp, Homo sapiens
ttacaaagagtgccagagtgtg

SEQ ID NO: 7302958 - DNA, 22 bp, Homo sapiens
ttacaaagtgctgcaccatttt

SEQ ID NO: 7302959 - DNA, 22 bp, Homo sapiens
ttacaaagtgctgcaccatttt

SEQ ID NO: 7302960 - DNA, 22 bp, Homo sapiens
ttacaaagagaagttgtagaat

SEQ ID NO: 7302961 - DNA, 22 bp, Homo sapiens
ttacagaggcttccagggccca

SEQ ID NO: 7302962 - DNA, 22 bp, Homo sapiens
ttacagagctcatttctaaggg

SEQ ID NO: 7302963 - DNA, 22 bp, Homo sapiens
ttacagagctgggtggagagag

SEQ ID NO: 7302964 - DNA, 22 bp, Homo sapiens
ttacagagaggtgattgtgaag

SEQ ID NO: 7302965 - DNA, 22 bp, Homo sapiens
ttacagagaggtgattgtgaag

SEQ ID NO: 7302966 - DNA, 22 bp, Homo sapiens
ttacagatactttgtaggcaag

SEQ ID NO: 7302967 - DNA, 22 bp, Homo sapiens
ttacagagttcgcacctggtgg

SEQ ID NO: 7302968 - DNA, 22 bp, Homo sapiens
ttacagagtggtctggctatgt

SEQ ID NO: 7302969 - DNA, 22 bp, Homo sapiens
ttacagagtagtgcagaactca

SEQ ID NO: 7302970 - DNA, 22 bp, Homo sapiens
ttacagaggtatgtatgtctct

SEQ ID NO: 7302971 - DNA, 22 bp, Homo sapiens
ttacagagtagggaattgaagt

SEQ ID NO: 7302972 - DNA, 22 bp, Homo sapiens
ttacaagtactgaatatgattt

SEQ ID NO: 7302973 - DNA, 22 bp, Homo sapiens
ttacaattgagtctattgtatg

SEQ ID NO: 7302974 - DNA, 22 bp, Homo sapiens
ttacaatgtaaggcatggttct

SEQ ID NO: 7302975 - DNA, 22 bp, Homo sapiens
ttacagatggatctagcaaaat

SEQ ID NO: 7302976 - DNA, 22 bp, Homo sapiens
ttacagatggggttgcaataaa

SEQ ID NO: 7302977 - DNA, 22 bp, Homo sapiens
ttacagatggggttgcaataaa

SEQ ID NO: 7302978 - DNA, 22 bp, Homo sapiens
ttacagatgtaggaactgaagt

SEQ ID NO: 7302979 - DNA, 22 bp, Homo sapiens
ttacatgcaggtcagactgcat

SEQ ID NO: 7302980 - DNA, 22 bp, Homo sapiens
ttacattaagccaatggattct

SEQ ID NO: 7302981 - DNA, 22 bp, Homo sapiens
ttacattagacccactttcatg

SEQ ID NO: 7302982 - DNA, 22 bp, Homo sapiens
ttacattagacccactttcatg

SEQ ID NO: 7302983 - DNA, 23 bp, Homo sapiens
ttacatgtgtgcacacattctgg

SEQ ID NO: 7302984 - DNA, 22 bp, Homo sapiens
ttacattagacccactttcatg

SEQ ID NO: 7302985 - DNA, 22 bp, Homo sapiens
ttacattcaaggaactcattct

SEQ ID NO: 7302986 - DNA, 22 bp, Homo sapiens
ttacatttggctatgtcctcta

SEQ ID NO: 7302987 - DNA, 22 bp, Homo sapiens
ttacattttagttaacctgtga

SEQ ID NO: 7302988 - DNA, 22 bp, Homo sapiens
tgtgcatggccagctggatcga

SEQ ID NO: 7302989 - DNA, 22 bp, Homo sapiens
tgtgcatgtaccttattctgga

SEQ ID NO: 7302990 - DNA, 22 bp, Homo sapiens
tgtgcatgtctgggcctgtaag

SEQ ID NO: 7302991 - DNA, 22 bp, Homo sapiens
tgtgcatgtattgatttgtacc

SEQ ID NO: 7302992 - DNA, 22 bp, Homo sapiens
tgtgcatgtctgggcctgtaag

SEQ ID NO: 7302993 - DNA, 22 bp, Homo sapiens
tgtgcatgtgtctttatagtag

SEQ ID NO: 7302994 - DNA, 16 bp, Homo sapiens
tgtgcatgttctgtgt

SEQ ID NO: 7302995 - DNA, 22 bp, Homo sapiens
tgtgcatgtgtttcatggatct

SEQ ID NO: 7302996 - DNA, 22 bp, Homo sapiens
tgtgcatgttctcatttctaac

SEQ ID NO: 7302997 - DNA, 22 bp, Homo sapiens
tgtgccaagactatattgtgct

SEQ ID NO: 7302998 - DNA, 22 bp, Homo sapiens
tgtgccaagatcaaacttttct

SEQ ID NO: 7302999 - DNA, 22 bp, Homo sapiens
tgtgcatgtttgttttcagggt

SEQ ID NO: 7303000 - DNA, 16 bp, Homo sapiens
tgtgcatgttctgtgt

SEQ ID NO: 7303001 - DNA, 22 bp, Homo sapiens
tgtgcatgttgcttgaactcct

SEQ ID NO: 7303002 - DNA, 22 bp, Homo sapiens
tgtgcatgtaccttattctgga

SEQ ID NO: 7303003 - DNA, 22 bp, Homo sapiens
tgtgcatgcacatatatgttgc

SEQ ID NO: 7303004 - DNA, 22 bp, Homo sapiens
tgtgcatgcatatgtatttttg

SEQ ID NO: 7303005 - DNA, 22 bp, Homo sapiens
tgtgcatggcatcattgcagcc

SEQ ID NO: 7303006 - DNA, 22 bp, Homo sapiens
tgtgcatgaatcaatgattccg

SEQ ID NO: 7303007 - DNA, 22 bp, Homo sapiens
tgtgcatgacagcatacaaacg

SEQ ID NO: 7303008 - DNA, 22 bp, Homo sapiens
tgtgcatcaaacccatttaaat

SEQ ID NO: 7303009 - DNA, 20 bp, Homo sapiens
tgtgcatgaactgagggatt

SEQ ID NO: 7303010 - DNA, 17 bp, Homo sapiens
tgtgcatagaataatga

SEQ ID NO: 7303011 - DNA, 22 bp, Homo sapiens
tgtgcagtttctatgttgtcca

SEQ ID NO: 7303012 - DNA, 22 bp, Homo sapiens
tgtgcagttttaagtggtctaa

SEQ ID NO: 7303013 - DNA, 22 bp, Homo sapiens
tgtgcagttttaagtggtctaa

SEQ ID NO: 7303014 - DNA, 22 bp, Homo sapiens
tgtgcctagttctgtatttaca

SEQ ID NO: 7303015 - DNA, 22 bp, Homo sapiens
tgtgcctaatgtttccattttc

SEQ ID NO: 7303016 - DNA, 18 bp, Homo sapiens
tgtgcctctgcaggacgt

SEQ ID NO: 7303017 - DNA, 22 bp, Homo sapiens
tgtgcctgactaggtgaatcaa

SEQ ID NO: 7303018 - DNA, 22 bp, Homo sapiens
tgtgcctgactaggtgaatcaa

SEQ ID NO: 7303019 - DNA, 22 bp, Homo sapiens
tgtgcccttttgacagtgagag

SEQ ID NO: 7303020 - DNA, 22 bp, Homo sapiens
tgtgccctcagaagagtacatc

SEQ ID NO: 7303021 - DNA, 18 bp, Homo sapiens
tgtgcaatattaaccacc

SEQ ID NO: 7303022 - DNA, 22 bp, Homo sapiens
tgtgcaatttcaatttacacag

SEQ ID NO: 7303023 - DNA, 22 bp, Homo sapiens
tgtgcaatcttgagcaatttat

SEQ ID NO: 7303024 - DNA, 18 bp, Homo sapiens
tgtgcaatattaaccacc

SEQ ID NO: 7303025 - DNA, 22 bp, Homo sapiens
tgtgcaatcatattttaaaatg

SEQ ID NO: 7303026 - DNA, 22 bp, Homo sapiens
tgtgcaatcatattttaaaatg

SEQ ID NO: 7303027 - DNA, 22 bp, Homo sapiens
tgtgcacatatactcatattcc

SEQ ID NO: 7303028 - DNA, 23 bp, Homo sapiens
tgtgcagcatttcttgctatagg

SEQ ID NO: 7303029 - DNA, 22 bp, Homo sapiens
tgtgcagggaagggcatgctat

SEQ ID NO: 7303030 - DNA, 21 bp, Homo sapiens
tgtgcagtccaatgtgctagc

SEQ ID NO: 7303031 - DNA, 22 bp, Homo sapiens
tgtgcagtttctatgttgtcca

SEQ ID NO: 7303032 - DNA, 22 bp, Homo sapiens
tgtgcagttcaaacccgtgttg

SEQ ID NO: 7303033 - DNA, 22 bp, Homo sapiens
tgtgcctgttggtgtagacata

SEQ ID NO: 7303034 - DNA, 22 bp, Homo sapiens
tgtgcctgtcaccctcagagag

SEQ ID NO: 7303035 - DNA, 17 bp, Homo sapiens
tgtgcgcttgtgtgagg

SEQ ID NO: 7303036 - DNA, 23 bp, Homo sapiens
tgtgcgtgatgctttgttgaagg

SEQ ID NO: 7303037 - DNA, 23 bp, Homo sapiens
tgtgcgtgatgctttgttgaagg

SEQ ID NO: 7303038 - DNA, 22 bp, Homo sapiens
tgtgcgtgatggaccgggcctg

SEQ ID NO: 7303039 - DNA, 22 bp, Homo sapiens
tgtgcgtgggcacacacatatg

SEQ ID NO: 7303040 - DNA, 22 bp, Homo sapiens
tgtgcgtggattcctgtactca

SEQ ID NO: 7303041 - DNA, 22 bp, Homo sapiens
tgtgcgctccggcgagtcagcg

SEQ ID NO: 7303042 - DNA, 22 bp, Homo sapiens
tgtgcgcgtgcagcggagtgtt

SEQ ID NO: 7303043 - DNA, 22 bp, Homo sapiens
tgtgcgatgggtacatgagagt

SEQ ID NO: 7303044 - DNA, 22 bp, Homo sapiens
tgtgccttctcagtcctgctca

SEQ ID NO: 7303045 - DNA, 22 bp, Homo sapiens
tgtgcctggatctctgtgacaa

SEQ ID NO: 7303046 - DNA, 22 bp, Homo sapiens
tgtgcctggatctctgtgacaa

SEQ ID NO: 7303047 - DNA, 22 bp, Homo sapiens
tgtgcctggtccctgagtcgag

SEQ ID NO: 7303048 - DNA, 22 bp, Homo sapiens
tgtgcctggcccagtggtgtca

SEQ ID NO: 7303049 - DNA, 22 bp, Homo sapiens
tgtgcctgatggtcacgtggcc

SEQ ID NO: 7303050 - DNA, 22 bp, Homo sapiens
tgtgcctgctagatggttgtcg

SEQ ID NO: 7303051 - DNA, 22 bp, Homo sapiens
tgtgcctggagtccctgaggag

SEQ ID NO: 7303052 - DNA, 22 bp, Homo sapiens
tgtgcctgctagatggttgtcg

SEQ ID NO: 7303053 - DNA, 22 bp, Homo sapiens
tgtgcctgagttggctgagtac

SEQ ID NO: 7303054 - DNA, 22 bp, Homo sapiens
tgtgctcttgtctgtgactaac

SEQ ID NO: 7303055 - DNA, 22 bp, Homo sapiens
tgtgctgagcaaatccatctgt

SEQ ID NO: 7303056 - DNA, 22 bp, Homo sapiens
tgtgctgctctcagtgacagcc

SEQ ID NO: 7303057 - DNA, 22 bp, Homo sapiens
tgtgctgctgtgaataagacct

SEQ ID NO: 7303058 - DNA, 22 bp, Homo sapiens
tgtgctcatggtccagcatggt

SEQ ID NO: 7303059 - DNA, 22 bp, Homo sapiens
tgtgcgtggattcctgtactca

SEQ ID NO: 7303060 - DNA, 22 bp, Homo sapiens
tgtgcgtggttcccggggccat

SEQ ID NO: 7303061 - DNA, 22 bp, Homo sapiens
tgtgctaagtattttcttattt

SEQ ID NO: 7303062 - DNA, 22 bp, Homo sapiens
tgtgctattacacatttattta

SEQ ID NO: 7303063 - DNA, 22 bp, Homo sapiens
tgtgctatttgactgtttgcta

SEQ ID NO: 7303064 - DNA, 22 bp, Homo sapiens
tgtgagagcagaagacacatag

SEQ ID NO: 7303065 - DNA, 22 bp, Homo sapiens
tgtgagtctaggtcagggtgtt

SEQ ID NO: 7303066 - DNA, 22 bp, Homo sapiens
tgtgagtgaatgggtctgaagt

SEQ ID NO: 7303067 - DNA, 22 bp, Homo sapiens
tgtgatatttgagtattgtcaa

SEQ ID NO: 7303068 - DNA, 21 bp, Homo sapiens
tgtgataatactatatgctct

SEQ ID NO: 7303069 - DNA, 22 bp, Homo sapiens
tgtgatgctggagtgcgaatat

SEQ ID NO: 7303070 - DNA, 22 bp, Homo sapiens
tgtgagacgtgttagaacagtg

SEQ ID NO: 7303071 - DNA, 22 bp, Homo sapiens
tgtgagacgtaggccatcgagg

SEQ ID NO: 7303072 - DNA, 22 bp, Homo sapiens
tgtgagacgtgttagaacagtg

SEQ ID NO: 7303073 - DNA, 22 bp, Homo sapiens
tgtgagacaggacctgttgact

SEQ ID NO: 7303074 - DNA, 22 bp, Homo sapiens
tgtgagactttctttggcctct

SEQ ID NO: 7303075 - DNA, 22 bp, Homo sapiens
tgtgagacacactgctgcttca

SEQ ID NO: 7303076 - DNA, 21 bp, Homo sapiens
tgtgactgttgcatttgtcgt

SEQ ID NO: 7303077 - DNA, 22 bp, Homo sapiens
tgtgactgtggacttttgtggg

SEQ ID NO: 7303078 - DNA, 22 bp, Homo sapiens
tgtgactgtggtgagatttaag

SEQ ID NO: 7303079 - DNA, 22 bp, Homo sapiens
tgtgactggcttatttcactta

SEQ ID NO: 7303080 - DNA, 22 bp, Homo sapiens
tgtgactggttgtcccgctttc

SEQ ID NO: 7303081 - DNA, 22 bp, Homo sapiens
tgtgactgcatttggagctggg

SEQ ID NO: 7303082 - DNA, 22 bp, Homo sapiens
tgtgactgaggctccaagctag

SEQ ID NO: 7303083 - DNA, 22 bp, Homo sapiens
tgtgactgagctgcagagtgtc

SEQ ID NO: 7303084 - DNA, 22 bp, Homo sapiens
tgtgaccataatttgtaaataa

SEQ ID NO: 7303085 - DNA, 22 bp, Homo sapiens
tgtgacataaaaacagcaatca

SEQ ID NO: 7303086 - DNA, 22 bp, Homo sapiens
tgtgaaggtttttatgggatat

SEQ ID NO: 7303087 - DNA, 21 bp, Homo sapiens
tgtgaaatagctatgctacat

SEQ ID NO: 7303088 - DNA, 21 bp, Homo sapiens
tgtgaaatagctatgctacat

SEQ ID NO: 7303089 - DNA, 22 bp, Homo sapiens
tgtgaaatattggcaatttcat

SEQ ID NO: 7303090 - DNA, 22 bp, Homo sapiens
tgtgaaatatttatatactcaa

SEQ ID NO: 7303091 - DNA, 22 bp, Homo sapiens
tgtgaaatattggcaatttcat

SEQ ID NO: 7303092 - DNA, 22 bp, Homo sapiens
tgtgaaatctgaactcaaagat

SEQ ID NO: 7303093 - DNA, 22 bp, Homo sapiens
tgtgaaatcaattagctgcaga

SEQ ID NO: 7303094 - DNA, 22 bp, Homo sapiens
tgtgaaatcacaggctatttag

SEQ ID NO: 7303095 - DNA, 22 bp, Homo sapiens
tgtgaaatcacaggctatttag

SEQ ID NO: 7303096 - DNA, 22 bp, Homo sapiens
tgtgaaagcagccatgggcatt

SEQ ID NO: 7303097 - DNA, 20 bp, Homo sapiens
tgtgaaagcagtagaatgac

SEQ ID NO: 7303098 - DNA, 22 bp, Homo sapiens
tgtgaaagatactaggcagagg

SEQ ID NO: 7303099 - DNA, 22 bp, Homo sapiens
tgtgaaatctgatgaattgacc

SEQ ID NO: 7303100 - DNA, 22 bp, Homo sapiens
tgtgaaatctgaactcaaagat

SEQ ID NO: 7303101 - DNA, 22 bp, Homo sapiens
tgtgaaatgaagataattcttg

SEQ ID NO: 7303102 - DNA, 22 bp, Homo sapiens
tgtgaaatgaagataattcttg

SEQ ID NO: 7303103 - DNA, 22 bp, Homo sapiens
tgtgaaatgagtatatttgaat

SEQ ID NO: 7303104 - DNA, 22 bp, Homo sapiens
tgtgaaatgctatttccatgag

SEQ ID NO: 7303105 - DNA, 22 bp, Homo sapiens
tgtgaaatgtggatgttaatag

SEQ ID NO: 7303106 - DNA, 22 bp, Homo sapiens
tgtgaaatgctatttccatgag

SEQ ID NO: 7303107 - DNA, 22 bp, Homo sapiens
tgtgaaatgctattgtgacaaa

SEQ ID NO: 7303108 - DNA, 22 bp, Homo sapiens
tgtgaaatgctattgtgacaaa

SEQ ID NO: 7303109 - DNA, 22 bp, Homo sapiens
tgtgaaatgtgtgtataattaa

SEQ ID NO: 7303110 - DNA, 22 bp, Homo sapiens
tgtgaaatgtgtgtataattaa

SEQ ID NO: 7303111 - DNA, 22 bp, Homo sapiens
tgtgaaattcttgaaatgcaca

SEQ ID NO: 7303112 - DNA, 22 bp, Homo sapiens
tgtgaaattacttaaaggaaat

SEQ ID NO: 7303113 - DNA, 22 bp, Homo sapiens
tgtgaacagtatgtcatttcac

SEQ ID NO: 7303114 - DNA, 22 bp, Homo sapiens
tgtgaaattgagaaactttcac

SEQ ID NO: 7303115 - DNA, 22 bp, Homo sapiens
tgtgaaattgagaaactttcac

SEQ ID NO: 7303116 - DNA, 22 bp, Homo sapiens
tgtctttttactatgttcaatc

SEQ ID NO: 7303117 - DNA, 22 bp, Homo sapiens
tgtgaaaagggctttgtacaaa

SEQ ID NO: 7303118 - DNA, 22 bp, Homo sapiens
tgtgaaaagcaggctactttct

SEQ ID NO: 7303119 - DNA, 22 bp, Homo sapiens
tgtcttttagtttgtgagatct

SEQ ID NO: 7303120 - DNA, 22 bp, Homo sapiens
tgtcttttataactgacatata

SEQ ID NO: 7303121 - DNA, 22 bp, Homo sapiens
tgtcttttctactgtaagcata

SEQ ID NO: 7303122 - DNA, 22 bp, Homo sapiens
tgtcttttgccaaagatcagtt

SEQ ID NO: 7303123 - DNA, 23 bp, Homo sapiens
tgtctttgttaggactgtgttta

SEQ ID NO: 7303124 - DNA, 22 bp, Homo sapiens
tgtctttggggctgtacctgtt

SEQ ID NO: 7303125 - DNA, 19 bp, Homo sapiens
tgtctttggtctgagtttc

SEQ ID NO: 7303126 - DNA, 22 bp, Homo sapiens
tgtcttgtctgtgagggcattg

SEQ ID NO: 7303127 - DNA, 22 bp, Homo sapiens
tgtctgtgtgagcaaatgactt

SEQ ID NO: 7303128 - DNA, 22 bp, Homo sapiens
tgtctgtggcaattgtgggtaa

SEQ ID NO: 7303129 - DNA, 22 bp, Homo sapiens
tgtctgtggcaattgtgggtaa

SEQ ID NO: 7303130 - DNA, 22 bp, Homo sapiens
tgtctgtgcccaaggctcccgg

SEQ ID NO: 7303131 - DNA, 20 bp, Homo sapiens
tgtctgtgccacggcactcc

SEQ ID NO: 7303132 - DNA, 22 bp, Homo sapiens
tgtctgttattggtgtataaga

SEQ ID NO: 7303133 - DNA, 22 bp, Homo sapiens
tgtctgtgtgagcaaatgactt

SEQ ID NO: 7303134 - DNA, 22 bp, Homo sapiens
tgtctgtgtccaaatttcctct

SEQ ID NO: 7303135 - DNA, 22 bp, Homo sapiens
tgtctgtgtccaaatttcctct

SEQ ID NO: 7303136 - DNA, 22 bp, Homo sapiens
tgtctgtgggcaacgcctccca

SEQ ID NO: 7303137 - DNA, 22 bp, Homo sapiens
tgtctgggatgttggcagccac

SEQ ID NO: 7303138 - DNA, 22 bp, Homo sapiens
tgtctgtgacagacctttgcta

SEQ ID NO: 7303139 - DNA, 22 bp, Homo sapiens
tgtctggggaactgtgcatcca

SEQ ID NO: 7303140 - DNA, 22 bp, Homo sapiens
tgtctgggatgtaattcctgcc

SEQ ID NO: 7303141 - DNA, 22 bp, Homo sapiens
tgtctgtgacctcttaggcaag

SEQ ID NO: 7303142 - DNA, 22 bp, Homo sapiens
tgtctgtgacagacctttgcta

SEQ ID NO: 7303143 - DNA, 22 bp, Homo sapiens
tgtctgtgacctcttaggcaag

SEQ ID NO: 7303144 - DNA, 22 bp, Homo sapiens
tgtctgtgacctctttggagcc

SEQ ID NO: 7303145 - DNA, 22 bp, Homo sapiens
tgtctgtgacctctttggagcc

SEQ ID NO: 7303146 - DNA, 22 bp, Homo sapiens
tgtctgtgatttaggccagggc

SEQ ID NO: 7303147 - DNA, 22 bp, Homo sapiens
tgtctggcctcaaaagccattt

SEQ ID NO: 7303148 - DNA, 22 bp, Homo sapiens
tgtctgggagggacagggctac

SEQ ID NO: 7303149 - DNA, 22 bp, Homo sapiens
tgtctgggagactgatcacccg

SEQ ID NO: 7303150 - DNA, 22 bp, Homo sapiens
tgtctcctgggccctggccctg

SEQ ID NO: 7303151 - DNA, 22 bp, Homo sapiens
tgtctcctgcaggggtgtgggc

SEQ ID NO: 7303152 - DNA, 22 bp, Homo sapiens
tgtctcctcaactcatgctcga

SEQ ID NO: 7303153 - DNA, 22 bp, Homo sapiens
tgtctccatgtgatagtggcct

SEQ ID NO: 7303154 - DNA, 23 bp, Homo sapiens
tgtctccatctcattacttgggg

SEQ ID NO: 7303155 - DNA, 22 bp, Homo sapiens
tgtctccaggggcaggccagcc

SEQ ID NO: 7303156 - DNA, 22 bp, Homo sapiens
tgtctccaggggcaggccagcc

SEQ ID NO: 7303157 - DNA, 22 bp, Homo sapiens
tgtctagtccaagaattcaatt

SEQ ID NO: 7303158 - DNA, 22 bp, Homo sapiens
tgtctagtggtttataaaatca

SEQ ID NO: 7303159 - DNA, 22 bp, Homo sapiens
tgtctatacctgatacagagtt

SEQ ID NO: 7303160 - DNA, 22 bp, Homo sapiens
tgtctaggttgcggttttatgt

SEQ ID NO: 7303161 - DNA, 22 bp, Homo sapiens
tgtctaggggcaggggtttgaa

SEQ ID NO: 7303162 - DNA, 22 bp, Homo sapiens
tgtctatgtatacatgtgtata

SEQ ID NO: 7303163 - DNA, 22 bp, Homo sapiens
tgtctccacaggtgtcagctca

SEQ ID NO: 7303164 - DNA, 22 bp, Homo sapiens
tgtctaaacttgttttatctca

SEQ ID NO: 7303165 - DNA, 22 bp, Homo sapiens
tgtctaaatgcaatggatttcc

SEQ ID NO: 7303166 - DNA, 22 bp, Homo sapiens
tgtctacagaatgttaatattt

SEQ ID NO: 7303167 - DNA, 22 bp, Homo sapiens
tgtctcttgttaatgattacta

SEQ ID NO: 7303168 - DNA, 22 bp, Homo sapiens
tgtctcttggctctatcactta

SEQ ID NO: 7303169 - DNA, 22 bp, Homo sapiens
tgtctcttttcaagctaccctt

SEQ ID NO: 7303170 - DNA, 22 bp, Homo sapiens
tgtctctttgggttcctcttgg

SEQ ID NO: 7303171 - DNA, 22 bp, Homo sapiens
tgtctctttgggttcctcttgg

SEQ ID NO: 7303172 - DNA, 22 bp, Homo sapiens
tgtctgaaaggctttttctcac

SEQ ID NO: 7303173 - DNA, 22 bp, Homo sapiens
tgtctctgaaatatgtggctcc

SEQ ID NO: 7303174 - DNA, 20 bp, Homo sapiens
tgtctgctgagctgctgccc

SEQ ID NO: 7303175 - DNA, 21 bp, Homo sapiens
tgtctgatgtattttttgcct

SEQ ID NO: 7303176 - DNA, 22 bp, Homo sapiens
tgtctgcaccctgtgattgttt

SEQ ID NO: 7303177 - DNA, 21 bp, Homo sapiens
tgtctgcagacttgcttgttg

SEQ ID NO: 7303178 - DNA, 22 bp, Homo sapiens
tgtctgagcgagaaagtagtgt

SEQ ID NO: 7303179 - DNA, 22 bp, Homo sapiens
tgtctgagcacctgtgctgaac

SEQ ID NO: 7303180 - DNA, 22 bp, Homo sapiens
tgtctgagcgagaaagtagtgt

SEQ ID NO: 7303181 - DNA, 22 bp, Homo sapiens
tgtgggacagggacagtgatat

SEQ ID NO: 7303182 - DNA, 22 bp, Homo sapiens
tgtgtacacaagtatatataca

SEQ ID NO: 7303183 - DNA, 22 bp, Homo sapiens
tgtgtacaagcctgagtacaga

SEQ ID NO: 7303184 - DNA, 22 bp, Homo sapiens
tgtgtacatatacacaaataca

SEQ ID NO: 7303185 - DNA, 23 bp, Homo sapiens
tgtgtacatacatatgtacacac

SEQ ID NO: 7303186 - DNA, 22 bp, Homo sapiens
tgtgtacacgagaggttatata

SEQ ID NO: 7303187 - DNA, 22 bp, Homo sapiens
tgtgtacacacagatatataca

SEQ ID NO: 7303188 - DNA, 22 bp, Homo sapiens
tgtgggcctcagcaggactcca

SEQ ID NO: 7303189 - DNA, 22 bp, Homo sapiens
tgtgggcaggcccgggtctgag

SEQ ID NO: 7303190 - DNA, 20 bp, Homo sapiens
tgtgtgtgtacttctaaata

SEQ ID NO: 7303191 - DNA, 20 bp, Homo sapiens
tgtgtgtgtacttctaaata

SEQ ID NO: 7303192 - DNA, 20 bp, Homo sapiens
tgtgtgtgtacttctaaata

SEQ ID NO: 7303193 - DNA, 23 bp, Homo sapiens
tgtgtgtgtattctacgcaaggt

SEQ ID NO: 7303194 - DNA, 23 bp, Homo sapiens
tgtgtgtgtattctacgcaaggt

SEQ ID NO: 7303195 - DNA, 22 bp, Homo sapiens
tgtgtgtgtcctcatttgcaga

SEQ ID NO: 7303196 - DNA, 22 bp, Homo sapiens
tgtgtgtgtcctcatttgcaga

SEQ ID NO: 7303197 - DNA, 22 bp, Homo sapiens
tgtgtgtgttcctcctcagcta

SEQ ID NO: 7303198 - DNA, 22 bp, Homo sapiens
tgtgtgtgttcctcctcagcta

SEQ ID NO: 7303199 - DNA, 22 bp, Homo sapiens
tgtgtgtgttcctcctcagcta

SEQ ID NO: 7303200 - DNA, 22 bp, Homo sapiens
tgtgtgtgtcctcatttgcaga

SEQ ID NO: 7303201 - DNA, 22 bp, Homo sapiens
tgtgtgtgtgcgcgcacgcata

SEQ ID NO: 7303202 - DNA, 22 bp, Homo sapiens
tgtgtgtgtgcgcgcacgcata

SEQ ID NO: 7303203 - DNA, 22 bp, Homo sapiens
tgtgtgtgtgcgcgcacgcata

SEQ ID NO: 7303204 - DNA, 22 bp, Homo sapiens
tgtgtgtgcaggagagcaggtg

SEQ ID NO: 7303205 - DNA, 22 bp, Homo sapiens
tgtgtgtgcaggagagcaggtg

SEQ ID NO: 7303206 - DNA, 22 bp, Homo sapiens
tgtgtgtgcaggagagcaggtg

SEQ ID NO: 7303207 - DNA, 22 bp, Homo sapiens
tgtgtgtgcacgtgcgcgcgag

SEQ ID NO: 7303208 - DNA, 22 bp, Homo sapiens
tgtgtgtgcacgtgcgcgcgag

SEQ ID NO: 7303209 - DNA, 21 bp, Homo sapiens
tgtgtgtgcaggcacacacac

SEQ ID NO: 7303210 - DNA, 21 bp, Homo sapiens
tgtgtgtgcaggcacacacac

SEQ ID NO: 7303211 - DNA, 21 bp, Homo sapiens
tgtgtgtgcaggcacacacac

SEQ ID NO: 7303212 - DNA, 22 bp, Homo sapiens
tgtgtgtggggaggcagcagat

SEQ ID NO: 7303213 - DNA, 22 bp, Homo sapiens
tgtgtgtggggaggcagcagat

SEQ ID NO: 7303214 - DNA, 22 bp, Homo sapiens
tgtgtgtgggcggaacggcccc

SEQ ID NO: 7303215 - DNA, 22 bp, Homo sapiens
tgtgtgtgggcggaacggcccc

SEQ ID NO: 7303216 - DNA, 22 bp, Homo sapiens
tgtgtgtgggcggaacggcccc

SEQ ID NO: 7303217 - DNA, 22 bp, Homo sapiens
tgtgtgtgtaaaagcatttata

SEQ ID NO: 7303218 - DNA, 22 bp, Homo sapiens
tgtgtgtgtaaaagcatttata

SEQ ID NO: 7303219 - DNA, 22 bp, Homo sapiens
tgtgtgtgtaaaagcatttata

SEQ ID NO: 7303220 - DNA, 22 bp, Homo sapiens
tgtgtgtggggaggcagcagat

SEQ ID NO: 7303221 - DNA, 22 bp, Homo sapiens
tgtgtgtgtttataaatctaaa

SEQ ID NO: 7303222 - DNA, 22 bp, Homo sapiens
tgtgtgtgtttataaatctaaa

SEQ ID NO: 7303223 - DNA, 22 bp, Homo sapiens
tgtgtgtgtttctgctcataca

SEQ ID NO: 7303224 - DNA, 22 bp, Homo sapiens
tgtgtgtgtttctgctcataca

SEQ ID NO: 7303225 - DNA, 22 bp, Homo sapiens
tgtgtgtgtttacagtttctca

SEQ ID NO: 7303226 - DNA, 22 bp, Homo sapiens
tgtgtgtgtttacagtttctca

SEQ ID NO: 7303227 - DNA, 22 bp, Homo sapiens
tgtgtgtgtttataaatctaaa

SEQ ID NO: 7303228 - DNA, 22 bp, Homo sapiens
tgtgtgttattttcagccatta

SEQ ID NO: 7303229 - DNA, 22 bp, Homo sapiens
tgtgtgttcagagatagatata

SEQ ID NO: 7303230 - DNA, 19 bp, Homo sapiens
tgtgtgtttatatatgtat

SEQ ID NO: 7303231 - DNA, 22 bp, Homo sapiens
tgtgtgtgtttctgctcataca

SEQ ID NO: 7303232 - DNA, 19 bp, Homo sapiens
tgtgtgtttatatatgtat

SEQ ID NO: 7303233 - DNA, 22 bp, Homo sapiens
tgtgttaacactgcatgataat

SEQ ID NO: 7303234 - DNA, 22 bp, Homo sapiens
tgtgttaaggtgcatctagtgc

SEQ ID NO: 7303235 - DNA, 22 bp, Homo sapiens
tgtgttaagtatttgatacact

SEQ ID NO: 7303236 - DNA, 22 bp, Homo sapiens
tgttaaacagctgtcttcttca

SEQ ID NO: 7303237 - DNA, 22 bp, Homo sapiens
tgttaaactgtattgcataagg

SEQ ID NO: 7303238 - DNA, 20 bp, Homo sapiens
tgttaaaggacacttgcttt

SEQ ID NO: 7303239 - DNA, 22 bp, Homo sapiens
tgtgtgtgacaacctagttcag

SEQ ID NO: 7303240 - DNA, 22 bp, Homo sapiens
tgtgtgtgacaacctagttcag

SEQ ID NO: 7303241 - DNA, 22 bp, Homo sapiens
tgtgtgtgacaacctagttcag

SEQ ID NO: 7303242 - DNA, 22 bp, Homo sapiens
tgtgtgtgacaacctagttcag

SEQ ID NO: 7303243 - DNA, 22 bp, Homo sapiens
tgtgtgtgactcatactagaac

SEQ ID NO: 7303244 - DNA, 22 bp, Homo sapiens
tgtgtgtgactcatactagaac

SEQ ID NO: 7303245 - DNA, 22 bp, Homo sapiens
tgtgtgtgactcatactagaac

SEQ ID NO: 7303246 - DNA, 22 bp, Homo sapiens
tgtgtgtgaaccattgagggct

SEQ ID NO: 7303247 - DNA, 22 bp, Homo sapiens
tgtgtgtgaaccattgagggct

SEQ ID NO: 7303248 - DNA, 22 bp, Homo sapiens
tgtgtgtctttgcctcctctca

SEQ ID NO: 7303249 - DNA, 22 bp, Homo sapiens
tgtgtgtgagtcctggctttcc

SEQ ID NO: 7303250 - DNA, 22 bp, Homo sapiens
tgtgtgtgagtcctggctttcc

SEQ ID NO: 7303251 - DNA, 22 bp, Homo sapiens
tgtgtgtgagtcctggctttcc

SEQ ID NO: 7303252 - DNA, 22 bp, Homo sapiens
tgtgtgtgcacatgcatataca

SEQ ID NO: 7303253 - DNA, 22 bp, Homo sapiens
tgtgtgtgcacatgcatataca

SEQ ID NO: 7303254 - DNA, 22 bp, Homo sapiens
tgtgtgtgcacatgcatataca

SEQ ID NO: 7303255 - DNA, 22 bp, Homo sapiens
tgtgtgctctaatgcctagtac

SEQ ID NO: 7303256 - DNA, 22 bp, Homo sapiens
tgtgtgctcgatggccctgcag

SEQ ID NO: 7303257 - DNA, 20 bp, Homo sapiens
tgtgtgctaggactacagtg

SEQ ID NO: 7303258 - DNA, 22 bp, Homo sapiens
tgtgtgctctaatgcctagtac

SEQ ID NO: 7303259 - DNA, 19 bp, Homo sapiens
tgtgtgctgactgccagag

SEQ ID NO: 7303260 - DNA, 22 bp, Homo sapiens
tgtgtgggagcacgggctgttg

SEQ ID NO: 7303261 - DNA, 22 bp, Homo sapiens
tgtgtgggagcacgggctgttg

SEQ ID NO: 7303262 - DNA, 22 bp, Homo sapiens
tgtgtggcgttgcgtggctagg

SEQ ID NO: 7303263 - DNA, 22 bp, Homo sapiens
tgtgtggcaagctgtatgctag

SEQ ID NO: 7303264 - DNA, 21 bp, Homo sapiens
tgtgtgggcatatctgctgca

SEQ ID NO: 7303265 - DNA, 21 bp, Homo sapiens
tgtgtgggcatatctgctgca

SEQ ID NO: 7303266 - DNA, 22 bp, Homo sapiens
tgtgtgcattagcattctaggg

SEQ ID NO: 7303267 - DNA, 22 bp, Homo sapiens
tgtgtgcattcacatgcatgcc

SEQ ID NO: 7303268 - DNA, 22 bp, Homo sapiens
tgtgtgcattcacatgcatgcc

SEQ ID NO: 7303269 - DNA, 22 bp, Homo sapiens
tgtgtgcattcacatgcatgcc

SEQ ID NO: 7303270 - DNA, 22 bp, Homo sapiens
tgtgtgccagcctacgaggagc

SEQ ID NO: 7303271 - DNA, 22 bp, Homo sapiens
tgtgtgcattagcattctaggg

SEQ ID NO: 7303272 - DNA, 22 bp, Homo sapiens
tgtgtgccccagatgagtagct

SEQ ID NO: 7303273 - DNA, 19 bp, Homo sapiens
tgtgtgccctcaccacata

SEQ ID NO: 7303274 - DNA, 22 bp, Homo sapiens
tgtgtgctaatgtatgctctaa

SEQ ID NO: 7303275 - DNA, 22 bp, Homo sapiens
tgtgtgcctgagccgtgcctgg

SEQ ID NO: 7303276 - DNA, 22 bp, Homo sapiens
tgtgtatttctggaacagacta

SEQ ID NO: 7303277 - DNA, 22 bp, Homo sapiens
tgtgtattaccattttacagct

SEQ ID NO: 7303278 - DNA, 22 bp, Homo sapiens
tgtgtagctttcttctgtgggg

SEQ ID NO: 7303279 - DNA, 22 bp, Homo sapiens
tgtgtagctcatattagtgtta

SEQ ID NO: 7303280 - DNA, 20 bp, Homo sapiens
tgtgtagcaggtgctgtgcc

SEQ ID NO: 7303281 - DNA, 22 bp, Homo sapiens
tgtgtattctgaggtaggtata

SEQ ID NO: 7303282 - DNA, 22 bp, Homo sapiens
tgtttcaaaacagtgataattt

SEQ ID NO: 7303283 - DNA, 18 bp, Homo sapiens
tgtttatttttctcttac

SEQ ID NO: 7303284 - DNA, 18 bp, Homo sapiens
tgtttatttttctcttac

SEQ ID NO: 7303285 - DNA, 22 bp, Homo sapiens
tgtttgcacattcgtttcaata

SEQ ID NO: 7303286 - DNA, 22 bp, Homo sapiens
tgtttgcattaattagaaggta

SEQ ID NO: 7303287 - DNA, 22 bp, Homo sapiens
tgtttgcttacttgtatgctgc

SEQ ID NO: 7303288 - DNA, 22 bp, Homo sapiens
tgtttgcttggtcagtaagtag

SEQ ID NO: 7303289 - DNA, 20 bp, Homo sapiens
tgtttgtgccagctttgtca

SEQ ID NO: 7303290 - DNA, 22 bp, Homo sapiens
tgtttgtgagatgtgaggtacg

SEQ ID NO: 7303291 - DNA, 22 bp, Homo sapiens
tgtttgtggttataataagtat

SEQ ID NO: 7303292 - DNA, 20 bp, Homo sapiens
tgtttgtgtggggccttggc

SEQ ID NO: 7303293 - DNA, 22 bp, Homo sapiens
tgtttgtgctgcctggtgggca

SEQ ID NO: 7303294 - DNA, 22 bp, Homo sapiens
tgtttgtggaatattctttaag

SEQ ID NO: 7303295 - DNA, 22 bp, Homo sapiens
tgtttgtggaatattctttaag

SEQ ID NO: 7303296 - DNA, 22 bp, Homo sapiens
tgtttgtgctgcctggtgggca

SEQ ID NO: 7303297 - DNA, 20 bp, Homo sapiens
tgtttgtgccagctttgtca

SEQ ID NO: 7303298 - DNA, 22 bp, Homo sapiens
tgtttttgtctccttgtctgct

SEQ ID NO: 7303299 - DNA, 22 bp, Homo sapiens
tgttttatgagccatataacct

SEQ ID NO: 7303300 - DNA, 22 bp, Homo sapiens
tgttttatataagcagagcggt

SEQ ID NO: 7303301 - DNA, 22 bp, Homo sapiens
tgttttaagagcgcactttata

SEQ ID NO: 7303302 - DNA, 22 bp, Homo sapiens
tgttttaagggtcaactgtcac

SEQ ID NO: 7303303 - DNA, 22 bp, Homo sapiens
tgttttaatctcccattgctct

SEQ ID NO: 7303304 - DNA, 22 bp, Homo sapiens
tgtttttgttcaatgctaggtc

SEQ ID NO: 7303305 - DNA, 22 bp, Homo sapiens
ttaaaacagcgtgaatctggca

SEQ ID NO: 7303306 - DNA, 22 bp, Homo sapiens
ttaaaccacaaggcaagttttg

SEQ ID NO: 7303307 - DNA, 22 bp, Homo sapiens
tgtttaaatagaacatactgca

SEQ ID NO: 7303308 - DNA, 22 bp, Homo sapiens
tgtttaaatagaacatactgca

SEQ ID NO: 7303309 - DNA, 22 bp, Homo sapiens
tgtttaaatagaacatactgca

SEQ ID NO: 7303310 - DNA, 22 bp, Homo sapiens
tgttgtactcaacagatgaatt

SEQ ID NO: 7303311 - DNA, 22 bp, Homo sapiens
tgttgagacacagacacaagcc

SEQ ID NO: 7303312 - DNA, 22 bp, Homo sapiens
tgtttattgcagtgctgggctg

SEQ ID NO: 7303313 - DNA, 22 bp, Homo sapiens
tgtttattacagttcttggaat

SEQ ID NO: 7303314 - DNA, 22 bp, Homo sapiens
tgtttatagggtctgtcacttg

SEQ ID NO: 7303315 - DNA, 22 bp, Homo sapiens
tgttactgatttgatatacagt

SEQ ID NO: 7303316 - DNA, 22 bp, Homo sapiens
tgttactctggggttgtggtga

SEQ ID NO: 7303317 - DNA, 22 bp, Homo sapiens
tgttagaaattattagtaatat

SEQ ID NO: 7303318 - DNA, 22 bp, Homo sapiens
tgttaagagagtttctaatatt

SEQ ID NO: 7303319 - DNA, 22 bp, Homo sapiens
tgttacatttctctttcttgga

SEQ ID NO: 7303320 - DNA, 22 bp, Homo sapiens
tgttacatttctctttcttgga

SEQ ID NO: 7303321 - DNA, 22 bp, Homo sapiens
tgttaccaaaatcttgtatatc

SEQ ID NO: 7303322 - DNA, 22 bp, Homo sapiens
tgttaccaggcagtattgctta

SEQ ID NO: 7303323 - DNA, 22 bp, Homo sapiens
tgttaccaggcagtattgctta

SEQ ID NO: 7303324 - DNA, 22 bp, Homo sapiens
tgttacatcgttggctaggaga

SEQ ID NO: 7303325 - DNA, 22 bp, Homo sapiens
tgttacattggagttgtttaga

SEQ ID NO: 7303326 - DNA, 22 bp, Homo sapiens
tgttaaatgagattggaatttg

SEQ ID NO: 7303327 - DNA, 22 bp, Homo sapiens
tgttaaatgtattatgtgttct

SEQ ID NO: 7303328 - DNA, 22 bp, Homo sapiens
tgttaaatgttcctttactgga

SEQ ID NO: 7303329 - DNA, 22 bp, Homo sapiens
tgttaaatgttcctttactgga

SEQ ID NO: 7303330 - DNA, 22 bp, Homo sapiens
tgttaaatgtattatgtgttct

SEQ ID NO: 7303331 - DNA, 22 bp, Homo sapiens
tgttaacatactgctttctaat

SEQ ID NO: 7303332 - DNA, 22 bp, Homo sapiens
tgttaacatactgctttctaat

SEQ ID NO: 7303333 - DNA, 22 bp, Homo sapiens
tgttaacagaggtcattttggg

SEQ ID NO: 7303334 - DNA, 22 bp, Homo sapiens
tgttaacagccagatttggtga

SEQ ID NO: 7303335 - DNA, 22 bp, Homo sapiens
tgttagaatattgtaatattcg

SEQ ID NO: 7303336 - DNA, 22 bp, Homo sapiens
tgttagatattcattaatagga

SEQ ID NO: 7303337 - DNA, 22 bp, Homo sapiens
tgttagattcctgatgaattta

SEQ ID NO: 7303338 - DNA, 22 bp, Homo sapiens
tgttaggactccccagaagctg

SEQ ID NO: 7303339 - DNA, 22 bp, Homo sapiens
agcaggtgacagggctgtggtg

SEQ ID NO: 7303340 - DNA, 22 bp, Homo sapiens
agcatccagcatcctatagaaa

SEQ ID NO: 7303341 - DNA, 22 bp, Homo sapiens
agcatcccatgactctggagga

SEQ ID NO: 7303342 - DNA, 22 bp, Homo sapiens
agcagcccaaacagactaagac

SEQ ID NO: 7303343 - DNA, 22 bp, Homo sapiens
agcagctctgtttacctggagg

SEQ ID NO: 7303344 - DNA, 22 bp, Homo sapiens
agcaggagtgtcccctggctgt

SEQ ID NO: 7303345 - DNA, 22 bp, Homo sapiens
agcaggaggagagcctggcggt

SEQ ID NO: 7303346 - DNA, 22 bp, Homo sapiens
agcaggaacgagttcatgggga

SEQ ID NO: 7303347 - DNA, 22 bp, Homo sapiens
agcaggagctgtgggaagatgg

SEQ ID NO: 7303348 - DNA, 22 bp, Homo sapiens
agcagctgagccccagctgtga

SEQ ID NO: 7303349 - DNA, 22 bp, Homo sapiens
agcagcagattcagcaggaatg

SEQ ID NO: 7303350 - DNA, 19 bp, Homo sapiens
agcagcagcaccagggatt

SEQ ID NO: 7303351 - DNA, 22 bp, Homo sapiens
agcagcagctcattcttcctgt

SEQ ID NO: 7303352 - DNA, 22 bp, Homo sapiens
acacagaacctcatagcctctc

SEQ ID NO: 7303353 - DNA, 22 bp, Homo sapiens
agcacttatgtgattaggacag

SEQ ID NO: 7303354 - DNA, 22 bp, Homo sapiens
acacacgtatatatacgtatgt

SEQ ID NO: 7303355 - DNA, 22 bp, Homo sapiens
agcactttcctggcaaatgtgg

SEQ ID NO: 7303356 - DNA, 22 bp, Homo sapiens
agcagaaaattggaaatgacaa

SEQ ID NO: 7303357 - DNA, 22 bp, Homo sapiens
agcagaaaattggaaatgacaa

SEQ ID NO: 7303358 - DNA, 22 bp, Homo sapiens
agcagaaatagaagtcaatgat

SEQ ID NO: 7303359 - DNA, 22 bp, Homo sapiens
agatttgaaacttgcttcataa

SEQ ID NO: 7303360 - DNA, 22 bp, Homo sapiens
agatttgataaaagtagcagtt

SEQ ID NO: 7303361 - DNA, 22 bp, Homo sapiens
agatttgtatgtctaaatgtaa

SEQ ID NO: 7303362 - DNA, 22 bp, Homo sapiens
agatttctgtcaccttctatgc

SEQ ID NO: 7303363 - DNA, 22 bp, Homo sapiens
agatttctgtcaccttctatgc

SEQ ID NO: 7303364 - DNA, 22 bp, Homo sapiens
agatttctctttccctggctga

SEQ ID NO: 7303365 - DNA, 22 bp, Homo sapiens
acacacatggtattgttcagaa

SEQ ID NO: 7303366 - DNA, 22 bp, Homo sapiens
acacacatggtattgttcagaa

SEQ ID NO: 7303367 - DNA, 22 bp, Homo sapiens
acacacatgcctttcctaagta

SEQ ID NO: 7303368 - DNA, 22 bp, Homo sapiens
agattttatagataatttccca

SEQ ID NO: 7303369 - DNA, 18 bp, Homo sapiens
agattttgagaaatacaa

SEQ ID NO: 7303370 - DNA, 22 bp, Homo sapiens
agatttgtcagctcagtcttta

SEQ ID NO: 7303371 - DNA, 22 bp, Homo sapiens
agatttgtcctgctttctacct

SEQ ID NO: 7303372 - DNA, 22 bp, Homo sapiens
agcctgtgactctgtgaaacca

SEQ ID NO: 7303373 - DNA, 22 bp, Homo sapiens
agcctgtgacattgactatgaa

SEQ ID NO: 7303374 - DNA, 22 bp, Homo sapiens
agcctgtgagggatgctgcagt

SEQ ID NO: 7303375 - DNA, 22 bp, Homo sapiens
agcctgtgaaatctctgccact

SEQ ID NO: 7303376 - DNA, 22 bp, Homo sapiens
agcctgtgtgaagccctcagag

SEQ ID NO: 7303377 - DNA, 22 bp, Homo sapiens
agcctgtgtgctttggacaggg

SEQ ID NO: 7303378 - DNA, 22 bp, Homo sapiens
agcctgtgtcctcatctgcagc

SEQ ID NO: 7303379 - DNA, 20 bp, Homo sapiens
agcctgtgtacttgcctgtg

SEQ ID NO: 7303380 - DNA, 22 bp, Homo sapiens
agcctgtggatccctgcactgg

SEQ ID NO: 7303381 - DNA, 22 bp, Homo sapiens
agcctgtggaaactgggtgcag

SEQ ID NO: 7303382 - DNA, 22 bp, Homo sapiens
agcctgtgggagccgctcccgt

SEQ ID NO: 7303383 - DNA, 22 bp, Homo sapiens
agctcaggtagactcagcatct

SEQ ID NO: 7303384 - DNA, 22 bp, Homo sapiens
agccctgggtcccagtcctggc

SEQ ID NO: 7303385 - DNA, 21 bp, Homo sapiens
agcctggcccagggggaggct

SEQ ID NO: 7303386 - DNA, 22 bp, Homo sapiens
acagacatctatccatttaatt

SEQ ID NO: 7303387 - DNA, 22 bp, Homo sapiens
acagacatcatcaacatcttcc

SEQ ID NO: 7303388 - DNA, 22 bp, Homo sapiens
acagacatcatcaacatcttcc

SEQ ID NO: 7303389 - DNA, 21 bp, Homo sapiens
acagacagtccagagaaaaga

SEQ ID NO: 7303390 - DNA, 22 bp, Homo sapiens
acagacagtaaatagtgtggct

SEQ ID NO: 7303391 - DNA, 22 bp, Homo sapiens
acagacagtatggtggggctga

SEQ ID NO: 7303392 - DNA, 22 bp, Homo sapiens
acagacagtaaatagtgtggct

SEQ ID NO: 7303393 - DNA, 22 bp, Homo sapiens
acagaacaggctgagaaaaaca

SEQ ID NO: 7303394 - DNA, 22 bp, Homo sapiens
acagaacatattgcttctctca

SEQ ID NO: 7303395 - DNA, 22 bp, Homo sapiens
acagaacatggatttttgaagt

SEQ ID NO: 7303396 - DNA, 22 bp, Homo sapiens
acagaacatattgcttctctca

SEQ ID NO: 7303397 - DNA, 22 bp, Homo sapiens
agcccaggtccagttcactgca

SEQ ID NO: 7303398 - DNA, 22 bp, Homo sapiens
acagaacagagggttttagaat

SEQ ID NO: 7303399 - DNA, 22 bp, Homo sapiens
agccaggaatgcatgctctgct

SEQ ID NO: 7303400 - DNA, 22 bp, Homo sapiens
agcattggtggccagagtgcct

SEQ ID NO: 7303401 - DNA, 22 bp, Homo sapiens
agcatctgcttaatggcttaac

SEQ ID NO: 7303402 - DNA, 19 bp, Homo sapiens
agcatctccctgatcattc

SEQ ID NO: 7303403 - DNA, 22 bp, Homo sapiens
agatataataatttacaagtgt

SEQ ID NO: 7303404 - DNA, 22 bp, Homo sapiens
agagtacactgtacacacaatt

SEQ ID NO: 7303405 - DNA, 22 bp, Homo sapiens
agagtctggtgcatgataagca

SEQ ID NO: 7303406 - DNA, 22 bp, Homo sapiens
aattttgttttagtggaggctg

SEQ ID NO: 7303407 - DNA, 22 bp, Homo sapiens
aattttgtttaagtgatctgct

SEQ ID NO: 7303408 - DNA, 22 bp, Homo sapiens
agatatacacccatatcacata

SEQ ID NO: 7303409 - DNA, 22 bp, Homo sapiens
agatatatttaaggtaataagt

SEQ ID NO: 7303410 - DNA, 22 bp, Homo sapiens
agatatatttcctgcccaaggc

SEQ ID NO: 7303411 - DNA, 22 bp, Homo sapiens
agatatcaccagttttacatac

SEQ ID NO: 7303412 - DNA, 22 bp, Homo sapiens
agatatgtttgtatatatttgt

SEQ ID NO: 7303413 - DNA, 22 bp, Homo sapiens
agatctcacctctgtgtattat

SEQ ID NO: 7303414 - DNA, 22 bp, Homo sapiens
agatgttttgtgtatttcatca

SEQ ID NO: 7303415 - DNA, 20 bp, Homo sapiens
agatgttttgaagtcttgga

SEQ ID NO: 7303416 - DNA, 22 bp, Homo sapiens
agatgttttagagtttgacttg

SEQ ID NO: 7303417 - DNA, 22 bp, Homo sapiens
agatgttttggagacactaacc

SEQ ID NO: 7303418 - DNA, 22 bp, Homo sapiens
agatgttttgtgtatttcatca

SEQ ID NO: 7303419 - DNA, 22 bp, Homo sapiens
agattatctcctgattttaagg

SEQ ID NO: 7303420 - DNA, 19 bp, Homo sapiens
agattattgcacattcatg

SEQ ID NO: 7303421 - DNA, 21 bp, Homo sapiens
agattacaggtgtgatccacc

SEQ ID NO: 7303422 - DNA, 22 bp, Homo sapiens
agagcagctcgctacctctcta

SEQ ID NO: 7303423 - DNA, 22 bp, Homo sapiens
agagcagctgcattcagcacct

SEQ ID NO: 7303424 - DNA, 22 bp, Homo sapiens
aattcagttgacagctaatgcc

SEQ ID NO: 7303425 - DNA, 22 bp, Homo sapiens
aattcacaggatcacaggagag

SEQ ID NO: 7303426 - DNA, 22 bp, Homo sapiens
aattcacatatacattattcct

SEQ ID NO: 7303427 - DNA, 22 bp, Homo sapiens
aattcacatgcatgtctgtgca

SEQ ID NO: 7303428 - DNA, 22 bp, Homo sapiens
agagcaggtggcaactctggga

SEQ ID NO: 7303429 - DNA, 22 bp, Homo sapiens
agagcaggcataaagctttgaa

SEQ ID NO: 7303430 - DNA, 22 bp, Homo sapiens
aatttcaatgcactcatggttg

SEQ ID NO: 7303431 - DNA, 22 bp, Homo sapiens
aatttcaagtggcatctttgat

SEQ ID NO: 7303432 - DNA, 22 bp, Homo sapiens
aatttatttcctgccagtacac

SEQ ID NO: 7303433 - DNA, 22 bp, Homo sapiens
aatttatgacaaacaggtaggt

SEQ ID NO: 7303434 - DNA, 22 bp, Homo sapiens
agagggctgctgcacagtgctc

SEQ ID NO: 7303435 - DNA, 22 bp, Homo sapiens
agagggctggacgcaggttgga

SEQ ID NO: 7303436 - DNA, 22 bp, Homo sapiens
aattttgtgtgggatcaaagga

SEQ ID NO: 7303437 - DNA, 22 bp, Homo sapiens
aattttgttcttggaaatcagg

SEQ ID NO: 7303438 - DNA, 22 bp, Homo sapiens
agagaaatagattggtccagaa

SEQ ID NO: 7303439 - DNA, 22 bp, Homo sapiens
agagagaggggcgagcaaacac

SEQ ID NO: 7303440 - DNA, 20 bp, Homo sapiens
agagagaggtaaattgagca

SEQ ID NO: 7303441 - DNA, 22 bp, Homo sapiens
agagatcagttaaaatcttttt

SEQ ID NO: 7303442 - DNA, 22 bp, Homo sapiens
agagatatggatgtcagaaact

SEQ ID NO: 7303443 - DNA, 22 bp, Homo sapiens
agacactggtgaagaaatcagg

SEQ ID NO: 7303444 - DNA, 19 bp, Homo sapiens
agactctgtgtgagacttt

SEQ ID NO: 7303445 - DNA, 22 bp, Homo sapiens
agactctggagtcagctaggat

SEQ ID NO: 7303446 - DNA, 22 bp, Homo sapiens
agactctgctaagaatataatt

SEQ ID NO: 7303447 - DNA, 22 bp, Homo sapiens
aatgtataaccataggaaattt

SEQ ID NO: 7303448 - DNA, 22 bp, Homo sapiens
aatgtataaccataggaaattt

SEQ ID NO: 7303449 - DNA, 17 bp, Homo sapiens
agacactgagccaagta

SEQ ID NO: 7303450 - DNA, 22 bp, Homo sapiens
agactgagactggggaaagaca

SEQ ID NO: 7303451 - DNA, 22 bp, Homo sapiens
agactgaataacaagcaaataa

SEQ ID NO: 7303452 - DNA, 22 bp, Homo sapiens
agaattgttggggtaataaaag

SEQ ID NO: 7303453 - DNA, 22 bp, Homo sapiens
agaattgttggggtaataaaag

SEQ ID NO: 7303454 - DNA, 19 bp, Homo sapiens
agaattgttttatgtcttc

SEQ ID NO: 7303455 - DNA, 22 bp, Homo sapiens
agaatttaggatgcatgtgaat

SEQ ID NO: 7303456 - DNA, 22 bp, Homo sapiens
agaatttaggatgcatgtgaat

SEQ ID NO: 7303457 - DNA, 22 bp, Homo sapiens
agaatttcaaatggaagtttta

SEQ ID NO: 7303458 - DNA, 22 bp, Homo sapiens
agaatctgaaggcacctctggt

SEQ ID NO: 7303459 - DNA, 22 bp, Homo sapiens
agaatctgcatttctaataagc

SEQ ID NO: 7303460 - DNA, 22 bp, Homo sapiens
agaatctgcattttaacaagat

SEQ ID NO: 7303461 - DNA, 22 bp, Homo sapiens
agaatctgcattttaacaagcc

SEQ ID NO: 7303462 - DNA, 22 bp, Homo sapiens
agaatctgcattttaacaagct

SEQ ID NO: 7303463 - DNA, 22 bp, Homo sapiens
agaatctgcatttttaataaca

SEQ ID NO: 7303464 - DNA, 22 bp, Homo sapiens
agaatctgctttttaacaagat

SEQ ID NO: 7303465 - DNA, 22 bp, Homo sapiens
agaatctggtagaaccaaggat

SEQ ID NO: 7303466 - DNA, 22 bp, Homo sapiens
aatgtacagctgtctttcctcc

SEQ ID NO: 7303467 - DNA, 22 bp, Homo sapiens
aatgtacaggctggctatgggg

SEQ ID NO: 7303468 - DNA, 22 bp, Homo sapiens
aatgtacatctcagtgtagtac

SEQ ID NO: 7303469 - DNA, 22 bp, Homo sapiens
aatgtacactgaaagcctatca

SEQ ID NO: 7303470 - DNA, 23 bp, Homo sapiens
agacaaaagcctcagtcttaggc

SEQ ID NO: 7303471 - DNA, 22 bp, Homo sapiens
aatgaaaattggaccctagaac

SEQ ID NO: 7303472 - DNA, 22 bp, Homo sapiens
aatgctttgagggaagatgaaa

SEQ ID NO: 7303473 - DNA, 22 bp, Homo sapiens
agaataaatgctacctatcaca

SEQ ID NO: 7303474 - DNA, 22 bp, Homo sapiens
agaataaaatagtctgaagatg

SEQ ID NO: 7303475 - DNA, 22 bp, Homo sapiens
agaataaaatagtctgaagatg

SEQ ID NO: 7303476 - DNA, 22 bp, Homo sapiens
agaataaatgttggacttagga

SEQ ID NO: 7303477 - DNA, 22 bp, Homo sapiens
acaggcttttacggatatcttt

SEQ ID NO: 7303478 - DNA, 22 bp, Homo sapiens
acaggtgacttgcattttcaca

SEQ ID NO: 7303479 - DNA, 22 bp, Homo sapiens
acaggtcagataaaggctggtg

SEQ ID NO: 7303480 - DNA, 22 bp, Homo sapiens
acaggctgacttcctgccatgt

SEQ ID NO: 7303481 - DNA, 22 bp, Homo sapiens
acaggctgagcgtccatcttca

SEQ ID NO: 7303482 - DNA, 22 bp, Homo sapiens
acagtgtatgatatttcacagt

SEQ ID NO: 7303483 - DNA, 22 bp, Homo sapiens
acagtttacagggatttgagct

SEQ ID NO: 7303484 - DNA, 20 bp, Homo sapiens
acagtgtaatattcacattc

SEQ ID NO: 7303485 - DNA, 22 bp, Homo sapiens
acagtgtactaggtacatgttc

SEQ ID NO: 7303486 - DNA, 22 bp, Homo sapiens
acagtgtactaggtacatgttc

SEQ ID NO: 7303487 - DNA, 22 bp, Homo sapiens
acagtgtatgatatttcacagt

SEQ ID NO: 7303488 - DNA, 20 bp, Homo sapiens
acaggagatctgaggaaagg

SEQ ID NO: 7303489 - DNA, 22 bp, Homo sapiens
acagatttgatctgagaacaaa

SEQ ID NO: 7303490 - DNA, 22 bp, Homo sapiens
acagatttattgaagctgctgc

SEQ ID NO: 7303491 - DNA, 22 bp, Homo sapiens
acagatgagattcattgaccac

SEQ ID NO: 7303492 - DNA, 22 bp, Homo sapiens
acagatgaggaatttatttggt

SEQ ID NO: 7303493 - DNA, 22 bp, Homo sapiens
acagctttttactaatagattg

SEQ ID NO: 7303494 - DNA, 22 bp, Homo sapiens
acaggaaattggcatatcagtt

SEQ ID NO: 7303495 - DNA, 22 bp, Homo sapiens
acaggaaatgaaatggtatcta

SEQ ID NO: 7303496 - DNA, 22 bp, Homo sapiens
acaggaaattggcatatcagtt

SEQ ID NO: 7303497 - DNA, 22 bp, Homo sapiens
acattcttcagctttgtcaggc

SEQ ID NO: 7303498 - DNA, 22 bp, Homo sapiens
accagcagagttgaggaggaca

SEQ ID NO: 7303499 - DNA, 22 bp, Homo sapiens
aaggtttattaaatgttgcatg

SEQ ID NO: 7303500 - DNA, 21 bp, Homo sapiens
accaggccaggaggctggcac

SEQ ID NO: 7303501 - DNA, 22 bp, Homo sapiens
accaggccaacagctaagttaa

SEQ ID NO: 7303502 - DNA, 22 bp, Homo sapiens
accaggccaaaatcatatttac

SEQ ID NO: 7303503 - DNA, 22 bp, Homo sapiens
acatactttttaaaagattgct

SEQ ID NO: 7303504 - DNA, 22 bp, Homo sapiens
acatagaaatttatttcttaca

SEQ ID NO: 7303505 - DNA, 22 bp, Homo sapiens
acatacttgaagcaagtgatca

SEQ ID NO: 7303506 - DNA, 22 bp, Homo sapiens
acatacttatgtgtatatgtgt

SEQ ID NO: 7303507 - DNA, 22 bp, Homo sapiens
acatgggagagaaataaatgta

SEQ ID NO: 7303508 - DNA, 22 bp, Homo sapiens
acatgggttattgtgaggttaa

SEQ ID NO: 7303509 - DNA, 22 bp, Homo sapiens
acatacattgcctcattggtaa

SEQ ID NO: 7303510 - DNA, 22 bp, Homo sapiens
acatacattgcctcattggtaa

SEQ ID NO: 7303511 - DNA, 22 bp, Homo sapiens
acatacttaacattaaagtcat

SEQ ID NO: 7303512 - DNA, 22 bp, Homo sapiens
acatactatgaatacatgtgtc

SEQ ID NO: 7303513 - DNA, 22 bp, Homo sapiens
acatactatgaatacatgtgtc

SEQ ID NO: 7303514 - DNA, 22 bp, Homo sapiens
acatacaaatagagctgtagta

SEQ ID NO: 7303515 - DNA, 18 bp, Homo sapiens
acatacattctgtctgca

SEQ ID NO: 7303516 - DNA, 22 bp, Homo sapiens
acataacatagttgacattttt

SEQ ID NO: 7303517 - DNA, 22 bp, Homo sapiens
acataatacctaggacagtttg

SEQ ID NO: 7303518 - DNA, 22 bp, Homo sapiens
acataataaaaataacagctca

SEQ ID NO: 7303519 - DNA, 22 bp, Homo sapiens
acattacataagattgtaacct

SEQ ID NO: 7303520 - DNA, 22 bp, Homo sapiens
acatgtgttaaaattctcacca

SEQ ID NO: 7303521 - DNA, 22 bp, Homo sapiens
acatgtaaaagataaattaaca

SEQ ID NO: 7303522 - DNA, 22 bp, Homo sapiens
acattagatgtgtggccacagt

SEQ ID NO: 7303523 - DNA, 22 bp, Homo sapiens
aataactggcacatatcacata

SEQ ID NO: 7303524 - DNA, 22 bp, Homo sapiens
actgtctgcacccgaggaggcc

SEQ ID NO: 7303525 - DNA, 22 bp, Homo sapiens
actgtctgctggcccctggtta

SEQ ID NO: 7303526 - DNA, 19 bp, Homo sapiens
actgtgctcgggaaccact

SEQ ID NO: 7303527 - DNA, 22 bp, Homo sapiens
aatactgctgcctgcaaattat

SEQ ID NO: 7303528 - DNA, 22 bp, Homo sapiens
aatactgctgcctgcaaattat

SEQ ID NO: 7303529 - DNA, 22 bp, Homo sapiens
aatactgctgctgctgaaatca

SEQ ID NO: 7303530 - DNA, 22 bp, Homo sapiens
aatactggactctcactattta

SEQ ID NO: 7303531 - DNA, 22 bp, Homo sapiens
aatactggctgtcaaagatgga

SEQ ID NO: 7303532 - DNA, 22 bp, Homo sapiens
aatactgtatgagctatggtag

SEQ ID NO: 7303533 - DNA, 22 bp, Homo sapiens
aatactgtctttcacagatatt

SEQ ID NO: 7303534 - DNA, 22 bp, Homo sapiens
aatacttgtgaattcaaagtct

SEQ ID NO: 7303535 - DNA, 22 bp, Homo sapiens
aatacttgtcagatgaataaga

SEQ ID NO: 7303536 - DNA, 22 bp, Homo sapiens
aatacttgtcagatgaataaga

SEQ ID NO: 7303537 - DNA, 22 bp, Homo sapiens
aatacttgaatttcatgtcagg

SEQ ID NO: 7303538 - DNA, 22 bp, Homo sapiens
aatacttgaatttcatgtcagg

SEQ ID NO: 7303539 - DNA, 22 bp, Homo sapiens
aatacttttgaactgaaaggca

SEQ ID NO: 7303540 - DNA, 22 bp, Homo sapiens
aatactttcctatataaggtgc

SEQ ID NO: 7303541 - DNA, 22 bp, Homo sapiens
aatactttgccaagttcgaaga

SEQ ID NO: 7303542 - DNA, 22 bp, Homo sapiens
acttatttattcattcagctca

SEQ ID NO: 7303543 - DNA, 22 bp, Homo sapiens
acttatttcatggatcataatg

SEQ ID NO: 7303544 - DNA, 22 bp, Homo sapiens
acttatttcatggatcataatg

SEQ ID NO: 7303545 - DNA, 22 bp, Homo sapiens
aatatgaattattgttacaagt

SEQ ID NO: 7303546 - DNA, 22 bp, Homo sapiens
aatatgacatagaattgagatg

SEQ ID NO: 7303547 - DNA, 22 bp, Homo sapiens
aatatcagctctgtcacttact

SEQ ID NO: 7303548 - DNA, 19 bp, Homo sapiens
acttcctgcccgctccttt

SEQ ID NO: 7303549 - DNA, 22 bp, Homo sapiens
acttcctgcagcttctcagccc

SEQ ID NO: 7303550 - DNA, 22 bp, Homo sapiens
acttcctgcaatcgtccactcc

SEQ ID NO: 7303551 - DNA, 22 bp, Homo sapiens
aatatggcttgttactatgttt

SEQ ID NO: 7303552 - DNA, 18 bp, Homo sapiens
aatatgtctagttacagc

SEQ ID NO: 7303553 - DNA, 22 bp, Homo sapiens
aatatgtctctggctagacatt

SEQ ID NO: 7303554 - DNA, 22 bp, Homo sapiens
aatatgtctctgtggttaagta

SEQ ID NO: 7303555 - DNA, 22 bp, Homo sapiens
aatatgatccttaaccttcatg

SEQ ID NO: 7303556 - DNA, 22 bp, Homo sapiens
aatattatcaaaagctttttca

SEQ ID NO: 7303557 - DNA, 22 bp, Homo sapiens
aatattaatagaaggggttcta

SEQ ID NO: 7303558 - DNA, 22 bp, Homo sapiens
aatatgttcaaaatagatcact

SEQ ID NO: 7303559 - DNA, 22 bp, Homo sapiens
aatatgtgggtgctaatcaaaa

SEQ ID NO: 7303560 - DNA, 22 bp, Homo sapiens
agaaaatattcattgagaggct

SEQ ID NO: 7303561 - DNA, 22 bp, Homo sapiens
agaaaattactccagagacaag

SEQ ID NO: 7303562 - DNA, 22 bp, Homo sapiens
agaaaattactccagagacaag

SEQ ID NO: 7303563 - DNA, 22 bp, Homo sapiens
aatctattccctttctgtaaaa

SEQ ID NO: 7303564 - DNA, 22 bp, Homo sapiens
agaaactgaacacaagagtcgg

SEQ ID NO: 7303565 - DNA, 22 bp, Homo sapiens
agaaactcatcctggagatgac

SEQ ID NO: 7303566 - DNA, 22 bp, Homo sapiens
aatctttgtaacagtgaggttt

SEQ ID NO: 7303567 - DNA, 22 bp, Homo sapiens
aatcttagagtgtttttgaagc

SEQ ID NO: 7303568 - DNA, 22 bp, Homo sapiens
aatcttcactcattcagagttg

SEQ ID NO: 7303569 - DNA, 22 bp, Homo sapiens
actcatatactgttgtttttaa

SEQ ID NO: 7303570 - DNA, 22 bp, Homo sapiens
actcatcagtggttttaatcaa

SEQ ID NO: 7303571 - DNA, 22 bp, Homo sapiens
actcagagcagagcagcctgag

SEQ ID NO: 7303572 - DNA, 22 bp, Homo sapiens
actcatgtaagcggaatgtagt

SEQ ID NO: 7303573 - DNA, 22 bp, Homo sapiens
aagttttaacaagtacttacta

SEQ ID NO: 7303574 - DNA, 22 bp, Homo sapiens
aagtttgttttagtctaatgat

SEQ ID NO: 7303575 - DNA, 22 bp, Homo sapiens
aagtttgtggttatacttgatt

SEQ ID NO: 7303576 - DNA, 22 bp, Homo sapiens
aataaagtagcgtttaaggtgc

SEQ ID NO: 7303577 - DNA, 22 bp, Homo sapiens
aataaagtgtattctttgtcat

SEQ ID NO: 7303578 - DNA, 22 bp, Homo sapiens
aataaagtagcgtttaaggtgc

SEQ ID NO: 7303579 - DNA, 22 bp, Homo sapiens
aataaagtagcgtttaaggtgc

SEQ ID NO: 7303580 - DNA, 22 bp, Homo sapiens
aataacagagtcttcaagatag

SEQ ID NO: 7303581 - DNA, 22 bp, Homo sapiens
aataaatgaacaaagcaggttg

SEQ ID NO: 7303582 - DNA, 22 bp, Homo sapiens
aagttttattggctatagcact

SEQ ID NO: 7303583 - DNA, 22 bp, Homo sapiens
aagttttattggctatagcact

SEQ ID NO: 7303584 - DNA, 22 bp, Homo sapiens
aagttttattggctatagcact

SEQ ID NO: 7303585 - DNA, 22 bp, Homo sapiens
actgactagacttacaacagag

SEQ ID NO: 7303586 - DNA, 22 bp, Homo sapiens
actgagaagattctcactctta

SEQ ID NO: 7303587 - DNA, 22 bp, Homo sapiens
aagtgattctagtcatgattct

SEQ ID NO: 7303588 - DNA, 22 bp, Homo sapiens
aagtgatgctacgactttgaca

SEQ ID NO: 7303589 - DNA, 22 bp, Homo sapiens
aagtgattttcctacttgctaa

SEQ ID NO: 7303590 - DNA, 22 bp, Homo sapiens
aagtgattttcttcttagttat

SEQ ID NO: 7303591 - DNA, 22 bp, Homo sapiens
aagtgcaaatttaagaaggcat

SEQ ID NO: 7303592 - DNA, 22 bp, Homo sapiens
aagtgaaattgccattcttata

SEQ ID NO: 7303593 - DNA, 22 bp, Homo sapiens
aagtgaagaaatacatgagaat

SEQ ID NO: 7303594 - DNA, 22 bp, Homo sapiens
aagtgaaattgccattcttata

SEQ ID NO: 7303595 - DNA, 22 bp, Homo sapiens
acctttatatatcaacttctcc

SEQ ID NO: 7303596 - DNA, 22 bp, Homo sapiens
aagtgacataaaatctcccagg

SEQ ID NO: 7303597 - DNA, 22 bp, Homo sapiens
acctggcttccaatctaggagc

SEQ ID NO: 7303598 - DNA, 21 bp, Homo sapiens
aagtaaatcagagaaataacc

SEQ ID NO: 7303599 - DNA, 22 bp, Homo sapiens
aagtaaatatctgtttatagca

SEQ ID NO: 7303600 - DNA, 22 bp, Homo sapiens
acctggctttggggataggctt

SEQ ID NO: 7303601 - DNA, 22 bp, Homo sapiens
aacattagatttgtttttctag

SEQ ID NO: 7303602 - DNA, 21 bp, Homo sapiens
aacattagtaatttgactttt

SEQ ID NO: 7303603 - DNA, 22 bp, Homo sapiens
aacatttcattggaagctatgt

SEQ ID NO: 7303604 - DNA, 22 bp, Homo sapiens
aacatttctgagaatatcagtt

SEQ ID NO: 7303605 - DNA, 21 bp, Homo sapiens
aacatttctgggagaactcac

SEQ ID NO: 7303606 - DNA, 22 bp, Homo sapiens
aacagtactggacaaggagtca

SEQ ID NO: 7303607 - DNA, 22 bp, Homo sapiens
aacagtaatggcattgccatga

SEQ ID NO: 7303608 - DNA, 22 bp, Homo sapiens
aacaggaatgaggagaaaaggt

SEQ ID NO: 7303609 - DNA, 22 bp, Homo sapiens
aacaggaaacaagttgttagga

SEQ ID NO: 7303610 - DNA, 22 bp, Homo sapiens
aacaggaaatacttatgaggta

SEQ ID NO: 7303611 - DNA, 22 bp, Homo sapiens
aacagtcttggaagtcttgtta

SEQ ID NO: 7303612 - DNA, 22 bp, Homo sapiens
aacatttgcagaggaaagctat

SEQ ID NO: 7303613 - DNA, 22 bp, Homo sapiens
aacatttgagaaaaatactctt

SEQ ID NO: 7303614 - DNA, 22 bp, Homo sapiens
aacatttcttctgaaactgagt

SEQ ID NO: 7303615 - DNA, 22 bp, Homo sapiens
aacatttgtactaaagaagttc

SEQ ID NO: 7303616 - DNA, 20 bp, Homo sapiens
aactatgaatagaagagatt

SEQ ID NO: 7303617 - DNA, 22 bp, Homo sapiens
aactatttttggagctaactct

SEQ ID NO: 7303618 - DNA, 22 bp, Homo sapiens
aactcaaagatgcatgacgctt

SEQ ID NO: 7303619 - DNA, 22 bp, Homo sapiens
aactcactttgtggcttctgaa

SEQ ID NO: 7303620 - DNA, 22 bp, Homo sapiens
aactgaactgataacatacacg

SEQ ID NO: 7303621 - DNA, 22 bp, Homo sapiens
aactgacttagccagtggagct

SEQ ID NO: 7303622 - DNA, 22 bp, Homo sapiens
aactgaaagtttcacctgaggt

SEQ ID NO: 7303623 - DNA, 22 bp, Homo sapiens
aactgaaatcaatcagtgattc

SEQ ID NO: 7303624 - DNA, 22 bp, Homo sapiens
aactgataatggacacataaaa

SEQ ID NO: 7303625 - DNA, 22 bp, Homo sapiens
aacttgcttcaacttatttcac

SEQ ID NO: 7303626 - DNA, 23 bp, Homo sapiens
aacttgctgtaaagttctaggca

SEQ ID NO: 7303627 - DNA, 22 bp, Homo sapiens
aactgagacacgaactatgatt

SEQ ID NO: 7303628 - DNA, 22 bp, Homo sapiens
aacacatatttatatatgcaca

SEQ ID NO: 7303629 - DNA, 23 bp, Homo sapiens
aacacattgctaattacattcaa

SEQ ID NO: 7303630 - DNA, 22 bp, Homo sapiens
aacacatgccttaagaataagt

SEQ ID NO: 7303631 - DNA, 22 bp, Homo sapiens
aacacatgccttaagaataagt

SEQ ID NO: 7303632 - DNA, 23 bp, Homo sapiens
aacacattgctaattacattcaa

SEQ ID NO: 7303633 - DNA, 23 bp, Homo sapiens
aacacattgctaattacattcaa

SEQ ID NO: 7303634 - DNA, 22 bp, Homo sapiens
aacagctttgagcagttctgta

SEQ ID NO: 7303635 - DNA, 22 bp, Homo sapiens
aacacataggcagagcatgaca

SEQ ID NO: 7303636 - DNA, 23 bp, Homo sapiens
aacacaaagctgattccagtggc

SEQ ID NO: 7303637 - DNA, 22 bp, Homo sapiens
aacacaaaaattctcaggggca

SEQ ID NO: 7303638 - DNA, 22 bp, Homo sapiens
aacacaaagaagctgcaggatc

SEQ ID NO: 7303639 - DNA, 22 bp, Homo sapiens
aacaacttgcgttcagagatgt

SEQ ID NO: 7303640 - DNA, 22 bp, Homo sapiens
aacaagaacacctacagttcta

SEQ ID NO: 7303641 - DNA, 22 bp, Homo sapiens
aacaattactaccaaggcctgt

SEQ ID NO: 7303642 - DNA, 22 bp, Homo sapiens
aaagcaattgtggtttttgtca

SEQ ID NO: 7303643 - DNA, 22 bp, Homo sapiens
aaagcaattacaaaagggataa

SEQ ID NO: 7303644 - DNA, 22 bp, Homo sapiens
aaagcaattgtggtttttgcca

SEQ ID NO: 7303645 - DNA, 22 bp, Homo sapiens
aaagcaatgggtctaaggtaaa

SEQ ID NO: 7303646 - DNA, 22 bp, Homo sapiens
aaatggtccatcctaaagaagt

SEQ ID NO: 7303647 - DNA, 22 bp, Homo sapiens
aaatggtagtagcattccatat

SEQ ID NO: 7303648 - DNA, 22 bp, Homo sapiens
aaatggtataatgtcatgtatt

SEQ ID NO: 7303649 - DNA, 22 bp, Homo sapiens
aaatggtatgaaaagagatttc

SEQ ID NO: 7303650 - DNA, 22 bp, Homo sapiens
aaatggtaatgtctttctgttt

SEQ ID NO: 7303651 - DNA, 22 bp, Homo sapiens
aaatggtaaattagtagtagct

SEQ ID NO: 7303652 - DNA, 22 bp, Homo sapiens
aaatggtaagacaacacattat

SEQ ID NO: 7303653 - DNA, 22 bp, Homo sapiens
aaagcacatgagtagtgtagta

SEQ ID NO: 7303654 - DNA, 22 bp, Homo sapiens
aaagcacattacaagctcagtc

SEQ ID NO: 7303655 - DNA, 22 bp, Homo sapiens
aaagcacctagcatagtgctta

SEQ ID NO: 7303656 - DNA, 22 bp, Homo sapiens
aaagcaccggggagccttggga

SEQ ID NO: 7303657 - DNA, 22 bp, Homo sapiens
aaagcacagagctcccacagga

SEQ ID NO: 7303658 - DNA, 22 bp, Homo sapiens
aaagcacagggtgctagagagt

SEQ ID NO: 7303659 - DNA, 22 bp, Homo sapiens
aaagcacagggtgctagagagt

SEQ ID NO: 7303660 - DNA, 22 bp, Homo sapiens
aacaaattagttgcaagactgg

SEQ ID NO: 7303661 - DNA, 22 bp, Homo sapiens
aacaaatttagctctgagtgct

SEQ ID NO: 7303662 - DNA, 22 bp, Homo sapiens
aacaacttgcgttcagagatgt

SEQ ID NO: 7303663 - DNA, 22 bp, Homo sapiens
aagagccatacaagtaaaagca

SEQ ID NO: 7303664 - DNA, 22 bp, Homo sapiens
aagagcctggctgctaggctca

SEQ ID NO: 7303665 - DNA, 22 bp, Homo sapiens
aagaggagaaaggctggctttg

SEQ ID NO: 7303666 - DNA, 22 bp, Homo sapiens
aagaggaccagtagataaattt

SEQ ID NO: 7303667 - DNA, 22 bp, Homo sapiens
aagaggaagtctccatggagag

SEQ ID NO: 7303668 - DNA, 22 bp, Homo sapiens
aagagccagctagtgaagaggc

SEQ ID NO: 7303669 - DNA, 22 bp, Homo sapiens
aagagcattccgttctgattct

SEQ ID NO: 7303670 - DNA, 22 bp, Homo sapiens
aagagcatatggttctcaaagc

SEQ ID NO: 7303671 - DNA, 22 bp, Homo sapiens
aagaatgttagtttctgataca

SEQ ID NO: 7303672 - DNA, 22 bp, Homo sapiens
aagaatgttcattaaactgttg

SEQ ID NO: 7303673 - DNA, 22 bp, Homo sapiens
aagaagttggaaatgattgaga

SEQ ID NO: 7303674 - DNA, 22 bp, Homo sapiens
aagaatgtcgttggtattttaa

SEQ ID NO: 7303675 - DNA, 22 bp, Homo sapiens
aagaatgtggcatttatttata

SEQ ID NO: 7303676 - DNA, 22 bp, Homo sapiens
aagaagttaggtgtaacaatat

SEQ ID NO: 7303677 - DNA, 22 bp, Homo sapiens
aagaagttaataatggtgagaa

SEQ ID NO: 7303678 - DNA, 22 bp, Homo sapiens
aagaaagtgtggagagcctagc

SEQ ID NO: 7303679 - DNA, 22 bp, Homo sapiens
aagaaaggtgtgtttgcagatg

SEQ ID NO: 7303680 - DNA, 22 bp, Homo sapiens
aagaaaggtctctgcccgctat

SEQ ID NO: 7303681 - DNA, 22 bp, Homo sapiens
aactttttctgggatggagggt

SEQ ID NO: 7303682 - DNA, 22 bp, Homo sapiens
aagaaaggatatatgggaggta

SEQ ID NO: 7303683 - DNA, 22 bp, Homo sapiens
aagaaagggctattgttctcca

SEQ ID NO: 7303684 - DNA, 22 bp, Homo sapiens
aagaaagggagaaggatggtgt

SEQ ID NO: 7303685 - DNA, 22 bp, Homo sapiens
aactttctttcacagaagtatc

SEQ ID NO: 7303686 - DNA, 22 bp, Homo sapiens
aaatatcattctggtgcacaga

SEQ ID NO: 7303687 - DNA, 22 bp, Homo sapiens
aaatatcatttataacttttaa

SEQ ID NO: 7303688 - DNA, 22 bp, Homo sapiens
aaatatgaatgataagagttat

SEQ ID NO: 7303689 - DNA, 22 bp, Homo sapiens
aaatatcttaggagtatatgag

SEQ ID NO: 7303690 - DNA, 17 bp, Homo sapiens
aaatatgacctcaaagt

SEQ ID NO: 7303691 - DNA, 22 bp, Homo sapiens
aaatatgactagaatgccaggt

SEQ ID NO: 7303692 - DNA, 22 bp, Homo sapiens
aagcaaatgtgggtgcagaatt

SEQ ID NO: 7303693 - DNA, 22 bp, Homo sapiens
aagaggagacttcagcaacttg

SEQ ID NO: 7303694 - DNA, 18 bp, Homo sapiens
aagaggaggaaacccagg

SEQ ID NO: 7303695 - DNA, 18 bp, Homo sapiens
aagaggaggagcaggttg

SEQ ID NO: 7303696 - DNA, 22 bp, Homo sapiens
aagattctcagagtgaaagaat

SEQ ID NO: 7303697 - DNA, 22 bp, Homo sapiens
aagccacaatctgcatcagcat

SEQ ID NO: 7303698 - DNA, 22 bp, Homo sapiens
aagccactcacaataactgtcc

SEQ ID NO: 7303699 - DNA, 22 bp, Homo sapiens
aagccactgagatttcactgca

SEQ ID NO: 7303700 - DNA, 18 bp, Homo sapiens
aagccagagaccactgcc

SEQ ID NO: 7303701 - DNA, 22 bp, Homo sapiens
aagccactttcagctgtctcag

SEQ ID NO: 7303702 - DNA, 22 bp, Homo sapiens
aagccagatagaagaactcatt

SEQ ID NO: 7303703 - DNA, 22 bp, Homo sapiens
aagcagcataattgctatttta

SEQ ID NO: 7303704 - DNA, 22 bp, Homo sapiens
aagcatggtggatgatacagtg

SEQ ID NO: 7303705 - DNA, 22 bp, Homo sapiens
aagcagcaacaaactggataaa

SEQ ID NO: 7303706 - DNA, 22 bp, Homo sapiens
aagcagaaagaacaactgagtg

SEQ ID NO: 7303707 - DNA, 22 bp, Homo sapiens
aagcagaactgggaagtagtgg

SEQ ID NO: 7303708 - DNA, 22 bp, Homo sapiens
aagcagagttagcttgtcacct

SEQ ID NO: 7303709 - DNA, 22 bp, Homo sapiens
aagcactgagcacagtggctga

SEQ ID NO: 7303710 - DNA, 22 bp, Homo sapiens
aaatactgtccaccatggagca

SEQ ID NO: 7303711 - DNA, 22 bp, Homo sapiens
aaatactgtccaccatggagca

SEQ ID NO: 7303712 - DNA, 22 bp, Homo sapiens
aaatactgtctctgagagagcc

SEQ ID NO: 7303713 - DNA, 22 bp, Homo sapiens
aaatactgtgaataaaggtttt

SEQ ID NO: 7303714 - DNA, 22 bp, Homo sapiens
aaatactgtgaataaaggtttt

SEQ ID NO: 7303715 - DNA, 21 bp, Homo sapiens
aaatactgtcaaatggtgggt

SEQ ID NO: 7303716 - DNA, 22 bp, Homo sapiens
aaatacagattctgactcagag

SEQ ID NO: 7303717 - DNA, 22 bp, Homo sapiens
aaatacagattctgactcagag

SEQ ID NO: 7303718 - DNA, 22 bp, Homo sapiens
aaatactgttgaatgaagtaag

SEQ ID NO: 7303719 - DNA, 22 bp, Homo sapiens
aaatactgttgaatgaagtaag

SEQ ID NO: 7303720 - DNA, 22 bp, Homo sapiens
aaatactgttttattccatgat

SEQ ID NO: 7303721 - DNA, 22 bp, Homo sapiens
aaacggaatgagtaagagtatc

SEQ ID NO: 7303722 - DNA, 22 bp, Homo sapiens
aaactactgatgcctgggccct

SEQ ID NO: 7303723 - DNA, 22 bp, Homo sapiens
aaatatgtaagattagcactag

SEQ ID NO: 7303724 - DNA, 23 bp, Homo sapiens
aaatatgtctgagggcaaagaat

SEQ ID NO: 7303725 - DNA, 22 bp, Homo sapiens
aaatatgatactcccttttagt

SEQ ID NO: 7303726 - DNA, 22 bp, Homo sapiens
aaatatgagggtgatgcccaga

SEQ ID NO: 7303727 - DNA, 22 bp, Homo sapiens
aaatatgtaagattagcactag

SEQ ID NO: 7303728 - DNA, 20 bp, Homo sapiens
aaatgccagtgattctgctt

SEQ ID NO: 7303729 - DNA, 22 bp, Homo sapiens
aaatggcattcagcaacctttc

SEQ ID NO: 7303730 - DNA, 22 bp, Homo sapiens
aaatggcaggctctttgctagt

SEQ ID NO: 7303731 - DNA, 22 bp, Homo sapiens
aaatgctcaccacagggatgtg

SEQ ID NO: 7303732 - DNA, 22 bp, Homo sapiens
aaatatgttttccagttgtcat

SEQ ID NO: 7303733 - DNA, 22 bp, Homo sapiens
aaatattagggagaacagggac

SEQ ID NO: 7303734 - DNA, 22 bp, Homo sapiens
aaatcagttgttatattaaaga

SEQ ID NO: 7303735 - DNA, 22 bp, Homo sapiens
aaatcatggtggaagaaacaga

SEQ ID NO: 7303736 - DNA, 22 bp, Homo sapiens
aaaggaggaatggagagatgct

SEQ ID NO: 7303737 - DNA, 22 bp, Homo sapiens
aaagcaatgcccgttcattatc

SEQ ID NO: 7303738 - DNA, 22 bp, Homo sapiens
aaagatgtgcctgtttcatagt

SEQ ID NO: 7303739 - DNA, 22 bp, Homo sapiens
aaagatgtcatacacattaaga

SEQ ID NO: 7303740 - DNA, 22 bp, Homo sapiens
aaagtgcatcaaatgacttccc

SEQ ID NO: 7303741 - DNA, 23 bp, Homo sapiens
aaagtgcagttgaggaatcatag

SEQ ID NO: 7303742 - DNA, 22 bp, Homo sapiens
aaagtcatttagccttatctcc

SEQ ID NO: 7303743 - DNA, 22 bp, Homo sapiens
aaagtccaattttgttcaggct

SEQ ID NO: 7303744 - DNA, 22 bp, Homo sapiens
aaacactgcagggtttacttga

SEQ ID NO: 7303745 - DNA, 22 bp, Homo sapiens
aaacactgcgtggtggcaactc

SEQ ID NO: 7303746 - DNA, 22 bp, Homo sapiens
aaacactggtatgatgtatagt

SEQ ID NO: 7303747 - DNA, 22 bp, Homo sapiens
aaacactggtatgatgtatagt

SEQ ID NO: 7303748 - DNA, 22 bp, Homo sapiens
aaacactgtacaatctgcaggg

SEQ ID NO: 7303749 - DNA, 22 bp, Homo sapiens
aaacactggtatgatgtatagt

SEQ ID NO: 7303750 - DNA, 22 bp, Homo sapiens
aaacagttttctcatttagtgt

SEQ ID NO: 7303751 - DNA, 22 bp, Homo sapiens
aaacatcataggcatgcatgat

SEQ ID NO: 7303752 - DNA, 22 bp, Homo sapiens
aaacatcaccattttacctaat

SEQ ID NO: 7303753 - DNA, 22 bp, Homo sapiens
aaacatcaccattttacctaat

SEQ ID NO: 7303754 - DNA, 20 bp, Homo sapiens
aaacatagtggataccacag

SEQ ID NO: 7303755 - DNA, 22 bp, Homo sapiens
aaagaagatggagacctgacta

SEQ ID NO: 7303756 - DNA, 22 bp, Homo sapiens
aaagaagagctggaaggagtct

SEQ ID NO: 7303757 - DNA, 22 bp, Homo sapiens
aaagatgaccgtatgtcagagc

SEQ ID NO: 7303758 - DNA, 22 bp, Homo sapiens
aaagatgatctacaagttcatt

SEQ ID NO: 7303759 - DNA, 22 bp, Homo sapiens
aaagatctgacttagacacaga

SEQ ID NO: 7303760 - DNA, 22 bp, Homo sapiens
aaacttgttctcttgtgcctat

SEQ ID NO: 7303761 - DNA, 22 bp, Homo sapiens
aaactttaaatttgtacctctg

SEQ ID NO: 7303762 - DNA, 22 bp, Homo sapiens
aaactttaagacagtcctcaag

SEQ ID NO: 7303763 - DNA, 23 bp, Homo sapiens
aaacttgttaatgaggcaacagg

SEQ ID NO: 7303764 - DNA, 22 bp, Homo sapiens
aaacttgttctcatgttgcaga

SEQ ID NO: 7303765 - DNA, 22 bp, Homo sapiens
aaactttaggaaggaatttaca

SEQ ID NO: 7303766 - DNA, 22 bp, Homo sapiens
aaacttgatttagaactaaggc

SEQ ID NO: 7303767 - DNA, 22 bp, Homo sapiens
aaacttgaggcaatgaaggtgt

SEQ ID NO: 7303768 - DNA, 20 bp, Homo sapiens
aaacttgatggcatagaata

SEQ ID NO: 7303769 - DNA, 20 bp, Homo sapiens
aaacttgatggcatagaata

SEQ ID NO: 7303770 - DNA, 22 bp, Homo sapiens
aaacttgagcagtcagatgaag

SEQ ID NO: 7303771 - DNA, 22 bp, Homo sapiens
aaacttgacagtagacagatta

SEQ ID NO: 7303772 - DNA, 22 bp, Homo sapiens
aaacttgacagtgagacagttt

SEQ ID NO: 7303773 - DNA, 22 bp, Homo sapiens
aaacatgaatagatattaaaca

SEQ ID NO: 7303774 - DNA, 22 bp, Homo sapiens
aaacatgagcacttgcttcata

SEQ ID NO: 7303775 - DNA, 22 bp, Homo sapiens
aaacatgagcatctcttcaagc

SEQ ID NO: 7303776 - DNA, 22 bp, Homo sapiens
aaacatgagcacttgcttcata

SEQ ID NO: 7303777 - DNA, 22 bp, Homo sapiens
aaacatctttctattgcaagtt

SEQ ID NO: 7303778 - DNA, 22 bp, Homo sapiens
aaacatcttctcttgattcttt

SEQ ID NO: 7303779 - DNA, 22 bp, Homo sapiens
aaacacaggtactgcagaagtg

SEQ ID NO: 7303780 - DNA, 22 bp, Homo sapiens
aaacacagggatatatattcca

SEQ ID NO: 7303781 - DNA, 20 bp, Homo sapiens
aaacacagcctctctttaca

SEQ ID NO: 7303782 - DNA, 22 bp, Homo sapiens
aaacacagatttctttgtccca

SEQ ID NO: 7303783 - DNA, 22 bp, Homo sapiens
aaacacagcatgtccttgggga

SEQ ID NO: 7303784 - DNA, 22 bp, Homo sapiens
aaaccattaggttttatctact

SEQ ID NO: 7303785 - DNA, 22 bp, Homo sapiens
aaacatgagttaaaagtaactg

SEQ ID NO: 7303786 - DNA, 22 bp, Homo sapiens
aaacattgttatgataaattac

SEQ ID NO: 7303787 - DNA, 22 bp, Homo sapiens
aaacatgagcatctcttcaagc

SEQ ID NO: 7303788 - DNA, 22 bp, Homo sapiens
aaacatttttcttcatcatcct

SEQ ID NO: 7303789 - DNA, 22 bp, Homo sapiens
aaaatagctatggaatgtcact

SEQ ID NO: 7303790 - DNA, 22 bp, Homo sapiens
aaaatagctatggaatgtcact

SEQ ID NO: 7303791 - DNA, 20 bp, Homo sapiens
aaaatagccccaggctcatt

SEQ ID NO: 7303792 - DNA, 22 bp, Homo sapiens
aaaatagcaatcagggactctc

SEQ ID NO: 7303793 - DNA, 22 bp, Homo sapiens
aaaatagcctcacataattgct

SEQ ID NO: 7303794 - DNA, 22 bp, Homo sapiens
aaaatagcctcacataattgct

SEQ ID NO: 7303795 - DNA, 22 bp, Homo sapiens
aaaatagcctcacataattgct

SEQ ID NO: 7303796 - DNA, 22 bp, Homo sapiens
aaaagtgtccagattatgaaga

SEQ ID NO: 7303797 - DNA, 22 bp, Homo sapiens
aaacaaagccagggaagttatg

SEQ ID NO: 7303798 - DNA, 22 bp, Homo sapiens
aaacaaagcatcttgctatgca

SEQ ID NO: 7303799 - DNA, 22 bp, Homo sapiens
aaacaaacataggtttgaaagt

SEQ ID NO: 7303800 - DNA, 22 bp, Homo sapiens
aaacaaagccagggaagttatg

SEQ ID NO: 7303801 - DNA, 19 bp, Homo sapiens
aaacacagatttcttacca

SEQ ID NO: 7303802 - DNA, 22 bp, Homo sapiens
aaaaatgaaacggctggttggc

SEQ ID NO: 7303803 - DNA, 22 bp, Homo sapiens
aaaaatgaattcttcagtggca

SEQ ID NO: 7303804 - DNA, 22 bp, Homo sapiens
aaaaatgaattcttcagtggca

SEQ ID NO: 7303805 - DNA, 21 bp, Homo sapiens
aaaaatgaagttgttcaggaa

SEQ ID NO: 7303806 - DNA, 22 bp, Homo sapiens
aaaaagatgtcctgaagtttag

SEQ ID NO: 7303807 - DNA, 22 bp, Homo sapiens
aaaaagagaaatgctctagtcc

SEQ ID NO: 7303808 - DNA, 22 bp, Homo sapiens
aaaaagacagaggatgaggcag

SEQ ID NO: 7303809 - DNA, 22 bp, Homo sapiens
aaggaccagttttgcagaattg

SEQ ID NO: 7303810 - DNA, 22 bp, Homo sapiens
aaggagaaggcatcattcaagt

SEQ ID NO: 7303811 - DNA, 22 bp, Homo sapiens
aaggagaaggcatcattcaagt

SEQ ID NO: 7303812 - DNA, 22 bp, Homo sapiens
aaggagaaatggtagatgtgca

SEQ ID NO: 7303813 - DNA, 22 bp, Homo sapiens
aaatttaaggaggtgctcactt

SEQ ID NO: 7303814 - DNA, 22 bp, Homo sapiens
aaattgttgatctacagtaagg

SEQ ID NO: 7303815 - DNA, 22 bp, Homo sapiens
aaattgcattttaaaggtagat

SEQ ID NO: 7303816 - DNA, 22 bp, Homo sapiens
aaattaactatcacttttgtga

SEQ ID NO: 7303817 - DNA, 22 bp, Homo sapiens
aaattaactatcacttttgtga

SEQ ID NO: 7303818 - DNA, 22 bp, Homo sapiens
aaggaaacagaggatgaccttg

SEQ ID NO: 7303819 - DNA, 22 bp, Homo sapiens
aaattagatcagtggattttct

SEQ ID NO: 7303820 - DNA, 22 bp, Homo sapiens
aaattataggtgccaccttgga

SEQ ID NO: 7303821 - DNA, 22 bp, Homo sapiens
aaggacatttctgactaatgca

SEQ ID NO: 7303822 - DNA, 22 bp, Homo sapiens
aagccatttgttgtccttcagg

SEQ ID NO: 7303823 - DNA, 22 bp, Homo sapiens
aagccattcccatagacttcag

SEQ ID NO: 7303824 - DNA, 22 bp, Homo sapiens
aagccattcatctaatgtcctg

SEQ ID NO: 7303825 - DNA, 21 bp, Homo sapiens
aaggaaaagcttggtctctga

SEQ ID NO: 7303826 - DNA, 22 bp, Homo sapiens
aagggagcttaggagatcaggc

SEQ ID NO: 7303827 - DNA, 22 bp, Homo sapiens
aagggagaggagggtcttgttg

SEQ ID NO: 7303828 - DNA, 22 bp, Homo sapiens
aaggggctcttgtcaggcgcag

SEQ ID NO: 7303829 - DNA, 22 bp, Homo sapiens
aacaatgaccacacaatgtact

SEQ ID NO: 7303830 - DNA, 22 bp, Homo sapiens
aacaatgaccacacaatgtact

SEQ ID NO: 7303831 - DNA, 22 bp, Homo sapiens
aacaatcaagtttctaaatgac

SEQ ID NO: 7303832 - DNA, 22 bp, Homo sapiens
aacaatgagtcctctgaggtta

SEQ ID NO: 7303833 - DNA, 22 bp, Homo sapiens
aacaatgagtcctctgaggtta

SEQ ID NO: 7303834 - DNA, 22 bp, Homo sapiens
aacaagttactcttaaagtata

SEQ ID NO: 7303835 - DNA, 22 bp, Homo sapiens
aacaagtgagtcatttaaactc

SEQ ID NO: 7303836 - DNA, 22 bp, Homo sapiens
aacaagtgatgctcatgattca

SEQ ID NO: 7303837 - DNA, 22 bp, Homo sapiens
aagggagacagttgtgtgagga

SEQ ID NO: 7303838 - DNA, 22 bp, Homo sapiens
aacaagttagattttgtgtctt

SEQ ID NO: 7303839 - DNA, 22 bp, Homo sapiens
aaatttcagttggaatgagctc

SEQ ID NO: 7303840 - DNA, 22 bp, Homo sapiens
aaatttcagttacctttacgtt

SEQ ID NO: 7303841 - DNA, 22 bp, Homo sapiens
aaatttcagttggaatgagctc

SEQ ID NO: 7303842 - DNA, 22 bp, Homo sapiens
aaatttcaagcaaagtagctat

SEQ ID NO: 7303843 - DNA, 22 bp, Homo sapiens
aacataaatttgaagtggcaaa

SEQ ID NO: 7303844 - DNA, 22 bp, Homo sapiens
aacataaatttgaagtggcaaa

SEQ ID NO: 7303845 - DNA, 22 bp, Homo sapiens
aacagtttgggtaggtatgtag

SEQ ID NO: 7303846 - DNA, 22 bp, Homo sapiens
aacattcttaagatttgtgtct

SEQ ID NO: 7303847 - DNA, 22 bp, Homo sapiens
aacattgaaatatttgcaatag

SEQ ID NO: 7303848 - DNA, 22 bp, Homo sapiens
aacatttacaaatccttctgca

SEQ ID NO: 7303849 - DNA, 22 bp, Homo sapiens
aacattgattgcatctgttcac

SEQ ID NO: 7303850 - DNA, 22 bp, Homo sapiens
aatatttgaacagtcactgagt

SEQ ID NO: 7303851 - DNA, 22 bp, Homo sapiens
aatatttgaacagtcactgagt

SEQ ID NO: 7303852 - DNA, 22 bp, Homo sapiens
aatatttgaacagtcactgagt

SEQ ID NO: 7303853 - DNA, 22 bp, Homo sapiens
aatatttgcatcattagctatt

SEQ ID NO: 7303854 - DNA, 22 bp, Homo sapiens
aatatttgcatcattagctatt

SEQ ID NO: 7303855 - DNA, 22 bp, Homo sapiens
aacatttcagcaaataagaaca

SEQ ID NO: 7303856 - DNA, 22 bp, Homo sapiens
aacatttattgagcacctactg

SEQ ID NO: 7303857 - DNA, 22 bp, Homo sapiens
aacatttcagcacctgattcct

SEQ ID NO: 7303858 - DNA, 22 bp, Homo sapiens
aacatttattgagcacctactg

SEQ ID NO: 7303859 - DNA, 22 bp, Homo sapiens
aacatttattctaattctggga

SEQ ID NO: 7303860 - DNA, 22 bp, Homo sapiens
aacatttatggtagtcattgca

SEQ ID NO: 7303861 - DNA, 22 bp, Homo sapiens
aacatttaggaaggacctcctc

SEQ ID NO: 7303862 - DNA, 22 bp, Homo sapiens
aacatttatgattgaggtaaat

SEQ ID NO: 7303863 - DNA, 22 bp, Homo sapiens
aacatttatatgggttcatgaa

SEQ ID NO: 7303864 - DNA, 22 bp, Homo sapiens
aactccagactactaatttagt

SEQ ID NO: 7303865 - DNA, 22 bp, Homo sapiens
aactccagggggtcaatattta

SEQ ID NO: 7303866 - DNA, 22 bp, Homo sapiens
aatcacattacagcatatctgt

SEQ ID NO: 7303867 - DNA, 22 bp, Homo sapiens
aatcacattagtgaaacactga

SEQ ID NO: 7303868 - DNA, 22 bp, Homo sapiens
aatcacattgaatctgctacct

SEQ ID NO: 7303869 - DNA, 22 bp, Homo sapiens
aagtatttggaatggcattttt

SEQ ID NO: 7303870 - DNA, 22 bp, Homo sapiens
aagtatttctggcctgtgaaag

SEQ ID NO: 7303871 - DNA, 22 bp, Homo sapiens
aagtatttctggcctgtgaaag

SEQ ID NO: 7303872 - DNA, 22 bp, Homo sapiens
aagtatttcgttctgaaaaagt

SEQ ID NO: 7303873 - DNA, 22 bp, Homo sapiens
aagtatttcgttctgaaaaagt

SEQ ID NO: 7303874 - DNA, 22 bp, Homo sapiens
aagtatttcagcggttctttgt

SEQ ID NO: 7303875 - DNA, 20 bp, Homo sapiens
aacactgaggcctactcttc

SEQ ID NO: 7303876 - DNA, 22 bp, Homo sapiens
aacactgagggaaaagagatag

SEQ ID NO: 7303877 - DNA, 20 bp, Homo sapiens
aacactgagggctactcttc

SEQ ID NO: 7303878 - DNA, 20 bp, Homo sapiens
aacactgcttctatattttc

SEQ ID NO: 7303879 - DNA, 22 bp, Homo sapiens
aagttcttgagccctattctag

SEQ ID NO: 7303880 - DNA, 22 bp, Homo sapiens
aacactgtaacagcatcatttt

SEQ ID NO: 7303881 - DNA, 22 bp, Homo sapiens
aacactggtttggcattagatg

SEQ ID NO: 7303882 - DNA, 20 bp, Homo sapiens
aagttacattgtattgtacc

SEQ ID NO: 7303883 - DNA, 22 bp, Homo sapiens
aagttacattttggtctaattg

SEQ ID NO: 7303884 - DNA, 22 bp, Homo sapiens
aacagtttgagctttgaatttc

SEQ ID NO: 7303885 - DNA, 22 bp, Homo sapiens
aacagtttgctttaagaggcac

SEQ ID NO: 7303886 - DNA, 22 bp, Homo sapiens
aacagtttgcctgaaatgtatt

SEQ ID NO: 7303887 - DNA, 18 bp, Homo sapiens
aacagtttccagattctc

SEQ ID NO: 7303888 - DNA, 22 bp, Homo sapiens
aacagtttcagttactgatgag

SEQ ID NO: 7303889 - DNA, 18 bp, Homo sapiens
aacagtttccagattctc

SEQ ID NO: 7303890 - DNA, 22 bp, Homo sapiens
aataaacaaatccttccttccc

SEQ ID NO: 7303891 - DNA, 22 bp, Homo sapiens
aataaacaaatctttcctgtgg

SEQ ID NO: 7303892 - DNA, 22 bp, Homo sapiens
aataaactgctcaattgcatca

SEQ ID NO: 7303893 - DNA, 20 bp, Homo sapiens
aataaactactgagagatgt

SEQ ID NO: 7303894 - DNA, 20 bp, Homo sapiens
aagtttgccccaggaaattg

SEQ ID NO: 7303895 - DNA, 22 bp, Homo sapiens
acaagaaccaaagaaggatatt

SEQ ID NO: 7303896 - DNA, 22 bp, Homo sapiens
acaactttctgggttatctgat

SEQ ID NO: 7303897 - DNA, 22 bp, Homo sapiens
acaactttgacccttgttctta

SEQ ID NO: 7303898 - DNA, 22 bp, Homo sapiens
acaactttgacccttgttctta

SEQ ID NO: 7303899 - DNA, 22 bp, Homo sapiens
acaactttgtagcaattccacg

SEQ ID NO: 7303900 - DNA, 23 bp, Homo sapiens
acaactttacagatacattttgt

SEQ ID NO: 7303901 - DNA, 23 bp, Homo sapiens
acaactttacagatacattttgt

SEQ ID NO: 7303902 - DNA, 22 bp, Homo sapiens
acaactttaatgggtttcagct

SEQ ID NO: 7303903 - DNA, 22 bp, Homo sapiens
aagacattgtcattttataatt

SEQ ID NO: 7303904 - DNA, 22 bp, Homo sapiens
aagacattgtcattttataatt

SEQ ID NO: 7303905 - DNA, 22 bp, Homo sapiens
aagacattggacaatccagagg

SEQ ID NO: 7303906 - DNA, 22 bp, Homo sapiens
aagacattgctgcttttaattg

SEQ ID NO: 7303907 - DNA, 22 bp, Homo sapiens
acaagaatgtagattagttaag

SEQ ID NO: 7303908 - DNA, 22 bp, Homo sapiens
aagacattcacaaatgttcact

SEQ ID NO: 7303909 - DNA, 22 bp, Homo sapiens
aagacattgcatgataatgctg

SEQ ID NO: 7303910 - DNA, 22 bp, Homo sapiens
aagacattgcatgataatgctg

SEQ ID NO: 7303911 - DNA, 22 bp, Homo sapiens
aagacacacacatatgctgagt

SEQ ID NO: 7303912 - DNA, 22 bp, Homo sapiens
aagacacacacatatgctgagt

SEQ ID NO: 7303913 - DNA, 22 bp, Homo sapiens
aagacacaatgtagcccagcac

SEQ ID NO: 7303914 - DNA, 22 bp, Homo sapiens
acaactgttagacacttctaag

SEQ ID NO: 7303915 - DNA, 22 bp, Homo sapiens
aagacaatttgatactagttgc

SEQ ID NO: 7303916 - DNA, 22 bp, Homo sapiens
aagacacaaagcttcccttttc

SEQ ID NO: 7303917 - DNA, 22 bp, Homo sapiens
aagacaatgcattactaagaag

SEQ ID NO: 7303918 - DNA, 22 bp, Homo sapiens
aagacaagcatcaaatcaggca

SEQ ID NO: 7303919 - DNA, 22 bp, Homo sapiens
aagaattttccagcatgtcagt

SEQ ID NO: 7303920 - DNA, 22 bp, Homo sapiens
aattcaaattacaatagttgtt

SEQ ID NO: 7303921 - DNA, 22 bp, Homo sapiens
aatgttaagtttagattataac

SEQ ID NO: 7303922 - DNA, 22 bp, Homo sapiens
aatgttaagtttagattataac

SEQ ID NO: 7303923 - DNA, 22 bp, Homo sapiens
aatgttaatgtgtttgcttatg

SEQ ID NO: 7303924 - DNA, 22 bp, Homo sapiens
aatgttaatgtgtttgcttatg

SEQ ID NO: 7303925 - DNA, 22 bp, Homo sapiens
aatgttacacaggtataatcag

SEQ ID NO: 7303926 - DNA, 22 bp, Homo sapiens
aatgttacagttttaattctga

SEQ ID NO: 7303927 - DNA, 22 bp, Homo sapiens
aatgtcttttgatacaagttac

SEQ ID NO: 7303928 - DNA, 22 bp, Homo sapiens
aatgtcttttgatacaagttac

SEQ ID NO: 7303929 - DNA, 22 bp, Homo sapiens
aactttctaaagtcaaattggt

SEQ ID NO: 7303930 - DNA, 22 bp, Homo sapiens
aactttctaattttggctgagc

SEQ ID NO: 7303931 - DNA, 22 bp, Homo sapiens
aactttagaaaggaaggaagtg

SEQ ID NO: 7303932 - DNA, 22 bp, Homo sapiens
aactttctctacggcatttgtt

SEQ ID NO: 7303933 - DNA, 22 bp, Homo sapiens
aactttctccagtgccaactat

SEQ ID NO: 7303934 - DNA, 22 bp, Homo sapiens
aactcttaattttcatgaaatg

SEQ ID NO: 7303935 - DNA, 22 bp, Homo sapiens
aactcttcttataatgcgtgat

SEQ ID NO: 7303936 - DNA, 22 bp, Homo sapiens
aactgaaaccaaacactttagg

SEQ ID NO: 7303937 - DNA, 22 bp, Homo sapiens
aatgtacaccgtgggtttttta

SEQ ID NO: 7303938 - DNA, 22 bp, Homo sapiens
aactgaaacggtgatcttttaa

SEQ ID NO: 7303939 - DNA, 20 bp, Homo sapiens
aactcctagcctcaagtgat

SEQ ID NO: 7303940 - DNA, 22 bp, Homo sapiens
aatgtattttgggagtttcttt

SEQ ID NO: 7303941 - DNA, 22 bp, Homo sapiens
aatgtcttgagaagagaaatct

SEQ ID NO: 7303942 - DNA, 22 bp, Homo sapiens
aatgtcaagtagccaatgcttc

SEQ ID NO: 7303943 - DNA, 22 bp, Homo sapiens
acacacagaaggaagccccact

SEQ ID NO: 7303944 - DNA, 22 bp, Homo sapiens
acacacagagtttatacaggca

SEQ ID NO: 7303945 - DNA, 19 bp, Homo sapiens
aagagggaaagtgctatgc

SEQ ID NO: 7303946 - DNA, 22 bp, Homo sapiens
acacacatgcatgcttgccatt

SEQ ID NO: 7303947 - DNA, 22 bp, Homo sapiens
aagaggaggattgatgtgggag

SEQ ID NO: 7303948 - DNA, 22 bp, Homo sapiens
aagacatttatgaaaagtgctg

SEQ ID NO: 7303949 - DNA, 22 bp, Homo sapiens
aagaggagtagatgtggttggt

SEQ ID NO: 7303950 - DNA, 22 bp, Homo sapiens
aagaggttgtctgtgatgagtt

SEQ ID NO: 7303951 - DNA, 22 bp, Homo sapiens
aagaggttgtctgtgatgagtt

SEQ ID NO: 7303952 - DNA, 22 bp, Homo sapiens
aagagtggagctggaaagtggg

SEQ ID NO: 7303953 - DNA, 23 bp, Homo sapiens
acacgtgtgtgtacatagatagt

SEQ ID NO: 7303954 - DNA, 22 bp, Homo sapiens
acactacttttcataaaagtaa

SEQ ID NO: 7303955 - DNA, 22 bp, Homo sapiens
acacatttctcccagtctccat

SEQ ID NO: 7303956 - DNA, 22 bp, Homo sapiens
acacatttctcccagtctccat

SEQ ID NO: 7303957 - DNA, 22 bp, Homo sapiens
acacctggtctttgcatgagca

SEQ ID NO: 7303958 - DNA, 22 bp, Homo sapiens
aagcacattaaggaacattgaa

SEQ ID NO: 7303959 - DNA, 22 bp, Homo sapiens
aagcacatctcaaacttcatct

SEQ ID NO: 7303960 - DNA, 22 bp, Homo sapiens
aagcacatttggaaaacatgga

SEQ ID NO: 7303961 - DNA, 22 bp, Homo sapiens
aagcacattatagctatctagg

SEQ ID NO: 7303962 - DNA, 22 bp, Homo sapiens
acagatgaatctgtgattgctg

SEQ ID NO: 7303963 - DNA, 23 bp, Homo sapiens
acagatcatctcgaaacaactat

SEQ ID NO: 7303964 - DNA, 22 bp, Homo sapiens
acagatcacttgactaaaatga

SEQ ID NO: 7303965 - DNA, 22 bp, Homo sapiens
acagaggaagcatatagcacaa

SEQ ID NO: 7303966 - DNA, 22 bp, Homo sapiens
acagaagacagagtgttcatct

SEQ ID NO: 7303967 - DNA, 22 bp, Homo sapiens
acagaagaaagggaggttttgc

SEQ ID NO: 7303968 - DNA, 22 bp, Homo sapiens
aagatacatcattcaggagtga

SEQ ID NO: 7303969 - DNA, 22 bp, Homo sapiens
aagatacatgttaggagcaacc

SEQ ID NO: 7303970 - DNA, 22 bp, Homo sapiens
acagaagagcacatttagtatg

SEQ ID NO: 7303971 - DNA, 22 bp, Homo sapiens
acagaagataactgggaccaga

SEQ ID NO: 7303972 - DNA, 22 bp, Homo sapiens
acagaagataatgctgccttgg

SEQ ID NO: 7303973 - DNA, 22 bp, Homo sapiens
acagaagagctggctctgtgct

SEQ ID NO: 7303974 - DNA, 22 bp, Homo sapiens
aagattttcagctaatggtgca

SEQ ID NO: 7303975 - DNA, 22 bp, Homo sapiens
aagattttctcaactgtatttg

SEQ ID NO: 7303976 - DNA, 22 bp, Homo sapiens
aagatttttttccacagactca

SEQ ID NO: 7303977 - DNA, 22 bp, Homo sapiens
aagcaaaaggttacacttctgg

SEQ ID NO: 7303978 - DNA, 22 bp, Homo sapiens
agcctggtgtggggctgcagag

SEQ ID NO: 7303979 - DNA, 22 bp, Homo sapiens
agcctggggtttcagtttgcac

SEQ ID NO: 7303980 - DNA, 22 bp, Homo sapiens
agctaattagaaatagattatt

SEQ ID NO: 7303981 - DNA, 22 bp, Homo sapiens
agctactcagagttccactcta

SEQ ID NO: 7303982 - DNA, 22 bp, Homo sapiens
agctactctgcagtgcccatgg

SEQ ID NO: 7303983 - DNA, 22 bp, Homo sapiens
agctacctgatccttcttctga

SEQ ID NO: 7303984 - DNA, 22 bp, Homo sapiens
agctacagtcggaaggacagac

SEQ ID NO: 7303985 - DNA, 22 bp, Homo sapiens
agctacagtggacaagtgaact

SEQ ID NO: 7303986 - DNA, 22 bp, Homo sapiens
cagatgtgattcttccctcagc

SEQ ID NO: 7303987 - DNA, 22 bp, Homo sapiens
cagatgtggaatgcagcaggct

SEQ ID NO: 7303988 - DNA, 22 bp, Homo sapiens
agcctgggagacactaagttgt

SEQ ID NO: 7303989 - DNA, 22 bp, Homo sapiens
agctcaggccggagctacaggc

SEQ ID NO: 7303990 - DNA, 22 bp, Homo sapiens
agctcctggatgaggcttatgt

SEQ ID NO: 7303991 - DNA, 22 bp, Homo sapiens
agctcctggaggtgcgcactcg

SEQ ID NO: 7303992 - DNA, 20 bp, Homo sapiens
agctcctggactagagagtg

SEQ ID NO: 7303993 - DNA, 22 bp, Homo sapiens
agctcctggacgaacagggagt

SEQ ID NO: 7303994 - DNA, 19 bp, Homo sapiens
agctcctgattgtgcctcg

SEQ ID NO: 7303995 - DNA, 22 bp, Homo sapiens
agctctttgactaatcttgctt

SEQ ID NO: 7303996 - DNA, 22 bp, Homo sapiens
agctcttccacctcatgatggg

SEQ ID NO: 7303997 - DNA, 22 bp, Homo sapiens
agctctgtaacccattccctgt

SEQ ID NO: 7303998 - DNA, 22 bp, Homo sapiens
agctctgtgttcacagcactaa

SEQ ID NO: 7303999 - DNA, 22 bp, Homo sapiens
agctctgtgcaggcagaggcat

SEQ ID NO: 7304000 - DNA, 22 bp, Homo sapiens
agctctgtgaagccagcagttc

SEQ ID NO: 7304001 - DNA, 22 bp, Homo sapiens
agctcctgtggctgaaagagga

SEQ ID NO: 7304002 - DNA, 22 bp, Homo sapiens
agctcctgtgtgaagcctccct

SEQ ID NO: 7304003 - DNA, 22 bp, Homo sapiens
agctcctgtggcagctcttctg

SEQ ID NO: 7304004 - DNA, 22 bp, Homo sapiens
agctcctggcaaggtcatggtg

SEQ ID NO: 7304005 - DNA, 22 bp, Homo sapiens
agctcctgggagcaggtggtac

SEQ ID NO: 7304006 - DNA, 22 bp, Homo sapiens
agctcctggctttcctctcacc

SEQ ID NO: 7304007 - DNA, 19 bp, Homo sapiens
agctcctgggctctgggcc

SEQ ID NO: 7304008 - DNA, 22 bp, Homo sapiens
agctcctgggccaagcccatgc

SEQ ID NO: 7304009 - DNA, 22 bp, Homo sapiens
agctcctgggcacctctttcac

SEQ ID NO: 7304010 - DNA, 22 bp, Homo sapiens
agctcctgggccatcacaacca

SEQ ID NO: 7304011 - DNA, 22 bp, Homo sapiens
agctcctggtgcctcagccgaa

SEQ ID NO: 7304012 - DNA, 23 bp, Homo sapiens
agctcctgtaaggtggtcgtcac

SEQ ID NO: 7304013 - DNA, 22 bp, Homo sapiens
agctcctggtctttgtccagag

SEQ ID NO: 7304014 - DNA, 22 bp, Homo sapiens
agctcctgtagtacatattatt

SEQ ID NO: 7304015 - DNA, 22 bp, Homo sapiens
agctcctgtctcaagggagcct

SEQ ID NO: 7304016 - DNA, 17 bp, Homo sapiens
agctcctggggtcttta

SEQ ID NO: 7304017 - DNA, 20 bp, Homo sapiens
agctcctggtataggtgcct

SEQ ID NO: 7304018 - DNA, 22 bp, Homo sapiens
agctcctgggggttccaagcag

SEQ ID NO: 7304019 - DNA, 18 bp, Homo sapiens
agctcctggtctcaggga

SEQ ID NO: 7304020 - DNA, 22 bp, Homo sapiens
agccagcaggtgggaaactgga

SEQ ID NO: 7304021 - DNA, 22 bp, Homo sapiens
cactttctcatgaatttggccc

SEQ ID NO: 7304022 - DNA, 23 bp, Homo sapiens
agccagatttctttgcagggcag

SEQ ID NO: 7304023 - DNA, 22 bp, Homo sapiens
cagagacccttctcagtggcca

SEQ ID NO: 7304024 - DNA, 20 bp, Homo sapiens
cagagacccaggcttcagct

SEQ ID NO: 7304025 - DNA, 22 bp, Homo sapiens
cagagaccccgctgcccttctg

SEQ ID NO: 7304026 - DNA, 22 bp, Homo sapiens
cagagaccctaggcaggtgaca

SEQ ID NO: 7304027 - DNA, 22 bp, Homo sapiens
cagagacatgtggcctgcacgt

SEQ ID NO: 7304028 - DNA, 22 bp, Homo sapiens
cagagacattaagtgccatgat

SEQ ID NO: 7304029 - DNA, 22 bp, Homo sapiens
cagagacattaagtgccatgat

SEQ ID NO: 7304030 - DNA, 22 bp, Homo sapiens
cagagacattcagtaaattatc

SEQ ID NO: 7304031 - DNA, 19 bp, Homo sapiens
agccagttggtaagaggct

SEQ ID NO: 7304032 - DNA, 22 bp, Homo sapiens
agccagtttccagatattaact

SEQ ID NO: 7304033 - DNA, 22 bp, Homo sapiens
agccccagcccctctctcacaa

SEQ ID NO: 7304034 - DNA, 22 bp, Homo sapiens
agccccaggatgggccgcagga

SEQ ID NO: 7304035 - DNA, 20 bp, Homo sapiens
agcccatctcccacagctac

SEQ ID NO: 7304036 - DNA, 22 bp, Homo sapiens
agccccacactctctctgagaa

SEQ ID NO: 7304037 - DNA, 20 bp, Homo sapiens
agccccacccttgtcctggc

SEQ ID NO: 7304038 - DNA, 22 bp, Homo sapiens
agccctggctcccagcagcgct

SEQ ID NO: 7304039 - DNA, 22 bp, Homo sapiens
agccctgggcagccaaggaagc

SEQ ID NO: 7304040 - DNA, 22 bp, Homo sapiens
agcccccaaaagtgcttatgat

SEQ ID NO: 7304041 - DNA, 22 bp, Homo sapiens
agcccccacgtttcctgggtcc

SEQ ID NO: 7304042 - DNA, 22 bp, Homo sapiens
agccctggcagagccaggtagt

SEQ ID NO: 7304043 - DNA, 22 bp, Homo sapiens
agccctggcagagccaggtagt

SEQ ID NO: 7304044 - DNA, 22 bp, Homo sapiens
agccctggagcaaaggtgtctt

SEQ ID NO: 7304045 - DNA, 22 bp, Homo sapiens
cacatttaatcctttataagta

SEQ ID NO: 7304046 - DNA, 22 bp, Homo sapiens
cacatttaatcctttataagta

SEQ ID NO: 7304047 - DNA, 22 bp, Homo sapiens
caccagcagcggtgtgagggtg

SEQ ID NO: 7304048 - DNA, 20 bp, Homo sapiens
caccagcagcagctgccacc

SEQ ID NO: 7304049 - DNA, 20 bp, Homo sapiens
caccagcagcagctgccacc

SEQ ID NO: 7304050 - DNA, 22 bp, Homo sapiens
caccagcagaagactgagggtg

SEQ ID NO: 7304051 - DNA, 22 bp, Homo sapiens
caccagcaccagctctgtgcct

SEQ ID NO: 7304052 - DNA, 22 bp, Homo sapiens
agcagggctgcagtgtgtcttt

SEQ ID NO: 7304053 - DNA, 22 bp, Homo sapiens
agcaggaaggggcctagcctgg

SEQ ID NO: 7304054 - DNA, 22 bp, Homo sapiens
agcaggaaggggcctagcctgg

SEQ ID NO: 7304055 - DNA, 22 bp, Homo sapiens
agcaggaaggggatgatgggca

SEQ ID NO: 7304056 - DNA, 22 bp, Homo sapiens
agcaggaactgacaccaagcca

SEQ ID NO: 7304057 - DNA, 22 bp, Homo sapiens
agcaggcttactttctgattag

SEQ ID NO: 7304058 - DNA, 22 bp, Homo sapiens
agcagggaggcggtgtgctggc

SEQ ID NO: 7304059 - DNA, 22 bp, Homo sapiens
agcagggaggcccagggcactg

SEQ ID NO: 7304060 - DNA, 17 bp, Homo sapiens
agcagggagtcaaggga

SEQ ID NO: 7304061 - DNA, 22 bp, Homo sapiens
cacagcagaaatatgaaggcag

SEQ ID NO: 7304062 - DNA, 23 bp, Homo sapiens
agcatggaataggaaagaggcag

SEQ ID NO: 7304063 - DNA, 22 bp, Homo sapiens
agcatgtggctatctttggggg

SEQ ID NO: 7304064 - DNA, 22 bp, Homo sapiens
agcatgtgtggagaaatatttt

SEQ ID NO: 7304065 - DNA, 22 bp, Homo sapiens
cacttaaaactcctggaattgt

SEQ ID NO: 7304066 - DNA, 22 bp, Homo sapiens
cacttaaagtcttagcttacag

SEQ ID NO: 7304067 - DNA, 22 bp, Homo sapiens
cacttaaagtcttagcttacag

SEQ ID NO: 7304068 - DNA, 22 bp, Homo sapiens
cactgttattactactatacat

SEQ ID NO: 7304069 - DNA, 22 bp, Homo sapiens
cactgttattactactatacat

SEQ ID NO: 7304070 - DNA, 22 bp, Homo sapiens
cactgtgtcagagtatgatgat

SEQ ID NO: 7304071 - DNA, 18 bp, Homo sapiens
agcaggttctcacagcca

SEQ ID NO: 7304072 - DNA, 21 bp, Homo sapiens
agcatgcactacttcatctta

SEQ ID NO: 7304073 - DNA, 23 bp, Homo sapiens
agcagtgagtaaacagataggat

SEQ ID NO: 7304074 - DNA, 20 bp, Homo sapiens
agcagagtgcccatcccgga

SEQ ID NO: 7304075 - DNA, 22 bp, Homo sapiens
agcagagtcttcaagggcaggc

SEQ ID NO: 7304076 - DNA, 22 bp, Homo sapiens
agcagagctgggatcctgggtc

SEQ ID NO: 7304077 - DNA, 22 bp, Homo sapiens
agcagagcggggcctccggaag

SEQ ID NO: 7304078 - DNA, 22 bp, Homo sapiens
agcagagcgcctgctcagaggg

SEQ ID NO: 7304079 - DNA, 22 bp, Homo sapiens
agcagagaggaggtggccctgt

SEQ ID NO: 7304080 - DNA, 22 bp, Homo sapiens
agcactgattttgttgcactta

SEQ ID NO: 7304081 - DNA, 22 bp, Homo sapiens
agcactgatttaaactggattt

SEQ ID NO: 7304082 - DNA, 22 bp, Homo sapiens
caaaggcatcggcaattaggga

SEQ ID NO: 7304083 - DNA, 22 bp, Homo sapiens
agcagctcccctcatgctccac

SEQ ID NO: 7304084 - DNA, 22 bp, Homo sapiens
agcagctcaacagtgtctctat

SEQ ID NO: 7304085 - DNA, 22 bp, Homo sapiens
cacagagcaactcaaatcagct

SEQ ID NO: 7304086 - DNA, 23 bp, Homo sapiens
agcagcccaatggcaagctctgg

SEQ ID NO: 7304087 - DNA, 22 bp, Homo sapiens
agcagccctatgtaattggact

SEQ ID NO: 7304088 - DNA, 22 bp, Homo sapiens
agcagccctagggattgctgtt

SEQ ID NO: 7304089 - DNA, 22 bp, Homo sapiens
agcagcccctcggcgggtgcgc

SEQ ID NO: 7304090 - DNA, 22 bp, Homo sapiens
agcagcccgaggatcatgtgtc

SEQ ID NO: 7304091 - DNA, 22 bp, Homo sapiens
agcagcccaggcaaagataaaa

SEQ ID NO: 7304092 - DNA, 23 bp, Homo sapiens
agcagcccagatgccttccatcc

SEQ ID NO: 7304093 - DNA, 22 bp, Homo sapiens
agcagcccagataaagctcagg

SEQ ID NO: 7304094 - DNA, 22 bp, Homo sapiens
agcagcccagttgtactgagtg

SEQ ID NO: 7304095 - DNA, 23 bp, Homo sapiens
agcagccctgggacctggcctgc

SEQ ID NO: 7304096 - DNA, 22 bp, Homo sapiens
agcagcagaggtcagaaaggta

SEQ ID NO: 7304097 - DNA, 22 bp, Homo sapiens
agcagcagaggtcagaaaggta

SEQ ID NO: 7304098 - DNA, 22 bp, Homo sapiens
agcagcagatcaaacaggcttg

SEQ ID NO: 7304099 - DNA, 22 bp, Homo sapiens
caatacagcacacctgtatcag

SEQ ID NO: 7304100 - DNA, 22 bp, Homo sapiens
caatacagcacacctgtatcag

SEQ ID NO: 7304101 - DNA, 22 bp, Homo sapiens
caatacatcaggtcaaaatgtg

SEQ ID NO: 7304102 - DNA, 22 bp, Homo sapiens
caatacaattaccagttaatca

SEQ ID NO: 7304103 - DNA, 18 bp, Homo sapiens
caatactgagaggtgggg

SEQ ID NO: 7304104 - DNA, 22 bp, Homo sapiens
caatactgagtttacattcatc

SEQ ID NO: 7304105 - DNA, 16 bp, Homo sapiens
caatacatggcatttc

SEQ ID NO: 7304106 - DNA, 22 bp, Homo sapiens
agacttctcttggctatattat

SEQ ID NO: 7304107 - DNA, 22 bp, Homo sapiens
agacttcttgagctggcacttc

SEQ ID NO: 7304108 - DNA, 22 bp, Homo sapiens
agactttatagtttttggctat

SEQ ID NO: 7304109 - DNA, 22 bp, Homo sapiens
agactgttaatttcaattaaaa

SEQ ID NO: 7304110 - DNA, 22 bp, Homo sapiens
agactgttgatggctgaattca

SEQ ID NO: 7304111 - DNA, 22 bp, Homo sapiens
agactgtattcaaaatgtggtt

SEQ ID NO: 7304112 - DNA, 22 bp, Homo sapiens
agagaaaagagttcaggctttg

SEQ ID NO: 7304113 - DNA, 23 bp, Homo sapiens
agagaaaaatatctgggcacatt

SEQ ID NO: 7304114 - DNA, 19 bp, Homo sapiens
agacttttgtaagttgaga

SEQ ID NO: 7304115 - DNA, 22 bp, Homo sapiens
agagacaatgccaatgcacacg

SEQ ID NO: 7304116 - DNA, 22 bp, Homo sapiens
agagacaatgccaatgcacacg

SEQ ID NO: 7304117 - DNA, 22 bp, Homo sapiens
agagacaatgccaatgcacacg

SEQ ID NO: 7304118 - DNA, 22 bp, Homo sapiens
agagacaagggacctctggaga

SEQ ID NO: 7304119 - DNA, 22 bp, Homo sapiens
agagacaagaaatacctgggac

SEQ ID NO: 7304120 - DNA, 21 bp, Homo sapiens
agagacagagaaagtaacatt

SEQ ID NO: 7304121 - DNA, 21 bp, Homo sapiens
agagacagagaaagtaacatt

SEQ ID NO: 7304122 - DNA, 21 bp, Homo sapiens
agagagaaggccatatggtcc

SEQ ID NO: 7304123 - DNA, 22 bp, Homo sapiens
agagaggtctcaggagaaacca

SEQ ID NO: 7304124 - DNA, 22 bp, Homo sapiens
agagctggatggtcaagatggc

SEQ ID NO: 7304125 - DNA, 22 bp, Homo sapiens
agagctggagcagccccactgg

SEQ ID NO: 7304126 - DNA, 22 bp, Homo sapiens
agagctggccagggatcactct

SEQ ID NO: 7304127 - DNA, 22 bp, Homo sapiens
agagctggccagggatcactct

SEQ ID NO: 7304128 - DNA, 22 bp, Homo sapiens
agagctggccagggatcactct

SEQ ID NO: 7304129 - DNA, 22 bp, Homo sapiens
agagctggctgtgggtgacttt

SEQ ID NO: 7304130 - DNA, 22 bp, Homo sapiens
agagcctgaggccctgagaggg

SEQ ID NO: 7304131 - DNA, 22 bp, Homo sapiens
agagcacggccaccatttacaa

SEQ ID NO: 7304132 - DNA, 22 bp, Homo sapiens
agagcagatggagctggaagag

SEQ ID NO: 7304133 - DNA, 22 bp, Homo sapiens
agagcagcacgttgtccccaca

SEQ ID NO: 7304134 - DNA, 22 bp, Homo sapiens
agagcccaggtcctggagaggg

SEQ ID NO: 7304135 - DNA, 20 bp, Homo sapiens
agagcccagatgtctgtatt

SEQ ID NO: 7304136 - DNA, 22 bp, Homo sapiens
agagcccagtctttgtgtgaag

SEQ ID NO: 7304137 - DNA, 22 bp, Homo sapiens
agagcccctgggtcacacagcc

SEQ ID NO: 7304138 - DNA, 22 bp, Homo sapiens
atgatatacttcctagaacagt

SEQ ID NO: 7304139 - DNA, 22 bp, Homo sapiens
atgatatacttcctagaacagt

SEQ ID NO: 7304140 - DNA, 20 bp, Homo sapiens
atgatagtcagaaaactagc

SEQ ID NO: 7304141 - DNA, 22 bp, Homo sapiens
atgcaggtaaccacacttcaca

SEQ ID NO: 7304142 - DNA, 22 bp, Homo sapiens
atgatacattgcaaaattttaa

SEQ ID NO: 7304143 - DNA, 20 bp, Homo sapiens
agacagaatcagagataaag

SEQ ID NO: 7304144 - DNA, 22 bp, Homo sapiens
atgcctgtgctatattctcaca

SEQ ID NO: 7304145 - DNA, 22 bp, Homo sapiens
atgccttatagtccacagtgga

SEQ ID NO: 7304146 - DNA, 22 bp, Homo sapiens
atgcctggtcccacctctaggt

SEQ ID NO: 7304147 - DNA, 22 bp, Homo sapiens
atgcctttttatcatggatgat

SEQ ID NO: 7304148 - DNA, 22 bp, Homo sapiens
agacccaggattggggctgccg

SEQ ID NO: 7304149 - DNA, 22 bp, Homo sapiens
agacccaggcttcatgtgaatc

SEQ ID NO: 7304150 - DNA, 22 bp, Homo sapiens
agacctggagtgaagagttccc

SEQ ID NO: 7304151 - DNA, 22 bp, Homo sapiens
atgccaattgcaggaagaaaac

SEQ ID NO: 7304152 - DNA, 22 bp, Homo sapiens
atgccaagttgacaaggggtgg

SEQ ID NO: 7304153 - DNA, 22 bp, Homo sapiens
atgccaagtatgattcacatgt

SEQ ID NO: 7304154 - DNA, 21 bp, Homo sapiens
atgccaagtcttaatgagggc

SEQ ID NO: 7304155 - DNA, 22 bp, Homo sapiens
atgccaagctctatccctgacc

SEQ ID NO: 7304156 - DNA, 22 bp, Homo sapiens
atgccaagcttcagctgaaact

SEQ ID NO: 7304157 - DNA, 22 bp, Homo sapiens
atgccaagtacaggcactgctc

SEQ ID NO: 7304158 - DNA, 20 bp, Homo sapiens
atgccaagctatctagaatc

SEQ ID NO: 7304159 - DNA, 22 bp, Homo sapiens
atgccaagaatcatatgccagg

SEQ ID NO: 7304160 - DNA, 22 bp, Homo sapiens
agacctggtttatcaccagcat

SEQ ID NO: 7304161 - DNA, 22 bp, Homo sapiens
agacctgtgatcacatggaatg

SEQ ID NO: 7304162 - DNA, 22 bp, Homo sapiens
agacctgttgggttcattggct

SEQ ID NO: 7304163 - DNA, 22 bp, Homo sapiens
agaatcaaagagaaatactttg

SEQ ID NO: 7304164 - DNA, 22 bp, Homo sapiens
atgaggcttaaactgctgcaac

SEQ ID NO: 7304165 - DNA, 22 bp, Homo sapiens
agacacattttacattaactgt

SEQ ID NO: 7304166 - DNA, 22 bp, Homo sapiens
agacaacatgatcagcagtcct

SEQ ID NO: 7304167 - DNA, 22 bp, Homo sapiens
agacaacatcactaaagctgag

SEQ ID NO: 7304168 - DNA, 22 bp, Homo sapiens
agacaactgcagagcaaagaat

SEQ ID NO: 7304169 - DNA, 22 bp, Homo sapiens
agacaagaaactgggagtctct

SEQ ID NO: 7304170 - DNA, 22 bp, Homo sapiens
atctgcttagaattcattgtcc

SEQ ID NO: 7304171 - DNA, 22 bp, Homo sapiens
atctgctgcccagccacttgct

SEQ ID NO: 7304172 - DNA, 19 bp, Homo sapiens
atctgccttagtgctgctg

SEQ ID NO: 7304173 - DNA, 22 bp, Homo sapiens
atctgcctggtctttgatgcag

SEQ ID NO: 7304174 - DNA, 22 bp, Homo sapiens
atctgcttgagtttgaagtcag

SEQ ID NO: 7304175 - DNA, 22 bp, Homo sapiens
atctgcttgccctcttaggacc

SEQ ID NO: 7304176 - DNA, 22 bp, Homo sapiens
atctgcttgccctcttaggacc

SEQ ID NO: 7304177 - DNA, 21 bp, Homo sapiens
atctgcttaggtttgttcaga

SEQ ID NO: 7304178 - DNA, 21 bp, Homo sapiens
atctgcttaggtttgttcaga

SEQ ID NO: 7304179 - DNA, 22 bp, Homo sapiens
atctgcttcagtgatatgtgaa

SEQ ID NO: 7304180 - DNA, 22 bp, Homo sapiens
atctgcttcctccttagggaaa

SEQ ID NO: 7304181 - DNA, 22 bp, Homo sapiens
atctgcttgaaacttcttatac

SEQ ID NO: 7304182 - DNA, 22 bp, Homo sapiens
atctgcttgaaacttcttatac

SEQ ID NO: 7304183 - DNA, 22 bp, Homo sapiens
atgaagggaatataagtgctgc

SEQ ID NO: 7304184 - DNA, 22 bp, Homo sapiens
atgaagctgaaaaaggcatata

SEQ ID NO: 7304185 - DNA, 22 bp, Homo sapiens
agaatatagttaccaaattctg

SEQ ID NO: 7304186 - DNA, 22 bp, Homo sapiens
agatcatattgtaactttattg

SEQ ID NO: 7304187 - DNA, 22 bp, Homo sapiens
agatcattaaccacctgttctg

SEQ ID NO: 7304188 - DNA, 22 bp, Homo sapiens
agatggaaaatatagacagaga

SEQ ID NO: 7304189 - DNA, 22 bp, Homo sapiens
agatgcttcagtgtttaattta

SEQ ID NO: 7304190 - DNA, 22 bp, Homo sapiens
agatgctgtcacacacactgtt

SEQ ID NO: 7304191 - DNA, 22 bp, Homo sapiens
agatggagtggagatgagtaaa

SEQ ID NO: 7304192 - DNA, 22 bp, Homo sapiens
agatggcttccttctcactgtg

SEQ ID NO: 7304193 - DNA, 22 bp, Homo sapiens
agatatttgtatcttgctattg

SEQ ID NO: 7304194 - DNA, 22 bp, Homo sapiens
agatatttgtatcttgctattg

SEQ ID NO: 7304195 - DNA, 22 bp, Homo sapiens
agatatttaaatcagacaaaga

SEQ ID NO: 7304196 - DNA, 22 bp, Homo sapiens
agatatttgtatcttgctattg

SEQ ID NO: 7304197 - DNA, 22 bp, Homo sapiens
agatatttaaatcagacaaaga

SEQ ID NO: 7304198 - DNA, 22 bp, Homo sapiens
agatatttaaatcagacaaaga

SEQ ID NO: 7304199 - DNA, 22 bp, Homo sapiens
agatattttgtgtgatgtttca

SEQ ID NO: 7304200 - DNA, 22 bp, Homo sapiens
agatcacagtcaattgcaagtt

SEQ ID NO: 7304201 - DNA, 22 bp, Homo sapiens
agatcacagtcaattgcaagtt

SEQ ID NO: 7304202 - DNA, 22 bp, Homo sapiens
agatcacataatttcctgtgac

SEQ ID NO: 7304203 - DNA, 23 bp, Homo sapiens
agatcacatgctgatggaaaatg

SEQ ID NO: 7304204 - DNA, 22 bp, Homo sapiens
attgggaagatttagatccact

SEQ ID NO: 7304205 - DNA, 22 bp, Homo sapiens
attggtcacctccctcagctct

SEQ ID NO: 7304206 - DNA, 22 bp, Homo sapiens
attggtcagagtaaatttattt

SEQ ID NO: 7304207 - DNA, 22 bp, Homo sapiens
attggtcaggactggcatgtgg

SEQ ID NO: 7304208 - DNA, 22 bp, Homo sapiens
attggtcagccacgtagggaat

SEQ ID NO: 7304209 - DNA, 22 bp, Homo sapiens
attggtcataaattgagtgatt

SEQ ID NO: 7304210 - DNA, 22 bp, Homo sapiens
attggtcatgtttttgtggtaa

SEQ ID NO: 7304211 - DNA, 22 bp, Homo sapiens
attggtcattttggtttagaag

SEQ ID NO: 7304212 - DNA, 22 bp, Homo sapiens
attggtctaggctttaaaaaga

SEQ ID NO: 7304213 - DNA, 22 bp, Homo sapiens
attggggagagctaatatttta

SEQ ID NO: 7304214 - DNA, 22 bp, Homo sapiens
attggtcaagtcttgcaggtga

SEQ ID NO: 7304215 - DNA, 22 bp, Homo sapiens
agcaagaagctttgctgtgata

SEQ ID NO: 7304216 - DNA, 20 bp, Homo sapiens
agcaagagtaaggacagcga

SEQ ID NO: 7304217 - DNA, 17 bp, Homo sapiens
caaaccagtaagactgc

SEQ ID NO: 7304218 - DNA, 22 bp, Homo sapiens
caaagataatcacagaataccc

SEQ ID NO: 7304219 - DNA, 22 bp, Homo sapiens
agcaaatcagctgctcaggaaa

SEQ ID NO: 7304220 - DNA, 22 bp, Homo sapiens
agatgtttaaaaagatgactct

SEQ ID NO: 7304221 - DNA, 18 bp, Homo sapiens
agatgttcaatatttctc

SEQ ID NO: 7304222 - DNA, 22 bp, Homo sapiens
agatgtttataactcatgagtg

SEQ ID NO: 7304223 - DNA, 22 bp, Homo sapiens
agatgtgggagatgcttctgca

SEQ ID NO: 7304224 - DNA, 22 bp, Homo sapiens
agatgtggttattctcttcctt

SEQ ID NO: 7304225 - DNA, 22 bp, Homo sapiens
attttatgacacgattcttcca

SEQ ID NO: 7304226 - DNA, 22 bp, Homo sapiens
attttcaaaacatctgctgtgt

SEQ ID NO: 7304227 - DNA, 22 bp, Homo sapiens
agatgtggatgagtcgccgacc

SEQ ID NO: 7304228 - DNA, 22 bp, Homo sapiens
agatgtgggagatgcttctgca

SEQ ID NO: 7304229 - DNA, 22 bp, Homo sapiens
agagggctgggatgtgctgtgt

SEQ ID NO: 7304230 - DNA, 22 bp, Homo sapiens
agagggcttccctaggagtgag

SEQ ID NO: 7304231 - DNA, 22 bp, Homo sapiens
agaggggaagtaatgaatgata

SEQ ID NO: 7304232 - DNA, 22 bp, Homo sapiens
agaggctgtcccttgctattcc

SEQ ID NO: 7304233 - DNA, 22 bp, Homo sapiens
agaggctgggtacgggccacct

SEQ ID NO: 7304234 - DNA, 18 bp, Homo sapiens
agaggggaggtaagtctg

SEQ ID NO: 7304235 - DNA, 22 bp, Homo sapiens
agaggggagagctaagcaattc

SEQ ID NO: 7304236 - DNA, 22 bp, Homo sapiens
agagtcaccaaagtaaaacagt

SEQ ID NO: 7304237 - DNA, 23 bp, Homo sapiens
agagtccacaagattttccagtg

SEQ ID NO: 7304238 - DNA, 22 bp, Homo sapiens
agagtcatagtttaacttttgt

SEQ ID NO: 7304239 - DNA, 22 bp, Homo sapiens
agagtcagcttatgacacagtc

SEQ ID NO: 7304240 - DNA, 22 bp, Homo sapiens
agagtcagaaagcagacagggg

SEQ ID NO: 7304241 - DNA, 22 bp, Homo sapiens
agagtccatatgtgggaggagt

SEQ ID NO: 7304242 - DNA, 22 bp, Homo sapiens
agagtctgaatgctcagagttg

SEQ ID NO: 7304243 - DNA, 22 bp, Homo sapiens
agaggctggattgagcatagac

SEQ ID NO: 7304244 - DNA, 22 bp, Homo sapiens
agaggctgcacttgctcatgat

SEQ ID NO: 7304245 - DNA, 22 bp, Homo sapiens
attacagattataaatttgagc

SEQ ID NO: 7304246 - DNA, 22 bp, Homo sapiens
attacagtaacagctacaatgc

SEQ ID NO: 7304247 - DNA, 22 bp, Homo sapiens
attacagagggtcggtcgtttt

SEQ ID NO: 7304248 - DNA, 22 bp, Homo sapiens
attacagaaatatggtcaaaga

SEQ ID NO: 7304249 - DNA, 22 bp, Homo sapiens
attacagaagatatgctcaaca

SEQ ID NO: 7304250 - DNA, 22 bp, Homo sapiens
attacagaaagcaatattgagt

SEQ ID NO: 7304251 - DNA, 22 bp, Homo sapiens
attacagaaagcaatattgagt

SEQ ID NO: 7304252 - DNA, 22 bp, Homo sapiens
attacacagcggttactactag

SEQ ID NO: 7304253 - DNA, 22 bp, Homo sapiens
attacacactcaagtcctgtta

SEQ ID NO: 7304254 - DNA, 22 bp, Homo sapiens
attacacagcggttactactag

SEQ ID NO: 7304255 - DNA, 22 bp, Homo sapiens
attacacagcggttactactag

SEQ ID NO: 7304256 - DNA, 22 bp, Homo sapiens
agagctgggaccgtctggaagt

SEQ ID NO: 7304257 - DNA, 20 bp, Homo sapiens
agagctgggaagctccctat

SEQ ID NO: 7304258 - DNA, 22 bp, Homo sapiens
agagctgggaccgtctggaagt

SEQ ID NO: 7304259 - DNA, 21 bp, Homo sapiens
agagctgggacttgcctgaga

SEQ ID NO: 7304260 - DNA, 22 bp, Homo sapiens
agtactttttgttcaattgtgc

SEQ ID NO: 7304261 - DNA, 22 bp, Homo sapiens
agtactttacttcttacagttt

SEQ ID NO: 7304262 - DNA, 22 bp, Homo sapiens
agtacttttttgatatctgagt

SEQ ID NO: 7304263 - DNA, 22 bp, Homo sapiens
agtagtttgggcagtgacagat

SEQ ID NO: 7304264 - DNA, 22 bp, Homo sapiens
agtatacaaataaatgtgtaat

SEQ ID NO: 7304265 - DNA, 22 bp, Homo sapiens
agtatacaaataaatgtgtaat

SEQ ID NO: 7304266 - DNA, 22 bp, Homo sapiens
aggtggggaaaccagcgatccc

SEQ ID NO: 7304267 - DNA, 22 bp, Homo sapiens
agtacatttagtttatgaacat

SEQ ID NO: 7304268 - DNA, 23 bp, Homo sapiens
agtacatttgacccaaataagct

SEQ ID NO: 7304269 - DNA, 22 bp, Homo sapiens
actctccttttgatcttcagaa

SEQ ID NO: 7304270 - DNA, 22 bp, Homo sapiens
actctctgggcatgccccacca

SEQ ID NO: 7304271 - DNA, 22 bp, Homo sapiens
actctctggtgtagaaagacct

SEQ ID NO: 7304272 - DNA, 22 bp, Homo sapiens
actctctgtctaaatgcagttt

SEQ ID NO: 7304273 - DNA, 22 bp, Homo sapiens
agtcacttcctgcttgacctga

SEQ ID NO: 7304274 - DNA, 22 bp, Homo sapiens
agtcacttcatggtttcttgga

SEQ ID NO: 7304275 - DNA, 22 bp, Homo sapiens
agtcacttaataggttcatctg

SEQ ID NO: 7304276 - DNA, 22 bp, Homo sapiens
agtcacttaacatttgctgcag

SEQ ID NO: 7304277 - DNA, 22 bp, Homo sapiens
agtcactaggctgaaagtggag

SEQ ID NO: 7304278 - DNA, 22 bp, Homo sapiens
actcctgggttccggagattct

SEQ ID NO: 7304279 - DNA, 22 bp, Homo sapiens
actcctgggtgcatttctgatt

SEQ ID NO: 7304280 - DNA, 22 bp, Homo sapiens
actcctgggtgctgaccagcgt

SEQ ID NO: 7304281 - DNA, 22 bp, Homo sapiens
actcctggggatccattccttt

SEQ ID NO: 7304282 - DNA, 22 bp, Homo sapiens
actcctggaaaagaacgcaggg

SEQ ID NO: 7304283 - DNA, 22 bp, Homo sapiens
actcctggggctgccatcacag

SEQ ID NO: 7304284 - DNA, 22 bp, Homo sapiens
actactgatgtaaaggagcaat

SEQ ID NO: 7304285 - DNA, 22 bp, Homo sapiens
actacatttcctgacccctgtg

SEQ ID NO: 7304286 - DNA, 22 bp, Homo sapiens
actacatttctcagtacctgaa

SEQ ID NO: 7304287 - DNA, 22 bp, Homo sapiens
actacattcatgctcgtgttgg

SEQ ID NO: 7304288 - DNA, 22 bp, Homo sapiens
aggtgactggtttatctggcag

SEQ ID NO: 7304289 - DNA, 22 bp, Homo sapiens
actacagtccctcatatgttgg

SEQ ID NO: 7304290 - DNA, 22 bp, Homo sapiens
aggtgactggtttatctggcag

SEQ ID NO: 7304291 - DNA, 22 bp, Homo sapiens
aggtgacaggatgcagataaac

SEQ ID NO: 7304292 - DNA, 21 bp, Homo sapiens
acctttgggtgtttataatag

SEQ ID NO: 7304293 - DNA, 20 bp, Homo sapiens
aggtccactgaggctgcctc

SEQ ID NO: 7304294 - DNA, 22 bp, Homo sapiens
aggtcaagagtaaatttgggta

SEQ ID NO: 7304295 - DNA, 22 bp, Homo sapiens
agtgaaggaaacaattggttga

SEQ ID NO: 7304296 - DNA, 22 bp, Homo sapiens
agtgaaggtttacagggcccct

SEQ ID NO: 7304297 - DNA, 22 bp, Homo sapiens
agtgaaggaagtttgtcttggg

SEQ ID NO: 7304298 - DNA, 22 bp, Homo sapiens
agtgctctgggtccactccaga

SEQ ID NO: 7304299 - DNA, 22 bp, Homo sapiens
agtgctctcatgctgactatta

SEQ ID NO: 7304300 - DNA, 22 bp, Homo sapiens
agtgctctctccccagtgctac

SEQ ID NO: 7304301 - DNA, 22 bp, Homo sapiens
actgcagcctagggaccacagt

SEQ ID NO: 7304302 - DNA, 22 bp, Homo sapiens
actctgaaatagaggctggtgg

SEQ ID NO: 7304303 - DNA, 22 bp, Homo sapiens
actgcctgatgtggttctaaat

SEQ ID NO: 7304304 - DNA, 22 bp, Homo sapiens
actgcctgcatccttagggtag

SEQ ID NO: 7304305 - DNA, 19 bp, Homo sapiens
actgcctgcaggtgttggg

SEQ ID NO: 7304306 - DNA, 23 bp, Homo sapiens
actgcctgctactatgcccacgg

SEQ ID NO: 7304307 - DNA, 22 bp, Homo sapiens
actgcctgccttccaggtactg

SEQ ID NO: 7304308 - DNA, 22 bp, Homo sapiens
actgcctgcctctgattctgca

SEQ ID NO: 7304309 - DNA, 22 bp, Homo sapiens
actgcctgtagccctgagatgt

SEQ ID NO: 7304310 - DNA, 22 bp, Homo sapiens
actgcctgtagccctgagatgt

SEQ ID NO: 7304311 - DNA, 22 bp, Homo sapiens
actgcctgtagctcttcatctc

SEQ ID NO: 7304312 - DNA, 18 bp, Homo sapiens
actgcctggcgaagatag

SEQ ID NO: 7304313 - DNA, 21 bp, Homo sapiens
actgcctggggtgctggccaa

SEQ ID NO: 7304314 - DNA, 22 bp, Homo sapiens
actgcctgctcctggctccaca

SEQ ID NO: 7304315 - DNA, 22 bp, Homo sapiens
actgcctgctcataacattgct

SEQ ID NO: 7304316 - DNA, 22 bp, Homo sapiens
actgcctggcagaggtttgcaa

SEQ ID NO: 7304317 - DNA, 22 bp, Homo sapiens
actgcctggcctggcctcactg

SEQ ID NO: 7304318 - DNA, 22 bp, Homo sapiens
actgcctgagctattggaaaag

SEQ ID NO: 7304319 - DNA, 19 bp, Homo sapiens
actgcctgaggctcacagg

SEQ ID NO: 7304320 - DNA, 22 bp, Homo sapiens
actgccaatggtagtttgatgg

SEQ ID NO: 7304321 - DNA, 22 bp, Homo sapiens
actgccaggatggcactagagg

SEQ ID NO: 7304322 - DNA, 22 bp, Homo sapiens
actgccaggccagtagaacata

SEQ ID NO: 7304323 - DNA, 22 bp, Homo sapiens
actgccattttgaataattact

SEQ ID NO: 7304324 - DNA, 22 bp, Homo sapiens
actgggaggcaaagagcaagga

SEQ ID NO: 7304325 - DNA, 22 bp, Homo sapiens
actggcttcagggggaaagtcc

SEQ ID NO: 7304326 - DNA, 22 bp, Homo sapiens
actggcttgaagtagattcaaa

SEQ ID NO: 7304327 - DNA, 23 bp, Homo sapiens
acttttcaattagctatgcttaa

SEQ ID NO: 7304328 - DNA, 20 bp, Homo sapiens
atagatatcatctttagaag

SEQ ID NO: 7304329 - DNA, 22 bp, Homo sapiens
atagatacttataacaattgtg

SEQ ID NO: 7304330 - DNA, 20 bp, Homo sapiens
atagatatcatctttagaag

SEQ ID NO: 7304331 - DNA, 22 bp, Homo sapiens
actttgggaagctgcaattgcc

SEQ ID NO: 7304332 - DNA, 22 bp, Homo sapiens
actttgggacccagccaaccct

SEQ ID NO: 7304333 - DNA, 22 bp, Homo sapiens
atagagtgatgtaaggtatgtg

SEQ ID NO: 7304334 - DNA, 21 bp, Homo sapiens
actttgggaggtgtgaggggc

SEQ ID NO: 7304335 - DNA, 22 bp, Homo sapiens
atacatcatgctccatatattt

SEQ ID NO: 7304336 - DNA, 22 bp, Homo sapiens
atacatcatttcccatcaatcg

SEQ ID NO: 7304337 - DNA, 22 bp, Homo sapiens
atacatcatttcccatcaatcg

SEQ ID NO: 7304338 - DNA, 22 bp, Homo sapiens
atacatcatttatggaataagg

SEQ ID NO: 7304339 - DNA, 22 bp, Homo sapiens
atacatcatttcccatcaatcg

SEQ ID NO: 7304340 - DNA, 22 bp, Homo sapiens
atacatcatttatgatgtgtgt

SEQ ID NO: 7304341 - DNA, 22 bp, Homo sapiens
atacatctagagtcataaaaac

SEQ ID NO: 7304342 - DNA, 22 bp, Homo sapiens
atacaaagacaaatctcaatct

SEQ ID NO: 7304343 - DNA, 22 bp, Homo sapiens
atacaaaatatatactggagac

SEQ ID NO: 7304344 - DNA, 22 bp, Homo sapiens
atacaaaaattagccgggagta

SEQ ID NO: 7304345 - DNA, 22 bp, Homo sapiens
actttacacatcttttctcatt

SEQ ID NO: 7304346 - DNA, 22 bp, Homo sapiens
atacatatccacaggagataaa

SEQ ID NO: 7304347 - DNA, 22 bp, Homo sapiens
atacatatccacaggagataaa

SEQ ID NO: 7304348 - DNA, 22 bp, Homo sapiens
atacatcacctatatattcaca

SEQ ID NO: 7304349 - DNA, 22 bp, Homo sapiens
atacatcacctatatattcaca

SEQ ID NO: 7304350 - DNA, 22 bp, Homo sapiens
atacatcaatttcttagttatc

SEQ ID NO: 7304351 - DNA, 22 bp, Homo sapiens
atacatcaaggatgatggtgta

SEQ ID NO: 7304352 - DNA, 22 bp, Homo sapiens
acttcctggctgggtgacctgg

SEQ ID NO: 7304353 - DNA, 22 bp, Homo sapiens
ataaagtggaggtagtattcat

SEQ ID NO: 7304354 - DNA, 22 bp, Homo sapiens
ataaagtggaagtgttaaaggg

SEQ ID NO: 7304355 - DNA, 22 bp, Homo sapiens
acttctctcattcagacatagc

SEQ ID NO: 7304356 - DNA, 22 bp, Homo sapiens
acttctaagctcaaattggtat

SEQ ID NO: 7304357 - DNA, 22 bp, Homo sapiens
acttcctgtgttggtcttgctg

SEQ ID NO: 7304358 - DNA, 22 bp, Homo sapiens
acttcctgttatgtgtgcctct

SEQ ID NO: 7304359 - DNA, 22 bp, Homo sapiens
actgttttgtgccttagtttcc

SEQ ID NO: 7304360 - DNA, 22 bp, Homo sapiens
acttaaaaacagatccagcagg

SEQ ID NO: 7304361 - DNA, 22 bp, Homo sapiens
actgtttctcaaattatgtggt

SEQ ID NO: 7304362 - DNA, 22 bp, Homo sapiens
actgtttctgccacaatagccc

SEQ ID NO: 7304363 - DNA, 22 bp, Homo sapiens
actgttttctaaagaacagatg

SEQ ID NO: 7304364 - DNA, 22 bp, Homo sapiens
actgttttcctaatgagcaaga

SEQ ID NO: 7304365 - DNA, 22 bp, Homo sapiens
acttaaaaagaatcttttcacg

SEQ ID NO: 7304366 - DNA, 22 bp, Homo sapiens
ataaagtagccactggaaagct

SEQ ID NO: 7304367 - DNA, 22 bp, Homo sapiens
ataaagtctaccgtattaaaga

SEQ ID NO: 7304368 - DNA, 18 bp, Homo sapiens
ataaagtgctaataatgg

SEQ ID NO: 7304369 - DNA, 23 bp, Homo sapiens
agtttttaatggtcatagctgag

SEQ ID NO: 7304370 - DNA, 21 bp, Homo sapiens
agtttttactcttaactgtgg

SEQ ID NO: 7304371 - DNA, 21 bp, Homo sapiens
agtttttactcttaactgtgg

SEQ ID NO: 7304372 - DNA, 21 bp, Homo sapiens
agtttttactcttaactgtgg

SEQ ID NO: 7304373 - DNA, 18 bp, Homo sapiens
agtttttaggaagaaatg

SEQ ID NO: 7304374 - DNA, 18 bp, Homo sapiens
agtttttaggaagaaatg

SEQ ID NO: 7304375 - DNA, 22 bp, Homo sapiens
agtttttctcccctggcttcat

SEQ ID NO: 7304376 - DNA, 22 bp, Homo sapiens
ataaaaactgacccatcctttg

SEQ ID NO: 7304377 - DNA, 22 bp, Homo sapiens
actgttatttcaccactactga

SEQ ID NO: 7304378 - DNA, 22 bp, Homo sapiens
agttttaaatgatggtggtggt

SEQ ID NO: 7304379 - DNA, 22 bp, Homo sapiens
agaaatcattgaattatttgct

SEQ ID NO: 7304380 - DNA, 22 bp, Homo sapiens
agaaatcattttaggcttgatg

SEQ ID NO: 7304381 - DNA, 20 bp, Homo sapiens
atccaggatgttgatttgaa

SEQ ID NO: 7304382 - DNA, 22 bp, Homo sapiens
agaaatcttatcaagaaatgcc

SEQ ID NO: 7304383 - DNA, 22 bp, Homo sapiens
agaaccagtttaagatttgggt

SEQ ID NO: 7304384 - DNA, 22 bp, Homo sapiens
agaaggagtgtacaggtcatgc

SEQ ID NO: 7304385 - DNA, 22 bp, Homo sapiens
atctgcccatctgtcctgcttc

SEQ ID NO: 7304386 - DNA, 22 bp, Homo sapiens
atctctggcccctggggtccga

SEQ ID NO: 7304387 - DNA, 22 bp, Homo sapiens
agaaatcattcccaaacccata

SEQ ID NO: 7304388 - DNA, 22 bp, Homo sapiens
agaaatcattcccaaacccata

SEQ ID NO: 7304389 - DNA, 22 bp, Homo sapiens
agaaatcatgtcttatttctat

SEQ ID NO: 7304390 - DNA, 22 bp, Homo sapiens
agaaatcatgactaagagcagt

SEQ ID NO: 7304391 - DNA, 22 bp, Homo sapiens
agaaatcaggaacagtaaggag

SEQ ID NO: 7304392 - DNA, 22 bp, Homo sapiens
agaaatcaggaacagtaaggag

SEQ ID NO: 7304393 - DNA, 22 bp, Homo sapiens
agaaatcatgactaagagcagt

SEQ ID NO: 7304394 - DNA, 23 bp, Homo sapiens
agaaatcatctccaccccatgtc

SEQ ID NO: 7304395 - DNA, 22 bp, Homo sapiens
atcagtttaaatgggctgttgg

SEQ ID NO: 7304396 - DNA, 22 bp, Homo sapiens
atcagtgatcttgtttgccaga

SEQ ID NO: 7304397 - DNA, 22 bp, Homo sapiens
atcagtgacctgaaatgttttt

SEQ ID NO: 7304398 - DNA, 22 bp, Homo sapiens
atcagtggggacgagaagttta

SEQ ID NO: 7304399 - DNA, 22 bp, Homo sapiens
atcagcaagtcctgttaattct

SEQ ID NO: 7304400 - DNA, 22 bp, Homo sapiens
agaaagcctgagcagacggagc

SEQ ID NO: 7304401 - DNA, 22 bp, Homo sapiens
atcaaaatgctccagtgatggt

SEQ ID NO: 7304402 - DNA, 20 bp, Homo sapiens
atcaaaatcctattgaggtt

SEQ ID NO: 7304403 - DNA, 21 bp, Homo sapiens
atatttttgtttggactgtca

SEQ ID NO: 7304404 - DNA, 22 bp, Homo sapiens
atatttttccatgtgggactct

SEQ ID NO: 7304405 - DNA, 22 bp, Homo sapiens
atattttgtaacttggaatagg

SEQ ID NO: 7304406 - DNA, 19 bp, Homo sapiens
agaaaaactggtactgctg

SEQ ID NO: 7304407 - DNA, 19 bp, Homo sapiens
agaaaaactggtactgctg

SEQ ID NO: 7304408 - DNA, 22 bp, Homo sapiens
agaaaaactaagagtgggtggt

SEQ ID NO: 7304409 - DNA, 21 bp, Homo sapiens
agaaaaaccagcatgttttca

SEQ ID NO: 7304410 - DNA, 22 bp, Homo sapiens
atattttggggtgatgtgcatc

SEQ ID NO: 7304411 - DNA, 22 bp, Homo sapiens
atattttggtagctctcaatga

SEQ ID NO: 7304412 - DNA, 22 bp, Homo sapiens
acttttgaagaattatgcaaaa

SEQ ID NO: 7304413 - DNA, 22 bp, Homo sapiens
actttttacagggtgtatacca

SEQ ID NO: 7304414 - DNA, 21 bp, Homo sapiens
agaaaaacacgatataagccc

SEQ ID NO: 7304415 - DNA, 21 bp, Homo sapiens
agaaaaaccagcatgttttca

SEQ ID NO: 7304416 - DNA, 23 bp, Homo sapiens
agaaaaacaggattgtgttccta

SEQ ID NO: 7304417 - DNA, 22 bp, Homo sapiens
agaaaaacacaatcgggcctcc

SEQ ID NO: 7304418 - DNA, 22 bp, Homo sapiens
acttttttataaggaagaagat

SEQ ID NO: 7304419 - DNA, 22 bp, Homo sapiens
actttttagtttcctcaaacat

SEQ ID NO: 7304420 - DNA, 22 bp, Homo sapiens
actttttagtttcctcaaacat

SEQ ID NO: 7304421 - DNA, 22 bp, Homo sapiens
actttttgcatagtaagtgtct

SEQ ID NO: 7304422 - DNA, 22 bp, Homo sapiens
acatacatggattcatggattc

SEQ ID NO: 7304423 - DNA, 20 bp, Homo sapiens
aggcagttagaaggagatga

SEQ ID NO: 7304424 - DNA, 22 bp, Homo sapiens
aggccacaggattgcacagcat

SEQ ID NO: 7304425 - DNA, 22 bp, Homo sapiens
aggccacaggtggaagccagag

SEQ ID NO: 7304426 - DNA, 22 bp, Homo sapiens
aggccacagagagtgcatgtgc

SEQ ID NO: 7304427 - DNA, 22 bp, Homo sapiens
aggccacagatactgtgaagta

SEQ ID NO: 7304428 - DNA, 22 bp, Homo sapiens
aggccagggtcccacactcgca

SEQ ID NO: 7304429 - DNA, 21 bp, Homo sapiens
aggcccagctttcctcttgct

SEQ ID NO: 7304430 - DNA, 22 bp, Homo sapiens
aggcccagggctgctctctgaa

SEQ ID NO: 7304431 - DNA, 22 bp, Homo sapiens
aggccctgagcatccgagggca

SEQ ID NO: 7304432 - DNA, 22 bp, Homo sapiens
acatgaaaagactatctgatta

SEQ ID NO: 7304433 - DNA, 22 bp, Homo sapiens
acatgaaaactggttccttcag

SEQ ID NO: 7304434 - DNA, 22 bp, Homo sapiens
acatcttttttctctaattgtg

SEQ ID NO: 7304435 - DNA, 22 bp, Homo sapiens
acatctttttggaaacggctga

SEQ ID NO: 7304436 - DNA, 22 bp, Homo sapiens
acatctttgtttcttagtgtat

SEQ ID NO: 7304437 - DNA, 22 bp, Homo sapiens
acatctttgtttcttagtgtat

SEQ ID NO: 7304438 - DNA, 22 bp, Homo sapiens
acattgaacagtacaaatgatc

SEQ ID NO: 7304439 - DNA, 22 bp, Homo sapiens
acattgaagggaatgcaaagat

SEQ ID NO: 7304440 - DNA, 22 bp, Homo sapiens
acattgaagctgtgaaatcaaa

SEQ ID NO: 7304441 - DNA, 18 bp, Homo sapiens
aggcttcccaggcaggcc

SEQ ID NO: 7304442 - DNA, 22 bp, Homo sapiens
acattcattgagcaacaacaat

SEQ ID NO: 7304443 - DNA, 22 bp, Homo sapiens
acattctttcaccttgtgtcca

SEQ ID NO: 7304444 - DNA, 22 bp, Homo sapiens
acattctagaagtctttgcaat

SEQ ID NO: 7304445 - DNA, 22 bp, Homo sapiens
acattctagatatgttatattt

SEQ ID NO: 7304446 - DNA, 22 bp, Homo sapiens
acattcatgcaccttcctatcc

SEQ ID NO: 7304447 - DNA, 22 bp, Homo sapiens
acattcatgggttttacattat

SEQ ID NO: 7304448 - DNA, 22 bp, Homo sapiens
acattcaccacacttatagggc

SEQ ID NO: 7304449 - DNA, 21 bp, Homo sapiens
agggcctctgtgtactggggg

SEQ ID NO: 7304450 - DNA, 22 bp, Homo sapiens
agggcctgagaccgtggcttga

SEQ ID NO: 7304451 - DNA, 19 bp, Homo sapiens
agggcctgagcagatgttg

SEQ ID NO: 7304452 - DNA, 22 bp, Homo sapiens
agggcctctggaacactgaggg

SEQ ID NO: 7304453 - DNA, 22 bp, Homo sapiens
agggcctctgagccagttctgg

SEQ ID NO: 7304454 - DNA, 17 bp, Homo sapiens
acccatccccagggcag

SEQ ID NO: 7304455 - DNA, 17 bp, Homo sapiens
acccattttgcacaggc

SEQ ID NO: 7304456 - DNA, 22 bp, Homo sapiens
accctggactggggctgaggct

SEQ ID NO: 7304457 - DNA, 22 bp, Homo sapiens
accctgggggtggccagtgcca

SEQ ID NO: 7304458 - DNA, 22 bp, Homo sapiens
accagtttgtaacctgttttca

SEQ ID NO: 7304459 - DNA, 22 bp, Homo sapiens
accagggcacattccggccaga

SEQ ID NO: 7304460 - DNA, 22 bp, Homo sapiens
accagggcagccgaggtgtgtc

SEQ ID NO: 7304461 - DNA, 22 bp, Homo sapiens
accaggctgtgaagtgagacta

SEQ ID NO: 7304462 - DNA, 22 bp, Homo sapiens
accagggcccgggagagctctc

SEQ ID NO: 7304463 - DNA, 22 bp, Homo sapiens
accagggccgcgggcgactagc

SEQ ID NO: 7304464 - DNA, 22 bp, Homo sapiens
accagggcggcttgaggaggca

SEQ ID NO: 7304465 - DNA, 22 bp, Homo sapiens
accagggttgagtcagctgcgt

SEQ ID NO: 7304466 - DNA, 22 bp, Homo sapiens
accagggctgacaatctgatgg

SEQ ID NO: 7304467 - DNA, 22 bp, Homo sapiens
accagggctgggataggtcagg

SEQ ID NO: 7304468 - DNA, 22 bp, Homo sapiens
accagggcttacagcagtagct

SEQ ID NO: 7304469 - DNA, 22 bp, Homo sapiens
accacagaggaatttgaagagg

SEQ ID NO: 7304470 - DNA, 22 bp, Homo sapiens
accaatctcctattttgtttca

SEQ ID NO: 7304471 - DNA, 22 bp, Homo sapiens
accaagcttcgtggaggaagtt

SEQ ID NO: 7304472 - DNA, 22 bp, Homo sapiens
accaacttgcagccaaatttga

SEQ ID NO: 7304473 - DNA, 22 bp, Homo sapiens
accaaagggcagaacatgagca

SEQ ID NO: 7304474 - DNA, 22 bp, Homo sapiens
accaggaagctgtgagaccttt

SEQ ID NO: 7304475 - DNA, 22 bp, Homo sapiens
accaggactttgtattcagctt

SEQ ID NO: 7304476 - DNA, 20 bp, Homo sapiens
accaggacaagacaaaagtg

SEQ ID NO: 7304477 - DNA, 22 bp, Homo sapiens
accaggaggaagtgttaatgat

SEQ ID NO: 7304478 - DNA, 20 bp, Homo sapiens
accaggagatggaggcaggg

SEQ ID NO: 7304479 - DNA, 22 bp, Homo sapiens
agcttagcacacacaggcaggt

SEQ ID NO: 7304480 - DNA, 22 bp, Homo sapiens
agcttagcacacacaggcaggt

SEQ ID NO: 7304481 - DNA, 22 bp, Homo sapiens
agcttcaacttactaaaagata

SEQ ID NO: 7304482 - DNA, 22 bp, Homo sapiens
agctgtgggcctgggagagctg

SEQ ID NO: 7304483 - DNA, 22 bp, Homo sapiens
agctgtggggaggaggctagca

SEQ ID NO: 7304484 - DNA, 22 bp, Homo sapiens
agctgtggggaggaggctagca

SEQ ID NO: 7304485 - DNA, 22 bp, Homo sapiens
agctgtggggcaggcagcgagg

SEQ ID NO: 7304486 - DNA, 19 bp, Homo sapiens
agctgtggggcctagcacc

SEQ ID NO: 7304487 - DNA, 22 bp, Homo sapiens
agctgtggtgttttcaagccct

SEQ ID NO: 7304488 - DNA, 22 bp, Homo sapiens
agctgtggttctgggcagcgac

SEQ ID NO: 7304489 - DNA, 22 bp, Homo sapiens
agctgtggttctgggcagcgac

SEQ ID NO: 7304490 - DNA, 21 bp, Homo sapiens
agctgtggttttacatctttt

SEQ ID NO: 7304491 - DNA, 22 bp, Homo sapiens
agctgtgggcctgggagagctg

SEQ ID NO: 7304492 - DNA, 22 bp, Homo sapiens
agctgtgggagaatctctgggt

SEQ ID NO: 7304493 - DNA, 22 bp, Homo sapiens
aggaagccatggtggacgtcta

SEQ ID NO: 7304494 - DNA, 22 bp, Homo sapiens
aggaaagaaaggaggtgcattt

SEQ ID NO: 7304495 - DNA, 18 bp, Homo sapiens
aggaaagaaaggcaggtg

SEQ ID NO: 7304496 - DNA, 18 bp, Homo sapiens
aggaaagaaaggcaggtg

SEQ ID NO: 7304497 - DNA, 22 bp, Homo sapiens
aggaagagcattcacatggtag

SEQ ID NO: 7304498 - DNA, 22 bp, Homo sapiens
aggaaagaaaggaggtgcattt

SEQ ID NO: 7304499 - DNA, 22 bp, Homo sapiens
aggaaaaacctgttaatggtag

SEQ ID NO: 7304500 - DNA, 22 bp, Homo sapiens
agctttggttgccatgatctga

SEQ ID NO: 7304501 - DNA, 22 bp, Homo sapiens
agctttgtgactttgagctagt

SEQ ID NO: 7304502 - DNA, 21 bp, Homo sapiens
acagcctccatctcctgggct

SEQ ID NO: 7304503 - DNA, 22 bp, Homo sapiens
agctgctggtttaagggatggg

SEQ ID NO: 7304504 - DNA, 22 bp, Homo sapiens
agctgctgtggggctcggcctg

SEQ ID NO: 7304505 - DNA, 22 bp, Homo sapiens
agctgctgtgtgctcaggcagg

SEQ ID NO: 7304506 - DNA, 22 bp, Homo sapiens
agctggccttagtgagcacctg

SEQ ID NO: 7304507 - DNA, 22 bp, Homo sapiens
agctggccttcggtgtcactgg

SEQ ID NO: 7304508 - DNA, 22 bp, Homo sapiens
agctggcaggggttcacactgc

SEQ ID NO: 7304509 - DNA, 22 bp, Homo sapiens
agctcccagaagccagagtcgg

SEQ ID NO: 7304510 - DNA, 22 bp, Homo sapiens
agctcccagaagccagagtcgg

SEQ ID NO: 7304511 - DNA, 22 bp, Homo sapiens
agctcccagaagccagagtcgg

SEQ ID NO: 7304512 - DNA, 22 bp, Homo sapiens
acagccagggtctcaggaggcg

SEQ ID NO: 7304513 - DNA, 22 bp, Homo sapiens
acagccagtaatctacccctgt

SEQ ID NO: 7304514 - DNA, 22 bp, Homo sapiens
acagccagtcatctcagcaggg

SEQ ID NO: 7304515 - DNA, 23 bp, Homo sapiens
acagccagttcacctctccttgg

SEQ ID NO: 7304516 - DNA, 22 bp, Homo sapiens
acagccagtgactgcagaccct

SEQ ID NO: 7304517 - DNA, 22 bp, Homo sapiens
aggaagggatacataggatagt

SEQ ID NO: 7304518 - DNA, 22 bp, Homo sapiens
aggaagggatacataggatagt

SEQ ID NO: 7304519 - DNA, 22 bp, Homo sapiens
aggaagggatacataggatagt

SEQ ID NO: 7304520 - DNA, 22 bp, Homo sapiens
aggaagctcaaagccatgatgt

SEQ ID NO: 7304521 - DNA, 23 bp, Homo sapiens
aggagccatgagttggatatgtt

SEQ ID NO: 7304522 - DNA, 22 bp, Homo sapiens
aggagccattgcaggatggcag

SEQ ID NO: 7304523 - DNA, 22 bp, Homo sapiens
acagggtcaagggtgctacaag

SEQ ID NO: 7304524 - DNA, 22 bp, Homo sapiens
acagggtcaagggtgctacaag

SEQ ID NO: 7304525 - DNA, 22 bp, Homo sapiens
acagggtcattttatgatctgt

SEQ ID NO: 7304526 - DNA, 22 bp, Homo sapiens
acagggtcttagagatcacctg

SEQ ID NO: 7304527 - DNA, 22 bp, Homo sapiens
aggagctgctttggtgcggttt

SEQ ID NO: 7304528 - DNA, 22 bp, Homo sapiens
aggagctggaatggtccttttg

SEQ ID NO: 7304529 - DNA, 22 bp, Homo sapiens
aggagctgcagattctgccttg

SEQ ID NO: 7304530 - DNA, 22 bp, Homo sapiens
aggagctgcagattctgccttg

SEQ ID NO: 7304531 - DNA, 22 bp, Homo sapiens
aggagccctgcgggaggcagag

SEQ ID NO: 7304532 - DNA, 23 bp, Homo sapiens
aggagcccctaattctgggcagc

SEQ ID NO: 7304533 - DNA, 23 bp, Homo sapiens
aggagcccaaggagaggtaactt

SEQ ID NO: 7304534 - DNA, 23 bp, Homo sapiens
aggagcccaaggagaggtaactt

SEQ ID NO: 7304535 - DNA, 22 bp, Homo sapiens
aggagcccagcctgggctcgga

SEQ ID NO: 7304536 - DNA, 22 bp, Homo sapiens
aggagcctgagtcacagtgcct

SEQ ID NO: 7304537 - DNA, 22 bp, Homo sapiens
acatacatcaagtatcacaaga

SEQ ID NO: 7304538 - DNA, 22 bp, Homo sapiens
acatacatatgacaactttcct

SEQ ID NO: 7304539 - DNA, 21 bp, Homo sapiens
acatacataccttaccacctt

SEQ ID NO: 7304540 - DNA, 23 bp, Homo sapiens
acatacatggagataaagtgatg

SEQ ID NO: 7304541 - DNA, 22 bp, Homo sapiens
acatacatcaagtatcacaaga

SEQ ID NO: 7304542 - DNA, 23 bp, Homo sapiens
acatacataagcaccacattttg

SEQ ID NO: 7304543 - DNA, 23 bp, Homo sapiens
acatacataagcaccacattttg

SEQ ID NO: 7304544 - DNA, 22 bp, Homo sapiens
acatacacaagcgtacatgaac

SEQ ID NO: 7304545 - DNA, 22 bp, Homo sapiens
acataacaatcataggacatag

SEQ ID NO: 7304546 - DNA, 22 bp, Homo sapiens
acatacacatgaatatattttt

SEQ ID NO: 7304547 - DNA, 22 bp, Homo sapiens
acatacacaagcgtacatgaac

SEQ ID NO: 7304548 - DNA, 22 bp, Homo sapiens
acatacacacatactttctcct

SEQ ID NO: 7304549 - DNA, 18 bp, Homo sapiens
aggcacagagcatacata

SEQ ID NO: 7304550 - DNA, 21 bp, Homo sapiens
aggaggggtctttcccactga

SEQ ID NO: 7304551 - DNA, 22 bp, Homo sapiens
aggagggtacaatgggtggaaa

SEQ ID NO: 7304552 - DNA, 23 bp, Homo sapiens
ccagctccgtgagcctcgggctc

SEQ ID NO: 7304553 - DNA, 22 bp, Homo sapiens
ccagctggaacggcagcccagc

SEQ ID NO: 7304554 - DNA, 22 bp, Homo sapiens
ccagctggcaggagagtcaggg

SEQ ID NO: 7304555 - DNA, 22 bp, Homo sapiens
ccaggaaggcaggcctccccgc

SEQ ID NO: 7304556 - DNA, 22 bp, Homo sapiens
aggcctgggacgggagccgtga

SEQ ID NO: 7304557 - DNA, 22 bp, Homo sapiens
ccaggaaggtatgggaagaaaa

SEQ ID NO: 7304558 - DNA, 22 bp, Homo sapiens
aggcggtgctgtggacagtgac

SEQ ID NO: 7304559 - DNA, 22 bp, Homo sapiens
aggcggtggccaaggagcggga

SEQ ID NO: 7304560 - DNA, 22 bp, Homo sapiens
aggcctgtctgaggtccccact

SEQ ID NO: 7304561 - DNA, 22 bp, Homo sapiens
aggcctgtcccagctgaggacg

SEQ ID NO: 7304562 - DNA, 22 bp, Homo sapiens
aggcctgtagttcctctttcca

SEQ ID NO: 7304563 - DNA, 22 bp, Homo sapiens
aggcctgtctggggctcagcca

SEQ ID NO: 7304564 - DNA, 22 bp, Homo sapiens
aggcctgtaatcccagcacttt

SEQ ID NO: 7304565 - DNA, 22 bp, Homo sapiens
aggccacaagaaaatgcttcat

SEQ ID NO: 7304566 - DNA, 22 bp, Homo sapiens
ccagacagttccttgaggttca

SEQ ID NO: 7304567 - DNA, 22 bp, Homo sapiens
ccagaagagatcacagttcttg

SEQ ID NO: 7304568 - DNA, 22 bp, Homo sapiens
ccagaaagttcagctgtgaatg

SEQ ID NO: 7304569 - DNA, 22 bp, Homo sapiens
ccagaacagacctgcctgacct

SEQ ID NO: 7304570 - DNA, 22 bp, Homo sapiens
ccagaagacaagaatgttctta

SEQ ID NO: 7304571 - DNA, 22 bp, Homo sapiens
ccagaagaccggggagtcaggg

SEQ ID NO: 7304572 - DNA, 22 bp, Homo sapiens
ccagaagaacttaattcaaaac

SEQ ID NO: 7304573 - DNA, 22 bp, Homo sapiens
ccagaagaaaaagctggtatta

SEQ ID NO: 7304574 - DNA, 18 bp, Homo sapiens
aggcaggctggagtgact

SEQ ID NO: 7304575 - DNA, 22 bp, Homo sapiens
ccagaaagaatgaactgaaccc

SEQ ID NO: 7304576 - DNA, 22 bp, Homo sapiens
aggccacatagcttgcatgtag

SEQ ID NO: 7304577 - DNA, 22 bp, Homo sapiens
aggccacagttgaggccagcaa

SEQ ID NO: 7304578 - DNA, 22 bp, Homo sapiens
ccagagcctggcatctgcataa

SEQ ID NO: 7304579 - DNA, 22 bp, Homo sapiens
ccaggtctttggccttggcact

SEQ ID NO: 7304580 - DNA, 22 bp, Homo sapiens
ccaggtgactgtcagaggtttt

SEQ ID NO: 7304581 - DNA, 22 bp, Homo sapiens
ccaggtcttggcccccggacct

SEQ ID NO: 7304582 - DNA, 22 bp, Homo sapiens
ccaggtctgtcttcttagctca

SEQ ID NO: 7304583 - DNA, 22 bp, Homo sapiens
ccatttcattgcctgtaaagtg

SEQ ID NO: 7304584 - DNA, 18 bp, Homo sapiens
ccatttcatgattattac

SEQ ID NO: 7304585 - DNA, 18 bp, Homo sapiens
ccatttcatgattattac

SEQ ID NO: 7304586 - DNA, 22 bp, Homo sapiens
ccatttcactgggtagttgtgg

SEQ ID NO: 7304587 - DNA, 22 bp, Homo sapiens
ccatttcactgggtagttgtgg

SEQ ID NO: 7304588 - DNA, 19 bp, Homo sapiens
ccatttcatatgtattgtg

SEQ ID NO: 7304589 - DNA, 19 bp, Homo sapiens
ccatttcatatgtattgtg

SEQ ID NO: 7304590 - DNA, 22 bp, Homo sapiens
ccatttcacccactgctttagg

SEQ ID NO: 7304591 - DNA, 22 bp, Homo sapiens
ccatttcactcttcctgaagga

SEQ ID NO: 7304592 - DNA, 22 bp, Homo sapiens
ccatttagtaaggaagaacagc

SEQ ID NO: 7304593 - DNA, 22 bp, Homo sapiens
ccatttatagatgtatttggct

SEQ ID NO: 7304594 - DNA, 22 bp, Homo sapiens
ccatttcacccactgctttagg

SEQ ID NO: 7304595 - DNA, 22 bp, Homo sapiens
aggctgggtacctgtcatatgc

SEQ ID NO: 7304596 - DNA, 22 bp, Homo sapiens
ccatttgttgtgtattaatatt

SEQ ID NO: 7304597 - DNA, 22 bp, Homo sapiens
ccatttgtaccatttctttgta

SEQ ID NO: 7304598 - DNA, 22 bp, Homo sapiens
aggctacaaataagcatgtaat

SEQ ID NO: 7304599 - DNA, 22 bp, Homo sapiens
ccaggctgggctacaagttgag

SEQ ID NO: 7304600 - DNA, 22 bp, Homo sapiens
ccagggcctgagggcgacgccc

SEQ ID NO: 7304601 - DNA, 22 bp, Homo sapiens
ccagggcctgccacttagcaag

SEQ ID NO: 7304602 - DNA, 22 bp, Homo sapiens
ccagggctggtggctgcagagg

SEQ ID NO: 7304603 - DNA, 22 bp, Homo sapiens
ccaggtctcgggtctgctcgtg

SEQ ID NO: 7304604 - DNA, 22 bp, Homo sapiens
ccctccattaaaacagacctat

SEQ ID NO: 7304605 - DNA, 20 bp, Homo sapiens
ccctcccagatgcttcccaa

SEQ ID NO: 7304606 - DNA, 22 bp, Homo sapiens
ccccagaaagcctggcactagg

SEQ ID NO: 7304607 - DNA, 22 bp, Homo sapiens
ccccagagagcaccatgaagcc

SEQ ID NO: 7304608 - DNA, 17 bp, Homo sapiens
ccctcactcctgccggg

SEQ ID NO: 7304609 - DNA, 22 bp, Homo sapiens
ccctcacttcacgctctgcaga

SEQ ID NO: 7304610 - DNA, 22 bp, Homo sapiens
ccctcactgtccttgggccctt

SEQ ID NO: 7304611 - DNA, 17 bp, Homo sapiens
ccctcactcctgccggg

SEQ ID NO: 7304612 - DNA, 22 bp, Homo sapiens
ccccagcactctgactcttacc

SEQ ID NO: 7304613 - DNA, 22 bp, Homo sapiens
cccaggaatgggaaggaggaat

SEQ ID NO: 7304614 - DNA, 22 bp, Homo sapiens
cccaggagccatctgtcttggc

SEQ ID NO: 7304615 - DNA, 22 bp, Homo sapiens
cccaggagccatctgtcttggc

SEQ ID NO: 7304616 - DNA, 22 bp, Homo sapiens
cccaggagatggtgcgtggtct

SEQ ID NO: 7304617 - DNA, 19 bp, Homo sapiens
cccaggagcagtattgatg

SEQ ID NO: 7304618 - DNA, 22 bp, Homo sapiens
cccaggctgagttagaggtgtc

SEQ ID NO: 7304619 - DNA, 22 bp, Homo sapiens
cccaggctgatgggatgggcca

SEQ ID NO: 7304620 - DNA, 22 bp, Homo sapiens
cccaggctgccacgattactgc

SEQ ID NO: 7304621 - DNA, 22 bp, Homo sapiens
cccaggctgcatgagtccatgg

SEQ ID NO: 7304622 - DNA, 22 bp, Homo sapiens
cccaggctgatgttcagcgggt

SEQ ID NO: 7304623 - DNA, 22 bp, Homo sapiens
cccaggcttttctcttgcccca

SEQ ID NO: 7304624 - DNA, 22 bp, Homo sapiens
cccaggcttttaagttagacag

SEQ ID NO: 7304625 - DNA, 22 bp, Homo sapiens
cccaggctgtctgtcctttgct

SEQ ID NO: 7304626 - DNA, 22 bp, Homo sapiens
cccaggctggtcctgaactcct

SEQ ID NO: 7304627 - DNA, 22 bp, Homo sapiens
cccaggctgcgtatccacaata

SEQ ID NO: 7304628 - DNA, 22 bp, Homo sapiens
cccaggcttcccaatcagaagg

SEQ ID NO: 7304629 - DNA, 22 bp, Homo sapiens
cccaggctgtgcaaacttcaaa

SEQ ID NO: 7304630 - DNA, 18 bp, Homo sapiens
cccaggctttgtgggtct

SEQ ID NO: 7304631 - DNA, 22 bp, Homo sapiens
agggtagggccgtagggccatg

SEQ ID NO: 7304632 - DNA, 22 bp, Homo sapiens
aggggtgaaggcccgataggag

SEQ ID NO: 7304633 - DNA, 22 bp, Homo sapiens
cctgagaggccctctcactgtc

SEQ ID NO: 7304634 - DNA, 22 bp, Homo sapiens
aggggatggagctggaaggcag

SEQ ID NO: 7304635 - DNA, 22 bp, Homo sapiens
aggggatggagctggaaggcag

SEQ ID NO: 7304636 - DNA, 22 bp, Homo sapiens
aggggcacgagtagagctctag

SEQ ID NO: 7304637 - DNA, 22 bp, Homo sapiens
aggggatggagctggaaggcag

SEQ ID NO: 7304638 - DNA, 22 bp, Homo sapiens
aggggcagcctcacaatcctct

SEQ ID NO: 7304639 - DNA, 23 bp, Homo sapiens
aggggcagcaagttttggtgtta

SEQ ID NO: 7304640 - DNA, 18 bp, Homo sapiens
aggggcagcttgtgtgga

SEQ ID NO: 7304641 - DNA, 22 bp, Homo sapiens
aggggagcaacatagtcactct

SEQ ID NO: 7304642 - DNA, 22 bp, Homo sapiens
agggctggccacatgatttggt

SEQ ID NO: 7304643 - DNA, 22 bp, Homo sapiens
aggggatgcctagtggagtctc

SEQ ID NO: 7304644 - DNA, 22 bp, Homo sapiens
agggctaggaatggaactggag

SEQ ID NO: 7304645 - DNA, 22 bp, Homo sapiens
agggctggagccacagctggga

SEQ ID NO: 7304646 - DNA, 22 bp, Homo sapiens
ccctggaacccatggccagtgt

SEQ ID NO: 7304647 - DNA, 22 bp, Homo sapiens
ccctggaaatgaggcatgtgcg

SEQ ID NO: 7304648 - DNA, 22 bp, Homo sapiens
ccctgctttgcacccaggctgg

SEQ ID NO: 7304649 - DNA, 18 bp, Homo sapiens
agggcctccatcccctcc

SEQ ID NO: 7304650 - DNA, 23 bp, Homo sapiens
ccctggaacttcactcatgcaca

SEQ ID NO: 7304651 - DNA, 22 bp, Homo sapiens
agggcctgaggctgacggggag

SEQ ID NO: 7304652 - DNA, 22 bp, Homo sapiens
agggcctggcgcgtggccgccg

SEQ ID NO: 7304653 - DNA, 22 bp, Homo sapiens
caggaaatcagaactcaagtgg

SEQ ID NO: 7304654 - DNA, 17 bp, Homo sapiens
caggaaaatatgagtga

SEQ ID NO: 7304655 - DNA, 22 bp, Homo sapiens
caggaaatataggaaaaggaac

SEQ ID NO: 7304656 - DNA, 22 bp, Homo sapiens
caggaaatatctcaacacttta

SEQ ID NO: 7304657 - DNA, 22 bp, Homo sapiens
agctgaaattttactgagtata

SEQ ID NO: 7304658 - DNA, 22 bp, Homo sapiens
caggaagaaagaggtgaggtgt

SEQ ID NO: 7304659 - DNA, 22 bp, Homo sapiens
caggaagaaagaggtgaggtgt

SEQ ID NO: 7304660 - DNA, 22 bp, Homo sapiens
caggaagaagggtggtgagtcc

SEQ ID NO: 7304661 - DNA, 22 bp, Homo sapiens
caggaagaagggtggtgagtcc

SEQ ID NO: 7304662 - DNA, 22 bp, Homo sapiens
caggaagaccagggctgtggct

SEQ ID NO: 7304663 - DNA, 22 bp, Homo sapiens
caggaagaccagggctgtggct

SEQ ID NO: 7304664 - DNA, 23 bp, Homo sapiens
caggaaatgcttggaggggctgg

SEQ ID NO: 7304665 - DNA, 22 bp, Homo sapiens
caggaaatgctatcatagctga

SEQ ID NO: 7304666 - DNA, 22 bp, Homo sapiens
caggaaatgaggctgaagggtg

SEQ ID NO: 7304667 - DNA, 23 bp, Homo sapiens
caggaaatgaatccaggaggatg

SEQ ID NO: 7304668 - DNA, 22 bp, Homo sapiens
caggaaatgaacaggaatgaac

SEQ ID NO: 7304669 - DNA, 22 bp, Homo sapiens
caggaaatgaacaggaatgaac

SEQ ID NO: 7304670 - DNA, 22 bp, Homo sapiens
caggaaatgaaagctagctaat

SEQ ID NO: 7304671 - DNA, 22 bp, Homo sapiens
agctgccctttatgatgctgaa

SEQ ID NO: 7304672 - DNA, 20 bp, Homo sapiens
agctgcccttttcacatgtt

SEQ ID NO: 7304673 - DNA, 22 bp, Homo sapiens
agctgccctgtggggagggttg

SEQ ID NO: 7304674 - DNA, 21 bp, Homo sapiens
agctgcctccacttctgaggc

SEQ ID NO: 7304675 - DNA, 22 bp, Homo sapiens
agctgccctgggctggagatgg

SEQ ID NO: 7304676 - DNA, 18 bp, Homo sapiens
agctgccctgggctggag

SEQ ID NO: 7304677 - DNA, 20 bp, Homo sapiens
agctgcccctgggcactgcc

SEQ ID NO: 7304678 - DNA, 22 bp, Homo sapiens
agctgcccctcattttcaccac

SEQ ID NO: 7304679 - DNA, 14 bp, Homo sapiens
caggaagactcagc

SEQ ID NO: 7304680 - DNA, 14 bp, Homo sapiens
caggaagactcagc

SEQ ID NO: 7304681 - DNA, 21 bp, Homo sapiens
agctgcctgctctggacctgg

SEQ ID NO: 7304682 - DNA, 22 bp, Homo sapiens
agctgcctccctgtgcttgtcc

SEQ ID NO: 7304683 - DNA, 22 bp, Homo sapiens
agctgcctccatggtcaaagat

SEQ ID NO: 7304684 - DNA, 22 bp, Homo sapiens
agctggtgaacctgaggcacag

SEQ ID NO: 7304685 - DNA, 19 bp, Homo sapiens
agctggggcggtgtgtgtt

SEQ ID NO: 7304686 - DNA, 22 bp, Homo sapiens
caggcagagtgaggtggtctaa

SEQ ID NO: 7304687 - DNA, 20 bp, Homo sapiens
caggcagaggatgctgacca

SEQ ID NO: 7304688 - DNA, 20 bp, Homo sapiens
caggcagaggatgctgacca

SEQ ID NO: 7304689 - DNA, 22 bp, Homo sapiens
caggcagaggaggccttctcct

SEQ ID NO: 7304690 - DNA, 22 bp, Homo sapiens
caggcagagtgagaagcccttg

SEQ ID NO: 7304691 - DNA, 22 bp, Homo sapiens
caggcagaggaagtctgggtct

SEQ ID NO: 7304692 - DNA, 22 bp, Homo sapiens
aggaagcaccggaatgatgact

SEQ ID NO: 7304693 - DNA, 22 bp, Homo sapiens
aggaagatgtgtttagcaggtt

SEQ ID NO: 7304694 - DNA, 22 bp, Homo sapiens
aggaagatgggagagctctgga

SEQ ID NO: 7304695 - DNA, 22 bp, Homo sapiens
aggaagatgggagagctctgga

SEQ ID NO: 7304696 - DNA, 22 bp, Homo sapiens
aggaagatgtgcaaagttggaa

SEQ ID NO: 7304697 - DNA, 22 bp, Homo sapiens
aggaagatgtgcaaagttggaa

SEQ ID NO: 7304698 - DNA, 20 bp, Homo sapiens
aggaagatcctttcttttaa

SEQ ID NO: 7304699 - DNA, 21 bp, Homo sapiens
aggaagatctggaggtcggcg

SEQ ID NO: 7304700 - DNA, 20 bp, Homo sapiens
aggaagatcctttcttttaa

SEQ ID NO: 7304701 - DNA, 22 bp, Homo sapiens
cagggtttcaccatgttagcag

SEQ ID NO: 7304702 - DNA, 22 bp, Homo sapiens
cagggtgcttccgtggagctgt

SEQ ID NO: 7304703 - DNA, 22 bp, Homo sapiens
cagggtgctgcaccatccctca

SEQ ID NO: 7304704 - DNA, 22 bp, Homo sapiens
aggaaacagttggtaatgcata

SEQ ID NO: 7304705 - DNA, 22 bp, Homo sapiens
caggtcctggcagctgactcag

SEQ ID NO: 7304706 - DNA, 22 bp, Homo sapiens
caggtcccgttccccagagatt

SEQ ID NO: 7304707 - DNA, 22 bp, Homo sapiens
aggaagggtggatagtaacgtg

SEQ ID NO: 7304708 - DNA, 22 bp, Homo sapiens
aggaaggggagaagttaaagct

SEQ ID NO: 7304709 - DNA, 22 bp, Homo sapiens
aggaagggttctttgtgaaaga

SEQ ID NO: 7304710 - DNA, 22 bp, Homo sapiens
aggaagggtgtcatgagccctt

SEQ ID NO: 7304711 - DNA, 20 bp, Homo sapiens
aggaagtattgtcatgaagg

SEQ ID NO: 7304712 - DNA, 22 bp, Homo sapiens
aggaagtgaaagggaaggagtt

SEQ ID NO: 7304713 - DNA, 17 bp, Homo sapiens
caggtcccagggtctct

SEQ ID NO: 7304714 - DNA, 17 bp, Homo sapiens
caggtcccagggtctct

SEQ ID NO: 7304715 - DNA, 22 bp, Homo sapiens
caggtccagtcactggtctgca

SEQ ID NO: 7304716 - DNA, 22 bp, Homo sapiens
aggaaacagagtgaagcttggg

SEQ ID NO: 7304717 - DNA, 22 bp, Homo sapiens
aggaaaattatcatgagagcca

SEQ ID NO: 7304718 - DNA, 22 bp, Homo sapiens
aggaaaattatcatgagagcca

SEQ ID NO: 7304719 - DNA, 22 bp, Homo sapiens
aggaaaatgaaacagcaactgt

SEQ ID NO: 7304720 - DNA, 22 bp, Homo sapiens
aggaaaatgaaacagcaactgt

SEQ ID NO: 7304721 - DNA, 20 bp, Homo sapiens
aggaaaaatggaaactggag

SEQ ID NO: 7304722 - DNA, 22 bp, Homo sapiens
agctttggtgctgtcacacaaa

SEQ ID NO: 7304723 - DNA, 22 bp, Homo sapiens
cagggactgagatccagactgt

SEQ ID NO: 7304724 - DNA, 22 bp, Homo sapiens
cagggaccctactagctcacac

SEQ ID NO: 7304725 - DNA, 22 bp, Homo sapiens
agctttattcatgatttcaggg

SEQ ID NO: 7304726 - DNA, 22 bp, Homo sapiens
agcttctggaagcctggcagca

SEQ ID NO: 7304727 - DNA, 22 bp, Homo sapiens
agctggtgatgtggtccctcac

SEQ ID NO: 7304728 - DNA, 22 bp, Homo sapiens
ccaaagcaagtcacatgatcaa

SEQ ID NO: 7304729 - DNA, 22 bp, Homo sapiens
ccaaaattaagcctcttatgtt

SEQ ID NO: 7304730 - DNA, 22 bp, Homo sapiens
ccaaaattattacatttgtagg

SEQ ID NO: 7304731 - DNA, 22 bp, Homo sapiens
ccaaacttaacgatgtttttgt

SEQ ID NO: 7304732 - DNA, 22 bp, Homo sapiens
ccaaactgggccagtcagctgt

SEQ ID NO: 7304733 - DNA, 22 bp, Homo sapiens
aggcaggctagtcgcttgagcc

SEQ ID NO: 7304734 - DNA, 19 bp, Homo sapiens
aggcagaggcttggctagc

SEQ ID NO: 7304735 - DNA, 22 bp, Homo sapiens
aggcagaggagaatgatcttcc

SEQ ID NO: 7304736 - DNA, 21 bp, Homo sapiens
catgtgtcttgtgttactgct

SEQ ID NO: 7304737 - DNA, 22 bp, Homo sapiens
catgtgtgaagactgcgggcca

SEQ ID NO: 7304738 - DNA, 22 bp, Homo sapiens
catgtgtgaatcttgtgatcat

SEQ ID NO: 7304739 - DNA, 22 bp, Homo sapiens
catgtgtgaatcttgtgatcat

SEQ ID NO: 7304740 - DNA, 22 bp, Homo sapiens
catgtgtggtctgtggctatct

SEQ ID NO: 7304741 - DNA, 22 bp, Homo sapiens
catgtgtggtctgtggctatct

SEQ ID NO: 7304742 - DNA, 22 bp, Homo sapiens
catgtgtggtctgtggctatct

SEQ ID NO: 7304743 - DNA, 22 bp, Homo sapiens
catgtgtggagggcatgcatgg

SEQ ID NO: 7304744 - DNA, 22 bp, Homo sapiens
catgtgtggagggcatgcatgg

SEQ ID NO: 7304745 - DNA, 22 bp, Homo sapiens
catgtgtggagggcatgcatgg

SEQ ID NO: 7304746 - DNA, 22 bp, Homo sapiens
catgtgtgagtgagcagtcttc

SEQ ID NO: 7304747 - DNA, 22 bp, Homo sapiens
catgtgtgcaccaaccctatgt

SEQ ID NO: 7304748 - DNA, 23 bp, Homo sapiens
catgtgtgacagtatcactgttt

SEQ ID NO: 7304749 - DNA, 22 bp, Homo sapiens
catgtgtgacaaactgcctgca

SEQ ID NO: 7304750 - DNA, 22 bp, Homo sapiens
catgtgtgagtatatcttatcc

SEQ ID NO: 7304751 - DNA, 22 bp, Homo sapiens
aggatcaaatgaaatattttga

SEQ ID NO: 7304752 - DNA, 22 bp, Homo sapiens
aggatccagccagggtggagtt

SEQ ID NO: 7304753 - DNA, 22 bp, Homo sapiens
aggatctgggtattccttttct

SEQ ID NO: 7304754 - DNA, 22 bp, Homo sapiens
aggatctgtgagtgctgcagac

SEQ ID NO: 7304755 - DNA, 20 bp, Homo sapiens
aggatctgagatagaatgga

SEQ ID NO: 7304756 - DNA, 23 bp, Homo sapiens
aggataaactaaactcattttgg

SEQ ID NO: 7304757 - DNA, 22 bp, Homo sapiens
aggcactgaagaactctttttg

SEQ ID NO: 7304758 - DNA, 22 bp, Homo sapiens
catcatttcacttagatgaagt

SEQ ID NO: 7304759 - DNA, 22 bp, Homo sapiens
catcatttgtttgcatgcagga

SEQ ID NO: 7304760 - DNA, 22 bp, Homo sapiens
catcatttgtttgcatgcagga

SEQ ID NO: 7304761 - DNA, 22 bp, Homo sapiens
catcattttattaaccaagaaa

SEQ ID NO: 7304762 - DNA, 22 bp, Homo sapiens
catcatttttgtaagctggtag

SEQ ID NO: 7304763 - DNA, 22 bp, Homo sapiens
aggaggtgagcggtcatgtggt

SEQ ID NO: 7304764 - DNA, 22 bp, Homo sapiens
aggaggtgacagcctgcatctg

SEQ ID NO: 7304765 - DNA, 22 bp, Homo sapiens
aggagggtggggtctgcctgtc

SEQ ID NO: 7304766 - DNA, 22 bp, Homo sapiens
catcagaacgtgagctccttgt

SEQ ID NO: 7304767 - DNA, 22 bp, Homo sapiens
cagttcagctagaagaaacaaa

SEQ ID NO: 7304768 - DNA, 22 bp, Homo sapiens
cagttcagctgtcagcctccca

SEQ ID NO: 7304769 - DNA, 22 bp, Homo sapiens
cagttctgactttcataatgtc

SEQ ID NO: 7304770 - DNA, 22 bp, Homo sapiens
catattttagttgctgaacagc

SEQ ID NO: 7304771 - DNA, 19 bp, Homo sapiens
catatttttgggctggcat

SEQ ID NO: 7304772 - DNA, 22 bp, Homo sapiens
catcacatttaattaaaatgtc

SEQ ID NO: 7304773 - DNA, 22 bp, Homo sapiens
aggaattgagatcctaggtttt

SEQ ID NO: 7304774 - DNA, 22 bp, Homo sapiens
aggaattttaatatgcttgtct

SEQ ID NO: 7304775 - DNA, 22 bp, Homo sapiens
aggaattgtgttgtagtggaga

SEQ ID NO: 7304776 - DNA, 22 bp, Homo sapiens
aggaattgcctggggcctggga

SEQ ID NO: 7304777 - DNA, 22 bp, Homo sapiens
aggaattggcacggccttctca

SEQ ID NO: 7304778 - DNA, 22 bp, Homo sapiens
aggaattggttcaaggtttatc

SEQ ID NO: 7304779 - DNA, 22 bp, Homo sapiens
cagtgaggagtccagggcagag

SEQ ID NO: 7304780 - DNA, 22 bp, Homo sapiens
cagtgaggagtccagggcagag

SEQ ID NO: 7304781 - DNA, 18 bp, Homo sapiens
cagtgaggatgaagggtt

SEQ ID NO: 7304782 - DNA, 22 bp, Homo sapiens
cagtgaggagtccagggcagag

SEQ ID NO: 7304783 - DNA, 22 bp, Homo sapiens
cagtgagggcccccttccaggt

SEQ ID NO: 7304784 - DNA, 22 bp, Homo sapiens
aggagccaagatggggcaagta

SEQ ID NO: 7304785 - DNA, 22 bp, Homo sapiens
aggagcagcttctgaaccatgt

SEQ ID NO: 7304786 - DNA, 22 bp, Homo sapiens
aggagctgatgattctttgatc

SEQ ID NO: 7304787 - DNA, 22 bp, Homo sapiens
aggagctggccactaggatgca

SEQ ID NO: 7304788 - DNA, 22 bp, Homo sapiens
aggagctgggctgctgctggga

SEQ ID NO: 7304789 - DNA, 22 bp, Homo sapiens
atcagctgctacattggcctct

SEQ ID NO: 7304790 - DNA, 20 bp, Homo sapiens
atcagctggagaacattatg

SEQ ID NO: 7304791 - DNA, 22 bp, Homo sapiens
atcagctggaacaagtgtctga

SEQ ID NO: 7304792 - DNA, 22 bp, Homo sapiens
ctgtcgcctggtcctctctgga

SEQ ID NO: 7304793 - DNA, 22 bp, Homo sapiens
ctgtctcctccactgcatggga

SEQ ID NO: 7304794 - DNA, 22 bp, Homo sapiens
atcagggtcttctttcagccta

SEQ ID NO: 7304795 - DNA, 22 bp, Homo sapiens
atcagtttgagtgctgtgtcaa

SEQ ID NO: 7304796 - DNA, 22 bp, Homo sapiens
atcagtttgtatatgaaacact

SEQ ID NO: 7304797 - DNA, 22 bp, Homo sapiens
atcacaaaggtctcagagcaca

SEQ ID NO: 7304798 - DNA, 22 bp, Homo sapiens
atcacaaaggtctcagagcaca

SEQ ID NO: 7304799 - DNA, 22 bp, Homo sapiens
atcacaaagggttttctctgag

SEQ ID NO: 7304800 - DNA, 22 bp, Homo sapiens
atcacaaagggttttctctgag

SEQ ID NO: 7304801 - DNA, 22 bp, Homo sapiens
atcacaatcttcaaatcgattc

SEQ ID NO: 7304802 - DNA, 22 bp, Homo sapiens
atcacagattgtgaataactat

SEQ ID NO: 7304803 - DNA, 22 bp, Homo sapiens
atcagcatctttaacaattacc

SEQ ID NO: 7304804 - DNA, 22 bp, Homo sapiens
atcagctgatgaatggatgaat

SEQ ID NO: 7304805 - DNA, 22 bp, Homo sapiens
atcagctgaaaaacaggcagca

SEQ ID NO: 7304806 - DNA, 19 bp, Homo sapiens
atcagctgaagccttcaga

SEQ ID NO: 7304807 - DNA, 21 bp, Homo sapiens
ctgtaagaaatcagttttatc

SEQ ID NO: 7304808 - DNA, 22 bp, Homo sapiens
ctgtaagatgggataagacttt

SEQ ID NO: 7304809 - DNA, 22 bp, Homo sapiens
ctgggagcttgttaggaatgca

SEQ ID NO: 7304810 - DNA, 22 bp, Homo sapiens
ctgggagcttttagaaatgcag

SEQ ID NO: 7304811 - DNA, 22 bp, Homo sapiens
ctgggagcttttagaaatgcag

SEQ ID NO: 7304812 - DNA, 22 bp, Homo sapiens
ctgggaggacaacttggagctc

SEQ ID NO: 7304813 - DNA, 22 bp, Homo sapiens
ctgggaggacaacttggagctc

SEQ ID NO: 7304814 - DNA, 22 bp, Homo sapiens
ctgggaggattcattgaggtga

SEQ ID NO: 7304815 - DNA, 22 bp, Homo sapiens
ctgggaggatacacaagatcag

SEQ ID NO: 7304816 - DNA, 22 bp, Homo sapiens
ctgggaggtggaggttgcattg

SEQ ID NO: 7304817 - DNA, 22 bp, Homo sapiens
ctgggaggggtagccaatccta

SEQ ID NO: 7304818 - DNA, 22 bp, Homo sapiens
ctgggggcaagcagacagctgt

SEQ ID NO: 7304819 - DNA, 22 bp, Homo sapiens
atattattctagctcttgtgtg

SEQ ID NO: 7304820 - DNA, 23 bp, Homo sapiens
ctggggctttcaaatctgggcag

SEQ ID NO: 7304821 - DNA, 22 bp, Homo sapiens
ctggggcttcaatgcttcggtg

SEQ ID NO: 7304822 - DNA, 22 bp, Homo sapiens
ctggtcatcactctaacagact

SEQ ID NO: 7304823 - DNA, 22 bp, Homo sapiens
atattcaaattacatttactaa

SEQ ID NO: 7304824 - DNA, 22 bp, Homo sapiens
atattcaaattacatttactaa

SEQ ID NO: 7304825 - DNA, 22 bp, Homo sapiens
atattattctagtaacagtgat

SEQ ID NO: 7304826 - DNA, 22 bp, Homo sapiens
atattcacactgtttagttaca

SEQ ID NO: 7304827 - DNA, 22 bp, Homo sapiens
cttatgtacacacatatattgt

SEQ ID NO: 7304828 - DNA, 22 bp, Homo sapiens
cttattcataagtcagacacac

SEQ ID NO: 7304829 - DNA, 22 bp, Homo sapiens
cttattcagatacagactcttg

SEQ ID NO: 7304830 - DNA, 22 bp, Homo sapiens
cttattcagaaggagaaatgga

SEQ ID NO: 7304831 - DNA, 22 bp, Homo sapiens
cttcaacatacacagagagagg

SEQ ID NO: 7304832 - DNA, 22 bp, Homo sapiens
atcatcagggacatttctgtgc

SEQ ID NO: 7304833 - DNA, 22 bp, Homo sapiens
atcataggatttaggtccatct

SEQ ID NO: 7304834 - DNA, 23 bp, Homo sapiens
atcataggccctagagagaaggc

SEQ ID NO: 7304835 - DNA, 22 bp, Homo sapiens
atcataggtataagtaaattag

SEQ ID NO: 7304836 - DNA, 22 bp, Homo sapiens
atcataggtgtgttaccagtta

SEQ ID NO: 7304837 - DNA, 22 bp, Homo sapiens
cttaacaagcccaactttcatt

SEQ ID NO: 7304838 - DNA, 22 bp, Homo sapiens
atcatacagcctttgttagtgt

SEQ ID NO: 7304839 - DNA, 22 bp, Homo sapiens
atcatacatacatggtcctcag

SEQ ID NO: 7304840 - DNA, 22 bp, Homo sapiens
atcatacagaacctgagcactt

SEQ ID NO: 7304841 - DNA, 19 bp, Homo sapiens
atcatacatgttacactct

SEQ ID NO: 7304842 - DNA, 19 bp, Homo sapiens
atcatacatgttacactct

SEQ ID NO: 7304843 - DNA, 19 bp, Homo sapiens
atcatacatgttacactct

SEQ ID NO: 7304844 - DNA, 22 bp, Homo sapiens
cttaacatcctgcatttttctt

SEQ ID NO: 7304845 - DNA, 22 bp, Homo sapiens
cttaacatcctgcatttttctt

SEQ ID NO: 7304846 - DNA, 22 bp, Homo sapiens
cttaagaaattgcattctaatc

SEQ ID NO: 7304847 - DNA, 22 bp, Homo sapiens
cttaagacaggctcaaagatta

SEQ ID NO: 7304848 - DNA, 22 bp, Homo sapiens
cttaagaatattgaagttgtgg

SEQ ID NO: 7304849 - DNA, 22 bp, Homo sapiens
atccatttcctccactataaag

SEQ ID NO: 7304850 - DNA, 22 bp, Homo sapiens
atccatgaccctctcaacaacc

SEQ ID NO: 7304851 - DNA, 22 bp, Homo sapiens
cttaataaatggtagctgttat

SEQ ID NO: 7304852 - DNA, 22 bp, Homo sapiens
cttctgagatgttgttttacag

SEQ ID NO: 7304853 - DNA, 22 bp, Homo sapiens
cttctgcaggagtcaactctgg

SEQ ID NO: 7304854 - DNA, 22 bp, Homo sapiens
cttccttggcttctggggtgtg

SEQ ID NO: 7304855 - DNA, 22 bp, Homo sapiens
atctggttcttcttaggcatca

SEQ ID NO: 7304856 - DNA, 22 bp, Homo sapiens
cttcttaactgtatatactatg

SEQ ID NO: 7304857 - DNA, 22 bp, Homo sapiens
atctgtaattttgaatgcaaat

SEQ ID NO: 7304858 - DNA, 22 bp, Homo sapiens
atctgtaacatcagtagcagaa

SEQ ID NO: 7304859 - DNA, 22 bp, Homo sapiens
atctgtaacactaagggcaaag

SEQ ID NO: 7304860 - DNA, 22 bp, Homo sapiens
atctggttttggctgtgtccct

SEQ ID NO: 7304861 - DNA, 22 bp, Homo sapiens
atctggttttggctgtgtccct

SEQ ID NO: 7304862 - DNA, 22 bp, Homo sapiens
atctgtgtgttattgtttatca

SEQ ID NO: 7304863 - DNA, 22 bp, Homo sapiens
atctgtgtgttcaggaagtcct

SEQ ID NO: 7304864 - DNA, 23 bp, Homo sapiens
atctgtgtgtgggtagggatgat

SEQ ID NO: 7304865 - DNA, 22 bp, Homo sapiens
atctgtgtgttgagttctcagc

SEQ ID NO: 7304866 - DNA, 22 bp, Homo sapiens
atctgttaggtcaggtatggaa

SEQ ID NO: 7304867 - DNA, 22 bp, Homo sapiens
atagtttgaaggctgttctact

SEQ ID NO: 7304868 - DNA, 22 bp, Homo sapiens
atagtttgctttaatacaactg

SEQ ID NO: 7304869 - DNA, 22 bp, Homo sapiens
ctggcctctctgagcagggagc

SEQ ID NO: 7304870 - DNA, 22 bp, Homo sapiens
ctggctctttcctagctaggct

SEQ ID NO: 7304871 - DNA, 22 bp, Homo sapiens
atataaagtgtttagaaagctg

SEQ ID NO: 7304872 - DNA, 23 bp, Homo sapiens
atataaacaccagatagattgta

SEQ ID NO: 7304873 - DNA, 22 bp, Homo sapiens
atataaagagcttagtatagtg

SEQ ID NO: 7304874 - DNA, 22 bp, Homo sapiens
ctgggagctggatgccctgccc

SEQ ID NO: 7304875 - DNA, 22 bp, Homo sapiens
ctgggagcttgttaggaatgca

SEQ ID NO: 7304876 - DNA, 22 bp, Homo sapiens
ctgggagctggaatgggagaag

SEQ ID NO: 7304877 - DNA, 22 bp, Homo sapiens
atatactgaggagactttatat

SEQ ID NO: 7304878 - DNA, 22 bp, Homo sapiens
atatactgatagctgcacttct

SEQ ID NO: 7304879 - DNA, 22 bp, Homo sapiens
atatactgtaggccactataag

SEQ ID NO: 7304880 - DNA, 22 bp, Homo sapiens
atatactgtgttccatggacca

SEQ ID NO: 7304881 - DNA, 20 bp, Homo sapiens
atataccatcccacaacagg

SEQ ID NO: 7304882 - DNA, 19 bp, Homo sapiens
atatacatactgtgtgcat

SEQ ID NO: 7304883 - DNA, 19 bp, Homo sapiens
atatacatactgtgtgcat

SEQ ID NO: 7304884 - DNA, 22 bp, Homo sapiens
ctggctgaggcagagcctgggg

SEQ ID NO: 7304885 - DNA, 22 bp, Homo sapiens
atatacacatttgcttatgtgt

SEQ ID NO: 7304886 - DNA, 22 bp, Homo sapiens
atatacacatttgcttatgtgt

SEQ ID NO: 7304887 - DNA, 22 bp, Homo sapiens
atatacacatgtgtatacattt

SEQ ID NO: 7304888 - DNA, 22 bp, Homo sapiens
atatacaggtggtatgtgtaaa

SEQ ID NO: 7304889 - DNA, 22 bp, Homo sapiens
atatacaggtggtatgtgtaaa

SEQ ID NO: 7304890 - DNA, 22 bp, Homo sapiens
atatacactcaccatggtattt

SEQ ID NO: 7304891 - DNA, 22 bp, Homo sapiens
atatacactcaccatggtattt

SEQ ID NO: 7304892 - DNA, 22 bp, Homo sapiens
atatacactccactgatacagg

SEQ ID NO: 7304893 - DNA, 22 bp, Homo sapiens
atatacactgtttcagttgaag

SEQ ID NO: 7304894 - DNA, 22 bp, Homo sapiens
atatacactccactgatacagg

SEQ ID NO: 7304895 - DNA, 22 bp, Homo sapiens
atatacactgtttcagttgaag

SEQ ID NO: 7304896 - DNA, 17 bp, Homo sapiens
atacatgtaaagtgctt

SEQ ID NO: 7304897 - DNA, 22 bp, Homo sapiens
atacatgtaactgcattgtaat

SEQ ID NO: 7304898 - DNA, 19 bp, Homo sapiens
atacatgcatttacatgct

SEQ ID NO: 7304899 - DNA, 22 bp, Homo sapiens
atacatgtgggtctaaacatat

SEQ ID NO: 7304900 - DNA, 22 bp, Homo sapiens
atacatgtgggtctaaacatat

SEQ ID NO: 7304901 - DNA, 22 bp, Homo sapiens
atacatgtacataaatgtagca

SEQ ID NO: 7304902 - DNA, 22 bp, Homo sapiens
atacatgtaactgcattgtaat

SEQ ID NO: 7304903 - DNA, 22 bp, Homo sapiens
atacatgtgtccctgatttatt

SEQ ID NO: 7304904 - DNA, 22 bp, Homo sapiens
atacatgtgtccctgatttatt

SEQ ID NO: 7304905 - DNA, 22 bp, Homo sapiens
atacacattactttctgtctga

SEQ ID NO: 7304906 - DNA, 22 bp, Homo sapiens
atacacattactttctgtctga

SEQ ID NO: 7304907 - DNA, 22 bp, Homo sapiens
atacacatgtgtatgtgcatgc

SEQ ID NO: 7304908 - DNA, 22 bp, Homo sapiens
atacacatgtgtatgtgcatgc

SEQ ID NO: 7304909 - DNA, 22 bp, Homo sapiens
ctggcaagtactgggccagctc

SEQ ID NO: 7304910 - DNA, 22 bp, Homo sapiens
ctggcacacagcaggctctcag

SEQ ID NO: 7304911 - DNA, 22 bp, Homo sapiens
ctggcaggtggaggttgcagtg

SEQ ID NO: 7304912 - DNA, 22 bp, Homo sapiens
ctggcaggttatagagctgccc

SEQ ID NO: 7304913 - DNA, 22 bp, Homo sapiens
ctggccctatgagcctcctgat

SEQ ID NO: 7304914 - DNA, 22 bp, Homo sapiens
ctggccagaggttcctctgccc

SEQ ID NO: 7304915 - DNA, 22 bp, Homo sapiens
ctggcctcagagggtcatggtg

SEQ ID NO: 7304916 - DNA, 22 bp, Homo sapiens
ctggcctcacctcagacttact

SEQ ID NO: 7304917 - DNA, 22 bp, Homo sapiens
ctggcctcagagggtcatggtg

SEQ ID NO: 7304918 - DNA, 22 bp, Homo sapiens
ctgcagggaccacaagcaggtt

SEQ ID NO: 7304919 - DNA, 22 bp, Homo sapiens
ctgcagggacccaagtctttgg

SEQ ID NO: 7304920 - DNA, 22 bp, Homo sapiens
ctgcagggagaggggacagcct

SEQ ID NO: 7304921 - DNA, 22 bp, Homo sapiens
ataaacatctgtttctcttctg

SEQ ID NO: 7304922 - DNA, 22 bp, Homo sapiens
ataaagcaggtccccagacact

SEQ ID NO: 7304923 - DNA, 22 bp, Homo sapiens
ataaagctaagacttacatgaa

SEQ ID NO: 7304924 - DNA, 22 bp, Homo sapiens
agttctggttgcccatgacatc

SEQ ID NO: 7304925 - DNA, 22 bp, Homo sapiens
agttctggttaacctgcaacct

SEQ ID NO: 7304926 - DNA, 22 bp, Homo sapiens
agttctgggaaaaacatggcca

SEQ ID NO: 7304927 - DNA, 22 bp, Homo sapiens
agttctgggaggtgcacgtcca

SEQ ID NO: 7304928 - DNA, 22 bp, Homo sapiens
agttctggcccagggtttcttg

SEQ ID NO: 7304929 - DNA, 22 bp, Homo sapiens
agttctggcgcccatgagcaga

SEQ ID NO: 7304930 - DNA, 22 bp, Homo sapiens
agttctggaactctacagcaac

SEQ ID NO: 7304931 - DNA, 22 bp, Homo sapiens
ataaaacttattagaattgtgt

SEQ ID NO: 7304932 - DNA, 20 bp, Homo sapiens
ataaaactctaatctggcct

SEQ ID NO: 7304933 - DNA, 22 bp, Homo sapiens
ataaaaggaaagcctgttgtga

SEQ ID NO: 7304934 - DNA, 22 bp, Homo sapiens
ataaaagatcccttctgagctc

SEQ ID NO: 7304935 - DNA, 22 bp, Homo sapiens
ataaaaatgagggcggtagcta

SEQ ID NO: 7304936 - DNA, 17 bp, Homo sapiens
agttttgatataatggc

SEQ ID NO: 7304937 - DNA, 22 bp, Homo sapiens
ctgctggggtcagagcactggg

SEQ ID NO: 7304938 - DNA, 22 bp, Homo sapiens
atacaagttaatgagaatgaca

SEQ ID NO: 7304939 - DNA, 22 bp, Homo sapiens
atacaagttctcatgtgtatct

SEQ ID NO: 7304940 - DNA, 22 bp, Homo sapiens
atacacatatcaggtgtataca

SEQ ID NO: 7304941 - DNA, 22 bp, Homo sapiens
atacacatatcaggtgtataca

SEQ ID NO: 7304942 - DNA, 22 bp, Homo sapiens
atacacatatgtgtgtatatgt

SEQ ID NO: 7304943 - DNA, 22 bp, Homo sapiens
atacacatatgtgtgtatatgt

SEQ ID NO: 7304944 - DNA, 22 bp, Homo sapiens
atacacatgcacacatgtgtgt

SEQ ID NO: 7304945 - DNA, 22 bp, Homo sapiens
atacacatgcacacatgtgtgt

SEQ ID NO: 7304946 - DNA, 22 bp, Homo sapiens
atacaagttgcccaaatgatta

SEQ ID NO: 7304947 - DNA, 22 bp, Homo sapiens
atacacaggtgctaggtcaata

SEQ ID NO: 7304948 - DNA, 21 bp, Homo sapiens
atacacatacacataaatgtg

SEQ ID NO: 7304949 - DNA, 19 bp, Homo sapiens
atacacatacgtaaactga

SEQ ID NO: 7304950 - DNA, 19 bp, Homo sapiens
atacacatacgtaaactga

SEQ ID NO: 7304951 - DNA, 22 bp, Homo sapiens
atacacatatatacacgtttaa

SEQ ID NO: 7304952 - DNA, 22 bp, Homo sapiens
atacacatatcaggtgtataca

SEQ ID NO: 7304953 - DNA, 22 bp, Homo sapiens
ctgctgggcctggtctctgagg

SEQ ID NO: 7304954 - DNA, 22 bp, Homo sapiens
ctgctgggctcctcatgtgact

SEQ ID NO: 7304955 - DNA, 21 bp, Homo sapiens
ctgctacttttcttactgtag

SEQ ID NO: 7304956 - DNA, 22 bp, Homo sapiens
ctgctacttttgcctgagtaac

SEQ ID NO: 7304957 - DNA, 22 bp, Homo sapiens
ctgctacttaccagctgtgtaa

SEQ ID NO: 7304958 - DNA, 21 bp, Homo sapiens
ctgctacttcatggaaaatag

SEQ ID NO: 7304959 - DNA, 22 bp, Homo sapiens
ctgctacttccagaagtgtcga

SEQ ID NO: 7304960 - DNA, 22 bp, Homo sapiens
ctgctactcgttgcattccggt

SEQ ID NO: 7304961 - DNA, 22 bp, Homo sapiens
ctgctactcttgtatgtgtatt

SEQ ID NO: 7304962 - DNA, 22 bp, Homo sapiens
ctgctactgaaattagatagtc

SEQ ID NO: 7304963 - DNA, 22 bp, Homo sapiens
ctgctactggccagctttgcag

SEQ ID NO: 7304964 - DNA, 22 bp, Homo sapiens
ctgctactggttctgcttgttc

SEQ ID NO: 7304965 - DNA, 22 bp, Homo sapiens
ctgcctgtgccaatgctccttt

SEQ ID NO: 7304966 - DNA, 22 bp, Homo sapiens
ctgcctgtgccaccgcctcatt

SEQ ID NO: 7304967 - DNA, 22 bp, Homo sapiens
ctgcctgtattgtctgcttggg

SEQ ID NO: 7304968 - DNA, 22 bp, Homo sapiens
ctgcctgtgatttttctctagt

SEQ ID NO: 7304969 - DNA, 22 bp, Homo sapiens
ataaaggaaattccatgtctaa

SEQ ID NO: 7304970 - DNA, 22 bp, Homo sapiens
ctatatttcttggctttaaaca

SEQ ID NO: 7304971 - DNA, 22 bp, Homo sapiens
ctatcaaacagccattaatata

SEQ ID NO: 7304972 - DNA, 22 bp, Homo sapiens
ctatatttggtgagggatgtct

SEQ ID NO: 7304973 - DNA, 22 bp, Homo sapiens
ctatcaaacagccattaatata

SEQ ID NO: 7304974 - DNA, 22 bp, Homo sapiens
ctatccaaggagtttttgaaat

SEQ ID NO: 7304975 - DNA, 22 bp, Homo sapiens
ctagtctgtgtgggaccagggc

SEQ ID NO: 7304976 - DNA, 22 bp, Homo sapiens
ctagtctgcagcggggaggggt

SEQ ID NO: 7304977 - DNA, 22 bp, Homo sapiens
ctattctagattacagtataaa

SEQ ID NO: 7304978 - DNA, 22 bp, Homo sapiens
ctattctaagctcagaatccca

SEQ ID NO: 7304979 - DNA, 22 bp, Homo sapiens
ctattgcatttgcatcttcatc

SEQ ID NO: 7304980 - DNA, 22 bp, Homo sapiens
ctagctgacgggttgataggtg

SEQ ID NO: 7304981 - DNA, 19 bp, Homo sapiens
ctagcttgtcatttgtgtg

SEQ ID NO: 7304982 - DNA, 22 bp, Homo sapiens
ctagctttgtccattgtcttgc

SEQ ID NO: 7304983 - DNA, 22 bp, Homo sapiens
ctaggaaagacacagagagttt

SEQ ID NO: 7304984 - DNA, 22 bp, Homo sapiens
ctaggaaagtgattcttcaatt

SEQ ID NO: 7304985 - DNA, 22 bp, Homo sapiens
ctaggaaatactgtttcaaggc

SEQ ID NO: 7304986 - DNA, 20 bp, Homo sapiens
agtcacatgcatacacaagt

SEQ ID NO: 7304987 - DNA, 22 bp, Homo sapiens
agtatttctgaatattatcata

SEQ ID NO: 7304988 - DNA, 22 bp, Homo sapiens
agtatttctgaatattatcata

SEQ ID NO: 7304989 - DNA, 22 bp, Homo sapiens
agtatttctgctcatgaaagag

SEQ ID NO: 7304990 - DNA, 22 bp, Homo sapiens
agtcaagtaggacctgttctag

SEQ ID NO: 7304991 - DNA, 22 bp, Homo sapiens
agtagatagattctaagcacta

SEQ ID NO: 7304992 - DNA, 22 bp, Homo sapiens
agtagataccagttctttgact

SEQ ID NO: 7304993 - DNA, 22 bp, Homo sapiens
agtagaaatgtagtgtagagaa

SEQ ID NO: 7304994 - DNA, 22 bp, Homo sapiens
agtacatacttcaaatgtactt

SEQ ID NO: 7304995 - DNA, 22 bp, Homo sapiens
agtaacagagcatgggttcaga

SEQ ID NO: 7304996 - DNA, 22 bp, Homo sapiens
ccttctctctgaagaccccaaa

SEQ ID NO: 7304997 - DNA, 22 bp, Homo sapiens
agtaaatttcagctccattgta

SEQ ID NO: 7304998 - DNA, 22 bp, Homo sapiens
agtaaagcggtgtcacagaatg

SEQ ID NO: 7304999 - DNA, 22 bp, Homo sapiens
agtaaacagtttcttagaagaa

SEQ ID NO: 7305000 - DNA, 22 bp, Homo sapiens
aggtaagggctgcgactataag

SEQ ID NO: 7305001 - DNA, 22 bp, Homo sapiens
aggtaaggggctcccaagtacc

SEQ ID NO: 7305002 - DNA, 22 bp, Homo sapiens
aggtaaattcagcagtgacatt

SEQ ID NO: 7305003 - DNA, 22 bp, Homo sapiens
aggtaatagggttcagaattat

SEQ ID NO: 7305004 - DNA, 22 bp, Homo sapiens
agggtttcttgcttatggtgct

SEQ ID NO: 7305005 - DNA, 21 bp, Homo sapiens
agggttttatagatctcttcc

SEQ ID NO: 7305006 - DNA, 22 bp, Homo sapiens
cctgggagggcaagtgctgatg

SEQ ID NO: 7305007 - DNA, 22 bp, Homo sapiens
cctgggagggcaagtgctgatg

SEQ ID NO: 7305008 - DNA, 22 bp, Homo sapiens
cctgggaggctgtgggtctgct

SEQ ID NO: 7305009 - DNA, 21 bp, Homo sapiens
cctgggagaattgggtgtggc

SEQ ID NO: 7305010 - DNA, 22 bp, Homo sapiens
aggtcaggtatcagcaggtatt

SEQ ID NO: 7305011 - DNA, 22 bp, Homo sapiens
aggtcacgtcctgtgatgtcat

SEQ ID NO: 7305012 - DNA, 20 bp, Homo sapiens
aggtcactgttagggcattc

SEQ ID NO: 7305013 - DNA, 22 bp, Homo sapiens
aggtcactgatttttttaatga

SEQ ID NO: 7305014 - DNA, 22 bp, Homo sapiens
aggtcacttggtgttattcagc

SEQ ID NO: 7305015 - DNA, 22 bp, Homo sapiens
aggtcacttcacacgttaatgt

SEQ ID NO: 7305016 - DNA, 22 bp, Homo sapiens
aggtcacttcctgtctggataa

SEQ ID NO: 7305017 - DNA, 22 bp, Homo sapiens
aggtcaccatggcatgctccac

SEQ ID NO: 7305018 - DNA, 22 bp, Homo sapiens
aggtcacatggataatgatcag

SEQ ID NO: 7305019 - DNA, 22 bp, Homo sapiens
aggtcacatggataatgatcag

SEQ ID NO: 7305020 - DNA, 22 bp, Homo sapiens
aggtcacccgtttgactatcca

SEQ ID NO: 7305021 - DNA, 22 bp, Homo sapiens
ccttccagagttcagtctgccc

SEQ ID NO: 7305022 - DNA, 22 bp, Homo sapiens
ccttccagaaagcacttagtta

SEQ ID NO: 7305023 - DNA, 22 bp, Homo sapiens
ccttccaggctggaggcttggg

SEQ ID NO: 7305024 - DNA, 22 bp, Homo sapiens
ccttccagccccatctcatcgt

SEQ ID NO: 7305025 - DNA, 19 bp, Homo sapiens
ccttccagctccttttcag

SEQ ID NO: 7305026 - DNA, 22 bp, Homo sapiens
cctgtgggtacaacagggtcac

SEQ ID NO: 7305027 - DNA, 22 bp, Homo sapiens
cctgtgggagcccaggcagata

SEQ ID NO: 7305028 - DNA, 17 bp, Homo sapiens
aggtgcagaggcagagc

SEQ ID NO: 7305029 - DNA, 22 bp, Homo sapiens
cctggggctctgcacagagcag

SEQ ID NO: 7305030 - DNA, 22 bp, Homo sapiens
ctctggagttctcatgaggaac

SEQ ID NO: 7305031 - DNA, 22 bp, Homo sapiens
ctctggagttcccttgatctga

SEQ ID NO: 7305032 - DNA, 22 bp, Homo sapiens
agtgggtgggtgtctgacagtt

SEQ ID NO: 7305033 - DNA, 22 bp, Homo sapiens
agtgtcctcctctgggagccag

SEQ ID NO: 7305034 - DNA, 22 bp, Homo sapiens
agtgtctggtctctgaactaaa

SEQ ID NO: 7305035 - DNA, 22 bp, Homo sapiens
agtgtctgggctcccttggagc

SEQ ID NO: 7305036 - DNA, 22 bp, Homo sapiens
agtgtccaagtcttctgtttgt

SEQ ID NO: 7305037 - DNA, 22 bp, Homo sapiens
agttatttcagtaacataatag

SEQ ID NO: 7305038 - DNA, 22 bp, Homo sapiens
agttcccaggtgatgctgatgt

SEQ ID NO: 7305039 - DNA, 22 bp, Homo sapiens
agttaacacatccagaatagag

SEQ ID NO: 7305040 - DNA, 22 bp, Homo sapiens
agtgtttgagacacatttcact

SEQ ID NO: 7305041 - DNA, 17 bp, Homo sapiens
agtgtttccttatcatt

SEQ ID NO: 7305042 - DNA, 22 bp, Homo sapiens
agtgtttggggtgattgtaacc

SEQ ID NO: 7305043 - DNA, 22 bp, Homo sapiens
agtgtttgtaaactacagatct

SEQ ID NO: 7305044 - DNA, 22 bp, Homo sapiens
agtgtttgtaaactacagatct

SEQ ID NO: 7305045 - DNA, 22 bp, Homo sapiens
agtgttttattagaacacagcc

SEQ ID NO: 7305046 - DNA, 22 bp, Homo sapiens
agtgttttatttcagcactttg

SEQ ID NO: 7305047 - DNA, 22 bp, Homo sapiens
agtgtttttacaagcactctgg

SEQ ID NO: 7305048 - DNA, 22 bp, Homo sapiens
agtgttttggagtgggaaggca

SEQ ID NO: 7305049 - DNA, 22 bp, Homo sapiens
agtgttttgctaatcctattaa

SEQ ID NO: 7305050 - DNA, 22 bp, Homo sapiens
agtgtttttcaggagcagaaca

SEQ ID NO: 7305051 - DNA, 22 bp, Homo sapiens
agtgtttttgggtagggtgagt

SEQ ID NO: 7305052 - DNA, 22 bp, Homo sapiens
agttaaatcattactgacagag

SEQ ID NO: 7305053 - DNA, 22 bp, Homo sapiens
agttaaagtctgaaatagagaa

SEQ ID NO: 7305054 - DNA, 22 bp, Homo sapiens
agttaaagaaagataattcgcc

SEQ ID NO: 7305055 - DNA, 22 bp, Homo sapiens
agttaacacaagtaagattcca

SEQ ID NO: 7305056 - DNA, 22 bp, Homo sapiens
agtgtggacttttcctaggagg

SEQ ID NO: 7305057 - DNA, 22 bp, Homo sapiens
agtgaggggcagctgagtgggc

SEQ ID NO: 7305058 - DNA, 22 bp, Homo sapiens
agtgagggactagtgctgggga

SEQ ID NO: 7305059 - DNA, 22 bp, Homo sapiens
agtgaggggattcaggcaaggt

SEQ ID NO: 7305060 - DNA, 19 bp, Homo sapiens
agtgaaatggagtattcaa

SEQ ID NO: 7305061 - DNA, 22 bp, Homo sapiens
agtgaaaacctaatcatgcagt

SEQ ID NO: 7305062 - DNA, 22 bp, Homo sapiens
agtgaaaacctaatcatgcagt

SEQ ID NO: 7305063 - DNA, 22 bp, Homo sapiens
agtgaaatatgcccattgctgt

SEQ ID NO: 7305064 - DNA, 22 bp, Homo sapiens
ctcacagtctctccctaatttt

SEQ ID NO: 7305065 - DNA, 22 bp, Homo sapiens
agtctattttcagaagcagttt

SEQ ID NO: 7305066 - DNA, 22 bp, Homo sapiens
agtctatttgctgtccgagcaa

SEQ ID NO: 7305067 - DNA, 22 bp, Homo sapiens
agtctattgcctaacagagagg

SEQ ID NO: 7305068 - DNA, 22 bp, Homo sapiens
agtctagggtggggtccacagg

SEQ ID NO: 7305069 - DNA, 22 bp, Homo sapiens
agtctaggcagccctgcagggt

SEQ ID NO: 7305070 - DNA, 22 bp, Homo sapiens
agtctacatttctaacaagctc

SEQ ID NO: 7305071 - DNA, 22 bp, Homo sapiens
agtctacaatcttaaatgaact

SEQ ID NO: 7305072 - DNA, 22 bp, Homo sapiens
ctcacatatgctgggatttccg

SEQ ID NO: 7305073 - DNA, 22 bp, Homo sapiens
ctcacagttggctcattaatga

SEQ ID NO: 7305074 - DNA, 22 bp, Homo sapiens
ctcacattccacttgtgccaac

SEQ ID NO: 7305075 - DNA, 19 bp, Homo sapiens
agtctttcccactcgtctt

SEQ ID NO: 7305076 - DNA, 22 bp, Homo sapiens
agtctttggttataagagacag

SEQ ID NO: 7305077 - DNA, 22 bp, Homo sapiens
agtggaaggctgggaaatgcgg

SEQ ID NO: 7305078 - DNA, 22 bp, Homo sapiens
agtgcttttatatcattaatcc

SEQ ID NO: 7305079 - DNA, 22 bp, Homo sapiens
agtggagcaggcggcgctcact

SEQ ID NO: 7305080 - DNA, 22 bp, Homo sapiens
agtggcaaagtcttcagaagtt

SEQ ID NO: 7305081 - DNA, 22 bp, Homo sapiens
agtgccaaaaaaaggacttaat

SEQ ID NO: 7305082 - DNA, 22 bp, Homo sapiens
agtgccaaacagtacataacat

SEQ ID NO: 7305083 - DNA, 22 bp, Homo sapiens
agtgccaagtagaaatgaattt

SEQ ID NO: 7305084 - DNA, 22 bp, Homo sapiens
agtgccattcaagttttaaggg

SEQ ID NO: 7305085 - DNA, 22 bp, Homo sapiens
agtgcctaaccccttgtatgaa

SEQ ID NO: 7305086 - DNA, 22 bp, Homo sapiens
agtgcctagatattgtttgaac

SEQ ID NO: 7305087 - DNA, 22 bp, Homo sapiens
agtgcgtggacccctggctgct

SEQ ID NO: 7305088 - DNA, 22 bp, Homo sapiens
agtgcgtgggcaggcatggaag

SEQ ID NO: 7305089 - DNA, 22 bp, Homo sapiens
agtgcgtggtttacagctagtt

SEQ ID NO: 7305090 - DNA, 22 bp, Homo sapiens
attgtgcagcacagatcatgac

SEQ ID NO: 7305091 - DNA, 22 bp, Homo sapiens
attgtgcagatagtaattagga

SEQ ID NO: 7305092 - DNA, 22 bp, Homo sapiens
attgtgcagaattggaattgca

SEQ ID NO: 7305093 - DNA, 22 bp, Homo sapiens
attgtgcacctactgtgtgcag

SEQ ID NO: 7305094 - DNA, 22 bp, Homo sapiens
attgtgcagcagtggtacctgg

SEQ ID NO: 7305095 - DNA, 20 bp, Homo sapiens
attgtgcagcccttggcaga

SEQ ID NO: 7305096 - DNA, 22 bp, Homo sapiens
attgtgcagctctgctcttatt

SEQ ID NO: 7305097 - DNA, 22 bp, Homo sapiens
attgtgcaggtcagttattgca

SEQ ID NO: 7305098 - DNA, 22 bp, Homo sapiens
attgtgcagtaaagtccttttc

SEQ ID NO: 7305099 - DNA, 22 bp, Homo sapiens
attgtgcatctactgtgtgcag

SEQ ID NO: 7305100 - DNA, 22 bp, Homo sapiens
attgttaatgttgcactaaggt

SEQ ID NO: 7305101 - DNA, 22 bp, Homo sapiens
attgttactgggttaatttgga

SEQ ID NO: 7305102 - DNA, 18 bp, Homo sapiens
gcagtgcaggaagaagag

SEQ ID NO: 7305103 - DNA, 22 bp, Homo sapiens
gcagtgctaagtagctggccca

SEQ ID NO: 7305104 - DNA, 22 bp, Homo sapiens
attgtaacaacaatagtttagg

SEQ ID NO: 7305105 - DNA, 22 bp, Homo sapiens
attgtaagtagaaatgttatgg

SEQ ID NO: 7305106 - DNA, 22 bp, Homo sapiens
attgtacaatgcctggaacatt

SEQ ID NO: 7305107 - DNA, 22 bp, Homo sapiens
gccactgattccaagtcaattt

SEQ ID NO: 7305108 - DNA, 22 bp, Homo sapiens
gccactgtcataccctggcaat

SEQ ID NO: 7305109 - DNA, 22 bp, Homo sapiens
gccactgtcatcttgtgaagca

SEQ ID NO: 7305110 - DNA, 22 bp, Homo sapiens
gccactgtagagtatggacaag

SEQ ID NO: 7305111 - DNA, 22 bp, Homo sapiens
gccactgtactccagcctgcga

SEQ ID NO: 7305112 - DNA, 22 bp, Homo sapiens
gccactgtcctgtgcctgtgct

SEQ ID NO: 7305113 - DNA, 22 bp, Homo sapiens
gcaggctgtctaaagttagagt

SEQ ID NO: 7305114 - DNA, 22 bp, Homo sapiens
gcaggattgggcagagggtgaa

SEQ ID NO: 7305115 - DNA, 22 bp, Homo sapiens
gcaggatgccagggcagcagcg

SEQ ID NO: 7305116 - DNA, 22 bp, Homo sapiens
attgtaaagtactgtgtacaat

SEQ ID NO: 7305117 - DNA, 22 bp, Homo sapiens
gcagggtctgaggccacagagg

SEQ ID NO: 7305118 - DNA, 22 bp, Homo sapiens
gcagggtcttgagaggcagcca

SEQ ID NO: 7305119 - DNA, 22 bp, Homo sapiens
gcagggtccatggaggcagccc

SEQ ID NO: 7305120 - DNA, 22 bp, Homo sapiens
gcagaggcctaggtggaaggcc

SEQ ID NO: 7305121 - DNA, 22 bp, Homo sapiens
gcagaatactgagagctgattg

SEQ ID NO: 7305122 - DNA, 22 bp, Homo sapiens
gcagaataatagaaaggcacac

SEQ ID NO: 7305123 - DNA, 22 bp, Homo sapiens
gcagaatattatggaaaaagta

SEQ ID NO: 7305124 - DNA, 22 bp, Homo sapiens
gcagatcaattgattgttcact

SEQ ID NO: 7305125 - DNA, 18 bp, Homo sapiens
gcagatcattagataatt

SEQ ID NO: 7305126 - DNA, 22 bp, Homo sapiens
gcagcctgggcaacagagtgag

SEQ ID NO: 7305127 - DNA, 17 bp, Homo sapiens
gcagcctcttggtagtg

SEQ ID NO: 7305128 - DNA, 22 bp, Homo sapiens
gcacagaggaagcacagactct

SEQ ID NO: 7305129 - DNA, 22 bp, Homo sapiens
gcacagggagacagccgtggcc

SEQ ID NO: 7305130 - DNA, 22 bp, Homo sapiens
gcacagggagcaggtctctggt

SEQ ID NO: 7305131 - DNA, 22 bp, Homo sapiens
gcacagggagcaggtctctggt

SEQ ID NO: 7305132 - DNA, 22 bp, Homo sapiens
gcacagggaggctggcctggcc

SEQ ID NO: 7305133 - DNA, 22 bp, Homo sapiens
gcacagggcaacaggtctgtta

SEQ ID NO: 7305134 - DNA, 22 bp, Homo sapiens
gcacagggcaacaggtctgtta

SEQ ID NO: 7305135 - DNA, 20 bp, Homo sapiens
gcaaaataggctctgttggt

SEQ ID NO: 7305136 - DNA, 22 bp, Homo sapiens
gcaaaacagtcgatgcctccca

SEQ ID NO: 7305137 - DNA, 22 bp, Homo sapiens
gcaaaaaatgcttgttgcttag

SEQ ID NO: 7305138 - DNA, 22 bp, Homo sapiens
gcaaatgttctatatttgctgt

SEQ ID NO: 7305139 - DNA, 22 bp, Homo sapiens
gcaaatgtttttgagtgtttac

SEQ ID NO: 7305140 - DNA, 22 bp, Homo sapiens
gcacacagggatttttgaatgg

SEQ ID NO: 7305141 - DNA, 22 bp, Homo sapiens
gcaacagcccaggttctgtgtg

SEQ ID NO: 7305142 - DNA, 22 bp, Homo sapiens
attttaataagatccatttggt

SEQ ID NO: 7305143 - DNA, 22 bp, Homo sapiens
attttaataagatccatttggt

SEQ ID NO: 7305144 - DNA, 22 bp, Homo sapiens
attttaataagatccatttggt

SEQ ID NO: 7305145 - DNA, 22 bp, Homo sapiens
attttaaggcttatttaaaggc

SEQ ID NO: 7305146 - DNA, 23 bp, Homo sapiens
attttaaccttgactaacatgca

SEQ ID NO: 7305147 - DNA, 23 bp, Homo sapiens
attttaaccttgactaacatgca

SEQ ID NO: 7305148 - DNA, 22 bp, Homo sapiens
attttaaggcttatttaaaggc

SEQ ID NO: 7305149 - DNA, 22 bp, Homo sapiens
atttgtctttgagtgccctgct

SEQ ID NO: 7305150 - DNA, 22 bp, Homo sapiens
atttgtctttgagtgccctgct

SEQ ID NO: 7305151 - DNA, 22 bp, Homo sapiens
atttgtctgcttgctgccttcc

SEQ ID NO: 7305152 - DNA, 22 bp, Homo sapiens
atttgcatttagaaagatcact

SEQ ID NO: 7305153 - DNA, 22 bp, Homo sapiens
atttgccatgaagagtgtttga

SEQ ID NO: 7305154 - DNA, 21 bp, Homo sapiens
atttgcattaaaatattacgc

SEQ ID NO: 7305155 - DNA, 22 bp, Homo sapiens
atttgatttgtagatagtgtag

SEQ ID NO: 7305156 - DNA, 22 bp, Homo sapiens
atttgagaaaggagggaacttt

SEQ ID NO: 7305157 - DNA, 22 bp, Homo sapiens
atttgcaaagtcgtatctgtga

SEQ ID NO: 7305158 - DNA, 22 bp, Homo sapiens
atttgcacacagtctcctgtgg

SEQ ID NO: 7305159 - DNA, 22 bp, Homo sapiens
attttctagatagatgatgcat

SEQ ID NO: 7305160 - DNA, 22 bp, Homo sapiens
attttcttctctccctggctgc

SEQ ID NO: 7305161 - DNA, 22 bp, Homo sapiens
attttgaaaagcatttgagtaa

SEQ ID NO: 7305162 - DNA, 22 bp, Homo sapiens
attttgaaaagcatttgagtaa

SEQ ID NO: 7305163 - DNA, 22 bp, Homo sapiens
attttgaaatacttgaaggaaa

SEQ ID NO: 7305164 - DNA, 18 bp, Homo sapiens
attttgaacaatgctgta

SEQ ID NO: 7305165 - DNA, 21 bp, Homo sapiens
gcctgccccatgtttctgttg

SEQ ID NO: 7305166 - DNA, 22 bp, Homo sapiens
gcccagcaggacagagtggttt

SEQ ID NO: 7305167 - DNA, 22 bp, Homo sapiens
gcccactccagcttctcccaca

SEQ ID NO: 7305168 - DNA, 20 bp, Homo sapiens
gcccactctaatccactgtc

SEQ ID NO: 7305169 - DNA, 22 bp, Homo sapiens
atttacatttatttgagaaggt

SEQ ID NO: 7305170 - DNA, 22 bp, Homo sapiens
gccctccacctggtctctctgg

SEQ ID NO: 7305171 - DNA, 22 bp, Homo sapiens
gccctccatgagacacagtgta

SEQ ID NO: 7305172 - DNA, 22 bp, Homo sapiens
gccctccaccagagcccttctc

SEQ ID NO: 7305173 - DNA, 22 bp, Homo sapiens
gcccaggagttgaagggctgac

SEQ ID NO: 7305174 - DNA, 21 bp, Homo sapiens
gccccctggactcctcatcca

SEQ ID NO: 7305175 - DNA, 22 bp, Homo sapiens
gctctaggttcctagccaagtc

SEQ ID NO: 7305176 - DNA, 22 bp, Homo sapiens
gctctaactattaagaggtcat

SEQ ID NO: 7305177 - DNA, 22 bp, Homo sapiens
gctcctggatgttcaagtcggc

SEQ ID NO: 7305178 - DNA, 22 bp, Homo sapiens
gctcgcgccgcaccggtccacc

SEQ ID NO: 7305179 - DNA, 22 bp, Homo sapiens
gctccaggcgagctggaccaga

SEQ ID NO: 7305180 - DNA, 22 bp, Homo sapiens
gctaatgtgatagagcagaaag

SEQ ID NO: 7305181 - DNA, 22 bp, Homo sapiens
gctatttctatattataaagaa

SEQ ID NO: 7305182 - DNA, 22 bp, Homo sapiens
gctatttctttaaattgatctc

SEQ ID NO: 7305183 - DNA, 22 bp, Homo sapiens
gctaaaaggagcactagagatt

SEQ ID NO: 7305184 - DNA, 22 bp, Homo sapiens
gctaaaataactgagtttttgc

SEQ ID NO: 7305185 - DNA, 22 bp, Homo sapiens
gcgtgtttgcccagtgagtggc

SEQ ID NO: 7305186 - DNA, 22 bp, Homo sapiens
gcgtgtgtgatatgcctctgca

SEQ ID NO: 7305187 - DNA, 22 bp, Homo sapiens
gcgtgtatgcaggtctgtgcag

SEQ ID NO: 7305188 - DNA, 22 bp, Homo sapiens
gctaaggagggtcttgcaaatt

SEQ ID NO: 7305189 - DNA, 22 bp, Homo sapiens
gctaagaaaaattcatgtatat

SEQ ID NO: 7305190 - DNA, 22 bp, Homo sapiens
caaattagaggtttgttttgat

SEQ ID NO: 7305191 - DNA, 22 bp, Homo sapiens
caaattagaggtttgttttgat

SEQ ID NO: 7305192 - DNA, 22 bp, Homo sapiens
caaattaccctcaacatctaga

SEQ ID NO: 7305193 - DNA, 22 bp, Homo sapiens
caaatgaagggagctgaagtct

SEQ ID NO: 7305194 - DNA, 22 bp, Homo sapiens
caaatagacttaagcatctgta

SEQ ID NO: 7305195 - DNA, 22 bp, Homo sapiens
caaatagacttcaatctcttga

SEQ ID NO: 7305196 - DNA, 22 bp, Homo sapiens
gctctgaagggtgagctgttcg

SEQ ID NO: 7305197 - DNA, 22 bp, Homo sapiens
gctctgaacttccaccttttca

SEQ ID NO: 7305198 - DNA, 22 bp, Homo sapiens
caaatctccttaaaggtaaaat

SEQ ID NO: 7305199 - DNA, 22 bp, Homo sapiens
caaatcctgcagggcttagatg

SEQ ID NO: 7305200 - DNA, 22 bp, Homo sapiens
caaatgaagaaccttctcacct

SEQ ID NO: 7305201 - DNA, 20 bp, Homo sapiens
gagtccaggggcctgtagca

SEQ ID NO: 7305202 - DNA, 23 bp, Homo sapiens
gagtgcagaatagacatgcagtg

SEQ ID NO: 7305203 - DNA, 22 bp, Homo sapiens
gagtgcagatgaacagaagatt

SEQ ID NO: 7305204 - DNA, 22 bp, Homo sapiens
gagtgcaggcctgagcaccatc

SEQ ID NO: 7305205 - DNA, 22 bp, Homo sapiens
atgtttcaataatgctgtgagt

SEQ ID NO: 7305206 - DNA, 22 bp, Homo sapiens
atgtttcaagagaaaaagagac

SEQ ID NO: 7305207 - DNA, 22 bp, Homo sapiens
atgtttcaagagaaaaagagac

SEQ ID NO: 7305208 - DNA, 22 bp, Homo sapiens
atgtttcaccagcaaattacct

SEQ ID NO: 7305209 - DNA, 22 bp, Homo sapiens
atgtttcaccagcaaattacct

SEQ ID NO: 7305210 - DNA, 22 bp, Homo sapiens
atgtttcaccagcaaattacct

SEQ ID NO: 7305211 - DNA, 22 bp, Homo sapiens
atgtttcaccagttttataaga

SEQ ID NO: 7305212 - DNA, 20 bp, Homo sapiens
atgtttaatgttgtccaccc

SEQ ID NO: 7305213 - DNA, 22 bp, Homo sapiens
atgtttattttgcagagtaggg

SEQ ID NO: 7305214 - DNA, 22 bp, Homo sapiens
atgtttaattatctgggttttg

SEQ ID NO: 7305215 - DNA, 22 bp, Homo sapiens
atgtttcagggtgatagaaggt

SEQ ID NO: 7305216 - DNA, 22 bp, Homo sapiens
atgtttcagttctaaagttaga

SEQ ID NO: 7305217 - DNA, 22 bp, Homo sapiens
atgtttcaggcgaactaacatg

SEQ ID NO: 7305218 - DNA, 22 bp, Homo sapiens
atgtttcaggaaatcagctaga

SEQ ID NO: 7305219 - DNA, 22 bp, Homo sapiens
atgtttcatttagatatcaggc

SEQ ID NO: 7305220 - DNA, 22 bp, Homo sapiens
atgtttcatgactgagcaaaat

SEQ ID NO: 7305221 - DNA, 22 bp, Homo sapiens
gatctgggagcctcatggagac

SEQ ID NO: 7305222 - DNA, 22 bp, Homo sapiens
atgtttccatgttcaatttact

SEQ ID NO: 7305223 - DNA, 22 bp, Homo sapiens
gatctggaatctgaaggctgag

SEQ ID NO: 7305224 - DNA, 22 bp, Homo sapiens
gatctggaagaaagggagggca

SEQ ID NO: 7305225 - DNA, 22 bp, Homo sapiens
gatctcagagtaactgaggggc

SEQ ID NO: 7305226 - DNA, 22 bp, Homo sapiens
gagggggcgtgcaaggctccgc

SEQ ID NO: 7305227 - DNA, 22 bp, Homo sapiens
gagggggctagcgcagtgccca

SEQ ID NO: 7305228 - DNA, 22 bp, Homo sapiens
gaggttggggctgcagtgagct

SEQ ID NO: 7305229 - DNA, 22 bp, Homo sapiens
gagtccaggcatccctcccata

SEQ ID NO: 7305230 - DNA, 22 bp, Homo sapiens
gagtccaggatttgagctctgt

SEQ ID NO: 7305231 - DNA, 22 bp, Homo sapiens
gaggtagccacagatagagact

SEQ ID NO: 7305232 - DNA, 22 bp, Homo sapiens
atgtcacccagctcccaacttt

SEQ ID NO: 7305233 - DNA, 22 bp, Homo sapiens
atgtcaccttcggtggcacggt

SEQ ID NO: 7305234 - DNA, 22 bp, Homo sapiens
atgtcaccagtttccaaatttg

SEQ ID NO: 7305235 - DNA, 22 bp, Homo sapiens
gaggctgtgtttcagtgaggcc

SEQ ID NO: 7305236 - DNA, 23 bp, Homo sapiens
gaggcttgatcagcttcctccac

SEQ ID NO: 7305237 - DNA, 22 bp, Homo sapiens
gagggaagaaagaattgatgcg

SEQ ID NO: 7305238 - DNA, 22 bp, Homo sapiens
atgtacaacctgcatgacagtc

SEQ ID NO: 7305239 - DNA, 22 bp, Homo sapiens
atgtacaagctgttttactgca

SEQ ID NO: 7305240 - DNA, 17 bp, Homo sapiens
atgtaagaagaaagcag

SEQ ID NO: 7305241 - DNA, 22 bp, Homo sapiens
atgtaaggttcagagtatgtga

SEQ ID NO: 7305242 - DNA, 22 bp, Homo sapiens
atgtaaggctgcctatgacact

SEQ ID NO: 7305243 - DNA, 23 bp, Homo sapiens
atgtaagagttccagttactttg

SEQ ID NO: 7305244 - DNA, 22 bp, Homo sapiens
atgtaaattgtactgacacacg

SEQ ID NO: 7305245 - DNA, 22 bp, Homo sapiens
atgtaacaaatggtatacatgt

SEQ ID NO: 7305246 - DNA, 22 bp, Homo sapiens
atgtaacaaatggtatacatgt

SEQ ID NO: 7305247 - DNA, 22 bp, Homo sapiens
atgtaaatcaagcagtgctggt

SEQ ID NO: 7305248 - DNA, 22 bp, Homo sapiens
atgtaacacccacttttatagc

SEQ ID NO: 7305249 - DNA, 22 bp, Homo sapiens
atggttatttcatggaaaaatt

SEQ ID NO: 7305250 - DNA, 22 bp, Homo sapiens
gagctctgcttgggttcttagg

SEQ ID NO: 7305251 - DNA, 22 bp, Homo sapiens
gagctctgcggaaaacgtgccg

SEQ ID NO: 7305252 - DNA, 22 bp, Homo sapiens
gagctctggacgaggggagtgg

SEQ ID NO: 7305253 - DNA, 22 bp, Homo sapiens
gagctctggttcatgatctatt

SEQ ID NO: 7305254 - DNA, 22 bp, Homo sapiens
gagctctgtccacacttggaga

SEQ ID NO: 7305255 - DNA, 22 bp, Homo sapiens
gagctctgtacacagagggtgt

SEQ ID NO: 7305256 - DNA, 22 bp, Homo sapiens
gagctctgtgaatgtggggagg

SEQ ID NO: 7305257 - DNA, 22 bp, Homo sapiens
gagccctgaacaacagcaggaa

SEQ ID NO: 7305258 - DNA, 22 bp, Homo sapiens
gagcaggtttcaatgctgatgc

SEQ ID NO: 7305259 - DNA, 22 bp, Homo sapiens
gagcagctgagctggaatgaga

SEQ ID NO: 7305260 - DNA, 22 bp, Homo sapiens
gagcagctctgtgcctggagac

SEQ ID NO: 7305261 - DNA, 22 bp, Homo sapiens
gagctctgcagattgttttagg

SEQ ID NO: 7305262 - DNA, 22 bp, Homo sapiens
gagcctggggaccctcctgagt

SEQ ID NO: 7305263 - DNA, 22 bp, Homo sapiens
gagaggaatatcattatattag

SEQ ID NO: 7305264 - DNA, 22 bp, Homo sapiens
gaagcagagcctaaggcagaca

SEQ ID NO: 7305265 - DNA, 22 bp, Homo sapiens
gaagcacagggctcgatctcag

SEQ ID NO: 7305266 - DNA, 22 bp, Homo sapiens
gaagcacagaatggttaacatg

SEQ ID NO: 7305267 - DNA, 22 bp, Homo sapiens
gaagcacaaagtgtagttccga

SEQ ID NO: 7305268 - DNA, 22 bp, Homo sapiens
gaagcacatggctatagctatt

SEQ ID NO: 7305269 - DNA, 19 bp, Homo sapiens
gaatgtttctgtctcttct

SEQ ID NO: 7305270 - DNA, 22 bp, Homo sapiens
gaatgtttgactaaaggtagct

SEQ ID NO: 7305271 - DNA, 22 bp, Homo sapiens
gaatgtttaaggaaggcgtggc

SEQ ID NO: 7305272 - DNA, 22 bp, Homo sapiens
gaatgtttaaaaggtgcagttt

SEQ ID NO: 7305273 - DNA, 20 bp, Homo sapiens
gaatgtttcacttgctccat

SEQ ID NO: 7305274 - DNA, 22 bp, Homo sapiens
gaatgtttcatgtgtatgttag

SEQ ID NO: 7305275 - DNA, 22 bp, Homo sapiens
gaatgttactttgattttgtcc

SEQ ID NO: 7305276 - DNA, 22 bp, Homo sapiens
gaatgtgggctgtgaagaggag

SEQ ID NO: 7305277 - DNA, 22 bp, Homo sapiens
atgccctgctgccatctggccg

SEQ ID NO: 7305278 - DNA, 22 bp, Homo sapiens
atgccctgctgccatctggccg

SEQ ID NO: 7305279 - DNA, 22 bp, Homo sapiens
atgccctgtgactctcctggac

SEQ ID NO: 7305280 - DNA, 23 bp, Homo sapiens
atgccctgtagaggctgctgacc

SEQ ID NO: 7305281 - DNA, 22 bp, Homo sapiens
atgccctggggctacctctgag

SEQ ID NO: 7305282 - DNA, 22 bp, Homo sapiens
atgccctgtggttcatgtgaga

SEQ ID NO: 7305283 - DNA, 22 bp, Homo sapiens
gacagggaggaaagagactgct

SEQ ID NO: 7305284 - DNA, 22 bp, Homo sapiens
gacagggacgaggcttcaggca

SEQ ID NO: 7305285 - DNA, 22 bp, Homo sapiens
gactggggtaaggtgaggaggt

SEQ ID NO: 7305286 - DNA, 22 bp, Homo sapiens
gaccctggaactttcagcagag

SEQ ID NO: 7305287 - DNA, 22 bp, Homo sapiens
gaccctctagatggaagcactg

SEQ ID NO: 7305288 - DNA, 22 bp, Homo sapiens
atgctttgatttggtttctcta

SEQ ID NO: 7305289 - DNA, 22 bp, Homo sapiens
atgctttggccaatgagaagtg

SEQ ID NO: 7305290 - DNA, 22 bp, Homo sapiens
gactttgagggatacaaacatt

SEQ ID NO: 7305291 - DNA, 22 bp, Homo sapiens
gacagtttaggttcaaatctca

SEQ ID NO: 7305292 - DNA, 22 bp, Homo sapiens
gacagtgttacaatttaatgga

SEQ ID NO: 7305293 - DNA, 22 bp, Homo sapiens
gacagtgtgaacatctaatagt

SEQ ID NO: 7305294 - DNA, 22 bp, Homo sapiens
gacataaaccttgagatattaa

SEQ ID NO: 7305295 - DNA, 22 bp, Homo sapiens
gacataaaccttgagatattaa

SEQ ID NO: 7305296 - DNA, 22 bp, Homo sapiens
atgcttaatacactgttaaagg

SEQ ID NO: 7305297 - DNA, 22 bp, Homo sapiens
atgcttaagctcagttatatat

SEQ ID NO: 7305298 - DNA, 22 bp, Homo sapiens
gaacatacaagaattaagtaca

SEQ ID NO: 7305299 - DNA, 22 bp, Homo sapiens
gaacatcatgaagaaaacatat

SEQ ID NO: 7305300 - DNA, 22 bp, Homo sapiens
gaacatcaaggtctgtgtctag

SEQ ID NO: 7305301 - DNA, 22 bp, Homo sapiens
gaacatcaaggtctgtgtctag

SEQ ID NO: 7305302 - DNA, 22 bp, Homo sapiens
gaacatcagtcataatttaacg

SEQ ID NO: 7305303 - DNA, 22 bp, Homo sapiens
gaaatgacaaggacattcctgt

SEQ ID NO: 7305304 - DNA, 18 bp, Homo sapiens
gaaatctcaagagacaga

SEQ ID NO: 7305305 - DNA, 22 bp, Homo sapiens
gaaatatacatgaagtcggctg

SEQ ID NO: 7305306 - DNA, 22 bp, Homo sapiens
gaactttgcgcagttcccgggg

SEQ ID NO: 7305307 - DNA, 22 bp, Homo sapiens
gaacatttgatgatgacattgg

SEQ ID NO: 7305308 - DNA, 22 bp, Homo sapiens
gaacatttatattagatagcta

SEQ ID NO: 7305309 - DNA, 22 bp, Homo sapiens
gaacatttccagaaaggaacta

SEQ ID NO: 7305310 - DNA, 22 bp, Homo sapiens
atgcacaacagacgaatggaag

SEQ ID NO: 7305311 - DNA, 22 bp, Homo sapiens
atgcaaggacatgtaatgatgt

SEQ ID NO: 7305312 - DNA, 22 bp, Homo sapiens
gaagaaagatcaaatagtttcc

SEQ ID NO: 7305313 - DNA, 22 bp, Homo sapiens
gaagaaagattggcatgcttca

SEQ ID NO: 7305314 - DNA, 22 bp, Homo sapiens
atgcaaatgctagagaatgttg

SEQ ID NO: 7305315 - DNA, 22 bp, Homo sapiens
atgcaaatgctagagaatgttg

SEQ ID NO: 7305316 - DNA, 22 bp, Homo sapiens
atgcaagagatggacttgtgtt

SEQ ID NO: 7305317 - DNA, 22 bp, Homo sapiens
atgcaagagcaatatggtatgc

SEQ ID NO: 7305318 - DNA, 22 bp, Homo sapiens
cttgagaatcttgatgtctacc

SEQ ID NO: 7305319 - DNA, 22 bp, Homo sapiens
atcttcccaggctggggagagg

SEQ ID NO: 7305320 - DNA, 22 bp, Homo sapiens
atcttcagcgaggtttcctttc

SEQ ID NO: 7305321 - DNA, 22 bp, Homo sapiens
atcttcaagggaagaaagagta

SEQ ID NO: 7305322 - DNA, 22 bp, Homo sapiens
atcttcaaggaaaaaatacagt

SEQ ID NO: 7305323 - DNA, 22 bp, Homo sapiens
atgaatattgaatgtcttatga

SEQ ID NO: 7305324 - DNA, 22 bp, Homo sapiens
atgaatattgaatgtcttatga

SEQ ID NO: 7305325 - DNA, 22 bp, Homo sapiens
atgaatatgtacacatctgtca

SEQ ID NO: 7305326 - DNA, 22 bp, Homo sapiens
atgaatcagaatctgcatttta

SEQ ID NO: 7305327 - DNA, 22 bp, Homo sapiens
gaaaacttggatctctagaatg

SEQ ID NO: 7305328 - DNA, 22 bp, Homo sapiens
gaaaagagaacatctgaggatc

SEQ ID NO: 7305329 - DNA, 22 bp, Homo sapiens
gaaaatagcagatagaccaatg

SEQ ID NO: 7305330 - DNA, 19 bp, Homo sapiens
gaaaacatgggtgagggtc

SEQ ID NO: 7305331 - DNA, 22 bp, Homo sapiens
atgaatgctgaattatgaactg

SEQ ID NO: 7305332 - DNA, 22 bp, Homo sapiens
caatctctggtgcttctgagag

SEQ ID NO: 7305333 - DNA, 22 bp, Homo sapiens
caatgatttttccattgcagga

SEQ ID NO: 7305334 - DNA, 20 bp, Homo sapiens
caagtgtagaaactaataag

SEQ ID NO: 7305335 - DNA, 21 bp, Homo sapiens
caagtgtggatgtggaaggta

SEQ ID NO: 7305336 - DNA, 22 bp, Homo sapiens
caagttacaaaagaaccacggt

SEQ ID NO: 7305337 - DNA, 22 bp, Homo sapiens
caagttaatatatagaattttg

SEQ ID NO: 7305338 - DNA, 19 bp, Homo sapiens
caagttaaaatgaggtcat

SEQ ID NO: 7305339 - DNA, 22 bp, Homo sapiens
caagtttaaagtgaggtttgaa

SEQ ID NO: 7305340 - DNA, 22 bp, Homo sapiens
caagttacagcgctgacagcag

SEQ ID NO: 7305341 - DNA, 22 bp, Homo sapiens
caagttacattagaaatcatgc

SEQ ID NO: 7305342 - DNA, 22 bp, Homo sapiens
caagttacattagaaatcatgc

SEQ ID NO: 7305343 - DNA, 22 bp, Homo sapiens
caagttacctacccaaggcctt

SEQ ID NO: 7305344 - DNA, 22 bp, Homo sapiens
caagttagttattcttgtgagc

SEQ ID NO: 7305345 - DNA, 22 bp, Homo sapiens
caagttatttcattggaacaat

SEQ ID NO: 7305346 - DNA, 22 bp, Homo sapiens
caatggttctcaaactatcatg

SEQ ID NO: 7305347 - DNA, 22 bp, Homo sapiens
caatgtaaatattttctaatca

SEQ ID NO: 7305348 - DNA, 19 bp, Homo sapiens
gcttccagcactgcaggag

SEQ ID NO: 7305349 - DNA, 22 bp, Homo sapiens
ggaaatgtttgggtttgtgtga

SEQ ID NO: 7305350 - DNA, 22 bp, Homo sapiens
ggaaatgtattatatttggaat

SEQ ID NO: 7305351 - DNA, 22 bp, Homo sapiens
ggaaatgtcatagaaatataag

SEQ ID NO: 7305352 - DNA, 22 bp, Homo sapiens
caaattgtgtttgcttttctct

SEQ ID NO: 7305353 - DNA, 22 bp, Homo sapiens
caaatttaagtgaggtctttgt

SEQ ID NO: 7305354 - DNA, 22 bp, Homo sapiens
caaattgcttgtctgtagtgga

SEQ ID NO: 7305355 - DNA, 22 bp, Homo sapiens
caaatttaagttagaaagcaat

SEQ ID NO: 7305356 - DNA, 23 bp, Homo sapiens
caaattctaggcaggctcttttg

SEQ ID NO: 7305357 - DNA, 22 bp, Homo sapiens
caaattctcaccctgtttgatt

SEQ ID NO: 7305358 - DNA, 18 bp, Homo sapiens
caaattctcattgatttc

SEQ ID NO: 7305359 - DNA, 22 bp, Homo sapiens
caaattctcttactgtttgaca

SEQ ID NO: 7305360 - DNA, 22 bp, Homo sapiens
ggaacagcgtggggctctcctg

SEQ ID NO: 7305361 - DNA, 22 bp, Homo sapiens
ggaagagaatgatggctatggg

SEQ ID NO: 7305362 - DNA, 22 bp, Homo sapiens
ggaagagaaatgagtcaagact

SEQ ID NO: 7305363 - DNA, 22 bp, Homo sapiens
ggaagagagatcccatagatgt

SEQ ID NO: 7305364 - DNA, 22 bp, Homo sapiens
ggaagagaatttctctcttttt

SEQ ID NO: 7305365 - DNA, 19 bp, Homo sapiens
ggaagagaggaaaggtgga

SEQ ID NO: 7305366 - DNA, 22 bp, Homo sapiens
ggaagagagggctgggcctcaa

SEQ ID NO: 7305367 - DNA, 22 bp, Homo sapiens
ggaagagaggttcagccctaag

SEQ ID NO: 7305368 - DNA, 22 bp, Homo sapiens
ggaagagattctttacattcat

SEQ ID NO: 7305369 - DNA, 22 bp, Homo sapiens
ggaaggggtcacctcctgatga

SEQ ID NO: 7305370 - DNA, 22 bp, Homo sapiens
ggacacacaagttatctaatga

SEQ ID NO: 7305371 - DNA, 23 bp, Homo sapiens
ggacacagagataagtgagacaa

SEQ ID NO: 7305372 - DNA, 22 bp, Homo sapiens
ggacacagataatcacacagat

SEQ ID NO: 7305373 - DNA, 22 bp, Homo sapiens
ggagatactatctttacaattc

SEQ ID NO: 7305374 - DNA, 22 bp, Homo sapiens
cacagagacagaagcacttatg

SEQ ID NO: 7305375 - DNA, 22 bp, Homo sapiens
cacagcataatgaaatatactt

SEQ ID NO: 7305376 - DNA, 22 bp, Homo sapiens
cacagcataatgaaatatactt

SEQ ID NO: 7305377 - DNA, 22 bp, Homo sapiens
cacagcagggatgaatggagtg

SEQ ID NO: 7305378 - DNA, 22 bp, Homo sapiens
cacagcaggcagaacgtgggca

SEQ ID NO: 7305379 - DNA, 22 bp, Homo sapiens
cacagcagggcatggctgttgt

SEQ ID NO: 7305380 - DNA, 22 bp, Homo sapiens
ggaggagacagtaaaaagcacg

SEQ ID NO: 7305381 - DNA, 22 bp, Homo sapiens
ggaggagacagtaaaaagcacg

SEQ ID NO: 7305382 - DNA, 22 bp, Homo sapiens
ggagctggccgcctatgtgcag

SEQ ID NO: 7305383 - DNA, 22 bp, Homo sapiens
ggagctggccgcctatgtgcag

SEQ ID NO: 7305384 - DNA, 22 bp, Homo sapiens
ggagcaggagtctcttgaattt

SEQ ID NO: 7305385 - DNA, 22 bp, Homo sapiens
cacagctaactttcactgagca

SEQ ID NO: 7305386 - DNA, 22 bp, Homo sapiens
cacagccttgagcgaggacaag

SEQ ID NO: 7305387 - DNA, 22 bp, Homo sapiens
ggaggggatttagtagatgcta

SEQ ID NO: 7305388 - DNA, 22 bp, Homo sapiens
ggagggcaacttttcagtaggt

SEQ ID NO: 7305389 - DNA, 19 bp, Homo sapiens
cacagctctgctcagggaa

SEQ ID NO: 7305390 - DNA, 22 bp, Homo sapiens
ggaggggcatagttcaccatca

SEQ ID NO: 7305391 - DNA, 22 bp, Homo sapiens
cactgagttagtacgcaaacat

SEQ ID NO: 7305392 - DNA, 22 bp, Homo sapiens
ggctcctgggggtgctcctgcc

SEQ ID NO: 7305393 - DNA, 22 bp, Homo sapiens
ggctcctgtcccctcagctgct

SEQ ID NO: 7305394 - DNA, 22 bp, Homo sapiens
ggctcctgtagatctctaaagc

SEQ ID NO: 7305395 - DNA, 16 bp, Homo sapiens
ggctcctggttccttc

SEQ ID NO: 7305396 - DNA, 18 bp, Homo sapiens
ggctcctgtgatcacatt

SEQ ID NO: 7305397 - DNA, 22 bp, Homo sapiens
ggctcctgtcctcctggagctc

SEQ ID NO: 7305398 - DNA, 19 bp, Homo sapiens
ggctcctgtggctgcagcc

SEQ ID NO: 7305399 - DNA, 22 bp, Homo sapiens
ggctcctgtggcaagacagctt

SEQ ID NO: 7305400 - DNA, 19 bp, Homo sapiens
ggctgcctttccttaccag

SEQ ID NO: 7305401 - DNA, 20 bp, Homo sapiens
cagaaatttgtaaaagggat

SEQ ID NO: 7305402 - DNA, 22 bp, Homo sapiens
cagaaatgtttgttaatattgt

SEQ ID NO: 7305403 - DNA, 22 bp, Homo sapiens
ggctgctgtgacctcaggtgat

SEQ ID NO: 7305404 - DNA, 22 bp, Homo sapiens
cagaacagacttaacagggctg

SEQ ID NO: 7305405 - DNA, 22 bp, Homo sapiens
cagaacagagtcaaaagtatgt

SEQ ID NO: 7305406 - DNA, 19 bp, Homo sapiens
cagaacagaggtcatggcc

SEQ ID NO: 7305407 - DNA, 22 bp, Homo sapiens
cagaacagtcgcctgcatggat

SEQ ID NO: 7305408 - DNA, 22 bp, Homo sapiens
cagaacaggtcatgcttgctgt

SEQ ID NO: 7305409 - DNA, 22 bp, Homo sapiens
cagaagaggactgggtagctca

SEQ ID NO: 7305410 - DNA, 22 bp, Homo sapiens
cagaagagtagctgaacaagtt

SEQ ID NO: 7305411 - DNA, 22 bp, Homo sapiens
cagaagagtagctgaacaagtt

SEQ ID NO: 7305412 - DNA, 18 bp, Homo sapiens
ggataggaccttaggcag

SEQ ID NO: 7305413 - DNA, 22 bp, Homo sapiens
ggataagcaactatgatggaga

SEQ ID NO: 7305414 - DNA, 19 bp, Homo sapiens
ggataaggttggagtgatc

SEQ ID NO: 7305415 - DNA, 22 bp, Homo sapiens
ggatcaagtgcactctgaacac

SEQ ID NO: 7305416 - DNA, 22 bp, Homo sapiens
ggatcacacatgcactgtttga

SEQ ID NO: 7305417 - DNA, 22 bp, Homo sapiens
ggcaggaagtagcagtctgagc

SEQ ID NO: 7305418 - DNA, 22 bp, Homo sapiens
ggagtctgggaattggagagaa

SEQ ID NO: 7305419 - DNA, 21 bp, Homo sapiens
ggagtctgtggatgctgtttc

SEQ ID NO: 7305420 - DNA, 22 bp, Homo sapiens
ggagtctgttttacatgcagga

SEQ ID NO: 7305421 - DNA, 22 bp, Homo sapiens
ggagtgactcacagctgggaca

SEQ ID NO: 7305422 - DNA, 20 bp, Homo sapiens
ggcaggaccccagtggcatc

SEQ ID NO: 7305423 - DNA, 22 bp, Homo sapiens
cacatttttactgccaacttaa

SEQ ID NO: 7305424 - DNA, 20 bp, Homo sapiens
caccacagaattggggacag

SEQ ID NO: 7305425 - DNA, 18 bp, Homo sapiens
ggccagccccaggccagc

SEQ ID NO: 7305426 - DNA, 22 bp, Homo sapiens
cacccaggctagagtgcagtgg

SEQ ID NO: 7305427 - DNA, 22 bp, Homo sapiens
ggcgagggaagtttactgtgag

SEQ ID NO: 7305428 - DNA, 23 bp, Homo sapiens
ggcctgtgttttgtctgaagtac

SEQ ID NO: 7305429 - DNA, 22 bp, Homo sapiens
ggccccagcctcagtcccctga

SEQ ID NO: 7305430 - DNA, 22 bp, Homo sapiens
ggccccagcagtgcttgtttat

SEQ ID NO: 7305431 - DNA, 22 bp, Homo sapiens
ggccccagcagaccctcctctg

SEQ ID NO: 7305432 - DNA, 22 bp, Homo sapiens
cagaagcacatgtttacatgta

SEQ ID NO: 7305433 - DNA, 22 bp, Homo sapiens
cagaagcaagtagtgattcttt

SEQ ID NO: 7305434 - DNA, 22 bp, Homo sapiens
cagaagcaagtagtgattcttt

SEQ ID NO: 7305435 - DNA, 22 bp, Homo sapiens
cagaagcaagtagtgattcttt

SEQ ID NO: 7305436 - DNA, 22 bp, Homo sapiens
cagaagcaagagccggagctag

SEQ ID NO: 7305437 - DNA, 18 bp, Homo sapiens
cagaagcaggcagtgcag

SEQ ID NO: 7305438 - DNA, 20 bp, Homo sapiens
cagagacctgtcttcacaga

SEQ ID NO: 7305439 - DNA, 22 bp, Homo sapiens
cagagacatccatgttagttgg

SEQ ID NO: 7305440 - DNA, 22 bp, Homo sapiens
cagagagaatcttggcagctga

SEQ ID NO: 7305441 - DNA, 22 bp, Homo sapiens
gggccaggagtggagatatggg

SEQ ID NO: 7305442 - DNA, 22 bp, Homo sapiens
gggccagctctgtgatgtaggg

SEQ ID NO: 7305443 - DNA, 22 bp, Homo sapiens
gggccctgggattcagagcaag

SEQ ID NO: 7305444 - DNA, 22 bp, Homo sapiens
cagagcagagtgattgttctgg

SEQ ID NO: 7305445 - DNA, 18 bp, Homo sapiens
cagagcagaggtggagcg

SEQ ID NO: 7305446 - DNA, 22 bp, Homo sapiens
cagaggaagagatacaagccct

SEQ ID NO: 7305447 - DNA, 22 bp, Homo sapiens
cagaggaaatgggaaggagata

SEQ ID NO: 7305448 - DNA, 22 bp, Homo sapiens
gggctcagtcctggttctaccc

SEQ ID NO: 7305449 - DNA, 22 bp, Homo sapiens
cagaggcaggaagatgggcagt

SEQ ID NO: 7305450 - DNA, 22 bp, Homo sapiens
cagaggcagaccctccagggcg

SEQ ID NO: 7305451 - DNA, 22 bp, Homo sapiens
cagaggcagaggtcatctctgg

SEQ ID NO: 7305452 - DNA, 22 bp, Homo sapiens
gggggcagaatgtactcttgtc

SEQ ID NO: 7305453 - DNA, 22 bp, Homo sapiens
gggggaggtgaatgcaataagg

SEQ ID NO: 7305454 - DNA, 22 bp, Homo sapiens
ggtgtgcaggctatcacagaca

SEQ ID NO: 7305455 - DNA, 19 bp, Homo sapiens
ggtgtgccaaatgggaatg

SEQ ID NO: 7305456 - DNA, 22 bp, Homo sapiens
gtaagacaagcggactgccgtt

SEQ ID NO: 7305457 - DNA, 22 bp, Homo sapiens
gtaagacatagatttctcatga

SEQ ID NO: 7305458 - DNA, 22 bp, Homo sapiens
cagcagagacggtaagcagaac

SEQ ID NO: 7305459 - DNA, 22 bp, Homo sapiens
cagcagactggagtaggcagtg

SEQ ID NO: 7305460 - DNA, 22 bp, Homo sapiens
cagcagagaaattaaacttctg

SEQ ID NO: 7305461 - DNA, 20 bp, Homo sapiens
cagcagagacccatggggag

SEQ ID NO: 7305462 - DNA, 20 bp, Homo sapiens
cagcagagacccatggggag

SEQ ID NO: 7305463 - DNA, 22 bp, Homo sapiens
cagcagagaccaagtgatttga

SEQ ID NO: 7305464 - DNA, 22 bp, Homo sapiens
cagcagagaaattacatatttg

SEQ ID NO: 7305465 - DNA, 18 bp, Homo sapiens
cagcagagacattcaaaa

SEQ ID NO: 7305466 - DNA, 22 bp, Homo sapiens
ggtgtctgatggtggcttctca

SEQ ID NO: 7305467 - DNA, 22 bp, Homo sapiens
ggtgtctcagctgctggcaggg

SEQ ID NO: 7305468 - DNA, 22 bp, Homo sapiens
ggtgtctgatggtggcttctca

SEQ ID NO: 7305469 - DNA, 22 bp, Homo sapiens
ggtgtctgattccaaggccaca

SEQ ID NO: 7305470 - DNA, 22 bp, Homo sapiens
ggtgtctgttgcctcctggtta

SEQ ID NO: 7305471 - DNA, 22 bp, Homo sapiens
ggtgtctgttgcctcctggtta

SEQ ID NO: 7305472 - DNA, 22 bp, Homo sapiens
ggtgtctgtgatggcatataac

SEQ ID NO: 7305473 - DNA, 22 bp, Homo sapiens
ggtgtctgcttccctccagctg

SEQ ID NO: 7305474 - DNA, 22 bp, Homo sapiens
ggtgtctgcttccctccagctg

SEQ ID NO: 7305475 - DNA, 15 bp, Homo sapiens
ggtgtctgcagtgtg

SEQ ID NO: 7305476 - DNA, 22 bp, Homo sapiens
ggtgtctggacagtgagccagg

SEQ ID NO: 7305477 - DNA, 22 bp, Homo sapiens
cagatggaacacagaaaggaga

SEQ ID NO: 7305478 - DNA, 22 bp, Homo sapiens
ggtgggaaataattaggattat

SEQ ID NO: 7305479 - DNA, 22 bp, Homo sapiens
cagaggctgccagccatgtgca

SEQ ID NO: 7305480 - DNA, 22 bp, Homo sapiens
ggggtgagatcaaggaagccct

SEQ ID NO: 7305481 - DNA, 22 bp, Homo sapiens
cagatatattttatttggtcaa

SEQ ID NO: 7305482 - DNA, 22 bp, Homo sapiens
cagatatattttccttattagg

SEQ ID NO: 7305483 - DNA, 22 bp, Homo sapiens
cagatacaggtttttgttagat

SEQ ID NO: 7305484 - DNA, 22 bp, Homo sapiens
cagatactcaagcttagacttt

SEQ ID NO: 7305485 - DNA, 20 bp, Homo sapiens
cagataaacgggaaagaagc

SEQ ID NO: 7305486 - DNA, 22 bp, Homo sapiens
cagataaaattaatattaccaa

SEQ ID NO: 7305487 - DNA, 22 bp, Homo sapiens
cagataaaggcttactagtagt

SEQ ID NO: 7305488 - DNA, 22 bp, Homo sapiens
cagataaatagacttggtcaga

SEQ ID NO: 7305489 - DNA, 22 bp, Homo sapiens
cagataaatagatagataaact

SEQ ID NO: 7305490 - DNA, 22 bp, Homo sapiens
ggtgcactgaggtgggaactag

SEQ ID NO: 7305491 - DNA, 22 bp, Homo sapiens
ggtgcacttcttgctagtcttt

SEQ ID NO: 7305492 - DNA, 22 bp, Homo sapiens
ggtgagaggcagtgctgtggaa

SEQ ID NO: 7305493 - DNA, 22 bp, Homo sapiens
ggtgcagagcagtgtcagagca

SEQ ID NO: 7305494 - DNA, 22 bp, Homo sapiens
ggtgcagaaggaagggagctgg

SEQ ID NO: 7305495 - DNA, 22 bp, Homo sapiens
cagctctgaggaacactccttt

SEQ ID NO: 7305496 - DNA, 22 bp, Homo sapiens
cagctctgatgaaatgtaccag

SEQ ID NO: 7305497 - DNA, 22 bp, Homo sapiens
cagctcccgccatcgggaggca

SEQ ID NO: 7305498 - DNA, 22 bp, Homo sapiens
cagctccccatggttcctgaag

SEQ ID NO: 7305499 - DNA, 22 bp, Homo sapiens
cagctccctatggtgaggcgac

SEQ ID NO: 7305500 - DNA, 22 bp, Homo sapiens
gtgctgagattggagtgagcag

SEQ ID NO: 7305501 - DNA, 22 bp, Homo sapiens
gtgctgagcacaccttggagca

SEQ ID NO: 7305502 - DNA, 22 bp, Homo sapiens
gtgctgagcatcatgaggcact

SEQ ID NO: 7305503 - DNA, 22 bp, Homo sapiens
gtgctgagctgcagatgcgctc

SEQ ID NO: 7305504 - DNA, 22 bp, Homo sapiens
gtgctgaggagagggggtggtc

SEQ ID NO: 7305505 - DNA, 22 bp, Homo sapiens
gtgctgaggatacagctgtgaa

SEQ ID NO: 7305506 - DNA, 22 bp, Homo sapiens
gtgcctgtaagttgtatgggct

SEQ ID NO: 7305507 - DNA, 22 bp, Homo sapiens
gtgcctgtgccaggggtgtgct

SEQ ID NO: 7305508 - DNA, 22 bp, Homo sapiens
gtgctgagaacaaaagtggaca

SEQ ID NO: 7305509 - DNA, 17 bp, Homo sapiens
gtgcctgttgtcctgga

SEQ ID NO: 7305510 - DNA, 22 bp, Homo sapiens
cagctcccagtggcagctcctt

SEQ ID NO: 7305511 - DNA, 22 bp, Homo sapiens
cagctcccagtggcagctcctt

SEQ ID NO: 7305512 - DNA, 22 bp, Homo sapiens
cagctccccatggttcctgaag

SEQ ID NO: 7305513 - DNA, 22 bp, Homo sapiens
cagctcccagtggcagctcctt

SEQ ID NO: 7305514 - DNA, 22 bp, Homo sapiens
cagctcccagaactgaccatgt

SEQ ID NO: 7305515 - DNA, 20 bp, Homo sapiens
gtgctgagggctgggcaatg

SEQ ID NO: 7305516 - DNA, 22 bp, Homo sapiens
gtgctgaggtgggtgggcagcc

SEQ ID NO: 7305517 - DNA, 22 bp, Homo sapiens
gtgcaggagccaggggtaggaa

SEQ ID NO: 7305518 - DNA, 21 bp, Homo sapiens
gtgcatggagaaaggcttgct

SEQ ID NO: 7305519 - DNA, 22 bp, Homo sapiens
gtgcatggccagggtggtctgg

SEQ ID NO: 7305520 - DNA, 18 bp, Homo sapiens
gtgcatgcatgctctgcc

SEQ ID NO: 7305521 - DNA, 22 bp, Homo sapiens
gtgcatgcacacatgtgtgagg

SEQ ID NO: 7305522 - DNA, 22 bp, Homo sapiens
gtgcatgcacacatgtgtgagg

SEQ ID NO: 7305523 - DNA, 22 bp, Homo sapiens
gtgcatgtcggggtgcatgtca

SEQ ID NO: 7305524 - DNA, 22 bp, Homo sapiens
gtgcatgtgcatccatgtgtac

SEQ ID NO: 7305525 - DNA, 22 bp, Homo sapiens
gtgcatgtctttggaggcctcc

SEQ ID NO: 7305526 - DNA, 22 bp, Homo sapiens
gtgcatgtgcatccatgtgtac

SEQ ID NO: 7305527 - DNA, 22 bp, Homo sapiens
gtgcatgtcggggtgcatgtca

SEQ ID NO: 7305528 - DNA, 22 bp, Homo sapiens
gtgcatgtggtaaagaggagag

SEQ ID NO: 7305529 - DNA, 22 bp, Homo sapiens
gtgcatgtgcgttgactgtcca

SEQ ID NO: 7305530 - DNA, 22 bp, Homo sapiens
gtgcatgtgcgttgactgtcca

SEQ ID NO: 7305531 - DNA, 22 bp, Homo sapiens
gtgcatgtgtctttatagtaga

SEQ ID NO: 7305532 - DNA, 23 bp, Homo sapiens
gtgcatgtgtctttacagtagca

SEQ ID NO: 7305533 - DNA, 22 bp, Homo sapiens
gtgcatgttaatggtgtacaaa

SEQ ID NO: 7305534 - DNA, 22 bp, Homo sapiens
gtgcatgtgtgcgtacatgctt

SEQ ID NO: 7305535 - DNA, 22 bp, Homo sapiens
gtgcatgtgtctttatagtagc

SEQ ID NO: 7305536 - DNA, 22 bp, Homo sapiens
gtgcatgttaatggtgtacaaa

SEQ ID NO: 7305537 - DNA, 22 bp, Homo sapiens
gtgccctgacacacctggtgtg

SEQ ID NO: 7305538 - DNA, 22 bp, Homo sapiens
cagcagagctgtgtgggaaggg

SEQ ID NO: 7305539 - DNA, 22 bp, Homo sapiens
cagcagagctgtgtgggaaggg

SEQ ID NO: 7305540 - DNA, 22 bp, Homo sapiens
cagcagagctgggctttgaatt

SEQ ID NO: 7305541 - DNA, 22 bp, Homo sapiens
cagcagagctgggaataaaatt

SEQ ID NO: 7305542 - DNA, 22 bp, Homo sapiens
cagcagagcatttggtaggagg

SEQ ID NO: 7305543 - DNA, 22 bp, Homo sapiens
cagcagagatgagattcctata

SEQ ID NO: 7305544 - DNA, 23 bp, Homo sapiens
cagcagagagcagacctttgtgt

SEQ ID NO: 7305545 - DNA, 22 bp, Homo sapiens
cagcagtctgtttcaacaggtc

SEQ ID NO: 7305546 - DNA, 22 bp, Homo sapiens
gtctatttgggatcatgatatg

SEQ ID NO: 7305547 - DNA, 22 bp, Homo sapiens
cagcagtggctgcaggcagctg

SEQ ID NO: 7305548 - DNA, 20 bp, Homo sapiens
gtcctaggtttgaaggtaaa

SEQ ID NO: 7305549 - DNA, 22 bp, Homo sapiens
gtcctaccatgaattcactcca

SEQ ID NO: 7305550 - DNA, 22 bp, Homo sapiens
gtctccagaagcctagacagcc

SEQ ID NO: 7305551 - DNA, 18 bp, Homo sapiens
gtctttggagtggaggta

SEQ ID NO: 7305552 - DNA, 22 bp, Homo sapiens
gtctttggaggcactgttgagt

SEQ ID NO: 7305553 - DNA, 22 bp, Homo sapiens
gtctttggagaggtgccatttc

SEQ ID NO: 7305554 - DNA, 22 bp, Homo sapiens
gtctttggaaagacaaagttca

SEQ ID NO: 7305555 - DNA, 22 bp, Homo sapiens
gtctttggaaagacaaagttca

SEQ ID NO: 7305556 - DNA, 22 bp, Homo sapiens
gtgaagttcaagcttgccatct

SEQ ID NO: 7305557 - DNA, 23 bp, Homo sapiens
gtgaaggtttctgcatttattgg

SEQ ID NO: 7305558 - DNA, 22 bp, Homo sapiens
gtctttggatgtaagataaagt

SEQ ID NO: 7305559 - DNA, 22 bp, Homo sapiens
gtctttcttaaacaacagaaca

SEQ ID NO: 7305560 - DNA, 22 bp, Homo sapiens
gtctttctgccatgtgaagaga

SEQ ID NO: 7305561 - DNA, 22 bp, Homo sapiens
gtctgttttctcttctgtggga

SEQ ID NO: 7305562 - DNA, 16 bp, Homo sapiens
gtctcttccctgctga

SEQ ID NO: 7305563 - DNA, 22 bp, Homo sapiens
gtgcaggagcaggagccatgtc

SEQ ID NO: 7305564 - DNA, 22 bp, Homo sapiens
gtgcagcttcctggtctcagcc

SEQ ID NO: 7305565 - DNA, 22 bp, Homo sapiens
gtgcagctgagggcctcttcta

SEQ ID NO: 7305566 - DNA, 22 bp, Homo sapiens
gtgcaaatgtaattgcagtttt

SEQ ID NO: 7305567 - DNA, 22 bp, Homo sapiens
gtgaataattttttagtataag

SEQ ID NO: 7305568 - DNA, 22 bp, Homo sapiens
gtgaatgtaaagtcatgtgact

SEQ ID NO: 7305569 - DNA, 22 bp, Homo sapiens
gtgaatattctttgtgcagtat

SEQ ID NO: 7305570 - DNA, 22 bp, Homo sapiens
catggtgcagggcacatgagga

SEQ ID NO: 7305571 - DNA, 23 bp, Homo sapiens
catggaaaactgaaagctgacct

SEQ ID NO: 7305572 - DNA, 22 bp, Homo sapiens
catgtaaagcacttcataacag

SEQ ID NO: 7305573 - DNA, 22 bp, Homo sapiens
tccagcagaaaagaggtaggga

SEQ ID NO: 7305574 - DNA, 22 bp, Homo sapiens
tccagcagaaccagagacctgg

SEQ ID NO: 7305575 - DNA, 22 bp, Homo sapiens
catgctgtgttacttggcatct

SEQ ID NO: 7305576 - DNA, 22 bp, Homo sapiens
tccagatcatgaagtttggttc

SEQ ID NO: 7305577 - DNA, 22 bp, Homo sapiens
catgcttttttctagtataaat

SEQ ID NO: 7305578 - DNA, 22 bp, Homo sapiens
catgctttctgtccaaatgtta

SEQ ID NO: 7305579 - DNA, 22 bp, Homo sapiens
catgctttgggtcagaaatgcc

SEQ ID NO: 7305580 - DNA, 22 bp, Homo sapiens
catgccacatggacttcaaacc

SEQ ID NO: 7305581 - DNA, 22 bp, Homo sapiens
tcatcagggatattggcctgaa

SEQ ID NO: 7305582 - DNA, 22 bp, Homo sapiens
catgctatataggaagagcact

SEQ ID NO: 7305583 - DNA, 22 bp, Homo sapiens
catgctctccattggacacaga

SEQ ID NO: 7305584 - DNA, 22 bp, Homo sapiens
catgctgcaggagctcttctca

SEQ ID NO: 7305585 - DNA, 22 bp, Homo sapiens
catgctgtactctgtgtcagaa

SEQ ID NO: 7305586 - DNA, 22 bp, Homo sapiens
catgctgtgcatcttgatgacc

SEQ ID NO: 7305587 - DNA, 22 bp, Homo sapiens
tccaagaagtttcgttaaatgt

SEQ ID NO: 7305588 - DNA, 22 bp, Homo sapiens
tccagggccaagtcatggaacc

SEQ ID NO: 7305589 - DNA, 22 bp, Homo sapiens
tccagggcatgctcagactcag

SEQ ID NO: 7305590 - DNA, 22 bp, Homo sapiens
tccagggtcagaagtcacatac

SEQ ID NO: 7305591 - DNA, 20 bp, Homo sapiens
tccagggtagatgaattctg

SEQ ID NO: 7305592 - DNA, 17 bp, Homo sapiens
tccagggtttatgaaat

SEQ ID NO: 7305593 - DNA, 22 bp, Homo sapiens
tccagggcagtgactacagcgg

SEQ ID NO: 7305594 - DNA, 21 bp, Homo sapiens
cattacaagatttccaatttg

SEQ ID NO: 7305595 - DNA, 22 bp, Homo sapiens
cattacaacaatctgccatggc

SEQ ID NO: 7305596 - DNA, 22 bp, Homo sapiens
cattaattgtatttttcaaagt

SEQ ID NO: 7305597 - DNA, 22 bp, Homo sapiens
cattaatttaatattcaaagaa

SEQ ID NO: 7305598 - DNA, 23 bp, Homo sapiens
catgtgcctgctgtgtggaagcc

SEQ ID NO: 7305599 - DNA, 22 bp, Homo sapiens
tccaggcttgagaccaggctct

SEQ ID NO: 7305600 - DNA, 22 bp, Homo sapiens
tccaggctttggggcaggagcg

SEQ ID NO: 7305601 - DNA, 19 bp, Homo sapiens
catgtgtcaatactgtacc

SEQ ID NO: 7305602 - DNA, 22 bp, Homo sapiens
catgtgtaccagctgttctttg

SEQ ID NO: 7305603 - DNA, 22 bp, Homo sapiens
catgtgtaggtatacaaaattc

SEQ ID NO: 7305604 - DNA, 22 bp, Homo sapiens
catgtgtagtgaaataagcagt

SEQ ID NO: 7305605 - DNA, 22 bp, Homo sapiens
catgtgtagtgaaataagcagt

SEQ ID NO: 7305606 - DNA, 22 bp, Homo sapiens
catgtgtatgcattcatacata

SEQ ID NO: 7305607 - DNA, 22 bp, Homo sapiens
catgtgtatgcattcatacata

SEQ ID NO: 7305608 - DNA, 22 bp, Homo sapiens
catgtacagtttttctgtcctg

SEQ ID NO: 7305609 - DNA, 22 bp, Homo sapiens
catgtacatgcatgggcactgt

SEQ ID NO: 7305610 - DNA, 20 bp, Homo sapiens
tccaggctcctccacttagt

SEQ ID NO: 7305611 - DNA, 22 bp, Homo sapiens
tccaggctgggctgaagggtgc

SEQ ID NO: 7305612 - DNA, 22 bp, Homo sapiens
tccaggcttcacgtctgccctc

SEQ ID NO: 7305613 - DNA, 22 bp, Homo sapiens
tccaggcttcacgtctgccctc

SEQ ID NO: 7305614 - DNA, 22 bp, Homo sapiens
tccaggctgtgcgcaccgtgtg

SEQ ID NO: 7305615 - DNA, 22 bp, Homo sapiens
tccaggctgtgcatgagtttag

SEQ ID NO: 7305616 - DNA, 22 bp, Homo sapiens
catgtacacacaaagggacaat

SEQ ID NO: 7305617 - DNA, 23 bp, Homo sapiens
catgtacacacagctgtacagtg

SEQ ID NO: 7305618 - DNA, 23 bp, Homo sapiens
catgtacagagtttgataaagtg

SEQ ID NO: 7305619 - DNA, 22 bp, Homo sapiens
catgtacactcatgtaactata

SEQ ID NO: 7305620 - DNA, 22 bp, Homo sapiens
catcatatatttctacaagtgc

SEQ ID NO: 7305621 - DNA, 22 bp, Homo sapiens
tcagtgtgtacactgagcattt

SEQ ID NO: 7305622 - DNA, 20 bp, Homo sapiens
tcagtgtggcggggacctca

SEQ ID NO: 7305623 - DNA, 22 bp, Homo sapiens
tcagtgtggaaaatcctttggc

SEQ ID NO: 7305624 - DNA, 22 bp, Homo sapiens
tcagtgtgcacgatacagattg

SEQ ID NO: 7305625 - DNA, 23 bp, Homo sapiens
tcagtgtgcaagaatggagaagc

SEQ ID NO: 7305626 - DNA, 22 bp, Homo sapiens
tcagtgtgaattcattttagat

SEQ ID NO: 7305627 - DNA, 21 bp, Homo sapiens
tcagtgtgactggcaaattga

SEQ ID NO: 7305628 - DNA, 22 bp, Homo sapiens
tcagtgtgaggtcttccacccg

SEQ ID NO: 7305629 - DNA, 22 bp, Homo sapiens
tcagtgtgagtaccatgctcag

SEQ ID NO: 7305630 - DNA, 22 bp, Homo sapiens
catcagctcttcattcttgatt

SEQ ID NO: 7305631 - DNA, 22 bp, Homo sapiens
catcagctgagggtgagcagaa

SEQ ID NO: 7305632 - DNA, 22 bp, Homo sapiens
catcagcactatgattaaagta

SEQ ID NO: 7305633 - DNA, 22 bp, Homo sapiens
catcagcaggcaacactcttgg

SEQ ID NO: 7305634 - DNA, 21 bp, Homo sapiens
catcagatttagaagttctat

SEQ ID NO: 7305635 - DNA, 19 bp, Homo sapiens
tcatcacttcagaggaaaa

SEQ ID NO: 7305636 - DNA, 22 bp, Homo sapiens
tcataatacaaagagttctgca

SEQ ID NO: 7305637 - DNA, 22 bp, Homo sapiens
tcataagtaatttaaacattcc

SEQ ID NO: 7305638 - DNA, 22 bp, Homo sapiens
tcatacacaagagcatgtaaca

SEQ ID NO: 7305639 - DNA, 20 bp, Homo sapiens
tcatacacatgagcatgcag

SEQ ID NO: 7305640 - DNA, 22 bp, Homo sapiens
tcatacacattcttattacttt

SEQ ID NO: 7305641 - DNA, 22 bp, Homo sapiens
tcagtgtgtagtaaattgtagg

SEQ ID NO: 7305642 - DNA, 22 bp, Homo sapiens
catcgtgtctaggtgtgcagca

SEQ ID NO: 7305643 - DNA, 22 bp, Homo sapiens
catctagaaaaaagacctgttg

SEQ ID NO: 7305644 - DNA, 22 bp, Homo sapiens
catctactttaaggattctggg

SEQ ID NO: 7305645 - DNA, 22 bp, Homo sapiens
catctacaggagaatgtcactg

SEQ ID NO: 7305646 - DNA, 22 bp, Homo sapiens
catctacactgattaggtgaac

SEQ ID NO: 7305647 - DNA, 22 bp, Homo sapiens
tcacttcacacccactatcatg

SEQ ID NO: 7305648 - DNA, 22 bp, Homo sapiens
tcacttagatggggatcatcac

SEQ ID NO: 7305649 - DNA, 22 bp, Homo sapiens
cagtgtataaactttaacatag

SEQ ID NO: 7305650 - DNA, 22 bp, Homo sapiens
tcaggaggccaccaggacctgt

SEQ ID NO: 7305651 - DNA, 22 bp, Homo sapiens
tcaggaggctcaagacctggca

SEQ ID NO: 7305652 - DNA, 22 bp, Homo sapiens
tcaggcagaattatcaaaagat

SEQ ID NO: 7305653 - DNA, 23 bp, Homo sapiens
catcaagtacttttgacaagtgt

SEQ ID NO: 7305654 - DNA, 22 bp, Homo sapiens
catcaagtcatcaaagaattca

SEQ ID NO: 7305655 - DNA, 22 bp, Homo sapiens
catcacaaaatgattattccct

SEQ ID NO: 7305656 - DNA, 22 bp, Homo sapiens
catcacaaatgtaataatgtct

SEQ ID NO: 7305657 - DNA, 22 bp, Homo sapiens
tcaggcagaccaccgtgggcag

SEQ ID NO: 7305658 - DNA, 22 bp, Homo sapiens
catcaaatgccatatatggttg

SEQ ID NO: 7305659 - DNA, 22 bp, Homo sapiens
catcaaataaagaaattccttg

SEQ ID NO: 7305660 - DNA, 22 bp, Homo sapiens
catcaaacaaatgcttttagat

SEQ ID NO: 7305661 - DNA, 22 bp, Homo sapiens
catcaaaattagacattgttga

SEQ ID NO: 7305662 - DNA, 22 bp, Homo sapiens
tctataaattatgcagtctcag

SEQ ID NO: 7305663 - DNA, 22 bp, Homo sapiens
tctatacatgtgcacacacatc

SEQ ID NO: 7305664 - DNA, 22 bp, Homo sapiens
tctcagtgtgttttctctcaga

SEQ ID NO: 7305665 - DNA, 22 bp, Homo sapiens
tctcagtgtggtgcttaggata

SEQ ID NO: 7305666 - DNA, 22 bp, Homo sapiens
tctcagtgtttaaaaagatttc

SEQ ID NO: 7305667 - DNA, 18 bp, Homo sapiens
tctagaaacccagactct

SEQ ID NO: 7305668 - DNA, 22 bp, Homo sapiens
ccagagcccgggacctggactt

SEQ ID NO: 7305669 - DNA, 22 bp, Homo sapiens
ccagagccagagaggtgcctgc

SEQ ID NO: 7305670 - DNA, 22 bp, Homo sapiens
ccagagggaactgggcctcatt

SEQ ID NO: 7305671 - DNA, 22 bp, Homo sapiens
ccagaggctggggaaggataca

SEQ ID NO: 7305672 - DNA, 22 bp, Homo sapiens
ccagagcctcaacacaggtcct

SEQ ID NO: 7305673 - DNA, 22 bp, Homo sapiens
tctctgtattcttcgtaatgcc

SEQ ID NO: 7305674 - DNA, 22 bp, Homo sapiens
ccagcaccttgatcttggagtt

SEQ ID NO: 7305675 - DNA, 18 bp, Homo sapiens
ccagagggtgcgtcagct

SEQ ID NO: 7305676 - DNA, 20 bp, Homo sapiens
ccagagggtagggccgcccc

SEQ ID NO: 7305677 - DNA, 22 bp, Homo sapiens
ccacagggcctttcctgctggc

SEQ ID NO: 7305678 - DNA, 22 bp, Homo sapiens
tcctggaggacagaggcatctc

SEQ ID NO: 7305679 - DNA, 22 bp, Homo sapiens
tcctggctccactgagcaggcc

SEQ ID NO: 7305680 - DNA, 22 bp, Homo sapiens
tcctggctccactgagcaggcc

SEQ ID NO: 7305681 - DNA, 22 bp, Homo sapiens
tcctggctaacacggtgacacc

SEQ ID NO: 7305682 - DNA, 21 bp, Homo sapiens
tcctgccttagtccagagcag

SEQ ID NO: 7305683 - DNA, 22 bp, Homo sapiens
tcctgagggctcggggctcatg

SEQ ID NO: 7305684 - DNA, 22 bp, Homo sapiens
ccaagaatgataggtgtgagca

SEQ ID NO: 7305685 - DNA, 22 bp, Homo sapiens
tccagtttgcactgtataatag

SEQ ID NO: 7305686 - DNA, 20 bp, Homo sapiens
tccagttttggagacattct

SEQ ID NO: 7305687 - DNA, 22 bp, Homo sapiens
catttcacagtatattcaaaat

SEQ ID NO: 7305688 - DNA, 22 bp, Homo sapiens
catttcaccttagagaattatt

SEQ ID NO: 7305689 - DNA, 22 bp, Homo sapiens
catttcacgcacactcattact

SEQ ID NO: 7305690 - DNA, 22 bp, Homo sapiens
catttcactattcactaaaagg

SEQ ID NO: 7305691 - DNA, 22 bp, Homo sapiens
tccatattaactaaaactagaa

SEQ ID NO: 7305692 - DNA, 20 bp, Homo sapiens
catttcattgtgtcttcact

SEQ ID NO: 7305693 - DNA, 22 bp, Homo sapiens
catttcattcctttgaaagtgg

SEQ ID NO: 7305694 - DNA, 22 bp, Homo sapiens
catttcattcctttgaaagtgg

SEQ ID NO: 7305695 - DNA, 22 bp, Homo sapiens
catttcattcctttgaaagtgg

SEQ ID NO: 7305696 - DNA, 21 bp, Homo sapiens
catttcatgattatagaaatg

SEQ ID NO: 7305697 - DNA, 22 bp, Homo sapiens
catttcatagttgtcacaataa

SEQ ID NO: 7305698 - DNA, 22 bp, Homo sapiens
catttcatagttgtcacaataa

SEQ ID NO: 7305699 - DNA, 22 bp, Homo sapiens
catttcagtgttattctaattt

SEQ ID NO: 7305700 - DNA, 21 bp, Homo sapiens
catttcagtaaggaagcctgt

SEQ ID NO: 7305701 - DNA, 22 bp, Homo sapiens
catttccacttctgaaaactgg

SEQ ID NO: 7305702 - DNA, 22 bp, Homo sapiens
catttctacagcttcttcagaa

SEQ ID NO: 7305703 - DNA, 22 bp, Homo sapiens
cattttcatgagtttctgttca

SEQ ID NO: 7305704 - DNA, 22 bp, Homo sapiens
cattttcatgagtttctgttca

SEQ ID NO: 7305705 - DNA, 22 bp, Homo sapiens
cattttgtgctagacactatgg

SEQ ID NO: 7305706 - DNA, 22 bp, Homo sapiens
tcctgagggctcggggctcatg

SEQ ID NO: 7305707 - DNA, 22 bp, Homo sapiens
cattttatcctctgggaagcta

SEQ ID NO: 7305708 - DNA, 22 bp, Homo sapiens
cattttcagcacccatctgaaa

SEQ ID NO: 7305709 - DNA, 22 bp, Homo sapiens
catttgtcatcactgagctgcc

SEQ ID NO: 7305710 - DNA, 22 bp, Homo sapiens
cattttaagatgacctggtttc

SEQ ID NO: 7305711 - DNA, 19 bp, Homo sapiens
cattttaagcatccccagt

SEQ ID NO: 7305712 - DNA, 22 bp, Homo sapiens
cattttaaatgatttaagccaa

SEQ ID NO: 7305713 - DNA, 22 bp, Homo sapiens
tatattgtagctgatgacaaat

SEQ ID NO: 7305714 - DNA, 22 bp, Homo sapiens
tatattgtagctgatgacaaat

SEQ ID NO: 7305715 - DNA, 22 bp, Homo sapiens
tatattgctagtggtactgtaa

SEQ ID NO: 7305716 - DNA, 22 bp, Homo sapiens
tatattgtaggtgctatttgaa

SEQ ID NO: 7305717 - DNA, 22 bp, Homo sapiens
tatattcttaccagtgtatgta

SEQ ID NO: 7305718 - DNA, 22 bp, Homo sapiens
tatattctgattccatctgtgt

SEQ ID NO: 7305719 - DNA, 22 bp, Homo sapiens
tatgaactgtgagtgtgatggg

SEQ ID NO: 7305720 - DNA, 22 bp, Homo sapiens
tatgaagaaacctatcctctag

SEQ ID NO: 7305721 - DNA, 22 bp, Homo sapiens
tatgaactttaagctctgtgtc

SEQ ID NO: 7305722 - DNA, 22 bp, Homo sapiens
tatgaacttttgatgtgacatg

SEQ ID NO: 7305723 - DNA, 22 bp, Homo sapiens
tatgaagaaatctttgaaaatc

SEQ ID NO: 7305724 - DNA, 22 bp, Homo sapiens
tatgaacatgctgtggttataa

SEQ ID NO: 7305725 - DNA, 17 bp, Homo sapiens
tatctgtatgatggata

SEQ ID NO: 7305726 - DNA, 22 bp, Homo sapiens
tatgaagaagttctgtgaaatg

SEQ ID NO: 7305727 - DNA, 22 bp, Homo sapiens
tatgaagaagttctgtgaaatg

SEQ ID NO: 7305728 - DNA, 22 bp, Homo sapiens
tatgaagaagacaaatgacact

SEQ ID NO: 7305729 - DNA, 22 bp, Homo sapiens
tatgtacatgatttcatttgct

SEQ ID NO: 7305730 - DNA, 22 bp, Homo sapiens
tatgtacatgatttcatttgct

SEQ ID NO: 7305731 - DNA, 22 bp, Homo sapiens
tatgtacatcttgagcaatgaa

SEQ ID NO: 7305732 - DNA, 22 bp, Homo sapiens
tatgtacatgttaaagggcaaa

SEQ ID NO: 7305733 - DNA, 22 bp, Homo sapiens
tatattcatattgttgtctctc

SEQ ID NO: 7305734 - DNA, 22 bp, Homo sapiens
tatattcattttaaagccatct

SEQ ID NO: 7305735 - DNA, 22 bp, Homo sapiens
tatattcaatgattagtatcag

SEQ ID NO: 7305736 - DNA, 22 bp, Homo sapiens
tatatatatgcacacacaccta

SEQ ID NO: 7305737 - DNA, 22 bp, Homo sapiens
tatatactatgcgattcctgcc

SEQ ID NO: 7305738 - DNA, 22 bp, Homo sapiens
tagttttagtcccattttacag

SEQ ID NO: 7305739 - DNA, 22 bp, Homo sapiens
tagttttagcagcaatgggatg

SEQ ID NO: 7305740 - DNA, 22 bp, Homo sapiens
tatataattttctgccatatcc

SEQ ID NO: 7305741 - DNA, 22 bp, Homo sapiens
tatatacaaggtaggtttaggt

SEQ ID NO: 7305742 - DNA, 22 bp, Homo sapiens
tagtgtgtccctggggagtgtt

SEQ ID NO: 7305743 - DNA, 22 bp, Homo sapiens
tagtgtgtccctggggagtgtt

SEQ ID NO: 7305744 - DNA, 22 bp, Homo sapiens
tagtttctagacagtaagaatt

SEQ ID NO: 7305745 - DNA, 22 bp, Homo sapiens
tagtgtctgttgcttttgttca

SEQ ID NO: 7305746 - DNA, 22 bp, Homo sapiens
tagtgtctgaatgcacctgttt

SEQ ID NO: 7305747 - DNA, 22 bp, Homo sapiens
tagtttgtcaaccactgtcaca

SEQ ID NO: 7305748 - DNA, 22 bp, Homo sapiens
cagggccaccctctgctgggtg

SEQ ID NO: 7305749 - DNA, 22 bp, Homo sapiens
cagggccaccgtgtttgctgct

SEQ ID NO: 7305750 - DNA, 22 bp, Homo sapiens
cagggccaccctctgctgggtg

SEQ ID NO: 7305751 - DNA, 22 bp, Homo sapiens
taggtatacagagatttctggg

SEQ ID NO: 7305752 - DNA, 22 bp, Homo sapiens
cagtggaggccttgggaccttt

SEQ ID NO: 7305753 - DNA, 22 bp, Homo sapiens
cagtggaggccttgggaccttt

SEQ ID NO: 7305754 - DNA, 19 bp, Homo sapiens
cagtggagattggaggagg

SEQ ID NO: 7305755 - DNA, 22 bp, Homo sapiens
cagtggagaggcatgcttggca

SEQ ID NO: 7305756 - DNA, 22 bp, Homo sapiens
tcacacatttctcaagtgtagg

SEQ ID NO: 7305757 - DNA, 22 bp, Homo sapiens
tcacacattgttgcttaagttg

SEQ ID NO: 7305758 - DNA, 22 bp, Homo sapiens
tcacacatgtaagggctttgga

SEQ ID NO: 7305759 - DNA, 22 bp, Homo sapiens
tcacacattctaggtatgttga

SEQ ID NO: 7305760 - DNA, 16 bp, Homo sapiens
tcacacatttgttggt

SEQ ID NO: 7305761 - DNA, 22 bp, Homo sapiens
tcacacatttgaaggcctgtca

SEQ ID NO: 7305762 - DNA, 16 bp, Homo sapiens
tcacacatttgttggt

SEQ ID NO: 7305763 - DNA, 22 bp, Homo sapiens
tcacacatttctcaagtgtagg

SEQ ID NO: 7305764 - DNA, 22 bp, Homo sapiens
tcacacatttgaaggcctgtca

SEQ ID NO: 7305765 - DNA, 22 bp, Homo sapiens
tcacacatgtaagggctttgga

SEQ ID NO: 7305766 - DNA, 22 bp, Homo sapiens
tcacacatgtaagggctttgga

SEQ ID NO: 7305767 - DNA, 20 bp, Homo sapiens
tcacacatggtaagctatga

SEQ ID NO: 7305768 - DNA, 22 bp, Homo sapiens
cagtgcagaggtgcaagcatgt

SEQ ID NO: 7305769 - DNA, 22 bp, Homo sapiens
cagtgggtgagaggaaaagctt

SEQ ID NO: 7305770 - DNA, 22 bp, Homo sapiens
tattccagttcaccttttcatc

SEQ ID NO: 7305771 - DNA, 22 bp, Homo sapiens
tattccatgccagagtttattg

SEQ ID NO: 7305772 - DNA, 22 bp, Homo sapiens
tattccaatgtcagttatatca

SEQ ID NO: 7305773 - DNA, 22 bp, Homo sapiens
tcaaattttaacatgcattaga

SEQ ID NO: 7305774 - DNA, 22 bp, Homo sapiens
tcaaattgtcatcttgataatg

SEQ ID NO: 7305775 - DNA, 22 bp, Homo sapiens
tcaaatgtaatttattgtttta

SEQ ID NO: 7305776 - DNA, 17 bp, Homo sapiens
tcaaatgtacagaacta

SEQ ID NO: 7305777 - DNA, 22 bp, Homo sapiens
cagtgaaatagtggacatcaaa

SEQ ID NO: 7305778 - DNA, 22 bp, Homo sapiens
cagtcttctaacctagcagcct

SEQ ID NO: 7305779 - DNA, 22 bp, Homo sapiens
tacagcagggcgctgtgatgaa

SEQ ID NO: 7305780 - DNA, 22 bp, Homo sapiens
tacagagactttatggcacaaa

SEQ ID NO: 7305781 - DNA, 22 bp, Homo sapiens
tacagagacccacaagagactg

SEQ ID NO: 7305782 - DNA, 22 bp, Homo sapiens
tacagagagaggggttaccagg

SEQ ID NO: 7305783 - DNA, 22 bp, Homo sapiens
tacagagagataagtgtaaaag

SEQ ID NO: 7305784 - DNA, 22 bp, Homo sapiens
tacagctaggcaaaaatgacat

SEQ ID NO: 7305785 - DNA, 23 bp, Homo sapiens
tacagctgcagaatcaggctaag

SEQ ID NO: 7305786 - DNA, 22 bp, Homo sapiens
caggctccagcttcctgctcag

SEQ ID NO: 7305787 - DNA, 22 bp, Homo sapiens
caggctcccaccctcctgcagc

SEQ ID NO: 7305788 - DNA, 22 bp, Homo sapiens
tacagtttagaaccatagatgg

SEQ ID NO: 7305789 - DNA, 22 bp, Homo sapiens
caggctccctaagtcagcagcc

SEQ ID NO: 7305790 - DNA, 23 bp, Homo sapiens
caggctcccggaccaggatccgc

SEQ ID NO: 7305791 - DNA, 22 bp, Homo sapiens
caggctccctgggcagtggcag

SEQ ID NO: 7305792 - DNA, 22 bp, Homo sapiens
caggctccctgccagggccggc

SEQ ID NO: 7305793 - DNA, 20 bp, Homo sapiens
caggctccgcaggactaggg

SEQ ID NO: 7305794 - DNA, 22 bp, Homo sapiens
caggctccttcccagggatggt

SEQ ID NO: 7305795 - DNA, 22 bp, Homo sapiens
tacaatagggcttttgtttatg

SEQ ID NO: 7305796 - DNA, 22 bp, Homo sapiens
tacacagaagccagaaggcctg

SEQ ID NO: 7305797 - DNA, 22 bp, Homo sapiens
tacacagaggctgatgtcttag

SEQ ID NO: 7305798 - DNA, 22 bp, Homo sapiens
tacacagtaaatggtaaataca

SEQ ID NO: 7305799 - DNA, 22 bp, Homo sapiens
caggccaaaattcaggcattct

SEQ ID NO: 7305800 - DNA, 22 bp, Homo sapiens
tacacagatttcagtatcatca

SEQ ID NO: 7305801 - DNA, 22 bp, Homo sapiens
tacacagcctgtaatgatgact

SEQ ID NO: 7305802 - DNA, 22 bp, Homo sapiens
cagctctgctgggaggatgcag

SEQ ID NO: 7305803 - DNA, 22 bp, Homo sapiens
cagctctgccatcatctgcctt

SEQ ID NO: 7305804 - DNA, 22 bp, Homo sapiens
cagctctgccatcatctgcctt

SEQ ID NO: 7305805 - DNA, 22 bp, Homo sapiens
cagctctgccacttcctagcta

SEQ ID NO: 7305806 - DNA, 17 bp, Homo sapiens
cagctctgcatcttcct

SEQ ID NO: 7305807 - DNA, 22 bp, Homo sapiens
gtggagatcctgagtgcatctg

SEQ ID NO: 7305808 - DNA, 22 bp, Homo sapiens
caggccctgccttgagggacct

SEQ ID NO: 7305809 - DNA, 22 bp, Homo sapiens
tacactttcgtttgtggattag

SEQ ID NO: 7305810 - DNA, 22 bp, Homo sapiens
tacagagaactcatagaaagaa

SEQ ID NO: 7305811 - DNA, 22 bp, Homo sapiens
caggccctgcactaggccctgg

SEQ ID NO: 7305812 - DNA, 22 bp, Homo sapiens
caggcccaggggtctggcccac

SEQ ID NO: 7305813 - DNA, 22 bp, Homo sapiens
tagaaagagcatagtattataa

SEQ ID NO: 7305814 - DNA, 19 bp, Homo sapiens
tagaaagatgatgggtggg

SEQ ID NO: 7305815 - DNA, 22 bp, Homo sapiens
tagaaagatctgtaggcaagag

SEQ ID NO: 7305816 - DNA, 22 bp, Homo sapiens
tagaaagatctgtaggcaagag

SEQ ID NO: 7305817 - DNA, 22 bp, Homo sapiens
tagaaagacaatgggaagtgct

SEQ ID NO: 7305818 - DNA, 22 bp, Homo sapiens
tagacatttatctccatgtgga

SEQ ID NO: 7305819 - DNA, 22 bp, Homo sapiens
tagacattatgtattaagttct

SEQ ID NO: 7305820 - DNA, 22 bp, Homo sapiens
tagacattggccattcctgtgg

SEQ ID NO: 7305821 - DNA, 22 bp, Homo sapiens
tagacatttctggttattgaca

SEQ ID NO: 7305822 - DNA, 22 bp, Homo sapiens
tagacatttctggttattgaca

SEQ ID NO: 7305823 - DNA, 22 bp, Homo sapiens
tagcatcatgatcagaactgtt

SEQ ID NO: 7305824 - DNA, 22 bp, Homo sapiens
tagcatctgcgttgggttggac

SEQ ID NO: 7305825 - DNA, 22 bp, Homo sapiens
tagcagcaggggaaacagctgt

SEQ ID NO: 7305826 - DNA, 22 bp, Homo sapiens
tagcagcacctacacgtcagag

SEQ ID NO: 7305827 - DNA, 22 bp, Homo sapiens
tagcagtgtgcaaaatctttaa

SEQ ID NO: 7305828 - DNA, 22 bp, Homo sapiens
cagggcagtgaagaacacacgt

SEQ ID NO: 7305829 - DNA, 22 bp, Homo sapiens
cagggagtcaacaaacagatca

SEQ ID NO: 7305830 - DNA, 22 bp, Homo sapiens
cagggaggctgtcttatgcctg

SEQ ID NO: 7305831 - DNA, 22 bp, Homo sapiens
tagacatttgtcaagaatgact

SEQ ID NO: 7305832 - DNA, 22 bp, Homo sapiens
cagggagcggagtcccatgcct

SEQ ID NO: 7305833 - DNA, 22 bp, Homo sapiens
tagacatttggcatggttttca

SEQ ID NO: 7305834 - DNA, 22 bp, Homo sapiens
cagggagcctgaatgttccagg

SEQ ID NO: 7305835 - DNA, 22 bp, Homo sapiens
cagggaggatgggctgttttgc

SEQ ID NO: 7305836 - DNA, 21 bp, Homo sapiens
tagcaattatagatgtctaaa

SEQ ID NO: 7305837 - DNA, 22 bp, Homo sapiens
tagcagagtttggtacctgggg

SEQ ID NO: 7305838 - DNA, 20 bp, Homo sapiens
tctgttattgcatgtacata

SEQ ID NO: 7305839 - DNA, 22 bp, Homo sapiens
tctgtggctatcatactgaagg

SEQ ID NO: 7305840 - DNA, 22 bp, Homo sapiens
tctgttctaagcattctatgtg

SEQ ID NO: 7305841 - DNA, 22 bp, Homo sapiens
ccaggagcagagtaggtgttca

SEQ ID NO: 7305842 - DNA, 22 bp, Homo sapiens
tctgggcctcagtttcttcatc

SEQ ID NO: 7305843 - DNA, 22 bp, Homo sapiens
tctggggaccatggcatctaaa

SEQ ID NO: 7305844 - DNA, 22 bp, Homo sapiens
tctggggaatgttcatttctga

SEQ ID NO: 7305845 - DNA, 21 bp, Homo sapiens
tctggggaagacatctaggat

SEQ ID NO: 7305846 - DNA, 22 bp, Homo sapiens
tctggggagggagccacaggtc

SEQ ID NO: 7305847 - DNA, 22 bp, Homo sapiens
tctggggagcagccctggtgag

SEQ ID NO: 7305848 - DNA, 22 bp, Homo sapiens
tctggggacggggcccagcaat

SEQ ID NO: 7305849 - DNA, 22 bp, Homo sapiens
tctggggagtcaaagagacctg

SEQ ID NO: 7305850 - DNA, 22 bp, Homo sapiens
tctggggagtgcctaagtggaa

SEQ ID NO: 7305851 - DNA, 22 bp, Homo sapiens
tctggggagtgcctaagtggaa

SEQ ID NO: 7305852 - DNA, 22 bp, Homo sapiens
tctggggataagacccaggtat

SEQ ID NO: 7305853 - DNA, 22 bp, Homo sapiens
tctggggatgaggacctagatg

SEQ ID NO: 7305854 - DNA, 22 bp, Homo sapiens
tcttacagccactctgtgaagc

SEQ ID NO: 7305855 - DNA, 22 bp, Homo sapiens
tcttagaaatgaagttctttct

SEQ ID NO: 7305856 - DNA, 17 bp, Homo sapiens
tcttctcttccagtctt

SEQ ID NO: 7305857 - DNA, 22 bp, Homo sapiens
ccaggcaggcgatggtgcagtg

SEQ ID NO: 7305858 - DNA, 22 bp, Homo sapiens
ccaggcccgttcccttctccag

SEQ ID NO: 7305859 - DNA, 22 bp, Homo sapiens
tgaaatgagatagataatcagg

SEQ ID NO: 7305860 - DNA, 22 bp, Homo sapiens
tgaaatgagcatttattcttta

SEQ ID NO: 7305861 - DNA, 22 bp, Homo sapiens
tgaaatgatatctgataacaaa

SEQ ID NO: 7305862 - DNA, 22 bp, Homo sapiens
tgaaggtgtatgctgtgggtca

SEQ ID NO: 7305863 - DNA, 22 bp, Homo sapiens
ccagggctgccgcatccctggt

SEQ ID NO: 7305864 - DNA, 22 bp, Homo sapiens
ccagggctctgcttctgccatg

SEQ ID NO: 7305865 - DNA, 17 bp, Homo sapiens
tgaaacaccaagactgt

SEQ ID NO: 7305866 - DNA, 23 bp, Homo sapiens
tgaaacagatgccaatgatcaag

SEQ ID NO: 7305867 - DNA, 23 bp, Homo sapiens
tgaaacagatgccaatgatcaag

SEQ ID NO: 7305868 - DNA, 22 bp, Homo sapiens
tgaaacactttcaattacatat

SEQ ID NO: 7305869 - DNA, 22 bp, Homo sapiens
tgaaacaaatttggaaaatcta

SEQ ID NO: 7305870 - DNA, 21 bp, Homo sapiens
tgaaacaatcagacagagtct

SEQ ID NO: 7305871 - DNA, 21 bp, Homo sapiens
tgaaacaatcagacagagtct

SEQ ID NO: 7305872 - DNA, 22 bp, Homo sapiens
tgaaacaagatccacagacttg

SEQ ID NO: 7305873 - DNA, 22 bp, Homo sapiens
tgaaatgagagcacagaataaa

SEQ ID NO: 7305874 - DNA, 22 bp, Homo sapiens
tgaaatgagagcacagaataaa

SEQ ID NO: 7305875 - DNA, 22 bp, Homo sapiens
ccaggcttcaggagtggtttcc

SEQ ID NO: 7305876 - DNA, 22 bp, Homo sapiens
ccaggcttcctaatgtgtgcag

SEQ ID NO: 7305877 - DNA, 22 bp, Homo sapiens
ccaggctgtggtttagatagag

SEQ ID NO: 7305878 - DNA, 22 bp, Homo sapiens
ccaggctgttttcaaacttggg

SEQ ID NO: 7305879 - DNA, 22 bp, Homo sapiens
ccaggcttattatcttctccat

SEQ ID NO: 7305880 - DNA, 22 bp, Homo sapiens
ccaggcctgattgggaatcttg

SEQ ID NO: 7305881 - DNA, 22 bp, Homo sapiens
tcttgccctcaacaagagcatg

SEQ ID NO: 7305882 - DNA, 22 bp, Homo sapiens
ccaggtgtgtcaccattgccca

SEQ ID NO: 7305883 - DNA, 22 bp, Homo sapiens
tgagcagtcatccatttctcct

SEQ ID NO: 7305884 - DNA, 22 bp, Homo sapiens
tgagcagtcagacaagcatcac

SEQ ID NO: 7305885 - DNA, 22 bp, Homo sapiens
ccagtccacgtcaagaagaggt

SEQ ID NO: 7305886 - DNA, 17 bp, Homo sapiens
tgagcagtagaagatgc

SEQ ID NO: 7305887 - DNA, 22 bp, Homo sapiens
tgagcagtaggtctgaatagtg

SEQ ID NO: 7305888 - DNA, 22 bp, Homo sapiens
tgagcagtaacagctcacaggg

SEQ ID NO: 7305889 - DNA, 22 bp, Homo sapiens
tgagcaggtgagtctagggcag

SEQ ID NO: 7305890 - DNA, 22 bp, Homo sapiens
ccagggctgctcattggctggt

SEQ ID NO: 7305891 - DNA, 22 bp, Homo sapiens
ccagtgctaaggtagcctctgc

SEQ ID NO: 7305892 - DNA, 19 bp, Homo sapiens
ccagtcccatacaggagat

SEQ ID NO: 7305893 - DNA, 18 bp, Homo sapiens
ccatcaccctaactagtg

SEQ ID NO: 7305894 - DNA, 22 bp, Homo sapiens
tgaggctgagatatcagggagg

SEQ ID NO: 7305895 - DNA, 22 bp, Homo sapiens
tgagtccaaattctaccacctc

SEQ ID NO: 7305896 - DNA, 22 bp, Homo sapiens
tgagttttttcaacatatgaag

SEQ ID NO: 7305897 - DNA, 22 bp, Homo sapiens
tgagttctttccgttaggtatg

SEQ ID NO: 7305898 - DNA, 18 bp, Homo sapiens
cccagaggaatgcctgga

SEQ ID NO: 7305899 - DNA, 19 bp, Homo sapiens
cccagaggaatgcctggaa

SEQ ID NO: 7305900 - DNA, 22 bp, Homo sapiens
cccagagatgggaggtgatcgg

SEQ ID NO: 7305901 - DNA, 22 bp, Homo sapiens
tgcagagaaagtgtagacaggc

SEQ ID NO: 7305902 - DNA, 19 bp, Homo sapiens
tgcagagagaggcaaagaa

SEQ ID NO: 7305903 - DNA, 22 bp, Homo sapiens
cccaagggtgcccagcagagga

SEQ ID NO: 7305904 - DNA, 22 bp, Homo sapiens
cccaaggggtgttgatggagga

SEQ ID NO: 7305905 - DNA, 22 bp, Homo sapiens
cccaaggggagattttcttgag

SEQ ID NO: 7305906 - DNA, 22 bp, Homo sapiens
cccaagggatgcttgagtagtt

SEQ ID NO: 7305907 - DNA, 22 bp, Homo sapiens
cccaagggagtgcctggtcaac

SEQ ID NO: 7305908 - DNA, 22 bp, Homo sapiens
tgcactccaggctgggtgacag

SEQ ID NO: 7305909 - DNA, 22 bp, Homo sapiens
tgcactccaggctgggtgacag

SEQ ID NO: 7305910 - DNA, 22 bp, Homo sapiens
tgcacagatgggcttgttcata

SEQ ID NO: 7305911 - DNA, 19 bp, Homo sapiens
tgcaatcagctacccaggt

SEQ ID NO: 7305912 - DNA, 22 bp, Homo sapiens
tgcaatcaggtaccatttgatt

SEQ ID NO: 7305913 - DNA, 21 bp, Homo sapiens
cccaagggaggcaggataagg

SEQ ID NO: 7305914 - DNA, 22 bp, Homo sapiens
tgcaagtagtccagcctttggg

SEQ ID NO: 7305915 - DNA, 22 bp, Homo sapiens
tgataatattttgaatcataag

SEQ ID NO: 7305916 - DNA, 22 bp, Homo sapiens
tgatacacagatttacatcaat

SEQ ID NO: 7305917 - DNA, 22 bp, Homo sapiens
tgcaggaccttgatcctggact

SEQ ID NO: 7305918 - DNA, 22 bp, Homo sapiens
tgcaggaccggaaccatgggat

SEQ ID NO: 7305919 - DNA, 22 bp, Homo sapiens
tgcaggacccgggctgtggtca

SEQ ID NO: 7305920 - DNA, 22 bp, Homo sapiens
tgcaggacattagttatgaatt

SEQ ID NO: 7305921 - DNA, 22 bp, Homo sapiens
tgcaggacagtttggaagagag

SEQ ID NO: 7305922 - DNA, 22 bp, Homo sapiens
tgcaggactgaaggagggctgg

SEQ ID NO: 7305923 - DNA, 22 bp, Homo sapiens
tgcaggactggggagcggaagg

SEQ ID NO: 7305924 - DNA, 22 bp, Homo sapiens
tgcaggactcaagggtagcagg

SEQ ID NO: 7305925 - DNA, 23 bp, Homo sapiens
tgcaggactactcgagcactgct

SEQ ID NO: 7305926 - DNA, 23 bp, Homo sapiens
tgcaggactcaagaaagaaaggc

SEQ ID NO: 7305927 - DNA, 20 bp, Homo sapiens
tgcaggacagagcctgtgtg

SEQ ID NO: 7305928 - DNA, 22 bp, Homo sapiens
tgcaggactttcagtgctcaaa

SEQ ID NO: 7305929 - DNA, 22 bp, Homo sapiens
tgcaggacttcaggactctgag

SEQ ID NO: 7305930 - DNA, 22 bp, Homo sapiens
cccagcagccttgtcccttctc

SEQ ID NO: 7305931 - DNA, 22 bp, Homo sapiens
cccagcagcttgcacagtgctg

SEQ ID NO: 7305932 - DNA, 22 bp, Homo sapiens
cccagcaggtcggtgctgcctg

SEQ ID NO: 7305933 - DNA, 22 bp, Homo sapiens
cccagcaggaggaggttgcagt

SEQ ID NO: 7305934 - DNA, 22 bp, Homo sapiens
cccagcagggtctctgtgtcta

SEQ ID NO: 7305935 - DNA, 22 bp, Homo sapiens
cccagcaggcatgttgggagga

SEQ ID NO: 7305936 - DNA, 22 bp, Homo sapiens
tgcagggatcctagctgaagag

SEQ ID NO: 7305937 - DNA, 23 bp, Homo sapiens
tggaggaaacacatcagaagacc

SEQ ID NO: 7305938 - DNA, 23 bp, Homo sapiens
tggagatgccccactccctgtct

SEQ ID NO: 7305939 - DNA, 22 bp, Homo sapiens
tggagatggcctcaggccctca

SEQ ID NO: 7305940 - DNA, 22 bp, Homo sapiens
tggaggaagttgctggaagtca

SEQ ID NO: 7305941 - DNA, 18 bp, Homo sapiens
tggaggaatcacaatggc

SEQ ID NO: 7305942 - DNA, 22 bp, Homo sapiens
tggaggacaggactggacagcc

SEQ ID NO: 7305943 - DNA, 22 bp, Homo sapiens
tggaggcatgacagtgtctgga

SEQ ID NO: 7305944 - DNA, 22 bp, Homo sapiens
tggaggcattgtgactgctgaa

SEQ ID NO: 7305945 - DNA, 22 bp, Homo sapiens
tggaggccaaggcaggcggatc

SEQ ID NO: 7305946 - DNA, 22 bp, Homo sapiens
tggaaagaattcctatggttca

SEQ ID NO: 7305947 - DNA, 22 bp, Homo sapiens
tggaaagaaaaacaggccatga

SEQ ID NO: 7305948 - DNA, 22 bp, Homo sapiens
tggaaagaaagtaaaggcgtat

SEQ ID NO: 7305949 - DNA, 22 bp, Homo sapiens
tggaaagaaagtaaaggcgtat

SEQ ID NO: 7305950 - DNA, 22 bp, Homo sapiens
tggagaattctatgttgagggg

SEQ ID NO: 7305951 - DNA, 22 bp, Homo sapiens
tggagaattctatgttgagggg

SEQ ID NO: 7305952 - DNA, 22 bp, Homo sapiens
tggagataacagatgcaaacct

SEQ ID NO: 7305953 - DNA, 19 bp, Homo sapiens
tggagataagctgtcaata

SEQ ID NO: 7305954 - DNA, 22 bp, Homo sapiens
tggagataggctgaggcagggc

SEQ ID NO: 7305955 - DNA, 22 bp, Homo sapiens
tggaaacctactgatacaggag

SEQ ID NO: 7305956 - DNA, 22 bp, Homo sapiens
tggaaagaaaaacaggccatga

SEQ ID NO: 7305957 - DNA, 19 bp, Homo sapiens
cccttggtagacagctgca

SEQ ID NO: 7305958 - DNA, 22 bp, Homo sapiens
tggcagggaatacagatgttta

SEQ ID NO: 7305959 - DNA, 22 bp, Homo sapiens
ccctggcttggcactctccact

SEQ ID NO: 7305960 - DNA, 22 bp, Homo sapiens
ccctgggaagtattccagctat

SEQ ID NO: 7305961 - DNA, 22 bp, Homo sapiens
tggcaggcggaggttgcagtga

SEQ ID NO: 7305962 - DNA, 22 bp, Homo sapiens
ccctggagtcctggcagttgat

SEQ ID NO: 7305963 - DNA, 22 bp, Homo sapiens
ccctggagtagcactgggtcgc

SEQ ID NO: 7305964 - DNA, 22 bp, Homo sapiens
ccctggaggttgaggctgcagt

SEQ ID NO: 7305965 - DNA, 22 bp, Homo sapiens
ccctggctgctaccaggtagct

SEQ ID NO: 7305966 - DNA, 22 bp, Homo sapiens
tggcagaatttctagcagattc

SEQ ID NO: 7305967 - DNA, 22 bp, Homo sapiens
tggcagaaagaaccatgtgcaa

SEQ ID NO: 7305968 - DNA, 22 bp, Homo sapiens
ccccaggcagggcctaacagag

SEQ ID NO: 7305969 - DNA, 22 bp, Homo sapiens
tgcttaaaaacagtatggtagt

SEQ ID NO: 7305970 - DNA, 22 bp, Homo sapiens
tgcttgtcacatacaggagcat

SEQ ID NO: 7305971 - DNA, 22 bp, Homo sapiens
tgcttgtcagtgtgctagaaac

SEQ ID NO: 7305972 - DNA, 22 bp, Homo sapiens
cccagtgtctcttgtgcctttc

SEQ ID NO: 7305973 - DNA, 22 bp, Homo sapiens
tgctgggggctttctggatacc

SEQ ID NO: 7305974 - DNA, 22 bp, Homo sapiens
tgctgggggttcagatgagtaa

SEQ ID NO: 7305975 - DNA, 22 bp, Homo sapiens
tgctagctcacccttgcctccc

SEQ ID NO: 7305976 - DNA, 23 bp, Homo sapiens
tgctactcaaagtgtggtcccag

SEQ ID NO: 7305977 - DNA, 23 bp, Homo sapiens
tgctactcaaagtgtggtcccag

SEQ ID NO: 7305978 - DNA, 22 bp, Homo sapiens
tgctactcctttgctcgaaatc

SEQ ID NO: 7305979 - DNA, 22 bp, Homo sapiens
tgctactgaataggtgtccaat

SEQ ID NO: 7305980 - DNA, 22 bp, Homo sapiens
tgctactcaattcacctgccac

SEQ ID NO: 7305981 - DNA, 17 bp, Homo sapiens
tgctacctttgggctcc

SEQ ID NO: 7305982 - DNA, 22 bp, Homo sapiens
tgctaccttttttattaaatga

SEQ ID NO: 7305983 - DNA, 22 bp, Homo sapiens
tgctactaggggagtccacgcc

SEQ ID NO: 7305984 - DNA, 22 bp, Homo sapiens
tgctagaattaggttaaacaaa

SEQ ID NO: 7305985 - DNA, 22 bp, Homo sapiens
tgctacttttgaaatcttcctt

SEQ ID NO: 7305986 - DNA, 22 bp, Homo sapiens
tgctagaatttgcagaagcata

SEQ ID NO: 7305987 - DNA, 22 bp, Homo sapiens
tgctaagttctgcaaaagataa

SEQ ID NO: 7305988 - DNA, 19 bp, Homo sapiens
tgctaagtcctttagaggc

SEQ ID NO: 7305989 - DNA, 22 bp, Homo sapiens
tgctaactattcctaaagatca

SEQ ID NO: 7305990 - DNA, 22 bp, Homo sapiens
tgctacatgcactgtgatctag

SEQ ID NO: 7305991 - DNA, 19 bp, Homo sapiens
tgctctctggtgcttcatg

SEQ ID NO: 7305992 - DNA, 22 bp, Homo sapiens
tgctctggacgctgagtggttt

SEQ ID NO: 7305993 - DNA, 22 bp, Homo sapiens
tgctctggaccatgactatgtg

SEQ ID NO: 7305994 - DNA, 22 bp, Homo sapiens
tgctctggagtggcttgtgcac

SEQ ID NO: 7305995 - DNA, 22 bp, Homo sapiens
tgggacaggaggcctctggaga

SEQ ID NO: 7305996 - DNA, 22 bp, Homo sapiens
tgggacaggaggcctctggaga

SEQ ID NO: 7305997 - DNA, 22 bp, Homo sapiens
tgggcactgtagctggtgctgg

SEQ ID NO: 7305998 - DNA, 21 bp, Homo sapiens
tgggcactgagggtgctgctc

SEQ ID NO: 7305999 - DNA, 22 bp, Homo sapiens
tggctttagggttccttctacc

SEQ ID NO: 7306000 - DNA, 20 bp, Homo sapiens
cctcctggtcaggtgtgcag

SEQ ID NO: 7306001 - DNA, 22 bp, Homo sapiens
cctcctggtaattagcgaaagg

SEQ ID NO: 7306002 - DNA, 22 bp, Homo sapiens
cctcctgggttcaagcgattct

SEQ ID NO: 7306003 - DNA, 22 bp, Homo sapiens
cctcctggtccagcatctcttt

SEQ ID NO: 7306004 - DNA, 22 bp, Homo sapiens
cctcctggcctgtgcagagccc

SEQ ID NO: 7306005 - DNA, 22 bp, Homo sapiens
cctcctgggactcattagcacc

SEQ ID NO: 7306006 - DNA, 22 bp, Homo sapiens
cctcctggcttttcccattgaa

SEQ ID NO: 7306007 - DNA, 22 bp, Homo sapiens
cctcctgggacaggctggcaca

SEQ ID NO: 7306008 - DNA, 22 bp, Homo sapiens
cctcctgggagagcacggaggg

SEQ ID NO: 7306009 - DNA, 23 bp, Homo sapiens
cctcctgggcacaggcctgatgg

SEQ ID NO: 7306010 - DNA, 22 bp, Homo sapiens
cctcctggggtgaaggatggga

SEQ ID NO: 7306011 - DNA, 22 bp, Homo sapiens
cctcctgggctcctgtctgcac

SEQ ID NO: 7306012 - DNA, 22 bp, Homo sapiens
cctcctgggccttgctctgtga

SEQ ID NO: 7306013 - DNA, 22 bp, Homo sapiens
tggcagtgggaagctggaagtc

SEQ ID NO: 7306014 - DNA, 22 bp, Homo sapiens
tggccaagatgcgacctctcag

SEQ ID NO: 7306015 - DNA, 22 bp, Homo sapiens
cctccagggcccctctcactgg

SEQ ID NO: 7306016 - DNA, 22 bp, Homo sapiens
tggccaatcactgacaaaatgc

SEQ ID NO: 7306017 - DNA, 22 bp, Homo sapiens
cctgccactgtaggtgacagtt

SEQ ID NO: 7306018 - DNA, 22 bp, Homo sapiens
cctgccacttcttgctatggag

SEQ ID NO: 7306019 - DNA, 22 bp, Homo sapiens
tggtacacatgtccaaggtcag

SEQ ID NO: 7306020 - DNA, 22 bp, Homo sapiens
tggtaccagctgtgtgttcact

SEQ ID NO: 7306021 - DNA, 22 bp, Homo sapiens
tggtaccaggggttatttctgc

SEQ ID NO: 7306022 - DNA, 19 bp, Homo sapiens
tggtactagcgctgtctat

SEQ ID NO: 7306023 - DNA, 22 bp, Homo sapiens
cctgcctgaaggtcagccaccc

SEQ ID NO: 7306024 - DNA, 22 bp, Homo sapiens
cctgcctgacagagaaggttca

SEQ ID NO: 7306025 - DNA, 19 bp, Homo sapiens
cctgcctgaccccggctac

SEQ ID NO: 7306026 - DNA, 17 bp, Homo sapiens
cctgcctgagccatagc

SEQ ID NO: 7306027 - DNA, 19 bp, Homo sapiens
cctgcctgagctgtccctc

SEQ ID NO: 7306028 - DNA, 22 bp, Homo sapiens
cctgcctgcaaaatgggacaag

SEQ ID NO: 7306029 - DNA, 22 bp, Homo sapiens
cctgcctgattccaggatggct

SEQ ID NO: 7306030 - DNA, 22 bp, Homo sapiens
cctgcctgcaccttctctgggg

SEQ ID NO: 7306031 - DNA, 22 bp, Homo sapiens
cctgcctgcagaaagtatctcc

SEQ ID NO: 7306032 - DNA, 22 bp, Homo sapiens
tggttactagtgacttggggac

SEQ ID NO: 7306033 - DNA, 22 bp, Homo sapiens
tggttactctaggtggctgtaa

SEQ ID NO: 7306034 - DNA, 22 bp, Homo sapiens
tggttactttcactggtctggg

SEQ ID NO: 7306035 - DNA, 22 bp, Homo sapiens
tgggctccggcggcctcaggct

SEQ ID NO: 7306036 - DNA, 22 bp, Homo sapiens
tgggctcctcgtcactcgctgt

SEQ ID NO: 7306037 - DNA, 22 bp, Homo sapiens
tgggctcatggcccagcactgg

SEQ ID NO: 7306038 - DNA, 22 bp, Homo sapiens
tgggcaggataatatctcatgt

SEQ ID NO: 7306039 - DNA, 22 bp, Homo sapiens
tgggcaggatgcgttgattctt

SEQ ID NO: 7306040 - DNA, 22 bp, Homo sapiens
tgggcaggcaagtgaatacctt

SEQ ID NO: 7306041 - DNA, 22 bp, Homo sapiens
tggggagaaatgtctttgttcc

SEQ ID NO: 7306042 - DNA, 22 bp, Homo sapiens
tggggagaagcaatagactcta

SEQ ID NO: 7306043 - DNA, 22 bp, Homo sapiens
cctgatatggtgtcatttaaac

SEQ ID NO: 7306044 - DNA, 22 bp, Homo sapiens
cctgatattaagaaggagtgag

SEQ ID NO: 7306045 - DNA, 17 bp, Homo sapiens
cctgatattcaagcagc

SEQ ID NO: 7306046 - DNA, 22 bp, Homo sapiens
cctgatcaaaaatgtattgttg

SEQ ID NO: 7306047 - DNA, 22 bp, Homo sapiens
tggggagattgttaaatttaga

SEQ ID NO: 7306048 - DNA, 22 bp, Homo sapiens
tggggagcacggtagggaaatg

SEQ ID NO: 7306049 - DNA, 23 bp, Homo sapiens
tggggagagttaccctggaagcg

SEQ ID NO: 7306050 - DNA, 22 bp, Homo sapiens
tggggagagttacaaggaatct

SEQ ID NO: 7306051 - DNA, 22 bp, Homo sapiens
tggggagaggaatttgaatgat

SEQ ID NO: 7306052 - DNA, 22 bp, Homo sapiens
tggttcaggcagggtgttgctg

SEQ ID NO: 7306053 - DNA, 20 bp, Homo sapiens
tgttgattggtgtcatctca

SEQ ID NO: 7306054 - DNA, 22 bp, Homo sapiens
cctggggagaagagcttccccc

SEQ ID NO: 7306055 - DNA, 19 bp, Homo sapiens
tgttgccaggtatcatgtt

SEQ ID NO: 7306056 - DNA, 22 bp, Homo sapiens
tgtttcttacgtttttagaggc

SEQ ID NO: 7306057 - DNA, 17 bp, Homo sapiens
tgttttcattcattgct

SEQ ID NO: 7306058 - DNA, 22 bp, Homo sapiens
tgttttcatggttatgtgtcta

SEQ ID NO: 7306059 - DNA, 22 bp, Homo sapiens
tgttttcatcacagaatgtaac

SEQ ID NO: 7306060 - DNA, 22 bp, Homo sapiens
tgttttcatttgatgtaacaaa

SEQ ID NO: 7306061 - DNA, 22 bp, Homo sapiens
tgttttcatttgatgtaacaaa

SEQ ID NO: 7306062 - DNA, 22 bp, Homo sapiens
tgttttcatttgatgtaacaaa

SEQ ID NO: 7306063 - DNA, 22 bp, Homo sapiens
cctggggattctgacacggagt

SEQ ID NO: 7306064 - DNA, 23 bp, Homo sapiens
cctggggagctgtatccagagtg

SEQ ID NO: 7306065 - DNA, 23 bp, Homo sapiens
cctggggcacttgagtcctcatc

SEQ ID NO: 7306066 - DNA, 22 bp, Homo sapiens
cctggggagagaaagcccagcc

SEQ ID NO: 7306067 - DNA, 22 bp, Homo sapiens
cctggggagccgcctgagcccc

SEQ ID NO: 7306068 - DNA, 22 bp, Homo sapiens
tgtttataatatgcagtgagca

SEQ ID NO: 7306069 - DNA, 22 bp, Homo sapiens
cctggggctcaagatggcgccg

SEQ ID NO: 7306070 - DNA, 22 bp, Homo sapiens
cctggggccccgagccagaagc

SEQ ID NO: 7306071 - DNA, 22 bp, Homo sapiens
ttaatagatttgattttaaagg

SEQ ID NO: 7306072 - DNA, 22 bp, Homo sapiens
ttaatatgttgaaatttattag

SEQ ID NO: 7306073 - DNA, 22 bp, Homo sapiens
ttaatatgctgcttcttgaaaa

SEQ ID NO: 7306074 - DNA, 22 bp, Homo sapiens
ttaatatgctgcttcttgaaaa

SEQ ID NO: 7306075 - DNA, 22 bp, Homo sapiens
ttaaaagtctgatgatttacat

SEQ ID NO: 7306076 - DNA, 23 bp, Homo sapiens
ttaaaagtggagagagaagctgg

SEQ ID NO: 7306077 - DNA, 22 bp, Homo sapiens
ttaaaatctaaagcagttgtct

SEQ ID NO: 7306078 - DNA, 22 bp, Homo sapiens
ttaaaatgaatattgattagca

SEQ ID NO: 7306079 - DNA, 22 bp, Homo sapiens
ttaatgaaacattgactatgat

SEQ ID NO: 7306080 - DNA, 22 bp, Homo sapiens
ttaatcttcagggactcttgct

SEQ ID NO: 7306081 - DNA, 22 bp, Homo sapiens
ttaatctgaatcagtaaacact

SEQ ID NO: 7306082 - DNA, 22 bp, Homo sapiens
cctgtggacattctgtgtggaa

SEQ ID NO: 7306083 - DNA, 20 bp, Homo sapiens
cctgtggagctgcctcctcc

SEQ ID NO: 7306084 - DNA, 22 bp, Homo sapiens
cctgtggagttcccatctgaat

SEQ ID NO: 7306085 - DNA, 18 bp, Homo sapiens
cctgtggctcagcccaca

SEQ ID NO: 7306086 - DNA, 21 bp, Homo sapiens
ttacaaagctacagatgttgc

SEQ ID NO: 7306087 - DNA, 22 bp, Homo sapiens
ttacaagtatttaagatgctgt

SEQ ID NO: 7306088 - DNA, 23 bp, Homo sapiens
ttacaagttctgaaatttccttc

SEQ ID NO: 7306089 - DNA, 22 bp, Homo sapiens
ttacaagttcagattttctcat

SEQ ID NO: 7306090 - DNA, 22 bp, Homo sapiens
ttacaagtttctggcttcatcc

SEQ ID NO: 7306091 - DNA, 22 bp, Homo sapiens
ttacaagttttcatgaaattga

SEQ ID NO: 7306092 - DNA, 22 bp, Homo sapiens
cgattgtcatattctgttggat

SEQ ID NO: 7306093 - DNA, 18 bp, Homo sapiens
cgatgtgtatgtgatttg

SEQ ID NO: 7306094 - DNA, 22 bp, Homo sapiens
cctttgggtgaattcctctctt

SEQ ID NO: 7306095 - DNA, 22 bp, Homo sapiens
cctttggggtcctgcctgggct

SEQ ID NO: 7306096 - DNA, 22 bp, Homo sapiens
cctttggggctttactgtggaa

SEQ ID NO: 7306097 - DNA, 22 bp, Homo sapiens
cctttgggaataggttccggct

SEQ ID NO: 7306098 - DNA, 22 bp, Homo sapiens
ttatgtacaatgttaatgtaaa

SEQ ID NO: 7306099 - DNA, 22 bp, Homo sapiens
ttatgtatgaatatagtagaag

SEQ ID NO: 7306100 - DNA, 22 bp, Homo sapiens
ttatgtactctgcaatgtttga

SEQ ID NO: 7306101 - DNA, 17 bp, Homo sapiens
cctttcttcccagaggg

SEQ ID NO: 7306102 - DNA, 22 bp, Homo sapiens
ttatgtatgaatatagtagaag

SEQ ID NO: 7306103 - DNA, 22 bp, Homo sapiens
ttatgtatggatggctgaaagt

SEQ ID NO: 7306104 - DNA, 17 bp, Homo sapiens
ttattttttgggctgag

SEQ ID NO: 7306105 - DNA, 22 bp, Homo sapiens
ttcaaaaaggtatgttcaagtc

SEQ ID NO: 7306106 - DNA, 22 bp, Homo sapiens
ttatttttaaaagttcacacag

SEQ ID NO: 7306107 - DNA, 23 bp, Homo sapiens
ttattttgtcagaagggactttt

SEQ ID NO: 7306108 - DNA, 23 bp, Homo sapiens
ttattttgtcagaagggactttt

SEQ ID NO: 7306109 - DNA, 22 bp, Homo sapiens
ttattattgtggttgcattatc

SEQ ID NO: 7306110 - DNA, 22 bp, Homo sapiens
ccttgggaccctgctggaggtt

SEQ ID NO: 7306111 - DNA, 22 bp, Homo sapiens
ccttgggagaaattgcagagtc

SEQ ID NO: 7306112 - DNA, 22 bp, Homo sapiens
cctttaaatggatgttcaactg

SEQ ID NO: 7306113 - DNA, 21 bp, Homo sapiens
ccttctcttgcttcagcttca

SEQ ID NO: 7306114 - DNA, 20 bp, Homo sapiens
ttacagaaatgatgttattt

SEQ ID NO: 7306115 - DNA, 20 bp, Homo sapiens
ttacagaaatgatgttattt

SEQ ID NO: 7306116 - DNA, 22 bp, Homo sapiens
ttaccattgttccccatgtgta

SEQ ID NO: 7306117 - DNA, 22 bp, Homo sapiens
ttaccattttataagttaaagt

SEQ ID NO: 7306118 - DNA, 22 bp, Homo sapiens
ttaccattattaggtggacttg

SEQ ID NO: 7306119 - DNA, 22 bp, Homo sapiens
ttaccattcaagttctctcctt

SEQ ID NO: 7306120 - DNA, 22 bp, Homo sapiens
ttaccattccatgacatcagga

SEQ ID NO: 7306121 - DNA, 22 bp, Homo sapiens
ttacctaaaatagctcaattta

SEQ ID NO: 7306122 - DNA, 22 bp, Homo sapiens
ttaccagatgggggactatgag

SEQ ID NO: 7306123 - DNA, 21 bp, Homo sapiens
ttaccaatggcttctctttcc

SEQ ID NO: 7306124 - DNA, 21 bp, Homo sapiens
ttaccaatggcttctctttcc

SEQ ID NO: 7306125 - DNA, 22 bp, Homo sapiens
ttaccaatgtgcttttgctaca

SEQ ID NO: 7306126 - DNA, 22 bp, Homo sapiens
ttaccaatgtgcttttgctaca

SEQ ID NO: 7306127 - DNA, 22 bp, Homo sapiens
ttctgaaatgagatataaggta

SEQ ID NO: 7306128 - DNA, 22 bp, Homo sapiens
ttctgaaaggcaggttgtttgc

SEQ ID NO: 7306129 - DNA, 22 bp, Homo sapiens
ttctgaaaattgggtcatactt

SEQ ID NO: 7306130 - DNA, 22 bp, Homo sapiens
ttctgaaaccttcagtatgaag

SEQ ID NO: 7306131 - DNA, 22 bp, Homo sapiens
ctataaatctacccagcattgg

SEQ ID NO: 7306132 - DNA, 22 bp, Homo sapiens
ttcttaagagggttaagtgaag

SEQ ID NO: 7306133 - DNA, 22 bp, Homo sapiens
ttcttaagtcagtaagatgcaa

SEQ ID NO: 7306134 - DNA, 22 bp, Homo sapiens
ttcttaagcacctaaaaagtgg

SEQ ID NO: 7306135 - DNA, 22 bp, Homo sapiens
ttcttaaagaggcaaaacacag

SEQ ID NO: 7306136 - DNA, 22 bp, Homo sapiens
ttgaatcattacaatagataag

SEQ ID NO: 7306137 - DNA, 22 bp, Homo sapiens
ttcttcccttcattccaccacc

SEQ ID NO: 7306138 - DNA, 22 bp, Homo sapiens
ttgaaggaggcgaaaattggtc

SEQ ID NO: 7306139 - DNA, 22 bp, Homo sapiens
ttgcactataggaaaatgtgtc

SEQ ID NO: 7306140 - DNA, 21 bp, Homo sapiens
ttgcaccatgataaattcaga

SEQ ID NO: 7306141 - DNA, 22 bp, Homo sapiens
ttgcactccagcccgagcaaca

SEQ ID NO: 7306142 - DNA, 22 bp, Homo sapiens
ttgcctatgtaactttatattt

SEQ ID NO: 7306143 - DNA, 22 bp, Homo sapiens
ttgctgcctgaggagcaacact

SEQ ID NO: 7306144 - DNA, 22 bp, Homo sapiens
ttgctgccttccgaatcctctc

SEQ ID NO: 7306145 - DNA, 22 bp, Homo sapiens
ttgatttttttctactatgcgc

SEQ ID NO: 7306146 - DNA, 22 bp, Homo sapiens
ttgcaaaagcaattgcagtttt

SEQ ID NO: 7306147 - DNA, 22 bp, Homo sapiens
ttgcaaaaccatcctaagtaaa

SEQ ID NO: 7306148 - DNA, 22 bp, Homo sapiens
ctcagccagacatgacccagtc

SEQ ID NO: 7306149 - DNA, 22 bp, Homo sapiens
ctcagccaggtgggggtcggga

SEQ ID NO: 7306150 - DNA, 22 bp, Homo sapiens
ctcagccatgcaacatgctggg

SEQ ID NO: 7306151 - DNA, 22 bp, Homo sapiens
cgggaaagttccacagatggat

SEQ ID NO: 7306152 - DNA, 22 bp, Homo sapiens
ttccaaattccaatcccctgaa

SEQ ID NO: 7306153 - DNA, 22 bp, Homo sapiens
ttccaaattaaaatgtacaatg

SEQ ID NO: 7306154 - DNA, 22 bp, Homo sapiens
cggctggtgtcgggcacagcaa

SEQ ID NO: 7306155 - DNA, 21 bp, Homo sapiens
ttcagtttcttcctcatctat

SEQ ID NO: 7306156 - DNA, 22 bp, Homo sapiens
ttcagtttgaattctgtagaac

SEQ ID NO: 7306157 - DNA, 22 bp, Homo sapiens
ttcagtttcgttatctatgaga

SEQ ID NO: 7306158 - DNA, 22 bp, Homo sapiens
ttcagtttcgttatctatgaga

SEQ ID NO: 7306159 - DNA, 22 bp, Homo sapiens
ttcagtttccctaaagccaatt

SEQ ID NO: 7306160 - DNA, 22 bp, Homo sapiens
ttcagtttcagtcttgcaaaaa

SEQ ID NO: 7306161 - DNA, 22 bp, Homo sapiens
ttcagtttccacttacatttaa

SEQ ID NO: 7306162 - DNA, 22 bp, Homo sapiens
ttccacttttctctctcatgcc

SEQ ID NO: 7306163 - DNA, 22 bp, Homo sapiens
cgtgaaatgagttgaattattg

SEQ ID NO: 7306164 - DNA, 22 bp, Homo sapiens
cgtgacacattctggacatggt

SEQ ID NO: 7306165 - DNA, 17 bp, Homo sapiens
ttcctctcacatttttt

SEQ ID NO: 7306166 - DNA, 22 bp, Homo sapiens
ttcctctcaacatgcctgccgg

SEQ ID NO: 7306167 - DNA, 22 bp, Homo sapiens
ttcctctgaaatggcttggaaa

SEQ ID NO: 7306168 - DNA, 22 bp, Homo sapiens
ttcctctggaggctctaggaga

SEQ ID NO: 7306169 - DNA, 22 bp, Homo sapiens
ctacatcacttaattcttagaa

SEQ ID NO: 7306170 - DNA, 22 bp, Homo sapiens
ctacatcagaacatttacccta

SEQ ID NO: 7306171 - DNA, 22 bp, Homo sapiens
ctacataaatttatcacagact

SEQ ID NO: 7306172 - DNA, 22 bp, Homo sapiens
ctacatcacttaattcttagaa

SEQ ID NO: 7306173 - DNA, 22 bp, Homo sapiens
ctacatcaagtaatcttcaaaa

SEQ ID NO: 7306174 - DNA, 22 bp, Homo sapiens
ctaactttatttgctaagtaga

SEQ ID NO: 7306175 - DNA, 22 bp, Homo sapiens
ctaactttagcttagattatca

SEQ ID NO: 7306176 - DNA, 22 bp, Homo sapiens
ttctacagactataactgtgat

SEQ ID NO: 7306177 - DNA, 23 bp, Homo sapiens
ttctacagcttcttcagttaagg

SEQ ID NO: 7306178 - DNA, 22 bp, Homo sapiens
ctaaattatcatgagaattatg

SEQ ID NO: 7306179 - DNA, 22 bp, Homo sapiens
ctagggctcgcaagggctggag

SEQ ID NO: 7306180 - DNA, 22 bp, Homo sapiens
ttctccttgttcccttcaattg

SEQ ID NO: 7306181 - DNA, 22 bp, Homo sapiens
ttctccttgaaaagctgcatct

SEQ ID NO: 7306182 - DNA, 22 bp, Homo sapiens
ttctcctggggccgtgatgtga

SEQ ID NO: 7306183 - DNA, 22 bp, Homo sapiens
ttctcatagagacatgattata

SEQ ID NO: 7306184 - DNA, 22 bp, Homo sapiens
ttctcatacaggatctcttatt

SEQ ID NO: 7306185 - DNA, 22 bp, Homo sapiens
ttctcctgcccttggacttcca

SEQ ID NO: 7306186 - DNA, 22 bp, Homo sapiens
ctgcaggggctggagttggctt

SEQ ID NO: 7306187 - DNA, 22 bp, Homo sapiens
ctgcctctattcactgaggcag

SEQ ID NO: 7306188 - DNA, 22 bp, Homo sapiens
ctgccctgggagtacctgtcct

SEQ ID NO: 7306189 - DNA, 22 bp, Homo sapiens
ctgccctggccactgtgcccag

SEQ ID NO: 7306190 - DNA, 22 bp, Homo sapiens
ctgccctgcttgatgacagcga

SEQ ID NO: 7306191 - DNA, 22 bp, Homo sapiens
ctgccctgcctggccagtgtgg

SEQ ID NO: 7306192 - DNA, 22 bp, Homo sapiens
ctgccctgagtcatgccagatg

SEQ ID NO: 7306193 - DNA, 22 bp, Homo sapiens
ctgctgagccctggcacaggtg

SEQ ID NO: 7306194 - DNA, 22 bp, Homo sapiens
ctgctgcccctgagctcagcct

SEQ ID NO: 7306195 - DNA, 20 bp, Homo sapiens
ctgctgccctgtcagcctct

SEQ ID NO: 7306196 - DNA, 22 bp, Homo sapiens
ctgctgagcatttgcagggaca

SEQ ID NO: 7306197 - DNA, 22 bp, Homo sapiens
ctgctctgaagccaggattctg

SEQ ID NO: 7306198 - DNA, 22 bp, Homo sapiens
ctgctctaactgcattagtttt

SEQ ID NO: 7306199 - DNA, 22 bp, Homo sapiens
ctgctctaggtattgaggctaa

SEQ ID NO: 7306200 - DNA, 22 bp, Homo sapiens
ctgctctaggttcctgcatatg

SEQ ID NO: 7306201 - DNA, 21 bp, Homo sapiens
ctgctgctggggtctgggcag

SEQ ID NO: 7306202 - DNA, 22 bp, Homo sapiens
ctgctgctgagaatgcctcagg

SEQ ID NO: 7306203 - DNA, 22 bp, Homo sapiens
ctgctgctgctatctacccagg

SEQ ID NO: 7306204 - DNA, 22 bp, Homo sapiens
ctgctgctcgaccagtcccagg

SEQ ID NO: 7306205 - DNA, 22 bp, Homo sapiens
ctgcgttctgcctggcggccta

SEQ ID NO: 7306206 - DNA, 22 bp, Homo sapiens
ctgcgtgtttgcaccctgtctg

SEQ ID NO: 7306207 - DNA, 22 bp, Homo sapiens
ctgcgtgttcctgaagcgcgct

SEQ ID NO: 7306208 - DNA, 22 bp, Homo sapiens
ctgcgtgtctctgtctcatggc

SEQ ID NO: 7306209 - DNA, 22 bp, Homo sapiens
ctgcgtgcatgtctgcgtgcat

SEQ ID NO: 7306210 - DNA, 22 bp, Homo sapiens
ctgcgtgtctctgtctcatggc

SEQ ID NO: 7306211 - DNA, 22 bp, Homo sapiens
ctgcgtgtctccttggggcaga

SEQ ID NO: 7306212 - DNA, 22 bp, Homo sapiens
ctgcgtgtctccttggggcaga

SEQ ID NO: 7306213 - DNA, 22 bp, Homo sapiens
ctgcgtgcattaatatttcctt

SEQ ID NO: 7306214 - DNA, 22 bp, Homo sapiens
ctgagatactgtggcgaatgca

SEQ ID NO: 7306215 - DNA, 22 bp, Homo sapiens
ctgagagtctgcatttctaaca

SEQ ID NO: 7306216 - DNA, 22 bp, Homo sapiens
ctgagatctttatacgaggcac

SEQ ID NO: 7306217 - DNA, 22 bp, Homo sapiens
ctgagagtaattttctacttga

SEQ ID NO: 7306218 - DNA, 22 bp, Homo sapiens
ctgaggctgggcatggggtcca

SEQ ID NO: 7306219 - DNA, 22 bp, Homo sapiens
ttttctctatattgtctgtgaa

SEQ ID NO: 7306220 - DNA, 22 bp, Homo sapiens
ctctggagtgcagcctggtggc

SEQ ID NO: 7306221 - DNA, 22 bp, Homo sapiens
tttttcttgtgctggatctaat

SEQ ID NO: 7306222 - DNA, 22 bp, Homo sapiens
tttttcttaaatgtgggttggc

SEQ ID NO: 7306223 - DNA, 22 bp, Homo sapiens
ctgaaaaacgggatttggctgg

SEQ ID NO: 7306224 - DNA, 22 bp, Homo sapiens
ctgaaaatgttacacaggaaga

SEQ ID NO: 7306225 - DNA, 22 bp, Homo sapiens
ctgaaaatgttacacaggaaga

SEQ ID NO: 7306226 - DNA, 20 bp, Homo sapiens
ctgaaagacgtaacagtgca

SEQ ID NO: 7306227 - DNA, 22 bp, Homo sapiens
ctgaaactggagtccttatatc

SEQ ID NO: 7306228 - DNA, 22 bp, Homo sapiens
ctgaaagagccccaggggcctg

SEQ ID NO: 7306229 - DNA, 22 bp, Homo sapiens
ctccccagcattctgacttcct

SEQ ID NO: 7306230 - DNA, 22 bp, Homo sapiens
ctcaggctccagacttccgtcc

SEQ ID NO: 7306231 - DNA, 22 bp, Homo sapiens
ctcaggctctgtactccctttg

SEQ ID NO: 7306232 - DNA, 22 bp, Homo sapiens
ctcaggctctggccatccaagg

SEQ ID NO: 7306233 - DNA, 22 bp, Homo sapiens
ctcaggctgtgatgtgatggca

SEQ ID NO: 7306234 - DNA, 21 bp, Homo sapiens
ctcaggctggcagcaggctag

SEQ ID NO: 7306235 - DNA, 22 bp, Homo sapiens
ttgtttcagctgtatgctatgt

SEQ ID NO: 7306236 - DNA, 20 bp, Homo sapiens
ttgtttattatgttctgatc

SEQ ID NO: 7306237 - DNA, 22 bp, Homo sapiens
ttgtttatgtgttgtctatggc

SEQ ID NO: 7306238 - DNA, 22 bp, Homo sapiens
ctccccagcattctgacttcct

SEQ ID NO: 7306239 - DNA, 22 bp, Homo sapiens
ctccctggcagccgcactcctg

SEQ ID NO: 7306240 - DNA, 22 bp, Homo sapiens
tttcaaagttgggaattgtaat

SEQ ID NO: 7306241 - DNA, 22 bp, Homo sapiens
tttcaaagttgggaattgtaat

SEQ ID NO: 7306242 - DNA, 22 bp, Homo sapiens
tttcaaataccataaacctaat

SEQ ID NO: 7306243 - DNA, 22 bp, Homo sapiens
ctcggtggacatttcagaggtg

SEQ ID NO: 7306244 - DNA, 22 bp, Homo sapiens
ctccttctcctcgggaggccag

SEQ ID NO: 7306245 - DNA, 22 bp, Homo sapiens
ctcctgtcagaagcatcctgag

SEQ ID NO: 7306246 - DNA, 22 bp, Homo sapiens
tttatattacctggaatagctt

SEQ ID NO: 7306247 - DNA, 22 bp, Homo sapiens
tttcaaagtaaggattttcatc

SEQ ID NO: 7306248 - DNA, 22 bp, Homo sapiens
tttcaaagtcaagaaggatact

SEQ ID NO: 7306249 - DNA, 22 bp, Homo sapiens
tttcaaagtcaatatcattacc

SEQ ID NO: 7306250 - DNA, 22 bp, Homo sapiens
tttcaaagtcaatatcattacc

SEQ ID NO: 7306251 - DNA, 22 bp, Homo sapiens
ctcctgtcccggggaccgccga

SEQ ID NO: 7306252 - DNA, 22 bp, Homo sapiens
ctcctgtgcacctccagcggca

SEQ ID NO: 7306253 - DNA, 22 bp, Homo sapiens
ctcctgtgggtcaccaataggc

SEQ ID NO: 7306254 - DNA, 22 bp, Homo sapiens
tttacacaaaagatagcacacc

SEQ ID NO: 7306255 - DNA, 22 bp, Homo sapiens
tttacacatacctctttaaagt

SEQ ID NO: 7306256 - DNA, 22 bp, Homo sapiens
tttacacagaggacactgggct

SEQ ID NO: 7306257 - DNA, 22 bp, Homo sapiens
tttacacataaatgtgtagaca

SEQ ID NO: 7306258 - DNA, 22 bp, Homo sapiens
tttacaattctctaccagtgtt

SEQ ID NO: 7306259 - DNA, 22 bp, Homo sapiens
tttacaatagggtctgaatgaa

SEQ ID NO: 7306260 - DNA, 22 bp, Homo sapiens
ctcctggaggatagtgactggg

SEQ ID NO: 7306261 - DNA, 22 bp, Homo sapiens
ctcctggagcagcaggcgcagg

SEQ ID NO: 7306262 - DNA, 22 bp, Homo sapiens
ctcctggatcttagccagattc

SEQ ID NO: 7306263 - DNA, 22 bp, Homo sapiens
tttatatggttgactatgagtt

SEQ ID NO: 7306264 - DNA, 22 bp, Homo sapiens
tttatatggttgactatgagtt

SEQ ID NO: 7306265 - DNA, 22 bp, Homo sapiens
tttatatgtgaaggtttgcaga

SEQ ID NO: 7306266 - DNA, 22 bp, Homo sapiens
ctctggaggccgttggccctta

SEQ ID NO: 7306267 - DNA, 22 bp, Homo sapiens
ctctggagggaggctgagctgg

SEQ ID NO: 7306268 - DNA, 22 bp, Homo sapiens
ctctggaggtcaggtgtggtgg

SEQ ID NO: 7306269 - DNA, 22 bp, Homo sapiens
tttgaagggcacgacaatagtt

SEQ ID NO: 7306270 - DNA, 22 bp, Homo sapiens
tttgaagggcacgacaatagtt

SEQ ID NO: 7306271 - DNA, 20 bp, Homo sapiens
ctctgctttaggagagtcag

SEQ ID NO: 7306272 - DNA, 22 bp, Homo sapiens
tttcttcttgatttaaacaggg

SEQ ID NO: 7306273 - DNA, 22 bp, Homo sapiens
tttcttatattctgtcattgtt

SEQ ID NO: 7306274 - DNA, 22 bp, Homo sapiens
ctctgcttcatccaccactggc

SEQ ID NO: 7306275 - DNA, 22 bp, Homo sapiens
ctctgcttctgagatggaagct

SEQ ID NO: 7306276 - DNA, 19 bp, Homo sapiens
ctctgcttggtccatatgc

SEQ ID NO: 7306277 - DNA, 22 bp, Homo sapiens
ctctgcttgtatcacatttgct

SEQ ID NO: 7306278 - DNA, 22 bp, Homo sapiens
ctctgcttggaactggacagaa

SEQ ID NO: 7306279 - DNA, 22 bp, Homo sapiens
ctctgcttggaactggacagaa

SEQ ID NO: 7306280 - DNA, 22 bp, Homo sapiens
ctctgcttggaacaggggtttg

SEQ ID NO: 7306281 - DNA, 22 bp, Homo sapiens
tttctgattctcactttggcat

SEQ ID NO: 7306282 - DNA, 22 bp, Homo sapiens
tttctgatttgacttgaagtat

SEQ ID NO: 7306283 - DNA, 22 bp, Homo sapiens
tttctgttgtacttaaactagg

SEQ ID NO: 7306284 - DNA, 22 bp, Homo sapiens
tttctctcagcctgtagaaact

SEQ ID NO: 7306285 - DNA, 22 bp, Homo sapiens
ctctctggaattaaagcccaat

SEQ ID NO: 7306286 - DNA, 22 bp, Homo sapiens
tttctctgctgtgttggcagct

SEQ ID NO: 7306287 - DNA, 22 bp, Homo sapiens
ctctagcagcagcccttcctta

SEQ ID NO: 7306288 - DNA, 22 bp, Homo sapiens
ctctattctaatggattctggg

SEQ ID NO: 7306289 - DNA, 22 bp, Homo sapiens
gaaacacatgcagctccataga

SEQ ID NO: 7306290 - DNA, 22 bp, Homo sapiens
gaaacacatgcagctccataga

SEQ ID NO: 7306291 - DNA, 22 bp, Homo sapiens
gaaacaatttttgttgtctaag

SEQ ID NO: 7306292 - DNA, 22 bp, Homo sapiens
gaaacagattaacagcatattt

SEQ ID NO: 7306293 - DNA, 22 bp, Homo sapiens
gaaagagaggggctgagatgca

SEQ ID NO: 7306294 - DNA, 22 bp, Homo sapiens
gaaaatttctgccacatgtgtg

SEQ ID NO: 7306295 - DNA, 22 bp, Homo sapiens
gaaacaatacttgtcctcacta

SEQ ID NO: 7306296 - DNA, 22 bp, Homo sapiens
gaaacaatcatcatgtgatttg

SEQ ID NO: 7306297 - DNA, 22 bp, Homo sapiens
gaaacaatacttgtcctcacta

SEQ ID NO: 7306298 - DNA, 22 bp, Homo sapiens
gaaaatttaattctcttctgtg

SEQ ID NO: 7306299 - DNA, 22 bp, Homo sapiens
gaaaatttaattctcttctgtg

SEQ ID NO: 7306300 - DNA, 22 bp, Homo sapiens
cttttgatagttgctgagcagg

SEQ ID NO: 7306301 - DNA, 22 bp, Homo sapiens
cttttgatggagttcaagaagc

SEQ ID NO: 7306302 - DNA, 22 bp, Homo sapiens
cttttgattgagcagtttcaaa

SEQ ID NO: 7306303 - DNA, 22 bp, Homo sapiens
cttttcttgtattggatgcccc

SEQ ID NO: 7306304 - DNA, 22 bp, Homo sapiens
cttttcttatgtggacgtacct

SEQ ID NO: 7306305 - DNA, 22 bp, Homo sapiens
cttttcttctcacggctgtcag

SEQ ID NO: 7306306 - DNA, 22 bp, Homo sapiens
cttttcttactcccgcaaggca

SEQ ID NO: 7306307 - DNA, 21 bp, Homo sapiens
cttttctctccgcaggacatt

SEQ ID NO: 7306308 - DNA, 22 bp, Homo sapiens
ctttgatttctctggtccaatc

SEQ ID NO: 7306309 - DNA, 22 bp, Homo sapiens
ctttgcaagggatttcatgtct

SEQ ID NO: 7306310 - DNA, 21 bp, Homo sapiens
cttttacattcagtcatgatg

SEQ ID NO: 7306311 - DNA, 22 bp, Homo sapiens
cttgtgcttttatgaatgcaga

SEQ ID NO: 7306312 - DNA, 22 bp, Homo sapiens
cttgtgcatctcttcatgacca

SEQ ID NO: 7306313 - DNA, 22 bp, Homo sapiens
cttgtgcatttcattcctcagg

SEQ ID NO: 7306314 - DNA, 22 bp, Homo sapiens
cttgtgcagcctcctcttgcag

SEQ ID NO: 7306315 - DNA, 19 bp, Homo sapiens
cttgtgcagttcacgctca

SEQ ID NO: 7306316 - DNA, 22 bp, Homo sapiens
cttgtgcataagaagacctgag

SEQ ID NO: 7306317 - DNA, 22 bp, Homo sapiens
cttgtgcatcatagtttgccaa

SEQ ID NO: 7306318 - DNA, 22 bp, Homo sapiens
cttgtgcaaatcctcgagcaca

SEQ ID NO: 7306319 - DNA, 22 bp, Homo sapiens
cttgtgcaagaaacctggaatg

SEQ ID NO: 7306320 - DNA, 22 bp, Homo sapiens
cttgtgcaattgacattgaatc

SEQ ID NO: 7306321 - DNA, 22 bp, Homo sapiens
cttctgggttgcaggtcttggc

SEQ ID NO: 7306322 - DNA, 22 bp, Homo sapiens
cttctgggcattcagctgcaca

SEQ ID NO: 7306323 - DNA, 22 bp, Homo sapiens
cttctgaatggctgtgtatgct

SEQ ID NO: 7306324 - DNA, 22 bp, Homo sapiens
cttctgctgctgttcatggttg

SEQ ID NO: 7306325 - DNA, 22 bp, Homo sapiens
cttctgctgctgttcatggttg

SEQ ID NO: 7306326 - DNA, 22 bp, Homo sapiens
cttctgaaacccccagtgtggg

SEQ ID NO: 7306327 - DNA, 22 bp, Homo sapiens
cttctgaaacccccagtgtggg

SEQ ID NO: 7306328 - DNA, 22 bp, Homo sapiens
cttctggaggacactggcccca

SEQ ID NO: 7306329 - DNA, 22 bp, Homo sapiens
cttctggaggctccagggaggt

SEQ ID NO: 7306330 - DNA, 22 bp, Homo sapiens
cttctggaaacttttccaattt

SEQ ID NO: 7306331 - DNA, 22 bp, Homo sapiens
cttctggatttattcattcctt

SEQ ID NO: 7306332 - DNA, 22 bp, Homo sapiens
cttctggcaaaacaggcagaaa

SEQ ID NO: 7306333 - DNA, 19 bp, Homo sapiens
cttctggatccgcagggcc

SEQ ID NO: 7306334 - DNA, 22 bp, Homo sapiens
ctttctcttcagcacccagccc

SEQ ID NO: 7306335 - DNA, 22 bp, Homo sapiens
ctttaattgtagctcccataat

SEQ ID NO: 7306336 - DNA, 22 bp, Homo sapiens
ctttacaaagcaattttgtctc

SEQ ID NO: 7306337 - DNA, 22 bp, Homo sapiens
ctttaacaaatgactcttgtct

SEQ ID NO: 7306338 - DNA, 22 bp, Homo sapiens
ctttaattctcaggtgcacata

SEQ ID NO: 7306339 - DNA, 22 bp, Homo sapiens
ctttgatataagtatacatagt

SEQ ID NO: 7306340 - DNA, 22 bp, Homo sapiens
ctttgacatccttgttcctcag

SEQ ID NO: 7306341 - DNA, 22 bp, Homo sapiens
ctttgaaacctgctctgcagaa

SEQ ID NO: 7306342 - DNA, 22 bp, Homo sapiens
ctttgaaagctcccaggactta

SEQ ID NO: 7306343 - DNA, 22 bp, Homo sapiens
ctttgaaagctcccaggactta

SEQ ID NO: 7306344 - DNA, 22 bp, Homo sapiens
ctttgaaaggaagccacacagc

SEQ ID NO: 7306345 - DNA, 22 bp, Homo sapiens
ctttgaaattcttcagctgaag

SEQ ID NO: 7306346 - DNA, 22 bp, Homo sapiens
ctttgaaaacttaaataacagc

SEQ ID NO: 7306347 - DNA, 22 bp, Homo sapiens
ctttctttgtccaccaacaatg

SEQ ID NO: 7306348 - DNA, 22 bp, Homo sapiens
ctgtttatactcaaaagataca

SEQ ID NO: 7306349 - DNA, 22 bp, Homo sapiens
ctgtttatcatgtacatttcca

SEQ ID NO: 7306350 - DNA, 21 bp, Homo sapiens
ctgtgctttttaagtgtgatg

SEQ ID NO: 7306351 - DNA, 22 bp, Homo sapiens
ctgtgctttcgagatgtgatct

SEQ ID NO: 7306352 - DNA, 22 bp, Homo sapiens
ctgtggaacttagtgggagaca

SEQ ID NO: 7306353 - DNA, 22 bp, Homo sapiens
ctgtgcttgtgttcattgttaa

SEQ ID NO: 7306354 - DNA, 22 bp, Homo sapiens
ctgtgcttgtgttcattgttaa

SEQ ID NO: 7306355 - DNA, 22 bp, Homo sapiens
ctgtgcttccaggatggcagct

SEQ ID NO: 7306356 - DNA, 22 bp, Homo sapiens
ctgtgcttccaggatggcagct

SEQ ID NO: 7306357 - DNA, 22 bp, Homo sapiens
cttaaaagttgcttccctaact

SEQ ID NO: 7306358 - DNA, 22 bp, Homo sapiens
cttaaaatctggcagttagcta

SEQ ID NO: 7306359 - DNA, 22 bp, Homo sapiens
cttaaaagagatgacggcaggg

SEQ ID NO: 7306360 - DNA, 22 bp, Homo sapiens
cttaaactgaaagctacaagat

SEQ ID NO: 7306361 - DNA, 22 bp, Homo sapiens
ctgtttgtgattagcagtgggt

SEQ ID NO: 7306362 - DNA, 22 bp, Homo sapiens
ctgtttgttggctattgacagt

SEQ ID NO: 7306363 - DNA, 22 bp, Homo sapiens
cttaaagagtatttaatataat

SEQ ID NO: 7306364 - DNA, 22 bp, Homo sapiens
cttaaatccatcatttctaatc

SEQ ID NO: 7306365 - DNA, 22 bp, Homo sapiens
cttaaagtctatcctttctaga

SEQ ID NO: 7306366 - DNA, 22 bp, Homo sapiens
cttaaattggatgagttaagtt

SEQ ID NO: 7306367 - DNA, 22 bp, Homo sapiens
cttaaattttcatctacaagaa

SEQ ID NO: 7306368 - DNA, 22 bp, Homo sapiens
cttaatttaaaatagttcaggc

SEQ ID NO: 7306369 - DNA, 22 bp, Homo sapiens
cttagaaattgttactcattca

SEQ ID NO: 7306370 - DNA, 22 bp, Homo sapiens
cttagaaataatggtttcagtt

SEQ ID NO: 7306371 - DNA, 22 bp, Homo sapiens
cttacaacttgtatgtgattgt

SEQ ID NO: 7306372 - DNA, 22 bp, Homo sapiens
cttacatactgagaaaatatcc

SEQ ID NO: 7306373 - DNA, 22 bp, Homo sapiens
cttacatactgagaaaatatcc

SEQ ID NO: 7306374 - DNA, 22 bp, Homo sapiens
cttacatatgcaagacaaaggg

SEQ ID NO: 7306375 - DNA, 22 bp, Homo sapiens
cttatacaccctcttcccaggc

SEQ ID NO: 7306376 - DNA, 22 bp, Homo sapiens
cttagtttttgccctggagttt

SEQ ID NO: 7306377 - DNA, 22 bp, Homo sapiens
cttagtttaggtaaacccagca

SEQ ID NO: 7306378 - DNA, 22 bp, Homo sapiens
cttcattaatgtctataagttt

SEQ ID NO: 7306379 - DNA, 22 bp, Homo sapiens
cttcagttagtttcatgtgagc

SEQ ID NO: 7306380 - DNA, 22 bp, Homo sapiens
cttcagtgttggttcattacga

SEQ ID NO: 7306381 - DNA, 22 bp, Homo sapiens
cttcatttggagaactgtgctt

SEQ ID NO: 7306382 - DNA, 22 bp, Homo sapiens
cttcatttccatccaactggga

SEQ ID NO: 7306383 - DNA, 22 bp, Homo sapiens
cttcatttggcaggctggcctc

SEQ ID NO: 7306384 - DNA, 22 bp, Homo sapiens
cttcatttggagaactgtgctt

SEQ ID NO: 7306385 - DNA, 22 bp, Homo sapiens
cttcatttcaggctgaagaata

SEQ ID NO: 7306386 - DNA, 22 bp, Homo sapiens
cttccaaatgtaaataagtttc

SEQ ID NO: 7306387 - DNA, 22 bp, Homo sapiens
cttccaagtggggcacgtgcca

SEQ ID NO: 7306388 - DNA, 22 bp, Homo sapiens
cttccaagttgctctgctgacc

SEQ ID NO: 7306389 - DNA, 22 bp, Homo sapiens
cttccaatagcaacaaagatta

SEQ ID NO: 7306390 - DNA, 22 bp, Homo sapiens
cttcctttggttggagcgccgt

SEQ ID NO: 7306391 - DNA, 22 bp, Homo sapiens
cttccagctgattggcatccag

SEQ ID NO: 7306392 - DNA, 22 bp, Homo sapiens
cttctattcactggtcacagtt

SEQ ID NO: 7306393 - DNA, 22 bp, Homo sapiens
ctgctgttaggttggtgcaaaa

SEQ ID NO: 7306394 - DNA, 22 bp, Homo sapiens
ctgctgttgccacctgcatgga

SEQ ID NO: 7306395 - DNA, 22 bp, Homo sapiens
ctgctgtttctcaaaattaagt

SEQ ID NO: 7306396 - DNA, 22 bp, Homo sapiens
ctgctgtttgccgtcattgcct

SEQ ID NO: 7306397 - DNA, 22 bp, Homo sapiens
ctgctgtttggtgagtgagaaa

SEQ ID NO: 7306398 - DNA, 22 bp, Homo sapiens
ctgcttaaaatgcagattctgt

SEQ ID NO: 7306399 - DNA, 22 bp, Homo sapiens
ctgcttaatttaatagttgcaa

SEQ ID NO: 7306400 - DNA, 22 bp, Homo sapiens
ctgcttcagcaaagctatttgc

SEQ ID NO: 7306401 - DNA, 22 bp, Homo sapiens
ctgcttcaccctgcctgagaac

SEQ ID NO: 7306402 - DNA, 22 bp, Homo sapiens
ctgggagattcaggtgaagttt

SEQ ID NO: 7306403 - DNA, 22 bp, Homo sapiens
ctgggactggacctctgcctgg

SEQ ID NO: 7306404 - DNA, 22 bp, Homo sapiens
ctgggacctcctgaggtggagc

SEQ ID NO: 7306405 - DNA, 22 bp, Homo sapiens
ctgggagcaagtcaggaaaggt

SEQ ID NO: 7306406 - DNA, 22 bp, Homo sapiens
ctgggagcccgcgtcctggtgg

SEQ ID NO: 7306407 - DNA, 22 bp, Homo sapiens
ctgggagcaagaggctgcaaat

SEQ ID NO: 7306408 - DNA, 22 bp, Homo sapiens
ctgggagcaagaggctgcaaat

SEQ ID NO: 7306409 - DNA, 17 bp, Homo sapiens
ctgggatgtggactctt

SEQ ID NO: 7306410 - DNA, 22 bp, Homo sapiens
ctgggagcggctgtcactggtt

SEQ ID NO: 7306411 - DNA, 22 bp, Homo sapiens
ctggtctggctagtttaggcca

SEQ ID NO: 7306412 - DNA, 22 bp, Homo sapiens
ctggtctgggatgagggatgta

SEQ ID NO: 7306413 - DNA, 22 bp, Homo sapiens
ctggtctgctagaaagatgcat

SEQ ID NO: 7306414 - DNA, 22 bp, Homo sapiens
ctggtcacgtgccatatttcct

SEQ ID NO: 7306415 - DNA, 22 bp, Homo sapiens
ctggtcactcctccacctgctt

SEQ ID NO: 7306416 - DNA, 22 bp, Homo sapiens
ctggtctgaaaaggaggcatgc

SEQ ID NO: 7306417 - DNA, 22 bp, Homo sapiens
ctggtcagagcaactgctcaca

SEQ ID NO: 7306418 - DNA, 22 bp, Homo sapiens
ctggtcactgagttggcaaagt

SEQ ID NO: 7306419 - DNA, 22 bp, Homo sapiens
ctggtcactggtctcatccagc

SEQ ID NO: 7306420 - DNA, 22 bp, Homo sapiens
ctggggaacaatttgccacact

SEQ ID NO: 7306421 - DNA, 22 bp, Homo sapiens
ctggggaatagagctggagacc

SEQ ID NO: 7306422 - DNA, 22 bp, Homo sapiens
ctggggaccagtgtctgtttgt

SEQ ID NO: 7306423 - DNA, 20 bp, Homo sapiens
ctggggacagcaatggctgt

SEQ ID NO: 7306424 - DNA, 22 bp, Homo sapiens
ctggggactcattcagagcata

SEQ ID NO: 7306425 - DNA, 22 bp, Homo sapiens
ctggggacgtcgggcagtgttc

SEQ ID NO: 7306426 - DNA, 22 bp, Homo sapiens
ctggggaccgagcaagctctgg

SEQ ID NO: 7306427 - DNA, 22 bp, Homo sapiens
ctggggagaagcgactcggctg

SEQ ID NO: 7306428 - DNA, 22 bp, Homo sapiens
ctggggactgaaggatgttgct

SEQ ID NO: 7306429 - DNA, 22 bp, Homo sapiens
ctggggactttggttctccatg

SEQ ID NO: 7306430 - DNA, 22 bp, Homo sapiens
ctggggacttgcagacacaatt

SEQ ID NO: 7306431 - DNA, 22 bp, Homo sapiens
ctgtaaaatgaacctagtcatc

SEQ ID NO: 7306432 - DNA, 22 bp, Homo sapiens
ctgtacagaagctagagcaaat

SEQ ID NO: 7306433 - DNA, 22 bp, Homo sapiens
ctgtacagaagctagagcaaat

SEQ ID NO: 7306434 - DNA, 22 bp, Homo sapiens
ctgtacagacctattagcccag

SEQ ID NO: 7306435 - DNA, 22 bp, Homo sapiens
ctgtacaggtcaatgataagat

SEQ ID NO: 7306436 - DNA, 22 bp, Homo sapiens
ctgtacaggagacgtctgtgca

SEQ ID NO: 7306437 - DNA, 22 bp, Homo sapiens
ctgtacagagttctgagtgtac

SEQ ID NO: 7306438 - DNA, 22 bp, Homo sapiens
ctgtcacactaaaacaagaagt

SEQ ID NO: 7306439 - DNA, 22 bp, Homo sapiens
ctgtcaacattggtgtctgtca

SEQ ID NO: 7306440 - DNA, 22 bp, Homo sapiens
ctgtcacccacccagcctgtca

SEQ ID NO: 7306441 - DNA, 18 bp, Homo sapiens
ctgtcaccgccaccacac

SEQ ID NO: 7306442 - DNA, 22 bp, Homo sapiens
ctgtcaccatttgagccctgga

SEQ ID NO: 7306443 - DNA, 22 bp, Homo sapiens
ctgtcaaattcataacacttat

SEQ ID NO: 7306444 - DNA, 22 bp, Homo sapiens
ctgtcaacacgggtgtgcgtgc

SEQ ID NO: 7306445 - DNA, 22 bp, Homo sapiens
ctgtattttcatgcctacgtac

SEQ ID NO: 7306446 - DNA, 22 bp, Homo sapiens
ctgtatatggcttactttatat

SEQ ID NO: 7306447 - DNA, 22 bp, Homo sapiens
ctgtatataatgtatgcatggg

SEQ ID NO: 7306448 - DNA, 22 bp, Homo sapiens
ctgtatttgtcctctatttatt

SEQ ID NO: 7306449 - DNA, 19 bp, Homo sapiens
ctgtccttggctgcactgt

SEQ ID NO: 7306450 - DNA, 22 bp, Homo sapiens
ctgtcaggtttcccatctgcaa

SEQ ID NO: 7306451 - DNA, 22 bp, Homo sapiens
ctgtccttgctggccaggtatg

SEQ ID NO: 7306452 - DNA, 22 bp, Homo sapiens
ctgtccttgctggccaggtatg

SEQ ID NO: 7306453 - DNA, 22 bp, Homo sapiens
ctgtcacctgttcactgcagca

SEQ ID NO: 7306454 - DNA, 22 bp, Homo sapiens
ctgtcacctctgccctttgccc

SEQ ID NO: 7306455 - DNA, 22 bp, Homo sapiens
ctgtcacctctgtggacccact

SEQ ID NO: 7306456 - DNA, 22 bp, Homo sapiens
ctgtcacctgccagcataccca

SEQ ID NO: 7306457 - DNA, 21 bp, Homo sapiens
ctgtcacctgctcagagaggg

SEQ ID NO: 7306458 - DNA, 22 bp, Homo sapiens
ctgtcacttaaattcaggctga

SEQ ID NO: 7306459 - DNA, 22 bp, Homo sapiens
ctgtcaggggcgggtggagcgg

SEQ ID NO: 7306460 - DNA, 22 bp, Homo sapiens
ctgtcagaggctctctgttgcc

SEQ ID NO: 7306461 - DNA, 19 bp, Homo sapiens
ctgtcaggggctggatgtt

SEQ ID NO: 7306462 - DNA, 22 bp, Homo sapiens
ctgtgccctgtggctggcacct

SEQ ID NO: 7306463 - DNA, 22 bp, Homo sapiens
ctgtgccctttcgctgcactgt

SEQ ID NO: 7306464 - DNA, 22 bp, Homo sapiens
ctgtctgtggagcttctgatgt

SEQ ID NO: 7306465 - DNA, 22 bp, Homo sapiens
ctgtctgtggagcttctgatgt

SEQ ID NO: 7306466 - DNA, 22 bp, Homo sapiens
ctgtgctggcagacctggagtt

SEQ ID NO: 7306467 - DNA, 22 bp, Homo sapiens
ctgtgcttagccatcacattca

SEQ ID NO: 7306468 - DNA, 22 bp, Homo sapiens
ctgtgcttagccatcacattca

SEQ ID NO: 7306469 - DNA, 22 bp, Homo sapiens
ctgtctggatataccttggcca

SEQ ID NO: 7306470 - DNA, 22 bp, Homo sapiens
ctgtctgtacaaatgtggggcc

SEQ ID NO: 7306471 - DNA, 22 bp, Homo sapiens
ctgtctgtacaaatgtggggcc

SEQ ID NO: 7306472 - DNA, 22 bp, Homo sapiens
ctgtctggtgtccctgtctaca

SEQ ID NO: 7306473 - DNA, 22 bp, Homo sapiens
ctgtctgtcaagttcatctcca

SEQ ID NO: 7306474 - DNA, 22 bp, Homo sapiens
ctgtctgtcaagttcatctcca

SEQ ID NO: 7306475 - DNA, 22 bp, Homo sapiens
ctgtctgtatccctgttggtaa

SEQ ID NO: 7306476 - DNA, 22 bp, Homo sapiens
ctgtctgtagacatttttggtt

SEQ ID NO: 7306477 - DNA, 22 bp, Homo sapiens
ctgtctgtatccctgttggtaa

SEQ ID NO: 7306478 - DNA, 22 bp, Homo sapiens
ctgtctgtagacatttttggtt

SEQ ID NO: 7306479 - DNA, 22 bp, Homo sapiens
ctgtctgtactgagagttctgt

SEQ ID NO: 7306480 - DNA, 22 bp, Homo sapiens
ctgtctgtactgagagttctgt

SEQ ID NO: 7306481 - DNA, 22 bp, Homo sapiens
ctgtctgtgcctcttctcccag

SEQ ID NO: 7306482 - DNA, 19 bp, Homo sapiens
ctgtctgtgcagagatgtg

SEQ ID NO: 7306483 - DNA, 22 bp, Homo sapiens
ctgtctgtgacctctgcatgtc

SEQ ID NO: 7306484 - DNA, 22 bp, Homo sapiens
ctgtctgtgacctctgcatgtc

SEQ ID NO: 7306485 - DNA, 22 bp, Homo sapiens
ctgtctgtcctgagttcaacca

SEQ ID NO: 7306486 - DNA, 22 bp, Homo sapiens
ctgtctgtcccgtcaccgcccc

SEQ ID NO: 7306487 - DNA, 22 bp, Homo sapiens
ctgtctgtcaccaaaacagact

SEQ ID NO: 7306488 - DNA, 20 bp, Homo sapiens
gacattgtaattaatgatga

SEQ ID NO: 7306489 - DNA, 22 bp, Homo sapiens
gacatttaaattgcaggcagcc

SEQ ID NO: 7306490 - DNA, 22 bp, Homo sapiens
gacattgtggttattaaatgtt

SEQ ID NO: 7306491 - DNA, 22 bp, Homo sapiens
gacatttagaagtctaatggcc

SEQ ID NO: 7306492 - DNA, 22 bp, Homo sapiens
gacatttactgaatactgatta

SEQ ID NO: 7306493 - DNA, 22 bp, Homo sapiens
gacatttaatagtattgtggga

SEQ ID NO: 7306494 - DNA, 22 bp, Homo sapiens
gacatttaaggcagtcacttaa

SEQ ID NO: 7306495 - DNA, 22 bp, Homo sapiens
gacattcacaggtaaacattcc

SEQ ID NO: 7306496 - DNA, 22 bp, Homo sapiens
gacattcagactcacatggagg

SEQ ID NO: 7306497 - DNA, 22 bp, Homo sapiens
gactcggcacttgtcttggagt

SEQ ID NO: 7306498 - DNA, 22 bp, Homo sapiens
gactctggtgtcagaagtgccc

SEQ ID NO: 7306499 - DNA, 21 bp, Homo sapiens
gactctggggtcagctcaacc

SEQ ID NO: 7306500 - DNA, 22 bp, Homo sapiens
gactgaaagcttggaatgttcc

SEQ ID NO: 7306501 - DNA, 22 bp, Homo sapiens
gacatttagaagttagattcaa

SEQ ID NO: 7306502 - DNA, 22 bp, Homo sapiens
gacatttaggtagcttccagtt

SEQ ID NO: 7306503 - DNA, 22 bp, Homo sapiens
gacatttagctgttttgcattt

SEQ ID NO: 7306504 - DNA, 22 bp, Homo sapiens
gaccagaatctggactctgatt

SEQ ID NO: 7306505 - DNA, 22 bp, Homo sapiens
gaccagaaatgattctccagct

SEQ ID NO: 7306506 - DNA, 22 bp, Homo sapiens
gagaaacaacacttgatgcctt

SEQ ID NO: 7306507 - DNA, 22 bp, Homo sapiens
gactgcagtgaaggcacatggg

SEQ ID NO: 7306508 - DNA, 22 bp, Homo sapiens
gagaaacactgttagtttatta

SEQ ID NO: 7306509 - DNA, 22 bp, Homo sapiens
gagaccaggaagtacagcagcc

SEQ ID NO: 7306510 - DNA, 23 bp, Homo sapiens
gagaccagggccagctgtgtcat

SEQ ID NO: 7306511 - DNA, 22 bp, Homo sapiens
gagaaaggcattcctatgcaaa

SEQ ID NO: 7306512 - DNA, 22 bp, Homo sapiens
gagaaaggcattcctatgcaaa

SEQ ID NO: 7306513 - DNA, 22 bp, Homo sapiens
gagaaaggcattcctatgcaaa

SEQ ID NO: 7306514 - DNA, 22 bp, Homo sapiens
gagaaaggcatccttggcttca

SEQ ID NO: 7306515 - DNA, 18 bp, Homo sapiens
gagagggatccctcagga

SEQ ID NO: 7306516 - DNA, 22 bp, Homo sapiens
gagagaaatgtgcagtttgggc

SEQ ID NO: 7306517 - DNA, 22 bp, Homo sapiens
gagaccctcttcctccctacag

SEQ ID NO: 7306518 - DNA, 22 bp, Homo sapiens
gagacctgcagctgtagtctgc

SEQ ID NO: 7306519 - DNA, 22 bp, Homo sapiens
gagacctgagtcaccctgtctg

SEQ ID NO: 7306520 - DNA, 22 bp, Homo sapiens
gagagaaaaatgagcttcattg

SEQ ID NO: 7306521 - DNA, 22 bp, Homo sapiens
gagagaaaacaagttctccatt

SEQ ID NO: 7306522 - DNA, 22 bp, Homo sapiens
gagagaaaagggggaattgatt

SEQ ID NO: 7306523 - DNA, 22 bp, Homo sapiens
gagagaaaggataacagctcaa

SEQ ID NO: 7306524 - DNA, 22 bp, Homo sapiens
gagagaaaggataacagctcaa

SEQ ID NO: 7306525 - DNA, 22 bp, Homo sapiens
gacagacaggaggccacctgct

SEQ ID NO: 7306526 - DNA, 22 bp, Homo sapiens
gacagacaaatgtttttaactt

SEQ ID NO: 7306527 - DNA, 22 bp, Homo sapiens
gaatgaaagatttgcattctat

SEQ ID NO: 7306528 - DNA, 22 bp, Homo sapiens
gaatgaaaaccttggctcaaat

SEQ ID NO: 7306529 - DNA, 22 bp, Homo sapiens
gaatatttgtaattactgttga

SEQ ID NO: 7306530 - DNA, 22 bp, Homo sapiens
gaatctcaggggagttactgga

SEQ ID NO: 7306531 - DNA, 22 bp, Homo sapiens
gaagggctttctgggagaagag

SEQ ID NO: 7306532 - DNA, 22 bp, Homo sapiens
gaagggcttggctgggaggcca

SEQ ID NO: 7306533 - DNA, 18 bp, Homo sapiens
gaagggagctggaatgca

SEQ ID NO: 7306534 - DNA, 22 bp, Homo sapiens
gaagggtgtgtgtgagggacac

SEQ ID NO: 7306535 - DNA, 22 bp, Homo sapiens
gaagggtgtgatttgcctgaga

SEQ ID NO: 7306536 - DNA, 22 bp, Homo sapiens
gaaggagctaaagggagccctg

SEQ ID NO: 7306537 - DNA, 22 bp, Homo sapiens
gaagccactatagatattctaa

SEQ ID NO: 7306538 - DNA, 22 bp, Homo sapiens
gaagccaccctccttccagccc

SEQ ID NO: 7306539 - DNA, 22 bp, Homo sapiens
gaagccacagggaaggagaaca

SEQ ID NO: 7306540 - DNA, 22 bp, Homo sapiens
gaaggcagggaatgtggtgcta

SEQ ID NO: 7306541 - DNA, 22 bp, Homo sapiens
gaaggcaaggagggaagccacc

SEQ ID NO: 7306542 - DNA, 22 bp, Homo sapiens
gaaggcaccctccatcactcac

SEQ ID NO: 7306543 - DNA, 22 bp, Homo sapiens
gaaggcaggtttttcaaaactg

SEQ ID NO: 7306544 - DNA, 18 bp, Homo sapiens
gaagggagctggaatgca

SEQ ID NO: 7306545 - DNA, 22 bp, Homo sapiens
gaagggagaaggttgggtgacg

SEQ ID NO: 7306546 - DNA, 22 bp, Homo sapiens
gaagggagaaggttgggtgacg

SEQ ID NO: 7306547 - DNA, 22 bp, Homo sapiens
gaagggaatttggagggtttca

SEQ ID NO: 7306548 - DNA, 22 bp, Homo sapiens
gaaaggaagaaaggtcatttta

SEQ ID NO: 7306549 - DNA, 18 bp, Homo sapiens
gaaaggagagacagtagg

SEQ ID NO: 7306550 - DNA, 22 bp, Homo sapiens
gaaaggaacttgtgagtgggag

SEQ ID NO: 7306551 - DNA, 22 bp, Homo sapiens
gaaaggaaattgagggacgcat

SEQ ID NO: 7306552 - DNA, 22 bp, Homo sapiens
gaaaggaaatattctaagcact

SEQ ID NO: 7306553 - DNA, 22 bp, Homo sapiens
gaaaggagagggttaaggagct

SEQ ID NO: 7306554 - DNA, 22 bp, Homo sapiens
gaaaggagagggttaaggagct

SEQ ID NO: 7306555 - DNA, 18 bp, Homo sapiens
gaaaggagagacagtagg

SEQ ID NO: 7306556 - DNA, 22 bp, Homo sapiens
gaaaggagtcagtcttactgaa

SEQ ID NO: 7306557 - DNA, 22 bp, Homo sapiens
gaaaggagtgaatatttgtgac

SEQ ID NO: 7306558 - DNA, 22 bp, Homo sapiens
gaaaggagtgctttccaggtct

SEQ ID NO: 7306559 - DNA, 20 bp, Homo sapiens
gaaaggagtgtccctgtgag

SEQ ID NO: 7306560 - DNA, 22 bp, Homo sapiens
gaaaggagggctcacaaaagtg

SEQ ID NO: 7306561 - DNA, 22 bp, Homo sapiens
gaaaggagggaaacagagcggt

SEQ ID NO: 7306562 - DNA, 22 bp, Homo sapiens
gaaaggatttggtgccaagcgt

SEQ ID NO: 7306563 - DNA, 22 bp, Homo sapiens
gaagcaaagagctagtgccgct

SEQ ID NO: 7306564 - DNA, 22 bp, Homo sapiens
gaagcagggagcagtctttgca

SEQ ID NO: 7306565 - DNA, 22 bp, Homo sapiens
gagcagtgatgggaggacgtca

SEQ ID NO: 7306566 - DNA, 20 bp, Homo sapiens
gagcagtgagccagggaaag

SEQ ID NO: 7306567 - DNA, 22 bp, Homo sapiens
gagaggggcgcgcagctcgcga

SEQ ID NO: 7306568 - DNA, 22 bp, Homo sapiens
gagcatggcagctgagggcagg

SEQ ID NO: 7306569 - DNA, 22 bp, Homo sapiens
gagcagtggttgaacagaggca

SEQ ID NO: 7306570 - DNA, 22 bp, Homo sapiens
gagcagtgggaaggaacagggt

SEQ ID NO: 7306571 - DNA, 22 bp, Homo sapiens
gagcagtggtcacagggaggga

SEQ ID NO: 7306572 - DNA, 22 bp, Homo sapiens
gagcagttatttttagacatga

SEQ ID NO: 7306573 - DNA, 22 bp, Homo sapiens
gagcagttctccttggtagggg

SEQ ID NO: 7306574 - DNA, 22 bp, Homo sapiens
gagcagttgggctctaggaagt

SEQ ID NO: 7306575 - DNA, 22 bp, Homo sapiens
gagcagttttatttcatgagac

SEQ ID NO: 7306576 - DNA, 22 bp, Homo sapiens
gagcccagtctgctcctgcgcc

SEQ ID NO: 7306577 - DNA, 22 bp, Homo sapiens
gagcccagcccagagccatatg

SEQ ID NO: 7306578 - DNA, 22 bp, Homo sapiens
gagcccagcttgcacatggagc

SEQ ID NO: 7306579 - DNA, 22 bp, Homo sapiens
gagcccaggaagtggaggctga

SEQ ID NO: 7306580 - DNA, 22 bp, Homo sapiens
gagcccaggaagtggaggctga

SEQ ID NO: 7306581 - DNA, 22 bp, Homo sapiens
gagccctgtaggaatctctcaa

SEQ ID NO: 7306582 - DNA, 22 bp, Homo sapiens
gagccctgtagcaagtcatgtc

SEQ ID NO: 7306583 - DNA, 22 bp, Homo sapiens
gagctgcctgtgtgccatgatg

SEQ ID NO: 7306584 - DNA, 22 bp, Homo sapiens
gaggaaagagtcaaatctgaag

SEQ ID NO: 7306585 - DNA, 22 bp, Homo sapiens
gaggaaaatggagtgtaattaa

SEQ ID NO: 7306586 - DNA, 22 bp, Homo sapiens
gaggaaaatgggacaggctgta

SEQ ID NO: 7306587 - DNA, 22 bp, Homo sapiens
gaggaaaatgggacaggctgta

SEQ ID NO: 7306588 - DNA, 19 bp, Homo sapiens
gagctgccttttgaagacc

SEQ ID NO: 7306589 - DNA, 22 bp, Homo sapiens
gaggaagaaagcataggtgggg

SEQ ID NO: 7306590 - DNA, 22 bp, Homo sapiens
gaggaagaagcaaaccagctaa

SEQ ID NO: 7306591 - DNA, 22 bp, Homo sapiens
gaggaagaagcaaaccagctaa

SEQ ID NO: 7306592 - DNA, 22 bp, Homo sapiens
gaggaagaagcaaaccagctaa

SEQ ID NO: 7306593 - DNA, 22 bp, Homo sapiens
gaggaagaagggattagaactc

SEQ ID NO: 7306594 - DNA, 22 bp, Homo sapiens
gaggaagaagggattagaactc

SEQ ID NO: 7306595 - DNA, 22 bp, Homo sapiens
gaggaagaatcagggtggtgag

SEQ ID NO: 7306596 - DNA, 22 bp, Homo sapiens
gaggagagatggtagattgggt

SEQ ID NO: 7306597 - DNA, 22 bp, Homo sapiens
gaggaagaattggttattggag

SEQ ID NO: 7306598 - DNA, 22 bp, Homo sapiens
gaggaagaattggttattggag

SEQ ID NO: 7306599 - DNA, 22 bp, Homo sapiens
gaggaagaattggttattggag

SEQ ID NO: 7306600 - DNA, 22 bp, Homo sapiens
gaggaagaatcagggtggtgag

SEQ ID NO: 7306601 - DNA, 22 bp, Homo sapiens
gaggaagaaagcataggtgggg

SEQ ID NO: 7306602 - DNA, 22 bp, Homo sapiens
gaggaagaaagcataggtgggg

SEQ ID NO: 7306603 - DNA, 22 bp, Homo sapiens
gagggctgatgttgccacctca

SEQ ID NO: 7306604 - DNA, 22 bp, Homo sapiens
gaggggctgccctggtgtcagg

SEQ ID NO: 7306605 - DNA, 22 bp, Homo sapiens
gaggggctggcacgatggctgc

SEQ ID NO: 7306606 - DNA, 22 bp, Homo sapiens
gaggggctggctgtggtcccat

SEQ ID NO: 7306607 - DNA, 22 bp, Homo sapiens
gaggggctgggcagtccctgga

SEQ ID NO: 7306608 - DNA, 22 bp, Homo sapiens
gagggagcttgatggatgtttg

SEQ ID NO: 7306609 - DNA, 22 bp, Homo sapiens
gagggagctatgaatagaagaa

SEQ ID NO: 7306610 - DNA, 22 bp, Homo sapiens
gagggagccgccacagactggg

SEQ ID NO: 7306611 - DNA, 22 bp, Homo sapiens
gaggcataagtagaagagattg

SEQ ID NO: 7306612 - DNA, 22 bp, Homo sapiens
gcccagagtgagtcctgggccc

SEQ ID NO: 7306613 - DNA, 22 bp, Homo sapiens
gcccagaagttgaggctgcagt

SEQ ID NO: 7306614 - DNA, 22 bp, Homo sapiens
gcccagaagtgactcagcactg

SEQ ID NO: 7306615 - DNA, 21 bp, Homo sapiens
gcccagaagactggctctgcc

SEQ ID NO: 7306616 - DNA, 22 bp, Homo sapiens
gcccagaaatgaacttgctgtg

SEQ ID NO: 7306617 - DNA, 22 bp, Homo sapiens
gcccagaaagactgcctaacag

SEQ ID NO: 7306618 - DNA, 22 bp, Homo sapiens
gcccacaggtcctacctctttc

SEQ ID NO: 7306619 - DNA, 22 bp, Homo sapiens
gcccactctggagcctgttccc

SEQ ID NO: 7306620 - DNA, 22 bp, Homo sapiens
gcccacagtacgaggctcaggc

SEQ ID NO: 7306621 - DNA, 22 bp, Homo sapiens
gccaggtgtagtggccacacct

SEQ ID NO: 7306622 - DNA, 22 bp, Homo sapiens
gccaggtgtcctcacagtgagg

SEQ ID NO: 7306623 - DNA, 22 bp, Homo sapiens
gccaggtgggagacagacagca

SEQ ID NO: 7306624 - DNA, 22 bp, Homo sapiens
gccaggtggctgagtgactgag

SEQ ID NO: 7306625 - DNA, 22 bp, Homo sapiens
gccaggagagctccttcaggtt

SEQ ID NO: 7306626 - DNA, 22 bp, Homo sapiens
gccaggactagagggaggtgag

SEQ ID NO: 7306627 - DNA, 22 bp, Homo sapiens
gccaggactcttcctagaaggt

SEQ ID NO: 7306628 - DNA, 22 bp, Homo sapiens
gccaggacctcccagagctttc

SEQ ID NO: 7306629 - DNA, 22 bp, Homo sapiens
gccaggacctcagatgcagggc

SEQ ID NO: 7306630 - DNA, 22 bp, Homo sapiens
gccaggactgagaatgggagca

SEQ ID NO: 7306631 - DNA, 22 bp, Homo sapiens
gccctgagaagaagtcggaggg

SEQ ID NO: 7306632 - DNA, 22 bp, Homo sapiens
gccctgagcactgctgctgggg

SEQ ID NO: 7306633 - DNA, 22 bp, Homo sapiens
gcctaacttggctttgttcacc

SEQ ID NO: 7306634 - DNA, 22 bp, Homo sapiens
gcatttctgtgcatacacatga

SEQ ID NO: 7306635 - DNA, 22 bp, Homo sapiens
gcatttcatgtagattgagaac

SEQ ID NO: 7306636 - DNA, 19 bp, Homo sapiens
gcatttcatttaaccatca

SEQ ID NO: 7306637 - DNA, 22 bp, Homo sapiens
gcatctgttggagtctccggcc

SEQ ID NO: 7306638 - DNA, 22 bp, Homo sapiens
gcatccttttttcctgccctgc

SEQ ID NO: 7306639 - DNA, 22 bp, Homo sapiens
gcatccttgggcccagctcctg

SEQ ID NO: 7306640 - DNA, 20 bp, Homo sapiens
gcatctccagggctgtctcc

SEQ ID NO: 7306641 - DNA, 22 bp, Homo sapiens
gcatccaaatgtttcatttctt

SEQ ID NO: 7306642 - DNA, 18 bp, Homo sapiens
gcataatgtgtatattga

SEQ ID NO: 7306643 - DNA, 22 bp, Homo sapiens
gcagtcagtaaggcagccagaa

SEQ ID NO: 7306644 - DNA, 18 bp, Homo sapiens
gcagtctctctggtcttc

SEQ ID NO: 7306645 - DNA, 22 bp, Homo sapiens
gcagtcctctcattggcctcct

SEQ ID NO: 7306646 - DNA, 22 bp, Homo sapiens
gcatttttgatcccactaggat

SEQ ID NO: 7306647 - DNA, 22 bp, Homo sapiens
gcattttaataagattcatagg

SEQ ID NO: 7306648 - DNA, 23 bp, Homo sapiens
gccaagtagggggaaagcccgtg

SEQ ID NO: 7306649 - DNA, 22 bp, Homo sapiens
gccagagagagtccctgggcct

SEQ ID NO: 7306650 - DNA, 22 bp, Homo sapiens
gccaagggtagtggaggcccct

SEQ ID NO: 7306651 - DNA, 22 bp, Homo sapiens
gccaaggggttcaaaatgtata

SEQ ID NO: 7306652 - DNA, 21 bp, Homo sapiens
gccaagggggtagctattcct

SEQ ID NO: 7306653 - DNA, 22 bp, Homo sapiens
gccaagggggcagtgcatgggt

SEQ ID NO: 7306654 - DNA, 19 bp, Homo sapiens
gccaagggacttgcttctt

SEQ ID NO: 7306655 - DNA, 22 bp, Homo sapiens
gccaagggaactgagccggagg

SEQ ID NO: 7306656 - DNA, 22 bp, Homo sapiens
gccagcagtatgtcctggcagt

SEQ ID NO: 7306657 - DNA, 22 bp, Homo sapiens
gccagcaggttgtcaaggagct

SEQ ID NO: 7306658 - DNA, 22 bp, Homo sapiens
gccagcaggtggagagatcaag

SEQ ID NO: 7306659 - DNA, 22 bp, Homo sapiens
gccagcagtcctgctgtgtgcc

SEQ ID NO: 7306660 - DNA, 22 bp, Homo sapiens
gccagccccagacatcctatcg

SEQ ID NO: 7306661 - DNA, 22 bp, Homo sapiens
gccagcccctccatcctgttca

SEQ ID NO: 7306662 - DNA, 22 bp, Homo sapiens
gccagccccttagggctctccc

SEQ ID NO: 7306663 - DNA, 22 bp, Homo sapiens
gccagcccattaacccctgtcc

SEQ ID NO: 7306664 - DNA, 22 bp, Homo sapiens
gcagcatggagttgtggaatga

SEQ ID NO: 7306665 - DNA, 22 bp, Homo sapiens
gcagcatgttgaaagggccaca

SEQ ID NO: 7306666 - DNA, 22 bp, Homo sapiens
gcagcatgttgaaagggccaca

SEQ ID NO: 7306667 - DNA, 22 bp, Homo sapiens
gcagctgcaataggcatcaagc

SEQ ID NO: 7306668 - DNA, 22 bp, Homo sapiens
gcagctgcagaccctcagtgct

SEQ ID NO: 7306669 - DNA, 22 bp, Homo sapiens
gcagctgcaagcacttctggca

SEQ ID NO: 7306670 - DNA, 22 bp, Homo sapiens
gcagctgcaggtggtcccatgc

SEQ ID NO: 7306671 - DNA, 22 bp, Homo sapiens
gcagctgccagtccccttccag

SEQ ID NO: 7306672 - DNA, 22 bp, Homo sapiens
gcagcagctctgaatgggcccc

SEQ ID NO: 7306673 - DNA, 22 bp, Homo sapiens
gcaggagctttgcttactgctg

SEQ ID NO: 7306674 - DNA, 22 bp, Homo sapiens
gcaggagctttgcttactgctg

SEQ ID NO: 7306675 - DNA, 22 bp, Homo sapiens
gcagctgcctattcagggcttg

SEQ ID NO: 7306676 - DNA, 22 bp, Homo sapiens
gcactgagcattgttatttcca

SEQ ID NO: 7306677 - DNA, 22 bp, Homo sapiens
gcactgagtctgtcatgctgca

SEQ ID NO: 7306678 - DNA, 22 bp, Homo sapiens
gcactgagagctttattctaga

SEQ ID NO: 7306679 - DNA, 22 bp, Homo sapiens
gcacttaactggaaaagaattt

SEQ ID NO: 7306680 - DNA, 22 bp, Homo sapiens
gaggggcttgaggccctgatgg

SEQ ID NO: 7306681 - DNA, 22 bp, Homo sapiens
gaggggctgtggagctctctgg

SEQ ID NO: 7306682 - DNA, 22 bp, Homo sapiens
gaggggctggggttgactccaa

SEQ ID NO: 7306683 - DNA, 22 bp, Homo sapiens
gaggggctgggtagggcaaccc

SEQ ID NO: 7306684 - DNA, 22 bp, Homo sapiens
gaggggtgggctggaagttata

SEQ ID NO: 7306685 - DNA, 22 bp, Homo sapiens
gaggggtgtggagccatcagtt

SEQ ID NO: 7306686 - DNA, 22 bp, Homo sapiens
gagggtcagaagggcctggttc

SEQ ID NO: 7306687 - DNA, 22 bp, Homo sapiens
gaggggtgtggagccatcagtt

SEQ ID NO: 7306688 - DNA, 22 bp, Homo sapiens
gagggtccctgctcagggccag

SEQ ID NO: 7306689 - DNA, 22 bp, Homo sapiens
gcaaatcctcctgcctgaagaa

SEQ ID NO: 7306690 - DNA, 22 bp, Homo sapiens
gcacaggaatcttcatttttta

SEQ ID NO: 7306691 - DNA, 22 bp, Homo sapiens
gcacagcatgaagagaggaagc

SEQ ID NO: 7306692 - DNA, 22 bp, Homo sapiens
ggacccagctctgagaccctgc

SEQ ID NO: 7306693 - DNA, 18 bp, Homo sapiens
ggacccagggcctcaccc

SEQ ID NO: 7306694 - DNA, 22 bp, Homo sapiens
ggaccctgcagccacccgacat

SEQ ID NO: 7306695 - DNA, 22 bp, Homo sapiens
ggaccccagagataccagtttt

SEQ ID NO: 7306696 - DNA, 22 bp, Homo sapiens
ggacccagaggggagtctggca

SEQ ID NO: 7306697 - DNA, 22 bp, Homo sapiens
ggaccctgggcttgctcctggg

SEQ ID NO: 7306698 - DNA, 22 bp, Homo sapiens
ggaccctgggcagctggctgct

SEQ ID NO: 7306699 - DNA, 22 bp, Homo sapiens
ggaccctggagacccactggga

SEQ ID NO: 7306700 - DNA, 23 bp, Homo sapiens
ggaccctgtggagggtgagagtc

SEQ ID NO: 7306701 - DNA, 22 bp, Homo sapiens
ggacagaaaccatatgagtgta

SEQ ID NO: 7306702 - DNA, 22 bp, Homo sapiens
ggactctggtatttcactcttg

SEQ ID NO: 7306703 - DNA, 22 bp, Homo sapiens
ggactcaggctggtgttcggac

SEQ ID NO: 7306704 - DNA, 22 bp, Homo sapiens
ggactctgttttcctgatcact

SEQ ID NO: 7306705 - DNA, 22 bp, Homo sapiens
ggagaggagctattgggggctc

SEQ ID NO: 7306706 - DNA, 22 bp, Homo sapiens
ggagaggaaatgccagcacttc

SEQ ID NO: 7306707 - DNA, 22 bp, Homo sapiens
ggagagcttggagtgcgatttt

SEQ ID NO: 7306708 - DNA, 22 bp, Homo sapiens
ggaagcaggaggctggggtaaa

SEQ ID NO: 7306709 - DNA, 21 bp, Homo sapiens
ggaagctgtgtccatgctcct

SEQ ID NO: 7306710 - DNA, 18 bp, Homo sapiens
ggaaggaagaatgcattt

SEQ ID NO: 7306711 - DNA, 22 bp, Homo sapiens
ggaaggaagtgaccaggatatc

SEQ ID NO: 7306712 - DNA, 22 bp, Homo sapiens
ggaaggaagattctaactggag

SEQ ID NO: 7306713 - DNA, 22 bp, Homo sapiens
ggaaggaagtgaccaggatatc

SEQ ID NO: 7306714 - DNA, 22 bp, Homo sapiens
gcttccggagccaaaaggcccc

SEQ ID NO: 7306715 - DNA, 18 bp, Homo sapiens
gcttcctgaaagctgccc

SEQ ID NO: 7306716 - DNA, 22 bp, Homo sapiens
gcttcctgagaaacaatctgat

SEQ ID NO: 7306717 - DNA, 22 bp, Homo sapiens
gcttcctgagtacaccctcatc

SEQ ID NO: 7306718 - DNA, 22 bp, Homo sapiens
gcttcctgagagagacagttcc

SEQ ID NO: 7306719 - DNA, 22 bp, Homo sapiens
gcttcctgagacaacattgagt

SEQ ID NO: 7306720 - DNA, 22 bp, Homo sapiens
ggaaatcaagaagcagatgagt

SEQ ID NO: 7306721 - DNA, 22 bp, Homo sapiens
ggaaatcaaggggacaaattgt

SEQ ID NO: 7306722 - DNA, 20 bp, Homo sapiens
ggaaatcaccaggctccacc

SEQ ID NO: 7306723 - DNA, 22 bp, Homo sapiens
ggaaatcagcagatgctggtga

SEQ ID NO: 7306724 - DNA, 22 bp, Homo sapiens
ggaaatcaggggtgttgctttc

SEQ ID NO: 7306725 - DNA, 22 bp, Homo sapiens
ggaaatcatctgattggctttc

SEQ ID NO: 7306726 - DNA, 22 bp, Homo sapiens
ggaaatcatgggagagttggaa

SEQ ID NO: 7306727 - DNA, 22 bp, Homo sapiens
ggaaagggcagaggccttggag

SEQ ID NO: 7306728 - DNA, 22 bp, Homo sapiens
gcttcctgatattcatactgtt

SEQ ID NO: 7306729 - DNA, 22 bp, Homo sapiens
ggaaaggagatattggagagtg

SEQ ID NO: 7306730 - DNA, 22 bp, Homo sapiens
ggaaaggagatattggagagtg

SEQ ID NO: 7306731 - DNA, 22 bp, Homo sapiens
ggaaaggagatgaataggatta

SEQ ID NO: 7306732 - DNA, 22 bp, Homo sapiens
ggaaaggagatattggagagtg

SEQ ID NO: 7306733 - DNA, 19 bp, Homo sapiens
gctgggtggggtccacagc

SEQ ID NO: 7306734 - DNA, 22 bp, Homo sapiens
gctgggtgattcatttccataa

SEQ ID NO: 7306735 - DNA, 22 bp, Homo sapiens
gctggtcactctgggagctgct

SEQ ID NO: 7306736 - DNA, 16 bp, Homo sapiens
gctggtcaagcagcag

SEQ ID NO: 7306737 - DNA, 22 bp, Homo sapiens
gctgtctgttcgagcgtgtgtt

SEQ ID NO: 7306738 - DNA, 22 bp, Homo sapiens
gctgggagtcgcgtctgtggcc

SEQ ID NO: 7306739 - DNA, 21 bp, Homo sapiens
gctgtgcaggtgcccctgctc

SEQ ID NO: 7306740 - DNA, 22 bp, Homo sapiens
gctgtgcaaatcgatttgttgg

SEQ ID NO: 7306741 - DNA, 22 bp, Homo sapiens
gctgtgagtggagttctgtgct

SEQ ID NO: 7306742 - DNA, 22 bp, Homo sapiens
gctgtgagcactgctgggtgga

SEQ ID NO: 7306743 - DNA, 22 bp, Homo sapiens
gctgtgagaaacagggagtgtc

SEQ ID NO: 7306744 - DNA, 22 bp, Homo sapiens
gctgcaccagctgcacccagta

SEQ ID NO: 7306745 - DNA, 22 bp, Homo sapiens
gctgattctgaggtgctttcct

SEQ ID NO: 7306746 - DNA, 22 bp, Homo sapiens
gctgatggcttgctggctgaca

SEQ ID NO: 7306747 - DNA, 22 bp, Homo sapiens
gctgatgagagagacaaatgct

SEQ ID NO: 7306748 - DNA, 22 bp, Homo sapiens
gctgatgagagagacaaatgct

SEQ ID NO: 7306749 - DNA, 22 bp, Homo sapiens
gctgatataaaattacagagga

SEQ ID NO: 7306750 - DNA, 22 bp, Homo sapiens
gctgatataaaattacagagga

SEQ ID NO: 7306751 - DNA, 22 bp, Homo sapiens
gctgatatgattgataaaggta

SEQ ID NO: 7306752 - DNA, 22 bp, Homo sapiens
gctgatattttgaagggcaagg

SEQ ID NO: 7306753 - DNA, 22 bp, Homo sapiens
gctgcaggagctggagctgtgg

SEQ ID NO: 7306754 - DNA, 22 bp, Homo sapiens
gctgcagctttaggatccagtg

SEQ ID NO: 7306755 - DNA, 22 bp, Homo sapiens
gctgcaggtttgtctagtctgg

SEQ ID NO: 7306756 - DNA, 22 bp, Homo sapiens
gctgccacttggtcatgtcatg

SEQ ID NO: 7306757 - DNA, 22 bp, Homo sapiens
gctgcaggatgaggctctgctc

SEQ ID NO: 7306758 - DNA, 22 bp, Homo sapiens
gctgccagggaggtggtggagg

SEQ ID NO: 7306759 - DNA, 22 bp, Homo sapiens
gctctgctgagatatctgggag

SEQ ID NO: 7306760 - DNA, 22 bp, Homo sapiens
gctctgctgcttactagatggt

SEQ ID NO: 7306761 - DNA, 22 bp, Homo sapiens
gctctgctgacagctgggacag

SEQ ID NO: 7306762 - DNA, 22 bp, Homo sapiens
gctctgctgaagccccttgcat

SEQ ID NO: 7306763 - DNA, 21 bp, Homo sapiens
gctcctggtgctgcgtggcgc

SEQ ID NO: 7306764 - DNA, 22 bp, Homo sapiens
gctcctggtgcaaagtttcttc

SEQ ID NO: 7306765 - DNA, 22 bp, Homo sapiens
gctcagggaaagagctcctgtc

SEQ ID NO: 7306766 - DNA, 21 bp, Homo sapiens
gctctcagctgcctgctggtt

SEQ ID NO: 7306767 - DNA, 22 bp, Homo sapiens
gctcctggtgctgtagagattt

SEQ ID NO: 7306768 - DNA, 18 bp, Homo sapiens
gctcctggttggaaagaa

SEQ ID NO: 7306769 - DNA, 22 bp, Homo sapiens
gcgctcctcccggccctggtgg

SEQ ID NO: 7306770 - DNA, 22 bp, Homo sapiens
gcggaagcggtagtcaccctcg

SEQ ID NO: 7306771 - DNA, 22 bp, Homo sapiens
gcggagggagataggccttgct

SEQ ID NO: 7306772 - DNA, 16 bp, Homo sapiens
gcgcctcctcggcctc

SEQ ID NO: 7306773 - DNA, 16 bp, Homo sapiens
gcgcctcctcggcctc

SEQ ID NO: 7306774 - DNA, 22 bp, Homo sapiens
gccttttgatctataactgtgt

SEQ ID NO: 7306775 - DNA, 22 bp, Homo sapiens
gccttttgaaatagaaatctga

SEQ ID NO: 7306776 - DNA, 22 bp, Homo sapiens
gctcacaggtctgtggctattg

SEQ ID NO: 7306777 - DNA, 22 bp, Homo sapiens
gcctggctgggcaccaggggag

SEQ ID NO: 7306778 - DNA, 22 bp, Homo sapiens
ggctagcttagagtcatgctag

SEQ ID NO: 7306779 - DNA, 23 bp, Homo sapiens
ggctagagtggaggggaactgca

SEQ ID NO: 7306780 - DNA, 22 bp, Homo sapiens
ggctctggggttggcccatctc

SEQ ID NO: 7306781 - DNA, 22 bp, Homo sapiens
ggctctgggtctgtggggagcg

SEQ ID NO: 7306782 - DNA, 22 bp, Homo sapiens
ggctcctgatgctcagatttca

SEQ ID NO: 7306783 - DNA, 22 bp, Homo sapiens
ggctctggggaagctctcttca

SEQ ID NO: 7306784 - DNA, 22 bp, Homo sapiens
ggctcctgagaatgggccatca

SEQ ID NO: 7306785 - DNA, 22 bp, Homo sapiens
ggctcctgaaagactatgggaa

SEQ ID NO: 7306786 - DNA, 22 bp, Homo sapiens
ggctcctgaggaccaggcacag

SEQ ID NO: 7306787 - DNA, 22 bp, Homo sapiens
ggctcctgataggagaatgcgg

SEQ ID NO: 7306788 - DNA, 22 bp, Homo sapiens
ggctctgtttactttcagaggc

SEQ ID NO: 7306789 - DNA, 17 bp, Homo sapiens
ggctctgggtgtcacat

SEQ ID NO: 7306790 - DNA, 22 bp, Homo sapiens
ggctctgggtgtgaccttgggt

SEQ ID NO: 7306791 - DNA, 22 bp, Homo sapiens
ggctctggttgaccatgatggc

SEQ ID NO: 7306792 - DNA, 21 bp, Homo sapiens
ggctgggtcatgcagctggcc

SEQ ID NO: 7306793 - DNA, 19 bp, Homo sapiens
ggctgggtctggcaggttc

SEQ ID NO: 7306794 - DNA, 20 bp, Homo sapiens
ggctgtgcccttccgtggcc

SEQ ID NO: 7306795 - DNA, 22 bp, Homo sapiens
ggctgctgtttcagagactgtt

SEQ ID NO: 7306796 - DNA, 20 bp, Homo sapiens
ggctgctgtgggcagagagg

SEQ ID NO: 7306797 - DNA, 22 bp, Homo sapiens
gggaggttctgttcgcacttga

SEQ ID NO: 7306798 - DNA, 22 bp, Homo sapiens
gggagctggcggattccccagg

SEQ ID NO: 7306799 - DNA, 22 bp, Homo sapiens
gggagctggagttgtgttgcct

SEQ ID NO: 7306800 - DNA, 22 bp, Homo sapiens
gggagctggagctggaagactc

SEQ ID NO: 7306801 - DNA, 22 bp, Homo sapiens
gggcagtagcttcgtaggcatc

SEQ ID NO: 7306802 - DNA, 22 bp, Homo sapiens
gggcacagtctaaagttgggcc

SEQ ID NO: 7306803 - DNA, 22 bp, Homo sapiens
ggctttgacatgctgaattaaa

SEQ ID NO: 7306804 - DNA, 19 bp, Homo sapiens
gggaatgatggaagacttc

SEQ ID NO: 7306805 - DNA, 21 bp, Homo sapiens
gggaatgagattcttggagat

SEQ ID NO: 7306806 - DNA, 22 bp, Homo sapiens
gggaagtgatggagccaggatt

SEQ ID NO: 7306807 - DNA, 22 bp, Homo sapiens
gggaagtgagctggaatcaagg

SEQ ID NO: 7306808 - DNA, 22 bp, Homo sapiens
gggagctgagctggaagagaat

SEQ ID NO: 7306809 - DNA, 22 bp, Homo sapiens
gggagctgagctggaagagaat

SEQ ID NO: 7306810 - DNA, 22 bp, Homo sapiens
gggagctgagctggaagagaat

SEQ ID NO: 7306811 - DNA, 22 bp, Homo sapiens
gggagctgagctctgagccacg

SEQ ID NO: 7306812 - DNA, 22 bp, Homo sapiens
gggagctgagaaacaacattct

SEQ ID NO: 7306813 - DNA, 22 bp, Homo sapiens
gggagctggagctggaagactc

SEQ ID NO: 7306814 - DNA, 22 bp, Homo sapiens
gggagctggagctggaagactc

SEQ ID NO: 7306815 - DNA, 22 bp, Homo sapiens
gggagctgagggacctctgtgg

SEQ ID NO: 7306816 - DNA, 22 bp, Homo sapiens
gggagctgaggagccccgtcgg

SEQ ID NO: 7306817 - DNA, 22 bp, Homo sapiens
gggagctgagctggaagagaat

SEQ ID NO: 7306818 - DNA, 22 bp, Homo sapiens
ggccaggagatggacaccacat

SEQ ID NO: 7306819 - DNA, 22 bp, Homo sapiens
ggccaggagcaagccaggctct

SEQ ID NO: 7306820 - DNA, 22 bp, Homo sapiens
ggccaggagaggagggcactga

SEQ ID NO: 7306821 - DNA, 22 bp, Homo sapiens
ggccaggaggcaggggctcaat

SEQ ID NO: 7306822 - DNA, 22 bp, Homo sapiens
ggccctgggatgctcagcagtg

SEQ ID NO: 7306823 - DNA, 22 bp, Homo sapiens
ggcctggagcagagactaggga

SEQ ID NO: 7306824 - DNA, 22 bp, Homo sapiens
ggcctggagcagagactaggga

SEQ ID NO: 7306825 - DNA, 19 bp, Homo sapiens
ggcctggatttagggctcc

SEQ ID NO: 7306826 - DNA, 19 bp, Homo sapiens
ggcctggctatccctgctg

SEQ ID NO: 7306827 - DNA, 22 bp, Homo sapiens
ggcctggacacctgaggtctta

SEQ ID NO: 7306828 - DNA, 22 bp, Homo sapiens
ggcctggaaggacagcgtgatg

SEQ ID NO: 7306829 - DNA, 22 bp, Homo sapiens
ggcatgcatcaccacgccacgc

SEQ ID NO: 7306830 - DNA, 22 bp, Homo sapiens
ggccaggaagggaagatcagca

SEQ ID NO: 7306831 - DNA, 22 bp, Homo sapiens
ggcatcttgttgctcaaatcta

SEQ ID NO: 7306832 - DNA, 22 bp, Homo sapiens
ggcatctcagatagttcagacc

SEQ ID NO: 7306833 - DNA, 21 bp, Homo sapiens
ggcatcccaggccagtgactg

SEQ ID NO: 7306834 - DNA, 18 bp, Homo sapiens
ggcaggggtgaaccacag

SEQ ID NO: 7306835 - DNA, 22 bp, Homo sapiens
ggcaggagctctccagtttgcc

SEQ ID NO: 7306836 - DNA, 17 bp, Homo sapiens
ggcaggtgacagacacc

SEQ ID NO: 7306837 - DNA, 21 bp, Homo sapiens
ggcagaagtagcatggacggg

SEQ ID NO: 7306838 - DNA, 22 bp, Homo sapiens
ggagttgattttggatatatta

SEQ ID NO: 7306839 - DNA, 22 bp, Homo sapiens
ggagcagagctcttcatctgca

SEQ ID NO: 7306840 - DNA, 22 bp, Homo sapiens
ggagcagagctgggcttggctg

SEQ ID NO: 7306841 - DNA, 22 bp, Homo sapiens
ggagcagagcatttcacagcct

SEQ ID NO: 7306842 - DNA, 22 bp, Homo sapiens
ggatctggttacgtaagagtct

SEQ ID NO: 7306843 - DNA, 22 bp, Homo sapiens
ggatctggggtagagcagtggg

SEQ ID NO: 7306844 - DNA, 22 bp, Homo sapiens
ggagatggtggaagctggtgca

SEQ ID NO: 7306845 - DNA, 21 bp, Homo sapiens
ggagatgggtatcgcctgggc

SEQ ID NO: 7306846 - DNA, 22 bp, Homo sapiens
ggagatggctggcaggtagatg

SEQ ID NO: 7306847 - DNA, 22 bp, Homo sapiens
ggagcaccctgctcagccaagc

SEQ ID NO: 7306848 - DNA, 22 bp, Homo sapiens
ggagcaccaaagtaactagcac

SEQ ID NO: 7306849 - DNA, 22 bp, Homo sapiens
ggagatggtggaagctggtgca

SEQ ID NO: 7306850 - DNA, 21 bp, Homo sapiens
ggatgccacgaagcaccagga

SEQ ID NO: 7306851 - DNA, 22 bp, Homo sapiens
ggatgctgtctaagctgaggac

SEQ ID NO: 7306852 - DNA, 22 bp, Homo sapiens
ggtccaggatcaaggcatcacc

SEQ ID NO: 7306853 - DNA, 22 bp, Homo sapiens
ggtcagggctcttccagtggct

SEQ ID NO: 7306854 - DNA, 22 bp, Homo sapiens
ggtcagctctttgggctggtgg

SEQ ID NO: 7306855 - DNA, 22 bp, Homo sapiens
ggtcaggaaaagactccccaga

SEQ ID NO: 7306856 - DNA, 23 bp, Homo sapiens
gggtccagccaattccaaggaaa

SEQ ID NO: 7306857 - DNA, 22 bp, Homo sapiens
gggtccagcgacagcaggctca

SEQ ID NO: 7306858 - DNA, 22 bp, Homo sapiens
ggtaacagttacagtaacagta

SEQ ID NO: 7306859 - DNA, 22 bp, Homo sapiens
ggtacagacagggctgcctggg

SEQ ID NO: 7306860 - DNA, 22 bp, Homo sapiens
ggtactacatggttggctgggg

SEQ ID NO: 7306861 - DNA, 22 bp, Homo sapiens
ggtacagggcttcctggacaag

SEQ ID NO: 7306862 - DNA, 22 bp, Homo sapiens
ggtaccaccaattcagctgcca

SEQ ID NO: 7306863 - DNA, 22 bp, Homo sapiens
gggtccagaatgagaatgggct

SEQ ID NO: 7306864 - DNA, 23 bp, Homo sapiens
gggtccagagacaggcatgggtg

SEQ ID NO: 7306865 - DNA, 22 bp, Homo sapiens
ggtgcatggaaagagtaagtaa

SEQ ID NO: 7306866 - DNA, 22 bp, Homo sapiens
ggtgcatgtgagaaagactggg

SEQ ID NO: 7306867 - DNA, 22 bp, Homo sapiens
ggtgcatgtagccatcaagata

SEQ ID NO: 7306868 - DNA, 22 bp, Homo sapiens
ggtgcatggggagcactctcag

SEQ ID NO: 7306869 - DNA, 22 bp, Homo sapiens
ggtgcatggtggaggtgaccct

SEQ ID NO: 7306870 - DNA, 22 bp, Homo sapiens
ggtgaaggcacaagagggcaag

SEQ ID NO: 7306871 - DNA, 22 bp, Homo sapiens
ggtctgtgtgctttgggaagtg

SEQ ID NO: 7306872 - DNA, 17 bp, Homo sapiens
ggtctgtgtctagggaa

SEQ ID NO: 7306873 - DNA, 22 bp, Homo sapiens
ggtctgggcttgagtccttttg

SEQ ID NO: 7306874 - DNA, 22 bp, Homo sapiens
ggtctgggcttgagtccttttg

SEQ ID NO: 7306875 - DNA, 22 bp, Homo sapiens
ggtctgggtttccccaccacac

SEQ ID NO: 7306876 - DNA, 17 bp, Homo sapiens
ggtctggggccattggc

SEQ ID NO: 7306877 - DNA, 22 bp, Homo sapiens
ggtctggggcaggcatctgaca

SEQ ID NO: 7306878 - DNA, 22 bp, Homo sapiens
ggtctgtgtcataggctgagtt

SEQ ID NO: 7306879 - DNA, 22 bp, Homo sapiens
ggtctgtgtcataggctgagtt

SEQ ID NO: 7306880 - DNA, 22 bp, Homo sapiens
ggtctgtgctctggagcctctg

SEQ ID NO: 7306881 - DNA, 22 bp, Homo sapiens
ggtctgtgatcttatggattct

SEQ ID NO: 7306882 - DNA, 22 bp, Homo sapiens
ggtgccagtgggtctcaggata

SEQ ID NO: 7306883 - DNA, 22 bp, Homo sapiens
ggtgccaagttgcaactcgcca

SEQ ID NO: 7306884 - DNA, 22 bp, Homo sapiens
ggtgcgattggcttcacactgt

SEQ ID NO: 7306885 - DNA, 22 bp, Homo sapiens
ggggatggattccgggtccctg

SEQ ID NO: 7306886 - DNA, 22 bp, Homo sapiens
ggggatggaatgtagtagtgat

SEQ ID NO: 7306887 - DNA, 22 bp, Homo sapiens
ggggatggaggcgtgtggtcct

SEQ ID NO: 7306888 - DNA, 22 bp, Homo sapiens
ggggcagctcccgagggcagga

SEQ ID NO: 7306889 - DNA, 22 bp, Homo sapiens
gggctgggatggcttgaagatt

SEQ ID NO: 7306890 - DNA, 22 bp, Homo sapiens
gggggactggaccgtcctgggt

SEQ ID NO: 7306891 - DNA, 22 bp, Homo sapiens
ggggcaggagcccttcttcagc

SEQ ID NO: 7306892 - DNA, 22 bp, Homo sapiens
ggggcttttgcacgtgggaggc

SEQ ID NO: 7306893 - DNA, 22 bp, Homo sapiens
ggggcaggaggtgttctctttt

SEQ ID NO: 7306894 - DNA, 22 bp, Homo sapiens
gggggccatcttcaaggatgtg

SEQ ID NO: 7306895 - DNA, 20 bp, Homo sapiens
gggggccagcagcagacgcc

SEQ ID NO: 7306896 - DNA, 22 bp, Homo sapiens
gggggagagacgagcggctctg

SEQ ID NO: 7306897 - DNA, 22 bp, Homo sapiens
gggtcactgtaaggcaataagt

SEQ ID NO: 7306898 - DNA, 22 bp, Homo sapiens
gggtcacttttgctatgttggc

SEQ ID NO: 7306899 - DNA, 22 bp, Homo sapiens
gggtcaagccgttgcccaaggc

SEQ ID NO: 7306900 - DNA, 22 bp, Homo sapiens
gggtcagctgctgggggctgac

SEQ ID NO: 7306901 - DNA, 22 bp, Homo sapiens
gggtcagcgatttcaggggcag

SEQ ID NO: 7306902 - DNA, 22 bp, Homo sapiens
gggcctcagctggagtctgcct

SEQ ID NO: 7306903 - DNA, 22 bp, Homo sapiens
gggctccagccagctccttgtg

SEQ ID NO: 7306904 - DNA, 20 bp, Homo sapiens
gggctccagctgtgattctt

SEQ ID NO: 7306905 - DNA, 22 bp, Homo sapiens
gggctcctgcctcctggcacct

SEQ ID NO: 7306906 - DNA, 22 bp, Homo sapiens
gtcaacataggcctcagtgagg

SEQ ID NO: 7306907 - DNA, 22 bp, Homo sapiens
gtcaacatgttctgggtgaatg

SEQ ID NO: 7306908 - DNA, 22 bp, Homo sapiens
gtcaacatcggaaagcgtgtaa

SEQ ID NO: 7306909 - DNA, 22 bp, Homo sapiens
gtcaacatttactgccctggcc

SEQ ID NO: 7306910 - DNA, 22 bp, Homo sapiens
gtcaactttaagatgatctttt

SEQ ID NO: 7306911 - DNA, 22 bp, Homo sapiens
gtcaagtacaactcagaaaggt

SEQ ID NO: 7306912 - DNA, 22 bp, Homo sapiens
gtaggaagctctgaggctagtt

SEQ ID NO: 7306913 - DNA, 22 bp, Homo sapiens
gtagcagaatcagtgctacaga

SEQ ID NO: 7306914 - DNA, 18 bp, Homo sapiens
gtagcaaaggagttactt

SEQ ID NO: 7306915 - DNA, 22 bp, Homo sapiens
gtaaatcataaaatttgagctc

SEQ ID NO: 7306916 - DNA, 22 bp, Homo sapiens
gtaaattatttcaagatcatct

SEQ ID NO: 7306917 - DNA, 22 bp, Homo sapiens
gtaacaaaggataacttggttt

SEQ ID NO: 7306918 - DNA, 22 bp, Homo sapiens
gtaacaaaggataacttggttt

SEQ ID NO: 7306919 - DNA, 22 bp, Homo sapiens
gtaacaaacggttccaagatgc

SEQ ID NO: 7306920 - DNA, 22 bp, Homo sapiens
gtaaatcagtgtcattttagaa

SEQ ID NO: 7306921 - DNA, 22 bp, Homo sapiens
gtaaatcagtgtcattttagaa

SEQ ID NO: 7306922 - DNA, 22 bp, Homo sapiens
ggtgggcacccgagactggatc

SEQ ID NO: 7306923 - DNA, 19 bp, Homo sapiens
gtaacagtggacattttag

SEQ ID NO: 7306924 - DNA, 22 bp, Homo sapiens
gtaacagtttgggttccaattg

SEQ ID NO: 7306925 - DNA, 22 bp, Homo sapiens
gtaacaaagtttctaggtgctg

SEQ ID NO: 7306926 - DNA, 19 bp, Homo sapiens
gtaacagtggacattttag

SEQ ID NO: 7306927 - DNA, 22 bp, Homo sapiens
gtaataatactagtcagccttg

SEQ ID NO: 7306928 - DNA, 19 bp, Homo sapiens
gtaatatgtgctgagtcct

SEQ ID NO: 7306929 - DNA, 22 bp, Homo sapiens
gtaatattcagctattgagttg

SEQ ID NO: 7306930 - DNA, 22 bp, Homo sapiens
gtaatagaacactcagcatgga

SEQ ID NO: 7306931 - DNA, 22 bp, Homo sapiens
gtaatccaaagtaacattaaac

SEQ ID NO: 7306932 - DNA, 22 bp, Homo sapiens
gtaatgaatcaacattaatgat

SEQ ID NO: 7306933 - DNA, 22 bp, Homo sapiens
gtaatgaatagatggtggcagg

SEQ ID NO: 7306934 - DNA, 22 bp, Homo sapiens
gtaatgaatgaaagaaactggg

SEQ ID NO: 7306935 - DNA, 20 bp, Homo sapiens
gtaatgaatgtaaacagtaa

SEQ ID NO: 7306936 - DNA, 22 bp, Homo sapiens
gtcaggggccatgggccaagga

SEQ ID NO: 7306937 - DNA, 22 bp, Homo sapiens
gtcaggtttgttgtctggatac

SEQ ID NO: 7306938 - DNA, 21 bp, Homo sapiens
gtcaatacataggtgaagagg

SEQ ID NO: 7306939 - DNA, 22 bp, Homo sapiens
gtctcccactttctggcctctt

SEQ ID NO: 7306940 - DNA, 22 bp, Homo sapiens
gtctcccatctctgtccttgtg

SEQ ID NO: 7306941 - DNA, 22 bp, Homo sapiens
gtctcccatcgtttgtgaggaa

SEQ ID NO: 7306942 - DNA, 23 bp, Homo sapiens
gtctcccatagcgctcccaggct

SEQ ID NO: 7306943 - DNA, 22 bp, Homo sapiens
gtctcccatgtccctgtccagt

SEQ ID NO: 7306944 - DNA, 22 bp, Homo sapiens
gtctcctaaaccatcctggtac

SEQ ID NO: 7306945 - DNA, 23 bp, Homo sapiens
gtcctattttttgaaatactgag

SEQ ID NO: 7306946 - DNA, 22 bp, Homo sapiens
gtccctggagctgagcagtgct

SEQ ID NO: 7306947 - DNA, 22 bp, Homo sapiens
gtcctcagagtgggcaggtcct

SEQ ID NO: 7306948 - DNA, 22 bp, Homo sapiens
gtcctcagaagcctgcttagct

SEQ ID NO: 7306949 - DNA, 22 bp, Homo sapiens
gtcctcagggagtcccagtcat

SEQ ID NO: 7306950 - DNA, 22 bp, Homo sapiens
gtcctcaggaaggctttctgac

SEQ ID NO: 7306951 - DNA, 22 bp, Homo sapiens
gtctggggtccttttggcttta

SEQ ID NO: 7306952 - DNA, 22 bp, Homo sapiens
gtctctatcatagctgaaccct

SEQ ID NO: 7306953 - DNA, 22 bp, Homo sapiens
gtctcctgaggcatccattgaa

SEQ ID NO: 7306954 - DNA, 22 bp, Homo sapiens
gtcttattaaaatgcagtttct

SEQ ID NO: 7306955 - DNA, 22 bp, Homo sapiens
gtcttattatgaggttagactt

SEQ ID NO: 7306956 - DNA, 22 bp, Homo sapiens
gtcttatttaaagagatcatac

SEQ ID NO: 7306957 - DNA, 22 bp, Homo sapiens
gtctggggtgaggcccgggatt

SEQ ID NO: 7306958 - DNA, 23 bp, Homo sapiens
gtgagtcttgcctttgctgtgga

SEQ ID NO: 7306959 - DNA, 22 bp, Homo sapiens
gtgagtgtcagtcaaaggtttt

SEQ ID NO: 7306960 - DNA, 22 bp, Homo sapiens
gtgagtgttaacccactgcttc

SEQ ID NO: 7306961 - DNA, 22 bp, Homo sapiens
gtgatgtggggaccgtcctggc

SEQ ID NO: 7306962 - DNA, 22 bp, Homo sapiens
gtcttcttttcagtctgcttgt

SEQ ID NO: 7306963 - DNA, 22 bp, Homo sapiens
gtgcaatccagttgatttttac

SEQ ID NO: 7306964 - DNA, 22 bp, Homo sapiens
gtgccctgatgcaattgtctca

SEQ ID NO: 7306965 - DNA, 22 bp, Homo sapiens
gtgccctgcatgccccgggtat

SEQ ID NO: 7306966 - DNA, 22 bp, Homo sapiens
gtgcccaggggccagctgccgg

SEQ ID NO: 7306967 - DNA, 19 bp, Homo sapiens
gtgatttctttccacaagc

SEQ ID NO: 7306968 - DNA, 22 bp, Homo sapiens
gtgatttagtgagaggcagctg

SEQ ID NO: 7306969 - DNA, 22 bp, Homo sapiens
gtgcctcccggggctcttcctt

SEQ ID NO: 7306970 - DNA, 22 bp, Homo sapiens
gtgccgtgggccttagtgatct

SEQ ID NO: 7306971 - DNA, 22 bp, Homo sapiens
gtgccctggctcacagtgtctc

SEQ ID NO: 7306972 - DNA, 22 bp, Homo sapiens
gtgccctggctcacagtgtctc

SEQ ID NO: 7306973 - DNA, 22 bp, Homo sapiens
gtgccctgtctcttgtctccag

SEQ ID NO: 7306974 - DNA, 22 bp, Homo sapiens
gtgccctgttcatttctctccc

SEQ ID NO: 7306975 - DNA, 22 bp, Homo sapiens
gtgctgtaacaacagagtgtct

SEQ ID NO: 7306976 - DNA, 22 bp, Homo sapiens
gtgctgtacttctgtgttgaag

SEQ ID NO: 7306977 - DNA, 22 bp, Homo sapiens
gtgctgtatatgcaagaggaag

SEQ ID NO: 7306978 - DNA, 22 bp, Homo sapiens
gtgctgtatcagaatctgctct

SEQ ID NO: 7306979 - DNA, 22 bp, Homo sapiens
gtgctgtatcagtacatattga

SEQ ID NO: 7306980 - DNA, 22 bp, Homo sapiens
gtgctggggagataggaagaga

SEQ ID NO: 7306981 - DNA, 22 bp, Homo sapiens
gtgctgggggtttctgtaggtc

SEQ ID NO: 7306982 - DNA, 22 bp, Homo sapiens
tatttgttgagttgttatgtct

SEQ ID NO: 7306983 - DNA, 22 bp, Homo sapiens
tatttgtgtgggtatctatata

SEQ ID NO: 7306984 - DNA, 22 bp, Homo sapiens
tatttgtgagactgactgaagt

SEQ ID NO: 7306985 - DNA, 22 bp, Homo sapiens
tatttgtccttattaagatctg

SEQ ID NO: 7306986 - DNA, 22 bp, Homo sapiens
tatttgtctggtctaaggaggg

SEQ ID NO: 7306987 - DNA, 22 bp, Homo sapiens
tatttgtcacctatggctgtcc

SEQ ID NO: 7306988 - DNA, 22 bp, Homo sapiens
tatttgtcagctgttgagttca

SEQ ID NO: 7306989 - DNA, 22 bp, Homo sapiens
tatttgtccaggtaaatttcag

SEQ ID NO: 7306990 - DNA, 22 bp, Homo sapiens
tatttgtatttcatgcagtaaa

SEQ ID NO: 7306991 - DNA, 22 bp, Homo sapiens
tatttgttgcgggaattgctat

SEQ ID NO: 7306992 - DNA, 22 bp, Homo sapiens
tattttcaccatgtatccctgt

SEQ ID NO: 7306993 - DNA, 22 bp, Homo sapiens
tattttcaccttctctggatat

SEQ ID NO: 7306994 - DNA, 22 bp, Homo sapiens
tatttctaagagatatctgtac

SEQ ID NO: 7306995 - DNA, 22 bp, Homo sapiens
tatttctaagagatatctgtac

SEQ ID NO: 7306996 - DNA, 22 bp, Homo sapiens
tatttccagcagtaagaagaca

SEQ ID NO: 7306997 - DNA, 22 bp, Homo sapiens
tatttcagggagaataaatttg

SEQ ID NO: 7306998 - DNA, 22 bp, Homo sapiens
tatttccatgttagaactaagt

SEQ ID NO: 7306999 - DNA, 22 bp, Homo sapiens
tatttgtagaatggattaaggg

SEQ ID NO: 7307000 - DNA, 22 bp, Homo sapiens
tatttgtatgtgtgtacatata

SEQ ID NO: 7307001 - DNA, 22 bp, Homo sapiens
tatttgtatgtgtgtacatata

SEQ ID NO: 7307002 - DNA, 22 bp, Homo sapiens
tatttgtatttcatgcagtaaa

SEQ ID NO: 7307003 - DNA, 22 bp, Homo sapiens
tatttggatagacagggagatg

SEQ ID NO: 7307004 - DNA, 22 bp, Homo sapiens
tatttggcaaagaattttctgg

SEQ ID NO: 7307005 - DNA, 22 bp, Homo sapiens
tatttctaagctgtaagtctga

SEQ ID NO: 7307006 - DNA, 22 bp, Homo sapiens
tatttggaggccactgttgagt

SEQ ID NO: 7307007 - DNA, 22 bp, Homo sapiens
tatttggagtgatggaaatgtt

SEQ ID NO: 7307008 - DNA, 22 bp, Homo sapiens
tatttcaagaacttctatccat

SEQ ID NO: 7307009 - DNA, 22 bp, Homo sapiens
tatttcaagaacttctatccat

SEQ ID NO: 7307010 - DNA, 22 bp, Homo sapiens
tattgtactgaggaataaagct

SEQ ID NO: 7307011 - DNA, 22 bp, Homo sapiens
tatttcacagcagctcatttaa

SEQ ID NO: 7307012 - DNA, 22 bp, Homo sapiens
tatttcacataccacagagtgt

SEQ ID NO: 7307013 - DNA, 22 bp, Homo sapiens
tatttcacctaaaagtgtcaaa

SEQ ID NO: 7307014 - DNA, 22 bp, Homo sapiens
tatttcagagttgttttctgtc

SEQ ID NO: 7307015 - DNA, 22 bp, Homo sapiens
tatttcaggctatatttcttgt

SEQ ID NO: 7307016 - DNA, 22 bp, Homo sapiens
tattgtacatttccaaattgct

SEQ ID NO: 7307017 - DNA, 22 bp, Homo sapiens
tattggtgggggcagagagaga

SEQ ID NO: 7307018 - DNA, 22 bp, Homo sapiens
tattgcaagcaattccaaaagg

SEQ ID NO: 7307019 - DNA, 22 bp, Homo sapiens
tattgcaagtggcataaaattt

SEQ ID NO: 7307020 - DNA, 22 bp, Homo sapiens
tattgatgcagagccaaattgc

SEQ ID NO: 7307021 - DNA, 23 bp, Homo sapiens
tattgcacacatagaaacataga

SEQ ID NO: 7307022 - DNA, 21 bp, Homo sapiens
tattgcataacaaattaccct

SEQ ID NO: 7307023 - DNA, 22 bp, Homo sapiens
tattcacaggcacgaaatattg

SEQ ID NO: 7307024 - DNA, 22 bp, Homo sapiens
tatgtttagtatccattttcag

SEQ ID NO: 7307025 - DNA, 22 bp, Homo sapiens
tatgtttatactttgatgtact

SEQ ID NO: 7307026 - DNA, 22 bp, Homo sapiens
tattcatagtaaacaaaagtgg

SEQ ID NO: 7307027 - DNA, 22 bp, Homo sapiens
tattcagagtgtagcaaataga

SEQ ID NO: 7307028 - DNA, 22 bp, Homo sapiens
tattcagaataaagactacatt

SEQ ID NO: 7307029 - DNA, 22 bp, Homo sapiens
tattgaggattgaggaaagcac

SEQ ID NO: 7307030 - DNA, 22 bp, Homo sapiens
tattgagaccagtgcttgctta

SEQ ID NO: 7307031 - DNA, 19 bp, Homo sapiens
tatgttatgttgtttactc

SEQ ID NO: 7307032 - DNA, 22 bp, Homo sapiens
tatgtttaaatgtatgtgtatg

SEQ ID NO: 7307033 - DNA, 22 bp, Homo sapiens
tatgttgagcattcagtgatct

SEQ ID NO: 7307034 - DNA, 22 bp, Homo sapiens
tatgctactagaaataaaatgg

SEQ ID NO: 7307035 - DNA, 22 bp, Homo sapiens
tatgctaattgttagtcacatg

SEQ ID NO: 7307036 - DNA, 22 bp, Homo sapiens
tatgcgtgcctctgtctgtctg

SEQ ID NO: 7307037 - DNA, 22 bp, Homo sapiens
tatgctaaatatgttcacattg

SEQ ID NO: 7307038 - DNA, 22 bp, Homo sapiens
tatgctagatggaaaaatattg

SEQ ID NO: 7307039 - DNA, 22 bp, Homo sapiens
tatgctactagaaataaaatgg

SEQ ID NO: 7307040 - DNA, 22 bp, Homo sapiens
tatgcctacctccaaaatatat

SEQ ID NO: 7307041 - DNA, 22 bp, Homo sapiens
tatgtgtgtttcagtggaaatg

SEQ ID NO: 7307042 - DNA, 17 bp, Homo sapiens
tatgtgtgtttgcagca

SEQ ID NO: 7307043 - DNA, 17 bp, Homo sapiens
tatgtgtgtttgcagca

SEQ ID NO: 7307044 - DNA, 17 bp, Homo sapiens
tatgtgtgtttgcagca

SEQ ID NO: 7307045 - DNA, 22 bp, Homo sapiens
tatgtgttgaatttgaacgtta

SEQ ID NO: 7307046 - DNA, 22 bp, Homo sapiens
tatgtgttgtatatgtgcagag

SEQ ID NO: 7307047 - DNA, 22 bp, Homo sapiens
tatgtgttttggatttagaatg

SEQ ID NO: 7307048 - DNA, 22 bp, Homo sapiens
tatgtgtttcctgtggctgcca

SEQ ID NO: 7307049 - DNA, 22 bp, Homo sapiens
tatgcttattgtctcatccact

SEQ ID NO: 7307050 - DNA, 22 bp, Homo sapiens
tatgctgtattctgtatgttag

SEQ ID NO: 7307051 - DNA, 22 bp, Homo sapiens
tatgtgtgtttcagtggaaatg

SEQ ID NO: 7307052 - DNA, 17 bp, Homo sapiens
tatgtgtgtgtttatac

SEQ ID NO: 7307053 - DNA, 17 bp, Homo sapiens
tatgtgtgtgtttatac

SEQ ID NO: 7307054 - DNA, 19 bp, Homo sapiens
tatgtgtgtgtatttacat

SEQ ID NO: 7307055 - DNA, 19 bp, Homo sapiens
tatgtgtgtgtatttacat

SEQ ID NO: 7307056 - DNA, 19 bp, Homo sapiens
tatgtgtgtgtatttacat

SEQ ID NO: 7307057 - DNA, 22 bp, Homo sapiens
tatcttgtttaggtgcacaggt

SEQ ID NO: 7307058 - DNA, 22 bp, Homo sapiens
tatctttaacttgcagtattta

SEQ ID NO: 7307059 - DNA, 18 bp, Homo sapiens
tatctttgagtcctctgc

SEQ ID NO: 7307060 - DNA, 22 bp, Homo sapiens
tatctttgatgccagatgttac

SEQ ID NO: 7307061 - DNA, 19 bp, Homo sapiens
tatctttatgcagtggtgg

SEQ ID NO: 7307062 - DNA, 22 bp, Homo sapiens
tatcttcatagatttttacacc

SEQ ID NO: 7307063 - DNA, 22 bp, Homo sapiens
tatgcagtggtatcattttaaa

SEQ ID NO: 7307064 - DNA, 22 bp, Homo sapiens
tatctttgcaaatatctctaag

SEQ ID NO: 7307065 - DNA, 22 bp, Homo sapiens
tatctttgtatcaatctccatt

SEQ ID NO: 7307066 - DNA, 22 bp, Homo sapiens
tatctttggtagctttcctaag

SEQ ID NO: 7307067 - DNA, 22 bp, Homo sapiens
tatgcagtgtacgatgtttagt

SEQ ID NO: 7307068 - DNA, 22 bp, Homo sapiens
tatgcatatagatgcacacaca

SEQ ID NO: 7307069 - DNA, 19 bp, Homo sapiens
tatatttgagtgtgcatgc

SEQ ID NO: 7307070 - DNA, 19 bp, Homo sapiens
tatatttgagtgtgcatgc

SEQ ID NO: 7307071 - DNA, 19 bp, Homo sapiens
tatatttgagtgtgcatgc

SEQ ID NO: 7307072 - DNA, 22 bp, Homo sapiens
tatatttgctaaatgtgtgcaa

SEQ ID NO: 7307073 - DNA, 22 bp, Homo sapiens
tatatttgctaaatgtgtgcaa

SEQ ID NO: 7307074 - DNA, 22 bp, Homo sapiens
tatatttgctaaatgtgtgcaa

SEQ ID NO: 7307075 - DNA, 22 bp, Homo sapiens
tatatttgtgtgtgatttatga

SEQ ID NO: 7307076 - DNA, 18 bp, Homo sapiens
tatatttcacacatattc

SEQ ID NO: 7307077 - DNA, 18 bp, Homo sapiens
tatatttcacacatattc

SEQ ID NO: 7307078 - DNA, 19 bp, Homo sapiens
tatatttgagtgtgcatgc

SEQ ID NO: 7307079 - DNA, 22 bp, Homo sapiens
tatatttaattagttgctggat

SEQ ID NO: 7307080 - DNA, 22 bp, Homo sapiens
tatattcaacaggctaatgtca

SEQ ID NO: 7307081 - DNA, 20 bp, Homo sapiens
tatattttctctttggcctt

SEQ ID NO: 7307082 - DNA, 22 bp, Homo sapiens
tatcaaattgaggcagctgggg

SEQ ID NO: 7307083 - DNA, 19 bp, Homo sapiens
tatatttgttgaataaaaa

SEQ ID NO: 7307084 - DNA, 19 bp, Homo sapiens
tatatttgttgaataaaaa

SEQ ID NO: 7307085 - DNA, 22 bp, Homo sapiens
tatatttgctaaatgtgtgcaa

SEQ ID NO: 7307086 - DNA, 22 bp, Homo sapiens
tatattttagacaccctcacgc

SEQ ID NO: 7307087 - DNA, 22 bp, Homo sapiens
tatcacactagcctatagtgga

SEQ ID NO: 7307088 - DNA, 22 bp, Homo sapiens
tatctgtgaaatgtgtttgtat

SEQ ID NO: 7307089 - DNA, 22 bp, Homo sapiens
tatctgtgaaatgtgtttgtat

SEQ ID NO: 7307090 - DNA, 22 bp, Homo sapiens
tatattaacacccacttgcctc

SEQ ID NO: 7307091 - DNA, 22 bp, Homo sapiens
tatatgtgtggattcttgtaga

SEQ ID NO: 7307092 - DNA, 20 bp, Homo sapiens
tatatgtgtacatacacaca

SEQ ID NO: 7307093 - DNA, 22 bp, Homo sapiens
tatatgcaattttttagtgcaa

SEQ ID NO: 7307094 - DNA, 22 bp, Homo sapiens
tatatgcagattttcatcatcg

SEQ ID NO: 7307095 - DNA, 22 bp, Homo sapiens
tatatgcagtgtgtcattcaag

SEQ ID NO: 7307096 - DNA, 22 bp, Homo sapiens
tatagcaaggacataatatgct

SEQ ID NO: 7307097 - DNA, 22 bp, Homo sapiens
tatatgcaatgaggtgggagta

SEQ ID NO: 7307098 - DNA, 22 bp, Homo sapiens
tatagactagcagcagaattta

SEQ ID NO: 7307099 - DNA, 22 bp, Homo sapiens
tatatgcatgcccatgtataca

SEQ ID NO: 7307100 - DNA, 22 bp, Homo sapiens
tatatgtgcagcatttttaatt

SEQ ID NO: 7307101 - DNA, 22 bp, Homo sapiens
tatatgtctgctactgtataaa

SEQ ID NO: 7307102 - DNA, 22 bp, Homo sapiens
tatatgtagattgtaccaatgt

SEQ ID NO: 7307103 - DNA, 22 bp, Homo sapiens
tagtgtatgtctaacatacact

SEQ ID NO: 7307104 - DNA, 22 bp, Homo sapiens
tagtgttttctagaatggtttt

SEQ ID NO: 7307105 - DNA, 22 bp, Homo sapiens
tagttaaagccctaaattgata

SEQ ID NO: 7307106 - DNA, 22 bp, Homo sapiens
tagtgtttgggaattgtagaga

SEQ ID NO: 7307107 - DNA, 22 bp, Homo sapiens
tagttaatgtgaggcacctagt

SEQ ID NO: 7307108 - DNA, 22 bp, Homo sapiens
tagttaaggccacttgcctaag

SEQ ID NO: 7307109 - DNA, 22 bp, Homo sapiens
tatacagaactgcacgtgcacg

SEQ ID NO: 7307110 - DNA, 22 bp, Homo sapiens
tatactctgagaaacgtgtcac

SEQ ID NO: 7307111 - DNA, 22 bp, Homo sapiens
tatactctgagaaacgtgtcac

SEQ ID NO: 7307112 - DNA, 22 bp, Homo sapiens
tatactgagagcaaatacattc

SEQ ID NO: 7307113 - DNA, 22 bp, Homo sapiens
tatactttcctgcaactttgat

SEQ ID NO: 7307114 - DNA, 21 bp, Homo sapiens
tataccacagccatcaaatat

SEQ ID NO: 7307115 - DNA, 22 bp, Homo sapiens
tatacagatatctaagatgtaa

SEQ ID NO: 7307116 - DNA, 20 bp, Homo sapiens
tatactaacatatatctgtt

SEQ ID NO: 7307117 - DNA, 22 bp, Homo sapiens
tatactacgcaccaaacaaagg

SEQ ID NO: 7307118 - DNA, 22 bp, Homo sapiens
tatactatgcttctgatccaat

SEQ ID NO: 7307119 - DNA, 22 bp, Homo sapiens
tagagcagtgttgtccatcaga

SEQ ID NO: 7307120 - DNA, 22 bp, Homo sapiens
tagagcagtgggtaccatggca

SEQ ID NO: 7307121 - DNA, 23 bp, Homo sapiens
tagagcagtagatcaccatggga

SEQ ID NO: 7307122 - DNA, 22 bp, Homo sapiens
tagagcacagtttcagggtgta

SEQ ID NO: 7307123 - DNA, 22 bp, Homo sapiens
tagagagtcgggaacttacctg

SEQ ID NO: 7307124 - DNA, 22 bp, Homo sapiens
tagatgctacaattttgtactc

SEQ ID NO: 7307125 - DNA, 22 bp, Homo sapiens
tacttggtctgggcagggggtt

SEQ ID NO: 7307126 - DNA, 22 bp, Homo sapiens
tacttgtgtgtcatgtgcagag

SEQ ID NO: 7307127 - DNA, 22 bp, Homo sapiens
tacttgtcaggtgggtgggagg

SEQ ID NO: 7307128 - DNA, 22 bp, Homo sapiens
tacttgtctcttctgacaaagt

SEQ ID NO: 7307129 - DNA, 22 bp, Homo sapiens
tacttggtttagtttggaggga

SEQ ID NO: 7307130 - DNA, 22 bp, Homo sapiens
tactttcatgtctatacatatt

SEQ ID NO: 7307131 - DNA, 22 bp, Homo sapiens
tactttctaagacatacaactt

SEQ ID NO: 7307132 - DNA, 22 bp, Homo sapiens
tactttcatgtctatacatatt

SEQ ID NO: 7307133 - DNA, 22 bp, Homo sapiens
tagaagtttaaattcaccatgc

SEQ ID NO: 7307134 - DNA, 22 bp, Homo sapiens
tagattttacttctgtcattac

SEQ ID NO: 7307135 - DNA, 22 bp, Homo sapiens
tagattttttggagactctctg

SEQ ID NO: 7307136 - DNA, 22 bp, Homo sapiens
tagattttttggagactctctg

SEQ ID NO: 7307137 - DNA, 22 bp, Homo sapiens
tagattttgcatttctaacaag

SEQ ID NO: 7307138 - DNA, 22 bp, Homo sapiens
tagattttacttctgtcattac

SEQ ID NO: 7307139 - DNA, 22 bp, Homo sapiens
tagattttaggagattttactg

SEQ ID NO: 7307140 - DNA, 22 bp, Homo sapiens
tagatgttccacatatatatgt

SEQ ID NO: 7307141 - DNA, 22 bp, Homo sapiens
tagatgttgaagtcatatttgg

SEQ ID NO: 7307142 - DNA, 23 bp, Homo sapiens
tagatgtttggggaactttgccc

SEQ ID NO: 7307143 - DNA, 20 bp, Homo sapiens
tagatgtttcctgtcataaa

SEQ ID NO: 7307144 - DNA, 22 bp, Homo sapiens
tagcacaagaagtacacataga

SEQ ID NO: 7307145 - DNA, 22 bp, Homo sapiens
tagcaaaagccacgattacttt

SEQ ID NO: 7307146 - DNA, 22 bp, Homo sapiens
tagcaaaaactgcagttacttt

SEQ ID NO: 7307147 - DNA, 22 bp, Homo sapiens
tagcaaaaactgcagttacttt

SEQ ID NO: 7307148 - DNA, 22 bp, Homo sapiens
tagcattttagctgttttctct

SEQ ID NO: 7307149 - DNA, 22 bp, Homo sapiens
tagcatttggacattgtcacct

SEQ ID NO: 7307150 - DNA, 22 bp, Homo sapiens
tagcaccactggtgggaaaaac

SEQ ID NO: 7307151 - DNA, 22 bp, Homo sapiens
tagcaccatgatggaagagctg

SEQ ID NO: 7307152 - DNA, 22 bp, Homo sapiens
tagcagtgccaggattttgctg

SEQ ID NO: 7307153 - DNA, 22 bp, Homo sapiens
tagcagaaactgttacagaagg

SEQ ID NO: 7307154 - DNA, 22 bp, Homo sapiens
tagtggatgttcagagatttga

SEQ ID NO: 7307155 - DNA, 22 bp, Homo sapiens
tagtcctttccggctgctataa

SEQ ID NO: 7307156 - DNA, 23 bp, Homo sapiens
tagtgtatatcaacatttgtccc

SEQ ID NO: 7307157 - DNA, 22 bp, Homo sapiens
tagtccatcttgaattcagtga

SEQ ID NO: 7307158 - DNA, 22 bp, Homo sapiens
tagtcatttttccactaagtta

SEQ ID NO: 7307159 - DNA, 22 bp, Homo sapiens
tagtattttagaaaaccatgaa

SEQ ID NO: 7307160 - DNA, 22 bp, Homo sapiens
tagtatttaatcacttttgtct

SEQ ID NO: 7307161 - DNA, 22 bp, Homo sapiens
tagtatttcctgtaagctatag

SEQ ID NO: 7307162 - DNA, 22 bp, Homo sapiens
tagtatttataatcatgcttaa

SEQ ID NO: 7307163 - DNA, 22 bp, Homo sapiens
tagtatttataatcatgcttaa

SEQ ID NO: 7307164 - DNA, 22 bp, Homo sapiens
tagtatatctttagtacatagt

SEQ ID NO: 7307165 - DNA, 22 bp, Homo sapiens
tagtatatctttagtacatagt

SEQ ID NO: 7307166 - DNA, 22 bp, Homo sapiens
tagtagaatccaaaccaacagt

SEQ ID NO: 7307167 - DNA, 22 bp, Homo sapiens
tagtacttatctctgtcattgt

SEQ ID NO: 7307168 - DNA, 22 bp, Homo sapiens
taggaatttttgtaatggtact

SEQ ID NO: 7307169 - DNA, 22 bp, Homo sapiens
taggctcttggtaaacaaaatt

SEQ ID NO: 7307170 - DNA, 23 bp, Homo sapiens
taggctctgtaggtagagatggg

SEQ ID NO: 7307171 - DNA, 22 bp, Homo sapiens
taggctctccaagcccaggacc

SEQ ID NO: 7307172 - DNA, 22 bp, Homo sapiens
taggctctagatgtggtctttg

SEQ ID NO: 7307173 - DNA, 20 bp, Homo sapiens
taggaaatatgtttttaccc

SEQ ID NO: 7307174 - DNA, 22 bp, Homo sapiens
taggaagctatgggagatgtga

SEQ ID NO: 7307175 - DNA, 22 bp, Homo sapiens
taggaagctgagcagcattcct

SEQ ID NO: 7307176 - DNA, 22 bp, Homo sapiens
taggaagagctataggtcccca

SEQ ID NO: 7307177 - DNA, 22 bp, Homo sapiens
taggaagagctataggtcccca

SEQ ID NO: 7307178 - DNA, 22 bp, Homo sapiens
taggaagataaacatttgtatg

SEQ ID NO: 7307179 - DNA, 22 bp, Homo sapiens
taggaagataaacatttgtatg

SEQ ID NO: 7307180 - DNA, 22 bp, Homo sapiens
taggaagatcaagtttatctca

SEQ ID NO: 7307181 - DNA, 22 bp, Homo sapiens
taggaagatcaagtttatctca

SEQ ID NO: 7307182 - DNA, 22 bp, Homo sapiens
taggaagatgagtatcaacttg

SEQ ID NO: 7307183 - DNA, 22 bp, Homo sapiens
taggaagatgagtatcaacttg

SEQ ID NO: 7307184 - DNA, 22 bp, Homo sapiens
taggaaatggctcagttactgc

SEQ ID NO: 7307185 - DNA, 22 bp, Homo sapiens
taggaagaaactttccctgcag

SEQ ID NO: 7307186 - DNA, 22 bp, Homo sapiens
taggaagaaactttccctgcag

SEQ ID NO: 7307187 - DNA, 22 bp, Homo sapiens
taggaagaagcagccttgctta

SEQ ID NO: 7307188 - DNA, 22 bp, Homo sapiens
taggaagaagcagccttgctta

SEQ ID NO: 7307189 - DNA, 23 bp, Homo sapiens
taggaagacagcaaaagaatgga

SEQ ID NO: 7307190 - DNA, 23 bp, Homo sapiens
taggaagacagcaaaagaatgga

SEQ ID NO: 7307191 - DNA, 22 bp, Homo sapiens
taggaaatgctccattgcataa

SEQ ID NO: 7307192 - DNA, 22 bp, Homo sapiens
taggaaatgccagccttcctcc

SEQ ID NO: 7307193 - DNA, 22 bp, Homo sapiens
taggaaatgctgtcttattgta

SEQ ID NO: 7307194 - DNA, 22 bp, Homo sapiens
tacagtttttattcatgacaag

SEQ ID NO: 7307195 - DNA, 22 bp, Homo sapiens
tacagtttttattcatgacaag

SEQ ID NO: 7307196 - DNA, 22 bp, Homo sapiens
tacataatgagctagttaagtt

SEQ ID NO: 7307197 - DNA, 22 bp, Homo sapiens
tacatacaagatgtgtttaaaa

SEQ ID NO: 7307198 - DNA, 22 bp, Homo sapiens
tacagttactgcatttctaata

SEQ ID NO: 7307199 - DNA, 22 bp, Homo sapiens
tacaggaagttacagactatga

SEQ ID NO: 7307200 - DNA, 22 bp, Homo sapiens
tacagcagagtgggatgcatct

SEQ ID NO: 7307201 - DNA, 22 bp, Homo sapiens
tacagcttgatgtttgtgtgtt

SEQ ID NO: 7307202 - DNA, 22 bp, Homo sapiens
tacagcttaaaagatgcattta

SEQ ID NO: 7307203 - DNA, 22 bp, Homo sapiens
tacagcttgacccataatgtct

SEQ ID NO: 7307204 - DNA, 22 bp, Homo sapiens
tacagcttttcatatttgtgtt

SEQ ID NO: 7307205 - DNA, 22 bp, Homo sapiens
tacaggaaggagcacatcggga

SEQ ID NO: 7307206 - DNA, 22 bp, Homo sapiens
tacaggaagcactcaagaaatg

SEQ ID NO: 7307207 - DNA, 22 bp, Homo sapiens
tacattaaggatatggacatga

SEQ ID NO: 7307208 - DNA, 22 bp, Homo sapiens
tacattaaggatatggacatga

SEQ ID NO: 7307209 - DNA, 22 bp, Homo sapiens
tacattaacttacgtccacatg

SEQ ID NO: 7307210 - DNA, 22 bp, Homo sapiens
tacatacatattcatacaggtg

SEQ ID NO: 7307211 - DNA, 22 bp, Homo sapiens
tacatacatggtggaatggtta

SEQ ID NO: 7307212 - DNA, 22 bp, Homo sapiens
tacatacatattcatacaggtg

SEQ ID NO: 7307213 - DNA, 22 bp, Homo sapiens
tacatacagccaagtatgaagt

SEQ ID NO: 7307214 - DNA, 22 bp, Homo sapiens
tacatacagtggatgctttagg

SEQ ID NO: 7307215 - DNA, 22 bp, Homo sapiens
tacatacagtggatgctttagg

SEQ ID NO: 7307216 - DNA, 22 bp, Homo sapiens
tacatacagtggatgctttagg

SEQ ID NO: 7307217 - DNA, 22 bp, Homo sapiens
tacatacacaaatgctgaatgg

SEQ ID NO: 7307218 - DNA, 22 bp, Homo sapiens
tacatacacaaatgctgaatgg

SEQ ID NO: 7307219 - DNA, 22 bp, Homo sapiens
tacatacagccaagtatgaagt

SEQ ID NO: 7307220 - DNA, 22 bp, Homo sapiens
tacatacagagatgctagttaa

SEQ ID NO: 7307221 - DNA, 22 bp, Homo sapiens
tacatacaagatgtgtttaaaa

SEQ ID NO: 7307222 - DNA, 22 bp, Homo sapiens
tacatacaagcattcaatttta

SEQ ID NO: 7307223 - DNA, 22 bp, Homo sapiens
tacatacaagcattcaatttta

SEQ ID NO: 7307224 - DNA, 22 bp, Homo sapiens
tacatacacaaatatactgttt

SEQ ID NO: 7307225 - DNA, 22 bp, Homo sapiens
tacatacacaaatatactgttt

SEQ ID NO: 7307226 - DNA, 22 bp, Homo sapiens
tacatacacaaatatactgttt

SEQ ID NO: 7307227 - DNA, 22 bp, Homo sapiens
tactgagtaccaagcattgtgt

SEQ ID NO: 7307228 - DNA, 22 bp, Homo sapiens
tactgcttggtgttgttgtatc

SEQ ID NO: 7307229 - DNA, 23 bp, Homo sapiens
tactgccttgttcatgtgtattt

SEQ ID NO: 7307230 - DNA, 22 bp, Homo sapiens
tacttgccatcagagtttatta

SEQ ID NO: 7307231 - DNA, 22 bp, Homo sapiens
tacttcccactggggtctacca

SEQ ID NO: 7307232 - DNA, 22 bp, Homo sapiens
tactggtctcagcagattgagg

SEQ ID NO: 7307233 - DNA, 23 bp, Homo sapiens
tactggtcagtgcctctggggct

SEQ ID NO: 7307234 - DNA, 22 bp, Homo sapiens
tactggtccaacaaggttggca

SEQ ID NO: 7307235 - DNA, 19 bp, Homo sapiens
tacttattagaaatatggg

SEQ ID NO: 7307236 - DNA, 22 bp, Homo sapiens
tacttattggttcagaagttta

SEQ ID NO: 7307237 - DNA, 22 bp, Homo sapiens
tacttcatacctgctagaatgg

SEQ ID NO: 7307238 - DNA, 21 bp, Homo sapiens
tacgtgtgtgcatgtttatat

SEQ ID NO: 7307239 - DNA, 21 bp, Homo sapiens
tacgtgtgtgcatgtttatat

SEQ ID NO: 7307240 - DNA, 22 bp, Homo sapiens
tactgaaatggcagatatataa

SEQ ID NO: 7307241 - DNA, 22 bp, Homo sapiens
tactgaaagtggtcaacagtgg

SEQ ID NO: 7307242 - DNA, 22 bp, Homo sapiens
tactgaaagactgaatatttag

SEQ ID NO: 7307243 - DNA, 22 bp, Homo sapiens
taccttggaaatgctagagtaa

SEQ ID NO: 7307244 - DNA, 22 bp, Homo sapiens
tacccagaagattgtcagcaaa

SEQ ID NO: 7307245 - DNA, 22 bp, Homo sapiens
tacccagagggagagcaactat

SEQ ID NO: 7307246 - DNA, 22 bp, Homo sapiens
tacccagatatactttatgtta

SEQ ID NO: 7307247 - DNA, 22 bp, Homo sapiens
tacccagattcacaagccaagg

SEQ ID NO: 7307248 - DNA, 22 bp, Homo sapiens
taagtttaaatgtacatgaagc

SEQ ID NO: 7307249 - DNA, 22 bp, Homo sapiens
taagtttaccactttcagaatt

SEQ ID NO: 7307250 - DNA, 22 bp, Homo sapiens
taagtttccagattgtaagtcc

SEQ ID NO: 7307251 - DNA, 22 bp, Homo sapiens
taagcataagatacatgagaca

SEQ ID NO: 7307252 - DNA, 22 bp, Homo sapiens
taagttacacttaacttactag

SEQ ID NO: 7307253 - DNA, 22 bp, Homo sapiens
taagttacctgttttgtcatca

SEQ ID NO: 7307254 - DNA, 22 bp, Homo sapiens
taagttagagcacaattcttac

SEQ ID NO: 7307255 - DNA, 22 bp, Homo sapiens
taagttactagtaccaggcccc

SEQ ID NO: 7307256 - DNA, 20 bp, Homo sapiens
taagttactgatcggccatt

SEQ ID NO: 7307257 - DNA, 22 bp, Homo sapiens
taagttagccctattaaattaa

SEQ ID NO: 7307258 - DNA, 22 bp, Homo sapiens
taagttagcaaggccaaggtaa

SEQ ID NO: 7307259 - DNA, 22 bp, Homo sapiens
taagttagtcctttttaaaagt

SEQ ID NO: 7307260 - DNA, 22 bp, Homo sapiens
taagttagatcttaattaaagt

SEQ ID NO: 7307261 - DNA, 22 bp, Homo sapiens
taagttagaggttaggcactta

SEQ ID NO: 7307262 - DNA, 23 bp, Homo sapiens
taatgccagccctgcagttaagc

SEQ ID NO: 7307263 - DNA, 22 bp, Homo sapiens
taatgccacctacctgctttat

SEQ ID NO: 7307264 - DNA, 22 bp, Homo sapiens
taatgaatgagaatataacaga

SEQ ID NO: 7307265 - DNA, 22 bp, Homo sapiens
taatgaggggaaccatctgtag

SEQ ID NO: 7307266 - DNA, 22 bp, Homo sapiens
taatgaggcatttgagtcacct

SEQ ID NO: 7307267 - DNA, 22 bp, Homo sapiens
taatgaggaaatagagggaatg

SEQ ID NO: 7307268 - DNA, 22 bp, Homo sapiens
taatttctaattcattttcagt

SEQ ID NO: 7307269 - DNA, 22 bp, Homo sapiens
taatttcacagttcaacgcaca

SEQ ID NO: 7307270 - DNA, 22 bp, Homo sapiens
taatggagttggaattaataag

SEQ ID NO: 7307271 - DNA, 22 bp, Homo sapiens
taatgccaggagggagttttta

SEQ ID NO: 7307272 - DNA, 22 bp, Homo sapiens
taatttcttcatctctgcagct

SEQ ID NO: 7307273 - DNA, 22 bp, Homo sapiens
taattttgtccccctgcacata

SEQ ID NO: 7307274 - DNA, 22 bp, Homo sapiens
tacaatgaccatattatgtaag

SEQ ID NO: 7307275 - DNA, 22 bp, Homo sapiens
tacaatgaccatattatgtaag

SEQ ID NO: 7307276 - DNA, 22 bp, Homo sapiens
taatttttccacgtacactggg

SEQ ID NO: 7307277 - DNA, 22 bp, Homo sapiens
taatttttccacgtacactggg

SEQ ID NO: 7307278 - DNA, 22 bp, Homo sapiens
tacacatgatcatttagtagca

SEQ ID NO: 7307279 - DNA, 22 bp, Homo sapiens
tacacatgtatttatgtgtaca

SEQ ID NO: 7307280 - DNA, 22 bp, Homo sapiens
tacacatgtttggcaagtatgt

SEQ ID NO: 7307281 - DNA, 22 bp, Homo sapiens
tacacattagtgaggtattttg

SEQ ID NO: 7307282 - DNA, 22 bp, Homo sapiens
tacacattagtcaagagtttga

SEQ ID NO: 7307283 - DNA, 22 bp, Homo sapiens
tacacattctagggcacagtta

SEQ ID NO: 7307284 - DNA, 22 bp, Homo sapiens
tacacatttctcttagagacac

SEQ ID NO: 7307285 - DNA, 22 bp, Homo sapiens
tacacattacataatactatct

SEQ ID NO: 7307286 - DNA, 22 bp, Homo sapiens
tacacattacataatactatct

SEQ ID NO: 7307287 - DNA, 22 bp, Homo sapiens
tacacatttctcttagagacac

SEQ ID NO: 7307288 - DNA, 22 bp, Homo sapiens
tacacatatgtccattaatcag

SEQ ID NO: 7307289 - DNA, 22 bp, Homo sapiens
tacacatatgtgtgtatatgtg

SEQ ID NO: 7307290 - DNA, 22 bp, Homo sapiens
tacacatatgtgtgtatatgtg

SEQ ID NO: 7307291 - DNA, 22 bp, Homo sapiens
tacacaaaggcactctgttgtt

SEQ ID NO: 7307292 - DNA, 21 bp, Homo sapiens
tacacaaagcgtggtccagag

SEQ ID NO: 7307293 - DNA, 22 bp, Homo sapiens
tacaatttagtggtgtgtggtt

SEQ ID NO: 7307294 - DNA, 22 bp, Homo sapiens
tacaatgttaaggaaagagaga

SEQ ID NO: 7307295 - DNA, 22 bp, Homo sapiens
taaacagaattcaggcaagata

SEQ ID NO: 7307296 - DNA, 22 bp, Homo sapiens
taaacagagaagactttgagca

SEQ ID NO: 7307297 - DNA, 22 bp, Homo sapiens
gttttcaaggggatttaactga

SEQ ID NO: 7307298 - DNA, 22 bp, Homo sapiens
taaacagagagtgcagttatag

SEQ ID NO: 7307299 - DNA, 22 bp, Homo sapiens
taaacatcaggaatgaaaacct

SEQ ID NO: 7307300 - DNA, 21 bp, Homo sapiens
taaacataaccttgtatggct

SEQ ID NO: 7307301 - DNA, 22 bp, Homo sapiens
taaacatcaccttctgcagttg

SEQ ID NO: 7307302 - DNA, 22 bp, Homo sapiens
taaacatctgtcatgtgtttat

SEQ ID NO: 7307303 - DNA, 22 bp, Homo sapiens
taaacatctgtagccttcagtc

SEQ ID NO: 7307304 - DNA, 22 bp, Homo sapiens
gttttataattgcttcataaga

SEQ ID NO: 7307305 - DNA, 22 bp, Homo sapiens
gttttataattgcttcataaga

SEQ ID NO: 7307306 - DNA, 22 bp, Homo sapiens
gttttataggctgttgctatat

SEQ ID NO: 7307307 - DNA, 22 bp, Homo sapiens
gttttataggtgaaatattact

SEQ ID NO: 7307308 - DNA, 22 bp, Homo sapiens
gttttataggtgaaatattact

SEQ ID NO: 7307309 - DNA, 23 bp, Homo sapiens
gttttcaacacaataaatgtaac

SEQ ID NO: 7307310 - DNA, 23 bp, Homo sapiens
gttttcaacacaataaatgtaac

SEQ ID NO: 7307311 - DNA, 22 bp, Homo sapiens
taaagacaataggaaagttgtt

SEQ ID NO: 7307312 - DNA, 22 bp, Homo sapiens
taaagacaaacccactagggtt

SEQ ID NO: 7307313 - DNA, 22 bp, Homo sapiens
taaagacaatttcgagctgtag

SEQ ID NO: 7307314 - DNA, 22 bp, Homo sapiens
taaagtgtggatatgattagta

SEQ ID NO: 7307315 - DNA, 22 bp, Homo sapiens
taaagtttatttgaacatctct

SEQ ID NO: 7307316 - DNA, 22 bp, Homo sapiens
taaagtttgtagcaattgatat

SEQ ID NO: 7307317 - DNA, 22 bp, Homo sapiens
taaagtttggcagacaataaca

SEQ ID NO: 7307318 - DNA, 22 bp, Homo sapiens
taaataagtcactgaccattta

SEQ ID NO: 7307319 - DNA, 22 bp, Homo sapiens
taaatacagtcatttgagccat

SEQ ID NO: 7307320 - DNA, 17 bp, Homo sapiens
taaatacacaagggtat

SEQ ID NO: 7307321 - DNA, 22 bp, Homo sapiens
taacttctctgctatcatagga

SEQ ID NO: 7307322 - DNA, 22 bp, Homo sapiens
taacttctgaatagcaatagta

SEQ ID NO: 7307323 - DNA, 22 bp, Homo sapiens
taactgtttttgaaatatatct

SEQ ID NO: 7307324 - DNA, 22 bp, Homo sapiens
taagaaatttagttatagaatg

SEQ ID NO: 7307325 - DNA, 22 bp, Homo sapiens
taagaaatttagttatagaatg

SEQ ID NO: 7307326 - DNA, 22 bp, Homo sapiens
taagaaactgtcacagtactat

SEQ ID NO: 7307327 - DNA, 22 bp, Homo sapiens
taagataatccattataatgtt

SEQ ID NO: 7307328 - DNA, 22 bp, Homo sapiens
taagataataccatgggccagg

SEQ ID NO: 7307329 - DNA, 22 bp, Homo sapiens
taagataataagtatgtctatg

SEQ ID NO: 7307330 - DNA, 22 bp, Homo sapiens
taagataagtgggttgagatgg

SEQ ID NO: 7307331 - DNA, 22 bp, Homo sapiens
taagataagtgggttgagatgg

SEQ ID NO: 7307332 - DNA, 22 bp, Homo sapiens
taagataaggaacattctgtga

SEQ ID NO: 7307333 - DNA, 22 bp, Homo sapiens
taagataaggagagtgctagta

SEQ ID NO: 7307334 - DNA, 19 bp, Homo sapiens
taagatacccctctatttt

SEQ ID NO: 7307335 - DNA, 22 bp, Homo sapiens
taacaaaggttgccaaactaag

SEQ ID NO: 7307336 - DNA, 21 bp, Homo sapiens
taacaaagacttctggtcagg

SEQ ID NO: 7307337 - DNA, 22 bp, Homo sapiens
taaatttttgttaacagcctct

SEQ ID NO: 7307338 - DNA, 18 bp, Homo sapiens
taacaatcctgagtgtct

SEQ ID NO: 7307339 - DNA, 22 bp, Homo sapiens
taacacagtgtctaccattatt

SEQ ID NO: 7307340 - DNA, 22 bp, Homo sapiens
taactgtaatataaatatgagt

SEQ ID NO: 7307341 - DNA, 22 bp, Homo sapiens
gtgtgtgttcaataaatttaag

SEQ ID NO: 7307342 - DNA, 22 bp, Homo sapiens
gtgtgtgttcaataaatttaag

SEQ ID NO: 7307343 - DNA, 22 bp, Homo sapiens
gtgtgtttagcattagcagggg

SEQ ID NO: 7307344 - DNA, 22 bp, Homo sapiens
gtgtgtttcaccctgacaccaa

SEQ ID NO: 7307345 - DNA, 22 bp, Homo sapiens
gtgtgtttcagaagccaggtgt

SEQ ID NO: 7307346 - DNA, 22 bp, Homo sapiens
gtgtgtgttcaataaatttaag

SEQ ID NO: 7307347 - DNA, 22 bp, Homo sapiens
gtgtgtgtgtaaaaatccagag

SEQ ID NO: 7307348 - DNA, 22 bp, Homo sapiens
gtgtgtgtgtaaaaatccagag

SEQ ID NO: 7307349 - DNA, 22 bp, Homo sapiens
gtgtgtgtgtaaaaatccagag

SEQ ID NO: 7307350 - DNA, 22 bp, Homo sapiens
gtgtgtgtgcctgcacacacac

SEQ ID NO: 7307351 - DNA, 22 bp, Homo sapiens
gtgtgtgtgcctgcacacacac

SEQ ID NO: 7307352 - DNA, 22 bp, Homo sapiens
gtgttacaaatcacctgtgctg

SEQ ID NO: 7307353 - DNA, 22 bp, Homo sapiens
gtgttaaaaatcccatgatatg

SEQ ID NO: 7307354 - DNA, 22 bp, Homo sapiens
gtgttaaaatgctttatagtag

SEQ ID NO: 7307355 - DNA, 22 bp, Homo sapiens
gtgttaaaaatcccatgatatg

SEQ ID NO: 7307356 - DNA, 22 bp, Homo sapiens
gtgttaaaaatcccatgatatg

SEQ ID NO: 7307357 - DNA, 22 bp, Homo sapiens
gtgttaaacatgttcacagcat

SEQ ID NO: 7307358 - DNA, 22 bp, Homo sapiens
gtgttaaacatgttcacagcat

SEQ ID NO: 7307359 - DNA, 22 bp, Homo sapiens
gtgttaaatgcaatcacatgca

SEQ ID NO: 7307360 - DNA, 22 bp, Homo sapiens
gtgttaaatgcaatcacatgca

SEQ ID NO: 7307361 - DNA, 22 bp, Homo sapiens
gtgttaaatgcaatcacatgca

SEQ ID NO: 7307362 - DNA, 22 bp, Homo sapiens
gtgttaaatttctaatttgtga

SEQ ID NO: 7307363 - DNA, 22 bp, Homo sapiens
gtgttaaccagctaaactttgc

SEQ ID NO: 7307364 - DNA, 22 bp, Homo sapiens
gtgtgtgtgcatataacatata

SEQ ID NO: 7307365 - DNA, 22 bp, Homo sapiens
gtgtgtgtgcatctcttttatt

SEQ ID NO: 7307366 - DNA, 22 bp, Homo sapiens
gtgtgtgtgcatctcttttatt

SEQ ID NO: 7307367 - DNA, 22 bp, Homo sapiens
gtgtgtgtctccgcggccgtag

SEQ ID NO: 7307368 - DNA, 22 bp, Homo sapiens
gtgtgtgtctccgcggccgtag

SEQ ID NO: 7307369 - DNA, 22 bp, Homo sapiens
gtgtgtgtctccgcggccgtag

SEQ ID NO: 7307370 - DNA, 22 bp, Homo sapiens
gtgtgtgtgcatataacatata

SEQ ID NO: 7307371 - DNA, 22 bp, Homo sapiens
gtgtgtgtgcatataacatata

SEQ ID NO: 7307372 - DNA, 22 bp, Homo sapiens
gtgtgtgtatctgcctatcaca

SEQ ID NO: 7307373 - DNA, 21 bp, Homo sapiens
gtgtgtctaatgtagtggaaa

SEQ ID NO: 7307374 - DNA, 22 bp, Homo sapiens
gtgtgtgtatctgcctatcaca

SEQ ID NO: 7307375 - DNA, 22 bp, Homo sapiens
gtgctttgttaagtctgaaatt

SEQ ID NO: 7307376 - DNA, 20 bp, Homo sapiens
gttaggaggttggacatgga

SEQ ID NO: 7307377 - DNA, 22 bp, Homo sapiens
gttaggtagaagtttactttga

SEQ ID NO: 7307378 - DNA, 22 bp, Homo sapiens
gttaggaaggtatagttgtatt

SEQ ID NO: 7307379 - DNA, 22 bp, Homo sapiens
gttagcatgacttagaatcagg

SEQ ID NO: 7307380 - DNA, 22 bp, Homo sapiens
gttccaattccaaattccaagg

SEQ ID NO: 7307381 - DNA, 22 bp, Homo sapiens
gtttagaaaatagtgaagcaag

SEQ ID NO: 7307382 - DNA, 22 bp, Homo sapiens
gtttacattgctgtttgtgtct

SEQ ID NO: 7307383 - DNA, 22 bp, Homo sapiens
gtttaggaaattgggtattaga

SEQ ID NO: 7307384 - DNA, 22 bp, Homo sapiens
gtttataaggcccaatatttct

SEQ ID NO: 7307385 - DNA, 22 bp, Homo sapiens
gtttataaattctgcttttgtt

SEQ ID NO: 7307386 - DNA, 22 bp, Homo sapiens
gttccacaaagattgtctctct

SEQ ID NO: 7307387 - DNA, 22 bp, Homo sapiens
gttccacatcacactacttgat

SEQ ID NO: 7307388 - DNA, 22 bp, Homo sapiens
gttcctgggcctgcattcacca

SEQ ID NO: 7307389 - DNA, 22 bp, Homo sapiens
gtttacaaatattttaaatggt

SEQ ID NO: 7307390 - DNA, 22 bp, Homo sapiens
gtttcttaaatgtagcaggacc

SEQ ID NO: 7307391 - DNA, 23 bp, Homo sapiens
gttttacaggtgagaaaatggag

SEQ ID NO: 7307392 - DNA, 22 bp, Homo sapiens
gtttctggagtgactataactg

SEQ ID NO: 7307393 - DNA, 22 bp, Homo sapiens
gtttctggcgccggggcaggcc

SEQ ID NO: 7307394 - DNA, 22 bp, Homo sapiens
gtttatatgaacttcataccca

SEQ ID NO: 7307395 - DNA, 22 bp, Homo sapiens
gtttatatgtgtgccactctta

SEQ ID NO: 7307396 - DNA, 22 bp, Homo sapiens
gtttataatgtctgtgccaaaa

SEQ ID NO: 7307397 - DNA, 22 bp, Homo sapiens
gtttataatccaactctgctcc

SEQ ID NO: 7307398 - DNA, 22 bp, Homo sapiens
gtttcctacactgtagtattat

SEQ ID NO: 7307399 - DNA, 21 bp, Homo sapiens
tccctgagcccaaggggctcc

SEQ ID NO: 7307400 - DNA, 23 bp, Homo sapiens
tccctgagatgctgctctgtccc

SEQ ID NO: 7307401 - DNA, 23 bp, Homo sapiens
tccctgagctggagagactgcac

SEQ ID NO: 7307402 - DNA, 22 bp, Homo sapiens
tccctgagggcagctcaagtcc

SEQ ID NO: 7307403 - DNA, 22 bp, Homo sapiens
tcctccagtggcccagtccttc

SEQ ID NO: 7307404 - DNA, 23 bp, Homo sapiens
tcctcctgacacagcctgagtga

SEQ ID NO: 7307405 - DNA, 22 bp, Homo sapiens
tcctcctgctgttagtcttgaa

SEQ ID NO: 7307406 - DNA, 21 bp, Homo sapiens
tcctcctggccaggcggcccc

SEQ ID NO: 7307407 - DNA, 23 bp, Homo sapiens
tcctcctggatacaaagggaaca

SEQ ID NO: 7307408 - DNA, 23 bp, Homo sapiens
tcctcctgagtgagagtgccagc

SEQ ID NO: 7307409 - DNA, 22 bp, Homo sapiens
tcctcctgcctttgcttcttgt

SEQ ID NO: 7307410 - DNA, 22 bp, Homo sapiens
tccctttcactactgtgttggt

SEQ ID NO: 7307411 - DNA, 22 bp, Homo sapiens
tccgggcaactgaagggaggtt

SEQ ID NO: 7307412 - DNA, 22 bp, Homo sapiens
tcctccagcaggactgaggccc

SEQ ID NO: 7307413 - DNA, 22 bp, Homo sapiens
tcctccagaaactgaggcagaa

SEQ ID NO: 7307414 - DNA, 22 bp, Homo sapiens
tcctccaagcagaggccctgaa

SEQ ID NO: 7307415 - DNA, 22 bp, Homo sapiens
tccagaaaaagtaatttatttg

SEQ ID NO: 7307416 - DNA, 22 bp, Homo sapiens
tccagaaaattcagaaattgtt

SEQ ID NO: 7307417 - DNA, 21 bp, Homo sapiens
tccagaaaagaggtcattagc

SEQ ID NO: 7307418 - DNA, 22 bp, Homo sapiens
tccactgtgcagctctgctgat

SEQ ID NO: 7307419 - DNA, 22 bp, Homo sapiens
tccactgtggtcccttgctgcc

SEQ ID NO: 7307420 - DNA, 20 bp, Homo sapiens
tccacttactagctctgtga

SEQ ID NO: 7307421 - DNA, 22 bp, Homo sapiens
tccacagatgcctttaggagta

SEQ ID NO: 7307422 - DNA, 22 bp, Homo sapiens
tccacagattaaaaacatactt

SEQ ID NO: 7307423 - DNA, 22 bp, Homo sapiens
tccacagataaaaacagaggtt

SEQ ID NO: 7307424 - DNA, 22 bp, Homo sapiens
tccacagacgtgttattagttg

SEQ ID NO: 7307425 - DNA, 22 bp, Homo sapiens
tccacagactattaagtgatct

SEQ ID NO: 7307426 - DNA, 22 bp, Homo sapiens
tccacagaatgtaagatccaca

SEQ ID NO: 7307427 - DNA, 22 bp, Homo sapiens
tccacagaccagtatctgcagc

SEQ ID NO: 7307428 - DNA, 22 bp, Homo sapiens
tccacacacatttctatgtgca

SEQ ID NO: 7307429 - DNA, 22 bp, Homo sapiens
tccacagaatggaattctccgc

SEQ ID NO: 7307430 - DNA, 22 bp, Homo sapiens
tcatgtgtctgccagtgtttat

SEQ ID NO: 7307431 - DNA, 22 bp, Homo sapiens
tcatgtgtctgccagtgtttat

SEQ ID NO: 7307432 - DNA, 22 bp, Homo sapiens
tcatgtgtgtttcatgtatgga

SEQ ID NO: 7307433 - DNA, 22 bp, Homo sapiens
tcatgtgtgtttcatgtatgga

SEQ ID NO: 7307434 - DNA, 22 bp, Homo sapiens
tcatgttgaattatcgttccca

SEQ ID NO: 7307435 - DNA, 22 bp, Homo sapiens
tccaggaggaggaaggctgcca

SEQ ID NO: 7307436 - DNA, 23 bp, Homo sapiens
tccaggagaacccctgtctgtcc

SEQ ID NO: 7307437 - DNA, 22 bp, Homo sapiens
tccaggagaaggccatccagcg

SEQ ID NO: 7307438 - DNA, 22 bp, Homo sapiens
tccaggagaaggccatccagcg

SEQ ID NO: 7307439 - DNA, 23 bp, Homo sapiens
tccaggagcatgctggctggcga

SEQ ID NO: 7307440 - DNA, 21 bp, Homo sapiens
tccaggaatgtctgttcatct

SEQ ID NO: 7307441 - DNA, 22 bp, Homo sapiens
tccagccttgccacttttctgt

SEQ ID NO: 7307442 - DNA, 22 bp, Homo sapiens
tccagaaacttcatttgcaagc

SEQ ID NO: 7307443 - DNA, 22 bp, Homo sapiens
tccagaaacttttccagtctca

SEQ ID NO: 7307444 - DNA, 22 bp, Homo sapiens
tcccagaatctttggaagagca

SEQ ID NO: 7307445 - DNA, 21 bp, Homo sapiens
tccagttgagactgaagatct

SEQ ID NO: 7307446 - DNA, 22 bp, Homo sapiens
tcccacagtggtacagccctga

SEQ ID NO: 7307447 - DNA, 22 bp, Homo sapiens
tcccagaaaaaggaggctatga

SEQ ID NO: 7307448 - DNA, 22 bp, Homo sapiens
tcccagaaccctgccaggtcct

SEQ ID NO: 7307449 - DNA, 17 bp, Homo sapiens
tcccaggaacagggaat

SEQ ID NO: 7307450 - DNA, 20 bp, Homo sapiens
tccagtggcctgaatctgga

SEQ ID NO: 7307451 - DNA, 21 bp, Homo sapiens
tccaggcctcaggaagggatg

SEQ ID NO: 7307452 - DNA, 22 bp, Homo sapiens
tccaggcctaggccaagtgatt

SEQ ID NO: 7307453 - DNA, 22 bp, Homo sapiens
tccaggccgcatagttactctg

SEQ ID NO: 7307454 - DNA, 22 bp, Homo sapiens
tccaggccgcaggggcagcccc

SEQ ID NO: 7307455 - DNA, 22 bp, Homo sapiens
tccaggccctgggatgggagca

SEQ ID NO: 7307456 - DNA, 22 bp, Homo sapiens
tccaggcccatagacacttctc

SEQ ID NO: 7307457 - DNA, 22 bp, Homo sapiens
tccaggcccactcggtggggct

SEQ ID NO: 7307458 - DNA, 22 bp, Homo sapiens
tccaggcccagacggggtgagg

SEQ ID NO: 7307459 - DNA, 20 bp, Homo sapiens
tccaggcccactcagctgaa

SEQ ID NO: 7307460 - DNA, 22 bp, Homo sapiens
tccaggcccactcagctgaaat

SEQ ID NO: 7307461 - DNA, 22 bp, Homo sapiens
tccaggccattgactgcatcct

SEQ ID NO: 7307462 - DNA, 19 bp, Homo sapiens
tccaggccattcccagagc

SEQ ID NO: 7307463 - DNA, 21 bp, Homo sapiens
tccaggccatggtggggaggc

SEQ ID NO: 7307464 - DNA, 22 bp, Homo sapiens
tccaggccagggtaagaggaga

SEQ ID NO: 7307465 - DNA, 22 bp, Homo sapiens
tccaggaggcagggctgtgccc

SEQ ID NO: 7307466 - DNA, 22 bp, Homo sapiens
tccaggaggcagggctgtgccc

SEQ ID NO: 7307467 - DNA, 22 bp, Homo sapiens
tcaatactaatcttgctggaag

SEQ ID NO: 7307468 - DNA, 22 bp, Homo sapiens
tcaatactaatcttgctggaag

SEQ ID NO: 7307469 - DNA, 22 bp, Homo sapiens
tcaatacttaagcttaattcta

SEQ ID NO: 7307470 - DNA, 22 bp, Homo sapiens
tcaatacttggcacactgcaca

SEQ ID NO: 7307471 - DNA, 21 bp, Homo sapiens
tcaatacaggtgcatgtgtct

SEQ ID NO: 7307472 - DNA, 22 bp, Homo sapiens
tcaatgatagtacaatcagcct

SEQ ID NO: 7307473 - DNA, 18 bp, Homo sapiens
tcaaaatatttctgtgga

SEQ ID NO: 7307474 - DNA, 22 bp, Homo sapiens
tcaatgtttgttcatgaaaata

SEQ ID NO: 7307475 - DNA, 22 bp, Homo sapiens
tcaatgttcaagtatgacaatg

SEQ ID NO: 7307476 - DNA, 22 bp, Homo sapiens
tcacagacagaagggatgggat

SEQ ID NO: 7307477 - DNA, 22 bp, Homo sapiens
tcacagacagaagggatgggat

SEQ ID NO: 7307478 - DNA, 18 bp, Homo sapiens
tcacagacagctgtcttt

SEQ ID NO: 7307479 - DNA, 22 bp, Homo sapiens
tcacagacacattaaacatgtg

SEQ ID NO: 7307480 - DNA, 22 bp, Homo sapiens
tcacagacatggtgaggtaaca

SEQ ID NO: 7307481 - DNA, 22 bp, Homo sapiens
tcacagcaaaagtgtgcagagc

SEQ ID NO: 7307482 - DNA, 22 bp, Homo sapiens
tcacagcaaatgctgcttctca

SEQ ID NO: 7307483 - DNA, 21 bp, Homo sapiens
tcacagagccacagaattggt

SEQ ID NO: 7307484 - DNA, 20 bp, Homo sapiens
tcacacataagtgaacgcac

SEQ ID NO: 7307485 - DNA, 20 bp, Homo sapiens
tcacacataagtgaacgcac

SEQ ID NO: 7307486 - DNA, 22 bp, Homo sapiens
tcacacatactcatgtgtgagt

SEQ ID NO: 7307487 - DNA, 22 bp, Homo sapiens
tcacacatactcatgtgtgagt

SEQ ID NO: 7307488 - DNA, 22 bp, Homo sapiens
tcacacataaaaagaagactag

SEQ ID NO: 7307489 - DNA, 22 bp, Homo sapiens
tcacacatactcatgtgtgagt

SEQ ID NO: 7307490 - DNA, 22 bp, Homo sapiens
tcacacatactcatgtgtgagt

SEQ ID NO: 7307491 - DNA, 22 bp, Homo sapiens
tcacacatgagtaaatacaggg

SEQ ID NO: 7307492 - DNA, 22 bp, Homo sapiens
tcacacatctcaggtgtttaat

SEQ ID NO: 7307493 - DNA, 22 bp, Homo sapiens
tcacagaatgtctagcataatt

SEQ ID NO: 7307494 - DNA, 20 bp, Homo sapiens
tcacagaatgcctgaagaag

SEQ ID NO: 7307495 - DNA, 19 bp, Homo sapiens
tcacagcatctgtctgaac

SEQ ID NO: 7307496 - DNA, 22 bp, Homo sapiens
tcacagcagtaaagaaaacact

SEQ ID NO: 7307497 - DNA, 22 bp, Homo sapiens
tcacagcatttttagaaagatt

SEQ ID NO: 7307498 - DNA, 22 bp, Homo sapiens
tcacagcattgagtgtactaga

SEQ ID NO: 7307499 - DNA, 22 bp, Homo sapiens
tcacagcattgagtgtactaga

SEQ ID NO: 7307500 - DNA, 22 bp, Homo sapiens
tcacagcaccaggatctctcca

SEQ ID NO: 7307501 - DNA, 22 bp, Homo sapiens
tcacagcaaccctgaggcgagt

SEQ ID NO: 7307502 - DNA, 22 bp, Homo sapiens
tcacagcaggcagatattgttg

SEQ ID NO: 7307503 - DNA, 22 bp, Homo sapiens
tcacagcaggcagatattgttg

SEQ ID NO: 7307504 - DNA, 22 bp, Homo sapiens
tcacatatttaagaaagttaaa

SEQ ID NO: 7307505 - DNA, 22 bp, Homo sapiens
tcacatcatggagaattatggg

SEQ ID NO: 7307506 - DNA, 21 bp, Homo sapiens
tcacatctatgttaagcaaac

SEQ ID NO: 7307507 - DNA, 19 bp, Homo sapiens
tcagaggatttggctatga

SEQ ID NO: 7307508 - DNA, 22 bp, Homo sapiens
tcagaggactaccttctccagt

SEQ ID NO: 7307509 - DNA, 20 bp, Homo sapiens
tcagaggctgccagctgggg

SEQ ID NO: 7307510 - DNA, 22 bp, Homo sapiens
tcagaggctcactgtctacttt

SEQ ID NO: 7307511 - DNA, 22 bp, Homo sapiens
tcagaggcctgaaagaatttgg

SEQ ID NO: 7307512 - DNA, 22 bp, Homo sapiens
tcagaggcctgaaagaatttgg

SEQ ID NO: 7307513 - DNA, 22 bp, Homo sapiens
tcagaggcaaagaactttatta

SEQ ID NO: 7307514 - DNA, 22 bp, Homo sapiens
tcagaggcagctgatgttctgt

SEQ ID NO: 7307515 - DNA, 22 bp, Homo sapiens
tcagaggcatcattcatagtta

SEQ ID NO: 7307516 - DNA, 22 bp, Homo sapiens
tcagaggcctatgtctacaact

SEQ ID NO: 7307517 - DNA, 22 bp, Homo sapiens
tcagaacattgacattcttatt

SEQ ID NO: 7307518 - DNA, 22 bp, Homo sapiens
tcagaacattgacattcttatt

SEQ ID NO: 7307519 - DNA, 22 bp, Homo sapiens
tcagaacatttaaaaagtggtt

SEQ ID NO: 7307520 - DNA, 22 bp, Homo sapiens
tcagaacatttgggactttggg

SEQ ID NO: 7307521 - DNA, 22 bp, Homo sapiens
tcagaacatttgggactttggg

SEQ ID NO: 7307522 - DNA, 22 bp, Homo sapiens
tcagaacattctcattgactgc

SEQ ID NO: 7307523 - DNA, 22 bp, Homo sapiens
tcagaacattaaggatttgaag

SEQ ID NO: 7307524 - DNA, 22 bp, Homo sapiens
tcagaacatgtttgagtaagac
